United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 78

SEQ ID NO: 2819338 - RNA, 14 nt, Mycobacterium avium subsp. paratuberculosis
ccacagcgccagca

SEQ ID NO: 2819339 - RNA, 14 nt, Mycobacterium avium subsp. paratuberculosis
ccacagcgccucgc

SEQ ID NO: 2819340 - RNA, 17 nt, Mycobacterium avium subsp. paratuberculosis
ccacagcgccucgucga

SEQ ID NO: 2819341 - RNA, 20 nt, Mycobacterium avium subsp. paratuberculosis
ccacagcgccucgucgagcc

SEQ ID NO: 2819342 - RNA, 17 nt, Mycobacterium avium subsp. paratuberculosis
ccacagcggcgacagcg

SEQ ID NO: 2819343 - RNA, 15 nt, Mycobacterium avium subsp. paratuberculosis
ccacagcggcgcaug

SEQ ID NO: 2819344 - RNA, 21 nt, Mycobacterium avium subsp. paratuberculosis
ccacagcggcgcaugaccgau

SEQ ID NO: 2819345 - RNA, 14 nt, Mycobacterium avium subsp. paratuberculosis
ccacagcgguucgg

SEQ ID NO: 2819346 - RNA, 15 nt, Mycobacterium avium subsp. paratuberculosis
ccacagcgguucggc

SEQ ID NO: 2819347 - RNA, 22 nt, Mycobacterium avium subsp. paratuberculosis
ccacagcgguucggcgacgcug

SEQ ID NO: 2819348 - RNA, 23 nt, Mycobacterium avium subsp. paratuberculosis
ccacagcgucaauacgucacggu

SEQ ID NO: 2819349 - RNA, 15 nt, Mycobacterium avium subsp. paratuberculosis
ccacagcgucucgac

SEQ ID NO: 2819350 - RNA, 17 nt, Mycobacterium avium subsp. paratuberculosis
ccacagcucgggcagcg

SEQ ID NO: 2819351 - RNA, 18 nt, Mycobacterium avium subsp. paratuberculosis
ccacagcucgggcagcgu

SEQ ID NO: 2819352 - RNA, 19 nt, Mycobacterium avium subsp. paratuberculosis
ccaccacgacgccgggcgc

SEQ ID NO: 2819353 - RNA, 14 nt, Mycobacterium avium subsp. paratuberculosis
ccaccacgacgggg

SEQ ID NO: 2819354 - RNA, 19 nt, Mycobacterium avium subsp. paratuberculosis
ccaccacgaggaccagcau

SEQ ID NO: 2819355 - RNA, 19 nt, Mycobacterium avium subsp. paratuberculosis
ccaccacgcuggccccggu

SEQ ID NO: 2819356 - RNA, 24 nt, Mycobacterium avium subsp. paratuberculosis
ccaccacggagcgcccggccagcc

SEQ ID NO: 2819357 - RNA, 13 nt, Mycobacterium avium subsp. paratuberculosis
ccaccacggccau

SEQ ID NO: 2819358 - RNA, 15 nt, Mycobacterium avium subsp. paratuberculosis
ccaccacggccgcag

SEQ ID NO: 2819359 - RNA, 15 nt, Mycobacterium avium subsp. paratuberculosis
ccaccacggccgccg

SEQ ID NO: 2819360 - RNA, 21 nt, Mycobacterium avium subsp. paratuberculosis
ccaccacggcgucgcugaacg

SEQ ID NO: 2819361 - RNA, 14 nt, Mycobacterium avium subsp. paratuberculosis
ccaccacgguggcg

SEQ ID NO: 2819362 - RNA, 20 nt, Mycobacterium avium subsp. paratuberculosis
ccaccacgguggcgccggca

SEQ ID NO: 2819363 - RNA, 23 nt, Mycobacterium avium subsp. paratuberculosis
ccaccacgguggcgccggcaucg

SEQ ID NO: 2819364 - RNA, 20 nt, Mycobacterium avium subsp. paratuberculosis
ccaccacguacuccugcgcg

SEQ ID NO: 2819365 - RNA, 22 nt, Mycobacterium avium subsp. paratuberculosis
ccaccacguaggcgaucagcgc

SEQ ID NO: 2819366 - RNA, 16 nt, Mycobacterium avium subsp. paratuberculosis
ccaccacgugccccuc

SEQ ID NO: 2819367 - RNA, 18 nt, Mycobacterium avium subsp. paratuberculosis
ccaccacgugccccuccu

SEQ ID NO: 2819368 - RNA, 19 nt, Mycobacterium avium subsp. paratuberculosis
ccaccacgugccccuccuc

SEQ ID NO: 2819369 - RNA, 12 nt, Mycobacterium avium subsp. paratuberculosis
ccaccacgugcg

SEQ ID NO: 2819370 - RNA, 18 nt, Mycobacterium avium subsp. paratuberculosis
ccaccacguugcgcggcc

SEQ ID NO: 2819371 - RNA, 21 nt, Mycobacterium avium subsp. paratuberculosis
ccaccacguugcgcggccgca

SEQ ID NO: 2819372 - RNA, 23 nt, Mycobacterium avium subsp. paratuberculosis
ccaccacguugcgcggccgcaug

SEQ ID NO: 2819373 - RNA, 19 nt, Mycobacterium avium subsp. paratuberculosis
ccaccacugcgccgucauc

SEQ ID NO: 2819374 - RNA, 21 nt, Mycobacterium avium subsp. paratuberculosis
ccaccacuuccuucuugggcu

SEQ ID NO: 2819375 - RNA, 15 nt, Mycobacterium avium subsp. paratuberculosis
ccaccagaccggcga

SEQ ID NO: 2819376 - RNA, 19 nt, Mycobacterium avium subsp. paratuberculosis
ccaccagaucgccccgcug

SEQ ID NO: 2819377 - RNA, 21 nt, Mycobacterium avium subsp. paratuberculosis
ccaccagaucgccccgcugga

SEQ ID NO: 2819378 - RNA, 20 nt, Mycobacterium avium subsp. paratuberculosis
ccaccagaucguguccgcgc

SEQ ID NO: 2819379 - RNA, 22 nt, Mycobacterium avium subsp. paratuberculosis
ccaccagaucguguccgcgccg

SEQ ID NO: 2819380 - RNA, 23 nt, Mycobacterium avium subsp. paratuberculosis
ccaccagaucguguccgcgccgg

SEQ ID NO: 2819381 - RNA, 17 nt, Mycobacterium avium subsp. paratuberculosis
ccaccagaugccgggcu

SEQ ID NO: 2819382 - RNA, 19 nt, Mycobacterium avium subsp. paratuberculosis
ccaccagaugccgggcucc

SEQ ID NO: 2819383 - RNA, 23 nt, Mycobacterium avium subsp. paratuberculosis
ccaccagaugccgggcuccgcgu

SEQ ID NO: 2819384 - RNA, 12 nt, Mycobacterium avium subsp. paratuberculosis
ccaccagcaccg

SEQ ID NO: 2819385 - RNA, 17 nt, Mycobacterium avium subsp. paratuberculosis
ccaccagcaccgggaag

SEQ ID NO: 2819386 - RNA, 17 nt, Mycobacterium avium subsp. paratuberculosis
ccaccagcacgccguug

SEQ ID NO: 2819387 - RNA, 17 nt, Mycobacterium avium subsp. paratuberculosis
ccaccagcagcagguug

SEQ ID NO: 2819388 - RNA, 15 nt, Mycobacterium avium subsp. paratuberculosis
ccaccagcagcgaga

SEQ ID NO: 2819389 - RNA, 14 nt, Mycobacterium avium subsp. paratuberculosis
ccaccagcaggucg

SEQ ID NO: 2819390 - RNA, 20 nt, Mycobacterium avium subsp. paratuberculosis
ccaccagccacaccgccgcg

SEQ ID NO: 2819391 - RNA, 22 nt, Mycobacterium avium subsp. paratuberculosis
ccaccagccgagaucgacccgc

SEQ ID NO: 2819392 - RNA, 14 nt, Mycobacterium avium subsp. paratuberculosis
ccaccagccggccg

SEQ ID NO: 2819393 - RNA, 15 nt, Mycobacterium avium subsp. paratuberculosis
ccaccagccggccgg

SEQ ID NO: 2819394 - RNA, 16 nt, Mycobacterium avium subsp. paratuberculosis
ccaccagccggccggc

SEQ ID NO: 2819395 - RNA, 18 nt, Mycobacterium avium subsp. paratuberculosis
ccaccagccggccggccg

SEQ ID NO: 2819396 - RNA, 15 nt, Mycobacterium avium subsp. paratuberculosis
ccaccagcgcagguc

SEQ ID NO: 2819397 - RNA, 12 nt, Mycobacterium avium subsp. paratuberculosis
ccaccagcgccc

SEQ ID NO: 2819398 - RNA, 12 nt, Mycobacterium avium subsp. paratuberculosis
ccaccagcgccu

SEQ ID NO: 2819399 - RNA, 19 nt, Mycobacterium avium subsp. paratuberculosis
ccaccagcgcggccaccac

SEQ ID NO: 2819400 - RNA, 13 nt, Mycobacterium avium subsp. paratuberculosis
ccaccagcgcggu

SEQ ID NO: 2819401 - RNA, 15 nt, Mycobacterium avium subsp. paratuberculosis
ccaccagcgcgguga

SEQ ID NO: 2819402 - RNA, 14 nt, Mycobacterium avium subsp. paratuberculosis
ccaccagcggccgg

SEQ ID NO: 2819403 - RNA, 15 nt, Mycobacterium avium subsp. paratuberculosis
ccaccagcggccguc

SEQ ID NO: 2819404 - RNA, 14 nt, Mycobacterium avium subsp. paratuberculosis
ccaccagcggcgcg

SEQ ID NO: 2819405 - RNA, 15 nt, Mycobacterium avium subsp. paratuberculosis
ccaccagcgggcugu

SEQ ID NO: 2819406 - RNA, 19 nt, Mycobacterium avium subsp. paratuberculosis
ccaccagcgggcugugccg

SEQ ID NO: 2819407 - RNA, 21 nt, Mycobacterium avium subsp. paratuberculosis
ccaccagcgggcugugccggc

SEQ ID NO: 2819408 - RNA, 21 nt, Mycobacterium avium subsp. paratuberculosis
ccaccagcgguaaccacccgu

SEQ ID NO: 2819409 - RNA, 19 nt, Mycobacterium avium subsp. paratuberculosis
ccaccagcguuccagcacc

SEQ ID NO: 2819410 - RNA, 12 nt, Mycobacterium avium subsp. paratuberculosis
ccaccagcucga

SEQ ID NO: 2819411 - RNA, 16 nt, Mycobacterium avium subsp. paratuberculosis
ccaccagcucgaugcc

SEQ ID NO: 2819412 - RNA, 22 nt, Mycobacterium avium subsp. paratuberculosis
ccaccagcucgaugccguucgc

SEQ ID NO: 2819413 - RNA, 15 nt, Mycobacterium avium subsp. paratuberculosis
ccaccagcucgucgc

SEQ ID NO: 2819414 - RNA, 18 nt, Mycobacterium avium subsp. paratuberculosis
ccaccagcucgucgccga

SEQ ID NO: 2819415 - RNA, 19 nt, Mycobacterium avium subsp. paratuberculosis
ccaccagcucgucgccgac

SEQ ID NO: 2819416 - RNA, 19 nt, Mycobacterium avium subsp. paratuberculosis
ccaccaggaaggucccggu

SEQ ID NO: 2819417 - RNA, 14 nt, Mycobacterium avium subsp. paratuberculosis
ccaccaggcgccgu

SEQ ID NO: 2819418 - RNA, 15 nt, Mycobacterium avium subsp. paratuberculosis
ccaccaggcgccguc

SEQ ID NO: 2819419 - RNA, 14 nt, Mycobacterium avium subsp. paratuberculosis
ccaccaggcgcggg

SEQ ID NO: 2819420 - RNA, 15 nt, Mycobacterium avium subsp. paratuberculosis
ccaccaggcgcgggc

SEQ ID NO: 2819421 - RNA, 15 nt, Mycobacterium avium subsp. paratuberculosis
ccaccagggcgguga

SEQ ID NO: 2819422 - RNA, 14 nt, Mycobacterium avium subsp. paratuberculosis
ccaccaggggcagc

SEQ ID NO: 2819423 - RNA, 12 nt, Mycobacterium avium subsp. paratuberculosis
ccaccagggugg

SEQ ID NO: 2819424 - RNA, 19 nt, Mycobacterium avium subsp. paratuberculosis
ccaccaggguggccgccac

SEQ ID NO: 2819425 - RNA, 17 nt, Mycobacterium avium subsp. paratuberculosis
ccaccagguaggcgacc

SEQ ID NO: 2819426 - RNA, 23 nt, Mycobacterium avium subsp. paratuberculosis
ccaccagguaggcgaccaugccc

SEQ ID NO: 2819427 - RNA, 22 nt, Mycobacterium avium subsp. paratuberculosis
ccaccaggucgcacaccagcac

SEQ ID NO: 2819428 - RNA, 19 nt, Mycobacterium avium subsp. paratuberculosis
ccaccaggucuccgucggc

SEQ ID NO: 2819429 - RNA, 20 nt, Mycobacterium avium subsp. paratuberculosis
ccaccaggucuccgucggcg

SEQ ID NO: 2819430 - RNA, 21 nt, Mycobacterium avium subsp. paratuberculosis
ccaccaggucuccgucggcgc

SEQ ID NO: 2819431 - RNA, 17 nt, Mycobacterium avium subsp. paratuberculosis
ccaccaggugcggggac

SEQ ID NO: 2819432 - RNA, 17 nt, Mycobacterium avium subsp. paratuberculosis
ccaccagguucgcgcag

SEQ ID NO: 2819433 - RNA, 13 nt, Mycobacterium avium subsp. paratuberculosis
ccaccaguaacac

SEQ ID NO: 2819434 - RNA, 14 nt, Mycobacterium avium subsp. paratuberculosis
ccaccagucggcgc

SEQ ID NO: 2819435 - RNA, 15 nt, Mycobacterium avium subsp. paratuberculosis
ccaccagucggcgcg

SEQ ID NO: 2819436 - RNA, 20 nt, Mycobacterium avium subsp. paratuberculosis
ccaccagucggcgcguuggc

SEQ ID NO: 2819437 - RNA, 18 nt, Mycobacterium avium subsp. paratuberculosis
ccacccucagggagcugc

SEQ ID NO: 2819438 - RNA, 23 nt, Mycobacterium avium subsp. paratuberculosis
ccacccucagggagcugcccgca

SEQ ID NO: 2819439 - RNA, 15 nt, Mycobacterium avium subsp. paratuberculosis
ccacccucgccgccg

SEQ ID NO: 2819440 - RNA, 18 nt, Mycobacterium avium subsp. paratuberculosis
ccacccucgccgccgccg

SEQ ID NO: 2819441 - RNA, 20 nt, Mycobacterium avium subsp. paratuberculosis
ccacccucgccgccgccgau

SEQ ID NO: 2819442 - RNA, 21 nt, Mycobacterium avium subsp. paratuberculosis
ccacccucgccgccgccgauc

SEQ ID NO: 2819443 - RNA, 20 nt, Mycobacterium avium subsp. paratuberculosis
ccacccugccgaccugcgcg

SEQ ID NO: 2819444 - RNA, 20 nt, Mycobacterium avium subsp. paratuberculosis
ccacccugcgcaccgcggau

SEQ ID NO: 2819445 - RNA, 18 nt, Mycobacterium avium subsp. paratuberculosis
ccaccgaaaagcccgccg

SEQ ID NO: 2819446 - RNA, 22 nt, Mycobacterium avium subsp. paratuberculosis
ccaccgaaaagcccgccgccuc

SEQ ID NO: 2819447 - RNA, 21 nt, Mycobacterium avium subsp. paratuberculosis
ccaccgaaucacccacggcca

SEQ ID NO: 2819448 - RNA, 19 nt, Mycobacterium avium subsp. paratuberculosis
ccaccgacaccaccggccg

SEQ ID NO: 2819449 - RNA, 20 nt, Mycobacterium avium subsp. paratuberculosis
ccaccgacaccaccggccgc

SEQ ID NO: 2819450 - RNA, 21 nt, Mycobacterium avium subsp. paratuberculosis
ccaccgacaccaccggccgcc

SEQ ID NO: 2819451 - RNA, 16 nt, Mycobacterium avium subsp. paratuberculosis
ccaccgacaccccgau

SEQ ID NO: 2819452 - RNA, 15 nt, Mycobacterium avium subsp. paratuberculosis
ccaccgacagcaccc

SEQ ID NO: 2819453 - RNA, 20 nt, Mycobacterium avium subsp. paratuberculosis
ccaccgacagcacccggccc

SEQ ID NO: 2819454 - RNA, 21 nt, Mycobacterium avium subsp. paratuberculosis
ccaccgacagcacccggcccc

SEQ ID NO: 2819455 - RNA, 12 nt, Mycobacterium avium subsp. paratuberculosis
ccaccgacagcc

SEQ ID NO: 2819456 - RNA, 16 nt, Mycobacterium avium subsp. paratuberculosis
ccaccgacagccggac

SEQ ID NO: 2819457 - RNA, 14 nt, Mycobacterium avium subsp. paratuberculosis
ccaccgacaucgaa

SEQ ID NO: 2819458 - RNA, 20 nt, Mycobacterium avium subsp. paratuberculosis
ccaccgacgccacgucguuc

SEQ ID NO: 2819459 - RNA, 17 nt, Mycobacterium avium subsp. paratuberculosis
ccaccgacgcgucgcgg

SEQ ID NO: 2819460 - RNA, 13 nt, Mycobacterium avium subsp. paratuberculosis
ccaccgagcagcu

SEQ ID NO: 2819461 - RNA, 15 nt, Mycobacterium avium subsp. paratuberculosis
ccaccgagcagcugc

SEQ ID NO: 2819462 - RNA, 14 nt, Mycobacterium avium subsp. paratuberculosis
ccaccgagccggcg

SEQ ID NO: 2819463 - RNA, 21 nt, Mycobacterium avium subsp. paratuberculosis
ccaccgagccggcgucgccgc

SEQ ID NO: 2819464 - RNA, 16 nt, Mycobacterium avium subsp. paratuberculosis
ccaccgagccgggcag

SEQ ID NO: 2819465 - RNA, 20 nt, Mycobacterium avium subsp. paratuberculosis
ccaccgagccgggcagcgcg

SEQ ID NO: 2819466 - RNA, 15 nt, Mycobacterium avium subsp. paratuberculosis
ccaccgagccggugc

SEQ ID NO: 2819467 - RNA, 17 nt, Mycobacterium avium subsp. paratuberculosis
ccaccgagccggugccg

SEQ ID NO: 2819468 - RNA, 17 nt, Mycobacterium avium subsp. paratuberculosis
ccaccgaggccagcaga

SEQ ID NO: 2819469 - RNA, 18 nt, Mycobacterium avium subsp. paratuberculosis
ccaccgaggccagcagau

SEQ ID NO: 2819470 - RNA, 15 nt, Mycobacterium avium subsp. paratuberculosis
ccaccgaggugacga

SEQ ID NO: 2819471 - RNA, 20 nt, Mycobacterium avium subsp. paratuberculosis
ccaccgaggugacgaggccc

SEQ ID NO: 2819472 - RNA, 17 nt, Mycobacterium avium subsp. paratuberculosis
ccaccgaggugacgucg

SEQ ID NO: 2819473 - RNA, 23 nt, Mycobacterium avium subsp. paratuberculosis
ccaccgaggugacgucgcgccgc

SEQ ID NO: 2819474 - RNA, 15 nt, Mycobacterium avium subsp. paratuberculosis
ccaccgagguggccc

SEQ ID NO: 2819475 - RNA, 17 nt, Mycobacterium avium subsp. paratuberculosis
ccaccgagugcggcgcg

SEQ ID NO: 2819476 - RNA, 19 nt, Mycobacterium avium subsp. paratuberculosis
ccaccgagugcggcgcggu

SEQ ID NO: 2819477 - RNA, 21 nt, Mycobacterium avium subsp. paratuberculosis
ccaccgagugcggcgcggugc

SEQ ID NO: 2819478 - RNA, 20 nt, Mycobacterium avium subsp. paratuberculosis
ccaccgaugcccgacaccgc

SEQ ID NO: 2819479 - RNA, 16 nt, Mycobacterium avium subsp. paratuberculosis
ccaccgaugcgggcca

SEQ ID NO: 2819480 - RNA, 12 nt, Mycobacterium avium subsp. paratuberculosis
ccaccgccacca

SEQ ID NO: 2819481 - RNA, 14 nt, Mycobacterium avium subsp. paratuberculosis
ccaccgccaccagc

SEQ ID NO: 2819482 - RNA, 14 nt, Mycobacterium avium subsp. paratuberculosis
ccaccgccaccgcg

SEQ ID NO: 2819483 - RNA, 14 nt, Mycobacterium avium subsp. paratuberculosis
ccaccgcccacagc

SEQ ID NO: 2819484 - RNA, 15 nt, Mycobacterium avium subsp. paratuberculosis
ccaccgcccacagca

SEQ ID NO: 2819485 - RNA, 14 nt, Mycobacterium avium subsp. paratuberculosis
ccaccgcccgaacc

SEQ ID NO: 2819486 - RNA, 20 nt, Mycobacterium avium subsp. paratuberculosis
ccaccgcccgcugaccgccg

SEQ ID NO: 2819487 - RNA, 21 nt, Mycobacterium avium subsp. paratuberculosis
ccaccgcccgcugaccgccgc

SEQ ID NO: 2819488 - RNA, 22 nt, Mycobacterium avium subsp. paratuberculosis
ccaccgcccgcugaccgccgcg

SEQ ID NO: 2819489 - RNA, 16 nt, Mycobacterium avium subsp. paratuberculosis
ccaccgcccggaccgg

SEQ ID NO: 2819490 - RNA, 18 nt, Mycobacterium avium subsp. paratuberculosis
ccaccgcccggaccggcu

SEQ ID NO: 2819491 - RNA, 13 nt, Mycobacterium avium subsp. paratuberculosis
ccaccgcccggau

SEQ ID NO: 2819492 - RNA, 21 nt, Mycobacterium avium subsp. paratuberculosis
ccaccgcccggaugccggcgc

SEQ ID NO: 2819493 - RNA, 16 nt, Mycobacterium avium subsp. paratuberculosis
ccaccgccgccagcag

SEQ ID NO: 2819494 - RNA, 14 nt, Mycobacterium avium subsp. paratuberculosis
ccaccgccgcgccg

SEQ ID NO: 2819495 - RNA, 15 nt, Mycobacterium avium subsp. paratuberculosis
ccaccgccgcgccga

SEQ ID NO: 2819496 - RNA, 16 nt, Mycobacterium avium subsp. paratuberculosis
ccaccgccgcgccgag

SEQ ID NO: 2819497 - RNA, 14 nt, Mycobacterium avium subsp. paratuberculosis
ccaccgccgcugcg

SEQ ID NO: 2819498 - RNA, 12 nt, Mycobacterium avium subsp. paratuberculosis
ccaccgccggcc

SEQ ID NO: 2819499 - RNA, 14 nt, Mycobacterium avium subsp. paratuberculosis
ccaccgccggccca

SEQ ID NO: 2819500 - RNA, 15 nt, Mycobacterium avium subsp. paratuberculosis
ccaccgccggcccgg

SEQ ID NO: 2819501 - RNA, 21 nt, Mycobacterium avium subsp. paratuberculosis
ccaccgccggggugugcagcg

SEQ ID NO: 2819502 - RNA, 18 nt, Mycobacterium avium subsp. paratuberculosis
ccaccgccgucaccgcca

SEQ ID NO: 2819503 - RNA, 21 nt, Mycobacterium avium subsp. paratuberculosis
ccaccgccgucaccgccagga

SEQ ID NO: 2819504 - RNA, 16 nt, Mycobacterium avium subsp. paratuberculosis
ccaccgccugcgcgau

SEQ ID NO: 2819505 - RNA, 20 nt, Mycobacterium avium subsp. paratuberculosis
ccaccgcgaaagcgucggcu

SEQ ID NO: 2819506 - RNA, 15 nt, Mycobacterium avium subsp. paratuberculosis
ccaccgcgacacguc

SEQ ID NO: 2819507 - RNA, 17 nt, Mycobacterium avium subsp. paratuberculosis
ccaccgcgacccggccg

SEQ ID NO: 2819508 - RNA, 14 nt, Mycobacterium avium subsp. paratuberculosis
ccaccgcgacgccc

SEQ ID NO: 2819509 - RNA, 15 nt, Mycobacterium avium subsp. paratuberculosis
ccaccgcgacgcugc

SEQ ID NO: 2819510 - RNA, 12 nt, Mycobacterium avium subsp. paratuberculosis
ccaccgcgagcg

SEQ ID NO: 2819511 - RNA, 19 nt, Mycobacterium avium subsp. paratuberculosis
ccaccgcgcaaccgggccg

SEQ ID NO: 2819512 - RNA, 22 nt, Mycobacterium avium subsp. paratuberculosis
ccaccgcgcaaccgggccgcac

SEQ ID NO: 2819513 - RNA, 16 nt, Mycobacterium avium subsp. paratuberculosis
ccaccgcgcccacccg

SEQ ID NO: 2819514 - RNA, 23 nt, Mycobacterium avium subsp. paratuberculosis
ccaccgcgcccagccccagcacg

SEQ ID NO: 2819515 - RNA, 21 nt, Mycobacterium avium subsp. paratuberculosis
ccaccgcgccccggcgcagcg

SEQ ID NO: 2819516 - RNA, 11 nt, Mycobacterium avium subsp. paratuberculosis
ccaccgcgccg

SEQ ID NO: 2819517 - RNA, 12 nt, Mycobacterium avium subsp. paratuberculosis
ccaccgcgccgg

SEQ ID NO: 2819518 - RNA, 14 nt, Mycobacterium avium subsp. paratuberculosis
ccaccgcgccggcg

SEQ ID NO: 2819519 - RNA, 16 nt, Mycobacterium avium subsp. paratuberculosis
ccaccgcgccggcggc

SEQ ID NO: 2819520 - RNA, 12 nt, Mycobacterium avium subsp. paratuberculosis
ccaccgcgccgu

SEQ ID NO: 2819521 - RNA, 13 nt, Mycobacterium avium subsp. paratuberculosis
ccaccgcgccguc

SEQ ID NO: 2819522 - RNA, 18 nt, Mycobacterium avium subsp. paratuberculosis
ccaccgucaccgccgcac

SEQ ID NO: 2819523 - RNA, 20 nt, Mycobacterium avium subsp. paratuberculosis
ccaccgucccggugucgccg

SEQ ID NO: 2819524 - RNA, 14 nt, Mycobacterium avium subsp. paratuberculosis
ccaccgucgaugga

SEQ ID NO: 2819525 - RNA, 16 nt, Mycobacterium avium subsp. paratuberculosis
ccaccgucgccacgau

SEQ ID NO: 2819526 - RNA, 18 nt, Mycobacterium avium subsp. paratuberculosis
ccaccgucgccacgauca

SEQ ID NO: 2819527 - RNA, 20 nt, Mycobacterium avium subsp. paratuberculosis
ccaccgucgccacgaucacc

SEQ ID NO: 2819528 - RNA, 21 nt, Mycobacterium avium subsp. paratuberculosis
ccaccgucgccacgaucacca

SEQ ID NO: 2819529 - RNA, 13 nt, Mycobacterium avium subsp. paratuberculosis
ccaccgucgucga

SEQ ID NO: 2819530 - RNA, 17 nt, Mycobacterium avium subsp. paratuberculosis
ccaccgucgucgagcgc

SEQ ID NO: 2819531 - RNA, 18 nt, Mycobacterium avium subsp. paratuberculosis
ccaccgucuucggggccg

SEQ ID NO: 2819532 - RNA, 19 nt, Mycobacterium avium subsp. paratuberculosis
ccaccgucuucggggccgc

SEQ ID NO: 2819533 - RNA, 23 nt, Mycobacterium avium subsp. paratuberculosis
ccaccgucuucggggccgccguc

SEQ ID NO: 2819534 - RNA, 17 nt, Mycobacterium avium subsp. paratuberculosis
ccaccgucuugccguug

SEQ ID NO: 2819535 - RNA, 22 nt, Mycobacterium avium subsp. paratuberculosis
ccaccgucuuggucucgccgau

SEQ ID NO: 2819536 - RNA, 23 nt, Mycobacterium avium subsp. paratuberculosis
ccaccgucuuggucucgccgauc

SEQ ID NO: 2819537 - RNA, 21 nt, Mycobacterium avium subsp. paratuberculosis
ccaccgugccgucgcgggcgu

SEQ ID NO: 2819538 - RNA, 20 nt, Mycobacterium avium subsp. paratuberculosis
ccaccgugccuuacgccggg

SEQ ID NO: 2819539 - RNA, 15 nt, Mycobacterium avium subsp. paratuberculosis
ccaccgugcuggcca

SEQ ID NO: 2819540 - RNA, 21 nt, Mycobacterium avium subsp. paratuberculosis
ccaccgugcuggccaccacgg

SEQ ID NO: 2819541 - RNA, 15 nt, Mycobacterium avium subsp. paratuberculosis
ccaccguggccccac

SEQ ID NO: 2819542 - RNA, 22 nt, Mycobacterium avium subsp. paratuberculosis
ccaccguggccccacgggccau

SEQ ID NO: 2819543 - RNA, 16 nt, Mycobacterium avium subsp. paratuberculosis
ccaccguggccccagc

SEQ ID NO: 2819544 - RNA, 19 nt, Mycobacterium avium subsp. paratuberculosis
ccaccguggccccagccac

SEQ ID NO: 2819545 - RNA, 15 nt, Mycobacterium avium subsp. paratuberculosis
ccaccguggcgaugg

SEQ ID NO: 2819546 - RNA, 21 nt, Mycobacterium avium subsp. paratuberculosis
ccaccguggucggcagcaccg

SEQ ID NO: 2819547 - RNA, 22 nt, Mycobacterium avium subsp. paratuberculosis
ccaccguggucggcagcaccgg

SEQ ID NO: 2819548 - RNA, 15 nt, Mycobacterium avium subsp. paratuberculosis
ccaccguguucacca

SEQ ID NO: 2819549 - RNA, 19 nt, Mycobacterium avium subsp. paratuberculosis
ccaccguguucaccagcgg

SEQ ID NO: 2819550 - RNA, 20 nt, Mycobacterium avium subsp. paratuberculosis
ccaccguguucaccagcggg

SEQ ID NO: 2819551 - RNA, 17 nt, Mycobacterium avium subsp. paratuberculosis
ccaccguugucucggcg

SEQ ID NO: 2819552 - RNA, 20 nt, Mycobacterium avium subsp. paratuberculosis
ccaccguugucucggcgccg

SEQ ID NO: 2819553 - RNA, 22 nt, Mycobacterium avium subsp. paratuberculosis
ccaccguugucucggcgccguc

SEQ ID NO: 2819554 - RNA, 23 nt, Mycobacterium avium subsp. paratuberculosis
ccaccguugucucggcgccgucg

SEQ ID NO: 2819555 - RNA, 17 nt, Mycobacterium avium subsp. paratuberculosis
ccaccuccccgcggugc

SEQ ID NO: 2819556 - RNA, 19 nt, Mycobacterium avium subsp. paratuberculosis
ccaccuccccgcggugccg

SEQ ID NO: 2819557 - RNA, 20 nt, Mycobacterium avium subsp. paratuberculosis
ccaccuccuccgguccgggc

SEQ ID NO: 2819558 - RNA, 14 nt, Mycobacterium avium subsp. paratuberculosis
ccaccucgagcaac

SEQ ID NO: 2819559 - RNA, 14 nt, Mycobacterium avium subsp. paratuberculosis
ccaccucgagcacg

SEQ ID NO: 2819560 - RNA, 21 nt, Mycobacterium avium subsp. paratuberculosis
ccaccucgagcacgcccugcg

SEQ ID NO: 2819561 - RNA, 19 nt, Mycobacterium avium subsp. paratuberculosis
ccaccucgagcucaccgac

SEQ ID NO: 2819562 - RNA, 16 nt, Mycobacterium avium subsp. paratuberculosis
ccaccucgaucagcgg

SEQ ID NO: 2819563 - RNA, 21 nt, Mycobacterium avium subsp. paratuberculosis
ccaccucgaucagcggcaucg

SEQ ID NO: 2819564 - RNA, 17 nt, Mycobacterium avium subsp. paratuberculosis
ccaccucgaugaccuuc

SEQ ID NO: 2819565 - RNA, 13 nt, Mycobacterium avium subsp. paratuberculosis
ccaccucgccgca

SEQ ID NO: 2819566 - RNA, 14 nt, Mycobacterium avium subsp. paratuberculosis
ccaccucgccgcag

SEQ ID NO: 2819567 - RNA, 13 nt, Mycobacterium avium subsp. paratuberculosis
ccaccucgcgcgg

SEQ ID NO: 2819568 - RNA, 14 nt, Mycobacterium avium subsp. paratuberculosis
ccaccucgcgcggg

SEQ ID NO: 2819569 - RNA, 17 nt, Mycobacterium avium subsp. paratuberculosis
ccaccucgcgcggggcg

SEQ ID NO: 2819570 - RNA, 21 nt, Mycobacterium avium subsp. paratuberculosis
ccaccucgcgcggggcggccg

SEQ ID NO: 2819571 - RNA, 13 nt, Mycobacterium avium subsp. paratuberculosis
ccaccucgcgggc

SEQ ID NO: 2819572 - RNA, 24 nt, Mycobacterium avium subsp. paratuberculosis
ccaccucgcgggcgaccuggugcu

SEQ ID NO: 2819573 - RNA, 14 nt, Mycobacterium avium subsp. paratuberculosis
ccaccucggcgauc

SEQ ID NO: 2819574 - RNA, 16 nt, Mycobacterium avium subsp. paratuberculosis
ccaccucggcgaucug

SEQ ID NO: 2819575 - RNA, 20 nt, Mycobacterium avium subsp. paratuberculosis
ccaccucggcggcaccgccc

SEQ ID NO: 2819576 - RNA, 22 nt, Mycobacterium avium subsp. paratuberculosis
ccaccucggcggcaccgcccgg

SEQ ID NO: 2819577 - RNA, 16 nt, Mycobacterium avium subsp. paratuberculosis
ccaccucgggcauugg

SEQ ID NO: 2819578 - RNA, 17 nt, Mycobacterium avium subsp. paratuberculosis
ccaccucgggccgggcg

SEQ ID NO: 2819579 - RNA, 23 nt, Mycobacterium avium subsp. paratuberculosis
ccaccucgggccgggcgggcacc

SEQ ID NO: 2819580 - RNA, 18 nt, Mycobacterium avium subsp. paratuberculosis
ccaccucgguggacgccg

SEQ ID NO: 2819581 - RNA, 20 nt, Mycobacterium avium subsp. paratuberculosis
ccaccucgguggacgccgcg

SEQ ID NO: 2819582 - RNA, 18 nt, Mycobacterium avium subsp. paratuberculosis
ccaccucgucccagcgca

SEQ ID NO: 2819583 - RNA, 12 nt, Mycobacterium avium subsp. paratuberculosis
ccaccucgucgg

SEQ ID NO: 2819584 - RNA, 15 nt, Mycobacterium avium subsp. paratuberculosis
ccaccucgucggcgg

SEQ ID NO: 2819585 - RNA, 17 nt, Mycobacterium avium subsp. paratuberculosis
ccaccucgucggcgguc

SEQ ID NO: 2819586 - RNA, 19 nt, Mycobacterium avium subsp. paratuberculosis
ccaccucuucgcgguccau

SEQ ID NO: 2819587 - RNA, 13 nt, Mycobacterium avium subsp. paratuberculosis
ccaccugaccgcg

SEQ ID NO: 2819588 - RNA, 18 nt, Mycobacterium avium subsp. paratuberculosis
ccaccugaccgcgggccc

SEQ ID NO: 2819589 - RNA, 21 nt, Mycobacterium avium subsp. paratuberculosis
ccaccugaccgcgggcccgcc

SEQ ID NO: 2819590 - RNA, 20 nt, Mycobacterium avium subsp. paratuberculosis
ccaccugcacggggacgucg

SEQ ID NO: 2819591 - RNA, 22 nt, Mycobacterium avium subsp. paratuberculosis
ccaccugcacggggacgucguc

SEQ ID NO: 2819592 - RNA, 13 nt, Mycobacterium avium subsp. paratuberculosis
ccaccugcggcac

SEQ ID NO: 2819593 - RNA, 12 nt, Mycobacterium avium subsp. paratuberculosis
ccaccuggaagc

SEQ ID NO: 2819594 - RNA, 13 nt, Mycobacterium avium subsp. paratuberculosis
ccaccuggaagcg

SEQ ID NO: 2819595 - RNA, 19 nt, Mycobacterium avium subsp. paratuberculosis
ccaccuggaagcgcaucgc

SEQ ID NO: 2819596 - RNA, 21 nt, Mycobacterium avium subsp. paratuberculosis
ccaccuggaggccaacgagcg

SEQ ID NO: 2819597 - RNA, 13 nt, Mycobacterium avium subsp. paratuberculosis
ccaccuggccggc

SEQ ID NO: 2819598 - RNA, 22 nt, Mycobacterium avium subsp. paratuberculosis
ccaccuggccggccaucuucag

SEQ ID NO: 2819599 - RNA, 12 nt, Mycobacterium avium subsp. paratuberculosis
ccaccugggcgg

SEQ ID NO: 2819600 - RNA, 15 nt, Mycobacterium avium subsp. paratuberculosis
ccaccugggcggggc

SEQ ID NO: 2819601 - RNA, 20 nt, Mycobacterium avium subsp. paratuberculosis
ccaccugggcgucgucggcc

SEQ ID NO: 2819602 - RNA, 22 nt, Mycobacterium avium subsp. paratuberculosis
ccaccugggcgucgucggccgg

SEQ ID NO: 2819603 - RNA, 20 nt, Mycobacterium avium subsp. paratuberculosis
ccaccugguucucccgucgc

SEQ ID NO: 2819604 - RNA, 21 nt, Mycobacterium avium subsp. paratuberculosis
ccaccugguucucccgucgcg

SEQ ID NO: 2819605 - RNA, 19 nt, Mycobacterium avium subsp. paratuberculosis
ccaccugguuggcccgcac

SEQ ID NO: 2819606 - RNA, 18 nt, Mycobacterium avium subsp. paratuberculosis
ccacgaucgcgaucgccg

SEQ ID NO: 2819607 - RNA, 12 nt, Mycobacterium avium subsp. paratuberculosis
ccacgaucgcgg

SEQ ID NO: 2819608 - RNA, 15 nt, Mycobacterium avium subsp. paratuberculosis
ccacgaucgcggcca

SEQ ID NO: 2819609 - RNA, 17 nt, Mycobacterium avium subsp. paratuberculosis
ccacgaucgcggccagc

SEQ ID NO: 2819610 - RNA, 18 nt, Mycobacterium avium subsp. paratuberculosis
ccacgaucgcggccagcg

SEQ ID NO: 2819611 - RNA, 19 nt, Mycobacterium avium subsp. paratuberculosis
ccacgaucgcggccagcgu

SEQ ID NO: 2819612 - RNA, 15 nt, Mycobacterium avium subsp. paratuberculosis
ccacgaucgcgucgg

SEQ ID NO: 2819613 - RNA, 19 nt, Mycobacterium avium subsp. paratuberculosis
ccacgaucugcuuggucac

SEQ ID NO: 2819614 - RNA, 21 nt, Mycobacterium avium subsp. paratuberculosis
ccacgaugaagccgugcccgc

SEQ ID NO: 2819615 - RNA, 19 nt, Mycobacterium avium subsp. paratuberculosis
ccacgaugacggugguggc

SEQ ID NO: 2819616 - RNA, 19 nt, Mycobacterium avium subsp. paratuberculosis
ccacgaugaucgucggcag

SEQ ID NO: 2819617 - RNA, 23 nt, Mycobacterium avium subsp. paratuberculosis
ccacgaugaucgucggcagcgac

SEQ ID NO: 2819618 - RNA, 13 nt, Mycobacterium avium subsp. paratuberculosis
ccacgaugcccgu

SEQ ID NO: 2819619 - RNA, 14 nt, Mycobacterium avium subsp. paratuberculosis
ccacgaugccgggc

SEQ ID NO: 2819620 - RNA, 24 nt, Mycobacterium avium subsp. paratuberculosis
ccacgaugccgggcacgaauucgg

SEQ ID NO: 2819621 - RNA, 22 nt, Mycobacterium avium subsp. paratuberculosis
ccacgaugcugauacccgcgcg

SEQ ID NO: 2819622 - RNA, 19 nt, Mycobacterium avium subsp. paratuberculosis
ccacgauggggacgucgac

SEQ ID NO: 2819623 - RNA, 21 nt, Mycobacterium avium subsp. paratuberculosis
ccacgauggggacgucgacgu

SEQ ID NO: 2819624 - RNA, 23 nt, Mycobacterium avium subsp. paratuberculosis
ccacgauggggacgucgacgugg

SEQ ID NO: 2819625 - RNA, 18 nt, Mycobacterium avium subsp. paratuberculosis
ccacgauuccucggaccg

SEQ ID NO: 2819626 - RNA, 18 nt, Mycobacterium avium subsp. paratuberculosis
ccacgcacaccaccgacg

SEQ ID NO: 2819627 - RNA, 20 nt, Mycobacterium avium subsp. paratuberculosis
ccacgcacaccaccgacgcg

SEQ ID NO: 2819628 - RNA, 23 nt, Mycobacterium avium subsp. paratuberculosis
ccacgcacaccaccgacgcgucg

SEQ ID NO: 2819629 - RNA, 12 nt, Mycobacterium avium subsp. paratuberculosis
ccacgcacaccg

SEQ ID NO: 2819630 - RNA, 19 nt, Mycobacterium avium subsp. paratuberculosis
ccacgcagcggugcagccc

SEQ ID NO: 2819631 - RNA, 20 nt, Mycobacterium avium subsp. paratuberculosis
ccacgcagcggugcagcccc

SEQ ID NO: 2819632 - RNA, 23 nt, Mycobacterium avium subsp. paratuberculosis
ccacgcaggcguccagggccacc

SEQ ID NO: 2819633 - RNA, 12 nt, Mycobacterium avium subsp. paratuberculosis
ccacgccagcca

SEQ ID NO: 2819634 - RNA, 16 nt, Mycobacterium avium subsp. paratuberculosis
ccacgccagccaggcg

SEQ ID NO: 2819635 - RNA, 17 nt, Mycobacterium avium subsp. paratuberculosis
ccacgccaugugccggc

SEQ ID NO: 2819636 - RNA, 18 nt, Mycobacterium avium subsp. paratuberculosis
ccacgccaugugccggcg

SEQ ID NO: 2819637 - RNA, 20 nt, Mycobacterium avium subsp. paratuberculosis
ccacgccaugugccggcgcu

SEQ ID NO: 2819638 - RNA, 14 nt, Mycobacterium avium subsp. paratuberculosis
ccacgcccaccggu

SEQ ID NO: 2819639 - RNA, 18 nt, Mycobacterium avium subsp. paratuberculosis
ccacgcccaccgguggcc

SEQ ID NO: 2819640 - RNA, 14 nt, Mycobacterium avium subsp. paratuberculosis
ccacgcccacgccg

SEQ ID NO: 2819641 - RNA, 14 nt, Mycobacterium avium subsp. paratuberculosis
ccacgcccagcgcc

SEQ ID NO: 2819642 - RNA, 16 nt, Mycobacterium avium subsp. paratuberculosis
ccacgccccauugccg

SEQ ID NO: 2819643 - RNA, 16 nt, Mycobacterium avium subsp. paratuberculosis
ccacgccccggcgccg

SEQ ID NO: 2819644 - RNA, 16 nt, Mycobacterium avium subsp. paratuberculosis
ccacgcccgcagcgca

SEQ ID NO: 2819645 - RNA, 18 nt, Mycobacterium avium subsp. paratuberculosis
ccacgcccgcagcgcauc

SEQ ID NO: 2819646 - RNA, 12 nt, Mycobacterium avium subsp. paratuberculosis
ccacgcccggac

SEQ ID NO: 2819647 - RNA, 15 nt, Mycobacterium avium subsp. paratuberculosis
ccacgcccggacccg

SEQ ID NO: 2819648 - RNA, 18 nt, Mycobacterium avium subsp. paratuberculosis
ccacgcccuagcgggcca

SEQ ID NO: 2819649 - RNA, 22 nt, Mycobacterium avium subsp. paratuberculosis
ccacgcccuagcgggccaggau

SEQ ID NO: 2819650 - RNA, 18 nt, Mycobacterium avium subsp. paratuberculosis
ccacgcccuggccgccgg

SEQ ID NO: 2819651 - RNA, 20 nt, Mycobacterium avium subsp. paratuberculosis
ccacgcccuggccgccggcc

SEQ ID NO: 2819652 - RNA, 21 nt, Mycobacterium avium subsp. paratuberculosis
ccacgcccuggccgccggccg

SEQ ID NO: 2819653 - RNA, 18 nt, Mycobacterium avium subsp. paratuberculosis
ccacgccgacaccgucgc

SEQ ID NO: 2819654 - RNA, 14 nt, Mycobacterium avium subsp. paratuberculosis
ccacgccgacgaac

SEQ ID NO: 2819655 - RNA, 14 nt, Mycobacterium avium subsp. paratuberculosis
ccacgccgagcacc

SEQ ID NO: 2819656 - RNA, 16 nt, Mycobacterium avium subsp. paratuberculosis
ccacgccgagggcggc

SEQ ID NO: 2819657 - RNA, 20 nt, Mycobacterium avium subsp. paratuberculosis
ccacgccgagggcggcggcu

SEQ ID NO: 2819658 - RNA, 17 nt, Mycobacterium avium subsp. paratuberculosis
ccacgccgagggugccg

SEQ ID NO: 2819659 - RNA, 18 nt, Mycobacterium avium subsp. paratuberculosis
ccacgccgagggugccgg

SEQ ID NO: 2819660 - RNA, 20 nt, Mycobacterium avium subsp. paratuberculosis
ccacgccgagggugccggcc

SEQ ID NO: 2819661 - RNA, 18 nt, Mycobacterium avium subsp. paratuberculosis
ccacgccgcccccgccgc

SEQ ID NO: 2819662 - RNA, 21 nt, Mycobacterium avium subsp. paratuberculosis
ccacgccgcccccgccgcgag

SEQ ID NO: 2819663 - RNA, 11 nt, Mycobacterium avium subsp. paratuberculosis
ccacgccgccg

SEQ ID NO: 2819664 - RNA, 19 nt, Mycobacterium avium subsp. paratuberculosis
ccacgccgccgggaacagc

SEQ ID NO: 2819665 - RNA, 18 nt, Mycobacterium avium subsp. paratuberculosis
ccacgccgcgauccgggc

SEQ ID NO: 2819666 - RNA, 21 nt, Mycobacterium avium subsp. paratuberculosis
ccacgccgcgcuugacggccg

SEQ ID NO: 2819667 - RNA, 13 nt, Mycobacterium avium subsp. paratuberculosis
ccacgccgcggga

SEQ ID NO: 2819668 - RNA, 13 nt, Mycobacterium avium subsp. paratuberculosis
ccacgccggcaca

SEQ ID NO: 2819669 - RNA, 15 nt, Mycobacterium avium subsp. paratuberculosis
ccacgccggcgaucu

SEQ ID NO: 2819670 - RNA, 19 nt, Mycobacterium avium subsp. paratuberculosis
ccacgccggcgaucuccac

SEQ ID NO: 2819671 - RNA, 14 nt, Mycobacterium avium subsp. paratuberculosis
ccacgccggugacc

SEQ ID NO: 2819672 - RNA, 18 nt, Mycobacterium avium subsp. paratuberculosis
ccacgccguacaccgugc

SEQ ID NO: 2819673 - RNA, 13 nt, Mycobacterium avium subsp. paratuberculosis
ccacgccgucgac

SEQ ID NO: 2819674 - RNA, 13 nt, Mycobacterium avium subsp. paratuberculosis
ccacgccgugcag

SEQ ID NO: 2819675 - RNA, 18 nt, Mycobacterium avium subsp. paratuberculosis
ccacgccguggcccgccc

SEQ ID NO: 2819676 - RNA, 19 nt, Mycobacterium avium subsp. paratuberculosis
ccacgccguggcccgccca

SEQ ID NO: 2819677 - RNA, 18 nt, Mycobacterium avium subsp. paratuberculosis
ccacgccguugggcgcau

SEQ ID NO: 2819678 - RNA, 13 nt, Mycobacterium avium subsp. paratuberculosis
ccacgccuccggc

SEQ ID NO: 2819679 - RNA, 22 nt, Mycobacterium avium subsp. paratuberculosis
ccacgccuugcgguuggccgga

SEQ ID NO: 2819680 - RNA, 13 nt, Mycobacterium avium subsp. paratuberculosis
ccacgcgcaacca

SEQ ID NO: 2819681 - RNA, 23 nt, Mycobacterium avium subsp. paratuberculosis
ccacgcgcagggcgaacggcgga

SEQ ID NO: 2819682 - RNA, 16 nt, Mycobacterium avium subsp. paratuberculosis
ccacgcgcucagcgcg

SEQ ID NO: 2819683 - RNA, 18 nt, Mycobacterium avium subsp. paratuberculosis
ccacgcgcucagcgcggc

SEQ ID NO: 2819684 - RNA, 20 nt, Mycobacterium avium subsp. paratuberculosis
ccacgcgcucagcgcggcca

SEQ ID NO: 2819685 - RNA, 21 nt, Mycobacterium avium subsp. paratuberculosis
ccacgcgcucagcgcggccac

SEQ ID NO: 2819686 - RNA, 23 nt, Mycobacterium avium subsp. paratuberculosis
ccacgcggauagcccagcguggu

SEQ ID NO: 2819687 - RNA, 17 nt, Mycobacterium avium subsp. paratuberculosis
ccacgcggcggcggugc

SEQ ID NO: 2819688 - RNA, 13 nt, Mycobacterium avium subsp. paratuberculosis
ccacgcggugauc

SEQ ID NO: 2819689 - RNA, 20 nt, Mycobacterium avium subsp. paratuberculosis
ccacgcggugauccagagca

SEQ ID NO: 2819690 - RNA, 16 nt, Mycobacterium avium subsp. paratuberculosis
ccacgcguagccgacc

SEQ ID NO: 2819691 - RNA, 21 nt, Mycobacterium avium subsp. paratuberculosis
ccacggucagcgcgucggcga

SEQ ID NO: 2819692 - RNA, 22 nt, Mycobacterium avium subsp. paratuberculosis
ccacggucagcgcgucggcgac

SEQ ID NO: 2819693 - RNA, 23 nt, Mycobacterium avium subsp. paratuberculosis
ccacggucagcgcgucggcgacc

SEQ ID NO: 2819694 - RNA, 19 nt, Mycobacterium avium subsp. paratuberculosis
ccacggucaggcgcagcca

SEQ ID NO: 2819695 - RNA, 15 nt, Mycobacterium avium subsp. paratuberculosis
ccacggucagggcca

SEQ ID NO: 2819696 - RNA, 16 nt, Mycobacterium avium subsp. paratuberculosis
ccacggucagggccag

SEQ ID NO: 2819697 - RNA, 19 nt, Mycobacterium avium subsp. paratuberculosis
ccacggucagggccagcaa

SEQ ID NO: 2819698 - RNA, 21 nt, Mycobacterium avium subsp. paratuberculosis
ccacggucagggccagcaaca

SEQ ID NO: 2819699 - RNA, 20 nt, Mycobacterium avium subsp. paratuberculosis
ccacgguccccgcgcccgcc

SEQ ID NO: 2819700 - RNA, 17 nt, Mycobacterium avium subsp. paratuberculosis
ccacggucgccgcgccg

SEQ ID NO: 2819701 - RNA, 13 nt, Mycobacterium avium subsp. paratuberculosis
ccacggucggcgg

SEQ ID NO: 2819702 - RNA, 14 nt, Mycobacterium avium subsp. paratuberculosis
ccacggucggcggg

SEQ ID NO: 2819703 - RNA, 17 nt, Mycobacterium avium subsp. paratuberculosis
ccacggucuuugccggc

SEQ ID NO: 2819704 - RNA, 18 nt, Mycobacterium avium subsp. paratuberculosis
ccacggucuuugccggcc

SEQ ID NO: 2819705 - RNA, 13 nt, Mycobacterium avium subsp. paratuberculosis
ccacggugaacgg

SEQ ID NO: 2819706 - RNA, 17 nt, Mycobacterium avium subsp. paratuberculosis
ccacggugaacgggccg

SEQ ID NO: 2819707 - RNA, 18 nt, Mycobacterium avium subsp. paratuberculosis
ccacggugaacgggccgc

SEQ ID NO: 2819708 - RNA, 19 nt, Mycobacterium avium subsp. paratuberculosis
ccacggugaacgggccgca

SEQ ID NO: 2819709 - RNA, 15 nt, Mycobacterium avium subsp. paratuberculosis
ccacggugaucucgc

SEQ ID NO: 2819710 - RNA, 18 nt, Mycobacterium avium subsp. paratuberculosis
ccacggugaucucgccga

SEQ ID NO: 2819711 - RNA, 19 nt, Mycobacterium avium subsp. paratuberculosis
ccacggugauuccggcacc

SEQ ID NO: 2819712 - RNA, 12 nt, Mycobacterium avium subsp. paratuberculosis
ccacggugcgca

SEQ ID NO: 2819713 - RNA, 14 nt, Mycobacterium avium subsp. paratuberculosis
ccacggugcgcucg

SEQ ID NO: 2819714 - RNA, 17 nt, Mycobacterium avium subsp. paratuberculosis
ccacggugcgcucguga

SEQ ID NO: 2819715 - RNA, 14 nt, Mycobacterium avium subsp. paratuberculosis
ccacgguggcgccg

SEQ ID NO: 2819716 - RNA, 15 nt, Mycobacterium avium subsp. paratuberculosis
ccacgguggcgccga

SEQ ID NO: 2819717 - RNA, 20 nt, Mycobacterium avium subsp. paratuberculosis
ccacgguggcgccgcgcagc

SEQ ID NO: 2819718 - RNA, 15 nt, Mycobacterium avium subsp. paratuberculosis
ccacgguggcgccgg

SEQ ID NO: 2819719 - RNA, 20 nt, Mycobacterium avium subsp. paratuberculosis
ccacgguggcgccggcaucg

SEQ ID NO: 2819720 - RNA, 16 nt, Mycobacterium avium subsp. paratuberculosis
ccacgguggcggucag

SEQ ID NO: 2819721 - RNA, 16 nt, Mycobacterium avium subsp. paratuberculosis
ccacgguggcguccag

SEQ ID NO: 2819722 - RNA, 20 nt, Mycobacterium avium subsp. paratuberculosis
ccacgguggugucgucgggc

SEQ ID NO: 2819723 - RNA, 22 nt, Mycobacterium avium subsp. paratuberculosis
ccacgguggugucgucgggccg

SEQ ID NO: 2819724 - RNA, 17 nt, Mycobacterium avium subsp. paratuberculosis
ccacgguguagcggcgg

SEQ ID NO: 2819725 - RNA, 19 nt, Mycobacterium avium subsp. paratuberculosis
ccacgguguagcggcggcu

SEQ ID NO: 2819726 - RNA, 17 nt, Mycobacterium avium subsp. paratuberculosis
ccacgguuucgccguac

SEQ ID NO: 2819727 - RNA, 15 nt, Mycobacterium avium subsp. paratuberculosis
ccacguacaccggga

SEQ ID NO: 2819728 - RNA, 14 nt, Mycobacterium avium subsp. paratuberculosis
ccacguacuccugc

SEQ ID NO: 2819729 - RNA, 18 nt, Mycobacterium avium subsp. paratuberculosis
ccacguacuccugcgcga

SEQ ID NO: 2819730 - RNA, 18 nt, Mycobacterium avium subsp. paratuberculosis
ccacguagcagcagaccg

SEQ ID NO: 2819731 - RNA, 20 nt, Mycobacterium avium subsp. paratuberculosis
ccacguagcagcagaccgcg

SEQ ID NO: 2819732 - RNA, 21 nt, Mycobacterium avium subsp. paratuberculosis
ccacguaggcgaucagcgcgc

SEQ ID NO: 2819733 - RNA, 23 nt, Mycobacterium avium subsp. paratuberculosis
ccacguaggcgaugucgacgugg

SEQ ID NO: 2819734 - RNA, 18 nt, Mycobacterium avium subsp. paratuberculosis
ccacguaguccgacgauc

SEQ ID NO: 2819735 - RNA, 23 nt, Mycobacterium avium subsp. paratuberculosis
ccacguaguccgacgauccgggc

SEQ ID NO: 2819736 - RNA, 12 nt, Mycobacterium avium subsp. paratuberculosis
ccacgucaccga

SEQ ID NO: 2819737 - RNA, 15 nt, Mycobacterium avium subsp. paratuberculosis
ccacgucaccgacgc

SEQ ID NO: 2819738 - RNA, 16 nt, Mycobacterium avium subsp. paratuberculosis
ccacgucaccgacgca

SEQ ID NO: 2819739 - RNA, 14 nt, Mycobacterium avium subsp. paratuberculosis
ccacguccaccagc

SEQ ID NO: 2819740 - RNA, 18 nt, Mycobacterium avium subsp. paratuberculosis
ccacguccaccagcacca

SEQ ID NO: 2819741 - RNA, 20 nt, Mycobacterium avium subsp. paratuberculosis
ccacguccaccagcaccagg

SEQ ID NO: 2819742 - RNA, 22 nt, Mycobacterium avium subsp. paratuberculosis
ccacguccaccagcaccaggcg

SEQ ID NO: 2819743 - RNA, 14 nt, Mycobacterium avium subsp. paratuberculosis
ccacguccagcugg

SEQ ID NO: 2819744 - RNA, 20 nt, Mycobacterium avium subsp. paratuberculosis
ccacguccccgggcgugccg

SEQ ID NO: 2819745 - RNA, 16 nt, Mycobacterium avium subsp. paratuberculosis
ccacguccgcggugag

SEQ ID NO: 2819746 - RNA, 18 nt, Mycobacterium avium subsp. paratuberculosis
ccacguccgcggugagca

SEQ ID NO: 2819747 - RNA, 17 nt, Mycobacterium avium subsp. paratuberculosis
ccacgucgaacccgacc

SEQ ID NO: 2819748 - RNA, 18 nt, Mycobacterium avium subsp. paratuberculosis
ccacgucgaacccgaccc

SEQ ID NO: 2819749 - RNA, 18 nt, Mycobacterium avium subsp. paratuberculosis
ccacgucgaagcccgggu

SEQ ID NO: 2819750 - RNA, 15 nt, Mycobacterium avium subsp. paratuberculosis
ccacgucgaugccga

SEQ ID NO: 2819751 - RNA, 22 nt, Mycobacterium avium subsp. paratuberculosis
ccacgucgaugccgaaccgcuc

SEQ ID NO: 2819752 - RNA, 17 nt, Mycobacterium avium subsp. paratuberculosis
ccacgucgcccagcgug

SEQ ID NO: 2819753 - RNA, 18 nt, Mycobacterium avium subsp. paratuberculosis
ccacgucgcccagcgugu

SEQ ID NO: 2819754 - RNA, 21 nt, Mycobacterium avium subsp. paratuberculosis
ccacgucgcgauagggccggc

SEQ ID NO: 2819755 - RNA, 22 nt, Mycobacterium avium subsp. paratuberculosis
ccacgucgcgauagggccggcc

SEQ ID NO: 2819756 - RNA, 14 nt, Mycobacterium avium subsp. paratuberculosis
ccacgucgcgccga

SEQ ID NO: 2819757 - RNA, 17 nt, Mycobacterium avium subsp. paratuberculosis
ccacgucggugccgcgu

SEQ ID NO: 2819758 - RNA, 14 nt, Mycobacterium avium subsp. paratuberculosis
ccacgucguccagc

SEQ ID NO: 2819759 - RNA, 22 nt, Mycobacterium avium subsp. paratuberculosis
ccacgucguucaugaucggcag

SEQ ID NO: 2819760 - RNA, 12 nt, Mycobacterium avium subsp. paratuberculosis
ccacgugcacgg

SEQ ID NO: 2819761 - RNA, 16 nt, Mycobacterium avium subsp. paratuberculosis
ccacgugcacggcgcc

SEQ ID NO: 2819762 - RNA, 17 nt, Mycobacterium avium subsp. paratuberculosis
ccacgugcacggcgccg

SEQ ID NO: 2819763 - RNA, 18 nt, Mycobacterium avium subsp. paratuberculosis
ccacgugcacggcgccgu

SEQ ID NO: 2819764 - RNA, 19 nt, Mycobacterium avium subsp. paratuberculosis
ccacgugcacggcgccgug

SEQ ID NO: 2819765 - RNA, 19 nt, Mycobacterium avium subsp. paratuberculosis
ccacgugccacuggcgcca

SEQ ID NO: 2819766 - RNA, 13 nt, Mycobacterium avium subsp. paratuberculosis
ccacgugccccuc

SEQ ID NO: 2819767 - RNA, 13 nt, Mycobacterium avium subsp. paratuberculosis
ccacgugcggcgc

SEQ ID NO: 2819768 - RNA, 12 nt, Mycobacterium avium subsp. paratuberculosis
ccacgugcggcu

SEQ ID NO: 2819769 - RNA, 23 nt, Mycobacterium avium subsp. paratuberculosis
ccacgugcggcugcgcguucggc

SEQ ID NO: 2819770 - RNA, 21 nt, Mycobacterium avium subsp. paratuberculosis
ccacguggugaucagcauccg

SEQ ID NO: 2819771 - RNA, 16 nt, Mycobacterium avium subsp. paratuberculosis
ccacgugucggcgucg

SEQ ID NO: 2819772 - RNA, 23 nt, Mycobacterium avium subsp. paratuberculosis
ccacguucagcgacuugccgccg

SEQ ID NO: 2819773 - RNA, 17 nt, Mycobacterium avium subsp. paratuberculosis
ccacguugagcacgccc

SEQ ID NO: 2819774 - RNA, 21 nt, Mycobacterium avium subsp. paratuberculosis
ccacguugaucaugucgaugc

SEQ ID NO: 2819775 - RNA, 12 nt, Mycobacterium avium subsp. paratuberculosis
ccagaccggcga

SEQ ID NO: 2819776 - RNA, 13 nt, Mycobacterium avium subsp. paratuberculosis
ccagaccggcggc

SEQ ID NO: 2819777 - RNA, 14 nt, Mycobacterium avium subsp. paratuberculosis
ccagaccggcggcg

SEQ ID NO: 2819778 - RNA, 23 nt, Mycobacterium avium subsp. paratuberculosis
ccagaccgguugcggcgaacgcg

SEQ ID NO: 2819779 - RNA, 16 nt, Mycobacterium avium subsp. paratuberculosis
ccagacgaacgcggcc

SEQ ID NO: 2819780 - RNA, 18 nt, Mycobacterium avium subsp. paratuberculosis
ccagacgaacgcggccgc

SEQ ID NO: 2819781 - RNA, 21 nt, Mycobacterium avium subsp. paratuberculosis
ccagacgaacgcggccgccag

SEQ ID NO: 2819782 - RNA, 14 nt, Mycobacterium avium subsp. paratuberculosis
ccagacgcgcaccg

SEQ ID NO: 2819783 - RNA, 21 nt, Mycobacterium avium subsp. paratuberculosis
ccagacgcgcaccgccaccgc

SEQ ID NO: 2819784 - RNA, 18 nt, Mycobacterium avium subsp. paratuberculosis
ccagacgcgggcgcccag

SEQ ID NO: 2819785 - RNA, 22 nt, Mycobacterium avium subsp. paratuberculosis
ccagacgcgggcgcccagcaaa

SEQ ID NO: 2819786 - RNA, 22 nt, Mycobacterium avium subsp. paratuberculosis
ccagacgguuccaccggucgga

SEQ ID NO: 2819787 - RNA, 17 nt, Mycobacterium avium subsp. paratuberculosis
ccagacguccagcgccg

SEQ ID NO: 2819788 - RNA, 19 nt, Mycobacterium avium subsp. paratuberculosis
ccagacguccagcgccgcc

SEQ ID NO: 2819789 - RNA, 19 nt, Mycobacterium avium subsp. paratuberculosis
ccagacguguggcacccgg

SEQ ID NO: 2819790 - RNA, 16 nt, Mycobacterium avium subsp. paratuberculosis
ccagacucacggcggc

SEQ ID NO: 2819791 - RNA, 17 nt, Mycobacterium avium subsp. paratuberculosis
ccagacucacggcggca

SEQ ID NO: 2819792 - RNA, 22 nt, Mycobacterium avium subsp. paratuberculosis
ccagacucacggcggcagcgcg

SEQ ID NO: 2819793 - RNA, 21 nt, Mycobacterium avium subsp. paratuberculosis
ccagacugaugcccucgccgg

SEQ ID NO: 2819794 - RNA, 15 nt, Mycobacterium avium subsp. paratuberculosis
ccagacugcgcaccg

SEQ ID NO: 2819795 - RNA, 17 nt, Mycobacterium avium subsp. paratuberculosis
ccagacugcgcaccgcc

SEQ ID NO: 2819796 - RNA, 18 nt, Mycobacterium avium subsp. paratuberculosis
ccagacugcgcaccgcca

SEQ ID NO: 2819797 - RNA, 19 nt, Mycobacterium avium subsp. paratuberculosis
ccagacugcgcaccgccag

SEQ ID NO: 2819798 - RNA, 20 nt, Mycobacterium avium subsp. paratuberculosis
ccagacugcgcaccgccagc

SEQ ID NO: 2819799 - RNA, 17 nt, Mycobacterium avium subsp. paratuberculosis
ccagagcgcgaaaacca

SEQ ID NO: 2819800 - RNA, 20 nt, Mycobacterium avium subsp. paratuberculosis
ccagagcgcgaaaaccagca

SEQ ID NO: 2819801 - RNA, 22 nt, Mycobacterium avium subsp. paratuberculosis
ccagagcgcgaaaaccagcacc

SEQ ID NO: 2819802 - RNA, 13 nt, Mycobacterium avium subsp. paratuberculosis
ccagauacgccgc

SEQ ID NO: 2819803 - RNA, 13 nt, Mycobacterium avium subsp. paratuberculosis
ccagauacuccuc

SEQ ID NO: 2819804 - RNA, 20 nt, Mycobacterium avium subsp. paratuberculosis
ccagauagaggaacagacuc

SEQ ID NO: 2819805 - RNA, 14 nt, Mycobacterium avium subsp. paratuberculosis
ccagaucagcgugg

SEQ ID NO: 2819806 - RNA, 21 nt, Mycobacterium avium subsp. paratuberculosis
ccagaucgacccccaccgcga

SEQ ID NO: 2819807 - RNA, 15 nt, Mycobacterium avium subsp. paratuberculosis
ccagaucgacgccga

SEQ ID NO: 2819808 - RNA, 22 nt, Mycobacterium avium subsp. paratuberculosis
ccagaucgacgccgaccgcggu

SEQ ID NO: 2819809 - RNA, 16 nt, Mycobacterium avium subsp. paratuberculosis
ccagaucgagcugggc

SEQ ID NO: 2819810 - RNA, 15 nt, Mycobacterium avium subsp. paratuberculosis
ccagaucgaggccag

SEQ ID NO: 2819811 - RNA, 16 nt, Mycobacterium avium subsp. paratuberculosis
ccagaucgaggccagc

SEQ ID NO: 2819812 - RNA, 18 nt, Mycobacterium avium subsp. paratuberculosis
ccagaucgaggccagcgc

SEQ ID NO: 2819813 - RNA, 19 nt, Mycobacterium avium subsp. paratuberculosis
ccagaucgaggccagcgcg

SEQ ID NO: 2819814 - RNA, 13 nt, Mycobacterium avium subsp. paratuberculosis
ccagaucgccccg

SEQ ID NO: 2819815 - RNA, 15 nt, Mycobacterium avium subsp. paratuberculosis
ccagaucgcccgggc

SEQ ID NO: 2819816 - RNA, 13 nt, Mycobacterium avium subsp. paratuberculosis
ccagaucgccgcc

SEQ ID NO: 2819817 - RNA, 21 nt, Mycobacterium avium subsp. paratuberculosis
ccagaucgccuggcagcugcc

SEQ ID NO: 2819818 - RNA, 22 nt, Mycobacterium avium subsp. paratuberculosis
ccagaucgccuggcagcugccg

SEQ ID NO: 2819819 - RNA, 15 nt, Mycobacterium avium subsp. paratuberculosis
ccagaucgcggucca

SEQ ID NO: 2819820 - RNA, 17 nt, Mycobacterium avium subsp. paratuberculosis
ccagaucgcugaugcgc

SEQ ID NO: 2819821 - RNA, 14 nt, Mycobacterium avium subsp. paratuberculosis
ccagaucggccagc

SEQ ID NO: 2819822 - RNA, 17 nt, Mycobacterium avium subsp. paratuberculosis
ccagaucggccagccac

SEQ ID NO: 2819823 - RNA, 21 nt, Mycobacterium avium subsp. paratuberculosis
ccagaucggccagccacgccg

SEQ ID NO: 2819824 - RNA, 15 nt, Mycobacterium avium subsp. paratuberculosis
ccagaucggccagcg

SEQ ID NO: 2819825 - RNA, 16 nt, Mycobacterium avium subsp. paratuberculosis
ccagaucggccagcgc

SEQ ID NO: 2819826 - RNA, 19 nt, Mycobacterium avium subsp. paratuberculosis
ccagaucggccagcgcggc

SEQ ID NO: 2819827 - RNA, 20 nt, Mycobacterium avium subsp. paratuberculosis
ccagaucggccagcgcggcc

SEQ ID NO: 2819828 - RNA, 23 nt, Mycobacterium avium subsp. paratuberculosis
ccagaucggccagcgcggccggg

SEQ ID NO: 2819829 - RNA, 15 nt, Mycobacterium avium subsp. paratuberculosis
ccagaucggccaggu

SEQ ID NO: 2819830 - RNA, 22 nt, Mycobacterium avium subsp. paratuberculosis
ccagaucggcgggugcgggcgc

SEQ ID NO: 2819831 - RNA, 23 nt, Mycobacterium avium subsp. paratuberculosis
ccagaucguagggcucggcgucg

SEQ ID NO: 2819832 - RNA, 19 nt, Mycobacterium avium subsp. paratuberculosis
ccagaucguguccgcgccg

SEQ ID NO: 2819833 - RNA, 23 nt, Mycobacterium avium subsp. paratuberculosis
ccagaucguguccgcgccggcgc

SEQ ID NO: 2819834 - RNA, 15 nt, Mycobacterium avium subsp. paratuberculosis
ccagaugcaccucgc

SEQ ID NO: 2819835 - RNA, 16 nt, Mycobacterium avium subsp. paratuberculosis
ccagaugcccagcggc

SEQ ID NO: 2819836 - RNA, 16 nt, Mycobacterium avium subsp. paratuberculosis
ccagaugccgccgcca

SEQ ID NO: 2819837 - RNA, 23 nt, Mycobacterium avium subsp. paratuberculosis
ccagaugccgccgccagcgcggg

SEQ ID NO: 2819838 - RNA, 13 nt, Mycobacterium avium subsp. paratuberculosis
ccagaugccgcuc

SEQ ID NO: 2819839 - RNA, 14 nt, Mycobacterium avium subsp. paratuberculosis
ccagaugccgcucg

SEQ ID NO: 2819840 - RNA, 22 nt, Mycobacterium avium subsp. paratuberculosis
ccagaugccgcucggcgcucca

SEQ ID NO: 2819841 - RNA, 13 nt, Mycobacterium avium subsp. paratuberculosis
ccagaugccggcg

SEQ ID NO: 2819842 - RNA, 13 nt, Mycobacterium avium subsp. paratuberculosis
ccagaugccgggu

SEQ ID NO: 2819843 - RNA, 21 nt, Mycobacterium avium subsp. paratuberculosis
ccagaugccgggugggcagcc

SEQ ID NO: 2819844 - RNA, 20 nt, Mycobacterium avium subsp. paratuberculosis
ccagaugcgcgacggccucg

SEQ ID NO: 2819845 - RNA, 21 nt, Mycobacterium avium subsp. paratuberculosis
ccagaugcgcgacggccucgc

SEQ ID NO: 2819846 - RNA, 17 nt, Mycobacterium avium subsp. paratuberculosis
ccagaugcgucaacccg

SEQ ID NO: 2819847 - RNA, 20 nt, Mycobacterium avium subsp. paratuberculosis
ccagaugcgucaacccguuc

SEQ ID NO: 2819848 - RNA, 13 nt, Mycobacterium avium subsp. paratuberculosis
ccagaugucgcgu

SEQ ID NO: 2819849 - RNA, 22 nt, Mycobacterium avium subsp. paratuberculosis
ccagauguugaggguccgcgcg

SEQ ID NO: 2819850 - RNA, 13 nt, Mycobacterium avium subsp. paratuberculosis
ccagauucaccag

SEQ ID NO: 2819851 - RNA, 16 nt, Mycobacterium avium subsp. paratuberculosis
ccagauucaccagcgc

SEQ ID NO: 2819852 - RNA, 21 nt, Mycobacterium avium subsp. paratuberculosis
ccagauucaccagcgccucgg

SEQ ID NO: 2819853 - RNA, 16 nt, Mycobacterium avium subsp. paratuberculosis
ccagauuccgaaaggg

SEQ ID NO: 2819854 - RNA, 15 nt, Mycobacterium avium subsp. paratuberculosis
ccagauugcggcccu

SEQ ID NO: 2819855 - RNA, 15 nt, Mycobacterium avium subsp. paratuberculosis
ccagcaaaaccccgc

SEQ ID NO: 2819856 - RNA, 16 nt, Mycobacterium avium subsp. paratuberculosis
ccagcaaaaccccgcc

SEQ ID NO: 2819857 - RNA, 18 nt, Mycobacterium avium subsp. paratuberculosis
ccagcaaaaccccgccgu

SEQ ID NO: 2819858 - RNA, 16 nt, Mycobacterium avium subsp. paratuberculosis
ccagcaaacccagcac

SEQ ID NO: 2819859 - RNA, 23 nt, Mycobacterium avium subsp. paratuberculosis
ccagcaccgccccggucaccccg

SEQ ID NO: 2819860 - RNA, 13 nt, Mycobacterium avium subsp. paratuberculosis
ccagcaccgccgc

SEQ ID NO: 2819861 - RNA, 14 nt, Mycobacterium avium subsp. paratuberculosis
ccagcaccgccgcg

SEQ ID NO: 2819862 - RNA, 18 nt, Mycobacterium avium subsp. paratuberculosis
ccagcaccgccgcggccg

SEQ ID NO: 2819863 - RNA, 21 nt, Mycobacterium avium subsp. paratuberculosis
ccagcaccgccgcggccgcga

SEQ ID NO: 2819864 - RNA, 14 nt, Mycobacterium avium subsp. paratuberculosis
ccagcaccgccggc

SEQ ID NO: 2819865 - RNA, 18 nt, Mycobacterium avium subsp. paratuberculosis
ccagcaccgccggcgccg

SEQ ID NO: 2819866 - RNA, 11 nt, Mycobacterium avium subsp. paratuberculosis
ccagcaccgcg

SEQ ID NO: 2819867 - RNA, 15 nt, Mycobacterium avium subsp. paratuberculosis
ccagcaccgcggccg

SEQ ID NO: 2819868 - RNA, 19 nt, Mycobacterium avium subsp. paratuberculosis
ccagcaccgcggccgucgc

SEQ ID NO: 2819869 - RNA, 14 nt, Mycobacterium avium subsp. paratuberculosis
ccagcaccgcggcg

SEQ ID NO: 2819870 - RNA, 16 nt, Mycobacterium avium subsp. paratuberculosis
ccagcaccgcggcgau

SEQ ID NO: 2819871 - RNA, 17 nt, Mycobacterium avium subsp. paratuberculosis
ccagcaccgcggcguag

SEQ ID NO: 2819872 - RNA, 21 nt, Mycobacterium avium subsp. paratuberculosis
ccagcaccgcgggggcggccg

SEQ ID NO: 2819873 - RNA, 17 nt, Mycobacterium avium subsp. paratuberculosis
ccagcaccgcgucgaug

SEQ ID NO: 2819874 - RNA, 19 nt, Mycobacterium avium subsp. paratuberculosis
ccagcaccggaugcucacc

SEQ ID NO: 2819875 - RNA, 12 nt, Mycobacterium avium subsp. paratuberculosis
ccagcaccggca

SEQ ID NO: 2819876 - RNA, 21 nt, Mycobacterium avium subsp. paratuberculosis
ccagcaccggcaccgccagcc

SEQ ID NO: 2819877 - RNA, 12 nt, Mycobacterium avium subsp. paratuberculosis
ccagcaccggcg

SEQ ID NO: 2819878 - RNA, 16 nt, Mycobacterium avium subsp. paratuberculosis
ccagcaccggcgccau

SEQ ID NO: 2819879 - RNA, 20 nt, Mycobacterium avium subsp. paratuberculosis
ccagcaccggcgccccgggc

SEQ ID NO: 2819880 - RNA, 14 nt, Mycobacterium avium subsp. paratuberculosis
ccagcaccggcgcg

SEQ ID NO: 2819881 - RNA, 15 nt, Mycobacterium avium subsp. paratuberculosis
ccagcaccggcgcgc

SEQ ID NO: 2819882 - RNA, 16 nt, Mycobacterium avium subsp. paratuberculosis
ccagcaccggcgcgcc

SEQ ID NO: 2819883 - RNA, 17 nt, Mycobacterium avium subsp. paratuberculosis
ccagcaccggcgcgccg

SEQ ID NO: 2819884 - RNA, 15 nt, Mycobacterium avium subsp. paratuberculosis
ccagcaccggcuggu

SEQ ID NO: 2819885 - RNA, 22 nt, Mycobacterium avium subsp. paratuberculosis
ccagcaccggcuggucggcggg

SEQ ID NO: 2819886 - RNA, 14 nt, Mycobacterium avium subsp. paratuberculosis
ccagcaccgggccc

SEQ ID NO: 2819887 - RNA, 15 nt, Mycobacterium avium subsp. paratuberculosis
ccagcaccgggccca

SEQ ID NO: 2819888 - RNA, 17 nt, Mycobacterium avium subsp. paratuberculosis
ccagcaccgggcccagc

SEQ ID NO: 2819889 - RNA, 20 nt, Mycobacterium avium subsp. paratuberculosis
ccagcaccgggcccagcucg

SEQ ID NO: 2819890 - RNA, 14 nt, Mycobacterium avium subsp. paratuberculosis
ccagcaccgucggc

SEQ ID NO: 2819891 - RNA, 17 nt, Mycobacterium avium subsp. paratuberculosis
ccagcaccgucugcgcc

SEQ ID NO: 2819892 - RNA, 23 nt, Mycobacterium avium subsp. paratuberculosis
ccagcaccgucugcgccgucacc

SEQ ID NO: 2819893 - RNA, 12 nt, Mycobacterium avium subsp. paratuberculosis
ccagcaccgugc

SEQ ID NO: 2819894 - RNA, 19 nt, Mycobacterium avium subsp. paratuberculosis
ccagcaccucgaacgccgg

SEQ ID NO: 2819895 - RNA, 16 nt, Mycobacterium avium subsp. paratuberculosis
ccagcaccucgcggca

SEQ ID NO: 2819896 - RNA, 15 nt, Mycobacterium avium subsp. paratuberculosis
ccagcaccucggcga

SEQ ID NO: 2819897 - RNA, 17 nt, Mycobacterium avium subsp. paratuberculosis
ccagcaccucggcgacc

SEQ ID NO: 2819898 - RNA, 21 nt, Mycobacterium avium subsp. paratuberculosis
ccagcaccucggcgaccacgu

SEQ ID NO: 2819899 - RNA, 19 nt, Mycobacterium avium subsp. paratuberculosis
ccagcaccugaccgucggc

SEQ ID NO: 2819900 - RNA, 21 nt, Mycobacterium avium subsp. paratuberculosis
ccagcaccugaccgucggcca

SEQ ID NO: 2819901 - RNA, 13 nt, Mycobacterium avium subsp. paratuberculosis
ccagcaccugcuc

SEQ ID NO: 2819902 - RNA, 15 nt, Mycobacterium avium subsp. paratuberculosis
ccagcaccugcucga

SEQ ID NO: 2819903 - RNA, 17 nt, Mycobacterium avium subsp. paratuberculosis
ccagcaccugcucgaug

SEQ ID NO: 2819904 - RNA, 20 nt, Mycobacterium avium subsp. paratuberculosis
ccagcaccugcucgaugcgc

SEQ ID NO: 2819905 - RNA, 18 nt, Mycobacterium avium subsp. paratuberculosis
ccagcaccuggcgcaccg

SEQ ID NO: 2819906 - RNA, 22 nt, Mycobacterium avium subsp. paratuberculosis
ccagcaccuggcgcaccgccgc

SEQ ID NO: 2819907 - RNA, 23 nt, Mycobacterium avium subsp. paratuberculosis
ccagcaccuggcgcaccgccgcg

SEQ ID NO: 2819908 - RNA, 22 nt, Mycobacterium avium subsp. paratuberculosis
ccagcaccuucagcgggcgcag

SEQ ID NO: 2819909 - RNA, 17 nt, Mycobacterium avium subsp. paratuberculosis
ccagcaccuucgggccg

SEQ ID NO: 2819910 - RNA, 18 nt, Mycobacterium avium subsp. paratuberculosis
ccagcaccuucgggccga

SEQ ID NO: 2819911 - RNA, 22 nt, Mycobacterium avium subsp. paratuberculosis
ccagcacgaaggccgccggguc

SEQ ID NO: 2819912 - RNA, 14 nt, Mycobacterium avium subsp. paratuberculosis
ccagcacgacaccg

SEQ ID NO: 2819913 - RNA, 15 nt, Mycobacterium avium subsp. paratuberculosis
ccagcacgacaccga

SEQ ID NO: 2819914 - RNA, 16 nt, Mycobacterium avium subsp. paratuberculosis
ccagcacgacaccgac

SEQ ID NO: 2819915 - RNA, 18 nt, Mycobacterium avium subsp. paratuberculosis
ccagcacgacaccgacga

SEQ ID NO: 2819916 - RNA, 15 nt, Mycobacterium avium subsp. paratuberculosis
ccagcacgaccccgc

SEQ ID NO: 2819917 - RNA, 15 nt, Mycobacterium avium subsp. paratuberculosis
ccagcacgacgccgc

SEQ ID NO: 2819918 - RNA, 19 nt, Mycobacterium avium subsp. paratuberculosis
ccagcacgaucccgccgcc

SEQ ID NO: 2819919 - RNA, 20 nt, Mycobacterium avium subsp. paratuberculosis
ccagcacgaucccgccgccc

SEQ ID NO: 2819920 - RNA, 15 nt, Mycobacterium avium subsp. paratuberculosis
ccagcacgaucgggu

SEQ ID NO: 2819921 - RNA, 19 nt, Mycobacterium avium subsp. paratuberculosis
ccagcacgaugacgaccgg

SEQ ID NO: 2819922 - RNA, 17 nt, Mycobacterium avium subsp. paratuberculosis
ccagcacgcaggcgugg

SEQ ID NO: 2819923 - RNA, 16 nt, Mycobacterium avium subsp. paratuberculosis
ccagcacgcccagauc

SEQ ID NO: 2819924 - RNA, 19 nt, Mycobacterium avium subsp. paratuberculosis
ccagcacgcccagaucgcc

SEQ ID NO: 2819925 - RNA, 22 nt, Mycobacterium avium subsp. paratuberculosis
ccagcacgcccagaucgccgac

SEQ ID NO: 2819926 - RNA, 18 nt, Mycobacterium avium subsp. paratuberculosis
ccagcacgcccccgcugg

SEQ ID NO: 2819927 - RNA, 22 nt, Mycobacterium avium subsp. paratuberculosis
ccagcacgcccccgcuggcccg

SEQ ID NO: 2819928 - RNA, 16 nt, Mycobacterium avium subsp. paratuberculosis
ccagcacgccggucag

SEQ ID NO: 2819929 - RNA, 20 nt, Mycobacterium avium subsp. paratuberculosis
ccagcacgccguccuuggcc

SEQ ID NO: 2819930 - RNA, 23 nt, Mycobacterium avium subsp. paratuberculosis
ccagcacgccguccuuggccgcc

SEQ ID NO: 2819931 - RNA, 15 nt, Mycobacterium avium subsp. paratuberculosis
ccagcacgccguuga

SEQ ID NO: 2819932 - RNA, 17 nt, Mycobacterium avium subsp. paratuberculosis
ccagcacggccaccagc

SEQ ID NO: 2819933 - RNA, 21 nt, Mycobacterium avium subsp. paratuberculosis
ccagcacggccaccagcagcg

SEQ ID NO: 2819934 - RNA, 13 nt, Mycobacterium avium subsp. paratuberculosis
ccagcacggccgc

SEQ ID NO: 2819935 - RNA, 14 nt, Mycobacterium avium subsp. paratuberculosis
ccagcacggccgcc

SEQ ID NO: 2819936 - RNA, 20 nt, Mycobacterium avium subsp. paratuberculosis
ccagcacggccgccaggaug

SEQ ID NO: 2819937 - RNA, 12 nt, Mycobacterium avium subsp. paratuberculosis
ccagcacggcga

SEQ ID NO: 2819938 - RNA, 14 nt, Mycobacterium avium subsp. paratuberculosis
ccagcacggcgacc

SEQ ID NO: 2819939 - RNA, 14 nt, Mycobacterium avium subsp. paratuberculosis
ccagcacggcggcg

SEQ ID NO: 2819940 - RNA, 16 nt, Mycobacterium avium subsp. paratuberculosis
ccagcacggcggcgug

SEQ ID NO: 2819941 - RNA, 17 nt, Mycobacterium avium subsp. paratuberculosis
ccagcacggcggcgugc

SEQ ID NO: 2819942 - RNA, 22 nt, Mycobacterium avium subsp. paratuberculosis
ccagcacggcggcgugcaccgc

SEQ ID NO: 2819943 - RNA, 13 nt, Mycobacterium avium subsp. paratuberculosis
ccagcacggucag

SEQ ID NO: 2819944 - RNA, 20 nt, Mycobacterium avium subsp. paratuberculosis
ccagcagcgucacgucgacg

SEQ ID NO: 2819945 - RNA, 22 nt, Mycobacterium avium subsp. paratuberculosis
ccagcagcgucacgucgacggc

SEQ ID NO: 2819946 - RNA, 22 nt, Mycobacterium avium subsp. paratuberculosis
ccagcagcgucgucaggccgug

SEQ ID NO: 2819947 - RNA, 21 nt, Mycobacterium avium subsp. paratuberculosis
ccagcagcugcgggaccagcg

SEQ ID NO: 2819948 - RNA, 23 nt, Mycobacterium avium subsp. paratuberculosis
ccagcagcugcgggaccagcgcc

SEQ ID NO: 2819949 - RNA, 12 nt, Mycobacterium avium subsp. paratuberculosis
ccagcagcuguu

SEQ ID NO: 2819950 - RNA, 22 nt, Mycobacterium avium subsp. paratuberculosis
ccagcagcuugacgucggucag

SEQ ID NO: 2819951 - RNA, 23 nt, Mycobacterium avium subsp. paratuberculosis
ccagcagcuugacgucggucagc

SEQ ID NO: 2819952 - RNA, 14 nt, Mycobacterium avium subsp. paratuberculosis
ccagcaggacgcgc

SEQ ID NO: 2819953 - RNA, 22 nt, Mycobacterium avium subsp. paratuberculosis
ccagcaggacgcgcccggcgac

SEQ ID NO: 2819954 - RNA, 21 nt, Mycobacterium avium subsp. paratuberculosis
ccagcaggaucuggugcgcgc

SEQ ID NO: 2819955 - RNA, 16 nt, Mycobacterium avium subsp. paratuberculosis
ccagcaggaugaugac

SEQ ID NO: 2819956 - RNA, 22 nt, Mycobacterium avium subsp. paratuberculosis
ccagcaggaugaugaccgacau

SEQ ID NO: 2819957 - RNA, 18 nt, Mycobacterium avium subsp. paratuberculosis
ccagcaggcccaacguga

SEQ ID NO: 2819958 - RNA, 15 nt, Mycobacterium avium subsp. paratuberculosis
ccagcaggcgcgccg

SEQ ID NO: 2819959 - RNA, 15 nt, Mycobacterium avium subsp. paratuberculosis
ccagcaggcuggcgu

SEQ ID NO: 2819960 - RNA, 16 nt, Mycobacterium avium subsp. paratuberculosis
ccagcagggcgccgac

SEQ ID NO: 2819961 - RNA, 17 nt, Mycobacterium avium subsp. paratuberculosis
ccagcagggcgccgacg

SEQ ID NO: 2819962 - RNA, 18 nt, Mycobacterium avium subsp. paratuberculosis
ccagcagggcgccgacga

SEQ ID NO: 2819963 - RNA, 20 nt, Mycobacterium avium subsp. paratuberculosis
ccagcagggcgccgacgauc

SEQ ID NO: 2819964 - RNA, 16 nt, Mycobacterium avium subsp. paratuberculosis
ccagcagggcggcgau

SEQ ID NO: 2819965 - RNA, 17 nt, Mycobacterium avium subsp. paratuberculosis
ccagcagggcggcgauc

SEQ ID NO: 2819966 - RNA, 21 nt, Mycobacterium avium subsp. paratuberculosis
ccagcagguagaagccgcgac

SEQ ID NO: 2819967 - RNA, 20 nt, Mycobacterium avium subsp. paratuberculosis
ccagcagguccauggccuug

SEQ ID NO: 2819968 - RNA, 22 nt, Mycobacterium avium subsp. paratuberculosis
ccagcagguccgccggugccag

SEQ ID NO: 2819969 - RNA, 18 nt, Mycobacterium avium subsp. paratuberculosis
ccagcaggucgaaggcgg

SEQ ID NO: 2819970 - RNA, 23 nt, Mycobacterium avium subsp. paratuberculosis
ccagcaggucgaaggcggccgcg

SEQ ID NO: 2819971 - RNA, 14 nt, Mycobacterium avium subsp. paratuberculosis
ccagcaggucgauc

SEQ ID NO: 2819972 - RNA, 15 nt, Mycobacterium avium subsp. paratuberculosis
ccagcaggucgucga

SEQ ID NO: 2819973 - RNA, 16 nt, Mycobacterium avium subsp. paratuberculosis
ccagcaggucgucgac

SEQ ID NO: 2819974 - RNA, 15 nt, Mycobacterium avium subsp. paratuberculosis
ccagcaguccggcgg

SEQ ID NO: 2819975 - RNA, 17 nt, Mycobacterium avium subsp. paratuberculosis
ccagcaguccggcgguc

SEQ ID NO: 2819976 - RNA, 19 nt, Mycobacterium avium subsp. paratuberculosis
ccagcaguccggcggucag

SEQ ID NO: 2819977 - RNA, 21 nt, Mycobacterium avium subsp. paratuberculosis
ccagcaguccggcggucagca

SEQ ID NO: 2819978 - RNA, 23 nt, Mycobacterium avium subsp. paratuberculosis
ccagcaguccggcggucagcacc

SEQ ID NO: 2819979 - RNA, 18 nt, Mycobacterium avium subsp. paratuberculosis
ccagcagucgugacgcgg

SEQ ID NO: 2819980 - RNA, 19 nt, Mycobacterium avium subsp. paratuberculosis
ccagcagucgugacgcggc

SEQ ID NO: 2819981 - RNA, 23 nt, Mycobacterium avium subsp. paratuberculosis
ccagcagucgugacgcggcgucg

SEQ ID NO: 2819982 - RNA, 21 nt, Mycobacterium avium subsp. paratuberculosis
ccagcagugccaccaccacgg

SEQ ID NO: 2819983 - RNA, 18 nt, Mycobacterium avium subsp. paratuberculosis
ccagcaguguccagucgg

SEQ ID NO: 2819984 - RNA, 19 nt, Mycobacterium avium subsp. paratuberculosis
ccagcaguguccagucggc

SEQ ID NO: 2819985 - RNA, 20 nt, Mycobacterium avium subsp. paratuberculosis
ccagcaguguccagucggcc

SEQ ID NO: 2819986 - RNA, 21 nt, Mycobacterium avium subsp. paratuberculosis
ccagcaguucguccacgcugg

SEQ ID NO: 2819987 - RNA, 17 nt, Mycobacterium avium subsp. paratuberculosis
ccagcaguuuggucauc

SEQ ID NO: 2819988 - RNA, 23 nt, Mycobacterium avium subsp. paratuberculosis
ccagcaguuuguccugcucggcg

SEQ ID NO: 2819989 - RNA, 18 nt, Mycobacterium avium subsp. paratuberculosis
ccagcauaaggauuuucg

SEQ ID NO: 2819990 - RNA, 23 nt, Mycobacterium avium subsp. paratuberculosis
ccagcauccgcuggugcgcgccg

SEQ ID NO: 2819991 - RNA, 22 nt, Mycobacterium avium subsp. paratuberculosis
ccagcauccggcauuugcccuc

SEQ ID NO: 2819992 - RNA, 13 nt, Mycobacterium avium subsp. paratuberculosis
ccagcaucgccgc

SEQ ID NO: 2819993 - RNA, 14 nt, Mycobacterium avium subsp. paratuberculosis
ccagcaucgccgcg

SEQ ID NO: 2819994 - RNA, 15 nt, Mycobacterium avium subsp. paratuberculosis
ccagcaucgccgcgg

SEQ ID NO: 2819995 - RNA, 17 nt, Mycobacterium avium subsp. paratuberculosis
ccagcaucgccgcggug

SEQ ID NO: 2819996 - RNA, 18 nt, Mycobacterium avium subsp. paratuberculosis
ccagcaucgccgcggugc

SEQ ID NO: 2819997 - RNA, 17 nt, Mycobacterium avium subsp. paratuberculosis
ccagcaucucggcgaag

SEQ ID NO: 2819998 - RNA, 16 nt, Mycobacterium avium subsp. paratuberculosis
ccagcaugaucaccgc

SEQ ID NO: 2819999 - RNA, 17 nt, Mycobacterium avium subsp. paratuberculosis
ccagcaugaucaccgcc

SEQ ID NO: 2820000 - RNA, 20 nt, Mycobacterium avium subsp. paratuberculosis
ccagcaugaucaccgccagc

SEQ ID NO: 2820001 - RNA, 22 nt, Mycobacterium avium subsp. paratuberculosis
ccagcaugcccacgccgucgac

SEQ ID NO: 2820002 - RNA, 21 nt, Mycobacterium avium subsp. paratuberculosis
ccagcaugcgaugaccacccu

SEQ ID NO: 2820003 - RNA, 18 nt, Mycobacterium avium subsp. paratuberculosis
ccagcaugcgccagagcg

SEQ ID NO: 2820004 - RNA, 20 nt, Mycobacterium avium subsp. paratuberculosis
ccagcauggcgaucaccccg

SEQ ID NO: 2820005 - RNA, 22 nt, Mycobacterium avium subsp. paratuberculosis
ccagcauggcgaucaccccggc

SEQ ID NO: 2820006 - RNA, 15 nt, Mycobacterium avium subsp. paratuberculosis
ccagcaugugcuccc

SEQ ID NO: 2820007 - RNA, 21 nt, Mycobacterium avium subsp. paratuberculosis
ccagcaugugcucccagcuca

SEQ ID NO: 2820008 - RNA, 16 nt, Mycobacterium avium subsp. paratuberculosis
ccagcauguguggcuc

SEQ ID NO: 2820009 - RNA, 14 nt, Mycobacterium avium subsp. paratuberculosis
ccagccacaccgcc

SEQ ID NO: 2820010 - RNA, 16 nt, Mycobacterium avium subsp. paratuberculosis
ccagccacaccgccgc

SEQ ID NO: 2820011 - RNA, 17 nt, Mycobacterium avium subsp. paratuberculosis
ccagccacaccgccgcg

SEQ ID NO: 2820012 - RNA, 23 nt, Mycobacterium avium subsp. paratuberculosis
ccagccacaccgccgcggcggug

SEQ ID NO: 2820013 - RNA, 24 nt, Mycobacterium avium subsp. paratuberculosis
ccagccacaccgccgcggcggugg

SEQ ID NO: 2820014 - RNA, 12 nt, Mycobacterium avium subsp. paratuberculosis
ccagccacagcc

SEQ ID NO: 2820015 - RNA, 14 nt, Mycobacterium avium subsp. paratuberculosis
ccagccacagccgc

SEQ ID NO: 2820016 - RNA, 14 nt, Mycobacterium avium subsp. paratuberculosis
ccagccacgccgac

SEQ ID NO: 2820017 - RNA, 19 nt, Mycobacterium avium subsp. paratuberculosis
ccagccagaacacgccccg

SEQ ID NO: 2820018 - RNA, 20 nt, Mycobacterium avium subsp. paratuberculosis
ccagccagaacacgccccgg

SEQ ID NO: 2820019 - RNA, 16 nt, Mycobacterium avium subsp. paratuberculosis
ccagccagaacgaaca

SEQ ID NO: 2820020 - RNA, 13 nt, Mycobacterium avium subsp. paratuberculosis
ccagccagccgcc

SEQ ID NO: 2820021 - RNA, 14 nt, Mycobacterium avium subsp. paratuberculosis
ccagccagccgccc

SEQ ID NO: 2820022 - RNA, 16 nt, Mycobacterium avium subsp. paratuberculosis
ccagccagccgcccag

SEQ ID NO: 2820023 - RNA, 19 nt, Mycobacterium avium subsp. paratuberculosis
ccagccagccgcccagcau

SEQ ID NO: 2820024 - RNA, 14 nt, Mycobacterium avium subsp. paratuberculosis
ccagccagccgcgc

SEQ ID NO: 2820025 - RNA, 16 nt, Mycobacterium avium subsp. paratuberculosis
ccagccagccgcgccg

SEQ ID NO: 2820026 - RNA, 16 nt, Mycobacterium avium subsp. paratuberculosis
ccagccagccggugcg

SEQ ID NO: 2820027 - RNA, 18 nt, Mycobacterium avium subsp. paratuberculosis
ccagccagccggugcggu

SEQ ID NO: 2820028 - RNA, 12 nt, Mycobacterium avium subsp. paratuberculosis
ccagccgcacga

SEQ ID NO: 2820029 - RNA, 17 nt, Mycobacterium avium subsp. paratuberculosis
ccagccgcagcaggcac

SEQ ID NO: 2820030 - RNA, 14 nt, Mycobacterium avium subsp. paratuberculosis
ccagccgcaggugc

SEQ ID NO: 2820031 - RNA, 16 nt, Mycobacterium avium subsp. paratuberculosis
ccagccgcaggugcag

SEQ ID NO: 2820032 - RNA, 14 nt, Mycobacterium avium subsp. paratuberculosis
ccagccgcauucgg

SEQ ID NO: 2820033 - RNA, 19 nt, Mycobacterium avium subsp. paratuberculosis
ccagccgcauucggugagc

SEQ ID NO: 2820034 - RNA, 16 nt, Mycobacterium avium subsp. paratuberculosis
ccagccgcccagcauc

SEQ ID NO: 2820035 - RNA, 17 nt, Mycobacterium avium subsp. paratuberculosis
ccagccgcccagcaucg

SEQ ID NO: 2820036 - RNA, 21 nt, Mycobacterium avium subsp. paratuberculosis
ccagccgcccagcaucgccgc

SEQ ID NO: 2820037 - RNA, 13 nt, Mycobacterium avium subsp. paratuberculosis
ccagccgccgccg

SEQ ID NO: 2820038 - RNA, 13 nt, Mycobacterium avium subsp. paratuberculosis
ccagccgccgcga

SEQ ID NO: 2820039 - RNA, 15 nt, Mycobacterium avium subsp. paratuberculosis
ccagccgccgcgaca

SEQ ID NO: 2820040 - RNA, 17 nt, Mycobacterium avium subsp. paratuberculosis
ccagccgccgcgacacc

SEQ ID NO: 2820041 - RNA, 13 nt, Mycobacterium avium subsp. paratuberculosis
ccagccgccggcc

SEQ ID NO: 2820042 - RNA, 15 nt, Mycobacterium avium subsp. paratuberculosis
ccagccgccggccac

SEQ ID NO: 2820043 - RNA, 16 nt, Mycobacterium avium subsp. paratuberculosis
ccagccgccggccacc

SEQ ID NO: 2820044 - RNA, 14 nt, Mycobacterium avium subsp. paratuberculosis
ccagccgccggcuc

SEQ ID NO: 2820045 - RNA, 16 nt, Mycobacterium avium subsp. paratuberculosis
ccagccgccggcucag

SEQ ID NO: 2820046 - RNA, 16 nt, Mycobacterium avium subsp. paratuberculosis
ccagccgccgguccag

SEQ ID NO: 2820047 - RNA, 16 nt, Mycobacterium avium subsp. paratuberculosis
ccagccgcgccgcgcc

SEQ ID NO: 2820048 - RNA, 18 nt, Mycobacterium avium subsp. paratuberculosis
ccagccgcgccgcgccgc

SEQ ID NO: 2820049 - RNA, 14 nt, Mycobacterium avium subsp. paratuberculosis
ccagccgcgcgacg

SEQ ID NO: 2820050 - RNA, 13 nt, Mycobacterium avium subsp. paratuberculosis
ccagccgcgcggc

SEQ ID NO: 2820051 - RNA, 14 nt, Mycobacterium avium subsp. paratuberculosis
ccagccgcgcggcc

SEQ ID NO: 2820052 - RNA, 16 nt, Mycobacterium avium subsp. paratuberculosis
ccagccgcgcggccgc

SEQ ID NO: 2820053 - RNA, 17 nt, Mycobacterium avium subsp. paratuberculosis
ccagccgcgcggccgcc

SEQ ID NO: 2820054 - RNA, 19 nt, Mycobacterium avium subsp. paratuberculosis
ccagccgcgcggccgccuc

SEQ ID NO: 2820055 - RNA, 20 nt, Mycobacterium avium subsp. paratuberculosis
ccagccgcggacggccagcc

SEQ ID NO: 2820056 - RNA, 23 nt, Mycobacterium avium subsp. paratuberculosis
ccagccgcgguucuuguccucga

SEQ ID NO: 2820057 - RNA, 14 nt, Mycobacterium avium subsp. paratuberculosis
ccagccgcgucacg

SEQ ID NO: 2820058 - RNA, 15 nt, Mycobacterium avium subsp. paratuberculosis
ccagccgcgucacgu

SEQ ID NO: 2820059 - RNA, 17 nt, Mycobacterium avium subsp. paratuberculosis
ccagccgcucccggcgc

SEQ ID NO: 2820060 - RNA, 18 nt, Mycobacterium avium subsp. paratuberculosis
ccagccgcucccggcgca

SEQ ID NO: 2820061 - RNA, 19 nt, Mycobacterium avium subsp. paratuberculosis
ccagccgcucccggcgcag

SEQ ID NO: 2820062 - RNA, 16 nt, Mycobacterium avium subsp. paratuberculosis
ccagccgcuccgcggc

SEQ ID NO: 2820063 - RNA, 18 nt, Mycobacterium avium subsp. paratuberculosis
ccagccgcuccgcggcgg

SEQ ID NO: 2820064 - RNA, 20 nt, Mycobacterium avium subsp. paratuberculosis
ccagccgcuccgcggcgggc

SEQ ID NO: 2820065 - RNA, 23 nt, Mycobacterium avium subsp. paratuberculosis
ccagccgcuccgcggcgggcgug

SEQ ID NO: 2820066 - RNA, 13 nt, Mycobacterium avium subsp. paratuberculosis
ccagccgcuccuc

SEQ ID NO: 2820067 - RNA, 14 nt, Mycobacterium avium subsp. paratuberculosis
ccagccgcuccucg

SEQ ID NO: 2820068 - RNA, 20 nt, Mycobacterium avium subsp. paratuberculosis
ccagccgcuccucguugauc

SEQ ID NO: 2820069 - RNA, 13 nt, Mycobacterium avium subsp. paratuberculosis
ccagccggacagc

SEQ ID NO: 2820070 - RNA, 13 nt, Mycobacterium avium subsp. paratuberculosis
ccagccggcccgc

SEQ ID NO: 2820071 - RNA, 23 nt, Mycobacterium avium subsp. paratuberculosis
ccagccggcccgcaucgcggcga

SEQ ID NO: 2820072 - RNA, 14 nt, Mycobacterium avium subsp. paratuberculosis
ccagccggccgacg

SEQ ID NO: 2820073 - RNA, 15 nt, Mycobacterium avium subsp. paratuberculosis
ccagccggccgacgc

SEQ ID NO: 2820074 - RNA, 19 nt, Mycobacterium avium subsp. paratuberculosis
ccagccggccgacgcggcc

SEQ ID NO: 2820075 - RNA, 20 nt, Mycobacterium avium subsp. paratuberculosis
ccagccggccgacgcggccu

SEQ ID NO: 2820076 - RNA, 22 nt, Mycobacterium avium subsp. paratuberculosis
ccagccggccgacgcggccucg

SEQ ID NO: 2820077 - RNA, 14 nt, Mycobacterium avium subsp. paratuberculosis
ccagccggccgagc

SEQ ID NO: 2820078 - RNA, 14 nt, Mycobacterium avium subsp. paratuberculosis
ccagccggccgcug

SEQ ID NO: 2820079 - RNA, 19 nt, Mycobacterium avium subsp. paratuberculosis
ccagccggccgcugaggau

SEQ ID NO: 2820080 - RNA, 14 nt, Mycobacterium avium subsp. paratuberculosis
ccagccggccggcc

SEQ ID NO: 2820081 - RNA, 16 nt, Mycobacterium avium subsp. paratuberculosis
ccagccggccggccga

SEQ ID NO: 2820082 - RNA, 15 nt, Mycobacterium avium subsp. paratuberculosis
ccagccggccggcga

SEQ ID NO: 2820083 - RNA, 14 nt, Mycobacterium avium subsp. paratuberculosis
ccagccggcgcacc

SEQ ID NO: 2820084 - RNA, 15 nt, Mycobacterium avium subsp. paratuberculosis
ccagccggcgcacca

SEQ ID NO: 2820085 - RNA, 13 nt, Mycobacterium avium subsp. paratuberculosis
ccagccggcggug

SEQ ID NO: 2820086 - RNA, 15 nt, Mycobacterium avium subsp. paratuberculosis
ccagccgggccgagc

SEQ ID NO: 2820087 - RNA, 18 nt, Mycobacterium avium subsp. paratuberculosis
ccagccgggccgagcgcg

SEQ ID NO: 2820088 - RNA, 19 nt, Mycobacterium avium subsp. paratuberculosis
ccagccgggccgagcgcgc

SEQ ID NO: 2820089 - RNA, 22 nt, Mycobacterium avium subsp. paratuberculosis
ccagccgggccgagcgcgccgc

SEQ ID NO: 2820090 - RNA, 23 nt, Mycobacterium avium subsp. paratuberculosis
ccagccgggccgagcgcgccgcc

SEQ ID NO: 2820091 - RNA, 14 nt, Mycobacterium avium subsp. paratuberculosis
ccagccgggcggcc

SEQ ID NO: 2820092 - RNA, 15 nt, Mycobacterium avium subsp. paratuberculosis
ccagccgggcggcca

SEQ ID NO: 2820093 - RNA, 18 nt, Mycobacterium avium subsp. paratuberculosis
ccagccgggcggccaggg

SEQ ID NO: 2820094 - RNA, 22 nt, Mycobacterium avium subsp. paratuberculosis
ccagccgggguagggcggcggg

SEQ ID NO: 2820095 - RNA, 12 nt, Mycobacterium avium subsp. paratuberculosis
ccagccgggugg

SEQ ID NO: 2820096 - RNA, 17 nt, Mycobacterium avium subsp. paratuberculosis
ccagccgguaugcgauc

SEQ ID NO: 2820097 - RNA, 16 nt, Mycobacterium avium subsp. paratuberculosis
ccagccggucaucgcg

SEQ ID NO: 2820098 - RNA, 16 nt, Mycobacterium avium subsp. paratuberculosis
ccagccggucgccggg

SEQ ID NO: 2820099 - RNA, 19 nt, Mycobacterium avium subsp. paratuberculosis
ccagccggucgccgggccg

SEQ ID NO: 2820100 - RNA, 15 nt, Mycobacterium avium subsp. paratuberculosis
ccagccggucgucgg

SEQ ID NO: 2820101 - RNA, 13 nt, Mycobacterium avium subsp. paratuberculosis
ccagccggugcac

SEQ ID NO: 2820102 - RNA, 17 nt, Mycobacterium avium subsp. paratuberculosis
ccagccggugcgagccg

SEQ ID NO: 2820103 - RNA, 18 nt, Mycobacterium avium subsp. paratuberculosis
ccagccggugcggucggc

SEQ ID NO: 2820104 - RNA, 13 nt, Mycobacterium avium subsp. paratuberculosis
ccagccggugcug

SEQ ID NO: 2820105 - RNA, 24 nt, Mycobacterium avium subsp. paratuberculosis
ccagccggugcugacccggucgcg

SEQ ID NO: 2820106 - RNA, 22 nt, Mycobacterium avium subsp. paratuberculosis
ccagccgguugcgguggccgau

SEQ ID NO: 2820107 - RNA, 14 nt, Mycobacterium avium subsp. paratuberculosis
ccagccguccagcc

SEQ ID NO: 2820108 - RNA, 17 nt, Mycobacterium avium subsp. paratuberculosis
ccagccgucccgccguc

SEQ ID NO: 2820109 - RNA, 17 nt, Mycobacterium avium subsp. paratuberculosis
ccagccgucgccgcgcc

SEQ ID NO: 2820110 - RNA, 21 nt, Mycobacterium avium subsp. paratuberculosis
ccagccgucgccgcgcccgcc

SEQ ID NO: 2820111 - RNA, 19 nt, Mycobacterium avium subsp. paratuberculosis
ccagccgucguugcgggcg

SEQ ID NO: 2820112 - RNA, 23 nt, Mycobacterium avium subsp. paratuberculosis
ccagccgucguugcgggcggcgc

SEQ ID NO: 2820113 - RNA, 19 nt, Mycobacterium avium subsp. paratuberculosis
ccagcgccaugccgccgac

SEQ ID NO: 2820114 - RNA, 16 nt, Mycobacterium avium subsp. paratuberculosis
ccagcgcccccagcgg

SEQ ID NO: 2820115 - RNA, 22 nt, Mycobacterium avium subsp. paratuberculosis
ccagcgcccccgacaggcccac

SEQ ID NO: 2820116 - RNA, 15 nt, Mycobacterium avium subsp. paratuberculosis
ccagcgccccgccgg

SEQ ID NO: 2820117 - RNA, 12 nt, Mycobacterium avium subsp. paratuberculosis
ccagcgcccgcc

SEQ ID NO: 2820118 - RNA, 14 nt, Mycobacterium avium subsp. paratuberculosis
ccagcgcccgcccg

SEQ ID NO: 2820119 - RNA, 17 nt, Mycobacterium avium subsp. paratuberculosis
ccagcgcccgcgcgugg

SEQ ID NO: 2820120 - RNA, 19 nt, Mycobacterium avium subsp. paratuberculosis
ccagcgcccgcgcgugggc

SEQ ID NO: 2820121 - RNA, 16 nt, Mycobacterium avium subsp. paratuberculosis
ccagcgcccggcgacc

SEQ ID NO: 2820122 - RNA, 14 nt, Mycobacterium avium subsp. paratuberculosis
ccagcgcccgggcg

SEQ ID NO: 2820123 - RNA, 16 nt, Mycobacterium avium subsp. paratuberculosis
ccagcgcccgggcgcg

SEQ ID NO: 2820124 - RNA, 16 nt, Mycobacterium avium subsp. paratuberculosis
ccagcgcccguagccg

SEQ ID NO: 2820125 - RNA, 14 nt, Mycobacterium avium subsp. paratuberculosis
ccagcgccgagacc

SEQ ID NO: 2820126 - RNA, 21 nt, Mycobacterium avium subsp. paratuberculosis
ccagcgccgagaucgcggugg

SEQ ID NO: 2820127 - RNA, 18 nt, Mycobacterium avium subsp. paratuberculosis
ccagcgccgagcacggcu

SEQ ID NO: 2820128 - RNA, 24 nt, Mycobacterium avium subsp. paratuberculosis
ccagcgccgagcacggcucgucca

SEQ ID NO: 2820129 - RNA, 15 nt, Mycobacterium avium subsp. paratuberculosis
ccagcgccgagccga

SEQ ID NO: 2820130 - RNA, 12 nt, Mycobacterium avium subsp. paratuberculosis
ccagcgccgcca

SEQ ID NO: 2820131 - RNA, 20 nt, Mycobacterium avium subsp. paratuberculosis
ccagcgccgccaaccagguc

SEQ ID NO: 2820132 - RNA, 13 nt, Mycobacterium avium subsp. paratuberculosis
ccagcgccgccag

SEQ ID NO: 2820133 - RNA, 14 nt, Mycobacterium avium subsp. paratuberculosis
ccagcgccgccauc

SEQ ID NO: 2820134 - RNA, 12 nt, Mycobacterium avium subsp. paratuberculosis
ccagcgccgccc

SEQ ID NO: 2820135 - RNA, 18 nt, Mycobacterium avium subsp. paratuberculosis
ccagcgccgcccgggcgg

SEQ ID NO: 2820136 - RNA, 19 nt, Mycobacterium avium subsp. paratuberculosis
ccagcgccgcccgggcggc

SEQ ID NO: 2820137 - RNA, 15 nt, Mycobacterium avium subsp. paratuberculosis
ccagcgccgcgauga

SEQ ID NO: 2820138 - RNA, 16 nt, Mycobacterium avium subsp. paratuberculosis
ccagcgccgcgaugau

SEQ ID NO: 2820139 - RNA, 23 nt, Mycobacterium avium subsp. paratuberculosis
ccagcgccgcgcgcgcggccucc

SEQ ID NO: 2820140 - RNA, 14 nt, Mycobacterium avium subsp. paratuberculosis
ccagcgccgcggcg

SEQ ID NO: 2820141 - RNA, 15 nt, Mycobacterium avium subsp. paratuberculosis
ccagcgccgcggcga

SEQ ID NO: 2820142 - RNA, 16 nt, Mycobacterium avium subsp. paratuberculosis
ccagcgccgcggcgaa

SEQ ID NO: 2820143 - RNA, 20 nt, Mycobacterium avium subsp. paratuberculosis
ccagcgccggcaccagcagc

SEQ ID NO: 2820144 - RNA, 21 nt, Mycobacterium avium subsp. paratuberculosis
ccagcgccggcaccagcagcc

SEQ ID NO: 2820145 - RNA, 13 nt, Mycobacterium avium subsp. paratuberculosis
ccagcgccggcag

SEQ ID NO: 2820146 - RNA, 11 nt, Mycobacterium avium subsp. paratuberculosis
ccagcgccggg

SEQ ID NO: 2820147 - RNA, 20 nt, Mycobacterium avium subsp. paratuberculosis
ccagcgccgucaucaccgcc

SEQ ID NO: 2820148 - RNA, 22 nt, Mycobacterium avium subsp. paratuberculosis
ccagcgccgucaucaccgccga

SEQ ID NO: 2820149 - RNA, 23 nt, Mycobacterium avium subsp. paratuberculosis
ccagcgccgucaucaccgccgag

SEQ ID NO: 2820150 - RNA, 14 nt, Mycobacterium avium subsp. paratuberculosis
ccagcgccuccagc

SEQ ID NO: 2820151 - RNA, 23 nt, Mycobacterium avium subsp. paratuberculosis
ccagcgccucgagcaccacggcc

SEQ ID NO: 2820152 - RNA, 24 nt, Mycobacterium avium subsp. paratuberculosis
ccagcgccucgagcaccacggccc

SEQ ID NO: 2820153 - RNA, 14 nt, Mycobacterium avium subsp. paratuberculosis
ccagcgccucggcc

SEQ ID NO: 2820154 - RNA, 16 nt, Mycobacterium avium subsp. paratuberculosis
ccagcgccucggccuc

SEQ ID NO: 2820155 - RNA, 19 nt, Mycobacterium avium subsp. paratuberculosis
ccagcgccucggccugcgc

SEQ ID NO: 2820156 - RNA, 24 nt, Mycobacterium avium subsp. paratuberculosis
ccagcgccucggccugcgcccggc

SEQ ID NO: 2820157 - RNA, 15 nt, Mycobacterium avium subsp. paratuberculosis
ccagcgccucggcgu

SEQ ID NO: 2820158 - RNA, 22 nt, Mycobacterium avium subsp. paratuberculosis
ccagcgccucggcgucaccgcg

SEQ ID NO: 2820159 - RNA, 18 nt, Mycobacterium avium subsp. paratuberculosis
ccagcgccuucggcgcca

SEQ ID NO: 2820160 - RNA, 14 nt, Mycobacterium avium subsp. paratuberculosis
ccagcgccuucucc

SEQ ID NO: 2820161 - RNA, 17 nt, Mycobacterium avium subsp. paratuberculosis
ccagcgccuucuccagc

SEQ ID NO: 2820162 - RNA, 14 nt, Mycobacterium avium subsp. paratuberculosis
ccagcgcgaacagc

SEQ ID NO: 2820163 - RNA, 15 nt, Mycobacterium avium subsp. paratuberculosis
ccagcgcgaacagcg

SEQ ID NO: 2820164 - RNA, 18 nt, Mycobacterium avium subsp. paratuberculosis
ccagcgcgaacagcgcgg

SEQ ID NO: 2820165 - RNA, 19 nt, Mycobacterium avium subsp. paratuberculosis
ccagcgcgaacagcgcggc

SEQ ID NO: 2820166 - RNA, 21 nt, Mycobacterium avium subsp. paratuberculosis
ccagcgcgaacagcgcggcca

SEQ ID NO: 2820167 - RNA, 21 nt, Mycobacterium avium subsp. paratuberculosis
ccagcgcgaccagugcaccuc

SEQ ID NO: 2820168 - RNA, 14 nt, Mycobacterium avium subsp. paratuberculosis
ccagcgcgacccgc

SEQ ID NO: 2820169 - RNA, 16 nt, Mycobacterium avium subsp. paratuberculosis
ccagcgcgaccgcccg

SEQ ID NO: 2820170 - RNA, 14 nt, Mycobacterium avium subsp. paratuberculosis
ccagcgcgacgcgc

SEQ ID NO: 2820171 - RNA, 14 nt, Mycobacterium avium subsp. paratuberculosis
ccagcgcgacggcc

SEQ ID NO: 2820172 - RNA, 21 nt, Mycobacterium avium subsp. paratuberculosis
ccagcgcgacggccucgugga

SEQ ID NO: 2820173 - RNA, 17 nt, Mycobacterium avium subsp. paratuberculosis
ccagcgcgacgguguag

SEQ ID NO: 2820174 - RNA, 16 nt, Mycobacterium avium subsp. paratuberculosis
ccagcgcgacgucgac

SEQ ID NO: 2820175 - RNA, 14 nt, Mycobacterium avium subsp. paratuberculosis
ccagcgcgaggucc

SEQ ID NO: 2820176 - RNA, 18 nt, Mycobacterium avium subsp. paratuberculosis
ccagcgcgcacgcggaca

SEQ ID NO: 2820177 - RNA, 19 nt, Mycobacterium avium subsp. paratuberculosis
ccagcgcgcacgcggacac

SEQ ID NO: 2820178 - RNA, 20 nt, Mycobacterium avium subsp. paratuberculosis
ccagcgcgcagaacaccacc

SEQ ID NO: 2820179 - RNA, 21 nt, Mycobacterium avium subsp. paratuberculosis
ccagcgcgcagaacaccaccg

SEQ ID NO: 2820180 - RNA, 23 nt, Mycobacterium avium subsp. paratuberculosis
ccagcgcgcagaacaccaccgcc

SEQ ID NO: 2820181 - RNA, 13 nt, Mycobacterium avium subsp. paratuberculosis
ccagcgcgcccgc

SEQ ID NO: 2820182 - RNA, 14 nt, Mycobacterium avium subsp. paratuberculosis
ccagcgcgccgauc

SEQ ID NO: 2820183 - RNA, 18 nt, Mycobacterium avium subsp. paratuberculosis
ccagcgcgccgaucgccc

SEQ ID NO: 2820184 - RNA, 23 nt, Mycobacterium avium subsp. paratuberculosis
ccagcgcgccgaucgcccagugc

SEQ ID NO: 2820185 - RNA, 12 nt, Mycobacterium avium subsp. paratuberculosis
ccagcgcgccgc

SEQ ID NO: 2820186 - RNA, 19 nt, Mycobacterium avium subsp. paratuberculosis
ccagcgcgccgcacagccg

SEQ ID NO: 2820187 - RNA, 23 nt, Mycobacterium avium subsp. paratuberculosis
ccagcgcgccgcacagccggcgg

SEQ ID NO: 2820188 - RNA, 17 nt, Mycobacterium avium subsp. paratuberculosis
ccagcgcgccgcccagc

SEQ ID NO: 2820189 - RNA, 21 nt, Mycobacterium avium subsp. paratuberculosis
ccagcgcgccgcccagcggcc

SEQ ID NO: 2820190 - RNA, 14 nt, Mycobacterium avium subsp. paratuberculosis
ccagcgcgccgccg

SEQ ID NO: 2820191 - RNA, 17 nt, Mycobacterium avium subsp. paratuberculosis
ccagcgcgccgccgaug

SEQ ID NO: 2820192 - RNA, 14 nt, Mycobacterium avium subsp. paratuberculosis
ccagcgcgccggcc

SEQ ID NO: 2820193 - RNA, 17 nt, Mycobacterium avium subsp. paratuberculosis
ccagcgcgccggccagc

SEQ ID NO: 2820194 - RNA, 21 nt, Mycobacterium avium subsp. paratuberculosis
ccagcgcgccggccagcagca

SEQ ID NO: 2820195 - RNA, 13 nt, Mycobacterium avium subsp. paratuberculosis
ccagcgcgcgauc

SEQ ID NO: 2820196 - RNA, 18 nt, Mycobacterium avium subsp. paratuberculosis
ccagcgcgcgaucagcgc

SEQ ID NO: 2820197 - RNA, 20 nt, Mycobacterium avium subsp. paratuberculosis
ccagcgcgcgaucagcgccg

SEQ ID NO: 2820198 - RNA, 14 nt, Mycobacterium avium subsp. paratuberculosis
ccagcggcaccagg

SEQ ID NO: 2820199 - RNA, 14 nt, Mycobacterium avium subsp. paratuberculosis
ccagcggcacgaag

SEQ ID NO: 2820200 - RNA, 15 nt, Mycobacterium avium subsp. paratuberculosis
ccagcggcacgggca

SEQ ID NO: 2820201 - RNA, 19 nt, Mycobacterium avium subsp. paratuberculosis
ccagcggcacgggcaccga

SEQ ID NO: 2820202 - RNA, 16 nt, Mycobacterium avium subsp. paratuberculosis
ccagcggcagcacguc

SEQ ID NO: 2820203 - RNA, 23 nt, Mycobacterium avium subsp. paratuberculosis
ccagcggcagcacguccccgggc

SEQ ID NO: 2820204 - RNA, 14 nt, Mycobacterium avium subsp. paratuberculosis
ccagcggcagcagc

SEQ ID NO: 2820205 - RNA, 18 nt, Mycobacterium avium subsp. paratuberculosis
ccagcggcagcagcacca

SEQ ID NO: 2820206 - RNA, 17 nt, Mycobacterium avium subsp. paratuberculosis
ccagcggcagcgacagc

SEQ ID NO: 2820207 - RNA, 21 nt, Mycobacterium avium subsp. paratuberculosis
ccagcggcagcgccagcggga

SEQ ID NO: 2820208 - RNA, 17 nt, Mycobacterium avium subsp. paratuberculosis
ccagcggcagcggcguc

SEQ ID NO: 2820209 - RNA, 18 nt, Mycobacterium avium subsp. paratuberculosis
ccagcggcagcggcgucg

SEQ ID NO: 2820210 - RNA, 22 nt, Mycobacterium avium subsp. paratuberculosis
ccagcggcagcggcgucgucgu

SEQ ID NO: 2820211 - RNA, 15 nt, Mycobacterium avium subsp. paratuberculosis
ccagcggcagcgucg

SEQ ID NO: 2820212 - RNA, 12 nt, Mycobacterium avium subsp. paratuberculosis
ccagcggcaggu

SEQ ID NO: 2820213 - RNA, 14 nt, Mycobacterium avium subsp. paratuberculosis
ccagcggcaggugg

SEQ ID NO: 2820214 - RNA, 16 nt, Mycobacterium avium subsp. paratuberculosis
ccagcggcaucgccgc

SEQ ID NO: 2820215 - RNA, 18 nt, Mycobacterium avium subsp. paratuberculosis
ccagcggcaucgccgcca

SEQ ID NO: 2820216 - RNA, 21 nt, Mycobacterium avium subsp. paratuberculosis
ccagcggcaucgccgccaagg

SEQ ID NO: 2820217 - RNA, 15 nt, Mycobacterium avium subsp. paratuberculosis
ccagcggcauggcga

SEQ ID NO: 2820218 - RNA, 14 nt, Mycobacterium avium subsp. paratuberculosis
ccagcggccacacc

SEQ ID NO: 2820219 - RNA, 15 nt, Mycobacterium avium subsp. paratuberculosis
ccagcggccacaccg

SEQ ID NO: 2820220 - RNA, 15 nt, Mycobacterium avium subsp. paratuberculosis
ccagcggccagcccg

SEQ ID NO: 2820221 - RNA, 15 nt, Mycobacterium avium subsp. paratuberculosis
ccagcggcccaccgc

SEQ ID NO: 2820222 - RNA, 16 nt, Mycobacterium avium subsp. paratuberculosis
ccagcggcccaccgcg

SEQ ID NO: 2820223 - RNA, 17 nt, Mycobacterium avium subsp. paratuberculosis
ccagcggcccaccgcga

SEQ ID NO: 2820224 - RNA, 17 nt, Mycobacterium avium subsp. paratuberculosis
ccagcggccccggcucg

SEQ ID NO: 2820225 - RNA, 19 nt, Mycobacterium avium subsp. paratuberculosis
ccagcggccccggcucggg

SEQ ID NO: 2820226 - RNA, 20 nt, Mycobacterium avium subsp. paratuberculosis
ccagcggccccggcucgggc

SEQ ID NO: 2820227 - RNA, 22 nt, Mycobacterium avium subsp. paratuberculosis
ccagcggccccggcucgggcca

SEQ ID NO: 2820228 - RNA, 13 nt, Mycobacterium avium subsp. paratuberculosis
ccagcggcccgcu

SEQ ID NO: 2820229 - RNA, 19 nt, Mycobacterium avium subsp. paratuberculosis
ccagcggcccucccccgag

SEQ ID NO: 2820230 - RNA, 16 nt, Mycobacterium avium subsp. paratuberculosis
ccagcggccgagggcu

SEQ ID NO: 2820231 - RNA, 23 nt, Mycobacterium avium subsp. paratuberculosis
ccagcggccgaucauggucggcg

SEQ ID NO: 2820232 - RNA, 14 nt, Mycobacterium avium subsp. paratuberculosis
ccagcggccgcagc

SEQ ID NO: 2820233 - RNA, 17 nt, Mycobacterium avium subsp. paratuberculosis
ccagcggccgcagcgcg

SEQ ID NO: 2820234 - RNA, 18 nt, Mycobacterium avium subsp. paratuberculosis
ccagcggccgcagcgcga

SEQ ID NO: 2820235 - RNA, 17 nt, Mycobacterium avium subsp. paratuberculosis
ccagcggccggaacagc

SEQ ID NO: 2820236 - RNA, 20 nt, Mycobacterium avium subsp. paratuberculosis
ccagcggccggaacagcugg

SEQ ID NO: 2820237 - RNA, 22 nt, Mycobacterium avium subsp. paratuberculosis
ccagcggccggaacagcugguc

SEQ ID NO: 2820238 - RNA, 17 nt, Mycobacterium avium subsp. paratuberculosis
ccagcggccgucgccgg

SEQ ID NO: 2820239 - RNA, 19 nt, Mycobacterium avium subsp. paratuberculosis
ccagcggccgucgccgggc

SEQ ID NO: 2820240 - RNA, 16 nt, Mycobacterium avium subsp. paratuberculosis
ccagcggccgucgcgc

SEQ ID NO: 2820241 - RNA, 13 nt, Mycobacterium avium subsp. paratuberculosis
ccagcggcgaugc

SEQ ID NO: 2820242 - RNA, 22 nt, Mycobacterium avium subsp. paratuberculosis
ccagcggcgaugcccacagcca

SEQ ID NO: 2820243 - RNA, 23 nt, Mycobacterium avium subsp. paratuberculosis
ccagcggcgaugcccacagccag

SEQ ID NO: 2820244 - RNA, 12 nt, Mycobacterium avium subsp. paratuberculosis
ccagcggcgcac

SEQ ID NO: 2820245 - RNA, 17 nt, Mycobacterium avium subsp. paratuberculosis
ccagcggcgcccacggc

SEQ ID NO: 2820246 - RNA, 18 nt, Mycobacterium avium subsp. paratuberculosis
ccagcggcgcccacggcc

SEQ ID NO: 2820247 - RNA, 21 nt, Mycobacterium avium subsp. paratuberculosis
ccagcggcgcccacggccacc

SEQ ID NO: 2820248 - RNA, 13 nt, Mycobacterium avium subsp. paratuberculosis
ccagcggcgccgg

SEQ ID NO: 2820249 - RNA, 21 nt, Mycobacterium avium subsp. paratuberculosis
ccagcggcgccgggucaccgg

SEQ ID NO: 2820250 - RNA, 13 nt, Mycobacterium avium subsp. paratuberculosis
ccagcggcgcgcc

SEQ ID NO: 2820251 - RNA, 16 nt, Mycobacterium avium subsp. paratuberculosis
ccagcggcgcgccggg

SEQ ID NO: 2820252 - RNA, 15 nt, Mycobacterium avium subsp. paratuberculosis
ccagcggcgcggccg

SEQ ID NO: 2820253 - RNA, 15 nt, Mycobacterium avium subsp. paratuberculosis
ccagcggcgcgucgc

SEQ ID NO: 2820254 - RNA, 18 nt, Mycobacterium avium subsp. paratuberculosis
ccagcggcgcgucgcugg

SEQ ID NO: 2820255 - RNA, 19 nt, Mycobacterium avium subsp. paratuberculosis
ccagcggcgcgucgcuggg

SEQ ID NO: 2820256 - RNA, 13 nt, Mycobacterium avium subsp. paratuberculosis
ccagcggcggccc

SEQ ID NO: 2820257 - RNA, 14 nt, Mycobacterium avium subsp. paratuberculosis
ccagcggcggcccu

SEQ ID NO: 2820258 - RNA, 14 nt, Mycobacterium avium subsp. paratuberculosis
ccagcggcggccuu

SEQ ID NO: 2820259 - RNA, 14 nt, Mycobacterium avium subsp. paratuberculosis
ccagcggcucggug

SEQ ID NO: 2820260 - RNA, 16 nt, Mycobacterium avium subsp. paratuberculosis
ccagcggcuguagcac

SEQ ID NO: 2820261 - RNA, 21 nt, Mycobacterium avium subsp. paratuberculosis
ccagcggcuguagcacccggc

SEQ ID NO: 2820262 - RNA, 22 nt, Mycobacterium avium subsp. paratuberculosis
ccagcggcuugagccggaucgg

SEQ ID NO: 2820263 - RNA, 20 nt, Mycobacterium avium subsp. paratuberculosis
ccagcggcuuggccgugcag

SEQ ID NO: 2820264 - RNA, 17 nt, Mycobacterium avium subsp. paratuberculosis
ccagcgggacagcacca

SEQ ID NO: 2820265 - RNA, 21 nt, Mycobacterium avium subsp. paratuberculosis
ccagcgggaugaaggcaccca

SEQ ID NO: 2820266 - RNA, 15 nt, Mycobacterium avium subsp. paratuberculosis
ccagcgggccgacag

SEQ ID NO: 2820267 - RNA, 16 nt, Mycobacterium avium subsp. paratuberculosis
ccagcgggccgacagc

SEQ ID NO: 2820268 - RNA, 19 nt, Mycobacterium avium subsp. paratuberculosis
ccagcgggccgacagcacg

SEQ ID NO: 2820269 - RNA, 21 nt, Mycobacterium avium subsp. paratuberculosis
ccagcgggccgacagcacgcc

SEQ ID NO: 2820270 - RNA, 23 nt, Mycobacterium avium subsp. paratuberculosis
ccagcgggccgacagcacgccgg

SEQ ID NO: 2820271 - RNA, 19 nt, Mycobacterium avium subsp. paratuberculosis
ccagcgggccgaccuggcg

SEQ ID NO: 2820272 - RNA, 21 nt, Mycobacterium avium subsp. paratuberculosis
ccagcgggccgagcguucggc

SEQ ID NO: 2820273 - RNA, 14 nt, Mycobacterium avium subsp. paratuberculosis
ccagcgggccgugc

SEQ ID NO: 2820274 - RNA, 17 nt, Mycobacterium avium subsp. paratuberculosis
ccagcgggcgacgucgg

SEQ ID NO: 2820275 - RNA, 15 nt, Mycobacterium avium subsp. paratuberculosis
ccagcgggcggcccc

SEQ ID NO: 2820276 - RNA, 13 nt, Mycobacterium avium subsp. paratuberculosis
ccagcgggcggcg

SEQ ID NO: 2820277 - RNA, 14 nt, Mycobacterium avium subsp. paratuberculosis
ccagcgggcggcgg

SEQ ID NO: 2820278 - RNA, 16 nt, Mycobacterium avium subsp. paratuberculosis
ccagcgggcggcggug

SEQ ID NO: 2820279 - RNA, 17 nt, Mycobacterium avium subsp. paratuberculosis
ccagcgggcggcggugg

SEQ ID NO: 2820280 - RNA, 16 nt, Mycobacterium avium subsp. paratuberculosis
ccagcgggcugucggc

SEQ ID NO: 2820281 - RNA, 18 nt, Mycobacterium avium subsp. paratuberculosis
ccagcgggcugucggcgc

SEQ ID NO: 2820282 - RNA, 14 nt, Mycobacterium avium subsp. paratuberculosis
ccagcgggcugugc

SEQ ID NO: 2820283 - RNA, 14 nt, Mycobacterium avium subsp. paratuberculosis
ccagcgugucgccg

SEQ ID NO: 2820284 - RNA, 14 nt, Mycobacterium avium subsp. paratuberculosis
ccagcgugucggcg

SEQ ID NO: 2820285 - RNA, 15 nt, Mycobacterium avium subsp. paratuberculosis
ccagcgugucggcga

SEQ ID NO: 2820286 - RNA, 14 nt, Mycobacterium avium subsp. paratuberculosis
ccagcguguugagc

SEQ ID NO: 2820287 - RNA, 21 nt, Mycobacterium avium subsp. paratuberculosis
ccagcguguugagcucgcggc

SEQ ID NO: 2820288 - RNA, 15 nt, Mycobacterium avium subsp. paratuberculosis
ccagcguuccagcac

SEQ ID NO: 2820289 - RNA, 16 nt, Mycobacterium avium subsp. paratuberculosis
ccagcguuccagcacc

SEQ ID NO: 2820290 - RNA, 17 nt, Mycobacterium avium subsp. paratuberculosis
ccagcguuccagcaccc

SEQ ID NO: 2820291 - RNA, 20 nt, Mycobacterium avium subsp. paratuberculosis
ccagcguuccagcacccggc

SEQ ID NO: 2820292 - RNA, 14 nt, Mycobacterium avium subsp. paratuberculosis
ccagcguucgucgc

SEQ ID NO: 2820293 - RNA, 16 nt, Mycobacterium avium subsp. paratuberculosis
ccagcguucgucgccg

SEQ ID NO: 2820294 - RNA, 17 nt, Mycobacterium avium subsp. paratuberculosis
ccagcguucgucgccgg

SEQ ID NO: 2820295 - RNA, 21 nt, Mycobacterium avium subsp. paratuberculosis
ccagcguucgucgccggugag

SEQ ID NO: 2820296 - RNA, 18 nt, Mycobacterium avium subsp. paratuberculosis
ccagcguuuccagcgccg

SEQ ID NO: 2820297 - RNA, 20 nt, Mycobacterium avium subsp. paratuberculosis
ccagcguuuccagcgccggc

SEQ ID NO: 2820298 - RNA, 23 nt, Mycobacterium avium subsp. paratuberculosis
ccagcguuugagcaccucuucga

SEQ ID NO: 2820299 - RNA, 15 nt, Mycobacterium avium subsp. paratuberculosis
ccagcucaccggcca

SEQ ID NO: 2820300 - RNA, 16 nt, Mycobacterium avium subsp. paratuberculosis
ccagcucaccggccag

SEQ ID NO: 2820301 - RNA, 14 nt, Mycobacterium avium subsp. paratuberculosis
ccagcucaccggga

SEQ ID NO: 2820302 - RNA, 16 nt, Mycobacterium avium subsp. paratuberculosis
ccagcucagcgcgcac

SEQ ID NO: 2820303 - RNA, 13 nt, Mycobacterium avium subsp. paratuberculosis
ccagcuccacgcg

SEQ ID NO: 2820304 - RNA, 14 nt, Mycobacterium avium subsp. paratuberculosis
ccagcuccacgcgu

SEQ ID NO: 2820305 - RNA, 14 nt, Mycobacterium avium subsp. paratuberculosis
ccagcuccagcagc

SEQ ID NO: 2820306 - RNA, 16 nt, Mycobacterium avium subsp. paratuberculosis
ccagcuccagcagccc

SEQ ID NO: 2820307 - RNA, 20 nt, Mycobacterium avium subsp. paratuberculosis
ccagcuccagcagcccgggc

SEQ ID NO: 2820308 - RNA, 13 nt, Mycobacterium avium subsp. paratuberculosis
ccagcucccacga

SEQ ID NO: 2820309 - RNA, 18 nt, Mycobacterium avium subsp. paratuberculosis
ccagcucccaggacgcgg

SEQ ID NO: 2820310 - RNA, 23 nt, Mycobacterium avium subsp. paratuberculosis
ccagcucccaggacgcggugacg

SEQ ID NO: 2820311 - RNA, 15 nt, Mycobacterium avium subsp. paratuberculosis
ccagcucccgggcgg

SEQ ID NO: 2820312 - RNA, 18 nt, Mycobacterium avium subsp. paratuberculosis
ccagcucccgggcggcgc

SEQ ID NO: 2820313 - RNA, 14 nt, Mycobacterium avium subsp. paratuberculosis
ccagcuccgccacc

SEQ ID NO: 2820314 - RNA, 23 nt, Mycobacterium avium subsp. paratuberculosis
ccagcuccgccacccugcgcacc

SEQ ID NO: 2820315 - RNA, 19 nt, Mycobacterium avium subsp. paratuberculosis
ccagcuccgccgacaccag

SEQ ID NO: 2820316 - RNA, 13 nt, Mycobacterium avium subsp. paratuberculosis
ccagcuccgcggc

SEQ ID NO: 2820317 - RNA, 14 nt, Mycobacterium avium subsp. paratuberculosis
ccagcuccgcggcc

SEQ ID NO: 2820318 - RNA, 16 nt, Mycobacterium avium subsp. paratuberculosis
ccagcuccgcggccag

SEQ ID NO: 2820319 - RNA, 20 nt, Mycobacterium avium subsp. paratuberculosis
ccagcuccgcggccagcucg

SEQ ID NO: 2820320 - RNA, 21 nt, Mycobacterium avium subsp. paratuberculosis
ccagcuccgggucgaccgccu

SEQ ID NO: 2820321 - RNA, 17 nt, Mycobacterium avium subsp. paratuberculosis
ccagcuccguccaccgg

SEQ ID NO: 2820322 - RNA, 18 nt, Mycobacterium avium subsp. paratuberculosis
ccagcuccguccaccggc

SEQ ID NO: 2820323 - RNA, 21 nt, Mycobacterium avium subsp. paratuberculosis
ccagcuccguccaccggcacg

SEQ ID NO: 2820324 - RNA, 22 nt, Mycobacterium avium subsp. paratuberculosis
ccagcuccucgauggucgucgg

SEQ ID NO: 2820325 - RNA, 16 nt, Mycobacterium avium subsp. paratuberculosis
ccagcuccucggccag

SEQ ID NO: 2820326 - RNA, 19 nt, Mycobacterium avium subsp. paratuberculosis
ccagcuccucggccagcac

SEQ ID NO: 2820327 - RNA, 20 nt, Mycobacterium avium subsp. paratuberculosis
ccagcuccucggccagcacc

SEQ ID NO: 2820328 - RNA, 20 nt, Mycobacterium avium subsp. paratuberculosis
ccagcuccucggccccaaaa

SEQ ID NO: 2820329 - RNA, 15 nt, Mycobacterium avium subsp. paratuberculosis
ccagcucgaacaccg

SEQ ID NO: 2820330 - RNA, 18 nt, Mycobacterium avium subsp. paratuberculosis
ccagcucgaaccuggagg

SEQ ID NO: 2820331 - RNA, 14 nt, Mycobacterium avium subsp. paratuberculosis
ccagcucgaccgcg

SEQ ID NO: 2820332 - RNA, 15 nt, Mycobacterium avium subsp. paratuberculosis
ccagcucgaccgcgg

SEQ ID NO: 2820333 - RNA, 19 nt, Mycobacterium avium subsp. paratuberculosis
ccagcucgaccgcggcgau

SEQ ID NO: 2820334 - RNA, 20 nt, Mycobacterium avium subsp. paratuberculosis
ccagcucgaccgcggcgaug

SEQ ID NO: 2820335 - RNA, 14 nt, Mycobacterium avium subsp. paratuberculosis
ccagcucgacgacu

SEQ ID NO: 2820336 - RNA, 18 nt, Mycobacterium avium subsp. paratuberculosis
ccagcucgacgacuucgg

SEQ ID NO: 2820337 - RNA, 23 nt, Mycobacterium avium subsp. paratuberculosis
ccagcucgacgacuucggccucg

SEQ ID NO: 2820338 - RNA, 22 nt, Mycobacterium avium subsp. paratuberculosis
ccagcucgagcaucacgaaccc

SEQ ID NO: 2820339 - RNA, 16 nt, Mycobacterium avium subsp. paratuberculosis
ccagcucgaggccgcg

SEQ ID NO: 2820340 - RNA, 17 nt, Mycobacterium avium subsp. paratuberculosis
ccagcucgaggccgcgg

SEQ ID NO: 2820341 - RNA, 18 nt, Mycobacterium avium subsp. paratuberculosis
ccagcucgaggccgcggg

SEQ ID NO: 2820342 - RNA, 14 nt, Mycobacterium avium subsp. paratuberculosis
ccagcucgccgaug

SEQ ID NO: 2820343 - RNA, 15 nt, Mycobacterium avium subsp. paratuberculosis
ccagcucgccgccga

SEQ ID NO: 2820344 - RNA, 16 nt, Mycobacterium avium subsp. paratuberculosis
ccagcucgccgccgac

SEQ ID NO: 2820345 - RNA, 19 nt, Mycobacterium avium subsp. paratuberculosis
ccagcucgcguucgggccc

SEQ ID NO: 2820346 - RNA, 17 nt, Mycobacterium avium subsp. paratuberculosis
ccagcucggcccgcugc

SEQ ID NO: 2820347 - RNA, 13 nt, Mycobacterium avium subsp. paratuberculosis
ccagcucggcggc

SEQ ID NO: 2820348 - RNA, 16 nt, Mycobacterium avium subsp. paratuberculosis
ccagcucggcggccau

SEQ ID NO: 2820349 - RNA, 15 nt, Mycobacterium avium subsp. paratuberculosis
ccagcucggcggccg

SEQ ID NO: 2820350 - RNA, 16 nt, Mycobacterium avium subsp. paratuberculosis
ccagcucggcggccgg

SEQ ID NO: 2820351 - RNA, 18 nt, Mycobacterium avium subsp. paratuberculosis
ccagcucggcggccgggu

SEQ ID NO: 2820352 - RNA, 22 nt, Mycobacterium avium subsp. paratuberculosis
ccagcucggucagccgggcggc

SEQ ID NO: 2820353 - RNA, 16 nt, Mycobacterium avium subsp. paratuberculosis
ccagcucggugaucac

SEQ ID NO: 2820354 - RNA, 17 nt, Mycobacterium avium subsp. paratuberculosis
ccagcucggugaucacc

SEQ ID NO: 2820355 - RNA, 20 nt, Mycobacterium avium subsp. paratuberculosis
ccagcucggugaucugcacc

SEQ ID NO: 2820356 - RNA, 22 nt, Mycobacterium avium subsp. paratuberculosis
ccagcucggugaucugcaccag

SEQ ID NO: 2820357 - RNA, 23 nt, Mycobacterium avium subsp. paratuberculosis
ccagcucggugaucugcaccagc

SEQ ID NO: 2820358 - RNA, 14 nt, Mycobacterium avium subsp. paratuberculosis
ccagcucggugaug

SEQ ID NO: 2820359 - RNA, 23 nt, Mycobacterium avium subsp. paratuberculosis
ccagcucggugaugaucgccggg

SEQ ID NO: 2820360 - RNA, 13 nt, Mycobacterium avium subsp. paratuberculosis
ccagcucggugcg

SEQ ID NO: 2820361 - RNA, 21 nt, Mycobacterium avium subsp. paratuberculosis
ccagcucggugcgcauggcgu

SEQ ID NO: 2820362 - RNA, 20 nt, Mycobacterium avium subsp. paratuberculosis
ccagcucguccagcgugccg

SEQ ID NO: 2820363 - RNA, 12 nt, Mycobacterium avium subsp. paratuberculosis
ccagcucgucga

SEQ ID NO: 2820364 - RNA, 15 nt, Mycobacterium avium subsp. paratuberculosis
ccagcucgucgagcc

SEQ ID NO: 2820365 - RNA, 20 nt, Mycobacterium avium subsp. paratuberculosis
ccagcucgucgagccggccg

SEQ ID NO: 2820366 - RNA, 12 nt, Mycobacterium avium subsp. paratuberculosis
ccagcucgucgc

SEQ ID NO: 2820367 - RNA, 14 nt, Mycobacterium avium subsp. paratuberculosis
ccagcucgucgccg

SEQ ID NO: 2820368 - RNA, 14 nt, Mycobacterium avium subsp. paratuberculosis
ccaggacaacgcag

SEQ ID NO: 2820369 - RNA, 14 nt, Mycobacterium avium subsp. paratuberculosis
ccaggacagcguca

SEQ ID NO: 2820370 - RNA, 20 nt, Mycobacterium avium subsp. paratuberculosis
ccaggacagcgucagccccg

SEQ ID NO: 2820371 - RNA, 22 nt, Mycobacterium avium subsp. paratuberculosis
ccaggaccacccacucccagcc

SEQ ID NO: 2820372 - RNA, 23 nt, Mycobacterium avium subsp. paratuberculosis
ccaggaccacccacucccagccg

SEQ ID NO: 2820373 - RNA, 19 nt, Mycobacterium avium subsp. paratuberculosis
ccaggaccagcgggucgau

SEQ ID NO: 2820374 - RNA, 22 nt, Mycobacterium avium subsp. paratuberculosis
ccaggaccagcgggucgauggc

SEQ ID NO: 2820375 - RNA, 18 nt, Mycobacterium avium subsp. paratuberculosis
ccaggaccagguuggaca

SEQ ID NO: 2820376 - RNA, 20 nt, Mycobacterium avium subsp. paratuberculosis
ccaggacccguacuucucga

SEQ ID NO: 2820377 - RNA, 14 nt, Mycobacterium avium subsp. paratuberculosis
ccaggaccgcgcgc

SEQ ID NO: 2820378 - RNA, 15 nt, Mycobacterium avium subsp. paratuberculosis
ccaggaccgcgcgcc

SEQ ID NO: 2820379 - RNA, 16 nt, Mycobacterium avium subsp. paratuberculosis
ccaggaccgcgcgccg

SEQ ID NO: 2820380 - RNA, 18 nt, Mycobacterium avium subsp. paratuberculosis
ccaggaccgcgcgccggc

SEQ ID NO: 2820381 - RNA, 18 nt, Mycobacterium avium subsp. paratuberculosis
ccaggaccgggacgacgg

SEQ ID NO: 2820382 - RNA, 19 nt, Mycobacterium avium subsp. paratuberculosis
ccaggaccgggacgacggc

SEQ ID NO: 2820383 - RNA, 20 nt, Mycobacterium avium subsp. paratuberculosis
ccaggaccugaccgaacagc

SEQ ID NO: 2820384 - RNA, 15 nt, Mycobacterium avium subsp. paratuberculosis
ccaggacgcgaccgg

SEQ ID NO: 2820385 - RNA, 16 nt, Mycobacterium avium subsp. paratuberculosis
ccaggacgcgaccggc

SEQ ID NO: 2820386 - RNA, 18 nt, Mycobacterium avium subsp. paratuberculosis
ccaggacgcgaccggcca

SEQ ID NO: 2820387 - RNA, 12 nt, Mycobacterium avium subsp. paratuberculosis
ccaggacgcggu

SEQ ID NO: 2820388 - RNA, 16 nt, Mycobacterium avium subsp. paratuberculosis
ccaggacgcggugacg

SEQ ID NO: 2820389 - RNA, 14 nt, Mycobacterium avium subsp. paratuberculosis
ccaggacggcgcgg

SEQ ID NO: 2820390 - RNA, 21 nt, Mycobacterium avium subsp. paratuberculosis
ccaggacgguuucugccggcc

SEQ ID NO: 2820391 - RNA, 12 nt, Mycobacterium avium subsp. paratuberculosis
ccaggacgucgg

SEQ ID NO: 2820392 - RNA, 15 nt, Mycobacterium avium subsp. paratuberculosis
ccaggacgucggccg

SEQ ID NO: 2820393 - RNA, 16 nt, Mycobacterium avium subsp. paratuberculosis
ccaggacgucggccgg

SEQ ID NO: 2820394 - RNA, 20 nt, Mycobacterium avium subsp. paratuberculosis
ccaggacgucggccggcugc

SEQ ID NO: 2820395 - RNA, 15 nt, Mycobacterium avium subsp. paratuberculosis
ccaggacuccuuggg

SEQ ID NO: 2820396 - RNA, 14 nt, Mycobacterium avium subsp. paratuberculosis
ccaggagcaccugc

SEQ ID NO: 2820397 - RNA, 17 nt, Mycobacterium avium subsp. paratuberculosis
ccaggagcaccugcgcg

SEQ ID NO: 2820398 - RNA, 18 nt, Mycobacterium avium subsp. paratuberculosis
ccaggagcaccugcgcga

SEQ ID NO: 2820399 - RNA, 18 nt, Mycobacterium avium subsp. paratuberculosis
ccaggaggcacuggcgcu

SEQ ID NO: 2820400 - RNA, 23 nt, Mycobacterium avium subsp. paratuberculosis
ccaggaggcacuggcgcugcgcu

SEQ ID NO: 2820401 - RNA, 17 nt, Mycobacterium avium subsp. paratuberculosis
ccaggaucaccgggacg

SEQ ID NO: 2820402 - RNA, 17 nt, Mycobacterium avium subsp. paratuberculosis
ccaggaucacgcggcgg

SEQ ID NO: 2820403 - RNA, 24 nt, Mycobacterium avium subsp. paratuberculosis
ccaggauccccguccagcccagcg

SEQ ID NO: 2820404 - RNA, 14 nt, Mycobacterium avium subsp. paratuberculosis
ccaggauccgauga

SEQ ID NO: 2820405 - RNA, 19 nt, Mycobacterium avium subsp. paratuberculosis
ccaggauccgaugacgcug

SEQ ID NO: 2820406 - RNA, 21 nt, Mycobacterium avium subsp. paratuberculosis
ccaggauccgaugacgcugcc

SEQ ID NO: 2820407 - RNA, 14 nt, Mycobacterium avium subsp. paratuberculosis
ccaggauccgcacc

SEQ ID NO: 2820408 - RNA, 15 nt, Mycobacterium avium subsp. paratuberculosis
ccaggauccgcaccg

SEQ ID NO: 2820409 - RNA, 16 nt, Mycobacterium avium subsp. paratuberculosis
ccaggauccgcccgcc

SEQ ID NO: 2820410 - RNA, 17 nt, Mycobacterium avium subsp. paratuberculosis
ccaggauccgcccgccg

SEQ ID NO: 2820411 - RNA, 20 nt, Mycobacterium avium subsp. paratuberculosis
ccaggauccgcccgccggug

SEQ ID NO: 2820412 - RNA, 21 nt, Mycobacterium avium subsp. paratuberculosis
ccaggaucgggaucggcuugg

SEQ ID NO: 2820413 - RNA, 18 nt, Mycobacterium avium subsp. paratuberculosis
ccaggaucucgcgggccc

SEQ ID NO: 2820414 - RNA, 21 nt, Mycobacterium avium subsp. paratuberculosis
ccaggaucucgcgggcccgcg

SEQ ID NO: 2820415 - RNA, 15 nt, Mycobacterium avium subsp. paratuberculosis
ccaggaucucgucgg

SEQ ID NO: 2820416 - RNA, 18 nt, Mycobacterium avium subsp. paratuberculosis
ccaggaucugcagcacgc

SEQ ID NO: 2820417 - RNA, 20 nt, Mycobacterium avium subsp. paratuberculosis
ccaggaucugcucggcgucg

SEQ ID NO: 2820418 - RNA, 20 nt, Mycobacterium avium subsp. paratuberculosis
ccaggaucuugucggcggcc

SEQ ID NO: 2820419 - RNA, 17 nt, Mycobacterium avium subsp. paratuberculosis
ccaggaugaacacccgg

SEQ ID NO: 2820420 - RNA, 22 nt, Mycobacterium avium subsp. paratuberculosis
ccaggaugaaccgggagaacuc

SEQ ID NO: 2820421 - RNA, 16 nt, Mycobacterium avium subsp. paratuberculosis
ccaggaugaucuucuc

SEQ ID NO: 2820422 - RNA, 19 nt, Mycobacterium avium subsp. paratuberculosis
ccaggaugcccaggaugau

SEQ ID NO: 2820423 - RNA, 18 nt, Mycobacterium avium subsp. paratuberculosis
ccaggaugccgaacgcga

SEQ ID NO: 2820424 - RNA, 20 nt, Mycobacterium avium subsp. paratuberculosis
ccaggaugccgaacgcgauc

SEQ ID NO: 2820425 - RNA, 18 nt, Mycobacterium avium subsp. paratuberculosis
ccaggauggggaaguccg

SEQ ID NO: 2820426 - RNA, 15 nt, Mycobacterium avium subsp. paratuberculosis
ccaggaugucgacga

SEQ ID NO: 2820427 - RNA, 17 nt, Mycobacterium avium subsp. paratuberculosis
ccaggaugucgacgaca

SEQ ID NO: 2820428 - RNA, 21 nt, Mycobacterium avium subsp. paratuberculosis
ccaggaugucgacgacacccu

SEQ ID NO: 2820429 - RNA, 17 nt, Mycobacterium avium subsp. paratuberculosis
ccaggaugucggacucg

SEQ ID NO: 2820430 - RNA, 22 nt, Mycobacterium avium subsp. paratuberculosis
ccaggaugucggacucgcgccg

SEQ ID NO: 2820431 - RNA, 20 nt, Mycobacterium avium subsp. paratuberculosis
ccaggaugucuccgcgcagc

SEQ ID NO: 2820432 - RNA, 22 nt, Mycobacterium avium subsp. paratuberculosis
ccaggaugucuccgcgcagcca

SEQ ID NO: 2820433 - RNA, 21 nt, Mycobacterium avium subsp. paratuberculosis
ccaggauguucaccccggcgc

SEQ ID NO: 2820434 - RNA, 22 nt, Mycobacterium avium subsp. paratuberculosis
ccaggauguucaccccggcgcg

SEQ ID NO: 2820435 - RNA, 14 nt, Mycobacterium avium subsp. paratuberculosis
ccaggauucccgac

SEQ ID NO: 2820436 - RNA, 19 nt, Mycobacterium avium subsp. paratuberculosis
ccaggauucccgaccccgc

SEQ ID NO: 2820437 - RNA, 20 nt, Mycobacterium avium subsp. paratuberculosis
ccaggauucccgaccccgcc

SEQ ID NO: 2820438 - RNA, 17 nt, Mycobacterium avium subsp. paratuberculosis
ccaggauuccgucggcg

SEQ ID NO: 2820439 - RNA, 18 nt, Mycobacterium avium subsp. paratuberculosis
ccaggauucucagcagcg

SEQ ID NO: 2820440 - RNA, 18 nt, Mycobacterium avium subsp. paratuberculosis
ccaggcacagcagggcac

SEQ ID NO: 2820441 - RNA, 13 nt, Mycobacterium avium subsp. paratuberculosis
ccaggcacagcga

SEQ ID NO: 2820442 - RNA, 15 nt, Mycobacterium avium subsp. paratuberculosis
ccaggcacggcccgu

SEQ ID NO: 2820443 - RNA, 23 nt, Mycobacterium avium subsp. paratuberculosis
ccaggcagaagcuccacgccgcc

SEQ ID NO: 2820444 - RNA, 21 nt, Mycobacterium avium subsp. paratuberculosis
ccaggcagacccccagcagcg

SEQ ID NO: 2820445 - RNA, 13 nt, Mycobacterium avium subsp. paratuberculosis
ccaggcagcgcga

SEQ ID NO: 2820446 - RNA, 11 nt, Mycobacterium avium subsp. paratuberculosis
ccaggcaggcg

SEQ ID NO: 2820447 - RNA, 16 nt, Mycobacterium avium subsp. paratuberculosis
ccaggcaggcggccag

SEQ ID NO: 2820448 - RNA, 19 nt, Mycobacterium avium subsp. paratuberculosis
ccaggcaggcggccagggc

SEQ ID NO: 2820449 - RNA, 20 nt, Mycobacterium avium subsp. paratuberculosis
ccaggcaggcggccagggcg

SEQ ID NO: 2820450 - RNA, 15 nt, Mycobacterium avium subsp. paratuberculosis
ccaggccaacagcag

SEQ ID NO: 2820451 - RNA, 17 nt, Mycobacterium avium subsp. paratuberculosis
ccaggccaacagcagca

SEQ ID NO: 2820452 - RNA, 17 nt, Mycobacterium avium subsp. paratuberculosis
ccaggcgugcacccggu

SEQ ID NO: 2820453 - RNA, 18 nt, Mycobacterium avium subsp. paratuberculosis
ccaggcguggucggcgcg

SEQ ID NO: 2820454 - RNA, 20 nt, Mycobacterium avium subsp. paratuberculosis
ccaggcguggucggcgcggu

SEQ ID NO: 2820455 - RNA, 23 nt, Mycobacterium avium subsp. paratuberculosis
ccaggcguggucggcgcggucca

SEQ ID NO: 2820456 - RNA, 21 nt, Mycobacterium avium subsp. paratuberculosis
ccaggcguugcaccgcgggca

SEQ ID NO: 2820457 - RNA, 22 nt, Mycobacterium avium subsp. paratuberculosis
ccaggcguuggucaccaucagc

SEQ ID NO: 2820458 - RNA, 23 nt, Mycobacterium avium subsp. paratuberculosis
ccaggcguuggucaccaucagcg

SEQ ID NO: 2820459 - RNA, 17 nt, Mycobacterium avium subsp. paratuberculosis
ccaggcguuugguguga

SEQ ID NO: 2820460 - RNA, 21 nt, Mycobacterium avium subsp. paratuberculosis
ccaggcucaggaucagcagcc

SEQ ID NO: 2820461 - RNA, 19 nt, Mycobacterium avium subsp. paratuberculosis
ccaggcucgcucccgcgcg

SEQ ID NO: 2820462 - RNA, 20 nt, Mycobacterium avium subsp. paratuberculosis
ccaggcucgcucccgcgcgg

SEQ ID NO: 2820463 - RNA, 21 nt, Mycobacterium avium subsp. paratuberculosis
ccaggcucgcucccgcgcggg

SEQ ID NO: 2820464 - RNA, 13 nt, Mycobacterium avium subsp. paratuberculosis
ccaggcugaacac

SEQ ID NO: 2820465 - RNA, 17 nt, Mycobacterium avium subsp. paratuberculosis
ccaggcugaacgucguc

SEQ ID NO: 2820466 - RNA, 21 nt, Mycobacterium avium subsp. paratuberculosis
ccaggcugaacgucgucagca

SEQ ID NO: 2820467 - RNA, 17 nt, Mycobacterium avium subsp. paratuberculosis
ccaggcugaccagcgcc

SEQ ID NO: 2820468 - RNA, 19 nt, Mycobacterium avium subsp. paratuberculosis
ccaggcugaccagcgccuc

SEQ ID NO: 2820469 - RNA, 21 nt, Mycobacterium avium subsp. paratuberculosis
ccaggcugaccagcgccucgc

SEQ ID NO: 2820470 - RNA, 17 nt, Mycobacterium avium subsp. paratuberculosis
ccaggcugcucggcggg

SEQ ID NO: 2820471 - RNA, 18 nt, Mycobacterium avium subsp. paratuberculosis
ccaggcugcucggcgggc

SEQ ID NO: 2820472 - RNA, 14 nt, Mycobacterium avium subsp. paratuberculosis
ccaggcuggccagg

SEQ ID NO: 2820473 - RNA, 15 nt, Mycobacterium avium subsp. paratuberculosis
ccaggcuggccaggc

SEQ ID NO: 2820474 - RNA, 14 nt, Mycobacterium avium subsp. paratuberculosis
ccaggcuuggcccg

SEQ ID NO: 2820475 - RNA, 16 nt, Mycobacterium avium subsp. paratuberculosis
ccaggcuuggcccgcc

SEQ ID NO: 2820476 - RNA, 17 nt, Mycobacterium avium subsp. paratuberculosis
ccaggcuuggcccgccg

SEQ ID NO: 2820477 - RNA, 18 nt, Mycobacterium avium subsp. paratuberculosis
ccaggcuuggcccgccgc

SEQ ID NO: 2820478 - RNA, 21 nt, Mycobacterium avium subsp. paratuberculosis
ccaggcuuggcccgccgccgg

SEQ ID NO: 2820479 - RNA, 22 nt, Mycobacterium avium subsp. paratuberculosis
ccaggcuuggcccgccgccggc

SEQ ID NO: 2820480 - RNA, 20 nt, Mycobacterium avium subsp. paratuberculosis
ccagggacaugccgagcagc

SEQ ID NO: 2820481 - RNA, 21 nt, Mycobacterium avium subsp. paratuberculosis
ccagggacaugccgagcagca

SEQ ID NO: 2820482 - RNA, 18 nt, Mycobacterium avium subsp. paratuberculosis
ccagggcagccagcccgc

SEQ ID NO: 2820483 - RNA, 13 nt, Mycobacterium avium subsp. paratuberculosis
ccagggcagcgcc

SEQ ID NO: 2820484 - RNA, 15 nt, Mycobacterium avium subsp. paratuberculosis
ccagggcagcgccuc

SEQ ID NO: 2820485 - RNA, 17 nt, Mycobacterium avium subsp. paratuberculosis
ccagggcagcgcgacca

SEQ ID NO: 2820486 - RNA, 15 nt, Mycobacterium avium subsp. paratuberculosis
ccagggccaccgcgu

SEQ ID NO: 2820487 - RNA, 16 nt, Mycobacterium avium subsp. paratuberculosis
ccagggcccgcagccg

SEQ ID NO: 2820488 - RNA, 12 nt, Mycobacterium avium subsp. paratuberculosis
ccagggcccgcu

SEQ ID NO: 2820489 - RNA, 17 nt, Mycobacterium avium subsp. paratuberculosis
ccagggccgggcgugcc

SEQ ID NO: 2820490 - RNA, 18 nt, Mycobacterium avium subsp. paratuberculosis
ccagggccgggcgugccc

SEQ ID NO: 2820491 - RNA, 22 nt, Mycobacterium avium subsp. paratuberculosis
ccagggccgggcgugcccggcg

SEQ ID NO: 2820492 - RNA, 23 nt, Mycobacterium avium subsp. paratuberculosis
ccagggccgggcgugcccggcgc

SEQ ID NO: 2820493 - RNA, 14 nt, Mycobacterium avium subsp. paratuberculosis
ccagggccucggcg

SEQ ID NO: 2820494 - RNA, 15 nt, Mycobacterium avium subsp. paratuberculosis
ccagggccucggcga

SEQ ID NO: 2820495 - RNA, 16 nt, Mycobacterium avium subsp. paratuberculosis
ccagggccucgucguc

SEQ ID NO: 2820496 - RNA, 16 nt, Mycobacterium avium subsp. paratuberculosis
ccagggcgaccgccgc

SEQ ID NO: 2820497 - RNA, 17 nt, Mycobacterium avium subsp. paratuberculosis
ccagggcgaccgccgcg

SEQ ID NO: 2820498 - RNA, 15 nt, Mycobacterium avium subsp. paratuberculosis
ccagggcgacgccgc

SEQ ID NO: 2820499 - RNA, 20 nt, Mycobacterium avium subsp. paratuberculosis
ccagggcgaggacggcuugg

SEQ ID NO: 2820500 - RNA, 14 nt, Mycobacterium avium subsp. paratuberculosis
ccagggcgaucacc

SEQ ID NO: 2820501 - RNA, 19 nt, Mycobacterium avium subsp. paratuberculosis
ccagggcgaucaccgcggc

SEQ ID NO: 2820502 - RNA, 21 nt, Mycobacterium avium subsp. paratuberculosis
ccagggcgaucaccgcggcca

SEQ ID NO: 2820503 - RNA, 13 nt, Mycobacterium avium subsp. paratuberculosis
ccagggcgcggcg

SEQ ID NO: 2820504 - RNA, 15 nt, Mycobacterium avium subsp. paratuberculosis
ccagggcgcggcgca

SEQ ID NO: 2820505 - RNA, 18 nt, Mycobacterium avium subsp. paratuberculosis
ccagggcgcggcgcaccg

SEQ ID NO: 2820506 - RNA, 14 nt, Mycobacterium avium subsp. paratuberculosis
ccagggcgcgucca

SEQ ID NO: 2820507 - RNA, 12 nt, Mycobacterium avium subsp. paratuberculosis
ccagggcggcgc

SEQ ID NO: 2820508 - RNA, 16 nt, Mycobacterium avium subsp. paratuberculosis
ccagggcggcgccggc

SEQ ID NO: 2820509 - RNA, 18 nt, Mycobacterium avium subsp. paratuberculosis
ccagggcggcgccggcac

SEQ ID NO: 2820510 - RNA, 14 nt, Mycobacterium avium subsp. paratuberculosis
ccagggcgucgagc

SEQ ID NO: 2820511 - RNA, 18 nt, Mycobacterium avium subsp. paratuberculosis
ccagggcucgugcagccg

SEQ ID NO: 2820512 - RNA, 19 nt, Mycobacterium avium subsp. paratuberculosis
ccagggcucgugcagccgg

SEQ ID NO: 2820513 - RNA, 22 nt, Mycobacterium avium subsp. paratuberculosis
ccagggggaguagucggcgauc

SEQ ID NO: 2820514 - RNA, 19 nt, Mycobacterium avium subsp. paratuberculosis
ccagggucucgggcagcag

SEQ ID NO: 2820515 - RNA, 21 nt, Mycobacterium avium subsp. paratuberculosis
ccagggucucgggcagcagca

SEQ ID NO: 2820516 - RNA, 19 nt, Mycobacterium avium subsp. paratuberculosis
ccagggucuucagcccgcg

SEQ ID NO: 2820517 - RNA, 20 nt, Mycobacterium avium subsp. paratuberculosis
ccagggucuucagcccgcgc

SEQ ID NO: 2820518 - RNA, 14 nt, Mycobacterium avium subsp. paratuberculosis
ccagggugccccgc

SEQ ID NO: 2820519 - RNA, 18 nt, Mycobacterium avium subsp. paratuberculosis
ccagggugccccgcaccg

SEQ ID NO: 2820520 - RNA, 17 nt, Mycobacterium avium subsp. paratuberculosis
ccagggugccgacgacc

SEQ ID NO: 2820521 - RNA, 17 nt, Mycobacterium avium subsp. paratuberculosis
ccagggugccgauguag

SEQ ID NO: 2820522 - RNA, 15 nt, Mycobacterium avium subsp. paratuberculosis
ccagggugccgccgg

SEQ ID NO: 2820523 - RNA, 17 nt, Mycobacterium avium subsp. paratuberculosis
ccagggugccgccgggc

SEQ ID NO: 2820524 - RNA, 13 nt, Mycobacterium avium subsp. paratuberculosis
ccagggugccgcu

SEQ ID NO: 2820525 - RNA, 16 nt, Mycobacterium avium subsp. paratuberculosis
ccagggugcgcacgau

SEQ ID NO: 2820526 - RNA, 21 nt, Mycobacterium avium subsp. paratuberculosis
ccagggugcgcacgaucugca

SEQ ID NO: 2820527 - RNA, 16 nt, Mycobacterium avium subsp. paratuberculosis
ccagggugcgcagcgc

SEQ ID NO: 2820528 - RNA, 17 nt, Mycobacterium avium subsp. paratuberculosis
ccagggugcgccgcucg

SEQ ID NO: 2820529 - RNA, 14 nt, Mycobacterium avium subsp. paratuberculosis
ccaggguggccagc

SEQ ID NO: 2820530 - RNA, 20 nt, Mycobacterium avium subsp. paratuberculosis
ccaggguggccagcacgcug

SEQ ID NO: 2820531 - RNA, 16 nt, Mycobacterium avium subsp. paratuberculosis
ccaggguggccccagc

SEQ ID NO: 2820532 - RNA, 18 nt, Mycobacterium avium subsp. paratuberculosis
ccaggguggccccagccc

SEQ ID NO: 2820533 - RNA, 19 nt, Mycobacterium avium subsp. paratuberculosis
ccaggguggccccagcccg

SEQ ID NO: 2820534 - RNA, 21 nt, Mycobacterium avium subsp. paratuberculosis
ccaggguggccccagcccggg

SEQ ID NO: 2820535 - RNA, 13 nt, Mycobacterium avium subsp. paratuberculosis
ccaggguggccgc

SEQ ID NO: 2820536 - RNA, 15 nt, Mycobacterium avium subsp. paratuberculosis
ccaggguggccgcca

SEQ ID NO: 2820537 - RNA, 15 nt, Mycobacterium avium subsp. paratuberculosis
ccaggugcacccgcg

SEQ ID NO: 2820538 - RNA, 19 nt, Mycobacterium avium subsp. paratuberculosis
ccaggugcacccgcggcgc

SEQ ID NO: 2820539 - RNA, 22 nt, Mycobacterium avium subsp. paratuberculosis
ccaggugcagaccggacagcug

SEQ ID NO: 2820540 - RNA, 15 nt, Mycobacterium avium subsp. paratuberculosis
ccaggugcgccgccg

SEQ ID NO: 2820541 - RNA, 16 nt, Mycobacterium avium subsp. paratuberculosis
ccaggugcgccgccgc

SEQ ID NO: 2820542 - RNA, 14 nt, Mycobacterium avium subsp. paratuberculosis
ccagguggcccgac

SEQ ID NO: 2820543 - RNA, 16 nt, Mycobacterium avium subsp. paratuberculosis
ccagguggcccgaccc

SEQ ID NO: 2820544 - RNA, 13 nt, Mycobacterium avium subsp. paratuberculosis
ccagguggccgcu

SEQ ID NO: 2820545 - RNA, 14 nt, Mycobacterium avium subsp. paratuberculosis
ccagguggcgccuc

SEQ ID NO: 2820546 - RNA, 16 nt, Mycobacterium avium subsp. paratuberculosis
ccagguggcgccuccg

SEQ ID NO: 2820547 - RNA, 21 nt, Mycobacterium avium subsp. paratuberculosis
ccagguggcgccuccgcccgg

SEQ ID NO: 2820548 - RNA, 19 nt, Mycobacterium avium subsp. paratuberculosis
ccaggugggcggccaccac

SEQ ID NO: 2820549 - RNA, 16 nt, Mycobacterium avium subsp. paratuberculosis
ccagguggggcacggg

SEQ ID NO: 2820550 - RNA, 19 nt, Mycobacterium avium subsp. paratuberculosis
ccaggugggugaacgccug

SEQ ID NO: 2820551 - RNA, 13 nt, Mycobacterium avium subsp. paratuberculosis
ccagguggugaac

SEQ ID NO: 2820552 - RNA, 16 nt, Mycobacterium avium subsp. paratuberculosis
ccagguguaggcgugg

SEQ ID NO: 2820553 - RNA, 17 nt, Mycobacterium avium subsp. paratuberculosis
ccagguguccggcccga

SEQ ID NO: 2820554 - RNA, 15 nt, Mycobacterium avium subsp. paratuberculosis
ccaggugugcccgcc

SEQ ID NO: 2820555 - RNA, 20 nt, Mycobacterium avium subsp. paratuberculosis
ccagguguuguccgguaggc

SEQ ID NO: 2820556 - RNA, 16 nt, Mycobacterium avium subsp. paratuberculosis
ccagguucagcccggc

SEQ ID NO: 2820557 - RNA, 17 nt, Mycobacterium avium subsp. paratuberculosis
ccagguucagcccggcg

SEQ ID NO: 2820558 - RNA, 18 nt, Mycobacterium avium subsp. paratuberculosis
ccagguucagcccggcgc

SEQ ID NO: 2820559 - RNA, 14 nt, Mycobacterium avium subsp. paratuberculosis
ccagguucaggccc

SEQ ID NO: 2820560 - RNA, 19 nt, Mycobacterium avium subsp. paratuberculosis
ccagguucaggcccgcgcc

SEQ ID NO: 2820561 - RNA, 20 nt, Mycobacterium avium subsp. paratuberculosis
ccagguucaggcccgcgccg

SEQ ID NO: 2820562 - RNA, 19 nt, Mycobacterium avium subsp. paratuberculosis
ccagguuccaguacccgcg

SEQ ID NO: 2820563 - RNA, 23 nt, Mycobacterium avium subsp. paratuberculosis
ccagguuccaguacccgcgcaug

SEQ ID NO: 2820564 - RNA, 13 nt, Mycobacterium avium subsp. paratuberculosis
ccagguuccggug

SEQ ID NO: 2820565 - RNA, 22 nt, Mycobacterium avium subsp. paratuberculosis
ccagguuccggugucgagccgg

SEQ ID NO: 2820566 - RNA, 23 nt, Mycobacterium avium subsp. paratuberculosis
ccagguuccggugucgagccggu

SEQ ID NO: 2820567 - RNA, 15 nt, Mycobacterium avium subsp. paratuberculosis
ccagguucgccgccc

SEQ ID NO: 2820568 - RNA, 14 nt, Mycobacterium avium subsp. paratuberculosis
ccagguucgcgcag

SEQ ID NO: 2820569 - RNA, 19 nt, Mycobacterium avium subsp. paratuberculosis
ccagguucuccggcccgcu

SEQ ID NO: 2820570 - RNA, 20 nt, Mycobacterium avium subsp. paratuberculosis
ccagguucuccggcccgcuc

SEQ ID NO: 2820571 - RNA, 17 nt, Mycobacterium avium subsp. paratuberculosis
ccagguugaccaccagc

SEQ ID NO: 2820572 - RNA, 20 nt, Mycobacterium avium subsp. paratuberculosis
ccagguugaccaccagcgug

SEQ ID NO: 2820573 - RNA, 13 nt, Mycobacterium avium subsp. paratuberculosis
ccagguugcgccg

SEQ ID NO: 2820574 - RNA, 20 nt, Mycobacterium avium subsp. paratuberculosis
ccagguugcgccguccggcc

SEQ ID NO: 2820575 - RNA, 21 nt, Mycobacterium avium subsp. paratuberculosis
ccagguugcgccguccggcca

SEQ ID NO: 2820576 - RNA, 18 nt, Mycobacterium avium subsp. paratuberculosis
ccagguuggcggcggccc

SEQ ID NO: 2820577 - RNA, 23 nt, Mycobacterium avium subsp. paratuberculosis
ccagguuggucagcagcagcgcc

SEQ ID NO: 2820578 - RNA, 23 nt, Mycobacterium avium subsp. paratuberculosis
ccagguuggucucgauggucgcc

SEQ ID NO: 2820579 - RNA, 20 nt, Mycobacterium avium subsp. paratuberculosis
ccagguuguaggugcccgau

SEQ ID NO: 2820580 - RNA, 15 nt, Mycobacterium avium subsp. paratuberculosis
ccagguugucgccgc

SEQ ID NO: 2820581 - RNA, 19 nt, Mycobacterium avium subsp. paratuberculosis
ccagguugucgccgcgcca

SEQ ID NO: 2820582 - RNA, 22 nt, Mycobacterium avium subsp. paratuberculosis
ccagguugucgccgcgccagcc

SEQ ID NO: 2820583 - RNA, 23 nt, Mycobacterium avium subsp. paratuberculosis
ccagguugucgccgcgccagccg

SEQ ID NO: 2820584 - RNA, 15 nt, Mycobacterium avium subsp. paratuberculosis
ccagguugucgucgg

SEQ ID NO: 2820585 - RNA, 21 nt, Mycobacterium avium subsp. paratuberculosis
ccagguuguggugcacgaacg

SEQ ID NO: 2820586 - RNA, 23 nt, Mycobacterium avium subsp. paratuberculosis
ccagguuguggugcacgaacggc

SEQ ID NO: 2820587 - RNA, 22 nt, Mycobacterium avium subsp. paratuberculosis
ccagguuugcugcgagaucggc

SEQ ID NO: 2820588 - RNA, 13 nt, Mycobacterium avium subsp. paratuberculosis
ccaguacaccgcg

SEQ ID NO: 2820589 - RNA, 14 nt, Mycobacterium avium subsp. paratuberculosis
ccaguacaccgcga

SEQ ID NO: 2820590 - RNA, 15 nt, Mycobacterium avium subsp. paratuberculosis
ccaguaccagcggcc

SEQ ID NO: 2820591 - RNA, 18 nt, Mycobacterium avium subsp. paratuberculosis
ccaguaccagcggccguc

SEQ ID NO: 2820592 - RNA, 22 nt, Mycobacterium avium subsp. paratuberculosis
ccaguaccagcggccgucgcgc

SEQ ID NO: 2820593 - RNA, 13 nt, Mycobacterium avium subsp. paratuberculosis
ccaguaccgggcc

SEQ ID NO: 2820594 - RNA, 19 nt, Mycobacterium avium subsp. paratuberculosis
ccaguagaaguggccgacc

SEQ ID NO: 2820595 - RNA, 22 nt, Mycobacterium avium subsp. paratuberculosis
ccaguaggucacccgguccccg

SEQ ID NO: 2820596 - RNA, 18 nt, Mycobacterium avium subsp. paratuberculosis
ccaguaguggaucagcca

SEQ ID NO: 2820597 - RNA, 22 nt, Mycobacterium avium subsp. paratuberculosis
ccaguccagcgaaucgaccggg

SEQ ID NO: 2820598 - RNA, 13 nt, Mycobacterium avium subsp. paratuberculosis
ccaguccaggccg

SEQ ID NO: 2820599 - RNA, 16 nt, Mycobacterium avium subsp. paratuberculosis
ccaguccaggccgccg

SEQ ID NO: 2820600 - RNA, 17 nt, Mycobacterium avium subsp. paratuberculosis
ccagucccagcacagcc

SEQ ID NO: 2820601 - RNA, 23 nt, Mycobacterium avium subsp. paratuberculosis
ccagucccaguuguuuccccagc

SEQ ID NO: 2820602 - RNA, 13 nt, Mycobacterium avium subsp. paratuberculosis
ccaguccgccgcc

SEQ ID NO: 2820603 - RNA, 22 nt, Mycobacterium avium subsp. paratuberculosis
ccaguccgcgugacaagccggc

SEQ ID NO: 2820604 - RNA, 18 nt, Mycobacterium avium subsp. paratuberculosis
ccaguccggcagcagcga

SEQ ID NO: 2820605 - RNA, 14 nt, Mycobacterium avium subsp. paratuberculosis
ccaguccggccagc

SEQ ID NO: 2820606 - RNA, 23 nt, Mycobacterium avium subsp. paratuberculosis
ccaguccggccgugaugcgccgg

SEQ ID NO: 2820607 - RNA, 13 nt, Mycobacterium avium subsp. paratuberculosis
ccaguccggcgcc

SEQ ID NO: 2820608 - RNA, 18 nt, Mycobacterium avium subsp. paratuberculosis
ccaguccggcgcccggcu

SEQ ID NO: 2820609 - RNA, 15 nt, Mycobacterium avium subsp. paratuberculosis
ccaguccggcgccga

SEQ ID NO: 2820610 - RNA, 16 nt, Mycobacterium avium subsp. paratuberculosis
ccaguccggcgccgac

SEQ ID NO: 2820611 - RNA, 22 nt, Mycobacterium avium subsp. paratuberculosis
ccaguccggcgccgacccccgc

SEQ ID NO: 2820612 - RNA, 15 nt, Mycobacterium avium subsp. paratuberculosis
ccaguccugcagcuc

SEQ ID NO: 2820613 - RNA, 17 nt, Mycobacterium avium subsp. paratuberculosis
ccaguccugcagcucgc

SEQ ID NO: 2820614 - RNA, 15 nt, Mycobacterium avium subsp. paratuberculosis
ccaguccugggccag

SEQ ID NO: 2820615 - RNA, 17 nt, Mycobacterium avium subsp. paratuberculosis
ccaguccugggccgggg

SEQ ID NO: 2820616 - RNA, 13 nt, Mycobacterium avium subsp. paratuberculosis
ccagucgaagacc

SEQ ID NO: 2820617 - RNA, 18 nt, Mycobacterium avium subsp. paratuberculosis
ccagucgaagaccacgaa

SEQ ID NO: 2820618 - RNA, 20 nt, Mycobacterium avium subsp. paratuberculosis
ccagucgaagaccacgaacu

SEQ ID NO: 2820619 - RNA, 19 nt, Mycobacterium avium subsp. paratuberculosis
ccagucgaugucgguggcg

SEQ ID NO: 2820620 - RNA, 22 nt, Mycobacterium avium subsp. paratuberculosis
ccagucgcauaugcgugggccc

SEQ ID NO: 2820621 - RNA, 21 nt, Mycobacterium avium subsp. paratuberculosis
ccaucaccuccuuggccaggc

SEQ ID NO: 2820622 - RNA, 21 nt, Mycobacterium avium subsp. paratuberculosis
ccaucacgcagaacucgucgc

SEQ ID NO: 2820623 - RNA, 14 nt, Mycobacterium avium subsp. paratuberculosis
ccaucacgucgcgc

SEQ ID NO: 2820624 - RNA, 15 nt, Mycobacterium avium subsp. paratuberculosis
ccaucacgucgcgcu

SEQ ID NO: 2820625 - RNA, 14 nt, Mycobacterium avium subsp. paratuberculosis
ccaucacgucgggg

SEQ ID NO: 2820626 - RNA, 24 nt, Mycobacterium avium subsp. paratuberculosis
ccaucagaacgcccgcaacuccac

SEQ ID NO: 2820627 - RNA, 14 nt, Mycobacterium avium subsp. paratuberculosis
ccaucagcaccgaa

SEQ ID NO: 2820628 - RNA, 18 nt, Mycobacterium avium subsp. paratuberculosis
ccaucagcaccgccucgg

SEQ ID NO: 2820629 - RNA, 15 nt, Mycobacterium avium subsp. paratuberculosis
ccaucagcacgcccu

SEQ ID NO: 2820630 - RNA, 16 nt, Mycobacterium avium subsp. paratuberculosis
ccaucagcagcgccuc

SEQ ID NO: 2820631 - RNA, 21 nt, Mycobacterium avium subsp. paratuberculosis
ccaucagcagcgccucgccgg

SEQ ID NO: 2820632 - RNA, 13 nt, Mycobacterium avium subsp. paratuberculosis
ccaucagcccggc

SEQ ID NO: 2820633 - RNA, 15 nt, Mycobacterium avium subsp. paratuberculosis
ccaucagccgccguc

SEQ ID NO: 2820634 - RNA, 18 nt, Mycobacterium avium subsp. paratuberculosis
ccaucagcgcccgcgcgg

SEQ ID NO: 2820635 - RNA, 24 nt, Mycobacterium avium subsp. paratuberculosis
ccaucagcgcccgcgcgggcugca

SEQ ID NO: 2820636 - RNA, 18 nt, Mycobacterium avium subsp. paratuberculosis
ccaucagcgcccgggugg

SEQ ID NO: 2820637 - RNA, 20 nt, Mycobacterium avium subsp. paratuberculosis
ccaucaggaugcccgggccg

SEQ ID NO: 2820638 - RNA, 22 nt, Mycobacterium avium subsp. paratuberculosis
ccaucaggccggccugccaccg

SEQ ID NO: 2820639 - RNA, 14 nt, Mycobacterium avium subsp. paratuberculosis
ccaucauccgcugg

SEQ ID NO: 2820640 - RNA, 15 nt, Mycobacterium avium subsp. paratuberculosis
ccaucauggccuccc

SEQ ID NO: 2820641 - RNA, 14 nt, Mycobacterium avium subsp. paratuberculosis
ccaucauggcgcug

SEQ ID NO: 2820642 - RNA, 20 nt, Mycobacterium avium subsp. paratuberculosis
ccauccacucgggccagccc

SEQ ID NO: 2820643 - RNA, 23 nt, Mycobacterium avium subsp. paratuberculosis
ccauccagugcaguucgaugccg

SEQ ID NO: 2820644 - RNA, 16 nt, Mycobacterium avium subsp. paratuberculosis
ccaucccgauccgcgc

SEQ ID NO: 2820645 - RNA, 21 nt, Mycobacterium avium subsp. paratuberculosis
ccaucccgauccgcgccgccg

SEQ ID NO: 2820646 - RNA, 20 nt, Mycobacterium avium subsp. paratuberculosis
ccaucccgccgccgaacagc

SEQ ID NO: 2820647 - RNA, 22 nt, Mycobacterium avium subsp. paratuberculosis
ccaucccggggacaccgggcac

SEQ ID NO: 2820648 - RNA, 13 nt, Mycobacterium avium subsp. paratuberculosis
ccaucccggugga

SEQ ID NO: 2820649 - RNA, 17 nt, Mycobacterium avium subsp. paratuberculosis
ccaucccgguggacgcg

SEQ ID NO: 2820650 - RNA, 23 nt, Mycobacterium avium subsp. paratuberculosis
ccaucccguugcgcaugacggcc

SEQ ID NO: 2820651 - RNA, 17 nt, Mycobacterium avium subsp. paratuberculosis
ccaucccucguucagca

SEQ ID NO: 2820652 - RNA, 18 nt, Mycobacterium avium subsp. paratuberculosis
ccauccgcagcccgucga

SEQ ID NO: 2820653 - RNA, 14 nt, Mycobacterium avium subsp. paratuberculosis
ccauccgccacccg

SEQ ID NO: 2820654 - RNA, 22 nt, Mycobacterium avium subsp. paratuberculosis
ccauccgccacccgcugcucga

SEQ ID NO: 2820655 - RNA, 12 nt, Mycobacterium avium subsp. paratuberculosis
ccauccgcgacg

SEQ ID NO: 2820656 - RNA, 18 nt, Mycobacterium avium subsp. paratuberculosis
ccauccgcgacgccagca

SEQ ID NO: 2820657 - RNA, 19 nt, Mycobacterium avium subsp. paratuberculosis
ccauccgcgacgccagcac

SEQ ID NO: 2820658 - RNA, 21 nt, Mycobacterium avium subsp. paratuberculosis
ccauccgcgccgaacgcacca

SEQ ID NO: 2820659 - RNA, 12 nt, Mycobacterium avium subsp. paratuberculosis
ccauccgcggcc

SEQ ID NO: 2820660 - RNA, 16 nt, Mycobacterium avium subsp. paratuberculosis
ccauccgcggccaccg

SEQ ID NO: 2820661 - RNA, 21 nt, Mycobacterium avium subsp. paratuberculosis
ccauccgcggccaccgggacc

SEQ ID NO: 2820662 - RNA, 15 nt, Mycobacterium avium subsp. paratuberculosis
ccauccgcugcgcgu

SEQ ID NO: 2820663 - RNA, 12 nt, Mycobacterium avium subsp. paratuberculosis
ccauccggccgg

SEQ ID NO: 2820664 - RNA, 14 nt, Mycobacterium avium subsp. paratuberculosis
ccauccggcgccgc

SEQ ID NO: 2820665 - RNA, 15 nt, Mycobacterium avium subsp. paratuberculosis
ccauccggcgccgcg

SEQ ID NO: 2820666 - RNA, 13 nt, Mycobacterium avium subsp. paratuberculosis
ccauccgggagac

SEQ ID NO: 2820667 - RNA, 11 nt, Mycobacterium avium subsp. paratuberculosis
ccauccgggcg

SEQ ID NO: 2820668 - RNA, 13 nt, Mycobacterium avium subsp. paratuberculosis
ccauccgggcggc

SEQ ID NO: 2820669 - RNA, 20 nt, Mycobacterium avium subsp. paratuberculosis
ccauccgggcggcaucgcgc

SEQ ID NO: 2820670 - RNA, 15 nt, Mycobacterium avium subsp. paratuberculosis
ccauccgggcggcca

SEQ ID NO: 2820671 - RNA, 18 nt, Mycobacterium avium subsp. paratuberculosis
ccauccgggcggccagcc

SEQ ID NO: 2820672 - RNA, 23 nt, Mycobacterium avium subsp. paratuberculosis
ccaucgaccggaugaugccggug

SEQ ID NO: 2820673 - RNA, 12 nt, Mycobacterium avium subsp. paratuberculosis
ccaucgacgcug

SEQ ID NO: 2820674 - RNA, 14 nt, Mycobacterium avium subsp. paratuberculosis
ccaucgacgcugag

SEQ ID NO: 2820675 - RNA, 19 nt, Mycobacterium avium subsp. paratuberculosis
ccaucgacggaucgcccug

SEQ ID NO: 2820676 - RNA, 17 nt, Mycobacterium avium subsp. paratuberculosis
ccaucgacuccagcacc

SEQ ID NO: 2820677 - RNA, 20 nt, Mycobacterium avium subsp. paratuberculosis
ccaucgacuccagcaccggc

SEQ ID NO: 2820678 - RNA, 23 nt, Mycobacterium avium subsp. paratuberculosis
ccaucgacuccagcaccggcgcc

SEQ ID NO: 2820679 - RNA, 21 nt, Mycobacterium avium subsp. paratuberculosis
ccaucgaggcgaucaucgccc

SEQ ID NO: 2820680 - RNA, 16 nt, Mycobacterium avium subsp. paratuberculosis
ccaucgauggcggugu

SEQ ID NO: 2820681 - RNA, 15 nt, Mycobacterium avium subsp. paratuberculosis
ccaucgccacgccgu

SEQ ID NO: 2820682 - RNA, 20 nt, Mycobacterium avium subsp. paratuberculosis
ccaucgccaggaaccacacc

SEQ ID NO: 2820683 - RNA, 15 nt, Mycobacterium avium subsp. paratuberculosis
ccaucgcccggugcg

SEQ ID NO: 2820684 - RNA, 20 nt, Mycobacterium avium subsp. paratuberculosis
ccaucgcccggugcgccagc

SEQ ID NO: 2820685 - RNA, 12 nt, Mycobacterium avium subsp. paratuberculosis
ccaucgccgcca

SEQ ID NO: 2820686 - RNA, 19 nt, Mycobacterium avium subsp. paratuberculosis
ccaucgccgccaucgccgc

SEQ ID NO: 2820687 - RNA, 21 nt, Mycobacterium avium subsp. paratuberculosis
ccaucgccgccaucgccgccg

SEQ ID NO: 2820688 - RNA, 15 nt, Mycobacterium avium subsp. paratuberculosis
ccaucgccgccgcca

SEQ ID NO: 2820689 - RNA, 12 nt, Mycobacterium avium subsp. paratuberculosis
ccaucgccgcgc

SEQ ID NO: 2820690 - RNA, 15 nt, Mycobacterium avium subsp. paratuberculosis
ccaucgccgcgcacc

SEQ ID NO: 2820691 - RNA, 20 nt, Mycobacterium avium subsp. paratuberculosis
ccaucgccgcgguggcgccg

SEQ ID NO: 2820692 - RNA, 17 nt, Mycobacterium avium subsp. paratuberculosis
ccaucgccucgaccagc

SEQ ID NO: 2820693 - RNA, 12 nt, Mycobacterium avium subsp. paratuberculosis
ccaucgcggccg

SEQ ID NO: 2820694 - RNA, 13 nt, Mycobacterium avium subsp. paratuberculosis
ccaucgcggccgc

SEQ ID NO: 2820695 - RNA, 13 nt, Mycobacterium avium subsp. paratuberculosis
ccaucgcggucag

SEQ ID NO: 2820696 - RNA, 13 nt, Mycobacterium avium subsp. paratuberculosis
ccaucgcgucguc

SEQ ID NO: 2820697 - RNA, 20 nt, Mycobacterium avium subsp. paratuberculosis
ccaucgcugguggugagaau

SEQ ID NO: 2820698 - RNA, 18 nt, Mycobacterium avium subsp. paratuberculosis
ccaucggcagacccagca

SEQ ID NO: 2820699 - RNA, 15 nt, Mycobacterium avium subsp. paratuberculosis
ccaucgggaccgcgg

SEQ ID NO: 2820700 - RNA, 15 nt, Mycobacterium avium subsp. paratuberculosis
ccaucgggcccagca

SEQ ID NO: 2820701 - RNA, 18 nt, Mycobacterium avium subsp. paratuberculosis
ccaucgggcccagcagcc

SEQ ID NO: 2820702 - RNA, 14 nt, Mycobacterium avium subsp. paratuberculosis
ccaucggggcuaca

SEQ ID NO: 2820703 - RNA, 20 nt, Mycobacterium avium subsp. paratuberculosis
ccaucggggcuacaaaacca

SEQ ID NO: 2820704 - RNA, 15 nt, Mycobacterium avium subsp. paratuberculosis
ccaucgggucgucgg

SEQ ID NO: 2820705 - RNA, 20 nt, Mycobacterium avium subsp. paratuberculosis
ccaucguggccgcguagaag

SEQ ID NO: 2820706 - RNA, 13 nt, Mycobacterium avium subsp. paratuberculosis
ccauuccgccaga

SEQ ID NO: 2820707 - RNA, 18 nt, Mycobacterium avium subsp. paratuberculosis
ccauucgggccagcgccg

SEQ ID NO: 2820708 - RNA, 22 nt, Mycobacterium avium subsp. paratuberculosis
ccauucggucucgccccggccg

SEQ ID NO: 2820709 - RNA, 16 nt, Mycobacterium avium subsp. paratuberculosis
ccauucgucggcgguc

SEQ ID NO: 2820710 - RNA, 21 nt, Mycobacterium avium subsp. paratuberculosis
ccauucguggcugaacagcgc

SEQ ID NO: 2820711 - RNA, 15 nt, Mycobacterium avium subsp. paratuberculosis
ccauugccgcgccgg

SEQ ID NO: 2820712 - RNA, 19 nt, Mycobacterium avium subsp. paratuberculosis
ccauugcgggaagggcccg

SEQ ID NO: 2820713 - RNA, 19 nt, Mycobacterium avium subsp. paratuberculosis
ccauugggccgcggcgucg

SEQ ID NO: 2820714 - RNA, 20 nt, Mycobacterium avium subsp. paratuberculosis
ccauugggccgcggcgucgg

SEQ ID NO: 2820715 - RNA, 14 nt, Mycobacterium avium subsp. paratuberculosis
ccauugucggaucg

SEQ ID NO: 2820716 - RNA, 15 nt, Mycobacterium avium subsp. paratuberculosis
cccaaaacccggcau

SEQ ID NO: 2820717 - RNA, 22 nt, Mycobacterium avium subsp. paratuberculosis
cccaacaacucgacguucggcg

SEQ ID NO: 2820718 - RNA, 20 nt, Mycobacterium avium subsp. paratuberculosis
cccaaccccccuuggcggca

SEQ ID NO: 2820719 - RNA, 20 nt, Mycobacterium avium subsp. paratuberculosis
cccaaccgcauucggccgcc

SEQ ID NO: 2820720 - RNA, 15 nt, Mycobacterium avium subsp. paratuberculosis
cccaacgacgucggc

SEQ ID NO: 2820721 - RNA, 18 nt, Mycobacterium avium subsp. paratuberculosis
cccaacgcagcgcauccg

SEQ ID NO: 2820722 - RNA, 14 nt, Mycobacterium avium subsp. paratuberculosis
cccaacggcgugca

SEQ ID NO: 2820723 - RNA, 17 nt, Mycobacterium avium subsp. paratuberculosis
cccaacgguccaacgug

SEQ ID NO: 2820724 - RNA, 14 nt, Mycobacterium avium subsp. paratuberculosis
cccaacgucgacuu

SEQ ID NO: 2820725 - RNA, 16 nt, Mycobacterium avium subsp. paratuberculosis
cccaacgugaugagcg

SEQ ID NO: 2820726 - RNA, 19 nt, Mycobacterium avium subsp. paratuberculosis
cccaacuacccgccgacgc

SEQ ID NO: 2820727 - RNA, 23 nt, Mycobacterium avium subsp. paratuberculosis
cccaacucaugggcccggcccgu

SEQ ID NO: 2820728 - RNA, 23 nt, Mycobacterium avium subsp. paratuberculosis
cccaacuggcgaccgguccgcgg

SEQ ID NO: 2820729 - RNA, 19 nt, Mycobacterium avium subsp. paratuberculosis
cccaauaccguuccgcccc

SEQ ID NO: 2820730 - RNA, 16 nt, Mycobacterium avium subsp. paratuberculosis
cccaauccucgccgag

SEQ ID NO: 2820731 - RNA, 15 nt, Mycobacterium avium subsp. paratuberculosis
cccacaccaccaccg

SEQ ID NO: 2820732 - RNA, 16 nt, Mycobacterium avium subsp. paratuberculosis
cccacaccgacaccgg

SEQ ID NO: 2820733 - RNA, 17 nt, Mycobacterium avium subsp. paratuberculosis
cccacaccgacaccggc

SEQ ID NO: 2820734 - RNA, 19 nt, Mycobacterium avium subsp. paratuberculosis
cccacaccgacaccggccg

SEQ ID NO: 2820735 - RNA, 13 nt, Mycobacterium avium subsp. paratuberculosis
cccacacgcucgg

SEQ ID NO: 2820736 - RNA, 23 nt, Mycobacterium avium subsp. paratuberculosis
cccacacgggugugacauccccg

SEQ ID NO: 2820737 - RNA, 12 nt, Mycobacterium avium subsp. paratuberculosis
cccacagcagcc

SEQ ID NO: 2820738 - RNA, 11 nt, Mycobacterium avium subsp. paratuberculosis
cccacagcagg

SEQ ID NO: 2820739 - RNA, 13 nt, Mycobacterium avium subsp. paratuberculosis
cccacagcaggua

SEQ ID NO: 2820740 - RNA, 12 nt, Mycobacterium avium subsp. paratuberculosis
cccacagcgcca

SEQ ID NO: 2820741 - RNA, 19 nt, Mycobacterium avium subsp. paratuberculosis
cccacagcgccagcacggc

SEQ ID NO: 2820742 - RNA, 14 nt, Mycobacterium avium subsp. paratuberculosis
cccacagcgcgccc

SEQ ID NO: 2820743 - RNA, 15 nt, Mycobacterium avium subsp. paratuberculosis
cccacagcggggucg

SEQ ID NO: 2820744 - RNA, 16 nt, Mycobacterium avium subsp. paratuberculosis
cccacagcggggucgg

SEQ ID NO: 2820745 - RNA, 20 nt, Mycobacterium avium subsp. paratuberculosis
cccacagcugacgggccggc

SEQ ID NO: 2820746 - RNA, 22 nt, Mycobacterium avium subsp. paratuberculosis
cccacagcugacgggccggcgg

SEQ ID NO: 2820747 - RNA, 17 nt, Mycobacterium avium subsp. paratuberculosis
cccacagcuugccggag

SEQ ID NO: 2820748 - RNA, 14 nt, Mycobacterium avium subsp. paratuberculosis
cccacagucgcugg

SEQ ID NO: 2820749 - RNA, 23 nt, Mycobacterium avium subsp. paratuberculosis
cccacagucgcuggguguaaccg

SEQ ID NO: 2820750 - RNA, 22 nt, Mycobacterium avium subsp. paratuberculosis
cccacauacaccgggaucggcg

SEQ ID NO: 2820751 - RNA, 13 nt, Mycobacterium avium subsp. paratuberculosis
cccacauucggcg

SEQ ID NO: 2820752 - RNA, 21 nt, Mycobacterium avium subsp. paratuberculosis
cccacauucggcgaaccaggc

SEQ ID NO: 2820753 - RNA, 14 nt, Mycobacterium avium subsp. paratuberculosis
cccaccacaucggu

SEQ ID NO: 2820754 - RNA, 19 nt, Mycobacterium avium subsp. paratuberculosis
cccaccacauucccgccgc

SEQ ID NO: 2820755 - RNA, 21 nt, Mycobacterium avium subsp. paratuberculosis
cccaccacauucccgccgccg

SEQ ID NO: 2820756 - RNA, 22 nt, Mycobacterium avium subsp. paratuberculosis
cccaccaccacgaggaccagca

SEQ ID NO: 2820757 - RNA, 11 nt, Mycobacterium avium subsp. paratuberculosis
cccaccaccag

SEQ ID NO: 2820758 - RNA, 14 nt, Mycobacterium avium subsp. paratuberculosis
cccaccaccagggg

SEQ ID NO: 2820759 - RNA, 19 nt, Mycobacterium avium subsp. paratuberculosis
cccaccaccgacagcaccc

SEQ ID NO: 2820760 - RNA, 12 nt, Mycobacterium avium subsp. paratuberculosis
cccaccaccgcc

SEQ ID NO: 2820761 - RNA, 13 nt, Mycobacterium avium subsp. paratuberculosis
cccaccaccgccg

SEQ ID NO: 2820762 - RNA, 15 nt, Mycobacterium avium subsp. paratuberculosis
cccaccaccgccggc

SEQ ID NO: 2820763 - RNA, 21 nt, Mycobacterium avium subsp. paratuberculosis
cccaccaccgccggcccaggc

SEQ ID NO: 2820764 - RNA, 20 nt, Mycobacterium avium subsp. paratuberculosis
cccaccaccgccucgacggu

SEQ ID NO: 2820765 - RNA, 12 nt, Mycobacterium avium subsp. paratuberculosis
cccaccaccggc

SEQ ID NO: 2820766 - RNA, 20 nt, Mycobacterium avium subsp. paratuberculosis
cccaccacgaacgcgccgcc

SEQ ID NO: 2820767 - RNA, 24 nt, Mycobacterium avium subsp. paratuberculosis
cccaccacgaacgcgccgccgagc

SEQ ID NO: 2820768 - RNA, 18 nt, Mycobacterium avium subsp. paratuberculosis
cccaccacgaagcuggcg

SEQ ID NO: 2820769 - RNA, 12 nt, Mycobacterium avium subsp. paratuberculosis
cccaccagcagg

SEQ ID NO: 2820770 - RNA, 14 nt, Mycobacterium avium subsp. paratuberculosis
cccaccagcagguc

SEQ ID NO: 2820771 - RNA, 14 nt, Mycobacterium avium subsp. paratuberculosis
cccaccagcaucuc

SEQ ID NO: 2820772 - RNA, 17 nt, Mycobacterium avium subsp. paratuberculosis
cccaccagccggccggc

SEQ ID NO: 2820773 - RNA, 13 nt, Mycobacterium avium subsp. paratuberculosis
cccaccaggcgcg

SEQ ID NO: 2820774 - RNA, 14 nt, Mycobacterium avium subsp. paratuberculosis
cccaccaggcgcgg

SEQ ID NO: 2820775 - RNA, 16 nt, Mycobacterium avium subsp. paratuberculosis
cccaccaggcgcgggc

SEQ ID NO: 2820776 - RNA, 12 nt, Mycobacterium avium subsp. paratuberculosis
cccaccaggucg

SEQ ID NO: 2820777 - RNA, 16 nt, Mycobacterium avium subsp. paratuberculosis
cccaccaucccgccgc

SEQ ID NO: 2820778 - RNA, 17 nt, Mycobacterium avium subsp. paratuberculosis
cccaccaugagcagacc

SEQ ID NO: 2820779 - RNA, 18 nt, Mycobacterium avium subsp. paratuberculosis
cccaccaugagcagaccg

SEQ ID NO: 2820780 - RNA, 15 nt, Mycobacterium avium subsp. paratuberculosis
cccaccccgagcagg

SEQ ID NO: 2820781 - RNA, 21 nt, Mycobacterium avium subsp. paratuberculosis
cccaccccggcguccacgccg

SEQ ID NO: 2820782 - RNA, 21 nt, Mycobacterium avium subsp. paratuberculosis
cccacccgaugaccggcccgg

SEQ ID NO: 2820783 - RNA, 17 nt, Mycobacterium avium subsp. paratuberculosis
cccacccgcaacgcuga

SEQ ID NO: 2820784 - RNA, 13 nt, Mycobacterium avium subsp. paratuberculosis
cccacccgcacgc

SEQ ID NO: 2820785 - RNA, 13 nt, Mycobacterium avium subsp. paratuberculosis
cccacccgccagc

SEQ ID NO: 2820786 - RNA, 17 nt, Mycobacterium avium subsp. paratuberculosis
cccacccgccagcccgc

SEQ ID NO: 2820787 - RNA, 22 nt, Mycobacterium avium subsp. paratuberculosis
cccacccgccagcccgcgucgu

SEQ ID NO: 2820788 - RNA, 13 nt, Mycobacterium avium subsp. paratuberculosis
cccacccgcgccg

SEQ ID NO: 2820789 - RNA, 17 nt, Mycobacterium avium subsp. paratuberculosis
cccacccgcgccggcag

SEQ ID NO: 2820790 - RNA, 20 nt, Mycobacterium avium subsp. paratuberculosis
cccacccgcgccggcagauu

SEQ ID NO: 2820791 - RNA, 19 nt, Mycobacterium avium subsp. paratuberculosis
cccagacaggccggccgcu

SEQ ID NO: 2820792 - RNA, 14 nt, Mycobacterium avium subsp. paratuberculosis
cccagacccagcau

SEQ ID NO: 2820793 - RNA, 21 nt, Mycobacterium avium subsp. paratuberculosis
cccagacgaugucgucgccgg

SEQ ID NO: 2820794 - RNA, 23 nt, Mycobacterium avium subsp. paratuberculosis
cccagacgaugucgucgccggug

SEQ ID NO: 2820795 - RNA, 16 nt, Mycobacterium avium subsp. paratuberculosis
cccagacgcgggcgcc

SEQ ID NO: 2820796 - RNA, 18 nt, Mycobacterium avium subsp. paratuberculosis
cccagacgcgggcgccca

SEQ ID NO: 2820797 - RNA, 13 nt, Mycobacterium avium subsp. paratuberculosis
cccagacgucgac

SEQ ID NO: 2820798 - RNA, 14 nt, Mycobacterium avium subsp. paratuberculosis
cccagacgucgacc

SEQ ID NO: 2820799 - RNA, 20 nt, Mycobacterium avium subsp. paratuberculosis
cccagacguuuccguccggc

SEQ ID NO: 2820800 - RNA, 23 nt, Mycobacterium avium subsp. paratuberculosis
cccagacguuuccguccggcgac

SEQ ID NO: 2820801 - RNA, 14 nt, Mycobacterium avium subsp. paratuberculosis
cccagauacgccgc

SEQ ID NO: 2820802 - RNA, 15 nt, Mycobacterium avium subsp. paratuberculosis
cccagauacgccgcg

SEQ ID NO: 2820803 - RNA, 17 nt, Mycobacterium avium subsp. paratuberculosis
cccagauacgccgcgac

SEQ ID NO: 2820804 - RNA, 19 nt, Mycobacterium avium subsp. paratuberculosis
cccagauacgccgcgacga

SEQ ID NO: 2820805 - RNA, 15 nt, Mycobacterium avium subsp. paratuberculosis
cccagaucgacgccg

SEQ ID NO: 2820806 - RNA, 12 nt, Mycobacterium avium subsp. paratuberculosis
cccagaucgccc

SEQ ID NO: 2820807 - RNA, 16 nt, Mycobacterium avium subsp. paratuberculosis
cccagaucgcccgggc

SEQ ID NO: 2820808 - RNA, 19 nt, Mycobacterium avium subsp. paratuberculosis
cccagaucgcccgggcggc

SEQ ID NO: 2820809 - RNA, 22 nt, Mycobacterium avium subsp. paratuberculosis
cccagaucgcgguccaccagaa

SEQ ID NO: 2820810 - RNA, 18 nt, Mycobacterium avium subsp. paratuberculosis
cccagaucguagggcucg

SEQ ID NO: 2820811 - RNA, 20 nt, Mycobacterium avium subsp. paratuberculosis
cccagaucguagggcucggc

SEQ ID NO: 2820812 - RNA, 14 nt, Mycobacterium avium subsp. paratuberculosis
cccagaugcccagc

SEQ ID NO: 2820813 - RNA, 14 nt, Mycobacterium avium subsp. paratuberculosis
cccagaugccgccg

SEQ ID NO: 2820814 - RNA, 13 nt, Mycobacterium avium subsp. paratuberculosis
cccagaugccggc

SEQ ID NO: 2820815 - RNA, 16 nt, Mycobacterium avium subsp. paratuberculosis
cccagaugcgcgacgg

SEQ ID NO: 2820816 - RNA, 18 nt, Mycobacterium avium subsp. paratuberculosis
cccagaugcgcgacggcc

SEQ ID NO: 2820817 - RNA, 22 nt, Mycobacterium avium subsp. paratuberculosis
cccagauguugaggguccgcgc

SEQ ID NO: 2820818 - RNA, 16 nt, Mycobacterium avium subsp. paratuberculosis
cccagcaaacccagca

SEQ ID NO: 2820819 - RNA, 20 nt, Mycobacterium avium subsp. paratuberculosis
cccagcaaacccagcaccaa

SEQ ID NO: 2820820 - RNA, 21 nt, Mycobacterium avium subsp. paratuberculosis
cccagcaaacccagcaccaac

SEQ ID NO: 2820821 - RNA, 18 nt, Mycobacterium avium subsp. paratuberculosis
cccagcacaacgccuccg

SEQ ID NO: 2820822 - RNA, 15 nt, Mycobacterium avium subsp. paratuberculosis
cccagcacagccguc

SEQ ID NO: 2820823 - RNA, 17 nt, Mycobacterium avium subsp. paratuberculosis
cccagcacagccgucgc

SEQ ID NO: 2820824 - RNA, 18 nt, Mycobacterium avium subsp. paratuberculosis
cccagcacagccgucgca

SEQ ID NO: 2820825 - RNA, 19 nt, Mycobacterium avium subsp. paratuberculosis
cccagcaccaacagcggcc

SEQ ID NO: 2820826 - RNA, 22 nt, Mycobacterium avium subsp. paratuberculosis
cccagcaccaacagcggcccga

SEQ ID NO: 2820827 - RNA, 12 nt, Mycobacterium avium subsp. paratuberculosis
cccagcaccacc

SEQ ID NO: 2820828 - RNA, 14 nt, Mycobacterium avium subsp. paratuberculosis
cccagcaccaccac

SEQ ID NO: 2820829 - RNA, 19 nt, Mycobacterium avium subsp. paratuberculosis
cccagcaccaccacgcugg

SEQ ID NO: 2820830 - RNA, 18 nt, Mycobacterium avium subsp. paratuberculosis
cccagcaccaccacguug

SEQ ID NO: 2820831 - RNA, 20 nt, Mycobacterium avium subsp. paratuberculosis
cccagcaccaccacguugcg

SEQ ID NO: 2820832 - RNA, 21 nt, Mycobacterium avium subsp. paratuberculosis
cccagcaccaccacguugcgc

SEQ ID NO: 2820833 - RNA, 15 nt, Mycobacterium avium subsp. paratuberculosis
cccagcaccaccuug

SEQ ID NO: 2820834 - RNA, 13 nt, Mycobacterium avium subsp. paratuberculosis
cccagcaccacuu

SEQ ID NO: 2820835 - RNA, 20 nt, Mycobacterium avium subsp. paratuberculosis
cccagcaccccgguccaggc

SEQ ID NO: 2820836 - RNA, 22 nt, Mycobacterium avium subsp. paratuberculosis
cccagcaccccgguccaggcga

SEQ ID NO: 2820837 - RNA, 16 nt, Mycobacterium avium subsp. paratuberculosis
cccagcacccgcucgc

SEQ ID NO: 2820838 - RNA, 12 nt, Mycobacterium avium subsp. paratuberculosis
cccagcaccgcg

SEQ ID NO: 2820839 - RNA, 16 nt, Mycobacterium avium subsp. paratuberculosis
cccagcaccgcgacga

SEQ ID NO: 2820840 - RNA, 16 nt, Mycobacterium avium subsp. paratuberculosis
cccagcacgacgccgc

SEQ ID NO: 2820841 - RNA, 22 nt, Mycobacterium avium subsp. paratuberculosis
cccagcacgaugacgaccgggu

SEQ ID NO: 2820842 - RNA, 14 nt, Mycobacterium avium subsp. paratuberculosis
cccagcacggugau

SEQ ID NO: 2820843 - RNA, 16 nt, Mycobacterium avium subsp. paratuberculosis
cccagcacggugaugc

SEQ ID NO: 2820844 - RNA, 13 nt, Mycobacterium avium subsp. paratuberculosis
cccagcagcaccg

SEQ ID NO: 2820845 - RNA, 16 nt, Mycobacterium avium subsp. paratuberculosis
cccagcagcaccgcga

SEQ ID NO: 2820846 - RNA, 19 nt, Mycobacterium avium subsp. paratuberculosis
cccagcagccgcgccgacg

SEQ ID NO: 2820847 - RNA, 16 nt, Mycobacterium avium subsp. paratuberculosis
cccagcagccugcccc

SEQ ID NO: 2820848 - RNA, 15 nt, Mycobacterium avium subsp. paratuberculosis
cccagcagcgcaccg

SEQ ID NO: 2820849 - RNA, 12 nt, Mycobacterium avium subsp. paratuberculosis
cccagcagcggc

SEQ ID NO: 2820850 - RNA, 18 nt, Mycobacterium avium subsp. paratuberculosis
cccagcagcggccggcgc

SEQ ID NO: 2820851 - RNA, 23 nt, Mycobacterium avium subsp. paratuberculosis
cccagcagcggccggcgcagccg

SEQ ID NO: 2820852 - RNA, 17 nt, Mycobacterium avium subsp. paratuberculosis
cccagcagcgggcccgg

SEQ ID NO: 2820853 - RNA, 16 nt, Mycobacterium avium subsp. paratuberculosis
cccagcagcggggcga

SEQ ID NO: 2820854 - RNA, 21 nt, Mycobacterium avium subsp. paratuberculosis
cccagcagcggggcgagcugg

SEQ ID NO: 2820855 - RNA, 18 nt, Mycobacterium avium subsp. paratuberculosis
cccagcagcggggugugc

SEQ ID NO: 2820856 - RNA, 14 nt, Mycobacterium avium subsp. paratuberculosis
cccagcagcgucac

SEQ ID NO: 2820857 - RNA, 23 nt, Mycobacterium avium subsp. paratuberculosis
cccagcagcgucacgucgacggc

SEQ ID NO: 2820858 - RNA, 19 nt, Mycobacterium avium subsp. paratuberculosis
cccagcagcugcgcgucga

SEQ ID NO: 2820859 - RNA, 16 nt, Mycobacterium avium subsp. paratuberculosis
cccagcaguccggcgg

SEQ ID NO: 2820860 - RNA, 17 nt, Mycobacterium avium subsp. paratuberculosis
cccagcaguccggcggu

SEQ ID NO: 2820861 - RNA, 15 nt, Mycobacterium avium subsp. paratuberculosis
cccagcauaggugcg

SEQ ID NO: 2820862 - RNA, 21 nt, Mycobacterium avium subsp. paratuberculosis
cccagcaucgccgcgacccgg

SEQ ID NO: 2820863 - RNA, 22 nt, Mycobacterium avium subsp. paratuberculosis
cccagcaucgccgcgacccggu

SEQ ID NO: 2820864 - RNA, 18 nt, Mycobacterium avium subsp. paratuberculosis
cccagcaucgccgcggug

SEQ ID NO: 2820865 - RNA, 20 nt, Mycobacterium avium subsp. paratuberculosis
cccagcaucgccgcggugcg

SEQ ID NO: 2820866 - RNA, 14 nt, Mycobacterium avium subsp. paratuberculosis
cccagccacagccg

SEQ ID NO: 2820867 - RNA, 14 nt, Mycobacterium avium subsp. paratuberculosis
cccagccaccgugg

SEQ ID NO: 2820868 - RNA, 14 nt, Mycobacterium avium subsp. paratuberculosis
cccagccagccggu

SEQ ID NO: 2820869 - RNA, 17 nt, Mycobacterium avium subsp. paratuberculosis
cccagccagccgguggc

SEQ ID NO: 2820870 - RNA, 13 nt, Mycobacterium avium subsp. paratuberculosis
cccagccaggccg

SEQ ID NO: 2820871 - RNA, 16 nt, Mycobacterium avium subsp. paratuberculosis
cccagccaggccgccg

SEQ ID NO: 2820872 - RNA, 22 nt, Mycobacterium avium subsp. paratuberculosis
cccagccaggccgccgggccgc

SEQ ID NO: 2820873 - RNA, 19 nt, Mycobacterium avium subsp. paratuberculosis
cccagccaguccgccgccg

SEQ ID NO: 2820874 - RNA, 17 nt, Mycobacterium avium subsp. paratuberculosis
cccagccaucugcugac

SEQ ID NO: 2820875 - RNA, 18 nt, Mycobacterium avium subsp. paratuberculosis
cccagccaucugcugacu

SEQ ID NO: 2820876 - RNA, 21 nt, Mycobacterium avium subsp. paratuberculosis
cccagcggcacgggcaccgac

SEQ ID NO: 2820877 - RNA, 14 nt, Mycobacterium avium subsp. paratuberculosis
cccagcggccccgg

SEQ ID NO: 2820878 - RNA, 17 nt, Mycobacterium avium subsp. paratuberculosis
cccagcggccccggcuc

SEQ ID NO: 2820879 - RNA, 22 nt, Mycobacterium avium subsp. paratuberculosis
cccagcggcgaugcccacagcc

SEQ ID NO: 2820880 - RNA, 14 nt, Mycobacterium avium subsp. paratuberculosis
cccagcggcgcggc

SEQ ID NO: 2820881 - RNA, 16 nt, Mycobacterium avium subsp. paratuberculosis
cccagcggcgcggccg

SEQ ID NO: 2820882 - RNA, 17 nt, Mycobacterium avium subsp. paratuberculosis
cccagcggcgcggccga

SEQ ID NO: 2820883 - RNA, 18 nt, Mycobacterium avium subsp. paratuberculosis
cccagcggcgcggccgau

SEQ ID NO: 2820884 - RNA, 19 nt, Mycobacterium avium subsp. paratuberculosis
cccagcggcuguagcaccc

SEQ ID NO: 2820885 - RNA, 18 nt, Mycobacterium avium subsp. paratuberculosis
cccagcgggacagcacca

SEQ ID NO: 2820886 - RNA, 19 nt, Mycobacterium avium subsp. paratuberculosis
cccagcgggacagcaccac

SEQ ID NO: 2820887 - RNA, 13 nt, Mycobacterium avium subsp. paratuberculosis
cccagcgggcgac

SEQ ID NO: 2820888 - RNA, 23 nt, Mycobacterium avium subsp. paratuberculosis
cccagcgggcgacgucggggucg

SEQ ID NO: 2820889 - RNA, 12 nt, Mycobacterium avium subsp. paratuberculosis
cccagcggggcg

SEQ ID NO: 2820890 - RNA, 21 nt, Mycobacterium avium subsp. paratuberculosis
cccagcgucaacucgucggcg

SEQ ID NO: 2820891 - RNA, 16 nt, Mycobacterium avium subsp. paratuberculosis
cccagcgucaggaugu

SEQ ID NO: 2820892 - RNA, 14 nt, Mycobacterium avium subsp. paratuberculosis
cccagcgucucggc

SEQ ID NO: 2820893 - RNA, 17 nt, Mycobacterium avium subsp. paratuberculosis
cccagcgucucggcggc

SEQ ID NO: 2820894 - RNA, 18 nt, Mycobacterium avium subsp. paratuberculosis
cccagcgucucggcggcc

SEQ ID NO: 2820895 - RNA, 15 nt, Mycobacterium avium subsp. paratuberculosis
cccagcgugaaacua

SEQ ID NO: 2820896 - RNA, 16 nt, Mycobacterium avium subsp. paratuberculosis
cccagcgugacgucga

SEQ ID NO: 2820897 - RNA, 18 nt, Mycobacterium avium subsp. paratuberculosis
cccagcguggucacccgc

SEQ ID NO: 2820898 - RNA, 21 nt, Mycobacterium avium subsp. paratuberculosis
cccagcguggucacccgcagc

SEQ ID NO: 2820899 - RNA, 17 nt, Mycobacterium avium subsp. paratuberculosis
cccagcgugucggcgau

SEQ ID NO: 2820900 - RNA, 23 nt, Mycobacterium avium subsp. paratuberculosis
cccagcucagacugccgagcauc

SEQ ID NO: 2820901 - RNA, 18 nt, Mycobacterium avium subsp. paratuberculosis
cccagcuccacgcguagc

SEQ ID NO: 2820902 - RNA, 20 nt, Mycobacterium avium subsp. paratuberculosis
cccagcuccacgcguagccg

SEQ ID NO: 2820903 - RNA, 18 nt, Mycobacterium avium subsp. paratuberculosis
cccagcuccucggccagc

SEQ ID NO: 2820904 - RNA, 22 nt, Mycobacterium avium subsp. paratuberculosis
cccagcuccucggccagcacca

SEQ ID NO: 2820905 - RNA, 14 nt, Mycobacterium avium subsp. paratuberculosis
cccagcucgacgac

SEQ ID NO: 2820906 - RNA, 22 nt, Mycobacterium avium subsp. paratuberculosis
cccagcucgacgacuucggccu

SEQ ID NO: 2820907 - RNA, 17 nt, Mycobacterium avium subsp. paratuberculosis
cccagcucggugaucug

SEQ ID NO: 2820908 - RNA, 21 nt, Mycobacterium avium subsp. paratuberculosis
cccagcucggugaucugcacc

SEQ ID NO: 2820909 - RNA, 15 nt, Mycobacterium avium subsp. paratuberculosis
cccagcucggugcgc

SEQ ID NO: 2820910 - RNA, 20 nt, Mycobacterium avium subsp. paratuberculosis
cccagcucguugccggcggc

SEQ ID NO: 2820911 - RNA, 21 nt, Mycobacterium avium subsp. paratuberculosis
cccagcucguugccggcggcc

SEQ ID NO: 2820912 - RNA, 19 nt, Mycobacterium avium subsp. paratuberculosis
cccagcugcacccaccggc

SEQ ID NO: 2820913 - RNA, 21 nt, Mycobacterium avium subsp. paratuberculosis
cccagcugcacccaccggccc

SEQ ID NO: 2820914 - RNA, 19 nt, Mycobacterium avium subsp. paratuberculosis
cccagcugcauggacagcg

SEQ ID NO: 2820915 - RNA, 16 nt, Mycobacterium avium subsp. paratuberculosis
cccagcugcgcggagc

SEQ ID NO: 2820916 - RNA, 16 nt, Mycobacterium avium subsp. paratuberculosis
cccagcugcucgagca

SEQ ID NO: 2820917 - RNA, 12 nt, Mycobacterium avium subsp. paratuberculosis
cccagcugggcc

SEQ ID NO: 2820918 - RNA, 19 nt, Mycobacterium avium subsp. paratuberculosis
cccagcugggccagcgcgg

SEQ ID NO: 2820919 - RNA, 22 nt, Mycobacterium avium subsp. paratuberculosis
cccagcugggccagcgcggugg

SEQ ID NO: 2820920 - RNA, 16 nt, Mycobacterium avium subsp. paratuberculosis
cccagcugggccgcca

SEQ ID NO: 2820921 - RNA, 17 nt, Mycobacterium avium subsp. paratuberculosis
cccagcugggccgccag

SEQ ID NO: 2820922 - RNA, 18 nt, Mycobacterium avium subsp. paratuberculosis
cccagcugggccgccagc

SEQ ID NO: 2820923 - RNA, 20 nt, Mycobacterium avium subsp. paratuberculosis
cccagcugggccgccagccg

SEQ ID NO: 2820924 - RNA, 16 nt, Mycobacterium avium subsp. paratuberculosis
cccagcugucgggugg

SEQ ID NO: 2820925 - RNA, 21 nt, Mycobacterium avium subsp. paratuberculosis
cccagcuugaccacccggucg

SEQ ID NO: 2820926 - RNA, 24 nt, Mycobacterium avium subsp. paratuberculosis
cccaggaaaaccagcgacgccagc

SEQ ID NO: 2820927 - RNA, 20 nt, Mycobacterium avium subsp. paratuberculosis
cccaggaacacgggauagcg

SEQ ID NO: 2820928 - RNA, 18 nt, Mycobacterium avium subsp. paratuberculosis
cccaggaacgcgcccggc

SEQ ID NO: 2820929 - RNA, 18 nt, Mycobacterium avium subsp. paratuberculosis
cccaggaacgcgccggcg

SEQ ID NO: 2820930 - RNA, 22 nt, Mycobacterium avium subsp. paratuberculosis
cccaggaacuggucgaacagcg

SEQ ID NO: 2820931 - RNA, 21 nt, Mycobacterium avium subsp. paratuberculosis
cccaggaaguagccggccagc

SEQ ID NO: 2820932 - RNA, 22 nt, Mycobacterium avium subsp. paratuberculosis
cccaggaaguagccggccagcg

SEQ ID NO: 2820933 - RNA, 15 nt, Mycobacterium avium subsp. paratuberculosis
cccaggaccacuccu

SEQ ID NO: 2820934 - RNA, 14 nt, Mycobacterium avium subsp. paratuberculosis
cccaggacgcggug

SEQ ID NO: 2820935 - RNA, 15 nt, Mycobacterium avium subsp. paratuberculosis
cccaggacgcgguga

SEQ ID NO: 2820936 - RNA, 21 nt, Mycobacterium avium subsp. paratuberculosis
cccaggacgcggugacgguga

SEQ ID NO: 2820937 - RNA, 13 nt, Mycobacterium avium subsp. paratuberculosis
cccaggacggcgc

SEQ ID NO: 2820938 - RNA, 14 nt, Mycobacterium avium subsp. paratuberculosis
cccaggacggcgcg

SEQ ID NO: 2820939 - RNA, 17 nt, Mycobacterium avium subsp. paratuberculosis
cccaggacggcgcggug

SEQ ID NO: 2820940 - RNA, 18 nt, Mycobacterium avium subsp. paratuberculosis
cccaggacggcgcggugg

SEQ ID NO: 2820941 - RNA, 21 nt, Mycobacterium avium subsp. paratuberculosis
cccaggacgguuucugccggc

SEQ ID NO: 2820942 - RNA, 21 nt, Mycobacterium avium subsp. paratuberculosis
cccaggaggcacuggcgcugc

SEQ ID NO: 2820943 - RNA, 16 nt, Mycobacterium avium subsp. paratuberculosis
cccaggaugacgccga

SEQ ID NO: 2820944 - RNA, 15 nt, Mycobacterium avium subsp. paratuberculosis
cccaggauggccgcu

SEQ ID NO: 2820945 - RNA, 18 nt, Mycobacterium avium subsp. paratuberculosis
cccaggauucccgacccc

SEQ ID NO: 2820946 - RNA, 20 nt, Mycobacterium avium subsp. paratuberculosis
cccaggauucccgaccccgc

SEQ ID NO: 2820947 - RNA, 17 nt, Mycobacterium avium subsp. paratuberculosis
cccaggauuccgucggc

SEQ ID NO: 2820948 - RNA, 19 nt, Mycobacterium avium subsp. paratuberculosis
cccaggauuccgucggcgg

SEQ ID NO: 2820949 - RNA, 21 nt, Mycobacterium avium subsp. paratuberculosis
cccaggauuccgucggcggcc

SEQ ID NO: 2820950 - RNA, 22 nt, Mycobacterium avium subsp. paratuberculosis
cccaggauuccgucggcggccg

SEQ ID NO: 2820951 - RNA, 19 nt, Mycobacterium avium subsp. paratuberculosis
cccaggauucucagcagcg

SEQ ID NO: 2820952 - RNA, 16 nt, Mycobacterium avium subsp. paratuberculosis
cccaggcagaccccca

SEQ ID NO: 2820953 - RNA, 22 nt, Mycobacterium avium subsp. paratuberculosis
cccaggcagacccccagcagcg

SEQ ID NO: 2820954 - RNA, 15 nt, Mycobacterium avium subsp. paratuberculosis
cccaggccacccggg

SEQ ID NO: 2820955 - RNA, 19 nt, Mycobacterium avium subsp. paratuberculosis
cccaggccacccgggcgcc

SEQ ID NO: 2820956 - RNA, 21 nt, Mycobacterium avium subsp. paratuberculosis
cccaggccaggaucuggguga

SEQ ID NO: 2820957 - RNA, 13 nt, Mycobacterium avium subsp. paratuberculosis
cccaggcccagca

SEQ ID NO: 2820958 - RNA, 20 nt, Mycobacterium avium subsp. paratuberculosis
cccaggcccagcagcaccgc

SEQ ID NO: 2820959 - RNA, 19 nt, Mycobacterium avium subsp. paratuberculosis
cccaggcccaucgcgguca

SEQ ID NO: 2820960 - RNA, 13 nt, Mycobacterium avium subsp. paratuberculosis
cccaucaccagcg

SEQ ID NO: 2820961 - RNA, 14 nt, Mycobacterium avium subsp. paratuberculosis
cccaucaccagcgg

SEQ ID NO: 2820962 - RNA, 17 nt, Mycobacterium avium subsp. paratuberculosis
cccaucaccagcggcug

SEQ ID NO: 2820963 - RNA, 20 nt, Mycobacterium avium subsp. paratuberculosis
cccaucaccagcggcugcag

SEQ ID NO: 2820964 - RNA, 15 nt, Mycobacterium avium subsp. paratuberculosis
cccaucaccgcaccg

SEQ ID NO: 2820965 - RNA, 17 nt, Mycobacterium avium subsp. paratuberculosis
cccaucaccggaccggc

SEQ ID NO: 2820966 - RNA, 17 nt, Mycobacterium avium subsp. paratuberculosis
cccaucagugcggcccg

SEQ ID NO: 2820967 - RNA, 15 nt, Mycobacterium avium subsp. paratuberculosis
cccauccaggccagc

SEQ ID NO: 2820968 - RNA, 19 nt, Mycobacterium avium subsp. paratuberculosis
cccauccaggccagcaccu

SEQ ID NO: 2820969 - RNA, 14 nt, Mycobacterium avium subsp. paratuberculosis
cccauccgcggcca

SEQ ID NO: 2820970 - RNA, 16 nt, Mycobacterium avium subsp. paratuberculosis
cccauccgcggccacc

SEQ ID NO: 2820971 - RNA, 22 nt, Mycobacterium avium subsp. paratuberculosis
cccauccgcggccaccgggacc

SEQ ID NO: 2820972 - RNA, 13 nt, Mycobacterium avium subsp. paratuberculosis
cccauccggcgcc

SEQ ID NO: 2820973 - RNA, 15 nt, Mycobacterium avium subsp. paratuberculosis
cccauccggcgccgc

SEQ ID NO: 2820974 - RNA, 17 nt, Mycobacterium avium subsp. paratuberculosis
cccauccggcgccgcgc

SEQ ID NO: 2820975 - RNA, 21 nt, Mycobacterium avium subsp. paratuberculosis
cccaucgaccggaugaugccg

SEQ ID NO: 2820976 - RNA, 15 nt, Mycobacterium avium subsp. paratuberculosis
cccaucgccacgccg

SEQ ID NO: 2820977 - RNA, 16 nt, Mycobacterium avium subsp. paratuberculosis
cccaucgccacgccgu

SEQ ID NO: 2820978 - RNA, 18 nt, Mycobacterium avium subsp. paratuberculosis
cccaucgccacgccgugg

SEQ ID NO: 2820979 - RNA, 15 nt, Mycobacterium avium subsp. paratuberculosis
cccaucgcggccgcc

SEQ ID NO: 2820980 - RNA, 12 nt, Mycobacterium avium subsp. paratuberculosis
cccaucgcugcc

SEQ ID NO: 2820981 - RNA, 14 nt, Mycobacterium avium subsp. paratuberculosis
cccaucggccagga

SEQ ID NO: 2820982 - RNA, 15 nt, Mycobacterium avium subsp. paratuberculosis
cccaucucgagcagg

SEQ ID NO: 2820983 - RNA, 17 nt, Mycobacterium avium subsp. paratuberculosis
cccaucucgagcaggaa

SEQ ID NO: 2820984 - RNA, 15 nt, Mycobacterium avium subsp. paratuberculosis
cccaucugcacagcu

SEQ ID NO: 2820985 - RNA, 14 nt, Mycobacterium avium subsp. paratuberculosis
cccaugaucgccag

SEQ ID NO: 2820986 - RNA, 22 nt, Mycobacterium avium subsp. paratuberculosis
cccaugaucgccaguccggcgc

SEQ ID NO: 2820987 - RNA, 13 nt, Mycobacterium avium subsp. paratuberculosis
cccaugccccagg

SEQ ID NO: 2820988 - RNA, 19 nt, Mycobacterium avium subsp. paratuberculosis
cccaugggggaacccccuc

SEQ ID NO: 2820989 - RNA, 21 nt, Mycobacterium avium subsp. paratuberculosis
cccauguccagguacgcgacg

SEQ ID NO: 2820990 - RNA, 14 nt, Mycobacterium avium subsp. paratuberculosis
cccaugucgaucgg

SEQ ID NO: 2820991 - RNA, 15 nt, Mycobacterium avium subsp. paratuberculosis
cccaugucgcgggcg

SEQ ID NO: 2820992 - RNA, 23 nt, Mycobacterium avium subsp. paratuberculosis
cccauucgugguugccccagcug

SEQ ID NO: 2820993 - RNA, 16 nt, Mycobacterium avium subsp. paratuberculosis
cccauugucgccgugc

SEQ ID NO: 2820994 - RNA, 18 nt, Mycobacterium avium subsp. paratuberculosis
cccauugucgccgugcgg

SEQ ID NO: 2820995 - RNA, 14 nt, Mycobacterium avium subsp. paratuberculosis
cccauuucggcgaa

SEQ ID NO: 2820996 - RNA, 15 nt, Mycobacterium avium subsp. paratuberculosis
ccccaaaacccggca

SEQ ID NO: 2820997 - RNA, 17 nt, Mycobacterium avium subsp. paratuberculosis
ccccaaaacccggcauu

SEQ ID NO: 2820998 - RNA, 18 nt, Mycobacterium avium subsp. paratuberculosis
ccccaacggcgugcagcc

SEQ ID NO: 2820999 - RNA, 20 nt, Mycobacterium avium subsp. paratuberculosis
ccccaaugucacggcggguc

SEQ ID NO: 2821000 - RNA, 17 nt, Mycobacterium avium subsp. paratuberculosis
ccccaauugccgggcca

SEQ ID NO: 2821001 - RNA, 15 nt, Mycobacterium avium subsp. paratuberculosis
ccccacaccguccga

SEQ ID NO: 2821002 - RNA, 21 nt, Mycobacterium avium subsp. paratuberculosis
ccccacaccuucgcggucggc

SEQ ID NO: 2821003 - RNA, 14 nt, Mycobacterium avium subsp. paratuberculosis
ccccacacgcucgg

SEQ ID NO: 2821004 - RNA, 13 nt, Mycobacterium avium subsp. paratuberculosis
ccccacagcgcgc

SEQ ID NO: 2821005 - RNA, 23 nt, Mycobacterium avium subsp. paratuberculosis
ccccaccaccgacagcacccggc

SEQ ID NO: 2821006 - RNA, 13 nt, Mycobacterium avium subsp. paratuberculosis
ccccaccaccgcc

SEQ ID NO: 2821007 - RNA, 23 nt, Mycobacterium avium subsp. paratuberculosis
ccccaccaccgccggcccaggca

SEQ ID NO: 2821008 - RNA, 15 nt, Mycobacterium avium subsp. paratuberculosis
ccccaccaggcgcgg

SEQ ID NO: 2821009 - RNA, 23 nt, Mycobacterium avium subsp. paratuberculosis
ccccacccagguguccggcccga

SEQ ID NO: 2821010 - RNA, 21 nt, Mycobacterium avium subsp. paratuberculosis
ccccacccgcacggucgcggu

SEQ ID NO: 2821011 - RNA, 16 nt, Mycobacterium avium subsp. paratuberculosis
ccccacccgcgcgaca

SEQ ID NO: 2821012 - RNA, 14 nt, Mycobacterium avium subsp. paratuberculosis
ccccaccgccgcug

SEQ ID NO: 2821013 - RNA, 16 nt, Mycobacterium avium subsp. paratuberculosis
ccccaccgccgcugcg

SEQ ID NO: 2821014 - RNA, 12 nt, Mycobacterium avium subsp. paratuberculosis
ccccaccgcgcc

SEQ ID NO: 2821015 - RNA, 13 nt, Mycobacterium avium subsp. paratuberculosis
ccccaccgugacg

SEQ ID NO: 2821016 - RNA, 22 nt, Mycobacterium avium subsp. paratuberculosis
ccccacgaguaaccggugcgcu

SEQ ID NO: 2821017 - RNA, 22 nt, Mycobacterium avium subsp. paratuberculosis
ccccacgcgcucagcgcggcca

SEQ ID NO: 2821018 - RNA, 12 nt, Mycobacterium avium subsp. paratuberculosis
ccccacgcucgg

SEQ ID NO: 2821019 - RNA, 13 nt, Mycobacterium avium subsp. paratuberculosis
ccccacggcccgg

SEQ ID NO: 2821020 - RNA, 12 nt, Mycobacterium avium subsp. paratuberculosis
ccccacggccgc

SEQ ID NO: 2821021 - RNA, 14 nt, Mycobacterium avium subsp. paratuberculosis
ccccacggccgcaa

SEQ ID NO: 2821022 - RNA, 16 nt, Mycobacterium avium subsp. paratuberculosis
ccccagaaccgcucgg

SEQ ID NO: 2821023 - RNA, 19 nt, Mycobacterium avium subsp. paratuberculosis
ccccagaaccgcucggcgg

SEQ ID NO: 2821024 - RNA, 20 nt, Mycobacterium avium subsp. paratuberculosis
ccccagaaccgcucggcggc

SEQ ID NO: 2821025 - RNA, 12 nt, Mycobacterium avium subsp. paratuberculosis
ccccagacgaag

SEQ ID NO: 2821026 - RNA, 19 nt, Mycobacterium avium subsp. paratuberculosis
ccccagcaaaaccccgccg

SEQ ID NO: 2821027 - RNA, 14 nt, Mycobacterium avium subsp. paratuberculosis
ccccagcacgguga

SEQ ID NO: 2821028 - RNA, 17 nt, Mycobacterium avium subsp. paratuberculosis
ccccagcacggugaugc

SEQ ID NO: 2821029 - RNA, 14 nt, Mycobacterium avium subsp. paratuberculosis
ccccagcagcgggg

SEQ ID NO: 2821030 - RNA, 22 nt, Mycobacterium avium subsp. paratuberculosis
ccccagccccucgccgggcguc

SEQ ID NO: 2821031 - RNA, 13 nt, Mycobacterium avium subsp. paratuberculosis
ccccagcccgccg

SEQ ID NO: 2821032 - RNA, 12 nt, Mycobacterium avium subsp. paratuberculosis
ccccagcccgga

SEQ ID NO: 2821033 - RNA, 13 nt, Mycobacterium avium subsp. paratuberculosis
ccccagcccggau

SEQ ID NO: 2821034 - RNA, 14 nt, Mycobacterium avium subsp. paratuberculosis
ccccagcccggauc

SEQ ID NO: 2821035 - RNA, 17 nt, Mycobacterium avium subsp. paratuberculosis
ccccagcccggauccca

SEQ ID NO: 2821036 - RNA, 14 nt, Mycobacterium avium subsp. paratuberculosis
ccccagcccggcug

SEQ ID NO: 2821037 - RNA, 15 nt, Mycobacterium avium subsp. paratuberculosis
ccccagcccggcugg

SEQ ID NO: 2821038 - RNA, 14 nt, Mycobacterium avium subsp. paratuberculosis
ccccagccgccgcg

SEQ ID NO: 2821039 - RNA, 15 nt, Mycobacterium avium subsp. paratuberculosis
ccccagccgccgcga

SEQ ID NO: 2821040 - RNA, 13 nt, Mycobacterium avium subsp. paratuberculosis
ccccagccggccg

SEQ ID NO: 2821041 - RNA, 14 nt, Mycobacterium avium subsp. paratuberculosis
ccccagcgcgacca

SEQ ID NO: 2821042 - RNA, 22 nt, Mycobacterium avium subsp. paratuberculosis
ccccagcgcgaccagugcaccu

SEQ ID NO: 2821043 - RNA, 14 nt, Mycobacterium avium subsp. paratuberculosis
ccccagcggcacga

SEQ ID NO: 2821044 - RNA, 23 nt, Mycobacterium avium subsp. paratuberculosis
ccccagcggcacgaucucgacca

SEQ ID NO: 2821045 - RNA, 17 nt, Mycobacterium avium subsp. paratuberculosis
ccccagcggggcaagca

SEQ ID NO: 2821046 - RNA, 21 nt, Mycobacterium avium subsp. paratuberculosis
ccccgagcagcgggucgucgg

SEQ ID NO: 2821047 - RNA, 13 nt, Mycobacterium avium subsp. paratuberculosis
ccccgagccgacg

SEQ ID NO: 2821048 - RNA, 14 nt, Mycobacterium avium subsp. paratuberculosis
ccccgagccgacga

SEQ ID NO: 2821049 - RNA, 13 nt, Mycobacterium avium subsp. paratuberculosis
ccccgagcgggcc

SEQ ID NO: 2821050 - RNA, 19 nt, Mycobacterium avium subsp. paratuberculosis
ccccgagcgggccuucacg

SEQ ID NO: 2821051 - RNA, 18 nt, Mycobacterium avium subsp. paratuberculosis
ccccgagcucgggcgcga

SEQ ID NO: 2821052 - RNA, 20 nt, Mycobacterium avium subsp. paratuberculosis
ccccgaggagacgucggccg

SEQ ID NO: 2821053 - RNA, 23 nt, Mycobacterium avium subsp. paratuberculosis
ccccgaggagacgucggccgggu

SEQ ID NO: 2821054 - RNA, 15 nt, Mycobacterium avium subsp. paratuberculosis
ccccgaguucggcca

SEQ ID NO: 2821055 - RNA, 19 nt, Mycobacterium avium subsp. paratuberculosis
ccccgaucaacaccgccag

SEQ ID NO: 2821056 - RNA, 15 nt, Mycobacterium avium subsp. paratuberculosis
ccccgauccggcuga

SEQ ID NO: 2821057 - RNA, 22 nt, Mycobacterium avium subsp. paratuberculosis
ccccgaucgcgaucaccgcggc

SEQ ID NO: 2821058 - RNA, 23 nt, Mycobacterium avium subsp. paratuberculosis
ccccgaucgcgaucaccgcggcc

SEQ ID NO: 2821059 - RNA, 15 nt, Mycobacterium avium subsp. paratuberculosis
ccccgaucggggcca

SEQ ID NO: 2821060 - RNA, 12 nt, Mycobacterium avium subsp. paratuberculosis
ccccgaugcgcu

SEQ ID NO: 2821061 - RNA, 18 nt, Mycobacterium avium subsp. paratuberculosis
ccccgaugcgcucaccca

SEQ ID NO: 2821062 - RNA, 20 nt, Mycobacterium avium subsp. paratuberculosis
ccccgaugcgcucgccgauc

SEQ ID NO: 2821063 - RNA, 19 nt, Mycobacterium avium subsp. paratuberculosis
ccccgaugcggugccgggc

SEQ ID NO: 2821064 - RNA, 23 nt, Mycobacterium avium subsp. paratuberculosis
ccccgaugguauccgaucgcggc

SEQ ID NO: 2821065 - RNA, 18 nt, Mycobacterium avium subsp. paratuberculosis
ccccgcaaacacgagcag

SEQ ID NO: 2821066 - RNA, 12 nt, Mycobacterium avium subsp. paratuberculosis
ccccgcacaccg

SEQ ID NO: 2821067 - RNA, 13 nt, Mycobacterium avium subsp. paratuberculosis
ccccgcacgccag

SEQ ID NO: 2821068 - RNA, 17 nt, Mycobacterium avium subsp. paratuberculosis
ccccgcacgccagcauc

SEQ ID NO: 2821069 - RNA, 20 nt, Mycobacterium avium subsp. paratuberculosis
ccccgcagcucccccggcgu

SEQ ID NO: 2821070 - RNA, 21 nt, Mycobacterium avium subsp. paratuberculosis
ccccgccagauagggcagcgu

SEQ ID NO: 2821071 - RNA, 23 nt, Mycobacterium avium subsp. paratuberculosis
ccccgccagauagggcagcgucc

SEQ ID NO: 2821072 - RNA, 13 nt, Mycobacterium avium subsp. paratuberculosis
ccccgcccgcgac

SEQ ID NO: 2821073 - RNA, 12 nt, Mycobacterium avium subsp. paratuberculosis
ccccgcccggcc

SEQ ID NO: 2821074 - RNA, 14 nt, Mycobacterium avium subsp. paratuberculosis
ccccgcccggccgg

SEQ ID NO: 2821075 - RNA, 15 nt, Mycobacterium avium subsp. paratuberculosis
ccccgcccggccggu

SEQ ID NO: 2821076 - RNA, 14 nt, Mycobacterium avium subsp. paratuberculosis
ccccgcccggcgcg

SEQ ID NO: 2821077 - RNA, 15 nt, Mycobacterium avium subsp. paratuberculosis
ccccgcccggcgcgc

SEQ ID NO: 2821078 - RNA, 13 nt, Mycobacterium avium subsp. paratuberculosis
ccccgcccggcgg

SEQ ID NO: 2821079 - RNA, 14 nt, Mycobacterium avium subsp. paratuberculosis
ccccgcccggcggc

SEQ ID NO: 2821080 - RNA, 15 nt, Mycobacterium avium subsp. paratuberculosis
ccccgcccggcggcc

SEQ ID NO: 2821081 - RNA, 18 nt, Mycobacterium avium subsp. paratuberculosis
ccccgcccggcggccacc

SEQ ID NO: 2821082 - RNA, 13 nt, Mycobacterium avium subsp. paratuberculosis
ccccgcccggggc

SEQ ID NO: 2821083 - RNA, 13 nt, Mycobacterium avium subsp. paratuberculosis
ccccgccgaccgg

SEQ ID NO: 2821084 - RNA, 13 nt, Mycobacterium avium subsp. paratuberculosis
ccccgccgccgug

SEQ ID NO: 2821085 - RNA, 14 nt, Mycobacterium avium subsp. paratuberculosis
ccccgccgccgugc

SEQ ID NO: 2821086 - RNA, 13 nt, Mycobacterium avium subsp. paratuberculosis
ccccgccgcgccg

SEQ ID NO: 2821087 - RNA, 15 nt, Mycobacterium avium subsp. paratuberculosis
ccccgccgcggccag

SEQ ID NO: 2821088 - RNA, 14 nt, Mycobacterium avium subsp. paratuberculosis
ccccgccgcgucgg

SEQ ID NO: 2821089 - RNA, 14 nt, Mycobacterium avium subsp. paratuberculosis
ccccgccggagaug

SEQ ID NO: 2821090 - RNA, 13 nt, Mycobacterium avium subsp. paratuberculosis
ccccgccgggauc

SEQ ID NO: 2821091 - RNA, 18 nt, Mycobacterium avium subsp. paratuberculosis
ccccgccgggaucggcgg

SEQ ID NO: 2821092 - RNA, 13 nt, Mycobacterium avium subsp. paratuberculosis
ccccgccggggcc

SEQ ID NO: 2821093 - RNA, 18 nt, Mycobacterium avium subsp. paratuberculosis
ccccgccggggccggcga

SEQ ID NO: 2821094 - RNA, 13 nt, Mycobacterium avium subsp. paratuberculosis
ccccgccucgccg

SEQ ID NO: 2821095 - RNA, 14 nt, Mycobacterium avium subsp. paratuberculosis
ccccgccucgccgg

SEQ ID NO: 2821096 - RNA, 15 nt, Mycobacterium avium subsp. paratuberculosis
ccccgccucgccggu

SEQ ID NO: 2821097 - RNA, 11 nt, Mycobacterium avium subsp. paratuberculosis
ccccgccucgg

SEQ ID NO: 2821098 - RNA, 16 nt, Mycobacterium avium subsp. paratuberculosis
ccccgcgacacgccgc

SEQ ID NO: 2821099 - RNA, 13 nt, Mycobacterium avium subsp. paratuberculosis
ccccgcgacgucc

SEQ ID NO: 2821100 - RNA, 16 nt, Mycobacterium avium subsp. paratuberculosis
ccccgcgccacgccgc

SEQ ID NO: 2821101 - RNA, 16 nt, Mycobacterium avium subsp. paratuberculosis
ccccgcgcccgccgcg

SEQ ID NO: 2821102 - RNA, 15 nt, Mycobacterium avium subsp. paratuberculosis
ccccgcgccgcccgg

SEQ ID NO: 2821103 - RNA, 14 nt, Mycobacterium avium subsp. paratuberculosis
ccccgcgccgggcg

SEQ ID NO: 2821104 - RNA, 14 nt, Mycobacterium avium subsp. paratuberculosis
ccccgcgcgcgggc

SEQ ID NO: 2821105 - RNA, 19 nt, Mycobacterium avium subsp. paratuberculosis
ccccgcgcggcucgcgggc

SEQ ID NO: 2821106 - RNA, 14 nt, Mycobacterium avium subsp. paratuberculosis
ccccgcgcugccca

SEQ ID NO: 2821107 - RNA, 17 nt, Mycobacterium avium subsp. paratuberculosis
ccccgcgcugcccagcg

SEQ ID NO: 2821108 - RNA, 19 nt, Mycobacterium avium subsp. paratuberculosis
ccccgcgcugggcuggccg

SEQ ID NO: 2821109 - RNA, 22 nt, Mycobacterium avium subsp. paratuberculosis
ccccgcgggucgucgacgucgg

SEQ ID NO: 2821110 - RNA, 20 nt, Mycobacterium avium subsp. paratuberculosis
ccccgcggugccgcagcucg

SEQ ID NO: 2821111 - RNA, 24 nt, Mycobacterium avium subsp. paratuberculosis
ccccgcgguucgaggugcucgcgc

SEQ ID NO: 2821112 - RNA, 15 nt, Mycobacterium avium subsp. paratuberculosis
ccccgcgugacggcc

SEQ ID NO: 2821113 - RNA, 19 nt, Mycobacterium avium subsp. paratuberculosis
ccccgcgugacggccgcgg

SEQ ID NO: 2821114 - RNA, 23 nt, Mycobacterium avium subsp. paratuberculosis
ccccgcgugacggccgcggcgcg

SEQ ID NO: 2821115 - RNA, 16 nt, Mycobacterium avium subsp. paratuberculosis
ccccgcguuggccagc

SEQ ID NO: 2821116 - RNA, 17 nt, Mycobacterium avium subsp. paratuberculosis
ccccgcucccauccgga

SEQ ID NO: 2821117 - RNA, 19 nt, Mycobacterium avium subsp. paratuberculosis
ccccgcuccuccucgcgcc

SEQ ID NO: 2821118 - RNA, 20 nt, Mycobacterium avium subsp. paratuberculosis
ccccgcuccuccucgcgccg

SEQ ID NO: 2821119 - RNA, 21 nt, Mycobacterium avium subsp. paratuberculosis
ccccgcuccuccucgcgccgc

SEQ ID NO: 2821120 - RNA, 14 nt, Mycobacterium avium subsp. paratuberculosis
ccccgcucggccag

SEQ ID NO: 2821121 - RNA, 18 nt, Mycobacterium avium subsp. paratuberculosis
ccccgcucggccagcgcg

SEQ ID NO: 2821122 - RNA, 15 nt, Mycobacterium avium subsp. paratuberculosis
ccccgcugccguccg

SEQ ID NO: 2821123 - RNA, 20 nt, Mycobacterium avium subsp. paratuberculosis
ccccgcugccguccggcggc

SEQ ID NO: 2821124 - RNA, 17 nt, Mycobacterium avium subsp. paratuberculosis
ccccgcuggaucccggu

SEQ ID NO: 2821125 - RNA, 14 nt, Mycobacterium avium subsp. paratuberculosis
ccccgcuggcccgg

SEQ ID NO: 2821126 - RNA, 17 nt, Mycobacterium avium subsp. paratuberculosis
ccccgcuggcccggcgu

SEQ ID NO: 2821127 - RNA, 12 nt, Mycobacterium avium subsp. paratuberculosis
ccccgcuggcga

SEQ ID NO: 2821128 - RNA, 13 nt, Mycobacterium avium subsp. paratuberculosis
ccccgcuggcgaa

SEQ ID NO: 2821129 - RNA, 16 nt, Mycobacterium avium subsp. paratuberculosis
ccccgcuggcgccggc

SEQ ID NO: 2821130 - RNA, 17 nt, Mycobacterium avium subsp. paratuberculosis
ccccgcuggcgccggcg

SEQ ID NO: 2821131 - RNA, 22 nt, Mycobacterium avium subsp. paratuberculosis
ccccggaccggagacgguccuc

SEQ ID NO: 2821132 - RNA, 19 nt, Mycobacterium avium subsp. paratuberculosis
ccccguaugcgccaacgcu

SEQ ID NO: 2821133 - RNA, 20 nt, Mycobacterium avium subsp. paratuberculosis
ccccguauugccgucggcgu

SEQ ID NO: 2821134 - RNA, 21 nt, Mycobacterium avium subsp. paratuberculosis
ccccguauugccgucggcguc

SEQ ID NO: 2821135 - RNA, 15 nt, Mycobacterium avium subsp. paratuberculosis
ccccguccagcccag

SEQ ID NO: 2821136 - RNA, 18 nt, Mycobacterium avium subsp. paratuberculosis
ccccguccagcccagcgc

SEQ ID NO: 2821137 - RNA, 19 nt, Mycobacterium avium subsp. paratuberculosis
ccccguccagcccagcgcc

SEQ ID NO: 2821138 - RNA, 15 nt, Mycobacterium avium subsp. paratuberculosis
ccccguccggcgcca

SEQ ID NO: 2821139 - RNA, 19 nt, Mycobacterium avium subsp. paratuberculosis
ccccgucgaaaccgucucc

SEQ ID NO: 2821140 - RNA, 22 nt, Mycobacterium avium subsp. paratuberculosis
ccccgucgaaaccgucuccggc

SEQ ID NO: 2821141 - RNA, 13 nt, Mycobacterium avium subsp. paratuberculosis
ccccgucgagcag

SEQ ID NO: 2821142 - RNA, 22 nt, Mycobacterium avium subsp. paratuberculosis
ccccgucgagcagccgcaacac

SEQ ID NO: 2821143 - RNA, 13 nt, Mycobacterium avium subsp. paratuberculosis
ccccgucgggccg

SEQ ID NO: 2821144 - RNA, 21 nt, Mycobacterium avium subsp. paratuberculosis
ccccgucgggccguccgccgg

SEQ ID NO: 2821145 - RNA, 18 nt, Mycobacterium avium subsp. paratuberculosis
ccccgucggucccgacgc

SEQ ID NO: 2821146 - RNA, 19 nt, Mycobacterium avium subsp. paratuberculosis
ccccgucggucccgacgcg

SEQ ID NO: 2821147 - RNA, 15 nt, Mycobacterium avium subsp. paratuberculosis
ccccgugcagccggg

SEQ ID NO: 2821148 - RNA, 16 nt, Mycobacterium avium subsp. paratuberculosis
ccccgugcagccgggc

SEQ ID NO: 2821149 - RNA, 17 nt, Mycobacterium avium subsp. paratuberculosis
ccccgugcggggccucg

SEQ ID NO: 2821150 - RNA, 18 nt, Mycobacterium avium subsp. paratuberculosis
ccccgugcggggccucgu

SEQ ID NO: 2821151 - RNA, 15 nt, Mycobacterium avium subsp. paratuberculosis
ccccguucgccgaca

SEQ ID NO: 2821152 - RNA, 23 nt, Mycobacterium avium subsp. paratuberculosis
ccccguugaucuugaccgucgcg

SEQ ID NO: 2821153 - RNA, 24 nt, Mycobacterium avium subsp. paratuberculosis
ccccguugcacaggcacacgaaca

SEQ ID NO: 2821154 - RNA, 14 nt, Mycobacterium avium subsp. paratuberculosis
ccccguugccgccg

SEQ ID NO: 2821155 - RNA, 15 nt, Mycobacterium avium subsp. paratuberculosis
ccccguugccgccgg

SEQ ID NO: 2821156 - RNA, 20 nt, Mycobacterium avium subsp. paratuberculosis
ccccguugucguucuccccg

SEQ ID NO: 2821157 - RNA, 16 nt, Mycobacterium avium subsp. paratuberculosis
ccccuaccgccgagcg

SEQ ID NO: 2821158 - RNA, 20 nt, Mycobacterium avium subsp. paratuberculosis
ccccuacgggcgcaccgcgc

SEQ ID NO: 2821159 - RNA, 23 nt, Mycobacterium avium subsp. paratuberculosis
ccccuacgggcgcaccgcgcgcc

SEQ ID NO: 2821160 - RNA, 20 nt, Mycobacterium avium subsp. paratuberculosis
ccccucauugggaccggugc

SEQ ID NO: 2821161 - RNA, 21 nt, Mycobacterium avium subsp. paratuberculosis
ccccucccaccacggccgaug

SEQ ID NO: 2821162 - RNA, 20 nt, Mycobacterium avium subsp. paratuberculosis
ccccucgacgaacgcggcgg

SEQ ID NO: 2821163 - RNA, 17 nt, Mycobacterium avium subsp. paratuberculosis
ccccucgacguccaggc

SEQ ID NO: 2821164 - RNA, 21 nt, Mycobacterium avium subsp. paratuberculosis
ccccucgacguccaggccggc

SEQ ID NO: 2821165 - RNA, 23 nt, Mycobacterium avium subsp. paratuberculosis
ccccucgacguccaggccggcgc

SEQ ID NO: 2821166 - RNA, 12 nt, Mycobacterium avium subsp. paratuberculosis
ccccucgcgcaa

SEQ ID NO: 2821167 - RNA, 13 nt, Mycobacterium avium subsp. paratuberculosis
ccccucggccggu

SEQ ID NO: 2821168 - RNA, 20 nt, Mycobacterium avium subsp. paratuberculosis
ccccucggcgccgguggugu

SEQ ID NO: 2821169 - RNA, 18 nt, Mycobacterium avium subsp. paratuberculosis
ccccucggggcugcgcgg

SEQ ID NO: 2821170 - RNA, 23 nt, Mycobacterium avium subsp. paratuberculosis
ccccugagggugucggcgaucca

SEQ ID NO: 2821171 - RNA, 14 nt, Mycobacterium avium subsp. paratuberculosis
ccccugccgccacc

SEQ ID NO: 2821172 - RNA, 15 nt, Mycobacterium avium subsp. paratuberculosis
ccccugcucagcggc

SEQ ID NO: 2821173 - RNA, 23 nt, Mycobacterium avium subsp. paratuberculosis
ccccuucgaugucgccggcgacc

SEQ ID NO: 2821174 - RNA, 17 nt, Mycobacterium avium subsp. paratuberculosis
ccccuuggcggcaagcc

SEQ ID NO: 2821175 - RNA, 19 nt, Mycobacterium avium subsp. paratuberculosis
cccgaaaagcaccaggcuc

SEQ ID NO: 2821176 - RNA, 18 nt, Mycobacterium avium subsp. paratuberculosis
cccgaaaccauugcaccg

SEQ ID NO: 2821177 - RNA, 20 nt, Mycobacterium avium subsp. paratuberculosis
cccgaaaccauugcaccgca

SEQ ID NO: 2821178 - RNA, 17 nt, Mycobacterium avium subsp. paratuberculosis
cccgaaacugggaguug

SEQ ID NO: 2821179 - RNA, 15 nt, Mycobacterium avium subsp. paratuberculosis
cccgaaagcccccag

SEQ ID NO: 2821180 - RNA, 17 nt, Mycobacterium avium subsp. paratuberculosis
cccgaaagcccccagcu

SEQ ID NO: 2821181 - RNA, 14 nt, Mycobacterium avium subsp. paratuberculosis
cccgaaagggucug

SEQ ID NO: 2821182 - RNA, 21 nt, Mycobacterium avium subsp. paratuberculosis
cccgaacacgggcggcagggc

SEQ ID NO: 2821183 - RNA, 15 nt, Mycobacterium avium subsp. paratuberculosis
cccgaacagccgggc

SEQ ID NO: 2821184 - RNA, 23 nt, Mycobacterium avium subsp. paratuberculosis
cccgaacagcuugccgaucuggu

SEQ ID NO: 2821185 - RNA, 14 nt, Mycobacterium avium subsp. paratuberculosis
cccgaacagggcga

SEQ ID NO: 2821186 - RNA, 23 nt, Mycobacterium avium subsp. paratuberculosis
cccgaacaucgccucggccgcgg

SEQ ID NO: 2821187 - RNA, 15 nt, Mycobacterium avium subsp. paratuberculosis
cccgaacccagcgcc

SEQ ID NO: 2821188 - RNA, 14 nt, Mycobacterium avium subsp. paratuberculosis
cccgaacccggcca

SEQ ID NO: 2821189 - RNA, 15 nt, Mycobacterium avium subsp. paratuberculosis
cccgaaccgcccgcc

SEQ ID NO: 2821190 - RNA, 16 nt, Mycobacterium avium subsp. paratuberculosis
cccgaacgcgcgucgg

SEQ ID NO: 2821191 - RNA, 17 nt, Mycobacterium avium subsp. paratuberculosis
cccgaacgcgcgucggu

SEQ ID NO: 2821192 - RNA, 15 nt, Mycobacterium avium subsp. paratuberculosis
cccgaacgcgucguc

SEQ ID NO: 2821193 - RNA, 15 nt, Mycobacterium avium subsp. paratuberculosis
cccgaacggaccggg

SEQ ID NO: 2821194 - RNA, 16 nt, Mycobacterium avium subsp. paratuberculosis
cccgaacggaccgggc

SEQ ID NO: 2821195 - RNA, 17 nt, Mycobacterium avium subsp. paratuberculosis
cccgaacggaccgggcg

SEQ ID NO: 2821196 - RNA, 14 nt, Mycobacterium avium subsp. paratuberculosis
cccgaacugccgcg

SEQ ID NO: 2821197 - RNA, 20 nt, Mycobacterium avium subsp. paratuberculosis
cccgaacuucagcgcgucgu

SEQ ID NO: 2821198 - RNA, 22 nt, Mycobacterium avium subsp. paratuberculosis
cccgaagcgcuaacaaaagccc

SEQ ID NO: 2821199 - RNA, 19 nt, Mycobacterium avium subsp. paratuberculosis
cccgaaugagacgacccga

SEQ ID NO: 2821200 - RNA, 15 nt, Mycobacterium avium subsp. paratuberculosis
cccgaauugcgcugc

SEQ ID NO: 2821201 - RNA, 22 nt, Mycobacterium avium subsp. paratuberculosis
cccgaauugcgcugcaccgcag

SEQ ID NO: 2821202 - RNA, 12 nt, Mycobacterium avium subsp. paratuberculosis
cccgacaccgcc

SEQ ID NO: 2821203 - RNA, 13 nt, Mycobacterium avium subsp. paratuberculosis
cccgacaccgcca

SEQ ID NO: 2821204 - RNA, 16 nt, Mycobacterium avium subsp. paratuberculosis
cccgacaccgccagca

SEQ ID NO: 2821205 - RNA, 19 nt, Mycobacterium avium subsp. paratuberculosis
cccgacaccgccagcagcg

SEQ ID NO: 2821206 - RNA, 13 nt, Mycobacterium avium subsp. paratuberculosis
cccgacaccgccc

SEQ ID NO: 2821207 - RNA, 20 nt, Mycobacterium avium subsp. paratuberculosis
cccgacaccgccccgccgcg

SEQ ID NO: 2821208 - RNA, 13 nt, Mycobacterium avium subsp. paratuberculosis
cccgacaccgugg

SEQ ID NO: 2821209 - RNA, 18 nt, Mycobacterium avium subsp. paratuberculosis
cccgacaccgugguggcg

SEQ ID NO: 2821210 - RNA, 22 nt, Mycobacterium avium subsp. paratuberculosis
cccgacaccgugguggcggcga

SEQ ID NO: 2821211 - RNA, 13 nt, Mycobacterium avium subsp. paratuberculosis
cccgacacgccga

SEQ ID NO: 2821212 - RNA, 14 nt, Mycobacterium avium subsp. paratuberculosis
cccgacacgccgau

SEQ ID NO: 2821213 - RNA, 15 nt, Mycobacterium avium subsp. paratuberculosis
cccgacacgccgauc

SEQ ID NO: 2821214 - RNA, 16 nt, Mycobacterium avium subsp. paratuberculosis
cccgacaggcccaccc

SEQ ID NO: 2821215 - RNA, 19 nt, Mycobacterium avium subsp. paratuberculosis
cccgacaguccgaccgcgu

SEQ ID NO: 2821216 - RNA, 16 nt, Mycobacterium avium subsp. paratuberculosis
cccgagcgugggggcc

SEQ ID NO: 2821217 - RNA, 19 nt, Mycobacterium avium subsp. paratuberculosis
cccgagcgugggggccaug

SEQ ID NO: 2821218 - RNA, 16 nt, Mycobacterium avium subsp. paratuberculosis
cccgagcucgggcgcg

SEQ ID NO: 2821219 - RNA, 19 nt, Mycobacterium avium subsp. paratuberculosis
cccgagcugaucgcggccg

SEQ ID NO: 2821220 - RNA, 16 nt, Mycobacterium avium subsp. paratuberculosis
cccgaggaugccgccc

SEQ ID NO: 2821221 - RNA, 18 nt, Mycobacterium avium subsp. paratuberculosis
cccgaggaugccgcccac

SEQ ID NO: 2821222 - RNA, 19 nt, Mycobacterium avium subsp. paratuberculosis
cccgaggaugccgcccacc

SEQ ID NO: 2821223 - RNA, 15 nt, Mycobacterium avium subsp. paratuberculosis
cccgagucacccggc

SEQ ID NO: 2821224 - RNA, 21 nt, Mycobacterium avium subsp. paratuberculosis
cccgagucacccggcuggccg

SEQ ID NO: 2821225 - RNA, 20 nt, Mycobacterium avium subsp. paratuberculosis
cccgagucggagacccgccc

SEQ ID NO: 2821226 - RNA, 14 nt, Mycobacterium avium subsp. paratuberculosis
cccgaguggcgccg

SEQ ID NO: 2821227 - RNA, 18 nt, Mycobacterium avium subsp. paratuberculosis
cccgaguggcgccgucgg

SEQ ID NO: 2821228 - RNA, 19 nt, Mycobacterium avium subsp. paratuberculosis
cccgagugggaccgucggc

SEQ ID NO: 2821229 - RNA, 15 nt, Mycobacterium avium subsp. paratuberculosis
cccgaguucggccag

SEQ ID NO: 2821230 - RNA, 21 nt, Mycobacterium avium subsp. paratuberculosis
cccgaguucggccagaucggc

SEQ ID NO: 2821231 - RNA, 20 nt, Mycobacterium avium subsp. paratuberculosis
cccgauagccccgccaggcg

SEQ ID NO: 2821232 - RNA, 21 nt, Mycobacterium avium subsp. paratuberculosis
cccgauagccccgccaggcgg

SEQ ID NO: 2821233 - RNA, 21 nt, Mycobacterium avium subsp. paratuberculosis
cccgauagcuugagccccgcc

SEQ ID NO: 2821234 - RNA, 22 nt, Mycobacterium avium subsp. paratuberculosis
cccgauagcuugagccccgccg

SEQ ID NO: 2821235 - RNA, 16 nt, Mycobacterium avium subsp. paratuberculosis
cccgauaggccgacug

SEQ ID NO: 2821236 - RNA, 17 nt, Mycobacterium avium subsp. paratuberculosis
cccgaucaacaccgcca

SEQ ID NO: 2821237 - RNA, 21 nt, Mycobacterium avium subsp. paratuberculosis
cccgaucaacaccgccagcac

SEQ ID NO: 2821238 - RNA, 12 nt, Mycobacterium avium subsp. paratuberculosis
cccgaucaccag

SEQ ID NO: 2821239 - RNA, 23 nt, Mycobacterium avium subsp. paratuberculosis
cccgaucaccaggcccaggccga

SEQ ID NO: 2821240 - RNA, 13 nt, Mycobacterium avium subsp. paratuberculosis
cccgaucaccgcc

SEQ ID NO: 2821241 - RNA, 14 nt, Mycobacterium avium subsp. paratuberculosis
cccgaucaccgccg

SEQ ID NO: 2821242 - RNA, 15 nt, Mycobacterium avium subsp. paratuberculosis
cccgaucagccgggu

SEQ ID NO: 2821243 - RNA, 24 nt, Mycobacterium avium subsp. paratuberculosis
cccgaucagccggguagcgccgcc

SEQ ID NO: 2821244 - RNA, 12 nt, Mycobacterium avium subsp. paratuberculosis
cccgaucagcgu

SEQ ID NO: 2821245 - RNA, 18 nt, Mycobacterium avium subsp. paratuberculosis
cccgaucaggguccaggg

SEQ ID NO: 2821246 - RNA, 21 nt, Mycobacterium avium subsp. paratuberculosis
cccgauccacggcgaccccgu

SEQ ID NO: 2821247 - RNA, 14 nt, Mycobacterium avium subsp. paratuberculosis
cccgauccagacgg

SEQ ID NO: 2821248 - RNA, 17 nt, Mycobacterium avium subsp. paratuberculosis
cccgauccagggcccgc

SEQ ID NO: 2821249 - RNA, 13 nt, Mycobacterium avium subsp. paratuberculosis
cccgauccgccgu

SEQ ID NO: 2821250 - RNA, 13 nt, Mycobacterium avium subsp. paratuberculosis
cccgauccgcgcc

SEQ ID NO: 2821251 - RNA, 14 nt, Mycobacterium avium subsp. paratuberculosis
cccgauccgcgccg

SEQ ID NO: 2821252 - RNA, 19 nt, Mycobacterium avium subsp. paratuberculosis
cccgauccgcgccgccgcc

SEQ ID NO: 2821253 - RNA, 17 nt, Mycobacterium avium subsp. paratuberculosis
cccgauccggcugagca

SEQ ID NO: 2821254 - RNA, 12 nt, Mycobacterium avium subsp. paratuberculosis
cccgaucgagga

SEQ ID NO: 2821255 - RNA, 18 nt, Mycobacterium avium subsp. paratuberculosis
cccgaucgaucaucgccu

SEQ ID NO: 2821256 - RNA, 18 nt, Mycobacterium avium subsp. paratuberculosis
cccgaucgccagcgcccg

SEQ ID NO: 2821257 - RNA, 13 nt, Mycobacterium avium subsp. paratuberculosis
cccgaucgccgag

SEQ ID NO: 2821258 - RNA, 16 nt, Mycobacterium avium subsp. paratuberculosis
cccgaucgccgagucg

SEQ ID NO: 2821259 - RNA, 15 nt, Mycobacterium avium subsp. paratuberculosis
cccgaucgcgaucac

SEQ ID NO: 2821260 - RNA, 19 nt, Mycobacterium avium subsp. paratuberculosis
cccgaucgcgaucaccgcg

SEQ ID NO: 2821261 - RNA, 13 nt, Mycobacterium avium subsp. paratuberculosis
cccgaucgcggcg

SEQ ID NO: 2821262 - RNA, 21 nt, Mycobacterium avium subsp. paratuberculosis
cccgaucgcgucgacgauggc

SEQ ID NO: 2821263 - RNA, 20 nt, Mycobacterium avium subsp. paratuberculosis
cccgaucggauccgccugcc

SEQ ID NO: 2821264 - RNA, 21 nt, Mycobacterium avium subsp. paratuberculosis
cccgaucggauccgccugccc

SEQ ID NO: 2821265 - RNA, 12 nt, Mycobacterium avium subsp. paratuberculosis
cccgaucggcac

SEQ ID NO: 2821266 - RNA, 16 nt, Mycobacterium avium subsp. paratuberculosis
cccgaucggcacccgc

SEQ ID NO: 2821267 - RNA, 17 nt, Mycobacterium avium subsp. paratuberculosis
cccgaucggcccggcca

SEQ ID NO: 2821268 - RNA, 19 nt, Mycobacterium avium subsp. paratuberculosis
cccgaucggcccggccaac

SEQ ID NO: 2821269 - RNA, 15 nt, Mycobacterium avium subsp. paratuberculosis
cccgaucggggccag

SEQ ID NO: 2821270 - RNA, 15 nt, Mycobacterium avium subsp. paratuberculosis
cccgaucucgcgcgg

SEQ ID NO: 2821271 - RNA, 19 nt, Mycobacterium avium subsp. paratuberculosis
cccgaucucgcgcgggucg

SEQ ID NO: 2821272 - RNA, 15 nt, Mycobacterium avium subsp. paratuberculosis
cccgaucucgucggu

SEQ ID NO: 2821273 - RNA, 18 nt, Mycobacterium avium subsp. paratuberculosis
cccgaucucgucggugag

SEQ ID NO: 2821274 - RNA, 21 nt, Mycobacterium avium subsp. paratuberculosis
cccgaugaccggcccggcggc

SEQ ID NO: 2821275 - RNA, 22 nt, Mycobacterium avium subsp. paratuberculosis
cccgaugaucgagcacgggaug

SEQ ID NO: 2821276 - RNA, 13 nt, Mycobacterium avium subsp. paratuberculosis
cccgaugccgccg

SEQ ID NO: 2821277 - RNA, 15 nt, Mycobacterium avium subsp. paratuberculosis
cccgaugccgccgag

SEQ ID NO: 2821278 - RNA, 12 nt, Mycobacterium avium subsp. paratuberculosis
cccgaugccgcg

SEQ ID NO: 2821279 - RNA, 18 nt, Mycobacterium avium subsp. paratuberculosis
cccgaugccgcgcaggcc

SEQ ID NO: 2821280 - RNA, 13 nt, Mycobacterium avium subsp. paratuberculosis
cccgaugcgcucg

SEQ ID NO: 2821281 - RNA, 16 nt, Mycobacterium avium subsp. paratuberculosis
cccgaugcgcucgccg

SEQ ID NO: 2821282 - RNA, 17 nt, Mycobacterium avium subsp. paratuberculosis
cccgaugcgcucgccga

SEQ ID NO: 2821283 - RNA, 18 nt, Mycobacterium avium subsp. paratuberculosis
cccgaugcgcucgccgau

SEQ ID NO: 2821284 - RNA, 14 nt, Mycobacterium avium subsp. paratuberculosis
cccgaugcggaccg

SEQ ID NO: 2821285 - RNA, 16 nt, Mycobacterium avium subsp. paratuberculosis
cccgaugcggacgcgu

SEQ ID NO: 2821286 - RNA, 15 nt, Mycobacterium avium subsp. paratuberculosis
cccgaugcggugccg

SEQ ID NO: 2821287 - RNA, 17 nt, Mycobacterium avium subsp. paratuberculosis
cccgaugcucgaugcgc

SEQ ID NO: 2821288 - RNA, 23 nt, Mycobacterium avium subsp. paratuberculosis
cccgaugcuggccaucgccgagc

SEQ ID NO: 2821289 - RNA, 13 nt, Mycobacterium avium subsp. paratuberculosis
cccgauggcggcc

SEQ ID NO: 2821290 - RNA, 16 nt, Mycobacterium avium subsp. paratuberculosis
cccgauggcggccugc

SEQ ID NO: 2821291 - RNA, 19 nt, Mycobacterium avium subsp. paratuberculosis
cccgauggugaaccacuuc

SEQ ID NO: 2821292 - RNA, 13 nt, Mycobacterium avium subsp. paratuberculosis
cccgauguuggcc

SEQ ID NO: 2821293 - RNA, 13 nt, Mycobacterium avium subsp. paratuberculosis
cccgauucagccg

SEQ ID NO: 2821294 - RNA, 16 nt, Mycobacterium avium subsp. paratuberculosis
cccgauucagccggcg

SEQ ID NO: 2821295 - RNA, 22 nt, Mycobacterium avium subsp. paratuberculosis
cccgauucagccggcgggcgcu

SEQ ID NO: 2821296 - RNA, 17 nt, Mycobacterium avium subsp. paratuberculosis
cccgauuccccggcgug

SEQ ID NO: 2821297 - RNA, 21 nt, Mycobacterium avium subsp. paratuberculosis
cccgcaaacacgagcagaccc

SEQ ID NO: 2821298 - RNA, 16 nt, Mycobacterium avium subsp. paratuberculosis
cccgcaaaucagccga

SEQ ID NO: 2821299 - RNA, 15 nt, Mycobacterium avium subsp. paratuberculosis
cccgcaacgcgcgcg

SEQ ID NO: 2821300 - RNA, 20 nt, Mycobacterium avium subsp. paratuberculosis
cccgcaacgcgcgcgacggc

SEQ ID NO: 2821301 - RNA, 18 nt, Mycobacterium avium subsp. paratuberculosis
cccgccccgacagcaacg

SEQ ID NO: 2821302 - RNA, 22 nt, Mycobacterium avium subsp. paratuberculosis
cccgccccgacgugcagcgcca

SEQ ID NO: 2821303 - RNA, 17 nt, Mycobacterium avium subsp. paratuberculosis
cccgccccgcccggcgg

SEQ ID NO: 2821304 - RNA, 16 nt, Mycobacterium avium subsp. paratuberculosis
cccgcccgccgggcac

SEQ ID NO: 2821305 - RNA, 13 nt, Mycobacterium avium subsp. paratuberculosis
cccgcccggcaac

SEQ ID NO: 2821306 - RNA, 14 nt, Mycobacterium avium subsp. paratuberculosis
cccgcccggcacga

SEQ ID NO: 2821307 - RNA, 22 nt, Mycobacterium avium subsp. paratuberculosis
cccgcccggcacgaacgcgacg

SEQ ID NO: 2821308 - RNA, 20 nt, Mycobacterium avium subsp. paratuberculosis
cccgcccggcccggcgcggc

SEQ ID NO: 2821309 - RNA, 22 nt, Mycobacterium avium subsp. paratuberculosis
cccgcccggcccggcgcggccg

SEQ ID NO: 2821310 - RNA, 13 nt, Mycobacterium avium subsp. paratuberculosis
cccgcccggccgg

SEQ ID NO: 2821311 - RNA, 15 nt, Mycobacterium avium subsp. paratuberculosis
cccgcccggccgguc

SEQ ID NO: 2821312 - RNA, 21 nt, Mycobacterium avium subsp. paratuberculosis
cccgcccggccggucgccgau

SEQ ID NO: 2821313 - RNA, 12 nt, Mycobacterium avium subsp. paratuberculosis
cccgcccggcgc

SEQ ID NO: 2821314 - RNA, 17 nt, Mycobacterium avium subsp. paratuberculosis
cccgcccggcgccggcc

SEQ ID NO: 2821315 - RNA, 13 nt, Mycobacterium avium subsp. paratuberculosis
cccgcccggcgcg

SEQ ID NO: 2821316 - RNA, 15 nt, Mycobacterium avium subsp. paratuberculosis
cccgcccggcgcgca

SEQ ID NO: 2821317 - RNA, 13 nt, Mycobacterium avium subsp. paratuberculosis
cccgcccggcggc

SEQ ID NO: 2821318 - RNA, 20 nt, Mycobacterium avium subsp. paratuberculosis
cccgcccgggucgucggugc

SEQ ID NO: 2821319 - RNA, 18 nt, Mycobacterium avium subsp. paratuberculosis
cccgcccguagacccaca

SEQ ID NO: 2821320 - RNA, 19 nt, Mycobacterium avium subsp. paratuberculosis
cccgcccguagacccacag

SEQ ID NO: 2821321 - RNA, 14 nt, Mycobacterium avium subsp. paratuberculosis
cccgcccugcuuga

SEQ ID NO: 2821322 - RNA, 16 nt, Mycobacterium avium subsp. paratuberculosis
cccgcccuuggccgcg

SEQ ID NO: 2821323 - RNA, 21 nt, Mycobacterium avium subsp. paratuberculosis
cccgcccuuggccgcggagua

SEQ ID NO: 2821324 - RNA, 12 nt, Mycobacterium avium subsp. paratuberculosis
cccgcccuuguc

SEQ ID NO: 2821325 - RNA, 13 nt, Mycobacterium avium subsp. paratuberculosis
cccgcccuugucg

SEQ ID NO: 2821326 - RNA, 16 nt, Mycobacterium avium subsp. paratuberculosis
cccgccgaacaccggc

SEQ ID NO: 2821327 - RNA, 18 nt, Mycobacterium avium subsp. paratuberculosis
cccgccgaacaccggcag

SEQ ID NO: 2821328 - RNA, 20 nt, Mycobacterium avium subsp. paratuberculosis
cccgccgaacaccggcagcg

SEQ ID NO: 2821329 - RNA, 22 nt, Mycobacterium avium subsp. paratuberculosis
cccgccgaacaccggcagcgcc

SEQ ID NO: 2821330 - RNA, 23 nt, Mycobacterium avium subsp. paratuberculosis
cccgccgaacaccggcagcgcca

SEQ ID NO: 2821331 - RNA, 16 nt, Mycobacterium avium subsp. paratuberculosis
cccgccgaacccgccc

SEQ ID NO: 2821332 - RNA, 17 nt, Mycobacterium avium subsp. paratuberculosis
cccgccgaacgccuccg

SEQ ID NO: 2821333 - RNA, 22 nt, Mycobacterium avium subsp. paratuberculosis
cccgccgaccaccuugcgcagc

SEQ ID NO: 2821334 - RNA, 16 nt, Mycobacterium avium subsp. paratuberculosis
cccgccgaccaggauc

SEQ ID NO: 2821335 - RNA, 13 nt, Mycobacterium avium subsp. paratuberculosis
cccgccgaccggu

SEQ ID NO: 2821336 - RNA, 17 nt, Mycobacterium avium subsp. paratuberculosis
cccgccgaccgguccgc

SEQ ID NO: 2821337 - RNA, 20 nt, Mycobacterium avium subsp. paratuberculosis
cccgccgacgcccaggcuca

SEQ ID NO: 2821338 - RNA, 23 nt, Mycobacterium avium subsp. paratuberculosis
cccgccgagauccaccgcgcggc

SEQ ID NO: 2821339 - RNA, 22 nt, Mycobacterium avium subsp. paratuberculosis
cccgccgauggacacgcugccg

SEQ ID NO: 2821340 - RNA, 15 nt, Mycobacterium avium subsp. paratuberculosis
cccgccgcaacagcc

SEQ ID NO: 2821341 - RNA, 19 nt, Mycobacterium avium subsp. paratuberculosis
cccgccgcaacagccggcc

SEQ ID NO: 2821342 - RNA, 22 nt, Mycobacterium avium subsp. paratuberculosis
cccgccgcaacagccggcccga

SEQ ID NO: 2821343 - RNA, 13 nt, Mycobacterium avium subsp. paratuberculosis
cccgccgccacca

SEQ ID NO: 2821344 - RNA, 17 nt, Mycobacterium avium subsp. paratuberculosis
cccgccgccaccacggc

SEQ ID NO: 2821345 - RNA, 18 nt, Mycobacterium avium subsp. paratuberculosis
cccgccgccgcggguggc

SEQ ID NO: 2821346 - RNA, 16 nt, Mycobacterium avium subsp. paratuberculosis
cccgccgccggcgcug

SEQ ID NO: 2821347 - RNA, 19 nt, Mycobacterium avium subsp. paratuberculosis
cccgccgccggcgcuggcg

SEQ ID NO: 2821348 - RNA, 21 nt, Mycobacterium avium subsp. paratuberculosis
cccgccgccggcgcuggcgcg

SEQ ID NO: 2821349 - RNA, 15 nt, Mycobacterium avium subsp. paratuberculosis
cccgccgccggcggc

SEQ ID NO: 2821350 - RNA, 20 nt, Mycobacterium avium subsp. paratuberculosis
cccgccgccgucgguguagc

SEQ ID NO: 2821351 - RNA, 13 nt, Mycobacterium avium subsp. paratuberculosis
cccgccgccgugc

SEQ ID NO: 2821352 - RNA, 16 nt, Mycobacterium avium subsp. paratuberculosis
cccgccgcgagccgcc

SEQ ID NO: 2821353 - RNA, 12 nt, Mycobacterium avium subsp. paratuberculosis
cccgccgcgccg

SEQ ID NO: 2821354 - RNA, 14 nt, Mycobacterium avium subsp. paratuberculosis
cccgccgcggccag

SEQ ID NO: 2821355 - RNA, 16 nt, Mycobacterium avium subsp. paratuberculosis
cccgccgcggccaggu

SEQ ID NO: 2821356 - RNA, 13 nt, Mycobacterium avium subsp. paratuberculosis
cccgccgcggccg

SEQ ID NO: 2821357 - RNA, 14 nt, Mycobacterium avium subsp. paratuberculosis
cccgccgcggccgc

SEQ ID NO: 2821358 - RNA, 15 nt, Mycobacterium avium subsp. paratuberculosis
cccgccgcggccgcu

SEQ ID NO: 2821359 - RNA, 19 nt, Mycobacterium avium subsp. paratuberculosis
cccgccgcggccgcuggcg

SEQ ID NO: 2821360 - RNA, 21 nt, Mycobacterium avium subsp. paratuberculosis
cccgccgcggccgcuggcguu

SEQ ID NO: 2821361 - RNA, 24 nt, Mycobacterium avium subsp. paratuberculosis
cccgccgcggccgcuggcguugag

SEQ ID NO: 2821362 - RNA, 17 nt, Mycobacterium avium subsp. paratuberculosis
cccgccgcggcgaccgg

SEQ ID NO: 2821363 - RNA, 16 nt, Mycobacterium avium subsp. paratuberculosis
cccgccgcggcgagcc

SEQ ID NO: 2821364 - RNA, 17 nt, Mycobacterium avium subsp. paratuberculosis
cccgccgcggcgagccg

SEQ ID NO: 2821365 - RNA, 20 nt, Mycobacterium avium subsp. paratuberculosis
cccgccgcggcgagccggcc

SEQ ID NO: 2821366 - RNA, 18 nt, Mycobacterium avium subsp. paratuberculosis
cccgccgcguacaccggc

SEQ ID NO: 2821367 - RNA, 21 nt, Mycobacterium avium subsp. paratuberculosis
cccgccgcgucagcggcgggc

SEQ ID NO: 2821368 - RNA, 22 nt, Mycobacterium avium subsp. paratuberculosis
cccgccgcucaccgccgagccg

SEQ ID NO: 2821369 - RNA, 21 nt, Mycobacterium avium subsp. paratuberculosis
cccgccgcugcagcugcucgu

SEQ ID NO: 2821370 - RNA, 16 nt, Mycobacterium avium subsp. paratuberculosis
cccgccggagaugauc

SEQ ID NO: 2821371 - RNA, 13 nt, Mycobacterium avium subsp. paratuberculosis
cccgccggagccg

SEQ ID NO: 2821372 - RNA, 15 nt, Mycobacterium avium subsp. paratuberculosis
cccgccggagccgau

SEQ ID NO: 2821373 - RNA, 12 nt, Mycobacterium avium subsp. paratuberculosis
cccgccggcccg

SEQ ID NO: 2821374 - RNA, 21 nt, Mycobacterium avium subsp. paratuberculosis
cccgccggcgaacgacgucga

SEQ ID NO: 2821375 - RNA, 13 nt, Mycobacterium avium subsp. paratuberculosis
cccgccggcgauc

SEQ ID NO: 2821376 - RNA, 21 nt, Mycobacterium avium subsp. paratuberculosis
cccgccggcgaucgacgucac

SEQ ID NO: 2821377 - RNA, 12 nt, Mycobacterium avium subsp. paratuberculosis
cccgccggcggc

SEQ ID NO: 2821378 - RNA, 13 nt, Mycobacterium avium subsp. paratuberculosis
cccgccggcggcc

SEQ ID NO: 2821379 - RNA, 14 nt, Mycobacterium avium subsp. paratuberculosis
cccgccggcggcga

SEQ ID NO: 2821380 - RNA, 22 nt, Mycobacterium avium subsp. paratuberculosis
cccgccggcggguuggccgucg

SEQ ID NO: 2821381 - RNA, 13 nt, Mycobacterium avium subsp. paratuberculosis
cccgccggcgucu

SEQ ID NO: 2821382 - RNA, 18 nt, Mycobacterium avium subsp. paratuberculosis
cccgccgggaugcgccac

SEQ ID NO: 2821383 - RNA, 23 nt, Mycobacterium avium subsp. paratuberculosis
cccgccgggaugcgccaccgaca

SEQ ID NO: 2821384 - RNA, 14 nt, Mycobacterium avium subsp. paratuberculosis
cccgccgggcaccc

SEQ ID NO: 2821385 - RNA, 14 nt, Mycobacterium avium subsp. paratuberculosis
cccgccgggccgga

SEQ ID NO: 2821386 - RNA, 18 nt, Mycobacterium avium subsp. paratuberculosis
cccgcgcggcucacagcg

SEQ ID NO: 2821387 - RNA, 19 nt, Mycobacterium avium subsp. paratuberculosis
cccgcgcggcucacagcgc

SEQ ID NO: 2821388 - RNA, 17 nt, Mycobacterium avium subsp. paratuberculosis
cccgcgcgggcaagggc

SEQ ID NO: 2821389 - RNA, 13 nt, Mycobacterium avium subsp. paratuberculosis
cccgcgcgggcug

SEQ ID NO: 2821390 - RNA, 14 nt, Mycobacterium avium subsp. paratuberculosis
cccgcgcgggggcc

SEQ ID NO: 2821391 - RNA, 17 nt, Mycobacterium avium subsp. paratuberculosis
cccgcgcgggggccgcc

SEQ ID NO: 2821392 - RNA, 13 nt, Mycobacterium avium subsp. paratuberculosis
cccgcgcgggguc

SEQ ID NO: 2821393 - RNA, 16 nt, Mycobacterium avium subsp. paratuberculosis
cccgcgcgggguccca

SEQ ID NO: 2821394 - RNA, 17 nt, Mycobacterium avium subsp. paratuberculosis
cccgcgcggggucccaa

SEQ ID NO: 2821395 - RNA, 14 nt, Mycobacterium avium subsp. paratuberculosis
cccgcgcggugccc

SEQ ID NO: 2821396 - RNA, 14 nt, Mycobacterium avium subsp. paratuberculosis
cccgcgcgucgcgc

SEQ ID NO: 2821397 - RNA, 15 nt, Mycobacterium avium subsp. paratuberculosis
cccgcgcgucgcgca

SEQ ID NO: 2821398 - RNA, 21 nt, Mycobacterium avium subsp. paratuberculosis
cccgcgcgugggccaacgcga

SEQ ID NO: 2821399 - RNA, 12 nt, Mycobacterium avium subsp. paratuberculosis
cccgcgcugccc

SEQ ID NO: 2821400 - RNA, 19 nt, Mycobacterium avium subsp. paratuberculosis
cccgcgcugcccagcgcgg

SEQ ID NO: 2821401 - RNA, 16 nt, Mycobacterium avium subsp. paratuberculosis
cccgcgcuggugcugc

SEQ ID NO: 2821402 - RNA, 22 nt, Mycobacterium avium subsp. paratuberculosis
cccgcgcuggugcugcugcccc

SEQ ID NO: 2821403 - RNA, 13 nt, Mycobacterium avium subsp. paratuberculosis
cccgcggaucgcg

SEQ ID NO: 2821404 - RNA, 16 nt, Mycobacterium avium subsp. paratuberculosis
cccgcggcacgcugcg

SEQ ID NO: 2821405 - RNA, 16 nt, Mycobacterium avium subsp. paratuberculosis
cccgcggcagccgggc

SEQ ID NO: 2821406 - RNA, 17 nt, Mycobacterium avium subsp. paratuberculosis
cccgcggcagccgggcg

SEQ ID NO: 2821407 - RNA, 12 nt, Mycobacterium avium subsp. paratuberculosis
cccgcggccacc

SEQ ID NO: 2821408 - RNA, 15 nt, Mycobacterium avium subsp. paratuberculosis
cccgcggccgccgcc

SEQ ID NO: 2821409 - RNA, 12 nt, Mycobacterium avium subsp. paratuberculosis
cccgcggccgcu

SEQ ID NO: 2821410 - RNA, 19 nt, Mycobacterium avium subsp. paratuberculosis
cccgcggccgcugcgccca

SEQ ID NO: 2821411 - RNA, 23 nt, Mycobacterium avium subsp. paratuberculosis
cccgcggccgcugcgcccagcgc

SEQ ID NO: 2821412 - RNA, 21 nt, Mycobacterium avium subsp. paratuberculosis
cccgcggccggcccagcgcgc

SEQ ID NO: 2821413 - RNA, 14 nt, Mycobacterium avium subsp. paratuberculosis
cccgcggccuccag

SEQ ID NO: 2821414 - RNA, 17 nt, Mycobacterium avium subsp. paratuberculosis
cccgcggccuccagccg

SEQ ID NO: 2821415 - RNA, 19 nt, Mycobacterium avium subsp. paratuberculosis
cccgcggccuccagccgcu

SEQ ID NO: 2821416 - RNA, 17 nt, Mycobacterium avium subsp. paratuberculosis
cccgcggcgcgaugauc

SEQ ID NO: 2821417 - RNA, 18 nt, Mycobacterium avium subsp. paratuberculosis
cccgcggcgcgcaggucg

SEQ ID NO: 2821418 - RNA, 22 nt, Mycobacterium avium subsp. paratuberculosis
cccgcggcggauccagcaccgc

SEQ ID NO: 2821419 - RNA, 18 nt, Mycobacterium avium subsp. paratuberculosis
cccgcgggacacggcggc

SEQ ID NO: 2821420 - RNA, 19 nt, Mycobacterium avium subsp. paratuberculosis
cccgcgggacacggcggcg

SEQ ID NO: 2821421 - RNA, 18 nt, Mycobacterium avium subsp. paratuberculosis
cccgcgggaguccacgcc

SEQ ID NO: 2821422 - RNA, 20 nt, Mycobacterium avium subsp. paratuberculosis
cccgcgggaguccacgccgu

SEQ ID NO: 2821423 - RNA, 22 nt, Mycobacterium avium subsp. paratuberculosis
cccgcgggccagacugcgcacc

SEQ ID NO: 2821424 - RNA, 21 nt, Mycobacterium avium subsp. paratuberculosis
cccgcggggcguacgcgcugc

SEQ ID NO: 2821425 - RNA, 23 nt, Mycobacterium avium subsp. paratuberculosis
cccgcggggcguacgcgcugccg

SEQ ID NO: 2821426 - RNA, 19 nt, Mycobacterium avium subsp. paratuberculosis
cccgcggguagcccgucga

SEQ ID NO: 2821427 - RNA, 21 nt, Mycobacterium avium subsp. paratuberculosis
cccgcggguagcccgucgacg

SEQ ID NO: 2821428 - RNA, 14 nt, Mycobacterium avium subsp. paratuberculosis
cccgcgggucgucg

SEQ ID NO: 2821429 - RNA, 15 nt, Mycobacterium avium subsp. paratuberculosis
cccgcgggucgucga

SEQ ID NO: 2821430 - RNA, 16 nt, Mycobacterium avium subsp. paratuberculosis
cccgcgggucgucgac

SEQ ID NO: 2821431 - RNA, 20 nt, Mycobacterium avium subsp. paratuberculosis
cccgcgggucgucgacgucg

SEQ ID NO: 2821432 - RNA, 21 nt, Mycobacterium avium subsp. paratuberculosis
cccgcgggucgucgacgucgg

SEQ ID NO: 2821433 - RNA, 19 nt, Mycobacterium avium subsp. paratuberculosis
cccgcgggugacgcugacc

SEQ ID NO: 2821434 - RNA, 16 nt, Mycobacterium avium subsp. paratuberculosis
cccgcgggugcagccg

SEQ ID NO: 2821435 - RNA, 23 nt, Mycobacterium avium subsp. paratuberculosis
cccgcggguggccuucaucaccg

SEQ ID NO: 2821436 - RNA, 20 nt, Mycobacterium avium subsp. paratuberculosis
cccgcggguguuucggucgg

SEQ ID NO: 2821437 - RNA, 20 nt, Mycobacterium avium subsp. paratuberculosis
cccgcggucaugcgcgggca

SEQ ID NO: 2821438 - RNA, 15 nt, Mycobacterium avium subsp. paratuberculosis
cccgcggucggcggc

SEQ ID NO: 2821439 - RNA, 18 nt, Mycobacterium avium subsp. paratuberculosis
cccgcggucggcggcgua

SEQ ID NO: 2821440 - RNA, 20 nt, Mycobacterium avium subsp. paratuberculosis
cccgcggugcagucggucgg

SEQ ID NO: 2821441 - RNA, 16 nt, Mycobacterium avium subsp. paratuberculosis
cccgcggugccgcagc

SEQ ID NO: 2821442 - RNA, 20 nt, Mycobacterium avium subsp. paratuberculosis
cccgcgguggaacccagcac

SEQ ID NO: 2821443 - RNA, 22 nt, Mycobacterium avium subsp. paratuberculosis
cccgcgguggaacccagcaccc

SEQ ID NO: 2821444 - RNA, 18 nt, Mycobacterium avium subsp. paratuberculosis
cccgcggugugcuggcca

SEQ ID NO: 2821445 - RNA, 20 nt, Mycobacterium avium subsp. paratuberculosis
cccgcggugugcuggccagc

SEQ ID NO: 2821446 - RNA, 21 nt, Mycobacterium avium subsp. paratuberculosis
cccgcggugugcuggccagca

SEQ ID NO: 2821447 - RNA, 23 nt, Mycobacterium avium subsp. paratuberculosis
cccgcggugugcuggccagcacc

SEQ ID NO: 2821448 - RNA, 20 nt, Mycobacterium avium subsp. paratuberculosis
cccgcguauugcacggcggc

SEQ ID NO: 2821449 - RNA, 21 nt, Mycobacterium avium subsp. paratuberculosis
cccgcguauugcacggcggcg

SEQ ID NO: 2821450 - RNA, 22 nt, Mycobacterium avium subsp. paratuberculosis
cccgcgucacauccgucacgcc

SEQ ID NO: 2821451 - RNA, 16 nt, Mycobacterium avium subsp. paratuberculosis
cccgcguccagcagca

SEQ ID NO: 2821452 - RNA, 20 nt, Mycobacterium avium subsp. paratuberculosis
cccgcguccugcagcgccgu

SEQ ID NO: 2821453 - RNA, 24 nt, Mycobacterium avium subsp. paratuberculosis
cccgcguccugcagcgccguccgc

SEQ ID NO: 2821454 - RNA, 16 nt, Mycobacterium avium subsp. paratuberculosis
cccgcgucgcgcagca

SEQ ID NO: 2821455 - RNA, 17 nt, Mycobacterium avium subsp. paratuberculosis
cccgcgugacggccgcg

SEQ ID NO: 2821456 - RNA, 19 nt, Mycobacterium avium subsp. paratuberculosis
cccgcgugacggccgcggc

SEQ ID NO: 2821457 - RNA, 21 nt, Mycobacterium avium subsp. paratuberculosis
cccgcgugacggccgcggcgc

SEQ ID NO: 2821458 - RNA, 23 nt, Mycobacterium avium subsp. paratuberculosis
cccgcgugacggccgcggcgcgg

SEQ ID NO: 2821459 - RNA, 20 nt, Mycobacterium avium subsp. paratuberculosis
cccgcguggcaggucgggcu

SEQ ID NO: 2821460 - RNA, 18 nt, Mycobacterium avium subsp. paratuberculosis
cccgcguggccgccagga

SEQ ID NO: 2821461 - RNA, 19 nt, Mycobacterium avium subsp. paratuberculosis
cccgcgugggcaccccgau

SEQ ID NO: 2821462 - RNA, 22 nt, Mycobacterium avium subsp. paratuberculosis
cccgcguugcggcgcagcgucu

SEQ ID NO: 2821463 - RNA, 15 nt, Mycobacterium avium subsp. paratuberculosis
cccgcguuggccagc

SEQ ID NO: 2821464 - RNA, 20 nt, Mycobacterium avium subsp. paratuberculosis
cccgcuaaagccgacugccc

SEQ ID NO: 2821465 - RNA, 22 nt, Mycobacterium avium subsp. paratuberculosis
cccgcucagagcugcaccgggu

SEQ ID NO: 2821466 - RNA, 19 nt, Mycobacterium avium subsp. paratuberculosis
cccgcucaggucggccgcg

SEQ ID NO: 2821467 - RNA, 20 nt, Mycobacterium avium subsp. paratuberculosis
cccgcucaggucggccgcgg

SEQ ID NO: 2821468 - RNA, 21 nt, Mycobacterium avium subsp. paratuberculosis
cccgcucaggucggccgcggc

SEQ ID NO: 2821469 - RNA, 22 nt, Mycobacterium avium subsp. paratuberculosis
cccgcucaggucggccgcggcc

SEQ ID NO: 2821470 - RNA, 22 nt, Mycobacterium avium subsp. paratuberculosis
cccggaccaggguggccccagc

SEQ ID NO: 2821471 - RNA, 16 nt, Mycobacterium avium subsp. paratuberculosis
cccggacccgcucgcc

SEQ ID NO: 2821472 - RNA, 15 nt, Mycobacterium avium subsp. paratuberculosis
cccggaccgccgcgg

SEQ ID NO: 2821473 - RNA, 16 nt, Mycobacterium avium subsp. paratuberculosis
cccggaccgccgcggc

SEQ ID NO: 2821474 - RNA, 18 nt, Mycobacterium avium subsp. paratuberculosis
cccggaccgccgcggcgg

SEQ ID NO: 2821475 - RNA, 19 nt, Mycobacterium avium subsp. paratuberculosis
cccggaccgccgcggcggc

SEQ ID NO: 2821476 - RNA, 13 nt, Mycobacterium avium subsp. paratuberculosis
cccggaccgcgga

SEQ ID NO: 2821477 - RNA, 16 nt, Mycobacterium avium subsp. paratuberculosis
cccggaccgcggucgg

SEQ ID NO: 2821478 - RNA, 14 nt, Mycobacterium avium subsp. paratuberculosis
cccggaccugccgg

SEQ ID NO: 2821479 - RNA, 17 nt, Mycobacterium avium subsp. paratuberculosis
cccggaccugccggcga

SEQ ID NO: 2821480 - RNA, 18 nt, Mycobacterium avium subsp. paratuberculosis
cccggaccugccggcgau

SEQ ID NO: 2821481 - RNA, 20 nt, Mycobacterium avium subsp. paratuberculosis
cccggacgaugacccagccc

SEQ ID NO: 2821482 - RNA, 21 nt, Mycobacterium avium subsp. paratuberculosis
cccggacgaugacccagccca

SEQ ID NO: 2821483 - RNA, 23 nt, Mycobacterium avium subsp. paratuberculosis
cccggacgcgcacacggccucgc

SEQ ID NO: 2821484 - RNA, 14 nt, Mycobacterium avium subsp. paratuberculosis
cccggacggagccg

SEQ ID NO: 2821485 - RNA, 19 nt, Mycobacterium avium subsp. paratuberculosis
cccggacggagccgugccc

SEQ ID NO: 2821486 - RNA, 23 nt, Mycobacterium avium subsp. paratuberculosis
cccggacggccaccuugucggcg

SEQ ID NO: 2821487 - RNA, 13 nt, Mycobacterium avium subsp. paratuberculosis
cccggacggccga

SEQ ID NO: 2821488 - RNA, 22 nt, Mycobacterium avium subsp. paratuberculosis
cccggacggccgaaacgcccgg

SEQ ID NO: 2821489 - RNA, 16 nt, Mycobacterium avium subsp. paratuberculosis
cccggacgugaucgcg

SEQ ID NO: 2821490 - RNA, 22 nt, Mycobacterium avium subsp. paratuberculosis
cccggagaacaucagccccuug

SEQ ID NO: 2821491 - RNA, 17 nt, Mycobacterium avium subsp. paratuberculosis
cccggagauccggccgc

SEQ ID NO: 2821492 - RNA, 21 nt, Mycobacterium avium subsp. paratuberculosis
cccggagauccggccgcuggu

SEQ ID NO: 2821493 - RNA, 15 nt, Mycobacterium avium subsp. paratuberculosis
cccggagaugguggc

SEQ ID NO: 2821494 - RNA, 13 nt, Mycobacterium avium subsp. paratuberculosis
cccggagccgucg

SEQ ID NO: 2821495 - RNA, 15 nt, Mycobacterium avium subsp. paratuberculosis
cccggagccgucggc

SEQ ID NO: 2821496 - RNA, 14 nt, Mycobacterium avium subsp. paratuberculosis
cccggaggcggcgg

SEQ ID NO: 2821497 - RNA, 17 nt, Mycobacterium avium subsp. paratuberculosis
cccggagguucgccgga

SEQ ID NO: 2821498 - RNA, 14 nt, Mycobacterium avium subsp. paratuberculosis
cccggaguagccgg

SEQ ID NO: 2821499 - RNA, 15 nt, Mycobacterium avium subsp. paratuberculosis
cccggaguccggcuc

SEQ ID NO: 2821500 - RNA, 22 nt, Mycobacterium avium subsp. paratuberculosis
cccggaguccggcucggugccg

SEQ ID NO: 2821501 - RNA, 23 nt, Mycobacterium avium subsp. paratuberculosis
cccggauaacgcaaaacggugcg

SEQ ID NO: 2821502 - RNA, 16 nt, Mycobacterium avium subsp. paratuberculosis
cccggauacacggugg

SEQ ID NO: 2821503 - RNA, 15 nt, Mycobacterium avium subsp. paratuberculosis
cccggauccgucgcc

SEQ ID NO: 2821504 - RNA, 18 nt, Mycobacterium avium subsp. paratuberculosis
cccggauccgucgccccg

SEQ ID NO: 2821505 - RNA, 20 nt, Mycobacterium avium subsp. paratuberculosis
cccggauccgucgccccgca

SEQ ID NO: 2821506 - RNA, 23 nt, Mycobacterium avium subsp. paratuberculosis
cccggauccgucgccccgcaccg

SEQ ID NO: 2821507 - RNA, 16 nt, Mycobacterium avium subsp. paratuberculosis
cccggaucgccgaacg

SEQ ID NO: 2821508 - RNA, 12 nt, Mycobacterium avium subsp. paratuberculosis
cccggaucggcc

SEQ ID NO: 2821509 - RNA, 21 nt, Mycobacterium avium subsp. paratuberculosis
cccggaucuugccgucggccg

SEQ ID NO: 2821510 - RNA, 23 nt, Mycobacterium avium subsp. paratuberculosis
cccggaugaccaggguggucagc

SEQ ID NO: 2821511 - RNA, 20 nt, Mycobacterium avium subsp. paratuberculosis
cccggaugaucaacacgucg

SEQ ID NO: 2821512 - RNA, 23 nt, Mycobacterium avium subsp. paratuberculosis
cccggaugaucaacacgucgucg

SEQ ID NO: 2821513 - RNA, 23 nt, Mycobacterium avium subsp. paratuberculosis
cccggaugauguucuccggcccg

SEQ ID NO: 2821514 - RNA, 15 nt, Mycobacterium avium subsp. paratuberculosis
cccggaugccggcgc

SEQ ID NO: 2821515 - RNA, 22 nt, Mycobacterium avium subsp. paratuberculosis
cccggaugccggcgcccagcgg

SEQ ID NO: 2821516 - RNA, 16 nt, Mycobacterium avium subsp. paratuberculosis
cccggauggagcgcga

SEQ ID NO: 2821517 - RNA, 18 nt, Mycobacterium avium subsp. paratuberculosis
cccggauggagcgcgacg

SEQ ID NO: 2821518 - RNA, 16 nt, Mycobacterium avium subsp. paratuberculosis
cccggauggccgggca

SEQ ID NO: 2821519 - RNA, 20 nt, Mycobacterium avium subsp. paratuberculosis
cccggauggccgggcaggcc

SEQ ID NO: 2821520 - RNA, 14 nt, Mycobacterium avium subsp. paratuberculosis
cccggauggucugc

SEQ ID NO: 2821521 - RNA, 19 nt, Mycobacterium avium subsp. paratuberculosis
cccggauggucugcagcga

SEQ ID NO: 2821522 - RNA, 21 nt, Mycobacterium avium subsp. paratuberculosis
cccggauggucugcagcgacg

SEQ ID NO: 2821523 - RNA, 16 nt, Mycobacterium avium subsp. paratuberculosis
cccggaugucgggcga

SEQ ID NO: 2821524 - RNA, 17 nt, Mycobacterium avium subsp. paratuberculosis
cccggaugucguagacg

SEQ ID NO: 2821525 - RNA, 21 nt, Mycobacterium avium subsp. paratuberculosis
cccggauucgcggcggcgccg

SEQ ID NO: 2821526 - RNA, 13 nt, Mycobacterium avium subsp. paratuberculosis
cccggcaacaccg

SEQ ID NO: 2821527 - RNA, 16 nt, Mycobacterium avium subsp. paratuberculosis
cccggcaccaccaccc

SEQ ID NO: 2821528 - RNA, 15 nt, Mycobacterium avium subsp. paratuberculosis
cccggcaccgggacc

SEQ ID NO: 2821529 - RNA, 18 nt, Mycobacterium avium subsp. paratuberculosis
cccggcacgaacgcgacg

SEQ ID NO: 2821530 - RNA, 21 nt, Mycobacterium avium subsp. paratuberculosis
cccggcagaucgcggcccgcc

SEQ ID NO: 2821531 - RNA, 22 nt, Mycobacterium avium subsp. paratuberculosis
cccggcagaucgcggcccgccg

SEQ ID NO: 2821532 - RNA, 16 nt, Mycobacterium avium subsp. paratuberculosis
cccggcagcggggcga

SEQ ID NO: 2821533 - RNA, 20 nt, Mycobacterium avium subsp. paratuberculosis
cccggcagcggucauugaug

SEQ ID NO: 2821534 - RNA, 14 nt, Mycobacterium avium subsp. paratuberculosis
cccggccaacggga

SEQ ID NO: 2821535 - RNA, 16 nt, Mycobacterium avium subsp. paratuberculosis
cccggccaacgggaag

SEQ ID NO: 2821536 - RNA, 14 nt, Mycobacterium avium subsp. paratuberculosis
cccggccaccaggg

SEQ ID NO: 2821537 - RNA, 16 nt, Mycobacterium avium subsp. paratuberculosis
cccggccaccagggac

SEQ ID NO: 2821538 - RNA, 17 nt, Mycobacterium avium subsp. paratuberculosis
cccggccaccagggaca

SEQ ID NO: 2821539 - RNA, 15 nt, Mycobacterium avium subsp. paratuberculosis
cccggccaccccgca

SEQ ID NO: 2821540 - RNA, 17 nt, Mycobacterium avium subsp. paratuberculosis
cccggccaccgccgcca

SEQ ID NO: 2821541 - RNA, 18 nt, Mycobacterium avium subsp. paratuberculosis
cccggccaccgccgccag

SEQ ID NO: 2821542 - RNA, 18 nt, Mycobacterium avium subsp. paratuberculosis
cccggccaccuggccggu

SEQ ID NO: 2821543 - RNA, 15 nt, Mycobacterium avium subsp. paratuberculosis
cccggccacgccggg

SEQ ID NO: 2821544 - RNA, 17 nt, Mycobacterium avium subsp. paratuberculosis
cccggccacgucgaugc

SEQ ID NO: 2821545 - RNA, 15 nt, Mycobacterium avium subsp. paratuberculosis
cccggccacucgccg

SEQ ID NO: 2821546 - RNA, 17 nt, Mycobacterium avium subsp. paratuberculosis
cccggccacucgccgcg

SEQ ID NO: 2821547 - RNA, 13 nt, Mycobacterium avium subsp. paratuberculosis
cccggccagcacc

SEQ ID NO: 2821548 - RNA, 14 nt, Mycobacterium avium subsp. paratuberculosis
cccggccagcacgc

SEQ ID NO: 2821549 - RNA, 15 nt, Mycobacterium avium subsp. paratuberculosis
cccggccagcacgcc

SEQ ID NO: 2821550 - RNA, 12 nt, Mycobacterium avium subsp. paratuberculosis
cccggccagccg

SEQ ID NO: 2821551 - RNA, 13 nt, Mycobacterium avium subsp. paratuberculosis
cccggccagccgg

SEQ ID NO: 2821552 - RNA, 17 nt, Mycobacterium avium subsp. paratuberculosis
cccggccagccggccgc

SEQ ID NO: 2821553 - RNA, 15 nt, Mycobacterium avium subsp. paratuberculosis
cccggccagccgggc

SEQ ID NO: 2821554 - RNA, 16 nt, Mycobacterium avium subsp. paratuberculosis
cccggccagccgggcg

SEQ ID NO: 2821555 - RNA, 13 nt, Mycobacterium avium subsp. paratuberculosis
cccggcgagcagc

SEQ ID NO: 2821556 - RNA, 14 nt, Mycobacterium avium subsp. paratuberculosis
cccggcgagcgacg

SEQ ID NO: 2821557 - RNA, 14 nt, Mycobacterium avium subsp. paratuberculosis
cccggcgagcgcgu

SEQ ID NO: 2821558 - RNA, 17 nt, Mycobacterium avium subsp. paratuberculosis
cccggcgagcggcaccu

SEQ ID NO: 2821559 - RNA, 17 nt, Mycobacterium avium subsp. paratuberculosis
cccggcgaggccaggcg

SEQ ID NO: 2821560 - RNA, 19 nt, Mycobacterium avium subsp. paratuberculosis
cccggcgaggccaggcguu

SEQ ID NO: 2821561 - RNA, 23 nt, Mycobacterium avium subsp. paratuberculosis
cccggcgaguggaagucagcgcg

SEQ ID NO: 2821562 - RNA, 20 nt, Mycobacterium avium subsp. paratuberculosis
cccggcgauacccgggagca

SEQ ID NO: 2821563 - RNA, 19 nt, Mycobacterium avium subsp. paratuberculosis
cccggcgaucucgagcauc

SEQ ID NO: 2821564 - RNA, 11 nt, Mycobacterium avium subsp. paratuberculosis
cccggcgauga

SEQ ID NO: 2821565 - RNA, 13 nt, Mycobacterium avium subsp. paratuberculosis
cccggcgaugacc

SEQ ID NO: 2821566 - RNA, 17 nt, Mycobacterium avium subsp. paratuberculosis
cccggcgaugaccggga

SEQ ID NO: 2821567 - RNA, 20 nt, Mycobacterium avium subsp. paratuberculosis
cccggcgaugaucaggccgg

SEQ ID NO: 2821568 - RNA, 22 nt, Mycobacterium avium subsp. paratuberculosis
cccggcgaugaucaggccggac

SEQ ID NO: 2821569 - RNA, 14 nt, Mycobacterium avium subsp. paratuberculosis
cccggcgaugccga

SEQ ID NO: 2821570 - RNA, 15 nt, Mycobacterium avium subsp. paratuberculosis
cccggcgaugccgag

SEQ ID NO: 2821571 - RNA, 18 nt, Mycobacterium avium subsp. paratuberculosis
cccggcgaugccgagccc

SEQ ID NO: 2821572 - RNA, 13 nt, Mycobacterium avium subsp. paratuberculosis
cccggcgaugcgc

SEQ ID NO: 2821573 - RNA, 23 nt, Mycobacterium avium subsp. paratuberculosis
cccggcgaugcgcacgucggccg

SEQ ID NO: 2821574 - RNA, 17 nt, Mycobacterium avium subsp. paratuberculosis
cccggcgaugucgggca

SEQ ID NO: 2821575 - RNA, 14 nt, Mycobacterium avium subsp. paratuberculosis
cccggcgcacagga

SEQ ID NO: 2821576 - RNA, 16 nt, Mycobacterium avium subsp. paratuberculosis
cccggcgcaccaggcg

SEQ ID NO: 2821577 - RNA, 18 nt, Mycobacterium avium subsp. paratuberculosis
cccggcgcaccaggcgcc

SEQ ID NO: 2821578 - RNA, 17 nt, Mycobacterium avium subsp. paratuberculosis
cccggcgcagcgccgcg

SEQ ID NO: 2821579 - RNA, 19 nt, Mycobacterium avium subsp. paratuberculosis
cccggcgccacgcacaccg

SEQ ID NO: 2821580 - RNA, 16 nt, Mycobacterium avium subsp. paratuberculosis
cccggcgccacgccgc

SEQ ID NO: 2821581 - RNA, 17 nt, Mycobacterium avium subsp. paratuberculosis
cccggcgccacgccgcg

SEQ ID NO: 2821582 - RNA, 12 nt, Mycobacterium avium subsp. paratuberculosis
cccggcgcccgg

SEQ ID NO: 2821583 - RNA, 13 nt, Mycobacterium avium subsp. paratuberculosis
cccggcgcccggc

SEQ ID NO: 2821584 - RNA, 16 nt, Mycobacterium avium subsp. paratuberculosis
cccggcgcccggccgg

SEQ ID NO: 2821585 - RNA, 18 nt, Mycobacterium avium subsp. paratuberculosis
cccggcgcccggccggcc

SEQ ID NO: 2821586 - RNA, 17 nt, Mycobacterium avium subsp. paratuberculosis
cccggcgcccggccggu

SEQ ID NO: 2821587 - RNA, 20 nt, Mycobacterium avium subsp. paratuberculosis
cccggcgcccggccggugcu

SEQ ID NO: 2821588 - RNA, 16 nt, Mycobacterium avium subsp. paratuberculosis
cccggcgcccggcgcg

SEQ ID NO: 2821589 - RNA, 17 nt, Mycobacterium avium subsp. paratuberculosis
cccggcgcccggcgcgc

SEQ ID NO: 2821590 - RNA, 19 nt, Mycobacterium avium subsp. paratuberculosis
cccggcgcccggcgcgcca

SEQ ID NO: 2821591 - RNA, 17 nt, Mycobacterium avium subsp. paratuberculosis
cccggcgcccugcaccc

SEQ ID NO: 2821592 - RNA, 22 nt, Mycobacterium avium subsp. paratuberculosis
cccggcgcccugcacccagccg

SEQ ID NO: 2821593 - RNA, 21 nt, Mycobacterium avium subsp. paratuberculosis
cccggcgcccuucggcgcccg

SEQ ID NO: 2821594 - RNA, 13 nt, Mycobacterium avium subsp. paratuberculosis
cccggcgccgacc

SEQ ID NO: 2821595 - RNA, 21 nt, Mycobacterium avium subsp. paratuberculosis
cccggcgccgccguucgccgg

SEQ ID NO: 2821596 - RNA, 12 nt, Mycobacterium avium subsp. paratuberculosis
cccggcgccgga

SEQ ID NO: 2821597 - RNA, 12 nt, Mycobacterium avium subsp. paratuberculosis
cccggcgccggc

SEQ ID NO: 2821598 - RNA, 16 nt, Mycobacterium avium subsp. paratuberculosis
cccggcgccggcccgc

SEQ ID NO: 2821599 - RNA, 14 nt, Mycobacterium avium subsp. paratuberculosis
cccggcgccggccg

SEQ ID NO: 2821600 - RNA, 13 nt, Mycobacterium avium subsp. paratuberculosis
cccggcgccggcg

SEQ ID NO: 2821601 - RNA, 17 nt, Mycobacterium avium subsp. paratuberculosis
cccggcgccggcggcca

SEQ ID NO: 2821602 - RNA, 18 nt, Mycobacterium avium subsp. paratuberculosis
cccggcgccggcggccac

SEQ ID NO: 2821603 - RNA, 13 nt, Mycobacterium avium subsp. paratuberculosis
cccggcgccgucg

SEQ ID NO: 2821604 - RNA, 15 nt, Mycobacterium avium subsp. paratuberculosis
cccggcgcgacggca

SEQ ID NO: 2821605 - RNA, 20 nt, Mycobacterium avium subsp. paratuberculosis
cccggcgcgccacgacguac

SEQ ID NO: 2821606 - RNA, 12 nt, Mycobacterium avium subsp. paratuberculosis
cccggcgcgccg

SEQ ID NO: 2821607 - RNA, 14 nt, Mycobacterium avium subsp. paratuberculosis
cccggcgcgccgca

SEQ ID NO: 2821608 - RNA, 21 nt, Mycobacterium avium subsp. paratuberculosis
cccggcgcgccgcaggagauc

SEQ ID NO: 2821609 - RNA, 13 nt, Mycobacterium avium subsp. paratuberculosis
cccggcgcgccug

SEQ ID NO: 2821610 - RNA, 17 nt, Mycobacterium avium subsp. paratuberculosis
cccggcgcgccugcgcg

SEQ ID NO: 2821611 - RNA, 12 nt, Mycobacterium avium subsp. paratuberculosis
cccggcgcgcgg

SEQ ID NO: 2821612 - RNA, 11 nt, Mycobacterium avium subsp. paratuberculosis
cccggcgcgga

SEQ ID NO: 2821613 - RNA, 19 nt, Mycobacterium avium subsp. paratuberculosis
cccggcgcggaacgcgccg

SEQ ID NO: 2821614 - RNA, 16 nt, Mycobacterium avium subsp. paratuberculosis
cccggcgcggacagcg

SEQ ID NO: 2821615 - RNA, 18 nt, Mycobacterium avium subsp. paratuberculosis
cccggcgcggacagcgcg

SEQ ID NO: 2821616 - RNA, 24 nt, Mycobacterium avium subsp. paratuberculosis
cccggcgcggacagcgcggugaug

SEQ ID NO: 2821617 - RNA, 14 nt, Mycobacterium avium subsp. paratuberculosis
cccggcgcggccgc

SEQ ID NO: 2821618 - RNA, 15 nt, Mycobacterium avium subsp. paratuberculosis
cccggcgcggccggu

SEQ ID NO: 2821619 - RNA, 23 nt, Mycobacterium avium subsp. paratuberculosis
cccggcgcggccggugcgcguca

SEQ ID NO: 2821620 - RNA, 13 nt, Mycobacterium avium subsp. paratuberculosis
cccggcgcggcgg

SEQ ID NO: 2821621 - RNA, 14 nt, Mycobacterium avium subsp. paratuberculosis
cccggcgcggcggc

SEQ ID NO: 2821622 - RNA, 18 nt, Mycobacterium avium subsp. paratuberculosis
cccggcgcggcggcgccg

SEQ ID NO: 2821623 - RNA, 19 nt, Mycobacterium avium subsp. paratuberculosis
cccggcgcggcggcgccgc

SEQ ID NO: 2821624 - RNA, 22 nt, Mycobacterium avium subsp. paratuberculosis
cccggcgcuaaagccgaccgcc

SEQ ID NO: 2821625 - RNA, 23 nt, Mycobacterium avium subsp. paratuberculosis
cccggcgcuaaagccgaccgccc

SEQ ID NO: 2821626 - RNA, 17 nt, Mycobacterium avium subsp. paratuberculosis
cccggcgcucaccgcga

SEQ ID NO: 2821627 - RNA, 13 nt, Mycobacterium avium subsp. paratuberculosis
cccggcgcugcgc

SEQ ID NO: 2821628 - RNA, 17 nt, Mycobacterium avium subsp. paratuberculosis
cccggcgcugcgcccgg

SEQ ID NO: 2821629 - RNA, 13 nt, Mycobacterium avium subsp. paratuberculosis
cccggcggacccg

SEQ ID NO: 2821630 - RNA, 13 nt, Mycobacterium avium subsp. paratuberculosis
cccggcggcaccg

SEQ ID NO: 2821631 - RNA, 14 nt, Mycobacterium avium subsp. paratuberculosis
cccggcggcaccgc

SEQ ID NO: 2821632 - RNA, 16 nt, Mycobacterium avium subsp. paratuberculosis
cccggcggcaccgccg

SEQ ID NO: 2821633 - RNA, 13 nt, Mycobacterium avium subsp. paratuberculosis
cccggcggccacg

SEQ ID NO: 2821634 - RNA, 12 nt, Mycobacterium avium subsp. paratuberculosis
cccggcggcccc

SEQ ID NO: 2821635 - RNA, 15 nt, Mycobacterium avium subsp. paratuberculosis
cccggcggccccggu

SEQ ID NO: 2821636 - RNA, 12 nt, Mycobacterium avium subsp. paratuberculosis
cccggcggccgg

SEQ ID NO: 2821637 - RNA, 13 nt, Mycobacterium avium subsp. paratuberculosis
cccggcggccggc

SEQ ID NO: 2821638 - RNA, 14 nt, Mycobacterium avium subsp. paratuberculosis
cccggcggccggcc

SEQ ID NO: 2821639 - RNA, 15 nt, Mycobacterium avium subsp. paratuberculosis
cccggcggccggccc

SEQ ID NO: 2821640 - RNA, 21 nt, Mycobacterium avium subsp. paratuberculosis
cccggcggccggccccggccg

SEQ ID NO: 2821641 - RNA, 18 nt, Mycobacterium avium subsp. paratuberculosis
cccgggccaggcgcgcgu

SEQ ID NO: 2821642 - RNA, 12 nt, Mycobacterium avium subsp. paratuberculosis
cccgggccaggu

SEQ ID NO: 2821643 - RNA, 15 nt, Mycobacterium avium subsp. paratuberculosis
cccgggccagguucg

SEQ ID NO: 2821644 - RNA, 16 nt, Mycobacterium avium subsp. paratuberculosis
cccgggcccgcugcag

SEQ ID NO: 2821645 - RNA, 22 nt, Mycobacterium avium subsp. paratuberculosis
cccgggcccguagcucgcgccg

SEQ ID NO: 2821646 - RNA, 16 nt, Mycobacterium avium subsp. paratuberculosis
cccgggccgcagcucg

SEQ ID NO: 2821647 - RNA, 17 nt, Mycobacterium avium subsp. paratuberculosis
cccgggccgcagggugg

SEQ ID NO: 2821648 - RNA, 13 nt, Mycobacterium avium subsp. paratuberculosis
cccgggccgccac

SEQ ID NO: 2821649 - RNA, 15 nt, Mycobacterium avium subsp. paratuberculosis
cccgggccgccacgg

SEQ ID NO: 2821650 - RNA, 18 nt, Mycobacterium avium subsp. paratuberculosis
cccgggccgccacggcgc

SEQ ID NO: 2821651 - RNA, 15 nt, Mycobacterium avium subsp. paratuberculosis
cccgggccgcgccca

SEQ ID NO: 2821652 - RNA, 16 nt, Mycobacterium avium subsp. paratuberculosis
cccgggccgcgcccag

SEQ ID NO: 2821653 - RNA, 21 nt, Mycobacterium avium subsp. paratuberculosis
cccgggccgucaucgccgacg

SEQ ID NO: 2821654 - RNA, 21 nt, Mycobacterium avium subsp. paratuberculosis
cccgggccguucagcgggcgg

SEQ ID NO: 2821655 - RNA, 20 nt, Mycobacterium avium subsp. paratuberculosis
cccgggccugcggcggccgc

SEQ ID NO: 2821656 - RNA, 24 nt, Mycobacterium avium subsp. paratuberculosis
cccgggccugcggcggccgcagcg

SEQ ID NO: 2821657 - RNA, 14 nt, Mycobacterium avium subsp. paratuberculosis
cccgggcgaacguc

SEQ ID NO: 2821658 - RNA, 23 nt, Mycobacterium avium subsp. paratuberculosis
cccgggcgacuucguuggugguc

SEQ ID NO: 2821659 - RNA, 16 nt, Mycobacterium avium subsp. paratuberculosis
cccgggcgaucagccc

SEQ ID NO: 2821660 - RNA, 20 nt, Mycobacterium avium subsp. paratuberculosis
cccgggcgccggcgaugaac

SEQ ID NO: 2821661 - RNA, 13 nt, Mycobacterium avium subsp. paratuberculosis
cccgggcgcgacg

SEQ ID NO: 2821662 - RNA, 21 nt, Mycobacterium avium subsp. paratuberculosis
cccgggcgcgacggucacgcu

SEQ ID NO: 2821663 - RNA, 12 nt, Mycobacterium avium subsp. paratuberculosis
cccgggcgcgcc

SEQ ID NO: 2821664 - RNA, 16 nt, Mycobacterium avium subsp. paratuberculosis
cccgggcgcgcccacc

SEQ ID NO: 2821665 - RNA, 21 nt, Mycobacterium avium subsp. paratuberculosis
cccgggcgcgugcacaccggc

SEQ ID NO: 2821666 - RNA, 15 nt, Mycobacterium avium subsp. paratuberculosis
cccgggcgcugagca

SEQ ID NO: 2821667 - RNA, 19 nt, Mycobacterium avium subsp. paratuberculosis
cccgggcgcugagcacggu

SEQ ID NO: 2821668 - RNA, 14 nt, Mycobacterium avium subsp. paratuberculosis
cccgggcggcccgc

SEQ ID NO: 2821669 - RNA, 15 nt, Mycobacterium avium subsp. paratuberculosis
cccgggcggcccgca

SEQ ID NO: 2821670 - RNA, 14 nt, Mycobacterium avium subsp. paratuberculosis
cccgggcggccugc

SEQ ID NO: 2821671 - RNA, 16 nt, Mycobacterium avium subsp. paratuberculosis
cccgggcggccugcug

SEQ ID NO: 2821672 - RNA, 13 nt, Mycobacterium avium subsp. paratuberculosis
cccgggcggcgag

SEQ ID NO: 2821673 - RNA, 16 nt, Mycobacterium avium subsp. paratuberculosis
cccgggcggcggggcu

SEQ ID NO: 2821674 - RNA, 13 nt, Mycobacterium avium subsp. paratuberculosis
cccgggcggucgc

SEQ ID NO: 2821675 - RNA, 15 nt, Mycobacterium avium subsp. paratuberculosis
cccgggcggucgcgu

SEQ ID NO: 2821676 - RNA, 20 nt, Mycobacterium avium subsp. paratuberculosis
cccgggcgugccggacaccg

SEQ ID NO: 2821677 - RNA, 22 nt, Mycobacterium avium subsp. paratuberculosis
cccgggcgugccggacaccggc

SEQ ID NO: 2821678 - RNA, 17 nt, Mycobacterium avium subsp. paratuberculosis
cccgggcguucccgcgc

SEQ ID NO: 2821679 - RNA, 20 nt, Mycobacterium avium subsp. paratuberculosis
cccgggcuagacgcgcacca

SEQ ID NO: 2821680 - RNA, 20 nt, Mycobacterium avium subsp. paratuberculosis
cccgggcugcccggcgccgg

SEQ ID NO: 2821681 - RNA, 13 nt, Mycobacterium avium subsp. paratuberculosis
cccggggccucca

SEQ ID NO: 2821682 - RNA, 16 nt, Mycobacterium avium subsp. paratuberculosis
cccggggccuccagcc

SEQ ID NO: 2821683 - RNA, 15 nt, Mycobacterium avium subsp. paratuberculosis
cccggggcgcgcugg

SEQ ID NO: 2821684 - RNA, 18 nt, Mycobacterium avium subsp. paratuberculosis
cccggggcgcggaccgca

SEQ ID NO: 2821685 - RNA, 13 nt, Mycobacterium avium subsp. paratuberculosis
cccggggcggcga

SEQ ID NO: 2821686 - RNA, 15 nt, Mycobacterium avium subsp. paratuberculosis
cccggggcggcgaug

SEQ ID NO: 2821687 - RNA, 20 nt, Mycobacterium avium subsp. paratuberculosis
cccggggcggcgaugcgcgg

SEQ ID NO: 2821688 - RNA, 21 nt, Mycobacterium avium subsp. paratuberculosis
cccggggcggcgaugcgcggc

SEQ ID NO: 2821689 - RNA, 17 nt, Mycobacterium avium subsp. paratuberculosis
cccgggggaccagcgca

SEQ ID NO: 2821690 - RNA, 17 nt, Mycobacterium avium subsp. paratuberculosis
cccggggguagcggugg

SEQ ID NO: 2821691 - RNA, 18 nt, Mycobacterium avium subsp. paratuberculosis
cccgggguccaccggccg

SEQ ID NO: 2821692 - RNA, 22 nt, Mycobacterium avium subsp. paratuberculosis
cccgggguggauccgucgcuac

SEQ ID NO: 2821693 - RNA, 15 nt, Mycobacterium avium subsp. paratuberculosis
cccggguccuggauc

SEQ ID NO: 2821694 - RNA, 21 nt, Mycobacterium avium subsp. paratuberculosis
cccggguccuggcccccgccc

SEQ ID NO: 2821695 - RNA, 16 nt, Mycobacterium avium subsp. paratuberculosis
cccgggucgucggugc

SEQ ID NO: 2821696 - RNA, 19 nt, Mycobacterium avium subsp. paratuberculosis
cccgggucgugcggcggcg

SEQ ID NO: 2821697 - RNA, 19 nt, Mycobacterium avium subsp. paratuberculosis
cccgggucuagaucuccag

SEQ ID NO: 2821698 - RNA, 20 nt, Mycobacterium avium subsp. paratuberculosis
cccgggucuagaucuccagg

SEQ ID NO: 2821699 - RNA, 23 nt, Mycobacterium avium subsp. paratuberculosis
cccgggugaccgccuuggcgcgc

SEQ ID NO: 2821700 - RNA, 12 nt, Mycobacterium avium subsp. paratuberculosis
cccgggugcagg

SEQ ID NO: 2821701 - RNA, 19 nt, Mycobacterium avium subsp. paratuberculosis
cccgggugcaggcccagcu

SEQ ID NO: 2821702 - RNA, 21 nt, Mycobacterium avium subsp. paratuberculosis
cccgggugcaggcccagcugc

SEQ ID NO: 2821703 - RNA, 15 nt, Mycobacterium avium subsp. paratuberculosis
cccgggugcccggcu

SEQ ID NO: 2821704 - RNA, 19 nt, Mycobacterium avium subsp. paratuberculosis
cccgggugcgcgucgcggu

SEQ ID NO: 2821705 - RNA, 19 nt, Mycobacterium avium subsp. paratuberculosis
cccgggugcgcuugucggc

SEQ ID NO: 2821706 - RNA, 21 nt, Mycobacterium avium subsp. paratuberculosis
cccgggugcgcuugucggcgu

SEQ ID NO: 2821707 - RNA, 15 nt, Mycobacterium avium subsp. paratuberculosis
cccggguggacaccg

SEQ ID NO: 2821708 - RNA, 15 nt, Mycobacterium avium subsp. paratuberculosis
cccggguggcccgca

SEQ ID NO: 2821709 - RNA, 15 nt, Mycobacterium avium subsp. paratuberculosis
cccggguggcgucca

SEQ ID NO: 2821710 - RNA, 23 nt, Mycobacterium avium subsp. paratuberculosis
cccgggugugggcgccgucaaug

SEQ ID NO: 2821711 - RNA, 18 nt, Mycobacterium avium subsp. paratuberculosis
cccggguguuggagccgu

SEQ ID NO: 2821712 - RNA, 20 nt, Mycobacterium avium subsp. paratuberculosis
cccggguugagcaggucagc

SEQ ID NO: 2821713 - RNA, 23 nt, Mycobacterium avium subsp. paratuberculosis
cccggguugucgacguggugcac

SEQ ID NO: 2821714 - RNA, 15 nt, Mycobacterium avium subsp. paratuberculosis
cccgguacagcgccg

SEQ ID NO: 2821715 - RNA, 19 nt, Mycobacterium avium subsp. paratuberculosis
cccgguacaucgacgcgac

SEQ ID NO: 2821716 - RNA, 22 nt, Mycobacterium avium subsp. paratuberculosis
cccgguacggcucaacggccgg

SEQ ID NO: 2821717 - RNA, 23 nt, Mycobacterium avium subsp. paratuberculosis
cccgguacggcucaacggccggc

SEQ ID NO: 2821718 - RNA, 19 nt, Mycobacterium avium subsp. paratuberculosis
cccgguagagcggcaccag

SEQ ID NO: 2821719 - RNA, 23 nt, Mycobacterium avium subsp. paratuberculosis
cccgguagauauggcccuccacg

SEQ ID NO: 2821720 - RNA, 15 nt, Mycobacterium avium subsp. paratuberculosis
cccgguagccagcac

SEQ ID NO: 2821721 - RNA, 17 nt, Mycobacterium avium subsp. paratuberculosis
cccgguagccagcaccg

SEQ ID NO: 2821722 - RNA, 16 nt, Mycobacterium avium subsp. paratuberculosis
cccgguagcgcagcac

SEQ ID NO: 2821723 - RNA, 17 nt, Mycobacterium avium subsp. paratuberculosis
cccgguagcgcagcacc

SEQ ID NO: 2821724 - RNA, 21 nt, Mycobacterium avium subsp. paratuberculosis
cccgguagcgcagcaccaggc

SEQ ID NO: 2821725 - RNA, 22 nt, Mycobacterium avium subsp. paratuberculosis
cccgguuucguuguccaccauc

SEQ ID NO: 2821726 - RNA, 13 nt, Mycobacterium avium subsp. paratuberculosis
cccguaacacgau

SEQ ID NO: 2821727 - RNA, 21 nt, Mycobacterium avium subsp. paratuberculosis
cccguaacacgaucaccccga

SEQ ID NO: 2821728 - RNA, 16 nt, Mycobacterium avium subsp. paratuberculosis
cccguaccagcgcucg

SEQ ID NO: 2821729 - RNA, 19 nt, Mycobacterium avium subsp. paratuberculosis
cccguacggguugccgucg

SEQ ID NO: 2821730 - RNA, 22 nt, Mycobacterium avium subsp. paratuberculosis
cccguacggguugccgucgacg

SEQ ID NO: 2821731 - RNA, 21 nt, Mycobacterium avium subsp. paratuberculosis
cccguagaacaguucgacgua

SEQ ID NO: 2821732 - RNA, 12 nt, Mycobacterium avium subsp. paratuberculosis
cccguagaccca

SEQ ID NO: 2821733 - RNA, 15 nt, Mycobacterium avium subsp. paratuberculosis
cccguagaugccggu

SEQ ID NO: 2821734 - RNA, 14 nt, Mycobacterium avium subsp. paratuberculosis
cccguagaugcggc

SEQ ID NO: 2821735 - RNA, 17 nt, Mycobacterium avium subsp. paratuberculosis
cccguagaugcggccca

SEQ ID NO: 2821736 - RNA, 13 nt, Mycobacterium avium subsp. paratuberculosis
cccguagccguag

SEQ ID NO: 2821737 - RNA, 13 nt, Mycobacterium avium subsp. paratuberculosis
cccguagcggcgg

SEQ ID NO: 2821738 - RNA, 15 nt, Mycobacterium avium subsp. paratuberculosis
cccguagcggcggaa

SEQ ID NO: 2821739 - RNA, 13 nt, Mycobacterium avium subsp. paratuberculosis
cccguagcggugg

SEQ ID NO: 2821740 - RNA, 14 nt, Mycobacterium avium subsp. paratuberculosis
cccguaggucgccu

SEQ ID NO: 2821741 - RNA, 16 nt, Mycobacterium avium subsp. paratuberculosis
cccguagguugcccca

SEQ ID NO: 2821742 - RNA, 16 nt, Mycobacterium avium subsp. paratuberculosis
cccguagucggcggcg

SEQ ID NO: 2821743 - RNA, 18 nt, Mycobacterium avium subsp. paratuberculosis
cccguagucggcggcgag

SEQ ID NO: 2821744 - RNA, 19 nt, Mycobacterium avium subsp. paratuberculosis
cccguagucggcggcgagg

SEQ ID NO: 2821745 - RNA, 16 nt, Mycobacterium avium subsp. paratuberculosis
cccguauugccgucgg

SEQ ID NO: 2821746 - RNA, 19 nt, Mycobacterium avium subsp. paratuberculosis
cccgucacgcuggcgugac

SEQ ID NO: 2821747 - RNA, 15 nt, Mycobacterium avium subsp. paratuberculosis
cccgucacggccguc

SEQ ID NO: 2821748 - RNA, 21 nt, Mycobacterium avium subsp. paratuberculosis
cccgucacggccguccaggcg

SEQ ID NO: 2821749 - RNA, 22 nt, Mycobacterium avium subsp. paratuberculosis
cccgucacggcugccgaccucg

SEQ ID NO: 2821750 - RNA, 20 nt, Mycobacterium avium subsp. paratuberculosis
cccgucaggccucgaggauc

SEQ ID NO: 2821751 - RNA, 16 nt, Mycobacterium avium subsp. paratuberculosis
cccgucaggucgcggu

SEQ ID NO: 2821752 - RNA, 13 nt, Mycobacterium avium subsp. paratuberculosis
cccguccagaucg

SEQ ID NO: 2821753 - RNA, 23 nt, Mycobacterium avium subsp. paratuberculosis
cccguccagaucggccagcgcgg

SEQ ID NO: 2821754 - RNA, 13 nt, Mycobacterium avium subsp. paratuberculosis
cccguccagcgca

SEQ ID NO: 2821755 - RNA, 14 nt, Mycobacterium avium subsp. paratuberculosis
cccguccaucgccg

SEQ ID NO: 2821756 - RNA, 16 nt, Mycobacterium avium subsp. paratuberculosis
cccguccaucgccgcg

SEQ ID NO: 2821757 - RNA, 17 nt, Mycobacterium avium subsp. paratuberculosis
cccguccaucgccgcgc

SEQ ID NO: 2821758 - RNA, 22 nt, Mycobacterium avium subsp. paratuberculosis
cccguccaucgccgcgcacccg

SEQ ID NO: 2821759 - RNA, 14 nt, Mycobacterium avium subsp. paratuberculosis
cccguccccaccac

SEQ ID NO: 2821760 - RNA, 16 nt, Mycobacterium avium subsp. paratuberculosis
cccguccccaccaccg

SEQ ID NO: 2821761 - RNA, 20 nt, Mycobacterium avium subsp. paratuberculosis
cccguccccaccaccgacag

SEQ ID NO: 2821762 - RNA, 22 nt, Mycobacterium avium subsp. paratuberculosis
cccguccccaccaccgacagca

SEQ ID NO: 2821763 - RNA, 14 nt, Mycobacterium avium subsp. paratuberculosis
cccgucccgccgac

SEQ ID NO: 2821764 - RNA, 13 nt, Mycobacterium avium subsp. paratuberculosis
cccgucccggccc

SEQ ID NO: 2821765 - RNA, 13 nt, Mycobacterium avium subsp. paratuberculosis
cccguccgccccg

SEQ ID NO: 2821766 - RNA, 16 nt, Mycobacterium avium subsp. paratuberculosis
cccguccgccccgcug

SEQ ID NO: 2821767 - RNA, 17 nt, Mycobacterium avium subsp. paratuberculosis
cccguccgccccgcugc

SEQ ID NO: 2821768 - RNA, 18 nt, Mycobacterium avium subsp. paratuberculosis
cccguccggcgccagccc

SEQ ID NO: 2821769 - RNA, 16 nt, Mycobacterium avium subsp. paratuberculosis
cccguccgggccggcc

SEQ ID NO: 2821770 - RNA, 22 nt, Mycobacterium avium subsp. paratuberculosis
cccguccuggaugaacagcacg

SEQ ID NO: 2821771 - RNA, 17 nt, Mycobacterium avium subsp. paratuberculosis
cccguccugggccuggc

SEQ ID NO: 2821772 - RNA, 23 nt, Mycobacterium avium subsp. paratuberculosis
cccguccugggccuggcgcucca

SEQ ID NO: 2821773 - RNA, 12 nt, Mycobacterium avium subsp. paratuberculosis
cccgucgaaacc

SEQ ID NO: 2821774 - RNA, 14 nt, Mycobacterium avium subsp. paratuberculosis
cccgucgaccagga

SEQ ID NO: 2821775 - RNA, 21 nt, Mycobacterium avium subsp. paratuberculosis
cccgucgaccaggacgucggc

SEQ ID NO: 2821776 - RNA, 15 nt, Mycobacterium avium subsp. paratuberculosis
cccgucgacgggcca

SEQ ID NO: 2821777 - RNA, 14 nt, Mycobacterium avium subsp. paratuberculosis
cccgucgacgucga

SEQ ID NO: 2821778 - RNA, 22 nt, Mycobacterium avium subsp. paratuberculosis
cccgucgagcggcuugccgccg

SEQ ID NO: 2821779 - RNA, 21 nt, Mycobacterium avium subsp. paratuberculosis
cccgucgagcgucacgccgcg

SEQ ID NO: 2821780 - RNA, 13 nt, Mycobacterium avium subsp. paratuberculosis
cccgucgccacca

SEQ ID NO: 2821781 - RNA, 14 nt, Mycobacterium avium subsp. paratuberculosis
cccgucgccaccac

SEQ ID NO: 2821782 - RNA, 17 nt, Mycobacterium avium subsp. paratuberculosis
cccgucgccaccacggc

SEQ ID NO: 2821783 - RNA, 21 nt, Mycobacterium avium subsp. paratuberculosis
cccgucgccaccacggcgccc

SEQ ID NO: 2821784 - RNA, 12 nt, Mycobacterium avium subsp. paratuberculosis
cccgucgccgau

SEQ ID NO: 2821785 - RNA, 11 nt, Mycobacterium avium subsp. paratuberculosis
cccgucgccgg

SEQ ID NO: 2821786 - RNA, 15 nt, Mycobacterium avium subsp. paratuberculosis
cccgucgccggcgcg

SEQ ID NO: 2821787 - RNA, 13 nt, Mycobacterium avium subsp. paratuberculosis
cccgucgccuccg

SEQ ID NO: 2821788 - RNA, 14 nt, Mycobacterium avium subsp. paratuberculosis
cccgucgccuccga

SEQ ID NO: 2821789 - RNA, 23 nt, Mycobacterium avium subsp. paratuberculosis
cccgucgccuccugcuggcgcug

SEQ ID NO: 2821790 - RNA, 15 nt, Mycobacterium avium subsp. paratuberculosis
cccgucgcggacccu

SEQ ID NO: 2821791 - RNA, 17 nt, Mycobacterium avium subsp. paratuberculosis
cccgucggaggacaacg

SEQ ID NO: 2821792 - RNA, 13 nt, Mycobacterium avium subsp. paratuberculosis
cccgucggccauc

SEQ ID NO: 2821793 - RNA, 15 nt, Mycobacterium avium subsp. paratuberculosis
cccgucggccucggc

SEQ ID NO: 2821794 - RNA, 13 nt, Mycobacterium avium subsp. paratuberculosis
cccgucggcguga

SEQ ID NO: 2821795 - RNA, 18 nt, Mycobacterium avium subsp. paratuberculosis
cccgucggcgugauaggc

SEQ ID NO: 2821796 - RNA, 19 nt, Mycobacterium avium subsp. paratuberculosis
cccgucgggccguccgccg

SEQ ID NO: 2821797 - RNA, 22 nt, Mycobacterium avium subsp. paratuberculosis
cccgucgggccguccgccggcu

SEQ ID NO: 2821798 - RNA, 13 nt, Mycobacterium avium subsp. paratuberculosis
cccgucgggcgcg

SEQ ID NO: 2821799 - RNA, 19 nt, Mycobacterium avium subsp. paratuberculosis
cccgucgggcgcggcggca

SEQ ID NO: 2821800 - RNA, 20 nt, Mycobacterium avium subsp. paratuberculosis
cccgucgggcgcggcggcaa

SEQ ID NO: 2821801 - RNA, 17 nt, Mycobacterium avium subsp. paratuberculosis
cccgucgggcggggugg

SEQ ID NO: 2821802 - RNA, 15 nt, Mycobacterium avium subsp. paratuberculosis
cccgucggggcccgg

SEQ ID NO: 2821803 - RNA, 23 nt, Mycobacterium avium subsp. paratuberculosis
cccgucggggcccggcccggcga

SEQ ID NO: 2821804 - RNA, 13 nt, Mycobacterium avium subsp. paratuberculosis
cccgucggggugc

SEQ ID NO: 2821805 - RNA, 22 nt, Mycobacterium avium subsp. paratuberculosis
cccgucggggugcgccaggcag

SEQ ID NO: 2821806 - RNA, 13 nt, Mycobacterium avium subsp. paratuberculosis
cccgucgggugug

SEQ ID NO: 2821807 - RNA, 16 nt, Mycobacterium avium subsp. paratuberculosis
cccgucggucccgacg

SEQ ID NO: 2821808 - RNA, 15 nt, Mycobacterium avium subsp. paratuberculosis
cccgucggucgggca

SEQ ID NO: 2821809 - RNA, 16 nt, Mycobacterium avium subsp. paratuberculosis
cccgucggucgggcag

SEQ ID NO: 2821810 - RNA, 21 nt, Mycobacterium avium subsp. paratuberculosis
cccuccacggugcgcaccgac

SEQ ID NO: 2821811 - RNA, 15 nt, Mycobacterium avium subsp. paratuberculosis
cccuccagcaccguc

SEQ ID NO: 2821812 - RNA, 15 nt, Mycobacterium avium subsp. paratuberculosis
cccuccagccgccgg

SEQ ID NO: 2821813 - RNA, 21 nt, Mycobacterium avium subsp. paratuberculosis
cccuccaggaagaacccggcg

SEQ ID NO: 2821814 - RNA, 22 nt, Mycobacterium avium subsp. paratuberculosis
cccuccaggaagaacccggcgu

SEQ ID NO: 2821815 - RNA, 19 nt, Mycobacterium avium subsp. paratuberculosis
cccuccaggcaugggauca

SEQ ID NO: 2821816 - RNA, 15 nt, Mycobacterium avium subsp. paratuberculosis
cccucccaccacggc

SEQ ID NO: 2821817 - RNA, 15 nt, Mycobacterium avium subsp. paratuberculosis
cccuccccggccagc

SEQ ID NO: 2821818 - RNA, 17 nt, Mycobacterium avium subsp. paratuberculosis
cccuccccggccagcac

SEQ ID NO: 2821819 - RNA, 18 nt, Mycobacterium avium subsp. paratuberculosis
cccuccccggccagcacg

SEQ ID NO: 2821820 - RNA, 12 nt, Mycobacterium avium subsp. paratuberculosis
cccuccggcgcc

SEQ ID NO: 2821821 - RNA, 20 nt, Mycobacterium avium subsp. paratuberculosis
cccuccgggcggcaccgcug

SEQ ID NO: 2821822 - RNA, 19 nt, Mycobacterium avium subsp. paratuberculosis
cccucgaaguagagccgcu

SEQ ID NO: 2821823 - RNA, 20 nt, Mycobacterium avium subsp. paratuberculosis
cccucgaaguagagccgcug

SEQ ID NO: 2821824 - RNA, 18 nt, Mycobacterium avium subsp. paratuberculosis
cccucgaccaccucuucg

SEQ ID NO: 2821825 - RNA, 20 nt, Mycobacterium avium subsp. paratuberculosis
cccucgacgccgggcagcgc

SEQ ID NO: 2821826 - RNA, 17 nt, Mycobacterium avium subsp. paratuberculosis
cccucgacguccaggcc

SEQ ID NO: 2821827 - RNA, 18 nt, Mycobacterium avium subsp. paratuberculosis
cccucgacguccaggccg

SEQ ID NO: 2821828 - RNA, 20 nt, Mycobacterium avium subsp. paratuberculosis
cccucgacguccaggccggc

SEQ ID NO: 2821829 - RNA, 21 nt, Mycobacterium avium subsp. paratuberculosis
cccucgacguccaggccggcg

SEQ ID NO: 2821830 - RNA, 21 nt, Mycobacterium avium subsp. paratuberculosis
cccucgagccauaaaccggcc

SEQ ID NO: 2821831 - RNA, 18 nt, Mycobacterium avium subsp. paratuberculosis
cccucgaggccgacgugc

SEQ ID NO: 2821832 - RNA, 22 nt, Mycobacterium avium subsp. paratuberculosis
cccucgaucgcgaccaccggcc

SEQ ID NO: 2821833 - RNA, 16 nt, Mycobacterium avium subsp. paratuberculosis
cccucgaugcgcaccg

SEQ ID NO: 2821834 - RNA, 13 nt, Mycobacterium avium subsp. paratuberculosis
cccucgccccgga

SEQ ID NO: 2821835 - RNA, 12 nt, Mycobacterium avium subsp. paratuberculosis
cccucgccgccg

SEQ ID NO: 2821836 - RNA, 13 nt, Mycobacterium avium subsp. paratuberculosis
cccucgccgccgc

SEQ ID NO: 2821837 - RNA, 15 nt, Mycobacterium avium subsp. paratuberculosis
cccucgccgcgguca

SEQ ID NO: 2821838 - RNA, 13 nt, Mycobacterium avium subsp. paratuberculosis
cccucgccggcgg

SEQ ID NO: 2821839 - RNA, 14 nt, Mycobacterium avium subsp. paratuberculosis
cccucgccggcggc

SEQ ID NO: 2821840 - RNA, 20 nt, Mycobacterium avium subsp. paratuberculosis
cccucgccggcggcgcccgc

SEQ ID NO: 2821841 - RNA, 16 nt, Mycobacterium avium subsp. paratuberculosis
cccucgccgggcguca

SEQ ID NO: 2821842 - RNA, 18 nt, Mycobacterium avium subsp. paratuberculosis
cccucgccggucagcgca

SEQ ID NO: 2821843 - RNA, 18 nt, Mycobacterium avium subsp. paratuberculosis
cccucgcgcaauaacgga

SEQ ID NO: 2821844 - RNA, 19 nt, Mycobacterium avium subsp. paratuberculosis
cccucgcgcagggccagcg

SEQ ID NO: 2821845 - RNA, 22 nt, Mycobacterium avium subsp. paratuberculosis
cccucggaggugccgcgcggca

SEQ ID NO: 2821846 - RNA, 20 nt, Mycobacterium avium subsp. paratuberculosis
cccucggcauaacgcaaccg

SEQ ID NO: 2821847 - RNA, 19 nt, Mycobacterium avium subsp. paratuberculosis
cccucggccagccaggccg

SEQ ID NO: 2821848 - RNA, 12 nt, Mycobacterium avium subsp. paratuberculosis
cccucggccggu

SEQ ID NO: 2821849 - RNA, 19 nt, Mycobacterium avium subsp. paratuberculosis
cccucggccguaccggcgu

SEQ ID NO: 2821850 - RNA, 21 nt, Mycobacterium avium subsp. paratuberculosis
cccucggccguaccggcguac

SEQ ID NO: 2821851 - RNA, 13 nt, Mycobacterium avium subsp. paratuberculosis
cccucggcgccgg

SEQ ID NO: 2821852 - RNA, 19 nt, Mycobacterium avium subsp. paratuberculosis
cccucggcgccgguggugu

SEQ ID NO: 2821853 - RNA, 18 nt, Mycobacterium avium subsp. paratuberculosis
cccucggcggccgucgga

SEQ ID NO: 2821854 - RNA, 22 nt, Mycobacterium avium subsp. paratuberculosis
cccucggcgggaucggaccgca

SEQ ID NO: 2821855 - RNA, 24 nt, Mycobacterium avium subsp. paratuberculosis
cccucggcuuccgagccggugaug

SEQ ID NO: 2821856 - RNA, 18 nt, Mycobacterium avium subsp. paratuberculosis
cccucggggcucaccaca

SEQ ID NO: 2821857 - RNA, 19 nt, Mycobacterium avium subsp. paratuberculosis
cccucggggcugcgcggcu

SEQ ID NO: 2821858 - RNA, 22 nt, Mycobacterium avium subsp. paratuberculosis
cccucggggcugcgcggcuugc

SEQ ID NO: 2821859 - RNA, 19 nt, Mycobacterium avium subsp. paratuberculosis
cccucgggguacucggcgg

SEQ ID NO: 2821860 - RNA, 21 nt, Mycobacterium avium subsp. paratuberculosis
cccucgggguacucggcggcg

SEQ ID NO: 2821861 - RNA, 17 nt, Mycobacterium avium subsp. paratuberculosis
cccucgggguagccggc

SEQ ID NO: 2821862 - RNA, 18 nt, Mycobacterium avium subsp. paratuberculosis
cccucgggguagccggcc

SEQ ID NO: 2821863 - RNA, 19 nt, Mycobacterium avium subsp. paratuberculosis
cccucgggguagccggccc

SEQ ID NO: 2821864 - RNA, 20 nt, Mycobacterium avium subsp. paratuberculosis
cccucgggguagccggcccg

SEQ ID NO: 2821865 - RNA, 21 nt, Mycobacterium avium subsp. paratuberculosis
cccucgggguagccggcccgc

SEQ ID NO: 2821866 - RNA, 22 nt, Mycobacterium avium subsp. paratuberculosis
cccucgggguagccggcccgca

SEQ ID NO: 2821867 - RNA, 16 nt, Mycobacterium avium subsp. paratuberculosis
cccucggucgggcgau

SEQ ID NO: 2821868 - RNA, 14 nt, Mycobacterium avium subsp. paratuberculosis
cccucgguguucgg

SEQ ID NO: 2821869 - RNA, 18 nt, Mycobacterium avium subsp. paratuberculosis
cccucguagaaggaccgg

SEQ ID NO: 2821870 - RNA, 16 nt, Mycobacterium avium subsp. paratuberculosis
cccucguagcggccgc

SEQ ID NO: 2821871 - RNA, 12 nt, Mycobacterium avium subsp. paratuberculosis
cccucguccagg

SEQ ID NO: 2821872 - RNA, 15 nt, Mycobacterium avium subsp. paratuberculosis
cccucguccgacagc

SEQ ID NO: 2821873 - RNA, 22 nt, Mycobacterium avium subsp. paratuberculosis
cccucgucgaagccgaucaccg

SEQ ID NO: 2821874 - RNA, 22 nt, Mycobacterium avium subsp. paratuberculosis
cccucgucgaugacguccacca

SEQ ID NO: 2821875 - RNA, 16 nt, Mycobacterium avium subsp. paratuberculosis
cccucgucgcuaccuc

SEQ ID NO: 2821876 - RNA, 21 nt, Mycobacterium avium subsp. paratuberculosis
cccucgucgcuaccucaccac

SEQ ID NO: 2821877 - RNA, 20 nt, Mycobacterium avium subsp. paratuberculosis
cccucgucuuccgcggcggc

SEQ ID NO: 2821878 - RNA, 17 nt, Mycobacterium avium subsp. paratuberculosis
cccucgucuuggugcga

SEQ ID NO: 2821879 - RNA, 19 nt, Mycobacterium avium subsp. paratuberculosis
cccucgugcguagcggccc

SEQ ID NO: 2821880 - RNA, 21 nt, Mycobacterium avium subsp. paratuberculosis
cccucgugguggacggucagc

SEQ ID NO: 2821881 - RNA, 21 nt, Mycobacterium avium subsp. paratuberculosis
cccucguucgaauuguggcgg

SEQ ID NO: 2821882 - RNA, 22 nt, Mycobacterium avium subsp. paratuberculosis
cccucguucgaauuguggcggc

SEQ ID NO: 2821883 - RNA, 23 nt, Mycobacterium avium subsp. paratuberculosis
cccucguucgaauuguggcggcc

SEQ ID NO: 2821884 - RNA, 16 nt, Mycobacterium avium subsp. paratuberculosis
cccucugccacggcgg

SEQ ID NO: 2821885 - RNA, 23 nt, Mycobacterium avium subsp. paratuberculosis
cccucuucgaucaggcgcagccc

SEQ ID NO: 2821886 - RNA, 21 nt, Mycobacterium avium subsp. paratuberculosis
cccugaacgucuugggcgcga

SEQ ID NO: 2821887 - RNA, 12 nt, Mycobacterium avium subsp. paratuberculosis
cccugaagcugg

SEQ ID NO: 2821888 - RNA, 19 nt, Mycobacterium avium subsp. paratuberculosis
cccugaagcugggcgccca

SEQ ID NO: 2821889 - RNA, 13 nt, Mycobacterium avium subsp. paratuberculosis
cccugacacagca

SEQ ID NO: 2821890 - RNA, 22 nt, Mycobacterium avium subsp. paratuberculosis
cccugacacagcaccggcgucg

SEQ ID NO: 2821891 - RNA, 23 nt, Mycobacterium avium subsp. paratuberculosis
cccugacacagcaccggcgucga

SEQ ID NO: 2821892 - RNA, 20 nt, Mycobacterium avium subsp. paratuberculosis
cccugaccgugcuuggcggc

SEQ ID NO: 2821893 - RNA, 15 nt, Mycobacterium avium subsp. paratuberculosis
cccugcacccagccg

SEQ ID NO: 2821894 - RNA, 18 nt, Mycobacterium avium subsp. paratuberculosis
ccgaaaagcccgccgccu

SEQ ID NO: 2821895 - RNA, 13 nt, Mycobacterium avium subsp. paratuberculosis
ccgaaacaucaaa

SEQ ID NO: 2821896 - RNA, 13 nt, Mycobacterium avium subsp. paratuberculosis
ccgaaacccgcug

SEQ ID NO: 2821897 - RNA, 17 nt, Mycobacterium avium subsp. paratuberculosis
ccgaaacgucgcagccc

SEQ ID NO: 2821898 - RNA, 19 nt, Mycobacterium avium subsp. paratuberculosis
ccgaaacgucgcagcccgg

SEQ ID NO: 2821899 - RNA, 18 nt, Mycobacterium avium subsp. paratuberculosis
ccgaaagcccccagcucu

SEQ ID NO: 2821900 - RNA, 13 nt, Mycobacterium avium subsp. paratuberculosis
ccgaaagccgaca

SEQ ID NO: 2821901 - RNA, 16 nt, Mycobacterium avium subsp. paratuberculosis
ccgaaagccguaccgc

SEQ ID NO: 2821902 - RNA, 21 nt, Mycobacterium avium subsp. paratuberculosis
ccgaaagccguagcgcaacac

SEQ ID NO: 2821903 - RNA, 19 nt, Mycobacterium avium subsp. paratuberculosis
ccgaaaugcaucagcguga

SEQ ID NO: 2821904 - RNA, 16 nt, Mycobacterium avium subsp. paratuberculosis
ccgaaaugccgugcca

SEQ ID NO: 2821905 - RNA, 20 nt, Mycobacterium avium subsp. paratuberculosis
ccgaaaugccgugccagccg

SEQ ID NO: 2821906 - RNA, 16 nt, Mycobacterium avium subsp. paratuberculosis
ccgaacaacagggccg

SEQ ID NO: 2821907 - RNA, 18 nt, Mycobacterium avium subsp. paratuberculosis
ccgaacaacagggccgcg

SEQ ID NO: 2821908 - RNA, 19 nt, Mycobacterium avium subsp. paratuberculosis
ccgaacaacagggccgcgc

SEQ ID NO: 2821909 - RNA, 18 nt, Mycobacterium avium subsp. paratuberculosis
ccgaacaacggcggaccg

SEQ ID NO: 2821910 - RNA, 20 nt, Mycobacterium avium subsp. paratuberculosis
ccgaacaacggcggaccggc

SEQ ID NO: 2821911 - RNA, 23 nt, Mycobacterium avium subsp. paratuberculosis
ccgaacaacggcggaccggcggc

SEQ ID NO: 2821912 - RNA, 24 nt, Mycobacterium avium subsp. paratuberculosis
ccgaacaacugaccgauggccgcc

SEQ ID NO: 2821913 - RNA, 17 nt, Mycobacterium avium subsp. paratuberculosis
ccgaacaccggcagcgc

SEQ ID NO: 2821914 - RNA, 18 nt, Mycobacterium avium subsp. paratuberculosis
ccgaacaccggcagcgcc

SEQ ID NO: 2821915 - RNA, 12 nt, Mycobacterium avium subsp. paratuberculosis
ccgaacaccguc

SEQ ID NO: 2821916 - RNA, 13 nt, Mycobacterium avium subsp. paratuberculosis
ccgaacaccguca

SEQ ID NO: 2821917 - RNA, 23 nt, Mycobacterium avium subsp. paratuberculosis
ccgaacaccugcggcggcagucg

SEQ ID NO: 2821918 - RNA, 14 nt, Mycobacterium avium subsp. paratuberculosis
ccgaacacggccgc

SEQ ID NO: 2821919 - RNA, 15 nt, Mycobacterium avium subsp. paratuberculosis
ccgaacacggccgcc

SEQ ID NO: 2821920 - RNA, 23 nt, Mycobacterium avium subsp. paratuberculosis
ccgaacagaugccugcccagcgg

SEQ ID NO: 2821921 - RNA, 16 nt, Mycobacterium avium subsp. paratuberculosis
ccgaacagcagcgcgc

SEQ ID NO: 2821922 - RNA, 17 nt, Mycobacterium avium subsp. paratuberculosis
ccgaacagccgggcggc

SEQ ID NO: 2821923 - RNA, 18 nt, Mycobacterium avium subsp. paratuberculosis
ccgaacagccgggcggcc

SEQ ID NO: 2821924 - RNA, 19 nt, Mycobacterium avium subsp. paratuberculosis
ccgaacagccgggcggccg

SEQ ID NO: 2821925 - RNA, 15 nt, Mycobacterium avium subsp. paratuberculosis
ccgaacagcgacguc

SEQ ID NO: 2821926 - RNA, 13 nt, Mycobacterium avium subsp. paratuberculosis
ccgaacaggcgca

SEQ ID NO: 2821927 - RNA, 16 nt, Mycobacterium avium subsp. paratuberculosis
ccgaacagggcgacgg

SEQ ID NO: 2821928 - RNA, 15 nt, Mycobacterium avium subsp. paratuberculosis
ccgaacaucagccga

SEQ ID NO: 2821929 - RNA, 20 nt, Mycobacterium avium subsp. paratuberculosis
ccgaacaucgccucggccgc

SEQ ID NO: 2821930 - RNA, 21 nt, Mycobacterium avium subsp. paratuberculosis
ccgaacaucgccucggccgcg

SEQ ID NO: 2821931 - RNA, 19 nt, Mycobacterium avium subsp. paratuberculosis
ccgaaccaguucgccacca

SEQ ID NO: 2821932 - RNA, 21 nt, Mycobacterium avium subsp. paratuberculosis
ccgaaccaguucgccaccacg

SEQ ID NO: 2821933 - RNA, 17 nt, Mycobacterium avium subsp. paratuberculosis
ccgaacccaccagcgcc

SEQ ID NO: 2821934 - RNA, 22 nt, Mycobacterium avium subsp. paratuberculosis
ccgaacccaccagcgccugggc

SEQ ID NO: 2821935 - RNA, 13 nt, Mycobacterium avium subsp. paratuberculosis
ccgaacccagcgc

SEQ ID NO: 2821936 - RNA, 14 nt, Mycobacterium avium subsp. paratuberculosis
ccgaacccagcgcc

SEQ ID NO: 2821937 - RNA, 18 nt, Mycobacterium avium subsp. paratuberculosis
ccgaacccagcgccucga

SEQ ID NO: 2821938 - RNA, 19 nt, Mycobacterium avium subsp. paratuberculosis
ccgaacccggaucggccau

SEQ ID NO: 2821939 - RNA, 15 nt, Mycobacterium avium subsp. paratuberculosis
ccgaacccggccagc

SEQ ID NO: 2821940 - RNA, 13 nt, Mycobacterium avium subsp. paratuberculosis
ccgaacccgggcg

SEQ ID NO: 2821941 - RNA, 14 nt, Mycobacterium avium subsp. paratuberculosis
ccgaacccgggcgc

SEQ ID NO: 2821942 - RNA, 16 nt, Mycobacterium avium subsp. paratuberculosis
ccgaacccgggcgcgc

SEQ ID NO: 2821943 - RNA, 17 nt, Mycobacterium avium subsp. paratuberculosis
ccgaacccgggcgcgcc

SEQ ID NO: 2821944 - RNA, 22 nt, Mycobacterium avium subsp. paratuberculosis
ccgaacccgggcgcgcccaccc

SEQ ID NO: 2821945 - RNA, 17 nt, Mycobacterium avium subsp. paratuberculosis
ccgaacccguucccgac

SEQ ID NO: 2821946 - RNA, 16 nt, Mycobacterium avium subsp. paratuberculosis
ccgaaccgaucaccgg

SEQ ID NO: 2821947 - RNA, 20 nt, Mycobacterium avium subsp. paratuberculosis
ccgaaccgaucaccggcagc

SEQ ID NO: 2821948 - RNA, 15 nt, Mycobacterium avium subsp. paratuberculosis
ccgaaccgcccgccc

SEQ ID NO: 2821949 - RNA, 18 nt, Mycobacterium avium subsp. paratuberculosis
ccgaaccgcucgucggga

SEQ ID NO: 2821950 - RNA, 20 nt, Mycobacterium avium subsp. paratuberculosis
ccgaaccggaucuggcccug

SEQ ID NO: 2821951 - RNA, 13 nt, Mycobacterium avium subsp. paratuberculosis
ccgaaccgggcgc

SEQ ID NO: 2821952 - RNA, 15 nt, Mycobacterium avium subsp. paratuberculosis
ccgaaccgggcgcgc

SEQ ID NO: 2821953 - RNA, 22 nt, Mycobacterium avium subsp. paratuberculosis
ccgaaccgggcgcgcagaucgu

SEQ ID NO: 2821954 - RNA, 19 nt, Mycobacterium avium subsp. paratuberculosis
ccgaaccggggccgcaccu

SEQ ID NO: 2821955 - RNA, 18 nt, Mycobacterium avium subsp. paratuberculosis
ccgaacgcaccaccgcgg

SEQ ID NO: 2821956 - RNA, 15 nt, Mycobacterium avium subsp. paratuberculosis
ccgaacgccagcagc

SEQ ID NO: 2821957 - RNA, 20 nt, Mycobacterium avium subsp. paratuberculosis
ccgaacgccgaggugcaaca

SEQ ID NO: 2821958 - RNA, 21 nt, Mycobacterium avium subsp. paratuberculosis
ccgaacgccggauuggcgucg

SEQ ID NO: 2821959 - RNA, 17 nt, Mycobacterium avium subsp. paratuberculosis
ccgaacgccuccgccgc

SEQ ID NO: 2821960 - RNA, 13 nt, Mycobacterium avium subsp. paratuberculosis
ccgaacgcgucgu

SEQ ID NO: 2821961 - RNA, 18 nt, Mycobacterium avium subsp. paratuberculosis
ccgaacggaccgggcggg

SEQ ID NO: 2821962 - RNA, 13 nt, Mycobacterium avium subsp. paratuberculosis
ccgaacgggucgg

SEQ ID NO: 2821963 - RNA, 19 nt, Mycobacterium avium subsp. paratuberculosis
ccgaacgucacggcgagga

SEQ ID NO: 2821964 - RNA, 15 nt, Mycobacterium avium subsp. paratuberculosis
ccgaacgucgagcgc

SEQ ID NO: 2821965 - RNA, 18 nt, Mycobacterium avium subsp. paratuberculosis
ccgaacgucgagcgcggc

SEQ ID NO: 2821966 - RNA, 20 nt, Mycobacterium avium subsp. paratuberculosis
ccgaacgucgagcgcggccc

SEQ ID NO: 2821967 - RNA, 22 nt, Mycobacterium avium subsp. paratuberculosis
ccgaacgucgagcgcggcccgc

SEQ ID NO: 2821968 - RNA, 15 nt, Mycobacterium avium subsp. paratuberculosis
ccgaacgugcgcggc

SEQ ID NO: 2821969 - RNA, 23 nt, Mycobacterium avium subsp. paratuberculosis
ccgaacgugcgcggcgcgcgaaa

SEQ ID NO: 2821970 - RNA, 16 nt, Mycobacterium avium subsp. paratuberculosis
ccgaacuccgccgaac

SEQ ID NO: 2821971 - RNA, 19 nt, Mycobacterium avium subsp. paratuberculosis
ccgaacucggcgccgccgg

SEQ ID NO: 2821972 - RNA, 20 nt, Mycobacterium avium subsp. paratuberculosis
ccgaacucggcgccgccggu

SEQ ID NO: 2821973 - RNA, 23 nt, Mycobacterium avium subsp. paratuberculosis
ccgaacucggcgccgccggucgc

SEQ ID NO: 2821974 - RNA, 22 nt, Mycobacterium avium subsp. paratuberculosis
ccgaacugcaucauguccaggu

SEQ ID NO: 2821975 - RNA, 18 nt, Mycobacterium avium subsp. paratuberculosis
ccgaacugccggaccagg

SEQ ID NO: 2821976 - RNA, 15 nt, Mycobacterium avium subsp. paratuberculosis
ccgaacuucagcgcg

SEQ ID NO: 2821977 - RNA, 19 nt, Mycobacterium avium subsp. paratuberculosis
ccgaacuucagcgcgucgu

SEQ ID NO: 2821978 - RNA, 19 nt, Mycobacterium avium subsp. paratuberculosis
ccgacagcccgcccacaua

SEQ ID NO: 2821979 - RNA, 16 nt, Mycobacterium avium subsp. paratuberculosis
ccgacagccgcaccag

SEQ ID NO: 2821980 - RNA, 22 nt, Mycobacterium avium subsp. paratuberculosis
ccgacagccgcaccggcgccgc

SEQ ID NO: 2821981 - RNA, 15 nt, Mycobacterium avium subsp. paratuberculosis
ccgacagcgcgucgg

SEQ ID NO: 2821982 - RNA, 18 nt, Mycobacterium avium subsp. paratuberculosis
ccgacagcgggauguagc

SEQ ID NO: 2821983 - RNA, 23 nt, Mycobacterium avium subsp. paratuberculosis
ccgacagcgggauguagccgguc

SEQ ID NO: 2821984 - RNA, 13 nt, Mycobacterium avium subsp. paratuberculosis
ccgacagcgucgu

SEQ ID NO: 2821985 - RNA, 19 nt, Mycobacterium avium subsp. paratuberculosis
ccgacagcugagcagcccg

SEQ ID NO: 2821986 - RNA, 12 nt, Mycobacterium avium subsp. paratuberculosis
ccgacaggaugc

SEQ ID NO: 2821987 - RNA, 21 nt, Mycobacterium avium subsp. paratuberculosis
ccgacaggaugcuggggucgg

SEQ ID NO: 2821988 - RNA, 13 nt, Mycobacterium avium subsp. paratuberculosis
ccgacaggcccac

SEQ ID NO: 2821989 - RNA, 15 nt, Mycobacterium avium subsp. paratuberculosis
ccgacaggcccaccc

SEQ ID NO: 2821990 - RNA, 18 nt, Mycobacterium avium subsp. paratuberculosis
ccgacagggagccgacga

SEQ ID NO: 2821991 - RNA, 16 nt, Mycobacterium avium subsp. paratuberculosis
ccgacagggccagcgc

SEQ ID NO: 2821992 - RNA, 18 nt, Mycobacterium avium subsp. paratuberculosis
ccgacagggccagcgcca

SEQ ID NO: 2821993 - RNA, 20 nt, Mycobacterium avium subsp. paratuberculosis
ccgacagguagcaggcgcgc

SEQ ID NO: 2821994 - RNA, 14 nt, Mycobacterium avium subsp. paratuberculosis
ccgacaguccgacc

SEQ ID NO: 2821995 - RNA, 16 nt, Mycobacterium avium subsp. paratuberculosis
ccgacaguccgaccgc

SEQ ID NO: 2821996 - RNA, 17 nt, Mycobacterium avium subsp. paratuberculosis
ccgacaguccgaccgcg

SEQ ID NO: 2821997 - RNA, 15 nt, Mycobacterium avium subsp. paratuberculosis
ccgacagucgcgggc

SEQ ID NO: 2821998 - RNA, 16 nt, Mycobacterium avium subsp. paratuberculosis
ccgacagucgcgggca

SEQ ID NO: 2821999 - RNA, 16 nt, Mycobacterium avium subsp. paratuberculosis
ccgacagucgcgggcg

SEQ ID NO: 2822000 - RNA, 17 nt, Mycobacterium avium subsp. paratuberculosis
ccgacagucgcgggcga

SEQ ID NO: 2822001 - RNA, 18 nt, Mycobacterium avium subsp. paratuberculosis
ccgacagucgcgggcgag

SEQ ID NO: 2822002 - RNA, 20 nt, Mycobacterium avium subsp. paratuberculosis
ccgacagucgcgggcgagcc

SEQ ID NO: 2822003 - RNA, 18 nt, Mycobacterium avium subsp. paratuberculosis
ccgacagucgcgggcggg

SEQ ID NO: 2822004 - RNA, 15 nt, Mycobacterium avium subsp. paratuberculosis
ccgacaguucggcgc

SEQ ID NO: 2822005 - RNA, 18 nt, Mycobacterium avium subsp. paratuberculosis
ccgacaguucggcgcgca

SEQ ID NO: 2822006 - RNA, 22 nt, Mycobacterium avium subsp. paratuberculosis
ccgacaucaccaaccgcucggc

SEQ ID NO: 2822007 - RNA, 23 nt, Mycobacterium avium subsp. paratuberculosis
ccgacaucaccaaccgcucggcg

SEQ ID NO: 2822008 - RNA, 17 nt, Mycobacterium avium subsp. paratuberculosis
ccgacaucagaucgccg

SEQ ID NO: 2822009 - RNA, 19 nt, Mycobacterium avium subsp. paratuberculosis
ccgacauccaggaccgcgc

SEQ ID NO: 2822010 - RNA, 21 nt, Mycobacterium avium subsp. paratuberculosis
ccgacauccaggaccgcgcgc

SEQ ID NO: 2822011 - RNA, 14 nt, Mycobacterium avium subsp. paratuberculosis
ccgacauccgggua

SEQ ID NO: 2822012 - RNA, 15 nt, Mycobacterium avium subsp. paratuberculosis
ccgacauccggguag

SEQ ID NO: 2822013 - RNA, 14 nt, Mycobacterium avium subsp. paratuberculosis
ccgacaucgccauc

SEQ ID NO: 2822014 - RNA, 15 nt, Mycobacterium avium subsp. paratuberculosis
ccgacaucgccauca

SEQ ID NO: 2822015 - RNA, 21 nt, Mycobacterium avium subsp. paratuberculosis
ccgacaucgccaucagcagcg

SEQ ID NO: 2822016 - RNA, 16 nt, Mycobacterium avium subsp. paratuberculosis
ccgacaucgcccgguc

SEQ ID NO: 2822017 - RNA, 15 nt, Mycobacterium avium subsp. paratuberculosis
ccgacaucgcggcga

SEQ ID NO: 2822018 - RNA, 18 nt, Mycobacterium avium subsp. paratuberculosis
ccgacaucgcggcgaucu

SEQ ID NO: 2822019 - RNA, 14 nt, Mycobacterium avium subsp. paratuberculosis
ccgacaucgucggc

SEQ ID NO: 2822020 - RNA, 15 nt, Mycobacterium avium subsp. paratuberculosis
ccgacaucgucggcu

SEQ ID NO: 2822021 - RNA, 23 nt, Mycobacterium avium subsp. paratuberculosis
ccgacaucgucggcucguguccg

SEQ ID NO: 2822022 - RNA, 20 nt, Mycobacterium avium subsp. paratuberculosis
ccgacaucugccgggcggcg

SEQ ID NO: 2822023 - RNA, 14 nt, Mycobacterium avium subsp. paratuberculosis
ccgacauggacgcg

SEQ ID NO: 2822024 - RNA, 15 nt, Mycobacterium avium subsp. paratuberculosis
ccgacauggccagca

SEQ ID NO: 2822025 - RNA, 17 nt, Mycobacterium avium subsp. paratuberculosis
ccgacaugucgccgggc

SEQ ID NO: 2822026 - RNA, 17 nt, Mycobacterium avium subsp. paratuberculosis
ccgaccaacacccccgc

SEQ ID NO: 2822027 - RNA, 19 nt, Mycobacterium avium subsp. paratuberculosis
ccgaccaacacccccgcgc

SEQ ID NO: 2822028 - RNA, 20 nt, Mycobacterium avium subsp. paratuberculosis
ccgaccaacacccccgcgcu

SEQ ID NO: 2822029 - RNA, 13 nt, Mycobacterium avium subsp. paratuberculosis
ccgaccaacgggc

SEQ ID NO: 2822030 - RNA, 16 nt, Mycobacterium avium subsp. paratuberculosis
ccgaccaacgggcggc

SEQ ID NO: 2822031 - RNA, 15 nt, Mycobacterium avium subsp. paratuberculosis
ccgaccacaccggcg

SEQ ID NO: 2822032 - RNA, 18 nt, Mycobacterium avium subsp. paratuberculosis
ccgaccacaccggcgcug

SEQ ID NO: 2822033 - RNA, 23 nt, Mycobacterium avium subsp. paratuberculosis
ccgaccacaccggcgcugcccgc

SEQ ID NO: 2822034 - RNA, 20 nt, Mycobacterium avium subsp. paratuberculosis
ccgaccacccccagcccgcc

SEQ ID NO: 2822035 - RNA, 15 nt, Mycobacterium avium subsp. paratuberculosis
ccgaccaccuccccg

SEQ ID NO: 2822036 - RNA, 17 nt, Mycobacterium avium subsp. paratuberculosis
ccgaccaccuccccgcg

SEQ ID NO: 2822037 - RNA, 18 nt, Mycobacterium avium subsp. paratuberculosis
ccgaccaccuccccgcgg

SEQ ID NO: 2822038 - RNA, 21 nt, Mycobacterium avium subsp. paratuberculosis
ccgaccaccuugcgcagcagc

SEQ ID NO: 2822039 - RNA, 16 nt, Mycobacterium avium subsp. paratuberculosis
ccgaccacggccccag

SEQ ID NO: 2822040 - RNA, 22 nt, Mycobacterium avium subsp. paratuberculosis
ccgaccacggccccagccgccg

SEQ ID NO: 2822041 - RNA, 17 nt, Mycobacterium avium subsp. paratuberculosis
ccgaccagcacccgggc

SEQ ID NO: 2822042 - RNA, 20 nt, Mycobacterium avium subsp. paratuberculosis
ccgaccagcaggacgcgccc

SEQ ID NO: 2822043 - RNA, 12 nt, Mycobacterium avium subsp. paratuberculosis
ccgaccagccga

SEQ ID NO: 2822044 - RNA, 14 nt, Mycobacterium avium subsp. paratuberculosis
ccgaccagccgaag

SEQ ID NO: 2822045 - RNA, 15 nt, Mycobacterium avium subsp. paratuberculosis
ccgaccagccgaggc

SEQ ID NO: 2822046 - RNA, 13 nt, Mycobacterium avium subsp. paratuberculosis
ccgaccagccggu

SEQ ID NO: 2822047 - RNA, 20 nt, Mycobacterium avium subsp. paratuberculosis
ccgaccagccggucuuggac

SEQ ID NO: 2822048 - RNA, 21 nt, Mycobacterium avium subsp. paratuberculosis
ccgaccagccggucuuggaca

SEQ ID NO: 2822049 - RNA, 13 nt, Mycobacterium avium subsp. paratuberculosis
ccgaccagcgcga

SEQ ID NO: 2822050 - RNA, 15 nt, Mycobacterium avium subsp. paratuberculosis
ccgaccagcggccca

SEQ ID NO: 2822051 - RNA, 16 nt, Mycobacterium avium subsp. paratuberculosis
ccgaccagcggcccac

SEQ ID NO: 2822052 - RNA, 23 nt, Mycobacterium avium subsp. paratuberculosis
ccgaccagcggcccaccgcgacc

SEQ ID NO: 2822053 - RNA, 14 nt, Mycobacterium avium subsp. paratuberculosis
ccgaccagcgggau

SEQ ID NO: 2822054 - RNA, 13 nt, Mycobacterium avium subsp. paratuberculosis
ccgaccagcgggc

SEQ ID NO: 2822055 - RNA, 15 nt, Mycobacterium avium subsp. paratuberculosis
ccgaccagcgggccg

SEQ ID NO: 2822056 - RNA, 16 nt, Mycobacterium avium subsp. paratuberculosis
ccgaccagcgguuugg

SEQ ID NO: 2822057 - RNA, 12 nt, Mycobacterium avium subsp. paratuberculosis
ccgaccagcuga

SEQ ID NO: 2822058 - RNA, 12 nt, Mycobacterium avium subsp. paratuberculosis
ccgaccagcugu

SEQ ID NO: 2822059 - RNA, 11 nt, Mycobacterium avium subsp. paratuberculosis
ccgaccaggaa

SEQ ID NO: 2822060 - RNA, 18 nt, Mycobacterium avium subsp. paratuberculosis
ccgaccaggaucgggauc

SEQ ID NO: 2822061 - RNA, 16 nt, Mycobacterium avium subsp. paratuberculosis
ccgaccaguucggcca

SEQ ID NO: 2822062 - RNA, 21 nt, Mycobacterium avium subsp. paratuberculosis
ccgaccaguucggccaccgcg

SEQ ID NO: 2822063 - RNA, 13 nt, Mycobacterium avium subsp. paratuberculosis
ccgacgacgccgu

SEQ ID NO: 2822064 - RNA, 15 nt, Mycobacterium avium subsp. paratuberculosis
ccgacgacgccguca

SEQ ID NO: 2822065 - RNA, 13 nt, Mycobacterium avium subsp. paratuberculosis
ccgacgacggcga

SEQ ID NO: 2822066 - RNA, 15 nt, Mycobacterium avium subsp. paratuberculosis
ccgacgacggcgaac

SEQ ID NO: 2822067 - RNA, 14 nt, Mycobacterium avium subsp. paratuberculosis
ccgacgacgugacg

SEQ ID NO: 2822068 - RNA, 15 nt, Mycobacterium avium subsp. paratuberculosis
ccgacgacgugacga

SEQ ID NO: 2822069 - RNA, 16 nt, Mycobacterium avium subsp. paratuberculosis
ccgacgagaucagcac

SEQ ID NO: 2822070 - RNA, 19 nt, Mycobacterium avium subsp. paratuberculosis
ccgacgagaucagcaccag

SEQ ID NO: 2822071 - RNA, 20 nt, Mycobacterium avium subsp. paratuberculosis
ccgacgagaucagcaccagg

SEQ ID NO: 2822072 - RNA, 15 nt, Mycobacterium avium subsp. paratuberculosis
ccgacgagucgacgc

SEQ ID NO: 2822073 - RNA, 17 nt, Mycobacterium avium subsp. paratuberculosis
ccgacgagucgccguug

SEQ ID NO: 2822074 - RNA, 14 nt, Mycobacterium avium subsp. paratuberculosis
ccgacgaucccggc

SEQ ID NO: 2822075 - RNA, 16 nt, Mycobacterium avium subsp. paratuberculosis
ccgacgaucccggcga

SEQ ID NO: 2822076 - RNA, 17 nt, Mycobacterium avium subsp. paratuberculosis
ccgacgauccgcgccgc

SEQ ID NO: 2822077 - RNA, 14 nt, Mycobacterium avium subsp. paratuberculosis
ccgacgauccgggc

SEQ ID NO: 2822078 - RNA, 17 nt, Mycobacterium avium subsp. paratuberculosis
ccgacgauccgggcgcc

SEQ ID NO: 2822079 - RNA, 12 nt, Mycobacterium avium subsp. paratuberculosis
ccgacgaucgcg

SEQ ID NO: 2822080 - RNA, 13 nt, Mycobacterium avium subsp. paratuberculosis
ccgacgaucgcgc

SEQ ID NO: 2822081 - RNA, 14 nt, Mycobacterium avium subsp. paratuberculosis
ccgacgaucgcgcc

SEQ ID NO: 2822082 - RNA, 17 nt, Mycobacterium avium subsp. paratuberculosis
ccgacgaucgcgccggc

SEQ ID NO: 2822083 - RNA, 20 nt, Mycobacterium avium subsp. paratuberculosis
ccgacgaucgcgccggccgc

SEQ ID NO: 2822084 - RNA, 19 nt, Mycobacterium avium subsp. paratuberculosis
ccgacgaugagggccagca

SEQ ID NO: 2822085 - RNA, 19 nt, Mycobacterium avium subsp. paratuberculosis
ccgacgaugagggugauga

SEQ ID NO: 2822086 - RNA, 20 nt, Mycobacterium avium subsp. paratuberculosis
ccgacgaugagggugaugac

SEQ ID NO: 2822087 - RNA, 21 nt, Mycobacterium avium subsp. paratuberculosis
ccgacgaugcggggcggcggg

SEQ ID NO: 2822088 - RNA, 23 nt, Mycobacterium avium subsp. paratuberculosis
ccgacgaugcggggcggcgggau

SEQ ID NO: 2822089 - RNA, 20 nt, Mycobacterium avium subsp. paratuberculosis
ccgacgaugcugucgcgggu

SEQ ID NO: 2822090 - RNA, 17 nt, Mycobacterium avium subsp. paratuberculosis
ccgacgaugucgaaacc

SEQ ID NO: 2822091 - RNA, 17 nt, Mycobacterium avium subsp. paratuberculosis
ccgacgcauguccgccg

SEQ ID NO: 2822092 - RNA, 13 nt, Mycobacterium avium subsp. paratuberculosis
ccgacgccacguc

SEQ ID NO: 2822093 - RNA, 14 nt, Mycobacterium avium subsp. paratuberculosis
ccgacgccacgucg

SEQ ID NO: 2822094 - RNA, 14 nt, Mycobacterium avium subsp. paratuberculosis
ccgacgccagcacg

SEQ ID NO: 2822095 - RNA, 13 nt, Mycobacterium avium subsp. paratuberculosis
ccgacgccagcgg

SEQ ID NO: 2822096 - RNA, 17 nt, Mycobacterium avium subsp. paratuberculosis
ccgacgccagcgggccg

SEQ ID NO: 2822097 - RNA, 16 nt, Mycobacterium avium subsp. paratuberculosis
ccgacgcccacagcgc

SEQ ID NO: 2822098 - RNA, 18 nt, Mycobacterium avium subsp. paratuberculosis
ccgacgcccacagcgcca

SEQ ID NO: 2822099 - RNA, 13 nt, Mycobacterium avium subsp. paratuberculosis
ccgacgcccagca

SEQ ID NO: 2822100 - RNA, 14 nt, Mycobacterium avium subsp. paratuberculosis
ccgacgcccagcac

SEQ ID NO: 2822101 - RNA, 18 nt, Mycobacterium avium subsp. paratuberculosis
ccgacgcccagcaccgag

SEQ ID NO: 2822102 - RNA, 19 nt, Mycobacterium avium subsp. paratuberculosis
ccgacgcccagcaccgagu

SEQ ID NO: 2822103 - RNA, 13 nt, Mycobacterium avium subsp. paratuberculosis
ccgacgcccagcg

SEQ ID NO: 2822104 - RNA, 19 nt, Mycobacterium avium subsp. paratuberculosis
ccgacgcccaggcucagga

SEQ ID NO: 2822105 - RNA, 12 nt, Mycobacterium avium subsp. paratuberculosis
ccgacgcccggc

SEQ ID NO: 2822106 - RNA, 13 nt, Mycobacterium avium subsp. paratuberculosis
ccgacgccgacac

SEQ ID NO: 2822107 - RNA, 17 nt, Mycobacterium avium subsp. paratuberculosis
ccgacgccgacaccagc

SEQ ID NO: 2822108 - RNA, 19 nt, Mycobacterium avium subsp. paratuberculosis
ccgacgccgacaccagcgc

SEQ ID NO: 2822109 - RNA, 16 nt, Mycobacterium avium subsp. paratuberculosis
ccgacgccggacccca

SEQ ID NO: 2822110 - RNA, 16 nt, Mycobacterium avium subsp. paratuberculosis
ccgacgccggccacca

SEQ ID NO: 2822111 - RNA, 16 nt, Mycobacterium avium subsp. paratuberculosis
ccgacgccgucgagcc

SEQ ID NO: 2822112 - RNA, 18 nt, Mycobacterium avium subsp. paratuberculosis
ccgacgccuccacauacg

SEQ ID NO: 2822113 - RNA, 13 nt, Mycobacterium avium subsp. paratuberculosis
ccgacgccugcgc

SEQ ID NO: 2822114 - RNA, 16 nt, Mycobacterium avium subsp. paratuberculosis
ccgacgcgacggucgu

SEQ ID NO: 2822115 - RNA, 14 nt, Mycobacterium avium subsp. paratuberculosis
ccgacgcgccgucg

SEQ ID NO: 2822116 - RNA, 15 nt, Mycobacterium avium subsp. paratuberculosis
ccgacgcgccgucgg

SEQ ID NO: 2822117 - RNA, 16 nt, Mycobacterium avium subsp. paratuberculosis
ccgacgcgccgucggc

SEQ ID NO: 2822118 - RNA, 19 nt, Mycobacterium avium subsp. paratuberculosis
ccgacgcgccgucggccca

SEQ ID NO: 2822119 - RNA, 16 nt, Mycobacterium avium subsp. paratuberculosis
ccgacgcgcugcgcgc

SEQ ID NO: 2822120 - RNA, 19 nt, Mycobacterium avium subsp. paratuberculosis
ccgacgcgcugcgcgccgc

SEQ ID NO: 2822121 - RNA, 20 nt, Mycobacterium avium subsp. paratuberculosis
ccgacgcgcugcgcgccgcc

SEQ ID NO: 2822122 - RNA, 15 nt, Mycobacterium avium subsp. paratuberculosis
ccgacgcggccucga

SEQ ID NO: 2822123 - RNA, 13 nt, Mycobacterium avium subsp. paratuberculosis
ccgacgcggcgac

SEQ ID NO: 2822124 - RNA, 18 nt, Mycobacterium avium subsp. paratuberculosis
ccgacgcggcgaccacca

SEQ ID NO: 2822125 - RNA, 22 nt, Mycobacterium avium subsp. paratuberculosis
ccgacgcggcgaccaccaccgc

SEQ ID NO: 2822126 - RNA, 14 nt, Mycobacterium avium subsp. paratuberculosis
ccgacgcggcgcga

SEQ ID NO: 2822127 - RNA, 19 nt, Mycobacterium avium subsp. paratuberculosis
ccgacgcggcgcgacaccg

SEQ ID NO: 2822128 - RNA, 14 nt, Mycobacterium avium subsp. paratuberculosis
ccgacgcggcggcc

SEQ ID NO: 2822129 - RNA, 20 nt, Mycobacterium avium subsp. paratuberculosis
ccgacgcggcggccgacagc

SEQ ID NO: 2822130 - RNA, 16 nt, Mycobacterium avium subsp. paratuberculosis
ccgacgcggucaccgg

SEQ ID NO: 2822131 - RNA, 18 nt, Mycobacterium avium subsp. paratuberculosis
ccgacgcggucaccggcu

SEQ ID NO: 2822132 - RNA, 21 nt, Mycobacterium avium subsp. paratuberculosis
ccgacgcggucaccggcucgg

SEQ ID NO: 2822133 - RNA, 14 nt, Mycobacterium avium subsp. paratuberculosis
ccgacgcgguggcg

SEQ ID NO: 2822134 - RNA, 23 nt, Mycobacterium avium subsp. paratuberculosis
ccgacgcgguggcgugcucgaug

SEQ ID NO: 2822135 - RNA, 15 nt, Mycobacterium avium subsp. paratuberculosis
ccgacgcgucgcggc

SEQ ID NO: 2822136 - RNA, 17 nt, Mycobacterium avium subsp. paratuberculosis
ccgacgcgucgcggcgg

SEQ ID NO: 2822137 - RNA, 21 nt, Mycobacterium avium subsp. paratuberculosis
ccgacgcgucgcggcgggggu

SEQ ID NO: 2822138 - RNA, 19 nt, Mycobacterium avium subsp. paratuberculosis
ccgacgcucgccaccccgc

SEQ ID NO: 2822139 - RNA, 20 nt, Mycobacterium avium subsp. paratuberculosis
ccgacgcucgccaccccgcg

SEQ ID NO: 2822140 - RNA, 19 nt, Mycobacterium avium subsp. paratuberculosis
ccgacgcugacgaugcggc

SEQ ID NO: 2822141 - RNA, 15 nt, Mycobacterium avium subsp. paratuberculosis
ccgacggagccgagc

SEQ ID NO: 2822142 - RNA, 16 nt, Mycobacterium avium subsp. paratuberculosis
ccgacggagccgagca

SEQ ID NO: 2822143 - RNA, 17 nt, Mycobacterium avium subsp. paratuberculosis
ccgacggagccgagcac

SEQ ID NO: 2822144 - RNA, 20 nt, Mycobacterium avium subsp. paratuberculosis
ccgacggauucccgaacagg

SEQ ID NO: 2822145 - RNA, 21 nt, Mycobacterium avium subsp. paratuberculosis
ccgacggauucccgaacaggg

SEQ ID NO: 2822146 - RNA, 12 nt, Mycobacterium avium subsp. paratuberculosis
ccgacggcagca

SEQ ID NO: 2822147 - RNA, 14 nt, Mycobacterium avium subsp. paratuberculosis
ccgacggcagcacc

SEQ ID NO: 2822148 - RNA, 18 nt, Mycobacterium avium subsp. paratuberculosis
ccgacugccccgcuccuc

SEQ ID NO: 2822149 - RNA, 12 nt, Mycobacterium avium subsp. paratuberculosis
ccgacugcgacg

SEQ ID NO: 2822150 - RNA, 22 nt, Mycobacterium avium subsp. paratuberculosis
ccgacugcggcgcuucgggugc

SEQ ID NO: 2822151 - RNA, 22 nt, Mycobacterium avium subsp. paratuberculosis
ccgacugugaauuccgacgugc

SEQ ID NO: 2822152 - RNA, 21 nt, Mycobacterium avium subsp. paratuberculosis
ccgacugugcgaugucggugc

SEQ ID NO: 2822153 - RNA, 21 nt, Mycobacterium avium subsp. paratuberculosis
ccgacuguuugaugccgucgg

SEQ ID NO: 2822154 - RNA, 22 nt, Mycobacterium avium subsp. paratuberculosis
ccgacuuacggcgugaccggcu

SEQ ID NO: 2822155 - RNA, 14 nt, Mycobacterium avium subsp. paratuberculosis
ccgacuucgcgugc

SEQ ID NO: 2822156 - RNA, 19 nt, Mycobacterium avium subsp. paratuberculosis
ccgacuucggcucggcgac

SEQ ID NO: 2822157 - RNA, 18 nt, Mycobacterium avium subsp. paratuberculosis
ccgacuugaucgcggcgu

SEQ ID NO: 2822158 - RNA, 21 nt, Mycobacterium avium subsp. paratuberculosis
ccgacuugaucgcggcguagg

SEQ ID NO: 2822159 - RNA, 16 nt, Mycobacterium avium subsp. paratuberculosis
ccgacuuggugccaug

SEQ ID NO: 2822160 - RNA, 19 nt, Mycobacterium avium subsp. paratuberculosis
ccgagaacagaugccggug

SEQ ID NO: 2822161 - RNA, 15 nt, Mycobacterium avium subsp. paratuberculosis
ccgagaagggccgcc

SEQ ID NO: 2822162 - RNA, 18 nt, Mycobacterium avium subsp. paratuberculosis
ccgagaagggccgccgcu

SEQ ID NO: 2822163 - RNA, 16 nt, Mycobacterium avium subsp. paratuberculosis
ccgagaaugccguaga

SEQ ID NO: 2822164 - RNA, 21 nt, Mycobacterium avium subsp. paratuberculosis
ccgagaccaugccgccgaagc

SEQ ID NO: 2822165 - RNA, 21 nt, Mycobacterium avium subsp. paratuberculosis
ccgagacgaucccguagccgu

SEQ ID NO: 2822166 - RNA, 14 nt, Mycobacterium avium subsp. paratuberculosis
ccgagacggcgugg

SEQ ID NO: 2822167 - RNA, 16 nt, Mycobacterium avium subsp. paratuberculosis
ccgagacgucggcgua

SEQ ID NO: 2822168 - RNA, 17 nt, Mycobacterium avium subsp. paratuberculosis
ccgagacguggucgggc

SEQ ID NO: 2822169 - RNA, 14 nt, Mycobacterium avium subsp. paratuberculosis
ccgagacguggugg

SEQ ID NO: 2822170 - RNA, 19 nt, Mycobacterium avium subsp. paratuberculosis
ccgagacgugguggugcgg

SEQ ID NO: 2822171 - RNA, 23 nt, Mycobacterium avium subsp. paratuberculosis
ccgagacgugguggugcggacgg

SEQ ID NO: 2822172 - RNA, 22 nt, Mycobacterium avium subsp. paratuberculosis
ccgagacugaugguggcgcgca

SEQ ID NO: 2822173 - RNA, 12 nt, Mycobacterium avium subsp. paratuberculosis
ccgagagcgcgu

SEQ ID NO: 2822174 - RNA, 12 nt, Mycobacterium avium subsp. paratuberculosis
ccgagagcugcu

SEQ ID NO: 2822175 - RNA, 14 nt, Mycobacterium avium subsp. paratuberculosis
ccgagaguccgccg

SEQ ID NO: 2822176 - RNA, 15 nt, Mycobacterium avium subsp. paratuberculosis
ccgagaguccgccgc

SEQ ID NO: 2822177 - RNA, 16 nt, Mycobacterium avium subsp. paratuberculosis
ccgagaguccgccgcc

SEQ ID NO: 2822178 - RNA, 14 nt, Mycobacterium avium subsp. paratuberculosis
ccgagaucaccggc

SEQ ID NO: 2822179 - RNA, 15 nt, Mycobacterium avium subsp. paratuberculosis
ccgagaucaccggcu

SEQ ID NO: 2822180 - RNA, 18 nt, Mycobacterium avium subsp. paratuberculosis
ccgagaucaugccggcga

SEQ ID NO: 2822181 - RNA, 19 nt, Mycobacterium avium subsp. paratuberculosis
ccgagauccaccgcgcggc

SEQ ID NO: 2822182 - RNA, 20 nt, Mycobacterium avium subsp. paratuberculosis
ccgagauccaccgcgcggcc

SEQ ID NO: 2822183 - RNA, 13 nt, Mycobacterium avium subsp. paratuberculosis
ccgagaucgaccc

SEQ ID NO: 2822184 - RNA, 14 nt, Mycobacterium avium subsp. paratuberculosis
ccgagaucgcgggc

SEQ ID NO: 2822185 - RNA, 17 nt, Mycobacterium avium subsp. paratuberculosis
ccgagaucgcgggcugc

SEQ ID NO: 2822186 - RNA, 17 nt, Mycobacterium avium subsp. paratuberculosis
ccgagaucgcgguggcg

SEQ ID NO: 2822187 - RNA, 18 nt, Mycobacterium avium subsp. paratuberculosis
ccgagaugaagacccggc

SEQ ID NO: 2822188 - RNA, 21 nt, Mycobacterium avium subsp. paratuberculosis
ccgagaugaagacccggccgu

SEQ ID NO: 2822189 - RNA, 18 nt, Mycobacterium avium subsp. paratuberculosis
ccgagauggacagcaccu

SEQ ID NO: 2822190 - RNA, 20 nt, Mycobacterium avium subsp. paratuberculosis
ccgagauggacagcaccuug

SEQ ID NO: 2822191 - RNA, 21 nt, Mycobacterium avium subsp. paratuberculosis
ccgagauggacagcaccuugc

SEQ ID NO: 2822192 - RNA, 15 nt, Mycobacterium avium subsp. paratuberculosis
ccgagauggccacca

SEQ ID NO: 2822193 - RNA, 18 nt, Mycobacterium avium subsp. paratuberculosis
ccgagauggccaccauca

SEQ ID NO: 2822194 - RNA, 21 nt, Mycobacterium avium subsp. paratuberculosis
ccgagauggugaagugccggu

SEQ ID NO: 2822195 - RNA, 18 nt, Mycobacterium avium subsp. paratuberculosis
ccgagauguaguccuccg

SEQ ID NO: 2822196 - RNA, 12 nt, Mycobacterium avium subsp. paratuberculosis
ccgagcaaccgg

SEQ ID NO: 2822197 - RNA, 17 nt, Mycobacterium avium subsp. paratuberculosis
ccgagcaaccgggauac

SEQ ID NO: 2822198 - RNA, 16 nt, Mycobacterium avium subsp. paratuberculosis
ccgagcacaccgucgc

SEQ ID NO: 2822199 - RNA, 13 nt, Mycobacterium avium subsp. paratuberculosis
ccgagcaccacca

SEQ ID NO: 2822200 - RNA, 17 nt, Mycobacterium avium subsp. paratuberculosis
ccgagcaccaccaggcc

SEQ ID NO: 2822201 - RNA, 13 nt, Mycobacterium avium subsp. paratuberculosis
ccgagcaccagcg

SEQ ID NO: 2822202 - RNA, 14 nt, Mycobacterium avium subsp. paratuberculosis
ccgagcaccagcgg

SEQ ID NO: 2822203 - RNA, 13 nt, Mycobacterium avium subsp. paratuberculosis
ccgagcaccaggc

SEQ ID NO: 2822204 - RNA, 17 nt, Mycobacterium avium subsp. paratuberculosis
ccgagcaccaggcgcac

SEQ ID NO: 2822205 - RNA, 21 nt, Mycobacterium avium subsp. paratuberculosis
ccgagcaccaggcgcaccagc

SEQ ID NO: 2822206 - RNA, 23 nt, Mycobacterium avium subsp. paratuberculosis
ccgagcaccaggcgcaccagcug

SEQ ID NO: 2822207 - RNA, 13 nt, Mycobacterium avium subsp. paratuberculosis
ccgagcaccccgg

SEQ ID NO: 2822208 - RNA, 15 nt, Mycobacterium avium subsp. paratuberculosis
ccgagcaccccggcg

SEQ ID NO: 2822209 - RNA, 19 nt, Mycobacterium avium subsp. paratuberculosis
ccgagcaccccggcggccg

SEQ ID NO: 2822210 - RNA, 20 nt, Mycobacterium avium subsp. paratuberculosis
ccgagcaccccggcggccgc

SEQ ID NO: 2822211 - RNA, 16 nt, Mycobacterium avium subsp. paratuberculosis
ccgagcaccccgucga

SEQ ID NO: 2822212 - RNA, 11 nt, Mycobacterium avium subsp. paratuberculosis
ccgagcaccgg

SEQ ID NO: 2822213 - RNA, 15 nt, Mycobacterium avium subsp. paratuberculosis
ccgagcaccggcagc

SEQ ID NO: 2822214 - RNA, 16 nt, Mycobacterium avium subsp. paratuberculosis
ccgagcaccggcagca

SEQ ID NO: 2822215 - RNA, 19 nt, Mycobacterium avium subsp. paratuberculosis
ccgagcaccggcagcaccg

SEQ ID NO: 2822216 - RNA, 12 nt, Mycobacterium avium subsp. paratuberculosis
ccgagcaccggg

SEQ ID NO: 2822217 - RNA, 14 nt, Mycobacterium avium subsp. paratuberculosis
ccgagcaccgggcc

SEQ ID NO: 2822218 - RNA, 10 nt, Mycobacterium avium subsp. paratuberculosis
ccgagcaccu

SEQ ID NO: 2822219 - RNA, 12 nt, Mycobacterium avium subsp. paratuberculosis
ccgagcaccucc

SEQ ID NO: 2822220 - RNA, 17 nt, Mycobacterium avium subsp. paratuberculosis
ccgagcaccucgucgcc

SEQ ID NO: 2822221 - RNA, 20 nt, Mycobacterium avium subsp. paratuberculosis
ccgagcaccucgucgccguc

SEQ ID NO: 2822222 - RNA, 22 nt, Mycobacterium avium subsp. paratuberculosis
ccgagcaccucgucgccgucgg

SEQ ID NO: 2822223 - RNA, 22 nt, Mycobacterium avium subsp. paratuberculosis
ccgagcaccugaacggccgcgc

SEQ ID NO: 2822224 - RNA, 16 nt, Mycobacterium avium subsp. paratuberculosis
ccgagcaccuggccgu

SEQ ID NO: 2822225 - RNA, 17 nt, Mycobacterium avium subsp. paratuberculosis
ccgagcacgaacgcggc

SEQ ID NO: 2822226 - RNA, 19 nt, Mycobacterium avium subsp. paratuberculosis
ccgagcacgaacgcggccg

SEQ ID NO: 2822227 - RNA, 20 nt, Mycobacterium avium subsp. paratuberculosis
ccgagcacgaacgcggccgc

SEQ ID NO: 2822228 - RNA, 21 nt, Mycobacterium avium subsp. paratuberculosis
ccgagcacgaacgcggccgcc

SEQ ID NO: 2822229 - RNA, 17 nt, Mycobacterium avium subsp. paratuberculosis
ccgagcacgcagccgcg

SEQ ID NO: 2822230 - RNA, 18 nt, Mycobacterium avium subsp. paratuberculosis
ccgagcacgcagccgcgc

SEQ ID NO: 2822231 - RNA, 20 nt, Mycobacterium avium subsp. paratuberculosis
ccgagcacgcagccgcgccc

SEQ ID NO: 2822232 - RNA, 21 nt, Mycobacterium avium subsp. paratuberculosis
ccgagcacgcagccgcgcccg

SEQ ID NO: 2822233 - RNA, 15 nt, Mycobacterium avium subsp. paratuberculosis
ccgagcggccgucca

SEQ ID NO: 2822234 - RNA, 19 nt, Mycobacterium avium subsp. paratuberculosis
ccgagcggccguccaccac

SEQ ID NO: 2822235 - RNA, 17 nt, Mycobacterium avium subsp. paratuberculosis
ccgagcggcgcaggccg

SEQ ID NO: 2822236 - RNA, 13 nt, Mycobacterium avium subsp. paratuberculosis
ccgagcggcgcca

SEQ ID NO: 2822237 - RNA, 15 nt, Mycobacterium avium subsp. paratuberculosis
ccgagcggcgccacg

SEQ ID NO: 2822238 - RNA, 13 nt, Mycobacterium avium subsp. paratuberculosis
ccgagcggcgcug

SEQ ID NO: 2822239 - RNA, 14 nt, Mycobacterium avium subsp. paratuberculosis
ccgagcggcgcugc

SEQ ID NO: 2822240 - RNA, 20 nt, Mycobacterium avium subsp. paratuberculosis
ccgagcggcgcugcagcagc

SEQ ID NO: 2822241 - RNA, 21 nt, Mycobacterium avium subsp. paratuberculosis
ccgagcggcgcugcagcagcc

SEQ ID NO: 2822242 - RNA, 13 nt, Mycobacterium avium subsp. paratuberculosis
ccgagcggcugcu

SEQ ID NO: 2822243 - RNA, 23 nt, Mycobacterium avium subsp. paratuberculosis
ccgagcgggccguggcaccgggu

SEQ ID NO: 2822244 - RNA, 17 nt, Mycobacterium avium subsp. paratuberculosis
ccgagcgggccuucacg

SEQ ID NO: 2822245 - RNA, 13 nt, Mycobacterium avium subsp. paratuberculosis
ccgagcggggugu

SEQ ID NO: 2822246 - RNA, 20 nt, Mycobacterium avium subsp. paratuberculosis
ccgagcgggguguggcuguc

SEQ ID NO: 2822247 - RNA, 16 nt, Mycobacterium avium subsp. paratuberculosis
ccgagcgggucgucgu

SEQ ID NO: 2822248 - RNA, 18 nt, Mycobacterium avium subsp. paratuberculosis
ccgagcgguccaacgggc

SEQ ID NO: 2822249 - RNA, 21 nt, Mycobacterium avium subsp. paratuberculosis
ccgagcgguccaacgggcuca

SEQ ID NO: 2822250 - RNA, 14 nt, Mycobacterium avium subsp. paratuberculosis
ccgagcgucacgcc

SEQ ID NO: 2822251 - RNA, 20 nt, Mycobacterium avium subsp. paratuberculosis
ccgagcgucacgccagcgug

SEQ ID NO: 2822252 - RNA, 21 nt, Mycobacterium avium subsp. paratuberculosis
ccgagcgucacgccagcguga

SEQ ID NO: 2822253 - RNA, 20 nt, Mycobacterium avium subsp. paratuberculosis
ccgagcgucacgcuagcgug

SEQ ID NO: 2822254 - RNA, 17 nt, Mycobacterium avium subsp. paratuberculosis
ccgagcgucacgcuggc

SEQ ID NO: 2822255 - RNA, 21 nt, Mycobacterium avium subsp. paratuberculosis
ccgagcgucacgcuggcgugg

SEQ ID NO: 2822256 - RNA, 19 nt, Mycobacterium avium subsp. paratuberculosis
ccgagcgucauuccgccgc

SEQ ID NO: 2822257 - RNA, 20 nt, Mycobacterium avium subsp. paratuberculosis
ccgagcgucauuccgccgcg

SEQ ID NO: 2822258 - RNA, 21 nt, Mycobacterium avium subsp. paratuberculosis
ccgagcgucauuccgccgcgc

SEQ ID NO: 2822259 - RNA, 23 nt, Mycobacterium avium subsp. paratuberculosis
ccgagcgucauuccgccgcgccc

SEQ ID NO: 2822260 - RNA, 15 nt, Mycobacterium avium subsp. paratuberculosis
ccgagcgugaaacua

SEQ ID NO: 2822261 - RNA, 13 nt, Mycobacterium avium subsp. paratuberculosis
ccgagcguucggc

SEQ ID NO: 2822262 - RNA, 18 nt, Mycobacterium avium subsp. paratuberculosis
ccgagcucggccaccagc

SEQ ID NO: 2822263 - RNA, 20 nt, Mycobacterium avium subsp. paratuberculosis
ccgagcucggccaccagcgc

SEQ ID NO: 2822264 - RNA, 14 nt, Mycobacterium avium subsp. paratuberculosis
ccgagcucgggcgc

SEQ ID NO: 2822265 - RNA, 15 nt, Mycobacterium avium subsp. paratuberculosis
ccgagcucgggcgcg

SEQ ID NO: 2822266 - RNA, 16 nt, Mycobacterium avium subsp. paratuberculosis
ccgagcucgggcgcga

SEQ ID NO: 2822267 - RNA, 18 nt, Mycobacterium avium subsp. paratuberculosis
ccgagcugaucgcggccg

SEQ ID NO: 2822268 - RNA, 19 nt, Mycobacterium avium subsp. paratuberculosis
ccgagcugaucgcggccgg

SEQ ID NO: 2822269 - RNA, 22 nt, Mycobacterium avium subsp. paratuberculosis
ccgagcugaucgcggccggcga

SEQ ID NO: 2822270 - RNA, 17 nt, Mycobacterium avium subsp. paratuberculosis
ccgagcugggccggcgc

SEQ ID NO: 2822271 - RNA, 19 nt, Mycobacterium avium subsp. paratuberculosis
ccgagcugggccggcgccg

SEQ ID NO: 2822272 - RNA, 20 nt, Mycobacterium avium subsp. paratuberculosis
ccgagcugggccggcgccga

SEQ ID NO: 2822273 - RNA, 17 nt, Mycobacterium avium subsp. paratuberculosis
ccgagcuugggccggug

SEQ ID NO: 2822274 - RNA, 22 nt, Mycobacterium avium subsp. paratuberculosis
ccgagcuugggccggugcagca

SEQ ID NO: 2822275 - RNA, 16 nt, Mycobacterium avium subsp. paratuberculosis
ccgaggaaccggcagc

SEQ ID NO: 2822276 - RNA, 20 nt, Mycobacterium avium subsp. paratuberculosis
ccgaggaaccggcagccggc

SEQ ID NO: 2822277 - RNA, 18 nt, Mycobacterium avium subsp. paratuberculosis
ccgaggaacugcagcgac

SEQ ID NO: 2822278 - RNA, 19 nt, Mycobacterium avium subsp. paratuberculosis
ccgaggaacugcagcgacu

SEQ ID NO: 2822279 - RNA, 20 nt, Mycobacterium avium subsp. paratuberculosis
ccgaggacacguuggccaga

SEQ ID NO: 2822280 - RNA, 21 nt, Mycobacterium avium subsp. paratuberculosis
ccgaggacacguuggccagau

SEQ ID NO: 2822281 - RNA, 17 nt, Mycobacterium avium subsp. paratuberculosis
ccgaggagacgucggcc

SEQ ID NO: 2822282 - RNA, 18 nt, Mycobacterium avium subsp. paratuberculosis
ccgaggagacgucggccg

SEQ ID NO: 2822283 - RNA, 19 nt, Mycobacterium avium subsp. paratuberculosis
ccgaggagacgucggccgg

SEQ ID NO: 2822284 - RNA, 14 nt, Mycobacterium avium subsp. paratuberculosis
ccgaggaggccgcg

SEQ ID NO: 2822285 - RNA, 15 nt, Mycobacterium avium subsp. paratuberculosis
ccgaggaggccgcgg

SEQ ID NO: 2822286 - RNA, 21 nt, Mycobacterium avium subsp. paratuberculosis
ccgaggagguuuugcgugguc

SEQ ID NO: 2822287 - RNA, 18 nt, Mycobacterium avium subsp. paratuberculosis
ccgaggaucuugaucgcg

SEQ ID NO: 2822288 - RNA, 19 nt, Mycobacterium avium subsp. paratuberculosis
ccgaggaucuugaucgcga

SEQ ID NO: 2822289 - RNA, 16 nt, Mycobacterium avium subsp. paratuberculosis
ccgaggaugaccgcgg

SEQ ID NO: 2822290 - RNA, 18 nt, Mycobacterium avium subsp. paratuberculosis
ccgaggaugaccgcggcg

SEQ ID NO: 2822291 - RNA, 15 nt, Mycobacterium avium subsp. paratuberculosis
ccgaggaugccgccc

SEQ ID NO: 2822292 - RNA, 22 nt, Mycobacterium avium subsp. paratuberculosis
ccgaggaugccgcccaccaccg

SEQ ID NO: 2822293 - RNA, 20 nt, Mycobacterium avium subsp. paratuberculosis
ccgaggauggggucgcgggc

SEQ ID NO: 2822294 - RNA, 21 nt, Mycobacterium avium subsp. paratuberculosis
ccgaggauggggucgcgggcg

SEQ ID NO: 2822295 - RNA, 19 nt, Mycobacterium avium subsp. paratuberculosis
ccgaggauuucgcgaucga

SEQ ID NO: 2822296 - RNA, 23 nt, Mycobacterium avium subsp. paratuberculosis
ccgaggcaaucgagcgggcgggc

SEQ ID NO: 2822297 - RNA, 14 nt, Mycobacterium avium subsp. paratuberculosis
ccgaggccagcacg

SEQ ID NO: 2822298 - RNA, 16 nt, Mycobacterium avium subsp. paratuberculosis
ccgaggccagcacgcc

SEQ ID NO: 2822299 - RNA, 16 nt, Mycobacterium avium subsp. paratuberculosis
ccgaggccgauggcgc

SEQ ID NO: 2822300 - RNA, 18 nt, Mycobacterium avium subsp. paratuberculosis
ccgaggccgauggcgccc

SEQ ID NO: 2822301 - RNA, 19 nt, Mycobacterium avium subsp. paratuberculosis
ccgaggccgauggcgccca

SEQ ID NO: 2822302 - RNA, 21 nt, Mycobacterium avium subsp. paratuberculosis
ccgaggccgauggcgcccagc

SEQ ID NO: 2822303 - RNA, 21 nt, Mycobacterium avium subsp. paratuberculosis
ccgaggcgaagguggcgucgg

SEQ ID NO: 2822304 - RNA, 14 nt, Mycobacterium avium subsp. paratuberculosis
ccgaggcgagugag

SEQ ID NO: 2822305 - RNA, 16 nt, Mycobacterium avium subsp. paratuberculosis
ccgaggcgaucgcggc

SEQ ID NO: 2822306 - RNA, 18 nt, Mycobacterium avium subsp. paratuberculosis
ccgaggcgcaacaccgga

SEQ ID NO: 2822307 - RNA, 14 nt, Mycobacterium avium subsp. paratuberculosis
ccgaggcgcucgca

SEQ ID NO: 2822308 - RNA, 23 nt, Mycobacterium avium subsp. paratuberculosis
ccgaggcggguguauucgcccac

SEQ ID NO: 2822309 - RNA, 21 nt, Mycobacterium avium subsp. paratuberculosis
ccgaggcgguuccgguggcgc

SEQ ID NO: 2822310 - RNA, 21 nt, Mycobacterium avium subsp. paratuberculosis
ccgaggcgucagggguuggcg

SEQ ID NO: 2822311 - RNA, 14 nt, Mycobacterium avium subsp. paratuberculosis
ccgaggcgugccgc

SEQ ID NO: 2822312 - RNA, 15 nt, Mycobacterium avium subsp. paratuberculosis
ccgaggcgugccgcu

SEQ ID NO: 2822313 - RNA, 18 nt, Mycobacterium avium subsp. paratuberculosis
ccgaggcgugccgcuggg

SEQ ID NO: 2822314 - RNA, 19 nt, Mycobacterium avium subsp. paratuberculosis
ccgaggcugacgaucgucg

SEQ ID NO: 2822315 - RNA, 21 nt, Mycobacterium avium subsp. paratuberculosis
ccgaggcugacgaucgucgac

SEQ ID NO: 2822316 - RNA, 16 nt, Mycobacterium avium subsp. paratuberculosis
ccgaggcugucggagg

SEQ ID NO: 2822317 - RNA, 17 nt, Mycobacterium avium subsp. paratuberculosis
ccgaucacccccgacac

SEQ ID NO: 2822318 - RNA, 12 nt, Mycobacterium avium subsp. paratuberculosis
ccgaucaccgcc

SEQ ID NO: 2822319 - RNA, 23 nt, Mycobacterium avium subsp. paratuberculosis
ccgaucaccgcguugucggcgac

SEQ ID NO: 2822320 - RNA, 19 nt, Mycobacterium avium subsp. paratuberculosis
ccgaucaccggcacgugcg

SEQ ID NO: 2822321 - RNA, 23 nt, Mycobacterium avium subsp. paratuberculosis
ccgaucaccggcacgugcggguu

SEQ ID NO: 2822322 - RNA, 16 nt, Mycobacterium avium subsp. paratuberculosis
ccgaucaccggcagca

SEQ ID NO: 2822323 - RNA, 22 nt, Mycobacterium avium subsp. paratuberculosis
ccgaucaccggcagcagcgcgu

SEQ ID NO: 2822324 - RNA, 18 nt, Mycobacterium avium subsp. paratuberculosis
ccgaucaccggcgcguug

SEQ ID NO: 2822325 - RNA, 23 nt, Mycobacterium avium subsp. paratuberculosis
ccgaucaccgugaguucgcugac

SEQ ID NO: 2822326 - RNA, 20 nt, Mycobacterium avium subsp. paratuberculosis
ccgaucaccucgauggccgg

SEQ ID NO: 2822327 - RNA, 13 nt, Mycobacterium avium subsp. paratuberculosis
ccgaucaccucgc

SEQ ID NO: 2822328 - RNA, 17 nt, Mycobacterium avium subsp. paratuberculosis
ccgaucaccucgccggc

SEQ ID NO: 2822329 - RNA, 23 nt, Mycobacterium avium subsp. paratuberculosis
ccgaucaccugacagacccgauc

SEQ ID NO: 2822330 - RNA, 14 nt, Mycobacterium avium subsp. paratuberculosis
ccgaucacgccggu

SEQ ID NO: 2822331 - RNA, 13 nt, Mycobacterium avium subsp. paratuberculosis
ccgaucacgcgga

SEQ ID NO: 2822332 - RNA, 13 nt, Mycobacterium avium subsp. paratuberculosis
ccgaucacgguga

SEQ ID NO: 2822333 - RNA, 19 nt, Mycobacterium avium subsp. paratuberculosis
ccgaucacggugaucgccg

SEQ ID NO: 2822334 - RNA, 16 nt, Mycobacterium avium subsp. paratuberculosis
ccgaucagcagcaccu

SEQ ID NO: 2822335 - RNA, 17 nt, Mycobacterium avium subsp. paratuberculosis
ccgaucagcagcaccug

SEQ ID NO: 2822336 - RNA, 17 nt, Mycobacterium avium subsp. paratuberculosis
ccgaucagcaugccggu

SEQ ID NO: 2822337 - RNA, 19 nt, Mycobacterium avium subsp. paratuberculosis
ccgaucagcaugccgguca

SEQ ID NO: 2822338 - RNA, 11 nt, Mycobacterium avium subsp. paratuberculosis
ccgaucagccg

SEQ ID NO: 2822339 - RNA, 13 nt, Mycobacterium avium subsp. paratuberculosis
ccgaucagcggcg

SEQ ID NO: 2822340 - RNA, 16 nt, Mycobacterium avium subsp. paratuberculosis
ccgaucagcggcgggc

SEQ ID NO: 2822341 - RNA, 18 nt, Mycobacterium avium subsp. paratuberculosis
ccgaucagcggcgggccc

SEQ ID NO: 2822342 - RNA, 23 nt, Mycobacterium avium subsp. paratuberculosis
ccgaucagcggcgggcccagcag

SEQ ID NO: 2822343 - RNA, 21 nt, Mycobacterium avium subsp. paratuberculosis
ccgaucagcgucagcaccgcg

SEQ ID NO: 2822344 - RNA, 21 nt, Mycobacterium avium subsp. paratuberculosis
ccgaucaggaucggcgggcgc

SEQ ID NO: 2822345 - RNA, 13 nt, Mycobacterium avium subsp. paratuberculosis
ccgaucaggcugg

SEQ ID NO: 2822346 - RNA, 21 nt, Mycobacterium avium subsp. paratuberculosis
ccgaucaggcuggacaccacg

SEQ ID NO: 2822347 - RNA, 23 nt, Mycobacterium avium subsp. paratuberculosis
ccgaucaggguccagggcggguc

SEQ ID NO: 2822348 - RNA, 13 nt, Mycobacterium avium subsp. paratuberculosis
ccgaucagugccg

SEQ ID NO: 2822349 - RNA, 18 nt, Mycobacterium avium subsp. paratuberculosis
ccgaucaucucaccgacg

SEQ ID NO: 2822350 - RNA, 20 nt, Mycobacterium avium subsp. paratuberculosis
ccgaucaucucaccgacgac

SEQ ID NO: 2822351 - RNA, 23 nt, Mycobacterium avium subsp. paratuberculosis
ccgaucauggucggcgacgccgu

SEQ ID NO: 2822352 - RNA, 14 nt, Mycobacterium avium subsp. paratuberculosis
ccgauccacggcga

SEQ ID NO: 2822353 - RNA, 16 nt, Mycobacterium avium subsp. paratuberculosis
ccgauccacggcgacc

SEQ ID NO: 2822354 - RNA, 19 nt, Mycobacterium avium subsp. paratuberculosis
ccgauccagccgucguugc

SEQ ID NO: 2822355 - RNA, 15 nt, Mycobacterium avium subsp. paratuberculosis
ccgauccagggcccg

SEQ ID NO: 2822356 - RNA, 19 nt, Mycobacterium avium subsp. paratuberculosis
ccgaucccggccacgucga

SEQ ID NO: 2822357 - RNA, 14 nt, Mycobacterium avium subsp. paratuberculosis
ccgaucccggccag

SEQ ID NO: 2822358 - RNA, 16 nt, Mycobacterium avium subsp. paratuberculosis
ccgaucccgucgucgg

SEQ ID NO: 2822359 - RNA, 18 nt, Mycobacterium avium subsp. paratuberculosis
ccgauccgcaccggacgc

SEQ ID NO: 2822360 - RNA, 14 nt, Mycobacterium avium subsp. paratuberculosis
ccgauccgcagccg

SEQ ID NO: 2822361 - RNA, 13 nt, Mycobacterium avium subsp. paratuberculosis
ccgauccgccggc

SEQ ID NO: 2822362 - RNA, 16 nt, Mycobacterium avium subsp. paratuberculosis
ccgauccgccggcgaa

SEQ ID NO: 2822363 - RNA, 21 nt, Mycobacterium avium subsp. paratuberculosis
ccgauccgccguugcggccca

SEQ ID NO: 2822364 - RNA, 22 nt, Mycobacterium avium subsp. paratuberculosis
ccgauccgccguugcggcccac

SEQ ID NO: 2822365 - RNA, 14 nt, Mycobacterium avium subsp. paratuberculosis
ccgauccgcgccgc

SEQ ID NO: 2822366 - RNA, 23 nt, Mycobacterium avium subsp. paratuberculosis
ccgauccgcgccgccgccagcca

SEQ ID NO: 2822367 - RNA, 17 nt, Mycobacterium avium subsp. paratuberculosis
ccgauccgcgggccggc

SEQ ID NO: 2822368 - RNA, 14 nt, Mycobacterium avium subsp. paratuberculosis
ccgauccggcgccg

SEQ ID NO: 2822369 - RNA, 15 nt, Mycobacterium avium subsp. paratuberculosis
ccgauccggcgccgc

SEQ ID NO: 2822370 - RNA, 21 nt, Mycobacterium avium subsp. paratuberculosis
ccgauccggcgccgcgggcgc

SEQ ID NO: 2822371 - RNA, 22 nt, Mycobacterium avium subsp. paratuberculosis
ccgauccggcgccgcgggcgcc

SEQ ID NO: 2822372 - RNA, 16 nt, Mycobacterium avium subsp. paratuberculosis
ccgauccucgccuguc

SEQ ID NO: 2822373 - RNA, 18 nt, Mycobacterium avium subsp. paratuberculosis
ccgauccucgccugucgg

SEQ ID NO: 2822374 - RNA, 18 nt, Mycobacterium avium subsp. paratuberculosis
ccgaucgaggacaccgcg

SEQ ID NO: 2822375 - RNA, 15 nt, Mycobacterium avium subsp. paratuberculosis
ccgaucgaucagccg

SEQ ID NO: 2822376 - RNA, 14 nt, Mycobacterium avium subsp. paratuberculosis
ccgaucgcccggua

SEQ ID NO: 2822377 - RNA, 20 nt, Mycobacterium avium subsp. paratuberculosis
ccgaucgcccgguaggccgc

SEQ ID NO: 2822378 - RNA, 22 nt, Mycobacterium avium subsp. paratuberculosis
ccgaucgcccgguaggccgccg

SEQ ID NO: 2822379 - RNA, 12 nt, Mycobacterium avium subsp. paratuberculosis
ccgaucgccgcg

SEQ ID NO: 2822380 - RNA, 15 nt, Mycobacterium avium subsp. paratuberculosis
ccgaucgccgcggcg

SEQ ID NO: 2822381 - RNA, 16 nt, Mycobacterium avium subsp. paratuberculosis
ccgaucgccgcggcga

SEQ ID NO: 2822382 - RNA, 17 nt, Mycobacterium avium subsp. paratuberculosis
ccgaucgccgcggcgau

SEQ ID NO: 2822383 - RNA, 21 nt, Mycobacterium avium subsp. paratuberculosis
ccgaucgccgcggcgaucucg

SEQ ID NO: 2822384 - RNA, 14 nt, Mycobacterium avium subsp. paratuberculosis
ccgaucgccuccgu

SEQ ID NO: 2822385 - RNA, 20 nt, Mycobacterium avium subsp. paratuberculosis
ccgaucgccuccgucagcgc

SEQ ID NO: 2822386 - RNA, 16 nt, Mycobacterium avium subsp. paratuberculosis
ccgaucgccuccucau

SEQ ID NO: 2822387 - RNA, 19 nt, Mycobacterium avium subsp. paratuberculosis
ccgaucgcgagggccguug

SEQ ID NO: 2822388 - RNA, 16 nt, Mycobacterium avium subsp. paratuberculosis
ccgaucgcgaucaccg

SEQ ID NO: 2822389 - RNA, 20 nt, Mycobacterium avium subsp. paratuberculosis
ccgaucgcgaucaccgcggc

SEQ ID NO: 2822390 - RNA, 14 nt, Mycobacterium avium subsp. paratuberculosis
ccgaucgcggcccc

SEQ ID NO: 2822391 - RNA, 17 nt, Mycobacterium avium subsp. paratuberculosis
ccgaucgcggcgaucag

SEQ ID NO: 2822392 - RNA, 17 nt, Mycobacterium avium subsp. paratuberculosis
ccgaucgcgucgacgau

SEQ ID NO: 2822393 - RNA, 20 nt, Mycobacterium avium subsp. paratuberculosis
ccgaucgcgucgacgauggc

SEQ ID NO: 2822394 - RNA, 22 nt, Mycobacterium avium subsp. paratuberculosis
ccgaucgcgucgacgauggcgu

SEQ ID NO: 2822395 - RNA, 14 nt, Mycobacterium avium subsp. paratuberculosis
ccgaucggcacccg

SEQ ID NO: 2822396 - RNA, 19 nt, Mycobacterium avium subsp. paratuberculosis
ccgaucggcacccgcaaca

SEQ ID NO: 2822397 - RNA, 22 nt, Mycobacterium avium subsp. paratuberculosis
ccgaucggcacccgcaacacca

SEQ ID NO: 2822398 - RNA, 19 nt, Mycobacterium avium subsp. paratuberculosis
ccgaucggcacgucgagca

SEQ ID NO: 2822399 - RNA, 15 nt, Mycobacterium avium subsp. paratuberculosis
ccgaucggcccggcc

SEQ ID NO: 2822400 - RNA, 17 nt, Mycobacterium avium subsp. paratuberculosis
ccgaucggcccggccaa

SEQ ID NO: 2822401 - RNA, 18 nt, Mycobacterium avium subsp. paratuberculosis
ccgaucgggaccgucacc

SEQ ID NO: 2822402 - RNA, 15 nt, Mycobacterium avium subsp. paratuberculosis
ccgauggugaccucg

SEQ ID NO: 2822403 - RNA, 16 nt, Mycobacterium avium subsp. paratuberculosis
ccgauggugaccucgg

SEQ ID NO: 2822404 - RNA, 22 nt, Mycobacterium avium subsp. paratuberculosis
ccgauggugacgauccggucga

SEQ ID NO: 2822405 - RNA, 13 nt, Mycobacterium avium subsp. paratuberculosis
ccgauggugacgg

SEQ ID NO: 2822406 - RNA, 19 nt, Mycobacterium avium subsp. paratuberculosis
ccgauggugacggugccgc

SEQ ID NO: 2822407 - RNA, 22 nt, Mycobacterium avium subsp. paratuberculosis
ccgauggugacggugccgccgu

SEQ ID NO: 2822408 - RNA, 19 nt, Mycobacterium avium subsp. paratuberculosis
ccgauggugguaccgaccu

SEQ ID NO: 2822409 - RNA, 23 nt, Mycobacterium avium subsp. paratuberculosis
ccgauggugguaccgaccugucc

SEQ ID NO: 2822410 - RNA, 23 nt, Mycobacterium avium subsp. paratuberculosis
ccgaugguguggaucgcuucggc

SEQ ID NO: 2822411 - RNA, 19 nt, Mycobacterium avium subsp. paratuberculosis
ccgauguacugggccgucg

SEQ ID NO: 2822412 - RNA, 22 nt, Mycobacterium avium subsp. paratuberculosis
ccgauguacugggccgucgccc

SEQ ID NO: 2822413 - RNA, 15 nt, Mycobacterium avium subsp. paratuberculosis
ccgauguaggacagg

SEQ ID NO: 2822414 - RNA, 22 nt, Mycobacterium avium subsp. paratuberculosis
ccgauguaggacaggucgcggu

SEQ ID NO: 2822415 - RNA, 14 nt, Mycobacterium avium subsp. paratuberculosis
ccgauguccccgcg

SEQ ID NO: 2822416 - RNA, 13 nt, Mycobacterium avium subsp. paratuberculosis
ccgaugucggacu

SEQ ID NO: 2822417 - RNA, 16 nt, Mycobacterium avium subsp. paratuberculosis
ccgaugucggcgaaca

SEQ ID NO: 2822418 - RNA, 21 nt, Mycobacterium avium subsp. paratuberculosis
ccgaugucggcgaacaccugc

SEQ ID NO: 2822419 - RNA, 13 nt, Mycobacterium avium subsp. paratuberculosis
ccgaugucggcgu

SEQ ID NO: 2822420 - RNA, 14 nt, Mycobacterium avium subsp. paratuberculosis
ccgaugucgucgaa

SEQ ID NO: 2822421 - RNA, 22 nt, Mycobacterium avium subsp. paratuberculosis
ccgaugucgucgaacgcggcga

SEQ ID NO: 2822422 - RNA, 14 nt, Mycobacterium avium subsp. paratuberculosis
ccgauguggcgggc

SEQ ID NO: 2822423 - RNA, 17 nt, Mycobacterium avium subsp. paratuberculosis
ccgauucaaccccgcgc

SEQ ID NO: 2822424 - RNA, 20 nt, Mycobacterium avium subsp. paratuberculosis
ccgauucagccggcgggcgc

SEQ ID NO: 2822425 - RNA, 16 nt, Mycobacterium avium subsp. paratuberculosis
ccgauuccauccggga

SEQ ID NO: 2822426 - RNA, 14 nt, Mycobacterium avium subsp. paratuberculosis
ccgauuccccggcg

SEQ ID NO: 2822427 - RNA, 15 nt, Mycobacterium avium subsp. paratuberculosis
ccgauuccggccggc

SEQ ID NO: 2822428 - RNA, 15 nt, Mycobacterium avium subsp. paratuberculosis
ccgauucggcgccgc

SEQ ID NO: 2822429 - RNA, 19 nt, Mycobacterium avium subsp. paratuberculosis
ccgauucggcgccgcgacc

SEQ ID NO: 2822430 - RNA, 16 nt, Mycobacterium avium subsp. paratuberculosis
ccgauugcccgacucc

SEQ ID NO: 2822431 - RNA, 16 nt, Mycobacterium avium subsp. paratuberculosis
ccgauugcggcgcagg

SEQ ID NO: 2822432 - RNA, 22 nt, Mycobacterium avium subsp. paratuberculosis
ccgauuggaagagggccauccg

SEQ ID NO: 2822433 - RNA, 21 nt, Mycobacterium avium subsp. paratuberculosis
ccgauuucauauugguucgcu

SEQ ID NO: 2822434 - RNA, 16 nt, Mycobacterium avium subsp. paratuberculosis
ccgauuucccgacucc

SEQ ID NO: 2822435 - RNA, 20 nt, Mycobacterium avium subsp. paratuberculosis
ccgauuucccgacuccucac

SEQ ID NO: 2822436 - RNA, 16 nt, Mycobacterium avium subsp. paratuberculosis
ccgauuucggccagcc

SEQ ID NO: 2822437 - RNA, 17 nt, Mycobacterium avium subsp. paratuberculosis
ccgauuucggccagccg

SEQ ID NO: 2822438 - RNA, 18 nt, Mycobacterium avium subsp. paratuberculosis
ccgcaaaucagccgagcc

SEQ ID NO: 2822439 - RNA, 13 nt, Mycobacterium avium subsp. paratuberculosis
ccgcaacaccacg

SEQ ID NO: 2822440 - RNA, 15 nt, Mycobacterium avium subsp. paratuberculosis
ccgcaacaccagcac

SEQ ID NO: 2822441 - RNA, 16 nt, Mycobacterium avium subsp. paratuberculosis
ccgcaacacggccucg

SEQ ID NO: 2822442 - RNA, 17 nt, Mycobacterium avium subsp. paratuberculosis
ccgcaacagccggcccg

SEQ ID NO: 2822443 - RNA, 20 nt, Mycobacterium avium subsp. paratuberculosis
ccgcaaccacuuucgcgagc

SEQ ID NO: 2822444 - RNA, 14 nt, Mycobacterium avium subsp. paratuberculosis
ccgcaaccgccggc

SEQ ID NO: 2822445 - RNA, 16 nt, Mycobacterium avium subsp. paratuberculosis
ccgcaaccgccggcag

SEQ ID NO: 2822446 - RNA, 17 nt, Mycobacterium avium subsp. paratuberculosis
ccgcaaccgccggcagc

SEQ ID NO: 2822447 - RNA, 19 nt, Mycobacterium avium subsp. paratuberculosis
ccgcaaccgccggcagcgg

SEQ ID NO: 2822448 - RNA, 19 nt, Mycobacterium avium subsp. paratuberculosis
ccgcaaccuucuuggccgg

SEQ ID NO: 2822449 - RNA, 12 nt, Mycobacterium avium subsp. paratuberculosis
ccgcaacgccgg

SEQ ID NO: 2822450 - RNA, 15 nt, Mycobacterium avium subsp. paratuberculosis
ccgcaacgccggcgu

SEQ ID NO: 2822451 - RNA, 16 nt, Mycobacterium avium subsp. paratuberculosis
ccgcaacgccggcgug

SEQ ID NO: 2822452 - RNA, 13 nt, Mycobacterium avium subsp. paratuberculosis
ccgcaacgcggcg

SEQ ID NO: 2822453 - RNA, 15 nt, Mycobacterium avium subsp. paratuberculosis
ccgcaacgcggcggu

SEQ ID NO: 2822454 - RNA, 16 nt, Mycobacterium avium subsp. paratuberculosis
ccgcaacgcggcggug

SEQ ID NO: 2822455 - RNA, 18 nt, Mycobacterium avium subsp. paratuberculosis
ccgcaacgcugaccgcag

SEQ ID NO: 2822456 - RNA, 20 nt, Mycobacterium avium subsp. paratuberculosis
ccgcaacgcugaccgcagga

SEQ ID NO: 2822457 - RNA, 14 nt, Mycobacterium avium subsp. paratuberculosis
ccgcaacgggccgc

SEQ ID NO: 2822458 - RNA, 15 nt, Mycobacterium avium subsp. paratuberculosis
ccgcaacgggccgca

SEQ ID NO: 2822459 - RNA, 16 nt, Mycobacterium avium subsp. paratuberculosis
ccgcaacgggccgcag

SEQ ID NO: 2822460 - RNA, 17 nt, Mycobacterium avium subsp. paratuberculosis
ccgcaacgggccgcagc

SEQ ID NO: 2822461 - RNA, 18 nt, Mycobacterium avium subsp. paratuberculosis
ccgcaacgggccgcagcc

SEQ ID NO: 2822462 - RNA, 21 nt, Mycobacterium avium subsp. paratuberculosis
ccgcaacgggccgcagccgcg

SEQ ID NO: 2822463 - RNA, 17 nt, Mycobacterium avium subsp. paratuberculosis
ccgcaacgugcgccggc

SEQ ID NO: 2822464 - RNA, 22 nt, Mycobacterium avium subsp. paratuberculosis
ccgcaacgugcgccggccuacc

SEQ ID NO: 2822465 - RNA, 17 nt, Mycobacterium avium subsp. paratuberculosis
ccgcaacuccacaacca

SEQ ID NO: 2822466 - RNA, 20 nt, Mycobacterium avium subsp. paratuberculosis
ccgcaacuccacaaccagcg

SEQ ID NO: 2822467 - RNA, 22 nt, Mycobacterium avium subsp. paratuberculosis
ccgcaacuguucgcggcuggcc

SEQ ID NO: 2822468 - RNA, 17 nt, Mycobacterium avium subsp. paratuberculosis
ccgcaacuugcccgacg

SEQ ID NO: 2822469 - RNA, 23 nt, Mycobacterium avium subsp. paratuberculosis
ccgcaagaugugggcgucgucga

SEQ ID NO: 2822470 - RNA, 13 nt, Mycobacterium avium subsp. paratuberculosis
ccgcaaggccgcc

SEQ ID NO: 2822471 - RNA, 21 nt, Mycobacterium avium subsp. paratuberculosis
ccgcaaggugauucgcgcggc

SEQ ID NO: 2822472 - RNA, 22 nt, Mycobacterium avium subsp. paratuberculosis
ccgcaaggugauucgcgcggcg

SEQ ID NO: 2822473 - RNA, 17 nt, Mycobacterium avium subsp. paratuberculosis
ccgcaagugcggucagc

SEQ ID NO: 2822474 - RNA, 22 nt, Mycobacterium avium subsp. paratuberculosis
ccgcaauacggugcccgccgcg

SEQ ID NO: 2822475 - RNA, 14 nt, Mycobacterium avium subsp. paratuberculosis
ccgcaaucggcgcc

SEQ ID NO: 2822476 - RNA, 16 nt, Mycobacterium avium subsp. paratuberculosis
ccgcaauugcgccagc

SEQ ID NO: 2822477 - RNA, 17 nt, Mycobacterium avium subsp. paratuberculosis
ccgcaauugcgccagca

SEQ ID NO: 2822478 - RNA, 18 nt, Mycobacterium avium subsp. paratuberculosis
ccgcacaauccggucagc

SEQ ID NO: 2822479 - RNA, 15 nt, Mycobacterium avium subsp. paratuberculosis
ccgcacaccaccacg

SEQ ID NO: 2822480 - RNA, 15 nt, Mycobacterium avium subsp. paratuberculosis
ccgcacaccgcgcag

SEQ ID NO: 2822481 - RNA, 13 nt, Mycobacterium avium subsp. paratuberculosis
ccgcacaccgcgg

SEQ ID NO: 2822482 - RNA, 13 nt, Mycobacterium avium subsp. paratuberculosis
ccgcacaccgucu

SEQ ID NO: 2822483 - RNA, 14 nt, Mycobacterium avium subsp. paratuberculosis
ccgcacaccgucuc

SEQ ID NO: 2822484 - RNA, 18 nt, Mycobacterium avium subsp. paratuberculosis
ccgcacaccugcaucacg

SEQ ID NO: 2822485 - RNA, 15 nt, Mycobacterium avium subsp. paratuberculosis
ccgcacagccggcgg

SEQ ID NO: 2822486 - RNA, 18 nt, Mycobacterium avium subsp. paratuberculosis
ccgcacagccggcggcgg

SEQ ID NO: 2822487 - RNA, 15 nt, Mycobacterium avium subsp. paratuberculosis
ccgcacgugcgcgcc

SEQ ID NO: 2822488 - RNA, 16 nt, Mycobacterium avium subsp. paratuberculosis
ccgcacgugcgcgccg

SEQ ID NO: 2822489 - RNA, 19 nt, Mycobacterium avium subsp. paratuberculosis
ccgcacgugcgcgccgacc

SEQ ID NO: 2822490 - RNA, 21 nt, Mycobacterium avium subsp. paratuberculosis
ccgcacgugcgcgccgaccgc

SEQ ID NO: 2822491 - RNA, 23 nt, Mycobacterium avium subsp. paratuberculosis
ccgcacgugcgcgccgaccgcga

SEQ ID NO: 2822492 - RNA, 21 nt, Mycobacterium avium subsp. paratuberculosis
ccgcacguguucucacggcga

SEQ ID NO: 2822493 - RNA, 22 nt, Mycobacterium avium subsp. paratuberculosis
ccgcacguguucucacggcgaa

SEQ ID NO: 2822494 - RNA, 18 nt, Mycobacterium avium subsp. paratuberculosis
ccgcacugaacgggauga

SEQ ID NO: 2822495 - RNA, 18 nt, Mycobacterium avium subsp. paratuberculosis
ccgcacugcacggccucg

SEQ ID NO: 2822496 - RNA, 19 nt, Mycobacterium avium subsp. paratuberculosis
ccgcacugcacggccucgg

SEQ ID NO: 2822497 - RNA, 16 nt, Mycobacterium avium subsp. paratuberculosis
ccgcacugcaucucga

SEQ ID NO: 2822498 - RNA, 21 nt, Mycobacterium avium subsp. paratuberculosis
ccgcacugcaucucgaccugg

SEQ ID NO: 2822499 - RNA, 23 nt, Mycobacterium avium subsp. paratuberculosis
ccgcacuggucgugcuggagcgg

SEQ ID NO: 2822500 - RNA, 16 nt, Mycobacterium avium subsp. paratuberculosis
ccgcacuuggccucgg

SEQ ID NO: 2822501 - RNA, 14 nt, Mycobacterium avium subsp. paratuberculosis
ccgcagaacaccag

SEQ ID NO: 2822502 - RNA, 17 nt, Mycobacterium avium subsp. paratuberculosis
ccgcagaacaccagcgc

SEQ ID NO: 2822503 - RNA, 17 nt, Mycobacterium avium subsp. paratuberculosis
ccgcagauacaucucgg

SEQ ID NO: 2822504 - RNA, 18 nt, Mycobacterium avium subsp. paratuberculosis
ccgcagauagaucgacgc

SEQ ID NO: 2822505 - RNA, 22 nt, Mycobacterium avium subsp. paratuberculosis
ccgcagcaccaccucgugcaca

SEQ ID NO: 2822506 - RNA, 13 nt, Mycobacterium avium subsp. paratuberculosis
ccgcagcaccagg

SEQ ID NO: 2822507 - RNA, 16 nt, Mycobacterium avium subsp. paratuberculosis
ccgcagcaccaggguc

SEQ ID NO: 2822508 - RNA, 13 nt, Mycobacterium avium subsp. paratuberculosis
ccgcagcacgccc

SEQ ID NO: 2822509 - RNA, 14 nt, Mycobacterium avium subsp. paratuberculosis
ccgcagcacgcccg

SEQ ID NO: 2822510 - RNA, 20 nt, Mycobacterium avium subsp. paratuberculosis
ccgcagcacgcugaagccca

SEQ ID NO: 2822511 - RNA, 11 nt, Mycobacterium avium subsp. paratuberculosis
ccgcagcagcc

SEQ ID NO: 2822512 - RNA, 15 nt, Mycobacterium avium subsp. paratuberculosis
ccgcagcagccgcgc

SEQ ID NO: 2822513 - RNA, 16 nt, Mycobacterium avium subsp. paratuberculosis
ccgcagcagccgcgcc

SEQ ID NO: 2822514 - RNA, 22 nt, Mycobacterium avium subsp. paratuberculosis
ccgcagcagccgcgccaccgcg

SEQ ID NO: 2822515 - RNA, 15 nt, Mycobacterium avium subsp. paratuberculosis
ccgcagcaggugcgc

SEQ ID NO: 2822516 - RNA, 19 nt, Mycobacterium avium subsp. paratuberculosis
ccgcagcaucuuggccacg

SEQ ID NO: 2822517 - RNA, 15 nt, Mycobacterium avium subsp. paratuberculosis
ccgcagcccaggccc

SEQ ID NO: 2822518 - RNA, 18 nt, Mycobacterium avium subsp. paratuberculosis
ccgcagcccaggcccagc

SEQ ID NO: 2822519 - RNA, 23 nt, Mycobacterium avium subsp. paratuberculosis
ccgcagcccaggcccagcagcac

SEQ ID NO: 2822520 - RNA, 13 nt, Mycobacterium avium subsp. paratuberculosis
ccgcagcccgacc

SEQ ID NO: 2822521 - RNA, 21 nt, Mycobacterium avium subsp. paratuberculosis
ccgcagcccgaccuucugcug

SEQ ID NO: 2822522 - RNA, 15 nt, Mycobacterium avium subsp. paratuberculosis
ccgcagcccgccagg

SEQ ID NO: 2822523 - RNA, 12 nt, Mycobacterium avium subsp. paratuberculosis
ccgcagcccguc

SEQ ID NO: 2822524 - RNA, 16 nt, Mycobacterium avium subsp. paratuberculosis
ccgcagcccgucgauc

SEQ ID NO: 2822525 - RNA, 15 nt, Mycobacterium avium subsp. paratuberculosis
ccgcagccgcgacgg

SEQ ID NO: 2822526 - RNA, 16 nt, Mycobacterium avium subsp. paratuberculosis
ccgcagccgcgacggc

SEQ ID NO: 2822527 - RNA, 18 nt, Mycobacterium avium subsp. paratuberculosis
ccgcagccgcgacggcgg

SEQ ID NO: 2822528 - RNA, 15 nt, Mycobacterium avium subsp. paratuberculosis
ccgcagccgcgcggc

SEQ ID NO: 2822529 - RNA, 15 nt, Mycobacterium avium subsp. paratuberculosis
ccgcagccgcuggcc

SEQ ID NO: 2822530 - RNA, 16 nt, Mycobacterium avium subsp. paratuberculosis
ccgcagccgcuggccg

SEQ ID NO: 2822531 - RNA, 18 nt, Mycobacterium avium subsp. paratuberculosis
ccgcagccgcuggccgcg

SEQ ID NO: 2822532 - RNA, 20 nt, Mycobacterium avium subsp. paratuberculosis
ccgcagccgcuggccgcgcc

SEQ ID NO: 2822533 - RNA, 13 nt, Mycobacterium avium subsp. paratuberculosis
ccgcagccgggug

SEQ ID NO: 2822534 - RNA, 14 nt, Mycobacterium avium subsp. paratuberculosis
ccgcagccgggugc

SEQ ID NO: 2822535 - RNA, 15 nt, Mycobacterium avium subsp. paratuberculosis
ccgcagccgggugcg

SEQ ID NO: 2822536 - RNA, 18 nt, Mycobacterium avium subsp. paratuberculosis
ccgcagccgggugcgggc

SEQ ID NO: 2822537 - RNA, 20 nt, Mycobacterium avium subsp. paratuberculosis
ccgcagccgggugcgggcca

SEQ ID NO: 2822538 - RNA, 14 nt, Mycobacterium avium subsp. paratuberculosis
ccgcagccgggugg

SEQ ID NO: 2822539 - RNA, 13 nt, Mycobacterium avium subsp. paratuberculosis
ccgcagccguccc

SEQ ID NO: 2822540 - RNA, 14 nt, Mycobacterium avium subsp. paratuberculosis
ccgcagccuucuuc

SEQ ID NO: 2822541 - RNA, 19 nt, Mycobacterium avium subsp. paratuberculosis
ccgcagccuucuuggcggg

SEQ ID NO: 2822542 - RNA, 20 nt, Mycobacterium avium subsp. paratuberculosis
ccgcagccuucuuggcgggc

SEQ ID NO: 2822543 - RNA, 21 nt, Mycobacterium avium subsp. paratuberculosis
ccgcagccuucuuggcgggcg

SEQ ID NO: 2822544 - RNA, 23 nt, Mycobacterium avium subsp. paratuberculosis
ccgcagccuucuuggcgggcgcc

SEQ ID NO: 2822545 - RNA, 19 nt, Mycobacterium avium subsp. paratuberculosis
ccgcagcgaacgcggcuga

SEQ ID NO: 2822546 - RNA, 15 nt, Mycobacterium avium subsp. paratuberculosis
ccgcagcgaccgcgg

SEQ ID NO: 2822547 - RNA, 19 nt, Mycobacterium avium subsp. paratuberculosis
ccgcagcgaccgcggauga

SEQ ID NO: 2822548 - RNA, 23 nt, Mycobacterium avium subsp. paratuberculosis
ccgcagcgacuccugguccucga

SEQ ID NO: 2822549 - RNA, 17 nt, Mycobacterium avium subsp. paratuberculosis
ccgcagcgcagcgucgg

SEQ ID NO: 2822550 - RNA, 22 nt, Mycobacterium avium subsp. paratuberculosis
ccgcagcgcagcgucggcgugc

SEQ ID NO: 2822551 - RNA, 16 nt, Mycobacterium avium subsp. paratuberculosis
ccgcagcgcaucgccg

SEQ ID NO: 2822552 - RNA, 20 nt, Mycobacterium avium subsp. paratuberculosis
ccgcagcgcaucgccggcga

SEQ ID NO: 2822553 - RNA, 22 nt, Mycobacterium avium subsp. paratuberculosis
ccgcagcgcaucgccggcgaug

SEQ ID NO: 2822554 - RNA, 18 nt, Mycobacterium avium subsp. paratuberculosis
ccgcagcgcaucggugag

SEQ ID NO: 2822555 - RNA, 20 nt, Mycobacterium avium subsp. paratuberculosis
ccgcagcgcaucggugagac

SEQ ID NO: 2822556 - RNA, 16 nt, Mycobacterium avium subsp. paratuberculosis
ccgcagcgcaucguug

SEQ ID NO: 2822557 - RNA, 14 nt, Mycobacterium avium subsp. paratuberculosis
ccgcagcgccagcg

SEQ ID NO: 2822558 - RNA, 16 nt, Mycobacterium avium subsp. paratuberculosis
ccgcagcgccagcgcg

SEQ ID NO: 2822559 - RNA, 22 nt, Mycobacterium avium subsp. paratuberculosis
ccgcagcgccagcgcgcccgcc

SEQ ID NO: 2822560 - RNA, 16 nt, Mycobacterium avium subsp. paratuberculosis
ccgcagcgcccggcag

SEQ ID NO: 2822561 - RNA, 13 nt, Mycobacterium avium subsp. paratuberculosis
ccgcagcgccucg

SEQ ID NO: 2822562 - RNA, 12 nt, Mycobacterium avium subsp. paratuberculosis
ccgcagcgcgac

SEQ ID NO: 2822563 - RNA, 16 nt, Mycobacterium avium subsp. paratuberculosis
ccgcagcgcgacgaac

SEQ ID NO: 2822564 - RNA, 19 nt, Mycobacterium avium subsp. paratuberculosis
ccgcagcgcgacgaacagc

SEQ ID NO: 2822565 - RNA, 14 nt, Mycobacterium avium subsp. paratuberculosis
ccgcagcgcgcgac

SEQ ID NO: 2822566 - RNA, 17 nt, Mycobacterium avium subsp. paratuberculosis
ccgcagcgcgcgaccgc

SEQ ID NO: 2822567 - RNA, 19 nt, Mycobacterium avium subsp. paratuberculosis
ccgcagcgcgcgaccgcga

SEQ ID NO: 2822568 - RNA, 21 nt, Mycobacterium avium subsp. paratuberculosis
ccgcagcgcgcgaccgcgaug

SEQ ID NO: 2822569 - RNA, 16 nt, Mycobacterium avium subsp. paratuberculosis
ccgcagcgcgcgggug

SEQ ID NO: 2822570 - RNA, 13 nt, Mycobacterium avium subsp. paratuberculosis
ccgcagcgcggcg

SEQ ID NO: 2822571 - RNA, 14 nt, Mycobacterium avium subsp. paratuberculosis
ccgcagcgcggcga

SEQ ID NO: 2822572 - RNA, 12 nt, Mycobacterium avium subsp. paratuberculosis
ccgcaugucgac

SEQ ID NO: 2822573 - RNA, 16 nt, Mycobacterium avium subsp. paratuberculosis
ccgcaugucgaccucg

SEQ ID NO: 2822574 - RNA, 18 nt, Mycobacterium avium subsp. paratuberculosis
ccgcaugucgaccucggc

SEQ ID NO: 2822575 - RNA, 22 nt, Mycobacterium avium subsp. paratuberculosis
ccgcaugucgaccucggccacc

SEQ ID NO: 2822576 - RNA, 19 nt, Mycobacterium avium subsp. paratuberculosis
ccgcauguucucgagcccg

SEQ ID NO: 2822577 - RNA, 22 nt, Mycobacterium avium subsp. paratuberculosis
ccgcauguucucgagcccgauc

SEQ ID NO: 2822578 - RNA, 22 nt, Mycobacterium avium subsp. paratuberculosis
ccgcauuccgucuuggccaggc

SEQ ID NO: 2822579 - RNA, 16 nt, Mycobacterium avium subsp. paratuberculosis
ccgcauuccucggcca

SEQ ID NO: 2822580 - RNA, 17 nt, Mycobacterium avium subsp. paratuberculosis
ccgcauuccucggccag

SEQ ID NO: 2822581 - RNA, 18 nt, Mycobacterium avium subsp. paratuberculosis
ccgcauuccucggccagc

SEQ ID NO: 2822582 - RNA, 23 nt, Mycobacterium avium subsp. paratuberculosis
ccgcauucggccgccaccgaggu

SEQ ID NO: 2822583 - RNA, 23 nt, Mycobacterium avium subsp. paratuberculosis
ccgcauuggcaccgucgaccucg

SEQ ID NO: 2822584 - RNA, 23 nt, Mycobacterium avium subsp. paratuberculosis
ccgcauuugccgacaugcugggc

SEQ ID NO: 2822585 - RNA, 12 nt, Mycobacterium avium subsp. paratuberculosis
ccgccaaaacgg

SEQ ID NO: 2822586 - RNA, 17 nt, Mycobacterium avium subsp. paratuberculosis
ccgccaaaacggggugg

SEQ ID NO: 2822587 - RNA, 22 nt, Mycobacterium avium subsp. paratuberculosis
ccgccaaaacgggguggaauag

SEQ ID NO: 2822588 - RNA, 15 nt, Mycobacterium avium subsp. paratuberculosis
ccgccaaccaggucg

SEQ ID NO: 2822589 - RNA, 23 nt, Mycobacterium avium subsp. paratuberculosis
ccgccaaccaggucgcggcgcug

SEQ ID NO: 2822590 - RNA, 24 nt, Mycobacterium avium subsp. paratuberculosis
ccgccaaccaggucgcggcgcugc

SEQ ID NO: 2822591 - RNA, 18 nt, Mycobacterium avium subsp. paratuberculosis
ccgccaacgcgaacgggu

SEQ ID NO: 2822592 - RNA, 12 nt, Mycobacterium avium subsp. paratuberculosis
ccgccaagugcg

SEQ ID NO: 2822593 - RNA, 18 nt, Mycobacterium avium subsp. paratuberculosis
ccgccaagugcggugugg

SEQ ID NO: 2822594 - RNA, 15 nt, Mycobacterium avium subsp. paratuberculosis
ccgccaaucaccgcg

SEQ ID NO: 2822595 - RNA, 16 nt, Mycobacterium avium subsp. paratuberculosis
ccgccaaucaccgcgg

SEQ ID NO: 2822596 - RNA, 17 nt, Mycobacterium avium subsp. paratuberculosis
ccgccaaucaccgcggu

SEQ ID NO: 2822597 - RNA, 14 nt, Mycobacterium avium subsp. paratuberculosis
ccgccacagcgccu

SEQ ID NO: 2822598 - RNA, 15 nt, Mycobacterium avium subsp. paratuberculosis
ccgccacagcgccuc

SEQ ID NO: 2822599 - RNA, 16 nt, Mycobacterium avium subsp. paratuberculosis
ccgccacagcgccucg

SEQ ID NO: 2822600 - RNA, 21 nt, Mycobacterium avium subsp. paratuberculosis
ccgccacagcgccucgcgguc

SEQ ID NO: 2822601 - RNA, 12 nt, Mycobacterium avium subsp. paratuberculosis
ccgccaccaaca

SEQ ID NO: 2822602 - RNA, 20 nt, Mycobacterium avium subsp. paratuberculosis
ccgccaccaacaucgacgug

SEQ ID NO: 2822603 - RNA, 13 nt, Mycobacterium avium subsp. paratuberculosis
ccgccaccacccg

SEQ ID NO: 2822604 - RNA, 14 nt, Mycobacterium avium subsp. paratuberculosis
ccgccaccacccgg

SEQ ID NO: 2822605 - RNA, 18 nt, Mycobacterium avium subsp. paratuberculosis
ccgccaccacccggcgau

SEQ ID NO: 2822606 - RNA, 20 nt, Mycobacterium avium subsp. paratuberculosis
ccgccaccacccggcgauua

SEQ ID NO: 2822607 - RNA, 12 nt, Mycobacterium avium subsp. paratuberculosis
ccgccaccagcg

SEQ ID NO: 2822608 - RNA, 14 nt, Mycobacterium avium subsp. paratuberculosis
ccgccaccaggccg

SEQ ID NO: 2822609 - RNA, 19 nt, Mycobacterium avium subsp. paratuberculosis
ccgccaccccaggcgaugc

SEQ ID NO: 2822610 - RNA, 14 nt, Mycobacterium avium subsp. paratuberculosis
ccgccacccgaggc

SEQ ID NO: 2822611 - RNA, 22 nt, Mycobacterium avium subsp. paratuberculosis
ccgccacccgcugcucgaccuc

SEQ ID NO: 2822612 - RNA, 18 nt, Mycobacterium avium subsp. paratuberculosis
ccgccacccugcgcaccg

SEQ ID NO: 2822613 - RNA, 13 nt, Mycobacterium avium subsp. paratuberculosis
ccgccaccgcccg

SEQ ID NO: 2822614 - RNA, 15 nt, Mycobacterium avium subsp. paratuberculosis
ccgccaccgcccgcu

SEQ ID NO: 2822615 - RNA, 12 nt, Mycobacterium avium subsp. paratuberculosis
ccgccaccgcga

SEQ ID NO: 2822616 - RNA, 22 nt, Mycobacterium avium subsp. paratuberculosis
ccgccaccgcgaaagcgucggc

SEQ ID NO: 2822617 - RNA, 12 nt, Mycobacterium avium subsp. paratuberculosis
ccgccaccgcgc

SEQ ID NO: 2822618 - RNA, 22 nt, Mycobacterium avium subsp. paratuberculosis
ccgccaccgcgcaaccgggccg

SEQ ID NO: 2822619 - RNA, 16 nt, Mycobacterium avium subsp. paratuberculosis
ccgccaccggcccggc

SEQ ID NO: 2822620 - RNA, 18 nt, Mycobacterium avium subsp. paratuberculosis
ccgccaccggcccggccg

SEQ ID NO: 2822621 - RNA, 20 nt, Mycobacterium avium subsp. paratuberculosis
ccgccaccggcccggccggc

SEQ ID NO: 2822622 - RNA, 14 nt, Mycobacterium avium subsp. paratuberculosis
ccgccaccggccgg

SEQ ID NO: 2822623 - RNA, 15 nt, Mycobacterium avium subsp. paratuberculosis
ccgccaccggccggu

SEQ ID NO: 2822624 - RNA, 16 nt, Mycobacterium avium subsp. paratuberculosis
ccgccaccggccgguc

SEQ ID NO: 2822625 - RNA, 13 nt, Mycobacterium avium subsp. paratuberculosis
ccgccacgacgcg

SEQ ID NO: 2822626 - RNA, 14 nt, Mycobacterium avium subsp. paratuberculosis
ccgccacgacgcgg

SEQ ID NO: 2822627 - RNA, 16 nt, Mycobacterium avium subsp. paratuberculosis
ccgccacgacgcggcg

SEQ ID NO: 2822628 - RNA, 15 nt, Mycobacterium avium subsp. paratuberculosis
ccgccacgccguugg

SEQ ID NO: 2822629 - RNA, 13 nt, Mycobacterium avium subsp. paratuberculosis
ccgccacgcggcg

SEQ ID NO: 2822630 - RNA, 15 nt, Mycobacterium avium subsp. paratuberculosis
ccgccacgcggcgcg

SEQ ID NO: 2822631 - RNA, 16 nt, Mycobacterium avium subsp. paratuberculosis
ccgccacgcggcgcgc

SEQ ID NO: 2822632 - RNA, 17 nt, Mycobacterium avium subsp. paratuberculosis
ccgccacgcggcgcgca

SEQ ID NO: 2822633 - RNA, 21 nt, Mycobacterium avium subsp. paratuberculosis
ccgccacgcggcgcgcaucgu

SEQ ID NO: 2822634 - RNA, 12 nt, Mycobacterium avium subsp. paratuberculosis
ccgccacgcugg

SEQ ID NO: 2822635 - RNA, 17 nt, Mycobacterium avium subsp. paratuberculosis
ccgccacggcacgucga

SEQ ID NO: 2822636 - RNA, 14 nt, Mycobacterium avium subsp. paratuberculosis
ccgccacggccagc

SEQ ID NO: 2822637 - RNA, 12 nt, Mycobacterium avium subsp. paratuberculosis
ccgccacggcga

SEQ ID NO: 2822638 - RNA, 13 nt, Mycobacterium avium subsp. paratuberculosis
ccgccacggcgac

SEQ ID NO: 2822639 - RNA, 12 nt, Mycobacterium avium subsp. paratuberculosis
ccgccacggcgc

SEQ ID NO: 2822640 - RNA, 13 nt, Mycobacterium avium subsp. paratuberculosis
ccgccacggcgcc

SEQ ID NO: 2822641 - RNA, 14 nt, Mycobacterium avium subsp. paratuberculosis
ccgccacggcgcca

SEQ ID NO: 2822642 - RNA, 13 nt, Mycobacterium avium subsp. paratuberculosis
ccgccacggcggg

SEQ ID NO: 2822643 - RNA, 16 nt, Mycobacterium avium subsp. paratuberculosis
ccgccacggggcccgc

SEQ ID NO: 2822644 - RNA, 20 nt, Mycobacterium avium subsp. paratuberculosis
ccgccacgucgaacccgacc

SEQ ID NO: 2822645 - RNA, 16 nt, Mycobacterium avium subsp. paratuberculosis
ccgccacgugcggcug

SEQ ID NO: 2822646 - RNA, 22 nt, Mycobacterium avium subsp. paratuberculosis
ccgccacucauguucagggugc

SEQ ID NO: 2822647 - RNA, 20 nt, Mycobacterium avium subsp. paratuberculosis
ccgccagauagggcagcguc

SEQ ID NO: 2822648 - RNA, 20 nt, Mycobacterium avium subsp. paratuberculosis
ccgccagaucgccuggcagc

SEQ ID NO: 2822649 - RNA, 22 nt, Mycobacterium avium subsp. paratuberculosis
ccgccagaucgccuggcagcug

SEQ ID NO: 2822650 - RNA, 19 nt, Mycobacterium avium subsp. paratuberculosis
ccgccagcaaccccgcggu

SEQ ID NO: 2822651 - RNA, 13 nt, Mycobacterium avium subsp. paratuberculosis
ccgccagcaccac

SEQ ID NO: 2822652 - RNA, 15 nt, Mycobacterium avium subsp. paratuberculosis
ccgccagcaccaccg

SEQ ID NO: 2822653 - RNA, 14 nt, Mycobacterium avium subsp. paratuberculosis
ccgccagcaccgac

SEQ ID NO: 2822654 - RNA, 16 nt, Mycobacterium avium subsp. paratuberculosis
ccgccagcaccgacgc

SEQ ID NO: 2822655 - RNA, 18 nt, Mycobacterium avium subsp. paratuberculosis
ccgccagcaccgacgcgc

SEQ ID NO: 2822656 - RNA, 20 nt, Mycobacterium avium subsp. paratuberculosis
ccgccagcaccgacgcgccg

SEQ ID NO: 2822657 - RNA, 23 nt, Mycobacterium avium subsp. paratuberculosis
ccgccaucgaucgggcgucgcag

SEQ ID NO: 2822658 - RNA, 18 nt, Mycobacterium avium subsp. paratuberculosis
ccgccaucgcccggugcg

SEQ ID NO: 2822659 - RNA, 13 nt, Mycobacterium avium subsp. paratuberculosis
ccgccaucgccgc

SEQ ID NO: 2822660 - RNA, 16 nt, Mycobacterium avium subsp. paratuberculosis
ccgccaucgccgccgc

SEQ ID NO: 2822661 - RNA, 14 nt, Mycobacterium avium subsp. paratuberculosis
ccgccaucgccucg

SEQ ID NO: 2822662 - RNA, 18 nt, Mycobacterium avium subsp. paratuberculosis
ccgccaucgccucguccc

SEQ ID NO: 2822663 - RNA, 15 nt, Mycobacterium avium subsp. paratuberculosis
ccgccaucggcaucg

SEQ ID NO: 2822664 - RNA, 18 nt, Mycobacterium avium subsp. paratuberculosis
ccgccaucggcaucgcgc

SEQ ID NO: 2822665 - RNA, 15 nt, Mycobacterium avium subsp. paratuberculosis
ccgccaucuccuccg

SEQ ID NO: 2822666 - RNA, 16 nt, Mycobacterium avium subsp. paratuberculosis
ccgccaucucgggagu

SEQ ID NO: 2822667 - RNA, 17 nt, Mycobacterium avium subsp. paratuberculosis
ccgccaugcuugccaac

SEQ ID NO: 2822668 - RNA, 23 nt, Mycobacterium avium subsp. paratuberculosis
ccgccauggcggcauccccagcu

SEQ ID NO: 2822669 - RNA, 12 nt, Mycobacterium avium subsp. paratuberculosis
ccgcccaacgac

SEQ ID NO: 2822670 - RNA, 21 nt, Mycobacterium avium subsp. paratuberculosis
ccgcccaacgacgucggcguc

SEQ ID NO: 2822671 - RNA, 14 nt, Mycobacterium avium subsp. paratuberculosis
ccgcccacaccgac

SEQ ID NO: 2822672 - RNA, 12 nt, Mycobacterium avium subsp. paratuberculosis
ccgcccacagca

SEQ ID NO: 2822673 - RNA, 13 nt, Mycobacterium avium subsp. paratuberculosis
ccgcccacagcaa

SEQ ID NO: 2822674 - RNA, 18 nt, Mycobacterium avium subsp. paratuberculosis
ccgcccacagcaacgaca

SEQ ID NO: 2822675 - RNA, 23 nt, Mycobacterium avium subsp. paratuberculosis
ccgcccacagcaacgacauccag

SEQ ID NO: 2822676 - RNA, 13 nt, Mycobacterium avium subsp. paratuberculosis
ccgcccaccaccg

SEQ ID NO: 2822677 - RNA, 15 nt, Mycobacterium avium subsp. paratuberculosis
ccgcccaccaccggc

SEQ ID NO: 2822678 - RNA, 17 nt, Mycobacterium avium subsp. paratuberculosis
ccgcccaccaccggcuu

SEQ ID NO: 2822679 - RNA, 12 nt, Mycobacterium avium subsp. paratuberculosis
ccgcccaccacg

SEQ ID NO: 2822680 - RNA, 13 nt, Mycobacterium avium subsp. paratuberculosis
ccgcccaccacga

SEQ ID NO: 2822681 - RNA, 22 nt, Mycobacterium avium subsp. paratuberculosis
ccgcccaccacgaaccaggcgc

SEQ ID NO: 2822682 - RNA, 21 nt, Mycobacterium avium subsp. paratuberculosis
ccgcccaccacgaacgcgccg

SEQ ID NO: 2822683 - RNA, 13 nt, Mycobacterium avium subsp. paratuberculosis
ccgcccaccagca

SEQ ID NO: 2822684 - RNA, 20 nt, Mycobacterium avium subsp. paratuberculosis
ccgcccaccagcacaccgga

SEQ ID NO: 2822685 - RNA, 13 nt, Mycobacterium avium subsp. paratuberculosis
ccgcccacgccgc

SEQ ID NO: 2822686 - RNA, 16 nt, Mycobacterium avium subsp. paratuberculosis
ccgcccacgccgccca

SEQ ID NO: 2822687 - RNA, 21 nt, Mycobacterium avium subsp. paratuberculosis
ccgcccacgccgcccaggccc

SEQ ID NO: 2822688 - RNA, 14 nt, Mycobacterium avium subsp. paratuberculosis
ccgcccacgccgug

SEQ ID NO: 2822689 - RNA, 16 nt, Mycobacterium avium subsp. paratuberculosis
ccgcccacgccgugca

SEQ ID NO: 2822690 - RNA, 12 nt, Mycobacterium avium subsp. paratuberculosis
ccgcccacgggu

SEQ ID NO: 2822691 - RNA, 17 nt, Mycobacterium avium subsp. paratuberculosis
ccgcccacgggucgccg

SEQ ID NO: 2822692 - RNA, 19 nt, Mycobacterium avium subsp. paratuberculosis
ccgcccacgggucgccgau

SEQ ID NO: 2822693 - RNA, 20 nt, Mycobacterium avium subsp. paratuberculosis
ccgcccacguaggggcccgg

SEQ ID NO: 2822694 - RNA, 19 nt, Mycobacterium avium subsp. paratuberculosis
ccgcccacuggucguugca

SEQ ID NO: 2822695 - RNA, 22 nt, Mycobacterium avium subsp. paratuberculosis
ccgcccacuggucguugcacac

SEQ ID NO: 2822696 - RNA, 22 nt, Mycobacterium avium subsp. paratuberculosis
ccgcccacuucgacggugaugu

SEQ ID NO: 2822697 - RNA, 19 nt, Mycobacterium avium subsp. paratuberculosis
ccgcccagacgcgggcgcc

SEQ ID NO: 2822698 - RNA, 20 nt, Mycobacterium avium subsp. paratuberculosis
ccgcccagacgcgggcgccc

SEQ ID NO: 2822699 - RNA, 22 nt, Mycobacterium avium subsp. paratuberculosis
ccgcccagcagccgcgccgacg

SEQ ID NO: 2822700 - RNA, 21 nt, Mycobacterium avium subsp. paratuberculosis
ccgcccagcaucgccgcgacc

SEQ ID NO: 2822701 - RNA, 21 nt, Mycobacterium avium subsp. paratuberculosis
ccgcccagcgacucggccagg

SEQ ID NO: 2822702 - RNA, 22 nt, Mycobacterium avium subsp. paratuberculosis
ccgcccagcgacucggccagga

SEQ ID NO: 2822703 - RNA, 11 nt, Mycobacterium avium subsp. paratuberculosis
ccgcccagcgc

SEQ ID NO: 2822704 - RNA, 12 nt, Mycobacterium avium subsp. paratuberculosis
ccgcccagcgca

SEQ ID NO: 2822705 - RNA, 17 nt, Mycobacterium avium subsp. paratuberculosis
ccgcccagcgcagcauc

SEQ ID NO: 2822706 - RNA, 19 nt, Mycobacterium avium subsp. paratuberculosis
ccgcccagcgcauccacca

SEQ ID NO: 2822707 - RNA, 16 nt, Mycobacterium avium subsp. paratuberculosis
ccgcccagcgccacgg

SEQ ID NO: 2822708 - RNA, 15 nt, Mycobacterium avium subsp. paratuberculosis
ccgcccagcggcccc

SEQ ID NO: 2822709 - RNA, 19 nt, Mycobacterium avium subsp. paratuberculosis
ccgcccagcggccccggcu

SEQ ID NO: 2822710 - RNA, 16 nt, Mycobacterium avium subsp. paratuberculosis
ccgcccaggacccgua

SEQ ID NO: 2822711 - RNA, 17 nt, Mycobacterium avium subsp. paratuberculosis
ccgcccaggacccguac

SEQ ID NO: 2822712 - RNA, 18 nt, Mycobacterium avium subsp. paratuberculosis
ccgcccaggccccggccg

SEQ ID NO: 2822713 - RNA, 22 nt, Mycobacterium avium subsp. paratuberculosis
ccgcccaggccccggccgagcg

SEQ ID NO: 2822714 - RNA, 23 nt, Mycobacterium avium subsp. paratuberculosis
ccgcccaggccccggccgagcgc

SEQ ID NO: 2822715 - RNA, 17 nt, Mycobacterium avium subsp. paratuberculosis
ccgcccaggccgagcgc

SEQ ID NO: 2822716 - RNA, 18 nt, Mycobacterium avium subsp. paratuberculosis
ccgcccaggccgccagcu

SEQ ID NO: 2822717 - RNA, 18 nt, Mycobacterium avium subsp. paratuberculosis
ccgcccaggcgggccagc

SEQ ID NO: 2822718 - RNA, 20 nt, Mycobacterium avium subsp. paratuberculosis
ccgcccaggcgggccagcuc

SEQ ID NO: 2822719 - RNA, 14 nt, Mycobacterium avium subsp. paratuberculosis
ccgcccagucgccg

SEQ ID NO: 2822720 - RNA, 19 nt, Mycobacterium avium subsp. paratuberculosis
ccgcccagucgccgccgcg

SEQ ID NO: 2822721 - RNA, 19 nt, Mycobacterium avium subsp. paratuberculosis
ccgcccaguugcacggugu

SEQ ID NO: 2822722 - RNA, 14 nt, Mycobacterium avium subsp. paratuberculosis
ccgcccaucagcag

SEQ ID NO: 2822723 - RNA, 22 nt, Mycobacterium avium subsp. paratuberculosis
ccgcccaucagcaggaccaggc

SEQ ID NO: 2822724 - RNA, 23 nt, Mycobacterium avium subsp. paratuberculosis
ccgcccaucagcaggaccaggcc

SEQ ID NO: 2822725 - RNA, 14 nt, Mycobacterium avium subsp. paratuberculosis
ccgcccaucggcag

SEQ ID NO: 2822726 - RNA, 15 nt, Mycobacterium avium subsp. paratuberculosis
ccgcccaucggcagc

SEQ ID NO: 2822727 - RNA, 16 nt, Mycobacterium avium subsp. paratuberculosis
ccgcccaucggcagcc

SEQ ID NO: 2822728 - RNA, 22 nt, Mycobacterium avium subsp. paratuberculosis
ccgcccaucggcagcccggagg

SEQ ID NO: 2822729 - RNA, 15 nt, Mycobacterium avium subsp. paratuberculosis
ccgcccaugcccaug

SEQ ID NO: 2822730 - RNA, 12 nt, Mycobacterium avium subsp. paratuberculosis
ccgccccagccc

SEQ ID NO: 2822731 - RNA, 14 nt, Mycobacterium avium subsp. paratuberculosis
ccgccccagcccgg

SEQ ID NO: 2822732 - RNA, 16 nt, Mycobacterium avium subsp. paratuberculosis
ccgccccagcccggcu

SEQ ID NO: 2822733 - RNA, 17 nt, Mycobacterium avium subsp. paratuberculosis
ccgccccagcccggcug

SEQ ID NO: 2822734 - RNA, 16 nt, Mycobacterium avium subsp. paratuberculosis
ccgccccagccgacca

SEQ ID NO: 2822735 - RNA, 17 nt, Mycobacterium avium subsp. paratuberculosis
ccgccccagccgaccag

SEQ ID NO: 2822736 - RNA, 14 nt, Mycobacterium avium subsp. paratuberculosis
ccgcccccgauagc

SEQ ID NO: 2822737 - RNA, 15 nt, Mycobacterium avium subsp. paratuberculosis
ccgcccccgcggcgg

SEQ ID NO: 2822738 - RNA, 17 nt, Mycobacterium avium subsp. paratuberculosis
ccgcccccgcggcggcc

SEQ ID NO: 2822739 - RNA, 19 nt, Mycobacterium avium subsp. paratuberculosis
ccgcccccgcggcggccau

SEQ ID NO: 2822740 - RNA, 15 nt, Mycobacterium avium subsp. paratuberculosis
ccgcccccgcggcgu

SEQ ID NO: 2822741 - RNA, 20 nt, Mycobacterium avium subsp. paratuberculosis
ccgccccgaacagcgccagg

SEQ ID NO: 2822742 - RNA, 14 nt, Mycobacterium avium subsp. paratuberculosis
ccgcccggcggcgc

SEQ ID NO: 2822743 - RNA, 12 nt, Mycobacterium avium subsp. paratuberculosis
ccgcccgggaag

SEQ ID NO: 2822744 - RNA, 13 nt, Mycobacterium avium subsp. paratuberculosis
ccgcccgggcacg

SEQ ID NO: 2822745 - RNA, 17 nt, Mycobacterium avium subsp. paratuberculosis
ccgcccgggccaggcgc

SEQ ID NO: 2822746 - RNA, 18 nt, Mycobacterium avium subsp. paratuberculosis
ccgcccgggccaggcgcg

SEQ ID NO: 2822747 - RNA, 14 nt, Mycobacterium avium subsp. paratuberculosis
ccgcccgggcccgg

SEQ ID NO: 2822748 - RNA, 15 nt, Mycobacterium avium subsp. paratuberculosis
ccgcccgggcccggg

SEQ ID NO: 2822749 - RNA, 16 nt, Mycobacterium avium subsp. paratuberculosis
ccgcccgggcccgggg

SEQ ID NO: 2822750 - RNA, 18 nt, Mycobacterium avium subsp. paratuberculosis
ccgcccgggcccggggug

SEQ ID NO: 2822751 - RNA, 19 nt, Mycobacterium avium subsp. paratuberculosis
ccgcccgggcccggggugg

SEQ ID NO: 2822752 - RNA, 12 nt, Mycobacterium avium subsp. paratuberculosis
ccgcccgggccg

SEQ ID NO: 2822753 - RNA, 17 nt, Mycobacterium avium subsp. paratuberculosis
ccgcccgggccgcgccc

SEQ ID NO: 2822754 - RNA, 20 nt, Mycobacterium avium subsp. paratuberculosis
ccgcccgggccgcgcccagu

SEQ ID NO: 2822755 - RNA, 13 nt, Mycobacterium avium subsp. paratuberculosis
ccgcccgggcggc

SEQ ID NO: 2822756 - RNA, 14 nt, Mycobacterium avium subsp. paratuberculosis
ccgcccgggcggcc

SEQ ID NO: 2822757 - RNA, 16 nt, Mycobacterium avium subsp. paratuberculosis
ccgcccgggcggcccg

SEQ ID NO: 2822758 - RNA, 18 nt, Mycobacterium avium subsp. paratuberculosis
ccgcccgggcggcccgca

SEQ ID NO: 2822759 - RNA, 20 nt, Mycobacterium avium subsp. paratuberculosis
ccgcccgggcggcccgcauc

SEQ ID NO: 2822760 - RNA, 18 nt, Mycobacterium avium subsp. paratuberculosis
ccgcccgggcggcccggg

SEQ ID NO: 2822761 - RNA, 19 nt, Mycobacterium avium subsp. paratuberculosis
ccgcccgggcggcccgggu

SEQ ID NO: 2822762 - RNA, 13 nt, Mycobacterium avium subsp. paratuberculosis
ccgcccggggcgc

SEQ ID NO: 2822763 - RNA, 14 nt, Mycobacterium avium subsp. paratuberculosis
ccgcccggggcggc

SEQ ID NO: 2822764 - RNA, 17 nt, Mycobacterium avium subsp. paratuberculosis
ccgcccggggcggcgau

SEQ ID NO: 2822765 - RNA, 13 nt, Mycobacterium avium subsp. paratuberculosis
ccgcccgggucgu

SEQ ID NO: 2822766 - RNA, 12 nt, Mycobacterium avium subsp. paratuberculosis
ccgcccggguga

SEQ ID NO: 2822767 - RNA, 20 nt, Mycobacterium avium subsp. paratuberculosis
ccgcccgggugauggucucc

SEQ ID NO: 2822768 - RNA, 12 nt, Mycobacterium avium subsp. paratuberculosis
ccgcccgggugc

SEQ ID NO: 2822769 - RNA, 14 nt, Mycobacterium avium subsp. paratuberculosis
ccgcccgggugugg

SEQ ID NO: 2822770 - RNA, 20 nt, Mycobacterium avium subsp. paratuberculosis
ccgcccgggugugggcgccg

SEQ ID NO: 2822771 - RNA, 21 nt, Mycobacterium avium subsp. paratuberculosis
ccgcccgggugugggcgccgu

SEQ ID NO: 2822772 - RNA, 16 nt, Mycobacterium avium subsp. paratuberculosis
ccgcccgucagccccu

SEQ ID NO: 2822773 - RNA, 15 nt, Mycobacterium avium subsp. paratuberculosis
ccgcccguccagcgc

SEQ ID NO: 2822774 - RNA, 14 nt, Mycobacterium avium subsp. paratuberculosis
ccgcccguccgggc

SEQ ID NO: 2822775 - RNA, 16 nt, Mycobacterium avium subsp. paratuberculosis
ccgcccguccgggccg

SEQ ID NO: 2822776 - RNA, 17 nt, Mycobacterium avium subsp. paratuberculosis
ccgcccguccgggccgg

SEQ ID NO: 2822777 - RNA, 19 nt, Mycobacterium avium subsp. paratuberculosis
ccgcccguccgggccggcc

SEQ ID NO: 2822778 - RNA, 14 nt, Mycobacterium avium subsp. paratuberculosis
ccgcccgucgccuc

SEQ ID NO: 2822779 - RNA, 15 nt, Mycobacterium avium subsp. paratuberculosis
ccgcccgucgccucc

SEQ ID NO: 2822780 - RNA, 21 nt, Mycobacterium avium subsp. paratuberculosis
ccgcccgucgccuccugcugg

SEQ ID NO: 2822781 - RNA, 13 nt, Mycobacterium avium subsp. paratuberculosis
ccgcccgucgggg

SEQ ID NO: 2822782 - RNA, 18 nt, Mycobacterium avium subsp. paratuberculosis
ccgcccgucggggcccgg

SEQ ID NO: 2822783 - RNA, 23 nt, Mycobacterium avium subsp. paratuberculosis
ccgcccguuggcuuuucgggccg

SEQ ID NO: 2822784 - RNA, 12 nt, Mycobacterium avium subsp. paratuberculosis
ccgcccucaggc

SEQ ID NO: 2822785 - RNA, 14 nt, Mycobacterium avium subsp. paratuberculosis
ccgcccucgccccg

SEQ ID NO: 2822786 - RNA, 18 nt, Mycobacterium avium subsp. paratuberculosis
ccgcccucgcccucgcug

SEQ ID NO: 2822787 - RNA, 15 nt, Mycobacterium avium subsp. paratuberculosis
ccgcccucgccgaac

SEQ ID NO: 2822788 - RNA, 19 nt, Mycobacterium avium subsp. paratuberculosis
ccgcccucgcugccgcccc

SEQ ID NO: 2822789 - RNA, 13 nt, Mycobacterium avium subsp. paratuberculosis
ccgcccucggccg

SEQ ID NO: 2822790 - RNA, 14 nt, Mycobacterium avium subsp. paratuberculosis
ccgcccucggccgu

SEQ ID NO: 2822791 - RNA, 21 nt, Mycobacterium avium subsp. paratuberculosis
ccgcccucggccguaccggcg

SEQ ID NO: 2822792 - RNA, 22 nt, Mycobacterium avium subsp. paratuberculosis
ccgcccucggccguaccggcgu

SEQ ID NO: 2822793 - RNA, 15 nt, Mycobacterium avium subsp. paratuberculosis
ccgcccucggugacg

SEQ ID NO: 2822794 - RNA, 15 nt, Mycobacterium avium subsp. paratuberculosis
ccgcccucucacggc

SEQ ID NO: 2822795 - RNA, 14 nt, Mycobacterium avium subsp. paratuberculosis
ccgcccugcccguc

SEQ ID NO: 2822796 - RNA, 16 nt, Mycobacterium avium subsp. paratuberculosis
ccgcccugcccgucgg

SEQ ID NO: 2822797 - RNA, 23 nt, Mycobacterium avium subsp. paratuberculosis
ccgcccugcccgucgggcgcggc

SEQ ID NO: 2822798 - RNA, 12 nt, Mycobacterium avium subsp. paratuberculosis
ccgcccuggccc

SEQ ID NO: 2822799 - RNA, 22 nt, Mycobacterium avium subsp. paratuberculosis
ccgcccuggcuguagcggucgu

SEQ ID NO: 2822800 - RNA, 24 nt, Mycobacterium avium subsp. paratuberculosis
ccgcccuggcuguagcggucgugc

SEQ ID NO: 2822801 - RNA, 23 nt, Mycobacterium avium subsp. paratuberculosis
ccgcccuuccagcaccccgucga

SEQ ID NO: 2822802 - RNA, 18 nt, Mycobacterium avium subsp. paratuberculosis
ccgcccuugaacggcacc

SEQ ID NO: 2822803 - RNA, 19 nt, Mycobacterium avium subsp. paratuberculosis
ccgcccuugcucgcggcgu

SEQ ID NO: 2822804 - RNA, 15 nt, Mycobacterium avium subsp. paratuberculosis
ccgcccuuggccgcg

SEQ ID NO: 2822805 - RNA, 14 nt, Mycobacterium avium subsp. paratuberculosis
ccgccgaaacaccg

SEQ ID NO: 2822806 - RNA, 19 nt, Mycobacterium avium subsp. paratuberculosis
ccgccgaaacccgcuguca

SEQ ID NO: 2822807 - RNA, 18 nt, Mycobacterium avium subsp. paratuberculosis
ccgccgaaagccuccgcg

SEQ ID NO: 2822808 - RNA, 15 nt, Mycobacterium avium subsp. paratuberculosis
ccgccgaacaccggc

SEQ ID NO: 2822809 - RNA, 16 nt, Mycobacterium avium subsp. paratuberculosis
ccgccgaacaccggca

SEQ ID NO: 2822810 - RNA, 18 nt, Mycobacterium avium subsp. paratuberculosis
ccgccgaacaccggcagc

SEQ ID NO: 2822811 - RNA, 20 nt, Mycobacterium avium subsp. paratuberculosis
ccgccgaacaccggcagcgc

SEQ ID NO: 2822812 - RNA, 16 nt, Mycobacterium avium subsp. paratuberculosis
ccgccgaacagccggg

SEQ ID NO: 2822813 - RNA, 16 nt, Mycobacterium avium subsp. paratuberculosis
ccgccgaaccagaucg

SEQ ID NO: 2822814 - RNA, 20 nt, Mycobacterium avium subsp. paratuberculosis
ccgccgaaccagaucggcgg

SEQ ID NO: 2822815 - RNA, 22 nt, Mycobacterium avium subsp. paratuberculosis
ccgccgaaccagaucggcgggu

SEQ ID NO: 2822816 - RNA, 15 nt, Mycobacterium avium subsp. paratuberculosis
ccgccgaacccgccc

SEQ ID NO: 2822817 - RNA, 19 nt, Mycobacterium avium subsp. paratuberculosis
ccgccgaacccgcccucgc

SEQ ID NO: 2822818 - RNA, 15 nt, Mycobacterium avium subsp. paratuberculosis
ccgccgaaccgauca

SEQ ID NO: 2822819 - RNA, 15 nt, Mycobacterium avium subsp. paratuberculosis
ccgccgaacgccucc

SEQ ID NO: 2822820 - RNA, 20 nt, Mycobacterium avium subsp. paratuberculosis
ccgccgaacgccuccgccgc

SEQ ID NO: 2822821 - RNA, 14 nt, Mycobacterium avium subsp. paratuberculosis
ccgccgaagcccga

SEQ ID NO: 2822822 - RNA, 22 nt, Mycobacterium avium subsp. paratuberculosis
ccgccgaagcccgagcgucacg

SEQ ID NO: 2822823 - RNA, 17 nt, Mycobacterium avium subsp. paratuberculosis
ccgccgaagccggcucg

SEQ ID NO: 2822824 - RNA, 17 nt, Mycobacterium avium subsp. paratuberculosis
ccgccgaagcggcgcac

SEQ ID NO: 2822825 - RNA, 20 nt, Mycobacterium avium subsp. paratuberculosis
ccgccgaagcggcgcacgca

SEQ ID NO: 2822826 - RNA, 13 nt, Mycobacterium avium subsp. paratuberculosis
ccgccgacaccac

SEQ ID NO: 2822827 - RNA, 13 nt, Mycobacterium avium subsp. paratuberculosis
ccgccgcagcggc

SEQ ID NO: 2822828 - RNA, 15 nt, Mycobacterium avium subsp. paratuberculosis
ccgccgcagcggcgc

SEQ ID NO: 2822829 - RNA, 16 nt, Mycobacterium avium subsp. paratuberculosis
ccgccgcagcggcgcc

SEQ ID NO: 2822830 - RNA, 17 nt, Mycobacterium avium subsp. paratuberculosis
ccgccgcagcggcgccg

SEQ ID NO: 2822831 - RNA, 19 nt, Mycobacterium avium subsp. paratuberculosis
ccgccgcagcggcgccgca

SEQ ID NO: 2822832 - RNA, 13 nt, Mycobacterium avium subsp. paratuberculosis
ccgccgcaggcga

SEQ ID NO: 2822833 - RNA, 18 nt, Mycobacterium avium subsp. paratuberculosis
ccgccgcauaccgcccgc

SEQ ID NO: 2822834 - RNA, 23 nt, Mycobacterium avium subsp. paratuberculosis
ccgccgcauaccgcccgcgcugg

SEQ ID NO: 2822835 - RNA, 23 nt, Mycobacterium avium subsp. paratuberculosis
ccgccgcauuccucggccagcuc

SEQ ID NO: 2822836 - RNA, 14 nt, Mycobacterium avium subsp. paratuberculosis
ccgccgccaccacg

SEQ ID NO: 2822837 - RNA, 15 nt, Mycobacterium avium subsp. paratuberculosis
ccgccgccaccacgg

SEQ ID NO: 2822838 - RNA, 12 nt, Mycobacterium avium subsp. paratuberculosis
ccgccgccaccg

SEQ ID NO: 2822839 - RNA, 14 nt, Mycobacterium avium subsp. paratuberculosis
ccgccgccaccguc

SEQ ID NO: 2822840 - RNA, 19 nt, Mycobacterium avium subsp. paratuberculosis
ccgccgccaccgucgccgg

SEQ ID NO: 2822841 - RNA, 22 nt, Mycobacterium avium subsp. paratuberculosis
ccgccgccaccgucgccggcug

SEQ ID NO: 2822842 - RNA, 15 nt, Mycobacterium avium subsp. paratuberculosis
ccgccgccagcacca

SEQ ID NO: 2822843 - RNA, 16 nt, Mycobacterium avium subsp. paratuberculosis
ccgccgccagcaccac

SEQ ID NO: 2822844 - RNA, 20 nt, Mycobacterium avium subsp. paratuberculosis
ccgccgccagcagcagcgcc

SEQ ID NO: 2822845 - RNA, 22 nt, Mycobacterium avium subsp. paratuberculosis
ccgccgccagcagcagcgccgc

SEQ ID NO: 2822846 - RNA, 22 nt, Mycobacterium avium subsp. paratuberculosis
ccgccgccagccagccggugcg

SEQ ID NO: 2822847 - RNA, 13 nt, Mycobacterium avium subsp. paratuberculosis
ccgccgccagcgc

SEQ ID NO: 2822848 - RNA, 14 nt, Mycobacterium avium subsp. paratuberculosis
ccgccgccagcgcc

SEQ ID NO: 2822849 - RNA, 16 nt, Mycobacterium avium subsp. paratuberculosis
ccgccgccagcgccac

SEQ ID NO: 2822850 - RNA, 21 nt, Mycobacterium avium subsp. paratuberculosis
ccgccgccagcgcggggucgg

SEQ ID NO: 2822851 - RNA, 22 nt, Mycobacterium avium subsp. paratuberculosis
ccgccgccagcgcggggucggc

SEQ ID NO: 2822852 - RNA, 16 nt, Mycobacterium avium subsp. paratuberculosis
ccgccgccauccgcgc

SEQ ID NO: 2822853 - RNA, 18 nt, Mycobacterium avium subsp. paratuberculosis
ccgccgccaucuccuccg

SEQ ID NO: 2822854 - RNA, 23 nt, Mycobacterium avium subsp. paratuberculosis
ccgccgccaucuccuccgggcug

SEQ ID NO: 2822855 - RNA, 14 nt, Mycobacterium avium subsp. paratuberculosis
ccgccgcccacgcc

SEQ ID NO: 2822856 - RNA, 15 nt, Mycobacterium avium subsp. paratuberculosis
ccgccgccccgucgg

SEQ ID NO: 2822857 - RNA, 19 nt, Mycobacterium avium subsp. paratuberculosis
ccgccgccccgucggucgg

SEQ ID NO: 2822858 - RNA, 16 nt, Mycobacterium avium subsp. paratuberculosis
ccgccgcccgcccgag

SEQ ID NO: 2822859 - RNA, 13 nt, Mycobacterium avium subsp. paratuberculosis
ccgccgcccgcgc

SEQ ID NO: 2822860 - RNA, 16 nt, Mycobacterium avium subsp. paratuberculosis
ccgccgcccgcgcggc

SEQ ID NO: 2822861 - RNA, 15 nt, Mycobacterium avium subsp. paratuberculosis
ccgccgcccgucagc

SEQ ID NO: 2822862 - RNA, 13 nt, Mycobacterium avium subsp. paratuberculosis
ccgccgccgacuc

SEQ ID NO: 2822863 - RNA, 14 nt, Mycobacterium avium subsp. paratuberculosis
ccgccgccgagcuc

SEQ ID NO: 2822864 - RNA, 16 nt, Mycobacterium avium subsp. paratuberculosis
ccgccgccgagcucgg

SEQ ID NO: 2822865 - RNA, 12 nt, Mycobacterium avium subsp. paratuberculosis
ccgccgccgccc

SEQ ID NO: 2822866 - RNA, 14 nt, Mycobacterium avium subsp. paratuberculosis
ccgccgccgcgacc

SEQ ID NO: 2822867 - RNA, 12 nt, Mycobacterium avium subsp. paratuberculosis
ccgccgccgcgg

SEQ ID NO: 2822868 - RNA, 14 nt, Mycobacterium avium subsp. paratuberculosis
ccgccgccgcgggu

SEQ ID NO: 2822869 - RNA, 13 nt, Mycobacterium avium subsp. paratuberculosis
ccgccgccggcgc

SEQ ID NO: 2822870 - RNA, 14 nt, Mycobacterium avium subsp. paratuberculosis
ccgccgccggcgcu

SEQ ID NO: 2822871 - RNA, 15 nt, Mycobacterium avium subsp. paratuberculosis
ccgccgccggcgcug

SEQ ID NO: 2822872 - RNA, 14 nt, Mycobacterium avium subsp. paratuberculosis
ccgccgccggcggu

SEQ ID NO: 2822873 - RNA, 13 nt, Mycobacterium avium subsp. paratuberculosis
ccgccgccggcgu

SEQ ID NO: 2822874 - RNA, 14 nt, Mycobacterium avium subsp. paratuberculosis
ccgccgccggcguc

SEQ ID NO: 2822875 - RNA, 12 nt, Mycobacterium avium subsp. paratuberculosis
ccgccgccggga

SEQ ID NO: 2822876 - RNA, 12 nt, Mycobacterium avium subsp. paratuberculosis
ccgccgccgggc

SEQ ID NO: 2822877 - RNA, 12 nt, Mycobacterium avium subsp. paratuberculosis
ccgccgccgucg

SEQ ID NO: 2822878 - RNA, 13 nt, Mycobacterium avium subsp. paratuberculosis
ccgccgccgucgg

SEQ ID NO: 2822879 - RNA, 15 nt, Mycobacterium avium subsp. paratuberculosis
ccgccgccgugcauc

SEQ ID NO: 2822880 - RNA, 23 nt, Mycobacterium avium subsp. paratuberculosis
ccgccgccgugcauccagccguc

SEQ ID NO: 2822881 - RNA, 18 nt, Mycobacterium avium subsp. paratuberculosis
ccgccgccugagcccgcc

SEQ ID NO: 2822882 - RNA, 18 nt, Mycobacterium avium subsp. paratuberculosis
ccgccgcgaacgggucgg

SEQ ID NO: 2822883 - RNA, 17 nt, Mycobacterium avium subsp. paratuberculosis
ccgccgcgaacucaggc

SEQ ID NO: 2822884 - RNA, 20 nt, Mycobacterium avium subsp. paratuberculosis
ccgccgcgaacucaggcgcg

SEQ ID NO: 2822885 - RNA, 15 nt, Mycobacterium avium subsp. paratuberculosis
ccgccgcgaccacag

SEQ ID NO: 2822886 - RNA, 16 nt, Mycobacterium avium subsp. paratuberculosis
ccgccgcgaccacagc

SEQ ID NO: 2822887 - RNA, 17 nt, Mycobacterium avium subsp. paratuberculosis
ccgccgcgaccacagcg

SEQ ID NO: 2822888 - RNA, 14 nt, Mycobacterium avium subsp. paratuberculosis
ccgccgcgaccgcg

SEQ ID NO: 2822889 - RNA, 19 nt, Mycobacterium avium subsp. paratuberculosis
ccgccgcgaccgucagcag

SEQ ID NO: 2822890 - RNA, 22 nt, Mycobacterium avium subsp. paratuberculosis
ccgccgcgacgaugccggcguc

SEQ ID NO: 2822891 - RNA, 14 nt, Mycobacterium avium subsp. paratuberculosis
ccgccgcgacggcc

SEQ ID NO: 2822892 - RNA, 17 nt, Mycobacterium avium subsp. paratuberculosis
ccgccgcgacggccgcc

SEQ ID NO: 2822893 - RNA, 18 nt, Mycobacterium avium subsp. paratuberculosis
ccgccgcgacggccgccg

SEQ ID NO: 2822894 - RNA, 14 nt, Mycobacterium avium subsp. paratuberculosis
ccgccgcgacgggu

SEQ ID NO: 2822895 - RNA, 14 nt, Mycobacterium avium subsp. paratuberculosis
ccgccgcgagcaga

SEQ ID NO: 2822896 - RNA, 14 nt, Mycobacterium avium subsp. paratuberculosis
ccgccgcgagccgc

SEQ ID NO: 2822897 - RNA, 15 nt, Mycobacterium avium subsp. paratuberculosis
ccgccgcgagccgcc

SEQ ID NO: 2822898 - RNA, 18 nt, Mycobacterium avium subsp. paratuberculosis
ccgccgcgagccgcccag

SEQ ID NO: 2822899 - RNA, 19 nt, Mycobacterium avium subsp. paratuberculosis
ccgccgcgagccgcccagg

SEQ ID NO: 2822900 - RNA, 13 nt, Mycobacterium avium subsp. paratuberculosis
ccgccgcgauacg

SEQ ID NO: 2822901 - RNA, 19 nt, Mycobacterium avium subsp. paratuberculosis
ccgccgcgaucagggccca

SEQ ID NO: 2822902 - RNA, 21 nt, Mycobacterium avium subsp. paratuberculosis
ccgccgcgaucuugccgccgc

SEQ ID NO: 2822903 - RNA, 13 nt, Mycobacterium avium subsp. paratuberculosis
ccgccgcgcaccg

SEQ ID NO: 2822904 - RNA, 15 nt, Mycobacterium avium subsp. paratuberculosis
ccgccgcgcaggccg

SEQ ID NO: 2822905 - RNA, 18 nt, Mycobacterium avium subsp. paratuberculosis
ccgccgcgcaggccgccg

SEQ ID NO: 2822906 - RNA, 19 nt, Mycobacterium avium subsp. paratuberculosis
ccgccgcgcaggccgccga

SEQ ID NO: 2822907 - RNA, 14 nt, Mycobacterium avium subsp. paratuberculosis
ccgccgcgcauccg

SEQ ID NO: 2822908 - RNA, 15 nt, Mycobacterium avium subsp. paratuberculosis
ccgccgcgcccggcu

SEQ ID NO: 2822909 - RNA, 18 nt, Mycobacterium avium subsp. paratuberculosis
ccgccgcgcccggcuucg

SEQ ID NO: 2822910 - RNA, 17 nt, Mycobacterium avium subsp. paratuberculosis
ccgccgcgcccgucgag

SEQ ID NO: 2822911 - RNA, 13 nt, Mycobacterium avium subsp. paratuberculosis
ccgccgcgccggg

SEQ ID NO: 2822912 - RNA, 17 nt, Mycobacterium avium subsp. paratuberculosis
ccgccgcgccgggcgcc

SEQ ID NO: 2822913 - RNA, 22 nt, Mycobacterium avium subsp. paratuberculosis
ccgccggagccgaucgccuccg

SEQ ID NO: 2822914 - RNA, 22 nt, Mycobacterium avium subsp. paratuberculosis
ccgccggaucggcagcgcguug

SEQ ID NO: 2822915 - RNA, 23 nt, Mycobacterium avium subsp. paratuberculosis
ccgccggaucggcagcgcguuga

SEQ ID NO: 2822916 - RNA, 20 nt, Mycobacterium avium subsp. paratuberculosis
ccgccggaucgugucccggc

SEQ ID NO: 2822917 - RNA, 23 nt, Mycobacterium avium subsp. paratuberculosis
ccgccggaucgugucccggcgcc

SEQ ID NO: 2822918 - RNA, 19 nt, Mycobacterium avium subsp. paratuberculosis
ccgccggauuacucgccgg

SEQ ID NO: 2822919 - RNA, 14 nt, Mycobacterium avium subsp. paratuberculosis
ccgccggcagcggc

SEQ ID NO: 2822920 - RNA, 17 nt, Mycobacterium avium subsp. paratuberculosis
ccgccggcagcggcugc

SEQ ID NO: 2822921 - RNA, 19 nt, Mycobacterium avium subsp. paratuberculosis
ccgccggcagcggcugcug

SEQ ID NO: 2822922 - RNA, 20 nt, Mycobacterium avium subsp. paratuberculosis
ccgccggcagcggcugcugc

SEQ ID NO: 2822923 - RNA, 14 nt, Mycobacterium avium subsp. paratuberculosis
ccgccggcaguccg

SEQ ID NO: 2822924 - RNA, 13 nt, Mycobacterium avium subsp. paratuberculosis
ccgccggccagcu

SEQ ID NO: 2822925 - RNA, 15 nt, Mycobacterium avium subsp. paratuberculosis
ccgccggccagcucc

SEQ ID NO: 2822926 - RNA, 15 nt, Mycobacterium avium subsp. paratuberculosis
ccgccggccaggcga

SEQ ID NO: 2822927 - RNA, 17 nt, Mycobacterium avium subsp. paratuberculosis
ccgccggccaggcgacu

SEQ ID NO: 2822928 - RNA, 16 nt, Mycobacterium avium subsp. paratuberculosis
ccgccggcccagcucc

SEQ ID NO: 2822929 - RNA, 18 nt, Mycobacterium avium subsp. paratuberculosis
ccgccggcccagcuccac

SEQ ID NO: 2822930 - RNA, 15 nt, Mycobacterium avium subsp. paratuberculosis
ccgccggcccaggca

SEQ ID NO: 2822931 - RNA, 16 nt, Mycobacterium avium subsp. paratuberculosis
ccgccggcccaggcag

SEQ ID NO: 2822932 - RNA, 15 nt, Mycobacterium avium subsp. paratuberculosis
ccgccggcccggcgu

SEQ ID NO: 2822933 - RNA, 19 nt, Mycobacterium avium subsp. paratuberculosis
ccgccggcccggcguuacc

SEQ ID NO: 2822934 - RNA, 14 nt, Mycobacterium avium subsp. paratuberculosis
ccgccggcccgguc

SEQ ID NO: 2822935 - RNA, 15 nt, Mycobacterium avium subsp. paratuberculosis
ccgccggccgcgcgu

SEQ ID NO: 2822936 - RNA, 20 nt, Mycobacterium avium subsp. paratuberculosis
ccgccggccgcgcgugcgca

SEQ ID NO: 2822937 - RNA, 13 nt, Mycobacterium avium subsp. paratuberculosis
ccgccggccgcgg

SEQ ID NO: 2822938 - RNA, 16 nt, Mycobacterium avium subsp. paratuberculosis
ccgccggccgcggcgu

SEQ ID NO: 2822939 - RNA, 19 nt, Mycobacterium avium subsp. paratuberculosis
ccgccggccgcggcgugca

SEQ ID NO: 2822940 - RNA, 12 nt, Mycobacterium avium subsp. paratuberculosis
ccgccggccgcu

SEQ ID NO: 2822941 - RNA, 13 nt, Mycobacterium avium subsp. paratuberculosis
ccgccggccgcuc

SEQ ID NO: 2822942 - RNA, 14 nt, Mycobacterium avium subsp. paratuberculosis
ccgccggccgcucg

SEQ ID NO: 2822943 - RNA, 23 nt, Mycobacterium avium subsp. paratuberculosis
ccgccggccgguccucugcgacc

SEQ ID NO: 2822944 - RNA, 12 nt, Mycobacterium avium subsp. paratuberculosis
ccgccggccucg

SEQ ID NO: 2822945 - RNA, 20 nt, Mycobacterium avium subsp. paratuberculosis
ccgccggcgaacgacgucga

SEQ ID NO: 2822946 - RNA, 21 nt, Mycobacterium avium subsp. paratuberculosis
ccgccggcgaagcucgacgau

SEQ ID NO: 2822947 - RNA, 23 nt, Mycobacterium avium subsp. paratuberculosis
ccgccggcgaagcucgacgauga

SEQ ID NO: 2822948 - RNA, 17 nt, Mycobacterium avium subsp. paratuberculosis
ccgccggcgaucgacgu

SEQ ID NO: 2822949 - RNA, 14 nt, Mycobacterium avium subsp. paratuberculosis
ccgccggcgcaguc

SEQ ID NO: 2822950 - RNA, 23 nt, Mycobacterium avium subsp. paratuberculosis
ccgccggcgcaucaucucggcga

SEQ ID NO: 2822951 - RNA, 12 nt, Mycobacterium avium subsp. paratuberculosis
ccgccggcgcgg

SEQ ID NO: 2822952 - RNA, 15 nt, Mycobacterium avium subsp. paratuberculosis
ccgccggcgcggacg

SEQ ID NO: 2822953 - RNA, 18 nt, Mycobacterium avium subsp. paratuberculosis
ccgccggcgcuggcgcgc

SEQ ID NO: 2822954 - RNA, 20 nt, Mycobacterium avium subsp. paratuberculosis
ccgccggcgcuggcgcgccg

SEQ ID NO: 2822955 - RNA, 14 nt, Mycobacterium avium subsp. paratuberculosis
ccgccggcggccac

SEQ ID NO: 2822956 - RNA, 15 nt, Mycobacterium avium subsp. paratuberculosis
ccgccggcggccacg

SEQ ID NO: 2822957 - RNA, 14 nt, Mycobacterium avium subsp. paratuberculosis
ccgccggcggccuc

SEQ ID NO: 2822958 - RNA, 22 nt, Mycobacterium avium subsp. paratuberculosis
ccgccggcggccuccgccaccu

SEQ ID NO: 2822959 - RNA, 20 nt, Mycobacterium avium subsp. paratuberculosis
ccgccggcggguuggccguc

SEQ ID NO: 2822960 - RNA, 22 nt, Mycobacterium avium subsp. paratuberculosis
ccgccggcggguuggccgucga

SEQ ID NO: 2822961 - RNA, 11 nt, Mycobacterium avium subsp. paratuberculosis
ccgccggcggu

SEQ ID NO: 2822962 - RNA, 19 nt, Mycobacterium avium subsp. paratuberculosis
ccgccggcggugcgggugg

SEQ ID NO: 2822963 - RNA, 21 nt, Mycobacterium avium subsp. paratuberculosis
ccgccggcggugcggguggug

SEQ ID NO: 2822964 - RNA, 23 nt, Mycobacterium avium subsp. paratuberculosis
ccgccggcgucagagguuggcga

SEQ ID NO: 2822965 - RNA, 13 nt, Mycobacterium avium subsp. paratuberculosis
ccgccggcgucga

SEQ ID NO: 2822966 - RNA, 14 nt, Mycobacterium avium subsp. paratuberculosis
ccgccggcgucgac

SEQ ID NO: 2822967 - RNA, 16 nt, Mycobacterium avium subsp. paratuberculosis
ccgccggcgucgacgu

SEQ ID NO: 2822968 - RNA, 21 nt, Mycobacterium avium subsp. paratuberculosis
ccgccggcgucgacgucggga

SEQ ID NO: 2822969 - RNA, 18 nt, Mycobacterium avium subsp. paratuberculosis
ccgccggcgucgccgcuc

SEQ ID NO: 2822970 - RNA, 16 nt, Mycobacterium avium subsp. paratuberculosis
ccgccggcuggcgggc

SEQ ID NO: 2822971 - RNA, 14 nt, Mycobacterium avium subsp. paratuberculosis
ccgccgggacgggc

SEQ ID NO: 2822972 - RNA, 19 nt, Mycobacterium avium subsp. paratuberculosis
ccgccgggauaacccagca

SEQ ID NO: 2822973 - RNA, 19 nt, Mycobacterium avium subsp. paratuberculosis
ccgccgggaucggcggggc

SEQ ID NO: 2822974 - RNA, 21 nt, Mycobacterium avium subsp. paratuberculosis
ccgccgggaucggcggggcgc

SEQ ID NO: 2822975 - RNA, 14 nt, Mycobacterium avium subsp. paratuberculosis
ccgccgggaugcgc

SEQ ID NO: 2822976 - RNA, 19 nt, Mycobacterium avium subsp. paratuberculosis
ccgccgggaugcgccaccg

SEQ ID NO: 2822977 - RNA, 14 nt, Mycobacterium avium subsp. paratuberculosis
ccgccgggcacccg

SEQ ID NO: 2822978 - RNA, 15 nt, Mycobacterium avium subsp. paratuberculosis
ccgccgggcacccgg

SEQ ID NO: 2822979 - RNA, 17 nt, Mycobacterium avium subsp. paratuberculosis
ccgccgggcacccgggu

SEQ ID NO: 2822980 - RNA, 16 nt, Mycobacterium avium subsp. paratuberculosis
ccgccgggcaccucgg

SEQ ID NO: 2822981 - RNA, 11 nt, Mycobacterium avium subsp. paratuberculosis
ccgccgggcau

SEQ ID NO: 2822982 - RNA, 19 nt, Mycobacterium avium subsp. paratuberculosis
ccgccgggcauccgggccg

SEQ ID NO: 2822983 - RNA, 20 nt, Mycobacterium avium subsp. paratuberculosis
ccgccgggcauccgggccgc

SEQ ID NO: 2822984 - RNA, 21 nt, Mycobacterium avium subsp. paratuberculosis
ccgccgggcauccgggccgcc

SEQ ID NO: 2822985 - RNA, 23 nt, Mycobacterium avium subsp. paratuberculosis
ccgccgggcauccgggccgccgc

SEQ ID NO: 2822986 - RNA, 15 nt, Mycobacterium avium subsp. paratuberculosis
ccgccgggccacgcc

SEQ ID NO: 2822987 - RNA, 22 nt, Mycobacterium avium subsp. paratuberculosis
ccgccgggccacgccgacuagc

SEQ ID NO: 2822988 - RNA, 13 nt, Mycobacterium avium subsp. paratuberculosis
ccgccgggccgga

SEQ ID NO: 2822989 - RNA, 15 nt, Mycobacterium avium subsp. paratuberculosis
ccgccgggccggcgg

SEQ ID NO: 2822990 - RNA, 17 nt, Mycobacterium avium subsp. paratuberculosis
ccgccgggccggcggcc

SEQ ID NO: 2822991 - RNA, 19 nt, Mycobacterium avium subsp. paratuberculosis
ccgccgggccggcggccag

SEQ ID NO: 2822992 - RNA, 12 nt, Mycobacterium avium subsp. paratuberculosis
ccgccgggccug

SEQ ID NO: 2822993 - RNA, 14 nt, Mycobacterium avium subsp. paratuberculosis
ccgccgggcgccac

SEQ ID NO: 2822994 - RNA, 15 nt, Mycobacterium avium subsp. paratuberculosis
ccgccgggcgccacc

SEQ ID NO: 2822995 - RNA, 18 nt, Mycobacterium avium subsp. paratuberculosis
ccgccgggcgccacccgc

SEQ ID NO: 2822996 - RNA, 13 nt, Mycobacterium avium subsp. paratuberculosis
ccgccgggcgcga

SEQ ID NO: 2822997 - RNA, 12 nt, Mycobacterium avium subsp. paratuberculosis
ccgccgggcggc

SEQ ID NO: 2822998 - RNA, 20 nt, Mycobacterium avium subsp. paratuberculosis
ccgccgucguagccgcgggu

SEQ ID NO: 2822999 - RNA, 18 nt, Mycobacterium avium subsp. paratuberculosis
ccgccgugaccggcgauc

SEQ ID NO: 2823000 - RNA, 16 nt, Mycobacterium avium subsp. paratuberculosis
ccgccgugcgcggcga

SEQ ID NO: 2823001 - RNA, 18 nt, Mycobacterium avium subsp. paratuberculosis
ccgccgugcgcggcgacc

SEQ ID NO: 2823002 - RNA, 19 nt, Mycobacterium avium subsp. paratuberculosis
ccgccgugcgcggcgacca

SEQ ID NO: 2823003 - RNA, 21 nt, Mycobacterium avium subsp. paratuberculosis
ccgccgugcgcggcgaccacc

SEQ ID NO: 2823004 - RNA, 23 nt, Mycobacterium avium subsp. paratuberculosis
ccgccgugcgcggcgaccaccuc

SEQ ID NO: 2823005 - RNA, 23 nt, Mycobacterium avium subsp. paratuberculosis
ccgccguggaagauguugccgcc

SEQ ID NO: 2823006 - RNA, 20 nt, Mycobacterium avium subsp. paratuberculosis
ccgccguggcagggccagca

SEQ ID NO: 2823007 - RNA, 22 nt, Mycobacterium avium subsp. paratuberculosis
ccgccguggcguuacacccgcg

SEQ ID NO: 2823008 - RNA, 16 nt, Mycobacterium avium subsp. paratuberculosis
ccgccguguaggccgc

SEQ ID NO: 2823009 - RNA, 20 nt, Mycobacterium avium subsp. paratuberculosis
ccgccguguaggccgcgcug

SEQ ID NO: 2823010 - RNA, 23 nt, Mycobacterium avium subsp. paratuberculosis
ccgccguguaggccgcgcuggcc

SEQ ID NO: 2823011 - RNA, 21 nt, Mycobacterium avium subsp. paratuberculosis
ccgccguucgccggcgacggc

SEQ ID NO: 2823012 - RNA, 17 nt, Mycobacterium avium subsp. paratuberculosis
ccgccguugaccggugc

SEQ ID NO: 2823013 - RNA, 23 nt, Mycobacterium avium subsp. paratuberculosis
ccgccguugaccggugcgcccgc

SEQ ID NO: 2823014 - RNA, 23 nt, Mycobacterium avium subsp. paratuberculosis
ccgccguugcgagucaucgccac

SEQ ID NO: 2823015 - RNA, 19 nt, Mycobacterium avium subsp. paratuberculosis
ccgccguuggccugguagc

SEQ ID NO: 2823016 - RNA, 17 nt, Mycobacterium avium subsp. paratuberculosis
ccgccguuucagcagcg

SEQ ID NO: 2823017 - RNA, 14 nt, Mycobacterium avium subsp. paratuberculosis
ccgccucacagcga

SEQ ID NO: 2823018 - RNA, 16 nt, Mycobacterium avium subsp. paratuberculosis
ccgccucacagcgaca

SEQ ID NO: 2823019 - RNA, 12 nt, Mycobacterium avium subsp. paratuberculosis
ccgccucaccga

SEQ ID NO: 2823020 - RNA, 17 nt, Mycobacterium avium subsp. paratuberculosis
ccgccucacgcagggcc

SEQ ID NO: 2823021 - RNA, 18 nt, Mycobacterium avium subsp. paratuberculosis
ccgccucacgcagggcca

SEQ ID NO: 2823022 - RNA, 19 nt, Mycobacterium avium subsp. paratuberculosis
ccgccucacgcagggccaa

SEQ ID NO: 2823023 - RNA, 21 nt, Mycobacterium avium subsp. paratuberculosis
ccgccucaugccagacgcgca

SEQ ID NO: 2823024 - RNA, 14 nt, Mycobacterium avium subsp. paratuberculosis
ccgccuccagcacg

SEQ ID NO: 2823025 - RNA, 14 nt, Mycobacterium avium subsp. paratuberculosis
ccgccuccgacagc

SEQ ID NO: 2823026 - RNA, 16 nt, Mycobacterium avium subsp. paratuberculosis
ccgccuccgacagccg

SEQ ID NO: 2823027 - RNA, 21 nt, Mycobacterium avium subsp. paratuberculosis
ccgccuccgacagccgcaccg

SEQ ID NO: 2823028 - RNA, 17 nt, Mycobacterium avium subsp. paratuberculosis
ccgccuccgaccagccg

SEQ ID NO: 2823029 - RNA, 14 nt, Mycobacterium avium subsp. paratuberculosis
ccgccuccgggcug

SEQ ID NO: 2823030 - RNA, 19 nt, Mycobacterium avium subsp. paratuberculosis
ccgccuccgguuugcgccg

SEQ ID NO: 2823031 - RNA, 21 nt, Mycobacterium avium subsp. paratuberculosis
ccgccuccgguuugcgccggc

SEQ ID NO: 2823032 - RNA, 24 nt, Mycobacterium avium subsp. paratuberculosis
ccgccuccucgaugucgguggugg

SEQ ID NO: 2823033 - RNA, 18 nt, Mycobacterium avium subsp. paratuberculosis
ccgccucgaagucgccgg

SEQ ID NO: 2823034 - RNA, 20 nt, Mycobacterium avium subsp. paratuberculosis
ccgccucgaagucgccggcc

SEQ ID NO: 2823035 - RNA, 23 nt, Mycobacterium avium subsp. paratuberculosis
ccgccucgaagucgccggccucc

SEQ ID NO: 2823036 - RNA, 16 nt, Mycobacterium avium subsp. paratuberculosis
ccgccucgacggugac

SEQ ID NO: 2823037 - RNA, 16 nt, Mycobacterium avium subsp. paratuberculosis
ccgccucgcagcgaca

SEQ ID NO: 2823038 - RNA, 14 nt, Mycobacterium avium subsp. paratuberculosis
ccgccucgccagcc

SEQ ID NO: 2823039 - RNA, 15 nt, Mycobacterium avium subsp. paratuberculosis
ccgccucgccagccc

SEQ ID NO: 2823040 - RNA, 19 nt, Mycobacterium avium subsp. paratuberculosis
ccgccucggauuccgcgga

SEQ ID NO: 2823041 - RNA, 13 nt, Mycobacterium avium subsp. paratuberculosis
ccgccucggcgag

SEQ ID NO: 2823042 - RNA, 14 nt, Mycobacterium avium subsp. paratuberculosis
ccgccucggcgagg

SEQ ID NO: 2823043 - RNA, 20 nt, Mycobacterium avium subsp. paratuberculosis
ccgccucggcgaggucgucg

SEQ ID NO: 2823044 - RNA, 12 nt, Mycobacterium avium subsp. paratuberculosis
ccgccucggcgg

SEQ ID NO: 2823045 - RNA, 14 nt, Mycobacterium avium subsp. paratuberculosis
ccgccucggcggag

SEQ ID NO: 2823046 - RNA, 20 nt, Mycobacterium avium subsp. paratuberculosis
ccgccucggcggagucguag

SEQ ID NO: 2823047 - RNA, 13 nt, Mycobacterium avium subsp. paratuberculosis
ccgccucggcggc

SEQ ID NO: 2823048 - RNA, 15 nt, Mycobacterium avium subsp. paratuberculosis
ccgccucggcggccg

SEQ ID NO: 2823049 - RNA, 12 nt, Mycobacterium avium subsp. paratuberculosis
ccgccucgucga

SEQ ID NO: 2823050 - RNA, 13 nt, Mycobacterium avium subsp. paratuberculosis
ccgccugagcccg

SEQ ID NO: 2823051 - RNA, 15 nt, Mycobacterium avium subsp. paratuberculosis
ccgccugagcccgcc

SEQ ID NO: 2823052 - RNA, 14 nt, Mycobacterium avium subsp. paratuberculosis
ccgccugcccgggc

SEQ ID NO: 2823053 - RNA, 15 nt, Mycobacterium avium subsp. paratuberculosis
ccgccugcccgggcg

SEQ ID NO: 2823054 - RNA, 17 nt, Mycobacterium avium subsp. paratuberculosis
ccgccugcccgggcgcc

SEQ ID NO: 2823055 - RNA, 14 nt, Mycobacterium avium subsp. paratuberculosis
ccgccugcgcgauc

SEQ ID NO: 2823056 - RNA, 18 nt, Mycobacterium avium subsp. paratuberculosis
ccgccugcgcgaucgccg

SEQ ID NO: 2823057 - RNA, 13 nt, Mycobacterium avium subsp. paratuberculosis
ccgccugcgcgcc

SEQ ID NO: 2823058 - RNA, 18 nt, Mycobacterium avium subsp. paratuberculosis
ccgccugcgcgccgucgg

SEQ ID NO: 2823059 - RNA, 24 nt, Mycobacterium avium subsp. paratuberculosis
ccgccugcgcgccgucggcgaugc

SEQ ID NO: 2823060 - RNA, 13 nt, Mycobacterium avium subsp. paratuberculosis
ccgccugcgcggg

SEQ ID NO: 2823061 - RNA, 14 nt, Mycobacterium avium subsp. paratuberculosis
ccgccugcgcgggc

SEQ ID NO: 2823062 - RNA, 17 nt, Mycobacterium avium subsp. paratuberculosis
ccgccugcgcgggcgcg

SEQ ID NO: 2823063 - RNA, 16 nt, Mycobacterium avium subsp. paratuberculosis
ccgccugcggguucug

SEQ ID NO: 2823064 - RNA, 22 nt, Mycobacterium avium subsp. paratuberculosis
ccgccugcuugaugaugccggc

SEQ ID NO: 2823065 - RNA, 15 nt, Mycobacterium avium subsp. paratuberculosis
ccgccuggacgacgu

SEQ ID NO: 2823066 - RNA, 18 nt, Mycobacterium avium subsp. paratuberculosis
ccgccuggacgacgucga

SEQ ID NO: 2823067 - RNA, 20 nt, Mycobacterium avium subsp. paratuberculosis
ccgccuggacgacgucgaug

SEQ ID NO: 2823068 - RNA, 19 nt, Mycobacterium avium subsp. paratuberculosis
ccgccuggccaccucgacg

SEQ ID NO: 2823069 - RNA, 23 nt, Mycobacterium avium subsp. paratuberculosis
ccgccugggucucgggaucgccg

SEQ ID NO: 2823070 - RNA, 16 nt, Mycobacterium avium subsp. paratuberculosis
ccgccugugcgacggc

SEQ ID NO: 2823071 - RNA, 20 nt, Mycobacterium avium subsp. paratuberculosis
ccgccugugcgacggcgucg

SEQ ID NO: 2823072 - RNA, 20 nt, Mycobacterium avium subsp. paratuberculosis
ccgccuucacgaccggcagc

SEQ ID NO: 2823073 - RNA, 22 nt, Mycobacterium avium subsp. paratuberculosis
ccgccuucgacgaugccguaga

SEQ ID NO: 2823074 - RNA, 19 nt, Mycobacterium avium subsp. paratuberculosis
ccgccuucgacggccggcc

SEQ ID NO: 2823075 - RNA, 18 nt, Mycobacterium avium subsp. paratuberculosis
ccgccuucuccgggucgc

SEQ ID NO: 2823076 - RNA, 20 nt, Mycobacterium avium subsp. paratuberculosis
ccgccuucuugcgcggcgcg

SEQ ID NO: 2823077 - RNA, 21 nt, Mycobacterium avium subsp. paratuberculosis
ccgccuucuugcgcggcgcga

SEQ ID NO: 2823078 - RNA, 15 nt, Mycobacterium avium subsp. paratuberculosis
ccgccuugacgccgg

SEQ ID NO: 2823079 - RNA, 18 nt, Mycobacterium avium subsp. paratuberculosis
ccgccuugaucuuggccu

SEQ ID NO: 2823080 - RNA, 22 nt, Mycobacterium avium subsp. paratuberculosis
ccgccuugaucuuggccugggc

SEQ ID NO: 2823081 - RNA, 16 nt, Mycobacterium avium subsp. paratuberculosis
ccgccuugcccggcuc

SEQ ID NO: 2823082 - RNA, 14 nt, Mycobacterium avium subsp. paratuberculosis
ccgcgacgaccucg

SEQ ID NO: 2823083 - RNA, 22 nt, Mycobacterium avium subsp. paratuberculosis
ccgcgacgaccucgcccgccgc

SEQ ID NO: 2823084 - RNA, 20 nt, Mycobacterium avium subsp. paratuberculosis
ccgcgacgaucacgguguug

SEQ ID NO: 2823085 - RNA, 21 nt, Mycobacterium avium subsp. paratuberculosis
ccgcgacgaucacgguguugu

SEQ ID NO: 2823086 - RNA, 15 nt, Mycobacterium avium subsp. paratuberculosis
ccgcgacgaucgcga

SEQ ID NO: 2823087 - RNA, 19 nt, Mycobacterium avium subsp. paratuberculosis
ccgcgacgaucgcgacggc

SEQ ID NO: 2823088 - RNA, 22 nt, Mycobacterium avium subsp. paratuberculosis
ccgcgacgaucgcgacggccgg

SEQ ID NO: 2823089 - RNA, 23 nt, Mycobacterium avium subsp. paratuberculosis
ccgcgacgaucgcgacggccggg

SEQ ID NO: 2823090 - RNA, 22 nt, Mycobacterium avium subsp. paratuberculosis
ccgcgacgaugccggcgucguc

SEQ ID NO: 2823091 - RNA, 23 nt, Mycobacterium avium subsp. paratuberculosis
ccgcgacgaugccggcgucgucg

SEQ ID NO: 2823092 - RNA, 21 nt, Mycobacterium avium subsp. paratuberculosis
ccgcgacgaugucgacccgcg

SEQ ID NO: 2823093 - RNA, 23 nt, Mycobacterium avium subsp. paratuberculosis
ccgcgacgaugucgacccgcggc

SEQ ID NO: 2823094 - RNA, 16 nt, Mycobacterium avium subsp. paratuberculosis
ccgcgacgccaacaac

SEQ ID NO: 2823095 - RNA, 17 nt, Mycobacterium avium subsp. paratuberculosis
ccgcgacgcccaggugc

SEQ ID NO: 2823096 - RNA, 12 nt, Mycobacterium avium subsp. paratuberculosis
ccgcgacgccgc

SEQ ID NO: 2823097 - RNA, 13 nt, Mycobacterium avium subsp. paratuberculosis
ccgcgacgccgcc

SEQ ID NO: 2823098 - RNA, 14 nt, Mycobacterium avium subsp. paratuberculosis
ccgcgacgccgccg

SEQ ID NO: 2823099 - RNA, 15 nt, Mycobacterium avium subsp. paratuberculosis
ccgcgacgccgccgc

SEQ ID NO: 2823100 - RNA, 18 nt, Mycobacterium avium subsp. paratuberculosis
ccgcgacgccgccgccga

SEQ ID NO: 2823101 - RNA, 13 nt, Mycobacterium avium subsp. paratuberculosis
ccgcgacgcgauc

SEQ ID NO: 2823102 - RNA, 14 nt, Mycobacterium avium subsp. paratuberculosis
ccgcgacgcgcggu

SEQ ID NO: 2823103 - RNA, 18 nt, Mycobacterium avium subsp. paratuberculosis
ccgcgacgcgcggucguc

SEQ ID NO: 2823104 - RNA, 16 nt, Mycobacterium avium subsp. paratuberculosis
ccgcgacgcugagcgc

SEQ ID NO: 2823105 - RNA, 21 nt, Mycobacterium avium subsp. paratuberculosis
ccgcgacgcugagcgccaggc

SEQ ID NO: 2823106 - RNA, 12 nt, Mycobacterium avium subsp. paratuberculosis
ccgcgacgcugc

SEQ ID NO: 2823107 - RNA, 20 nt, Mycobacterium avium subsp. paratuberculosis
ccgcgacgcugccggggcgc

SEQ ID NO: 2823108 - RNA, 19 nt, Mycobacterium avium subsp. paratuberculosis
ccgcgacggaccagugcag

SEQ ID NO: 2823109 - RNA, 17 nt, Mycobacterium avium subsp. paratuberculosis
ccgcgacggccgccgau

SEQ ID NO: 2823110 - RNA, 15 nt, Mycobacterium avium subsp. paratuberculosis
ccgcgacggcgagcc

SEQ ID NO: 2823111 - RNA, 16 nt, Mycobacterium avium subsp. paratuberculosis
ccgcgacggcgagccg

SEQ ID NO: 2823112 - RNA, 21 nt, Mycobacterium avium subsp. paratuberculosis
ccgcgacggcgagccgggccg

SEQ ID NO: 2823113 - RNA, 22 nt, Mycobacterium avium subsp. paratuberculosis
ccgcgacggcgagccgggccgg

SEQ ID NO: 2823114 - RNA, 15 nt, Mycobacterium avium subsp. paratuberculosis
ccgcgacggcgcccg

SEQ ID NO: 2823115 - RNA, 16 nt, Mycobacterium avium subsp. paratuberculosis
ccgcgacggcgcccgc

SEQ ID NO: 2823116 - RNA, 18 nt, Mycobacterium avium subsp. paratuberculosis
ccgcgacggcgcccgccc

SEQ ID NO: 2823117 - RNA, 20 nt, Mycobacterium avium subsp. paratuberculosis
ccgcgacggcgcccgccccg

SEQ ID NO: 2823118 - RNA, 14 nt, Mycobacterium avium subsp. paratuberculosis
ccgcgacggcgggu

SEQ ID NO: 2823119 - RNA, 14 nt, Mycobacterium avium subsp. paratuberculosis
ccgcgacgggcucg

SEQ ID NO: 2823120 - RNA, 18 nt, Mycobacterium avium subsp. paratuberculosis
ccgcgacgggcucggcgu

SEQ ID NO: 2823121 - RNA, 19 nt, Mycobacterium avium subsp. paratuberculosis
ccgcgacgggcucggcgua

SEQ ID NO: 2823122 - RNA, 20 nt, Mycobacterium avium subsp. paratuberculosis
ccgcgacgggcucggcguac

SEQ ID NO: 2823123 - RNA, 21 nt, Mycobacterium avium subsp. paratuberculosis
ccgcgacgggcugucccggcc

SEQ ID NO: 2823124 - RNA, 22 nt, Mycobacterium avium subsp. paratuberculosis
ccgcgacgggcugucccggccg

SEQ ID NO: 2823125 - RNA, 21 nt, Mycobacterium avium subsp. paratuberculosis
ccgcgacggucaguccggguu

SEQ ID NO: 2823126 - RNA, 23 nt, Mycobacterium avium subsp. paratuberculosis
ccgcgacggugagcaacaccggc

SEQ ID NO: 2823127 - RNA, 21 nt, Mycobacterium avium subsp. paratuberculosis
ccgcgacgguuguucagcccg

SEQ ID NO: 2823128 - RNA, 20 nt, Mycobacterium avium subsp. paratuberculosis
ccgcgacgguuuccggcuuc

SEQ ID NO: 2823129 - RNA, 15 nt, Mycobacterium avium subsp. paratuberculosis
ccgcgacguagccgg

SEQ ID NO: 2823130 - RNA, 14 nt, Mycobacterium avium subsp. paratuberculosis
ccgcgacguccauc

SEQ ID NO: 2823131 - RNA, 16 nt, Mycobacterium avium subsp. paratuberculosis
ccgcgacguccaucgg

SEQ ID NO: 2823132 - RNA, 12 nt, Mycobacterium avium subsp. paratuberculosis
ccgcgacgucgg

SEQ ID NO: 2823133 - RNA, 17 nt, Mycobacterium avium subsp. paratuberculosis
ccgcgacucggugucgc

SEQ ID NO: 2823134 - RNA, 15 nt, Mycobacterium avium subsp. paratuberculosis
ccgcgacugcacccg

SEQ ID NO: 2823135 - RNA, 14 nt, Mycobacterium avium subsp. paratuberculosis
ccgcgacugucggc

SEQ ID NO: 2823136 - RNA, 16 nt, Mycobacterium avium subsp. paratuberculosis
ccgcgacugucggcgc

SEQ ID NO: 2823137 - RNA, 20 nt, Mycobacterium avium subsp. paratuberculosis
ccgcgacugucggcgccccg

SEQ ID NO: 2823138 - RNA, 21 nt, Mycobacterium avium subsp. paratuberculosis
ccgcgacugucggcucgcccg

SEQ ID NO: 2823139 - RNA, 17 nt, Mycobacterium avium subsp. paratuberculosis
ccgcgagcaccgcgauc

SEQ ID NO: 2823140 - RNA, 13 nt, Mycobacterium avium subsp. paratuberculosis
ccgcgagcacgac

SEQ ID NO: 2823141 - RNA, 15 nt, Mycobacterium avium subsp. paratuberculosis
ccgcgagcacgacgu

SEQ ID NO: 2823142 - RNA, 17 nt, Mycobacterium avium subsp. paratuberculosis
ccgcgagcacgacgucg

SEQ ID NO: 2823143 - RNA, 18 nt, Mycobacterium avium subsp. paratuberculosis
ccgcgagcacgacgucga

SEQ ID NO: 2823144 - RNA, 21 nt, Mycobacterium avium subsp. paratuberculosis
ccgcgagcacgacgucgacgu

SEQ ID NO: 2823145 - RNA, 22 nt, Mycobacterium avium subsp. paratuberculosis
ccgcgagcccgcaaaucagccg

SEQ ID NO: 2823146 - RNA, 15 nt, Mycobacterium avium subsp. paratuberculosis
ccgcgagcccggcga

SEQ ID NO: 2823147 - RNA, 17 nt, Mycobacterium avium subsp. paratuberculosis
ccgcgagcccggcgacg

SEQ ID NO: 2823148 - RNA, 18 nt, Mycobacterium avium subsp. paratuberculosis
ccgcgagcccggcgacgu

SEQ ID NO: 2823149 - RNA, 13 nt, Mycobacterium avium subsp. paratuberculosis
ccgcgagccgagc

SEQ ID NO: 2823150 - RNA, 15 nt, Mycobacterium avium subsp. paratuberculosis
ccgcgagccgcccag

SEQ ID NO: 2823151 - RNA, 18 nt, Mycobacterium avium subsp. paratuberculosis
ccgcgagccgcccaggcg

SEQ ID NO: 2823152 - RNA, 13 nt, Mycobacterium avium subsp. paratuberculosis
ccgcgagcgcagc

SEQ ID NO: 2823153 - RNA, 15 nt, Mycobacterium avium subsp. paratuberculosis
ccgcgagcgcgcggu

SEQ ID NO: 2823154 - RNA, 19 nt, Mycobacterium avium subsp. paratuberculosis
ccgcgagcgcgcggugaug

SEQ ID NO: 2823155 - RNA, 20 nt, Mycobacterium avium subsp. paratuberculosis
ccgcgagcgcgcggugauga

SEQ ID NO: 2823156 - RNA, 18 nt, Mycobacterium avium subsp. paratuberculosis
ccgcgagcgcuaccgcgc

SEQ ID NO: 2823157 - RNA, 23 nt, Mycobacterium avium subsp. paratuberculosis
ccgcgagcgggugaaucgacacc

SEQ ID NO: 2823158 - RNA, 18 nt, Mycobacterium avium subsp. paratuberculosis
ccgcgaggaaucgcggca

SEQ ID NO: 2823159 - RNA, 20 nt, Mycobacterium avium subsp. paratuberculosis
ccgcgaggaaucgcggcagg

SEQ ID NO: 2823160 - RNA, 17 nt, Mycobacterium avium subsp. paratuberculosis
ccgcgaggugucgacgc

SEQ ID NO: 2823161 - RNA, 20 nt, Mycobacterium avium subsp. paratuberculosis
ccgcgaggugucgacgcuga

SEQ ID NO: 2823162 - RNA, 17 nt, Mycobacterium avium subsp. paratuberculosis
ccgcgagucaccggcuc

SEQ ID NO: 2823163 - RNA, 13 nt, Mycobacterium avium subsp. paratuberculosis
ccgcgagucgagg

SEQ ID NO: 2823164 - RNA, 16 nt, Mycobacterium avium subsp. paratuberculosis
ccgcgaguucgcgcac

SEQ ID NO: 2823165 - RNA, 21 nt, Mycobacterium avium subsp. paratuberculosis
ccgcgaguucgcgcacgcugg

SEQ ID NO: 2823166 - RNA, 20 nt, Mycobacterium avium subsp. paratuberculosis
ccgcgcacucgaacggcccg

SEQ ID NO: 2823167 - RNA, 21 nt, Mycobacterium avium subsp. paratuberculosis
ccgcgcacucgaacggcccgg

SEQ ID NO: 2823168 - RNA, 23 nt, Mycobacterium avium subsp. paratuberculosis
ccgcgcacucgaacggcccggac

SEQ ID NO: 2823169 - RNA, 15 nt, Mycobacterium avium subsp. paratuberculosis
ccgcgcacuggagug

SEQ ID NO: 2823170 - RNA, 23 nt, Mycobacterium avium subsp. paratuberculosis
ccgcgcacuggagugcugcagac

SEQ ID NO: 2823171 - RNA, 12 nt, Mycobacterium avium subsp. paratuberculosis
ccgcgcagaacc

SEQ ID NO: 2823172 - RNA, 15 nt, Mycobacterium avium subsp. paratuberculosis
ccgcgcagaaccgca

SEQ ID NO: 2823173 - RNA, 13 nt, Mycobacterium avium subsp. paratuberculosis
ccgcgcagaucgc

SEQ ID NO: 2823174 - RNA, 17 nt, Mycobacterium avium subsp. paratuberculosis
ccgcgcagaucgccagc

SEQ ID NO: 2823175 - RNA, 18 nt, Mycobacterium avium subsp. paratuberculosis
ccgcgcagaucgccagca

SEQ ID NO: 2823176 - RNA, 20 nt, Mycobacterium avium subsp. paratuberculosis
ccgcgcagaucgccagcacc

SEQ ID NO: 2823177 - RNA, 12 nt, Mycobacterium avium subsp. paratuberculosis
ccgcgcagcacc

SEQ ID NO: 2823178 - RNA, 14 nt, Mycobacterium avium subsp. paratuberculosis
ccgcgcagcaccgc

SEQ ID NO: 2823179 - RNA, 16 nt, Mycobacterium avium subsp. paratuberculosis
ccgcgcagcaccgcgu

SEQ ID NO: 2823180 - RNA, 22 nt, Mycobacterium avium subsp. paratuberculosis
ccgcgcagcaccgcgucggcgc

SEQ ID NO: 2823181 - RNA, 15 nt, Mycobacterium avium subsp. paratuberculosis
ccgcgcagcaccguc

SEQ ID NO: 2823182 - RNA, 13 nt, Mycobacterium avium subsp. paratuberculosis
ccgcgcagcagcg

SEQ ID NO: 2823183 - RNA, 18 nt, Mycobacterium avium subsp. paratuberculosis
ccgcgcagccagaccucg

SEQ ID NO: 2823184 - RNA, 23 nt, Mycobacterium avium subsp. paratuberculosis
ccgcgcagccagaccucgccgac

SEQ ID NO: 2823185 - RNA, 15 nt, Mycobacterium avium subsp. paratuberculosis
ccgcgcagcggggcg

SEQ ID NO: 2823186 - RNA, 18 nt, Mycobacterium avium subsp. paratuberculosis
ccgcgcagcggggcgcgc

SEQ ID NO: 2823187 - RNA, 21 nt, Mycobacterium avium subsp. paratuberculosis
ccgcgcagcggggcgcgcagg

SEQ ID NO: 2823188 - RNA, 11 nt, Mycobacterium avium subsp. paratuberculosis
ccgcgcagcuc

SEQ ID NO: 2823189 - RNA, 21 nt, Mycobacterium avium subsp. paratuberculosis
ccgcgcagcucgacgaccucg

SEQ ID NO: 2823190 - RNA, 18 nt, Mycobacterium avium subsp. paratuberculosis
ccgcgcagcucggggucg

SEQ ID NO: 2823191 - RNA, 20 nt, Mycobacterium avium subsp. paratuberculosis
ccgcgcagcucggggucggc

SEQ ID NO: 2823192 - RNA, 14 nt, Mycobacterium avium subsp. paratuberculosis
ccgcgcaggccccg

SEQ ID NO: 2823193 - RNA, 12 nt, Mycobacterium avium subsp. paratuberculosis
ccgcgcaggccg

SEQ ID NO: 2823194 - RNA, 14 nt, Mycobacterium avium subsp. paratuberculosis
ccgcgcaggccgcc

SEQ ID NO: 2823195 - RNA, 17 nt, Mycobacterium avium subsp. paratuberculosis
ccgcgcaggccgccgac

SEQ ID NO: 2823196 - RNA, 22 nt, Mycobacterium avium subsp. paratuberculosis
ccgcgcaggccguccagcagca

SEQ ID NO: 2823197 - RNA, 13 nt, Mycobacterium avium subsp. paratuberculosis
ccgcgcaggcggc

SEQ ID NO: 2823198 - RNA, 16 nt, Mycobacterium avium subsp. paratuberculosis
ccgcgcaggcggcgac

SEQ ID NO: 2823199 - RNA, 19 nt, Mycobacterium avium subsp. paratuberculosis
ccgcgcaggcggcgacggc

SEQ ID NO: 2823200 - RNA, 22 nt, Mycobacterium avium subsp. paratuberculosis
ccgcgcagggacgggcgugacg

SEQ ID NO: 2823201 - RNA, 15 nt, Mycobacterium avium subsp. paratuberculosis
ccgcgcagucggcgu

SEQ ID NO: 2823202 - RNA, 16 nt, Mycobacterium avium subsp. paratuberculosis
ccgcgcagucggcguc

SEQ ID NO: 2823203 - RNA, 22 nt, Mycobacterium avium subsp. paratuberculosis
ccgcgcagucggcgucgcggcg

SEQ ID NO: 2823204 - RNA, 24 nt, Mycobacterium avium subsp. paratuberculosis
ccgcgcagucggcgucgcggcgca

SEQ ID NO: 2823205 - RNA, 18 nt, Mycobacterium avium subsp. paratuberculosis
ccgcgcaucaucgcccag

SEQ ID NO: 2823206 - RNA, 19 nt, Mycobacterium avium subsp. paratuberculosis
ccgcgcaucaucgcccagc

SEQ ID NO: 2823207 - RNA, 21 nt, Mycobacterium avium subsp. paratuberculosis
ccgcgcaucaucgcccagcgc

SEQ ID NO: 2823208 - RNA, 22 nt, Mycobacterium avium subsp. paratuberculosis
ccgcgcaucaucgcccagcgca

SEQ ID NO: 2823209 - RNA, 16 nt, Mycobacterium avium subsp. paratuberculosis
ccgcgcaucccgucga

SEQ ID NO: 2823210 - RNA, 17 nt, Mycobacterium avium subsp. paratuberculosis
ccgcgcaucccgucgac

SEQ ID NO: 2823211 - RNA, 19 nt, Mycobacterium avium subsp. paratuberculosis
ccgcgcaucccgucgacca

SEQ ID NO: 2823212 - RNA, 16 nt, Mycobacterium avium subsp. paratuberculosis
ccgcgcauccgcaccg

SEQ ID NO: 2823213 - RNA, 20 nt, Mycobacterium avium subsp. paratuberculosis
ccgcgcauccgcaccgagac

SEQ ID NO: 2823214 - RNA, 15 nt, Mycobacterium avium subsp. paratuberculosis
ccgcgcaucggucag

SEQ ID NO: 2823215 - RNA, 16 nt, Mycobacterium avium subsp. paratuberculosis
ccgcgcaucggucagc

SEQ ID NO: 2823216 - RNA, 23 nt, Mycobacterium avium subsp. paratuberculosis
ccgcgcauguuggugaucagccc

SEQ ID NO: 2823217 - RNA, 18 nt, Mycobacterium avium subsp. paratuberculosis
ccgcgcauucaccagcug

SEQ ID NO: 2823218 - RNA, 13 nt, Mycobacterium avium subsp. paratuberculosis
ccgcgccaacgag

SEQ ID NO: 2823219 - RNA, 20 nt, Mycobacterium avium subsp. paratuberculosis
ccgcgccaccccgagcucgg

SEQ ID NO: 2823220 - RNA, 13 nt, Mycobacterium avium subsp. paratuberculosis
ccgcgccaccgag

SEQ ID NO: 2823221 - RNA, 13 nt, Mycobacterium avium subsp. paratuberculosis
ccgcgccaccgcg

SEQ ID NO: 2823222 - RNA, 14 nt, Mycobacterium avium subsp. paratuberculosis
ccgcgccacgccgc

SEQ ID NO: 2823223 - RNA, 16 nt, Mycobacterium avium subsp. paratuberculosis
ccgcgccacgcgcagg

SEQ ID NO: 2823224 - RNA, 13 nt, Mycobacterium avium subsp. paratuberculosis
ccgcgccagcacc

SEQ ID NO: 2823225 - RNA, 17 nt, Mycobacterium avium subsp. paratuberculosis
ccgcgccagcaccucgg

SEQ ID NO: 2823226 - RNA, 15 nt, Mycobacterium avium subsp. paratuberculosis
ccgcgccagccgccg

SEQ ID NO: 2823227 - RNA, 16 nt, Mycobacterium avium subsp. paratuberculosis
ccgcgccagccgccgc

SEQ ID NO: 2823228 - RNA, 14 nt, Mycobacterium avium subsp. paratuberculosis
ccgcgccagcucgg

SEQ ID NO: 2823229 - RNA, 16 nt, Mycobacterium avium subsp. paratuberculosis
ccgcgccagcucggcg

SEQ ID NO: 2823230 - RNA, 17 nt, Mycobacterium avium subsp. paratuberculosis
ccgcgccagcucggcgg

SEQ ID NO: 2823231 - RNA, 18 nt, Mycobacterium avium subsp. paratuberculosis
ccgcgccagcucggcggc

SEQ ID NO: 2823232 - RNA, 23 nt, Mycobacterium avium subsp. paratuberculosis
ccgcgccagcucggcggccgggu

SEQ ID NO: 2823233 - RNA, 13 nt, Mycobacterium avium subsp. paratuberculosis
ccgcgcccacccg

SEQ ID NO: 2823234 - RNA, 22 nt, Mycobacterium avium subsp. paratuberculosis
ccgcgcccacccgaugaccggc

SEQ ID NO: 2823235 - RNA, 14 nt, Mycobacterium avium subsp. paratuberculosis
ccgcgcccacccgc

SEQ ID NO: 2823236 - RNA, 14 nt, Mycobacterium avium subsp. paratuberculosis
ccgcgcccaccugg

SEQ ID NO: 2823237 - RNA, 20 nt, Mycobacterium avium subsp. paratuberculosis
ccgcgcccaccuggaggcca

SEQ ID NO: 2823238 - RNA, 22 nt, Mycobacterium avium subsp. paratuberculosis
ccgcgcccaccuggaggccaac

SEQ ID NO: 2823239 - RNA, 12 nt, Mycobacterium avium subsp. paratuberculosis
ccgcgcccagca

SEQ ID NO: 2823240 - RNA, 12 nt, Mycobacterium avium subsp. paratuberculosis
ccgcgcccagcc

SEQ ID NO: 2823241 - RNA, 14 nt, Mycobacterium avium subsp. paratuberculosis
ccgcgcccagcccc

SEQ ID NO: 2823242 - RNA, 17 nt, Mycobacterium avium subsp. paratuberculosis
ccgcgcccagccccagc

SEQ ID NO: 2823243 - RNA, 12 nt, Mycobacterium avium subsp. paratuberculosis
ccgcgcccaggg

SEQ ID NO: 2823244 - RNA, 18 nt, Mycobacterium avium subsp. paratuberculosis
ccgcgcccaguguggggc

SEQ ID NO: 2823245 - RNA, 16 nt, Mycobacterium avium subsp. paratuberculosis
ccgcgcccaucgcggc

SEQ ID NO: 2823246 - RNA, 20 nt, Mycobacterium avium subsp. paratuberculosis
ccgcgcccaucgcggccgcc

SEQ ID NO: 2823247 - RNA, 22 nt, Mycobacterium avium subsp. paratuberculosis
ccgcgcccaucgcggccgcccg

SEQ ID NO: 2823248 - RNA, 21 nt, Mycobacterium avium subsp. paratuberculosis
ccgcgcccaugaacgcgucgc

SEQ ID NO: 2823249 - RNA, 17 nt, Mycobacterium avium subsp. paratuberculosis
ccgcgcccccugggaca

SEQ ID NO: 2823250 - RNA, 20 nt, Mycobacterium avium subsp. paratuberculosis
ccgcgcccccugggacagcg

SEQ ID NO: 2823251 - RNA, 15 nt, Mycobacterium avium subsp. paratuberculosis
ccgcgccgugaacug

SEQ ID NO: 2823252 - RNA, 22 nt, Mycobacterium avium subsp. paratuberculosis
ccgcgccgugaacugugcggug

SEQ ID NO: 2823253 - RNA, 12 nt, Mycobacterium avium subsp. paratuberculosis
ccgcgccgugcg

SEQ ID NO: 2823254 - RNA, 15 nt, Mycobacterium avium subsp. paratuberculosis
ccgcgccgugcgcca

SEQ ID NO: 2823255 - RNA, 16 nt, Mycobacterium avium subsp. paratuberculosis
ccgcgccgugcgccag

SEQ ID NO: 2823256 - RNA, 13 nt, Mycobacterium avium subsp. paratuberculosis
ccgcgccgugggc

SEQ ID NO: 2823257 - RNA, 16 nt, Mycobacterium avium subsp. paratuberculosis
ccgcgccgugggcguc

SEQ ID NO: 2823258 - RNA, 17 nt, Mycobacterium avium subsp. paratuberculosis
ccgcgccguugaccgcg

SEQ ID NO: 2823259 - RNA, 18 nt, Mycobacterium avium subsp. paratuberculosis
ccgcgccguugaccgcgg

SEQ ID NO: 2823260 - RNA, 24 nt, Mycobacterium avium subsp. paratuberculosis
ccgcgccguugaccgcggcgaugg

SEQ ID NO: 2823261 - RNA, 20 nt, Mycobacterium avium subsp. paratuberculosis
ccgcgccuccauucgggcca

SEQ ID NO: 2823262 - RNA, 24 nt, Mycobacterium avium subsp. paratuberculosis
ccgcgccuccauucgggccagcgc

SEQ ID NO: 2823263 - RNA, 19 nt, Mycobacterium avium subsp. paratuberculosis
ccgcgccucguugagcaca

SEQ ID NO: 2823264 - RNA, 14 nt, Mycobacterium avium subsp. paratuberculosis
ccgcgccuggcgca

SEQ ID NO: 2823265 - RNA, 15 nt, Mycobacterium avium subsp. paratuberculosis
ccgcgccuucgaccc

SEQ ID NO: 2823266 - RNA, 17 nt, Mycobacterium avium subsp. paratuberculosis
ccgcgccuucgacccgg

SEQ ID NO: 2823267 - RNA, 18 nt, Mycobacterium avium subsp. paratuberculosis
ccgcgccuucgacccggu

SEQ ID NO: 2823268 - RNA, 19 nt, Mycobacterium avium subsp. paratuberculosis
ccgcgccuucgacccggug

SEQ ID NO: 2823269 - RNA, 19 nt, Mycobacterium avium subsp. paratuberculosis
ccgcgcgaagucccacugc

SEQ ID NO: 2823270 - RNA, 17 nt, Mycobacterium avium subsp. paratuberculosis
ccgcgcgacaucaccgc

SEQ ID NO: 2823271 - RNA, 17 nt, Mycobacterium avium subsp. paratuberculosis
ccgcgcgacgccguaga

SEQ ID NO: 2823272 - RNA, 21 nt, Mycobacterium avium subsp. paratuberculosis
ccgcgcgagaguaucgccacg

SEQ ID NO: 2823273 - RNA, 17 nt, Mycobacterium avium subsp. paratuberculosis
ccgcgcgagcaucaccg

SEQ ID NO: 2823274 - RNA, 15 nt, Mycobacterium avium subsp. paratuberculosis
ccgcgcgagcgcagc

SEQ ID NO: 2823275 - RNA, 15 nt, Mycobacterium avium subsp. paratuberculosis
ccgcgcgagcgcgcu

SEQ ID NO: 2823276 - RNA, 16 nt, Mycobacterium avium subsp. paratuberculosis
ccgcgcgagcgcgcug

SEQ ID NO: 2823277 - RNA, 16 nt, Mycobacterium avium subsp. paratuberculosis
ccgcgcgaucaggccg

SEQ ID NO: 2823278 - RNA, 18 nt, Mycobacterium avium subsp. paratuberculosis
ccgcgcgaucaggccggc

SEQ ID NO: 2823279 - RNA, 21 nt, Mycobacterium avium subsp. paratuberculosis
ccgcgcgaucaggccggccac

SEQ ID NO: 2823280 - RNA, 22 nt, Mycobacterium avium subsp. paratuberculosis
ccgcgcgaucaggccggccacc

SEQ ID NO: 2823281 - RNA, 13 nt, Mycobacterium avium subsp. paratuberculosis
ccgcgcgaucggc

SEQ ID NO: 2823282 - RNA, 16 nt, Mycobacterium avium subsp. paratuberculosis
ccgcgcgaucggcgag

SEQ ID NO: 2823283 - RNA, 23 nt, Mycobacterium avium subsp. paratuberculosis
ccgcgcgaucggcgagccgggac

SEQ ID NO: 2823284 - RNA, 22 nt, Mycobacterium avium subsp. paratuberculosis
ccgcgcgaugcacaaccgcugc

SEQ ID NO: 2823285 - RNA, 15 nt, Mycobacterium avium subsp. paratuberculosis
ccgcgcgaugcgggc

SEQ ID NO: 2823286 - RNA, 16 nt, Mycobacterium avium subsp. paratuberculosis
ccgcgcgaugcgggcg

SEQ ID NO: 2823287 - RNA, 22 nt, Mycobacterium avium subsp. paratuberculosis
ccgcgcgaugcgggcgccgaac

SEQ ID NO: 2823288 - RNA, 24 nt, Mycobacterium avium subsp. paratuberculosis
ccgcgcgaugcgggcgccgaacgu

SEQ ID NO: 2823289 - RNA, 16 nt, Mycobacterium avium subsp. paratuberculosis
ccgcgcgcaacgaggc

SEQ ID NO: 2823290 - RNA, 12 nt, Mycobacterium avium subsp. paratuberculosis
ccgcgcgcacca

SEQ ID NO: 2823291 - RNA, 14 nt, Mycobacterium avium subsp. paratuberculosis
ccgcgcgcagcaca

SEQ ID NO: 2823292 - RNA, 17 nt, Mycobacterium avium subsp. paratuberculosis
ccgcgcgcaggccccgg

SEQ ID NO: 2823293 - RNA, 14 nt, Mycobacterium avium subsp. paratuberculosis
ccgcgcgcaggcgc

SEQ ID NO: 2823294 - RNA, 17 nt, Mycobacterium avium subsp. paratuberculosis
ccgcgcgcaggcgcuga

SEQ ID NO: 2823295 - RNA, 15 nt, Mycobacterium avium subsp. paratuberculosis
ccgcgcgccagcgcg

SEQ ID NO: 2823296 - RNA, 21 nt, Mycobacterium avium subsp. paratuberculosis
ccgcgcgccagcgcgugcggg

SEQ ID NO: 2823297 - RNA, 12 nt, Mycobacterium avium subsp. paratuberculosis
ccgcgcgccagg

SEQ ID NO: 2823298 - RNA, 15 nt, Mycobacterium avium subsp. paratuberculosis
ccgcgcgccaggucg

SEQ ID NO: 2823299 - RNA, 15 nt, Mycobacterium avium subsp. paratuberculosis
ccgcgcgcccgcggc

SEQ ID NO: 2823300 - RNA, 16 nt, Mycobacterium avium subsp. paratuberculosis
ccgcgcgcccgcggcc

SEQ ID NO: 2823301 - RNA, 17 nt, Mycobacterium avium subsp. paratuberculosis
ccgcgcgcccgcggcca

SEQ ID NO: 2823302 - RNA, 19 nt, Mycobacterium avium subsp. paratuberculosis
ccgcgcgcccgcggccauc

SEQ ID NO: 2823303 - RNA, 16 nt, Mycobacterium avium subsp. paratuberculosis
ccgcgcgcccgucguc

SEQ ID NO: 2823304 - RNA, 20 nt, Mycobacterium avium subsp. paratuberculosis
ccgcgcgcccuagucgacgc

SEQ ID NO: 2823305 - RNA, 22 nt, Mycobacterium avium subsp. paratuberculosis
ccgcgcgcccuagucgacgccg

SEQ ID NO: 2823306 - RNA, 15 nt, Mycobacterium avium subsp. paratuberculosis
ccgcgcgccgacaga

SEQ ID NO: 2823307 - RNA, 12 nt, Mycobacterium avium subsp. paratuberculosis
ccgcgcgccgag

SEQ ID NO: 2823308 - RNA, 15 nt, Mycobacterium avium subsp. paratuberculosis
ccgcgcgccgagagc

SEQ ID NO: 2823309 - RNA, 22 nt, Mycobacterium avium subsp. paratuberculosis
ccgcgcgccgagagcgcgucga

SEQ ID NO: 2823310 - RNA, 16 nt, Mycobacterium avium subsp. paratuberculosis
ccgcgcgccggccagc

SEQ ID NO: 2823311 - RNA, 14 nt, Mycobacterium avium subsp. paratuberculosis
ccgcgcgcgcggcc

SEQ ID NO: 2823312 - RNA, 19 nt, Mycobacterium avium subsp. paratuberculosis
ccgcgcgcgcggccuccag

SEQ ID NO: 2823313 - RNA, 23 nt, Mycobacterium avium subsp. paratuberculosis
ccgcgcgcgcggccuccagccgc

SEQ ID NO: 2823314 - RNA, 13 nt, Mycobacterium avium subsp. paratuberculosis
ccgcgcgcggcac

SEQ ID NO: 2823315 - RNA, 20 nt, Mycobacterium avium subsp. paratuberculosis
ccgcgcgcggcacgguggcc

SEQ ID NO: 2823316 - RNA, 13 nt, Mycobacterium avium subsp. paratuberculosis
ccgcgcgcggcca

SEQ ID NO: 2823317 - RNA, 14 nt, Mycobacterium avium subsp. paratuberculosis
ccgcgcgcggccac

SEQ ID NO: 2823318 - RNA, 20 nt, Mycobacterium avium subsp. paratuberculosis
ccgcgcgcggccaccgcgcg

SEQ ID NO: 2823319 - RNA, 21 nt, Mycobacterium avium subsp. paratuberculosis
ccgcgcgcggccaccgcgcgc

SEQ ID NO: 2823320 - RNA, 12 nt, Mycobacterium avium subsp. paratuberculosis
ccgcgcgcggcg

SEQ ID NO: 2823321 - RNA, 21 nt, Mycobacterium avium subsp. paratuberculosis
ccgcgcgcggcgccgcguacc

SEQ ID NO: 2823322 - RNA, 14 nt, Mycobacterium avium subsp. paratuberculosis
ccgcgcgcggcgcg

SEQ ID NO: 2823323 - RNA, 15 nt, Mycobacterium avium subsp. paratuberculosis
ccgcgcgcggcgcgg

SEQ ID NO: 2823324 - RNA, 23 nt, Mycobacterium avium subsp. paratuberculosis
ccgcgcgcggcgcggagccggcc

SEQ ID NO: 2823325 - RNA, 11 nt, Mycobacterium avium subsp. paratuberculosis
ccgcgcgcggg

SEQ ID NO: 2823326 - RNA, 18 nt, Mycobacterium avium subsp. paratuberculosis
ccgcgcgcgggccagcgu

SEQ ID NO: 2823327 - RNA, 16 nt, Mycobacterium avium subsp. paratuberculosis
ccgcgcgcgucgacgu

SEQ ID NO: 2823328 - RNA, 18 nt, Mycobacterium avium subsp. paratuberculosis
ccgcgcgcgucgacguuc

SEQ ID NO: 2823329 - RNA, 13 nt, Mycobacterium avium subsp. paratuberculosis
ccgcgcgcugcag

SEQ ID NO: 2823330 - RNA, 14 nt, Mycobacterium avium subsp. paratuberculosis
ccgcgcgcugcagc

SEQ ID NO: 2823331 - RNA, 20 nt, Mycobacterium avium subsp. paratuberculosis
ccgcgcgcugccgcgccccg

SEQ ID NO: 2823332 - RNA, 23 nt, Mycobacterium avium subsp. paratuberculosis
ccgcgcgcuguccucgucgggga

SEQ ID NO: 2823333 - RNA, 14 nt, Mycobacterium avium subsp. paratuberculosis
ccgcgcggacgcgg

SEQ ID NO: 2823334 - RNA, 17 nt, Mycobacterium avium subsp. paratuberculosis
ccgcgcggacgcggcgg

SEQ ID NO: 2823335 - RNA, 19 nt, Mycobacterium avium subsp. paratuberculosis
ccgcgcggacgcggcggac

SEQ ID NO: 2823336 - RNA, 22 nt, Mycobacterium avium subsp. paratuberculosis
ccgcgcguucgaguucgucgac

SEQ ID NO: 2823337 - RNA, 23 nt, Mycobacterium avium subsp. paratuberculosis
ccgcgcguucgaguucgucgacc

SEQ ID NO: 2823338 - RNA, 14 nt, Mycobacterium avium subsp. paratuberculosis
ccgcgcucaacccg

SEQ ID NO: 2823339 - RNA, 20 nt, Mycobacterium avium subsp. paratuberculosis
ccgcgcucaacccgggccgg

SEQ ID NO: 2823340 - RNA, 21 nt, Mycobacterium avium subsp. paratuberculosis
ccgcgcucaacccgggccgga

SEQ ID NO: 2823341 - RNA, 22 nt, Mycobacterium avium subsp. paratuberculosis
ccgcgcucaacccgggccggac

SEQ ID NO: 2823342 - RNA, 12 nt, Mycobacterium avium subsp. paratuberculosis
ccgcgcucaccg

SEQ ID NO: 2823343 - RNA, 21 nt, Mycobacterium avium subsp. paratuberculosis
ccgcgcucaccgucgcgguca

SEQ ID NO: 2823344 - RNA, 23 nt, Mycobacterium avium subsp. paratuberculosis
ccgcgcucaccgucgcggucagc

SEQ ID NO: 2823345 - RNA, 21 nt, Mycobacterium avium subsp. paratuberculosis
ccgcgcuccugccagcggcgc

SEQ ID NO: 2823346 - RNA, 19 nt, Mycobacterium avium subsp. paratuberculosis
ccgcgcucgaacucaccgg

SEQ ID NO: 2823347 - RNA, 16 nt, Mycobacterium avium subsp. paratuberculosis
ccgcgcucgcaccagc

SEQ ID NO: 2823348 - RNA, 22 nt, Mycobacterium avium subsp. paratuberculosis
ccgcgcucggccauccgggcgg

SEQ ID NO: 2823349 - RNA, 12 nt, Mycobacterium avium subsp. paratuberculosis
ccgcgcucggcg

SEQ ID NO: 2823350 - RNA, 13 nt, Mycobacterium avium subsp. paratuberculosis
ccgcgcucgucga

SEQ ID NO: 2823351 - RNA, 13 nt, Mycobacterium avium subsp. paratuberculosis
ccgcgcucgugcu

SEQ ID NO: 2823352 - RNA, 24 nt, Mycobacterium avium subsp. paratuberculosis
ccgcgcugaacgcggugggcacca

SEQ ID NO: 2823353 - RNA, 17 nt, Mycobacterium avium subsp. paratuberculosis
ccgcgcugaccagcgug

SEQ ID NO: 2823354 - RNA, 18 nt, Mycobacterium avium subsp. paratuberculosis
ccgcgcugaccagcguga

SEQ ID NO: 2823355 - RNA, 20 nt, Mycobacterium avium subsp. paratuberculosis
ccgcgcugaccagcgugacc

SEQ ID NO: 2823356 - RNA, 15 nt, Mycobacterium avium subsp. paratuberculosis
ccgcgcugcccagcg

SEQ ID NO: 2823357 - RNA, 16 nt, Mycobacterium avium subsp. paratuberculosis
ccgcgcugcccagcgc

SEQ ID NO: 2823358 - RNA, 17 nt, Mycobacterium avium subsp. paratuberculosis
ccgcgcugcccagcgcg

SEQ ID NO: 2823359 - RNA, 18 nt, Mycobacterium avium subsp. paratuberculosis
ccgcgcugcccagcgcgg

SEQ ID NO: 2823360 - RNA, 15 nt, Mycobacterium avium subsp. paratuberculosis
ccgcgcugcgcgcgu

SEQ ID NO: 2823361 - RNA, 21 nt, Mycobacterium avium subsp. paratuberculosis
ccgcgcuggccgaucccggcc

SEQ ID NO: 2823362 - RNA, 22 nt, Mycobacterium avium subsp. paratuberculosis
ccgcgcuggccgaucccggcca

SEQ ID NO: 2823363 - RNA, 13 nt, Mycobacterium avium subsp. paratuberculosis
ccgcgcuggccgg

SEQ ID NO: 2823364 - RNA, 15 nt, Mycobacterium avium subsp. paratuberculosis
ccgcgcuggccgggu

SEQ ID NO: 2823365 - RNA, 22 nt, Mycobacterium avium subsp. paratuberculosis
ccgcgcuggcgcaggcgcuggg

SEQ ID NO: 2823366 - RNA, 15 nt, Mycobacterium avium subsp. paratuberculosis
ccgcgcuggcguuga

SEQ ID NO: 2823367 - RNA, 12 nt, Mycobacterium avium subsp. paratuberculosis
ccgcgcugggcu

SEQ ID NO: 2823368 - RNA, 15 nt, Mycobacterium avium subsp. paratuberculosis
ccgcgcugggcuggc

SEQ ID NO: 2823369 - RNA, 20 nt, Mycobacterium avium subsp. paratuberculosis
ccgcgcuggucaacucgacc

SEQ ID NO: 2823370 - RNA, 12 nt, Mycobacterium avium subsp. paratuberculosis
ccgcgcugucca

SEQ ID NO: 2823371 - RNA, 18 nt, Mycobacterium avium subsp. paratuberculosis
ccgcgcuugacggccggg

SEQ ID NO: 2823372 - RNA, 17 nt, Mycobacterium avium subsp. paratuberculosis
ccgcgcuugccgcgacc

SEQ ID NO: 2823373 - RNA, 20 nt, Mycobacterium avium subsp. paratuberculosis
ccgcgcuugcgaccgccgcu

SEQ ID NO: 2823374 - RNA, 16 nt, Mycobacterium avium subsp. paratuberculosis
ccgcgcuugcgaucgc

SEQ ID NO: 2823375 - RNA, 19 nt, Mycobacterium avium subsp. paratuberculosis
ccgcgcuugcgaucgccgc

SEQ ID NO: 2823376 - RNA, 21 nt, Mycobacterium avium subsp. paratuberculosis
ccgcgcuugcgaucgccgcgc

SEQ ID NO: 2823377 - RNA, 21 nt, Mycobacterium avium subsp. paratuberculosis
ccgcgcuugguggcgacgaag

SEQ ID NO: 2823378 - RNA, 17 nt, Mycobacterium avium subsp. paratuberculosis
ccgcgcuuuggaccagg

SEQ ID NO: 2823379 - RNA, 23 nt, Mycobacterium avium subsp. paratuberculosis
ccgcgcuuuggaccagggcggug

SEQ ID NO: 2823380 - RNA, 23 nt, Mycobacterium avium subsp. paratuberculosis
ccgcggaaccguagaccaccucg

SEQ ID NO: 2823381 - RNA, 16 nt, Mycobacterium avium subsp. paratuberculosis
ccgcggaaggccagcu

SEQ ID NO: 2823382 - RNA, 20 nt, Mycobacterium avium subsp. paratuberculosis
ccgcggaaggccagcuccuc

SEQ ID NO: 2823383 - RNA, 22 nt, Mycobacterium avium subsp. paratuberculosis
ccgcggacauucugcacgacga

SEQ ID NO: 2823384 - RNA, 13 nt, Mycobacterium avium subsp. paratuberculosis
ccgcggaccaccg

SEQ ID NO: 2823385 - RNA, 14 nt, Mycobacterium avium subsp. paratuberculosis
ccgcggaccccagc

SEQ ID NO: 2823386 - RNA, 17 nt, Mycobacterium avium subsp. paratuberculosis
ccgcggaccccagcgug

SEQ ID NO: 2823387 - RNA, 18 nt, Mycobacterium avium subsp. paratuberculosis
ccgcggaccccagcguga

SEQ ID NO: 2823388 - RNA, 21 nt, Mycobacterium avium subsp. paratuberculosis
ccgcggacccgacggucgggc

SEQ ID NO: 2823389 - RNA, 17 nt, Mycobacterium avium subsp. paratuberculosis
ccgcggacggccagccc

SEQ ID NO: 2823390 - RNA, 15 nt, Mycobacterium avium subsp. paratuberculosis
ccgcggacggcgaac

SEQ ID NO: 2823391 - RNA, 22 nt, Mycobacterium avium subsp. paratuberculosis
ccgcggacggguugggcgccag

SEQ ID NO: 2823392 - RNA, 20 nt, Mycobacterium avium subsp. paratuberculosis
ccgcggacuggccaccgcga

SEQ ID NO: 2823393 - RNA, 19 nt, Mycobacterium avium subsp. paratuberculosis
ccgcggagcggcggucacg

SEQ ID NO: 2823394 - RNA, 21 nt, Mycobacterium avium subsp. paratuberculosis
ccgcggaggaauucgccgacg

SEQ ID NO: 2823395 - RNA, 22 nt, Mycobacterium avium subsp. paratuberculosis
ccgcggaggaauucgccgacgc

SEQ ID NO: 2823396 - RNA, 23 nt, Mycobacterium avium subsp. paratuberculosis
ccgcggaugaccaggucgccggc

SEQ ID NO: 2823397 - RNA, 20 nt, Mycobacterium avium subsp. paratuberculosis
ccgcggaugacgggugcuca

SEQ ID NO: 2823398 - RNA, 15 nt, Mycobacterium avium subsp. paratuberculosis
ccgcggauggugacg

SEQ ID NO: 2823399 - RNA, 19 nt, Mycobacterium avium subsp. paratuberculosis
ccgcggauggugacggccg

SEQ ID NO: 2823400 - RNA, 22 nt, Mycobacterium avium subsp. paratuberculosis
ccgcggauggugacggccguga

SEQ ID NO: 2823401 - RNA, 16 nt, Mycobacterium avium subsp. paratuberculosis
ccgcggauguggaggc

SEQ ID NO: 2823402 - RNA, 19 nt, Mycobacterium avium subsp. paratuberculosis
ccgcggauguggaggcgag

SEQ ID NO: 2823403 - RNA, 20 nt, Mycobacterium avium subsp. paratuberculosis
ccgcggauguggaggcgagc

SEQ ID NO: 2823404 - RNA, 21 nt, Mycobacterium avium subsp. paratuberculosis
ccgcggauguggaggcgagca

SEQ ID NO: 2823405 - RNA, 16 nt, Mycobacterium avium subsp. paratuberculosis
ccgcggauuccagcgc

SEQ ID NO: 2823406 - RNA, 19 nt, Mycobacterium avium subsp. paratuberculosis
ccgcggauuccggcaucgg

SEQ ID NO: 2823407 - RNA, 14 nt, Mycobacterium avium subsp. paratuberculosis
ccgcggcaaggcgu

SEQ ID NO: 2823408 - RNA, 18 nt, Mycobacterium avium subsp. paratuberculosis
ccgcggcaaggcguucca

SEQ ID NO: 2823409 - RNA, 13 nt, Mycobacterium avium subsp. paratuberculosis
ccgcggcaccuuc

SEQ ID NO: 2823410 - RNA, 19 nt, Mycobacterium avium subsp. paratuberculosis
ccgcggcaccuucaccgac

SEQ ID NO: 2823411 - RNA, 17 nt, Mycobacterium avium subsp. paratuberculosis
ccgcggcacgcugcgcc

SEQ ID NO: 2823412 - RNA, 20 nt, Mycobacterium avium subsp. paratuberculosis
ccgcggcacgcugcgccagc

SEQ ID NO: 2823413 - RNA, 11 nt, Mycobacterium avium subsp. paratuberculosis
ccgcggcagcc

SEQ ID NO: 2823414 - RNA, 15 nt, Mycobacterium avium subsp. paratuberculosis
ccgcggcagccagcc

SEQ ID NO: 2823415 - RNA, 18 nt, Mycobacterium avium subsp. paratuberculosis
ccgcggcagccagccugg

SEQ ID NO: 2823416 - RNA, 15 nt, Mycobacterium avium subsp. paratuberculosis
ccgcggcagccgggc

SEQ ID NO: 2823417 - RNA, 13 nt, Mycobacterium avium subsp. paratuberculosis
ccgcggccaaccc

SEQ ID NO: 2823418 - RNA, 19 nt, Mycobacterium avium subsp. paratuberculosis
ccgcggccaacccgggcgc

SEQ ID NO: 2823419 - RNA, 22 nt, Mycobacterium avium subsp. paratuberculosis
ccgcggccaagugcggucgguu

SEQ ID NO: 2823420 - RNA, 12 nt, Mycobacterium avium subsp. paratuberculosis
ccgcggcgccga

SEQ ID NO: 2823421 - RNA, 16 nt, Mycobacterium avium subsp. paratuberculosis
ccgcggcgccgauggc

SEQ ID NO: 2823422 - RNA, 18 nt, Mycobacterium avium subsp. paratuberculosis
ccgcggcgccgauggcga

SEQ ID NO: 2823423 - RNA, 14 nt, Mycobacterium avium subsp. paratuberculosis
ccgcggcgccgcca

SEQ ID NO: 2823424 - RNA, 15 nt, Mycobacterium avium subsp. paratuberculosis
ccgcggcgccgccac

SEQ ID NO: 2823425 - RNA, 14 nt, Mycobacterium avium subsp. paratuberculosis
ccgcggcgccgcgg

SEQ ID NO: 2823426 - RNA, 15 nt, Mycobacterium avium subsp. paratuberculosis
ccgcggcgccgcggc

SEQ ID NO: 2823427 - RNA, 17 nt, Mycobacterium avium subsp. paratuberculosis
ccgcggcgccgcggcgg

SEQ ID NO: 2823428 - RNA, 20 nt, Mycobacterium avium subsp. paratuberculosis
ccgcggcgccgcggcggcac

SEQ ID NO: 2823429 - RNA, 12 nt, Mycobacterium avium subsp. paratuberculosis
ccgcggcgccgg

SEQ ID NO: 2823430 - RNA, 14 nt, Mycobacterium avium subsp. paratuberculosis
ccgcggcgccgggc

SEQ ID NO: 2823431 - RNA, 15 nt, Mycobacterium avium subsp. paratuberculosis
ccgcggcgccgggcg

SEQ ID NO: 2823432 - RNA, 20 nt, Mycobacterium avium subsp. paratuberculosis
ccgcggcgccgggcggcccg

SEQ ID NO: 2823433 - RNA, 22 nt, Mycobacterium avium subsp. paratuberculosis
ccgcggcgccguagguggccau

SEQ ID NO: 2823434 - RNA, 17 nt, Mycobacterium avium subsp. paratuberculosis
ccgcggcgccgucgaac

SEQ ID NO: 2823435 - RNA, 15 nt, Mycobacterium avium subsp. paratuberculosis
ccgcggcgccguuga

SEQ ID NO: 2823436 - RNA, 20 nt, Mycobacterium avium subsp. paratuberculosis
ccgcggcgccguugaccggc

SEQ ID NO: 2823437 - RNA, 21 nt, Mycobacterium avium subsp. paratuberculosis
ccgcggcgcgaugaucgccgg

SEQ ID NO: 2823438 - RNA, 14 nt, Mycobacterium avium subsp. paratuberculosis
ccgcggcgcgcagg

SEQ ID NO: 2823439 - RNA, 18 nt, Mycobacterium avium subsp. paratuberculosis
ccgcggcgcgcaucgccg

SEQ ID NO: 2823440 - RNA, 19 nt, Mycobacterium avium subsp. paratuberculosis
ccgcggcgcgcaucgccgu

SEQ ID NO: 2823441 - RNA, 20 nt, Mycobacterium avium subsp. paratuberculosis
ccgcggcgcgcaucgccguc

SEQ ID NO: 2823442 - RNA, 14 nt, Mycobacterium avium subsp. paratuberculosis
ccgcggcgcgcggc

SEQ ID NO: 2823443 - RNA, 17 nt, Mycobacterium avium subsp. paratuberculosis
ccgcggcgcgcggccgc

SEQ ID NO: 2823444 - RNA, 19 nt, Mycobacterium avium subsp. paratuberculosis
ccgcggcgcgcggccgcga

SEQ ID NO: 2823445 - RNA, 12 nt, Mycobacterium avium subsp. paratuberculosis
ccgcggcgcggc

SEQ ID NO: 2823446 - RNA, 16 nt, Mycobacterium avium subsp. paratuberculosis
ccgcggcgcggcccgg

SEQ ID NO: 2823447 - RNA, 17 nt, Mycobacterium avium subsp. paratuberculosis
ccgcggcgcggcccggc

SEQ ID NO: 2823448 - RNA, 19 nt, Mycobacterium avium subsp. paratuberculosis
ccgcggcgcggcccggccc

SEQ ID NO: 2823449 - RNA, 21 nt, Mycobacterium avium subsp. paratuberculosis
ccgcggcgcggcccggcccgc

SEQ ID NO: 2823450 - RNA, 23 nt, Mycobacterium avium subsp. paratuberculosis
ccgcggcgcgguugacguagauc

SEQ ID NO: 2823451 - RNA, 18 nt, Mycobacterium avium subsp. paratuberculosis
ccgcggcgcuugaccucg

SEQ ID NO: 2823452 - RNA, 19 nt, Mycobacterium avium subsp. paratuberculosis
ccgcggcgcuugaccucgc

SEQ ID NO: 2823453 - RNA, 23 nt, Mycobacterium avium subsp. paratuberculosis
ccgcggcgcuugaccucgccgag

SEQ ID NO: 2823454 - RNA, 20 nt, Mycobacterium avium subsp. paratuberculosis
ccgcggcggauccagcaccg

SEQ ID NO: 2823455 - RNA, 22 nt, Mycobacterium avium subsp. paratuberculosis
ccgcggcggauccagcaccgcc

SEQ ID NO: 2823456 - RNA, 13 nt, Mycobacterium avium subsp. paratuberculosis
ccgcggcggcacc

SEQ ID NO: 2823457 - RNA, 18 nt, Mycobacterium avium subsp. paratuberculosis
ccgcggcggcacccaggu

SEQ ID NO: 2823458 - RNA, 12 nt, Mycobacterium avium subsp. paratuberculosis
ccgcggcggcag

SEQ ID NO: 2823459 - RNA, 16 nt, Mycobacterium avium subsp. paratuberculosis
ccgcggcggcagcacc

SEQ ID NO: 2823460 - RNA, 17 nt, Mycobacterium avium subsp. paratuberculosis
ccgcggcggcagcaccc

SEQ ID NO: 2823461 - RNA, 21 nt, Mycobacterium avium subsp. paratuberculosis
ccgcggcggccaucucgugcc

SEQ ID NO: 2823462 - RNA, 15 nt, Mycobacterium avium subsp. paratuberculosis
ccgcggcggcccggc

SEQ ID NO: 2823463 - RNA, 15 nt, Mycobacterium avium subsp. paratuberculosis
ccgcggcggccugcu

SEQ ID NO: 2823464 - RNA, 11 nt, Mycobacterium avium subsp. paratuberculosis
ccgcggcggcg

SEQ ID NO: 2823465 - RNA, 12 nt, Mycobacterium avium subsp. paratuberculosis
ccgcggcggcgc

SEQ ID NO: 2823466 - RNA, 15 nt, Mycobacterium avium subsp. paratuberculosis
ccgcggcggcgccga

SEQ ID NO: 2823467 - RNA, 17 nt, Mycobacterium avium subsp. paratuberculosis
ccgcggcggcgccgacg

SEQ ID NO: 2823468 - RNA, 18 nt, Mycobacterium avium subsp. paratuberculosis
ccgcggcggcgccgacgg

SEQ ID NO: 2823469 - RNA, 13 nt, Mycobacterium avium subsp. paratuberculosis
ccgcggcggcggc

SEQ ID NO: 2823470 - RNA, 17 nt, Mycobacterium avium subsp. paratuberculosis
ccgcggcggcggcccgu

SEQ ID NO: 2823471 - RNA, 12 nt, Mycobacterium avium subsp. paratuberculosis
ccgcggcggcgu

SEQ ID NO: 2823472 - RNA, 19 nt, Mycobacterium avium subsp. paratuberculosis
ccgcggcggcgucgaccgc

SEQ ID NO: 2823473 - RNA, 23 nt, Mycobacterium avium subsp. paratuberculosis
ccgcggcggcgucgaccgccccg

SEQ ID NO: 2823474 - RNA, 13 nt, Mycobacterium avium subsp. paratuberculosis
ccgcggcggcgug

SEQ ID NO: 2823475 - RNA, 19 nt, Mycobacterium avium subsp. paratuberculosis
ccgcggcggcgugccgccc

SEQ ID NO: 2823476 - RNA, 14 nt, Mycobacterium avium subsp. paratuberculosis
ccgcggcggcucgg

SEQ ID NO: 2823477 - RNA, 12 nt, Mycobacterium avium subsp. paratuberculosis
ccgcggcgggca

SEQ ID NO: 2823478 - RNA, 18 nt, Mycobacterium avium subsp. paratuberculosis
ccgcggcgggcgcgucga

SEQ ID NO: 2823479 - RNA, 21 nt, Mycobacterium avium subsp. paratuberculosis
ccgcggcgggcgcgucgaggu

SEQ ID NO: 2823480 - RNA, 13 nt, Mycobacterium avium subsp. paratuberculosis
ccgcggcgggguc

SEQ ID NO: 2823481 - RNA, 11 nt, Mycobacterium avium subsp. paratuberculosis
ccgcggcgguc

SEQ ID NO: 2823482 - RNA, 13 nt, Mycobacterium avium subsp. paratuberculosis
ccgcggcggucgc

SEQ ID NO: 2823483 - RNA, 16 nt, Mycobacterium avium subsp. paratuberculosis
ccgcggcggucgccac

SEQ ID NO: 2823484 - RNA, 20 nt, Mycobacterium avium subsp. paratuberculosis
ccgcggcggucgccacucgg

SEQ ID NO: 2823485 - RNA, 14 nt, Mycobacterium avium subsp. paratuberculosis
ccgcggcggugccg

SEQ ID NO: 2823486 - RNA, 15 nt, Mycobacterium avium subsp. paratuberculosis
ccgcggcggugccgg

SEQ ID NO: 2823487 - RNA, 18 nt, Mycobacterium avium subsp. paratuberculosis
ccgcggcggugccggugu

SEQ ID NO: 2823488 - RNA, 13 nt, Mycobacterium avium subsp. paratuberculosis
ccgcggcgguguc

SEQ ID NO: 2823489 - RNA, 14 nt, Mycobacterium avium subsp. paratuberculosis
ccgcggcggugucg

SEQ ID NO: 2823490 - RNA, 17 nt, Mycobacterium avium subsp. paratuberculosis
ccgcggcggugucggcg

SEQ ID NO: 2823491 - RNA, 22 nt, Mycobacterium avium subsp. paratuberculosis
ccgcggcguagcgccagucgcg

SEQ ID NO: 2823492 - RNA, 13 nt, Mycobacterium avium subsp. paratuberculosis
ccgcggcgucauc

SEQ ID NO: 2823493 - RNA, 13 nt, Mycobacterium avium subsp. paratuberculosis
ccgcggcgucccg

SEQ ID NO: 2823494 - RNA, 16 nt, Mycobacterium avium subsp. paratuberculosis
ccgcggcuccagcagc

SEQ ID NO: 2823495 - RNA, 13 nt, Mycobacterium avium subsp. paratuberculosis
ccgcggcuccggc

SEQ ID NO: 2823496 - RNA, 16 nt, Mycobacterium avium subsp. paratuberculosis
ccgcggcuccggccgc

SEQ ID NO: 2823497 - RNA, 17 nt, Mycobacterium avium subsp. paratuberculosis
ccgcggcuccggccgcg

SEQ ID NO: 2823498 - RNA, 18 nt, Mycobacterium avium subsp. paratuberculosis
ccgcggcuccggccgcgc

SEQ ID NO: 2823499 - RNA, 12 nt, Mycobacterium avium subsp. paratuberculosis
ccgcggcucgau

SEQ ID NO: 2823500 - RNA, 21 nt, Mycobacterium avium subsp. paratuberculosis
ccgcggcucgauggacgccag

SEQ ID NO: 2823501 - RNA, 23 nt, Mycobacterium avium subsp. paratuberculosis
ccgcggcucgauggacgccagca

SEQ ID NO: 2823502 - RNA, 19 nt, Mycobacterium avium subsp. paratuberculosis
ccgcggcucgcgacgcggc

SEQ ID NO: 2823503 - RNA, 15 nt, Mycobacterium avium subsp. paratuberculosis
ccgcggcucggucgc

SEQ ID NO: 2823504 - RNA, 16 nt, Mycobacterium avium subsp. paratuberculosis
ccgcgggacacggcgg

SEQ ID NO: 2823505 - RNA, 20 nt, Mycobacterium avium subsp. paratuberculosis
ccgcggugagcggccgcagc

SEQ ID NO: 2823506 - RNA, 16 nt, Mycobacterium avium subsp. paratuberculosis
ccgcggugaguucauc

SEQ ID NO: 2823507 - RNA, 13 nt, Mycobacterium avium subsp. paratuberculosis
ccgcggugaugcc

SEQ ID NO: 2823508 - RNA, 15 nt, Mycobacterium avium subsp. paratuberculosis
ccgcggugaugccga

SEQ ID NO: 2823509 - RNA, 13 nt, Mycobacterium avium subsp. paratuberculosis
ccgcggugcagca

SEQ ID NO: 2823510 - RNA, 16 nt, Mycobacterium avium subsp. paratuberculosis
ccgcggugcagucggu

SEQ ID NO: 2823511 - RNA, 15 nt, Mycobacterium avium subsp. paratuberculosis
ccgcggugccgcagc

SEQ ID NO: 2823512 - RNA, 16 nt, Mycobacterium avium subsp. paratuberculosis
ccgcggugccgcagcu

SEQ ID NO: 2823513 - RNA, 17 nt, Mycobacterium avium subsp. paratuberculosis
ccgcggugccgcagcuc

SEQ ID NO: 2823514 - RNA, 13 nt, Mycobacterium avium subsp. paratuberculosis
ccgcggugcgcca

SEQ ID NO: 2823515 - RNA, 22 nt, Mycobacterium avium subsp. paratuberculosis
ccgcggugcgccacgcccgcag

SEQ ID NO: 2823516 - RNA, 14 nt, Mycobacterium avium subsp. paratuberculosis
ccgcggugcggccc

SEQ ID NO: 2823517 - RNA, 15 nt, Mycobacterium avium subsp. paratuberculosis
ccgcggugcggcccg

SEQ ID NO: 2823518 - RNA, 19 nt, Mycobacterium avium subsp. paratuberculosis
ccgcggugcguuugaugac

SEQ ID NO: 2823519 - RNA, 22 nt, Mycobacterium avium subsp. paratuberculosis
ccgcggugcguuugaugacgcg

SEQ ID NO: 2823520 - RNA, 23 nt, Mycobacterium avium subsp. paratuberculosis
ccgcggugcguuugaugacgcga

SEQ ID NO: 2823521 - RNA, 13 nt, Mycobacterium avium subsp. paratuberculosis
ccgcggugcugau

SEQ ID NO: 2823522 - RNA, 19 nt, Mycobacterium avium subsp. paratuberculosis
ccgcggugcugcagcgcga

SEQ ID NO: 2823523 - RNA, 20 nt, Mycobacterium avium subsp. paratuberculosis
ccgcggugcugcagcgcgag

SEQ ID NO: 2823524 - RNA, 20 nt, Mycobacterium avium subsp. paratuberculosis
ccgcgguggaacccagcacc

SEQ ID NO: 2823525 - RNA, 21 nt, Mycobacterium avium subsp. paratuberculosis
ccgcgguggaacccagcaccc

SEQ ID NO: 2823526 - RNA, 16 nt, Mycobacterium avium subsp. paratuberculosis
ccgcgguggccgggau

SEQ ID NO: 2823527 - RNA, 12 nt, Mycobacterium avium subsp. paratuberculosis
ccgcgguggcgc

SEQ ID NO: 2823528 - RNA, 15 nt, Mycobacterium avium subsp. paratuberculosis
ccgcgguggcggugc

SEQ ID NO: 2823529 - RNA, 15 nt, Mycobacterium avium subsp. paratuberculosis
ccgcgguggcggugu

SEQ ID NO: 2823530 - RNA, 13 nt, Mycobacterium avium subsp. paratuberculosis
ccgcggugggcca

SEQ ID NO: 2823531 - RNA, 14 nt, Mycobacterium avium subsp. paratuberculosis
ccgcggugggccag

SEQ ID NO: 2823532 - RNA, 18 nt, Mycobacterium avium subsp. paratuberculosis
ccgcgguggguccgccgg

SEQ ID NO: 2823533 - RNA, 20 nt, Mycobacterium avium subsp. paratuberculosis
ccgcgguggguccgccgggc

SEQ ID NO: 2823534 - RNA, 14 nt, Mycobacterium avium subsp. paratuberculosis
ccgcgguggugauu

SEQ ID NO: 2823535 - RNA, 14 nt, Mycobacterium avium subsp. paratuberculosis
ccgcgguggugggc

SEQ ID NO: 2823536 - RNA, 16 nt, Mycobacterium avium subsp. paratuberculosis
ccgcgguggugggcgc

SEQ ID NO: 2823537 - RNA, 16 nt, Mycobacterium avium subsp. paratuberculosis
ccgcggugugcccggc

SEQ ID NO: 2823538 - RNA, 18 nt, Mycobacterium avium subsp. paratuberculosis
ccgcggugugcccggcgu

SEQ ID NO: 2823539 - RNA, 16 nt, Mycobacterium avium subsp. paratuberculosis
ccgcggugugcuggcc

SEQ ID NO: 2823540 - RNA, 17 nt, Mycobacterium avium subsp. paratuberculosis
ccgcggugugcuggcca

SEQ ID NO: 2823541 - RNA, 18 nt, Mycobacterium avium subsp. paratuberculosis
ccgcggugugcuggccag

SEQ ID NO: 2823542 - RNA, 20 nt, Mycobacterium avium subsp. paratuberculosis
ccgcggugugcuggccagca

SEQ ID NO: 2823543 - RNA, 23 nt, Mycobacterium avium subsp. paratuberculosis
ccgcggugugcuggccagcacca

SEQ ID NO: 2823544 - RNA, 15 nt, Mycobacterium avium subsp. paratuberculosis
ccgcgguucggcguc

SEQ ID NO: 2823545 - RNA, 19 nt, Mycobacterium avium subsp. paratuberculosis
ccgcgguucggcgucgguc

SEQ ID NO: 2823546 - RNA, 14 nt, Mycobacterium avium subsp. paratuberculosis
ccgcgguuggucac

SEQ ID NO: 2823547 - RNA, 20 nt, Mycobacterium avium subsp. paratuberculosis
ccgcgguuggucaccagguc

SEQ ID NO: 2823548 - RNA, 19 nt, Mycobacterium avium subsp. paratuberculosis
ccgcgguuucaccgugcgc

SEQ ID NO: 2823549 - RNA, 16 nt, Mycobacterium avium subsp. paratuberculosis
ccgcgguuuggucagc

SEQ ID NO: 2823550 - RNA, 21 nt, Mycobacterium avium subsp. paratuberculosis
ccgcgguuuggucagcgcccc

SEQ ID NO: 2823551 - RNA, 16 nt, Mycobacterium avium subsp. paratuberculosis
ccgcguaaccggcggc

SEQ ID NO: 2823552 - RNA, 17 nt, Mycobacterium avium subsp. paratuberculosis
ccgcguaaccggcggcg

SEQ ID NO: 2823553 - RNA, 14 nt, Mycobacterium avium subsp. paratuberculosis
ccgcguacaccggc

SEQ ID NO: 2823554 - RNA, 15 nt, Mycobacterium avium subsp. paratuberculosis
ccgcguacaccggcu

SEQ ID NO: 2823555 - RNA, 16 nt, Mycobacterium avium subsp. paratuberculosis
ccgcguacaccggcug

SEQ ID NO: 2823556 - RNA, 19 nt, Mycobacterium avium subsp. paratuberculosis
ccgcguacaccggcugacc

SEQ ID NO: 2823557 - RNA, 20 nt, Mycobacterium avium subsp. paratuberculosis
ccgcguacaccggcugaccg

SEQ ID NO: 2823558 - RNA, 22 nt, Mycobacterium avium subsp. paratuberculosis
ccgcguacaccggcugaccggc

SEQ ID NO: 2823559 - RNA, 14 nt, Mycobacterium avium subsp. paratuberculosis
ccgcguacagcagc

SEQ ID NO: 2823560 - RNA, 18 nt, Mycobacterium avium subsp. paratuberculosis
ccgcguacagggcgucgg

SEQ ID NO: 2823561 - RNA, 14 nt, Mycobacterium avium subsp. paratuberculosis
ccgcguaccagcgc

SEQ ID NO: 2823562 - RNA, 13 nt, Mycobacterium avium subsp. paratuberculosis
ccgcguacgccgc

SEQ ID NO: 2823563 - RNA, 23 nt, Mycobacterium avium subsp. paratuberculosis
ccgcguacuucgcgcccuggauc

SEQ ID NO: 2823564 - RNA, 15 nt, Mycobacterium avium subsp. paratuberculosis
ccgcguagcgccgcc

SEQ ID NO: 2823565 - RNA, 21 nt, Mycobacterium avium subsp. paratuberculosis
ccgcguagcucgccgcggcca

SEQ ID NO: 2823566 - RNA, 24 nt, Mycobacterium avium subsp. paratuberculosis
ccgcguagcucgccgcggccacgc

SEQ ID NO: 2823567 - RNA, 22 nt, Mycobacterium avium subsp. paratuberculosis
ccgcguaggccaggaccgggac

SEQ ID NO: 2823568 - RNA, 20 nt, Mycobacterium avium subsp. paratuberculosis
ccgcguaggucuucggugaa

SEQ ID NO: 2823569 - RNA, 22 nt, Mycobacterium avium subsp. paratuberculosis
ccgcguagucguugucggcggu

SEQ ID NO: 2823570 - RNA, 18 nt, Mycobacterium avium subsp. paratuberculosis
ccgcguauugcacggcgg

SEQ ID NO: 2823571 - RNA, 21 nt, Mycobacterium avium subsp. paratuberculosis
ccgcguauugcacggcggcga

SEQ ID NO: 2823572 - RNA, 16 nt, Mycobacterium avium subsp. paratuberculosis
ccgcgucacgucggcc

SEQ ID NO: 2823573 - RNA, 19 nt, Mycobacterium avium subsp. paratuberculosis
ccgcgucacgucggccugc

SEQ ID NO: 2823574 - RNA, 15 nt, Mycobacterium avium subsp. paratuberculosis
ccgcgucagcagcgc

SEQ ID NO: 2823575 - RNA, 16 nt, Mycobacterium avium subsp. paratuberculosis
ccgcgucagcagcgcg

SEQ ID NO: 2823576 - RNA, 17 nt, Mycobacterium avium subsp. paratuberculosis
ccgcgucaucgggcccg

SEQ ID NO: 2823577 - RNA, 19 nt, Mycobacterium avium subsp. paratuberculosis
ccgcgucaucgggcccgac

SEQ ID NO: 2823578 - RNA, 22 nt, Mycobacterium avium subsp. paratuberculosis
ccgcgucaucgggcccgacgac

SEQ ID NO: 2823579 - RNA, 12 nt, Mycobacterium avium subsp. paratuberculosis
ccgcguccacga

SEQ ID NO: 2823580 - RNA, 15 nt, Mycobacterium avium subsp. paratuberculosis
ccgcguccagcagca

SEQ ID NO: 2823581 - RNA, 22 nt, Mycobacterium avium subsp. paratuberculosis
ccgcguccagcagcauguuggc

SEQ ID NO: 2823582 - RNA, 18 nt, Mycobacterium avium subsp. paratuberculosis
ccgcguccgaggcgguuc

SEQ ID NO: 2823583 - RNA, 18 nt, Mycobacterium avium subsp. paratuberculosis
ccgcguccgcgucgucga

SEQ ID NO: 2823584 - RNA, 15 nt, Mycobacterium avium subsp. paratuberculosis
ccgcguccucgccgu

SEQ ID NO: 2823585 - RNA, 15 nt, Mycobacterium avium subsp. paratuberculosis
ccgcguccucgucga

SEQ ID NO: 2823586 - RNA, 17 nt, Mycobacterium avium subsp. paratuberculosis
ccgcguccucgucgaug

SEQ ID NO: 2823587 - RNA, 16 nt, Mycobacterium avium subsp. paratuberculosis
ccgcguccugcagcgc

SEQ ID NO: 2823588 - RNA, 18 nt, Mycobacterium avium subsp. paratuberculosis
ccgcguccugcagcgccg

SEQ ID NO: 2823589 - RNA, 20 nt, Mycobacterium avium subsp. paratuberculosis
ccgcguccugcagcgccguc

SEQ ID NO: 2823590 - RNA, 16 nt, Mycobacterium avium subsp. paratuberculosis
ccgcguugucggcgac

SEQ ID NO: 2823591 - RNA, 20 nt, Mycobacterium avium subsp. paratuberculosis
ccgcguugucggcgacggcg

SEQ ID NO: 2823592 - RNA, 22 nt, Mycobacterium avium subsp. paratuberculosis
ccgcguugucggcgacggcggg

SEQ ID NO: 2823593 - RNA, 15 nt, Mycobacterium avium subsp. paratuberculosis
ccgcguugucggcgu

SEQ ID NO: 2823594 - RNA, 18 nt, Mycobacterium avium subsp. paratuberculosis
ccgcguugugcaccaaca

SEQ ID NO: 2823595 - RNA, 16 nt, Mycobacterium avium subsp. paratuberculosis
ccgcuaaagccgacug

SEQ ID NO: 2823596 - RNA, 17 nt, Mycobacterium avium subsp. paratuberculosis
ccgcuaaagccgacugc

SEQ ID NO: 2823597 - RNA, 23 nt, Mycobacterium avium subsp. paratuberculosis
ccgcuaaagccgacugccccgcu

SEQ ID NO: 2823598 - RNA, 21 nt, Mycobacterium avium subsp. paratuberculosis
ccgcuaacucacggcgcgauc

SEQ ID NO: 2823599 - RNA, 14 nt, Mycobacterium avium subsp. paratuberculosis
ccgcuacccggcga

SEQ ID NO: 2823600 - RNA, 21 nt, Mycobacterium avium subsp. paratuberculosis
ccgcuagguuuggccagcacc

SEQ ID NO: 2823601 - RNA, 16 nt, Mycobacterium avium subsp. paratuberculosis
ccgcuagucgcccagc

SEQ ID NO: 2823602 - RNA, 18 nt, Mycobacterium avium subsp. paratuberculosis
ccgcucaacuugaucagc

SEQ ID NO: 2823603 - RNA, 18 nt, Mycobacterium avium subsp. paratuberculosis
ccgcucaaguccucggug

SEQ ID NO: 2823604 - RNA, 13 nt, Mycobacterium avium subsp. paratuberculosis
ccgcucacacagc

SEQ ID NO: 2823605 - RNA, 16 nt, Mycobacterium avium subsp. paratuberculosis
ccgcucacacagccgc

SEQ ID NO: 2823606 - RNA, 14 nt, Mycobacterium avium subsp. paratuberculosis
ccgcucaccgccga

SEQ ID NO: 2823607 - RNA, 17 nt, Mycobacterium avium subsp. paratuberculosis
ccgcucaccgccgagcc

SEQ ID NO: 2823608 - RNA, 19 nt, Mycobacterium avium subsp. paratuberculosis
ccgcucaccgccgagccgc

SEQ ID NO: 2823609 - RNA, 19 nt, Mycobacterium avium subsp. paratuberculosis
ccgcucaccugcggcccgu

SEQ ID NO: 2823610 - RNA, 20 nt, Mycobacterium avium subsp. paratuberculosis
ccgcucaccugcggcccguc

SEQ ID NO: 2823611 - RNA, 23 nt, Mycobacterium avium subsp. paratuberculosis
ccgcucaccugcggcccgucgcc

SEQ ID NO: 2823612 - RNA, 23 nt, Mycobacterium avium subsp. paratuberculosis
ccgcucagagcugcaccggguac

SEQ ID NO: 2823613 - RNA, 19 nt, Mycobacterium avium subsp. paratuberculosis
ccgcucagcgauugcggcc

SEQ ID NO: 2823614 - RNA, 17 nt, Mycobacterium avium subsp. paratuberculosis
ccgcucagcgggcggcc

SEQ ID NO: 2823615 - RNA, 21 nt, Mycobacterium avium subsp. paratuberculosis
ccgcucagcgggcggccagcc

SEQ ID NO: 2823616 - RNA, 13 nt, Mycobacterium avium subsp. paratuberculosis
ccgcucaggucgg

SEQ ID NO: 2823617 - RNA, 18 nt, Mycobacterium avium subsp. paratuberculosis
ccgcucaggucggccgcg

SEQ ID NO: 2823618 - RNA, 20 nt, Mycobacterium avium subsp. paratuberculosis
ccgcucaggucggccgcggc

SEQ ID NO: 2823619 - RNA, 22 nt, Mycobacterium avium subsp. paratuberculosis
ccgcucaggucggccgcggccg

SEQ ID NO: 2823620 - RNA, 15 nt, Mycobacterium avium subsp. paratuberculosis
ccgcuccaccagcgc

SEQ ID NO: 2823621 - RNA, 14 nt, Mycobacterium avium subsp. paratuberculosis
ccgcuccaccgcgu

SEQ ID NO: 2823622 - RNA, 17 nt, Mycobacterium avium subsp. paratuberculosis
ccgcuccaugaaccggu

SEQ ID NO: 2823623 - RNA, 14 nt, Mycobacterium avium subsp. paratuberculosis
ccgcuccccgagca

SEQ ID NO: 2823624 - RNA, 16 nt, Mycobacterium avium subsp. paratuberculosis
ccgcuccccgagcacg

SEQ ID NO: 2823625 - RNA, 17 nt, Mycobacterium avium subsp. paratuberculosis
ccgcuccccgauccggc

SEQ ID NO: 2823626 - RNA, 13 nt, Mycobacterium avium subsp. paratuberculosis
ccgcucccgcagc

SEQ ID NO: 2823627 - RNA, 17 nt, Mycobacterium avium subsp. paratuberculosis
ccgcucccggcgcagca

SEQ ID NO: 2823628 - RNA, 17 nt, Mycobacterium avium subsp. paratuberculosis
ccgcucccgggacagcc

SEQ ID NO: 2823629 - RNA, 17 nt, Mycobacterium avium subsp. paratuberculosis
ccgcuccgacgcggugg

SEQ ID NO: 2823630 - RNA, 18 nt, Mycobacterium avium subsp. paratuberculosis
ccgcuccgacgcgguggc

SEQ ID NO: 2823631 - RNA, 13 nt, Mycobacterium avium subsp. paratuberculosis
ccgcuccgcggcg

SEQ ID NO: 2823632 - RNA, 15 nt, Mycobacterium avium subsp. paratuberculosis
ccgcuccgcggcggg

SEQ ID NO: 2823633 - RNA, 16 nt, Mycobacterium avium subsp. paratuberculosis
ccgcuccgcggcgggc

SEQ ID NO: 2823634 - RNA, 18 nt, Mycobacterium avium subsp. paratuberculosis
ccgcuccgcggcgggcgu

SEQ ID NO: 2823635 - RNA, 15 nt, Mycobacterium avium subsp. paratuberculosis
ccgcuccgcgggcag

SEQ ID NO: 2823636 - RNA, 12 nt, Mycobacterium avium subsp. paratuberculosis
ccgcuccgcggu

SEQ ID NO: 2823637 - RNA, 14 nt, Mycobacterium avium subsp. paratuberculosis
ccgcuccggcccga

SEQ ID NO: 2823638 - RNA, 15 nt, Mycobacterium avium subsp. paratuberculosis
ccgcuccggcccgag

SEQ ID NO: 2823639 - RNA, 16 nt, Mycobacterium avium subsp. paratuberculosis
ccgcuccggcccgagc

SEQ ID NO: 2823640 - RNA, 21 nt, Mycobacterium avium subsp. paratuberculosis
ccgcuccggcccgagcaccac

SEQ ID NO: 2823641 - RNA, 15 nt, Mycobacterium avium subsp. paratuberculosis
ccgcuccggucgcgu

SEQ ID NO: 2823642 - RNA, 19 nt, Mycobacterium avium subsp. paratuberculosis
ccgcuccggucgcgucgug

SEQ ID NO: 2823643 - RNA, 20 nt, Mycobacterium avium subsp. paratuberculosis
ccgcuccggucgcgucgugc

SEQ ID NO: 2823644 - RNA, 17 nt, Mycobacterium avium subsp. paratuberculosis
ccgcuccuccucgcgcc

SEQ ID NO: 2823645 - RNA, 22 nt, Mycobacterium avium subsp. paratuberculosis
ccgcuccugcaggccgagccgc

SEQ ID NO: 2823646 - RNA, 13 nt, Mycobacterium avium subsp. paratuberculosis
ccgcucgaacacc

SEQ ID NO: 2823647 - RNA, 15 nt, Mycobacterium avium subsp. paratuberculosis
ccgcucgaacacccg

SEQ ID NO: 2823648 - RNA, 23 nt, Mycobacterium avium subsp. paratuberculosis
ccgcucgaucuggcggacccgcu

SEQ ID NO: 2823649 - RNA, 15 nt, Mycobacterium avium subsp. paratuberculosis
ccgcucgauggcgcc

SEQ ID NO: 2823650 - RNA, 19 nt, Mycobacterium avium subsp. paratuberculosis
ccgcucgauggcgccgauc

SEQ ID NO: 2823651 - RNA, 16 nt, Mycobacterium avium subsp. paratuberculosis
ccgcucgaugggugug

SEQ ID NO: 2823652 - RNA, 22 nt, Mycobacterium avium subsp. paratuberculosis
ccgcucgccaugcgaccacgac

SEQ ID NO: 2823653 - RNA, 16 nt, Mycobacterium avium subsp. paratuberculosis
ccgcucgcccagcgcg

SEQ ID NO: 2823654 - RNA, 17 nt, Mycobacterium avium subsp. paratuberculosis
ccgcucgcccagcgcgg

SEQ ID NO: 2823655 - RNA, 18 nt, Mycobacterium avium subsp. paratuberculosis
ccgcucgcccagcgcggc

SEQ ID NO: 2823656 - RNA, 20 nt, Mycobacterium avium subsp. paratuberculosis
ccgcucgcccagcgcggcgg

SEQ ID NO: 2823657 - RNA, 21 nt, Mycobacterium avium subsp. paratuberculosis
ccgcucgcccagcgcggcggc

SEQ ID NO: 2823658 - RNA, 14 nt, Mycobacterium avium subsp. paratuberculosis
ccgcucgccgcggg

SEQ ID NO: 2823659 - RNA, 12 nt, Mycobacterium avium subsp. paratuberculosis
ccgcucgccggg

SEQ ID NO: 2823660 - RNA, 13 nt, Mycobacterium avium subsp. paratuberculosis
ccgcucgccgggg

SEQ ID NO: 2823661 - RNA, 13 nt, Mycobacterium avium subsp. paratuberculosis
ccgcucgccgucg

SEQ ID NO: 2823662 - RNA, 14 nt, Mycobacterium avium subsp. paratuberculosis
ccgcucgccgucgg

SEQ ID NO: 2823663 - RNA, 12 nt, Mycobacterium avium subsp. paratuberculosis
ccgcucgcgggc

SEQ ID NO: 2823664 - RNA, 13 nt, Mycobacterium avium subsp. paratuberculosis
ccgcucgcgggcc

SEQ ID NO: 2823665 - RNA, 18 nt, Mycobacterium avium subsp. paratuberculosis
ccgcucgcgggccacagc

SEQ ID NO: 2823666 - RNA, 14 nt, Mycobacterium avium subsp. paratuberculosis
ccgcucgcgggccc

SEQ ID NO: 2823667 - RNA, 16 nt, Mycobacterium avium subsp. paratuberculosis
ccgcucgcgggcccgc

SEQ ID NO: 2823668 - RNA, 21 nt, Mycobacterium avium subsp. paratuberculosis
ccgcucgcgggcccgcgccgc

SEQ ID NO: 2823669 - RNA, 22 nt, Mycobacterium avium subsp. paratuberculosis
ccgcucgcuauaucgcaccggc

SEQ ID NO: 2823670 - RNA, 21 nt, Mycobacterium avium subsp. paratuberculosis
ccgcucggaguucgcccgcag

SEQ ID NO: 2823671 - RNA, 22 nt, Mycobacterium avium subsp. paratuberculosis
ccgcucggaguucgcccgcagc

SEQ ID NO: 2823672 - RNA, 12 nt, Mycobacterium avium subsp. paratuberculosis
ccgcucggccag

SEQ ID NO: 2823673 - RNA, 21 nt, Mycobacterium avium subsp. paratuberculosis
ccgcucggccagcgcagcgac

SEQ ID NO: 2823674 - RNA, 20 nt, Mycobacterium avium subsp. paratuberculosis
ccgcucggccagcgcgccgc

SEQ ID NO: 2823675 - RNA, 14 nt, Mycobacterium avium subsp. paratuberculosis
ccgcugcggcuggg

SEQ ID NO: 2823676 - RNA, 17 nt, Mycobacterium avium subsp. paratuberculosis
ccgcugcgggccaucga

SEQ ID NO: 2823677 - RNA, 15 nt, Mycobacterium avium subsp. paratuberculosis
ccgcugcgggcgggc

SEQ ID NO: 2823678 - RNA, 21 nt, Mycobacterium avium subsp. paratuberculosis
ccgcugcgggcgggccgccag

SEQ ID NO: 2823679 - RNA, 20 nt, Mycobacterium avium subsp. paratuberculosis
ccgcugcuccggguccgcgg

SEQ ID NO: 2823680 - RNA, 22 nt, Mycobacterium avium subsp. paratuberculosis
ccgcugcuccggguccgcggug

SEQ ID NO: 2823681 - RNA, 20 nt, Mycobacterium avium subsp. paratuberculosis
ccgcugcucgaccucggcga

SEQ ID NO: 2823682 - RNA, 24 nt, Mycobacterium avium subsp. paratuberculosis
ccgcugcucgaccucggcgaccag

SEQ ID NO: 2823683 - RNA, 21 nt, Mycobacterium avium subsp. paratuberculosis
ccgcugcugcucggccgcauc

SEQ ID NO: 2823684 - RNA, 13 nt, Mycobacterium avium subsp. paratuberculosis
ccgcugcugcugc

SEQ ID NO: 2823685 - RNA, 18 nt, Mycobacterium avium subsp. paratuberculosis
ccgcugcugggugccgcg

SEQ ID NO: 2823686 - RNA, 24 nt, Mycobacterium avium subsp. paratuberculosis
ccgcuggaacagcgggccggcguc

SEQ ID NO: 2823687 - RNA, 17 nt, Mycobacterium avium subsp. paratuberculosis
ccgcuggaucccgguga

SEQ ID NO: 2823688 - RNA, 20 nt, Mycobacterium avium subsp. paratuberculosis
ccgcuggaucccggugagcg

SEQ ID NO: 2823689 - RNA, 23 nt, Mycobacterium avium subsp. paratuberculosis
ccgcuggauuccaccguggucgg

SEQ ID NO: 2823690 - RNA, 14 nt, Mycobacterium avium subsp. paratuberculosis
ccgcuggccgaggc

SEQ ID NO: 2823691 - RNA, 13 nt, Mycobacterium avium subsp. paratuberculosis
ccgcuggccgccc

SEQ ID NO: 2823692 - RNA, 14 nt, Mycobacterium avium subsp. paratuberculosis
ccgcuggccgcccc

SEQ ID NO: 2823693 - RNA, 21 nt, Mycobacterium avium subsp. paratuberculosis
ccgcuggccgccccgaacagc

SEQ ID NO: 2823694 - RNA, 18 nt, Mycobacterium avium subsp. paratuberculosis
ccgcuggccgcgccacag

SEQ ID NO: 2823695 - RNA, 19 nt, Mycobacterium avium subsp. paratuberculosis
ccgcuggccgcgccacagc

SEQ ID NO: 2823696 - RNA, 22 nt, Mycobacterium avium subsp. paratuberculosis
ccgcuggccgcgccacagcguc

SEQ ID NO: 2823697 - RNA, 16 nt, Mycobacterium avium subsp. paratuberculosis
ccgcuggcgccggcgu

SEQ ID NO: 2823698 - RNA, 15 nt, Mycobacterium avium subsp. paratuberculosis
ccgcuggcguagauc

SEQ ID NO: 2823699 - RNA, 20 nt, Mycobacterium avium subsp. paratuberculosis
ccgcuggcguagaucugcac

SEQ ID NO: 2823700 - RNA, 15 nt, Mycobacterium avium subsp. paratuberculosis
ccgcuggcgucgauc

SEQ ID NO: 2823701 - RNA, 17 nt, Mycobacterium avium subsp. paratuberculosis
ccgcuggcgucgaucgc

SEQ ID NO: 2823702 - RNA, 24 nt, Mycobacterium avium subsp. paratuberculosis
ccgcugggagcacgugaugagcga

SEQ ID NO: 2823703 - RNA, 16 nt, Mycobacterium avium subsp. paratuberculosis
ccgcugggcggcgcgg

SEQ ID NO: 2823704 - RNA, 13 nt, Mycobacterium avium subsp. paratuberculosis
ccgcugggcgugg

SEQ ID NO: 2823705 - RNA, 14 nt, Mycobacterium avium subsp. paratuberculosis
ccgcugggcguggu

SEQ ID NO: 2823706 - RNA, 21 nt, Mycobacterium avium subsp. paratuberculosis
ccgcugggcguggugcggugc

SEQ ID NO: 2823707 - RNA, 14 nt, Mycobacterium avium subsp. paratuberculosis
ccgcuggggcccag

SEQ ID NO: 2823708 - RNA, 15 nt, Mycobacterium avium subsp. paratuberculosis
ccgcuggggcccagc

SEQ ID NO: 2823709 - RNA, 19 nt, Mycobacterium avium subsp. paratuberculosis
ccgcuggggcccagcucca

SEQ ID NO: 2823710 - RNA, 19 nt, Mycobacterium avium subsp. paratuberculosis
ccgcuggggcgcaccgccu

SEQ ID NO: 2823711 - RNA, 21 nt, Mycobacterium avium subsp. paratuberculosis
ccgcuggggcgcaccgccugu

SEQ ID NO: 2823712 - RNA, 18 nt, Mycobacterium avium subsp. paratuberculosis
ccgcugggugguguucug

SEQ ID NO: 2823713 - RNA, 22 nt, Mycobacterium avium subsp. paratuberculosis
ccgcugggugguguucuggaug

SEQ ID NO: 2823714 - RNA, 20 nt, Mycobacterium avium subsp. paratuberculosis
ccgcugguagcugcugucga

SEQ ID NO: 2823715 - RNA, 17 nt, Mycobacterium avium subsp. paratuberculosis
ccgcugguaggcggcgc

SEQ ID NO: 2823716 - RNA, 20 nt, Mycobacterium avium subsp. paratuberculosis
ccgcugguaggcggcgcagc

SEQ ID NO: 2823717 - RNA, 14 nt, Mycobacterium avium subsp. paratuberculosis
ccgcuggucaaugc

SEQ ID NO: 2823718 - RNA, 22 nt, Mycobacterium avium subsp. paratuberculosis
ccgcuggucaggccgaaugacg

SEQ ID NO: 2823719 - RNA, 21 nt, Mycobacterium avium subsp. paratuberculosis
ccgcuggugcgcgccggcguc

SEQ ID NO: 2823720 - RNA, 21 nt, Mycobacterium avium subsp. paratuberculosis
ccgcugguggugaucacccag

SEQ ID NO: 2823721 - RNA, 18 nt, Mycobacterium avium subsp. paratuberculosis
ccgcugucaauccccgcg

SEQ ID NO: 2823722 - RNA, 19 nt, Mycobacterium avium subsp. paratuberculosis
ccgcugucaauccccgcgg

SEQ ID NO: 2823723 - RNA, 16 nt, Mycobacterium avium subsp. paratuberculosis
ccgcuguccucgucgg

SEQ ID NO: 2823724 - RNA, 22 nt, Mycobacterium avium subsp. paratuberculosis
ccgcugucggugugagcgguga

SEQ ID NO: 2823725 - RNA, 16 nt, Mycobacterium avium subsp. paratuberculosis
ccgcugucgucgaaga

SEQ ID NO: 2823726 - RNA, 23 nt, Mycobacterium avium subsp. paratuberculosis
ccgcugucgucgaagagcugguc

SEQ ID NO: 2823727 - RNA, 14 nt, Mycobacterium avium subsp. paratuberculosis
ccgcugucgucguc

SEQ ID NO: 2823728 - RNA, 20 nt, Mycobacterium avium subsp. paratuberculosis
ccgcugugauagcggcguac

SEQ ID NO: 2823729 - RNA, 17 nt, Mycobacterium avium subsp. paratuberculosis
ccgcugugguccucguc

SEQ ID NO: 2823730 - RNA, 20 nt, Mycobacterium avium subsp. paratuberculosis
ccgcugugguccucgucacc

SEQ ID NO: 2823731 - RNA, 21 nt, Mycobacterium avium subsp. paratuberculosis
ccgcugugguccucgucaccg

SEQ ID NO: 2823732 - RNA, 15 nt, Mycobacterium avium subsp. paratuberculosis
ccgcuucccacccgg

SEQ ID NO: 2823733 - RNA, 14 nt, Mycobacterium avium subsp. paratuberculosis
ccgcuucgcccggc

SEQ ID NO: 2823734 - RNA, 13 nt, Mycobacterium avium subsp. paratuberculosis
ccgcuucggcucg

SEQ ID NO: 2823735 - RNA, 21 nt, Mycobacterium avium subsp. paratuberculosis
ccgcuucggcucggggucggc

SEQ ID NO: 2823736 - RNA, 14 nt, Mycobacterium avium subsp. paratuberculosis
ccgcuucggggugg

SEQ ID NO: 2823737 - RNA, 15 nt, Mycobacterium avium subsp. paratuberculosis
ccgcuucgucgccgg

SEQ ID NO: 2823738 - RNA, 17 nt, Mycobacterium avium subsp. paratuberculosis
ccgcuucgucgccggcc

SEQ ID NO: 2823739 - RNA, 18 nt, Mycobacterium avium subsp. paratuberculosis
ccgcuucgucgccggccg

SEQ ID NO: 2823740 - RNA, 20 nt, Mycobacterium avium subsp. paratuberculosis
ccgcuucgucgccggccgcc

SEQ ID NO: 2823741 - RNA, 18 nt, Mycobacterium avium subsp. paratuberculosis
ccgcuucuggcgggcgaa

SEQ ID NO: 2823742 - RNA, 13 nt, Mycobacterium avium subsp. paratuberculosis
ccgcuugacgccg

SEQ ID NO: 2823743 - RNA, 15 nt, Mycobacterium avium subsp. paratuberculosis
ccgcuugacgccgcc

SEQ ID NO: 2823744 - RNA, 16 nt, Mycobacterium avium subsp. paratuberculosis
ccgcuugacgccgccg

SEQ ID NO: 2823745 - RNA, 14 nt, Mycobacterium avium subsp. paratuberculosis
ccgcuugcccagcc

SEQ ID NO: 2823746 - RNA, 15 nt, Mycobacterium avium subsp. paratuberculosis
ccgcuugcccagccc

SEQ ID NO: 2823747 - RNA, 13 nt, Mycobacterium avium subsp. paratuberculosis
ccgcuugccgacg

SEQ ID NO: 2823748 - RNA, 14 nt, Mycobacterium avium subsp. paratuberculosis
ccgcuugccgacgu

SEQ ID NO: 2823749 - RNA, 17 nt, Mycobacterium avium subsp. paratuberculosis
ccgcuugccgacgugau

SEQ ID NO: 2823750 - RNA, 23 nt, Mycobacterium avium subsp. paratuberculosis
ccgcuugcgacuggauggcgaug

SEQ ID NO: 2823751 - RNA, 20 nt, Mycobacterium avium subsp. paratuberculosis
ccgcuugcgcagcgucgugu

SEQ ID NO: 2823752 - RNA, 16 nt, Mycobacterium avium subsp. paratuberculosis
ccgcuuggccgggcgg

SEQ ID NO: 2823753 - RNA, 20 nt, Mycobacterium avium subsp. paratuberculosis
ccgcuuggcgcgccgcaccu

SEQ ID NO: 2823754 - RNA, 18 nt, Mycobacterium avium subsp. paratuberculosis
ccgcuugguggcgccggu

SEQ ID NO: 2823755 - RNA, 17 nt, Mycobacterium avium subsp. paratuberculosis
ccgcuuguucgggccca

SEQ ID NO: 2823756 - RNA, 18 nt, Mycobacterium avium subsp. paratuberculosis
ccgcuuuccaccccggcg

SEQ ID NO: 2823757 - RNA, 19 nt, Mycobacterium avium subsp. paratuberculosis
ccgcuuuccaccccggcgg

SEQ ID NO: 2823758 - RNA, 22 nt, Mycobacterium avium subsp. paratuberculosis
ccgcuuugugaggcgcgccggu

SEQ ID NO: 2823759 - RNA, 14 nt, Mycobacterium avium subsp. paratuberculosis
ccggacgaccuggg

SEQ ID NO: 2823760 - RNA, 22 nt, Mycobacterium avium subsp. paratuberculosis
ccggacgaccugggcgccgucg

SEQ ID NO: 2823761 - RNA, 17 nt, Mycobacterium avium subsp. paratuberculosis
ccggacgaggaucgcag

SEQ ID NO: 2823762 - RNA, 22 nt, Mycobacterium avium subsp. paratuberculosis
ccggacgaggaucgcaggaugg

SEQ ID NO: 2823763 - RNA, 21 nt, Mycobacterium avium subsp. paratuberculosis
ccggacgaugacccagcccag

SEQ ID NO: 2823764 - RNA, 14 nt, Mycobacterium avium subsp. paratuberculosis
ccggacgaugccgc

SEQ ID NO: 2823765 - RNA, 21 nt, Mycobacterium avium subsp. paratuberculosis
ccggacgaugccgcggcgucc

SEQ ID NO: 2823766 - RNA, 17 nt, Mycobacterium avium subsp. paratuberculosis
ccggacgaugcgcaccc

SEQ ID NO: 2823767 - RNA, 21 nt, Mycobacterium avium subsp. paratuberculosis
ccggacgcagcgaucggcggc

SEQ ID NO: 2823768 - RNA, 15 nt, Mycobacterium avium subsp. paratuberculosis
ccggacgcgcacacg

SEQ ID NO: 2823769 - RNA, 19 nt, Mycobacterium avium subsp. paratuberculosis
ccggacgcgcacacggccu

SEQ ID NO: 2823770 - RNA, 22 nt, Mycobacterium avium subsp. paratuberculosis
ccggacgcugcgguacacgugg

SEQ ID NO: 2823771 - RNA, 17 nt, Mycobacterium avium subsp. paratuberculosis
ccggacggagccgugcc

SEQ ID NO: 2823772 - RNA, 13 nt, Mycobacterium avium subsp. paratuberculosis
ccggacggccacc

SEQ ID NO: 2823773 - RNA, 14 nt, Mycobacterium avium subsp. paratuberculosis
ccggacggcccgca

SEQ ID NO: 2823774 - RNA, 16 nt, Mycobacterium avium subsp. paratuberculosis
ccggacgggaucggcg

SEQ ID NO: 2823775 - RNA, 17 nt, Mycobacterium avium subsp. paratuberculosis
ccggacgggaucggcgc

SEQ ID NO: 2823776 - RNA, 17 nt, Mycobacterium avium subsp. paratuberculosis
ccggacgggucgaccgc

SEQ ID NO: 2823777 - RNA, 19 nt, Mycobacterium avium subsp. paratuberculosis
ccggacgggucgaccgccg

SEQ ID NO: 2823778 - RNA, 20 nt, Mycobacterium avium subsp. paratuberculosis
ccggacgggucgaccgccgc

SEQ ID NO: 2823779 - RNA, 13 nt, Mycobacterium avium subsp. paratuberculosis
ccggacggugacg

SEQ ID NO: 2823780 - RNA, 17 nt, Mycobacterium avium subsp. paratuberculosis
ccggacggugacgccgg

SEQ ID NO: 2823781 - RNA, 15 nt, Mycobacterium avium subsp. paratuberculosis
ccggacgugaucgcg

SEQ ID NO: 2823782 - RNA, 22 nt, Mycobacterium avium subsp. paratuberculosis
ccggacuauacacgccuggaca

SEQ ID NO: 2823783 - RNA, 14 nt, Mycobacterium avium subsp. paratuberculosis
ccggacuccucggu

SEQ ID NO: 2823784 - RNA, 17 nt, Mycobacterium avium subsp. paratuberculosis
ccggacuccuucaucga

SEQ ID NO: 2823785 - RNA, 19 nt, Mycobacterium avium subsp. paratuberculosis
ccggacucgaagaucgccu

SEQ ID NO: 2823786 - RNA, 18 nt, Mycobacterium avium subsp. paratuberculosis
ccggacugcuugggcgcc

SEQ ID NO: 2823787 - RNA, 18 nt, Mycobacterium avium subsp. paratuberculosis
ccggacuugaugcugccc

SEQ ID NO: 2823788 - RNA, 23 nt, Mycobacterium avium subsp. paratuberculosis
ccggacuugaugcugcccggcgc

SEQ ID NO: 2823789 - RNA, 16 nt, Mycobacterium avium subsp. paratuberculosis
ccggagaaaccgucgg

SEQ ID NO: 2823790 - RNA, 17 nt, Mycobacterium avium subsp. paratuberculosis
ccggagaaaccgucggc

SEQ ID NO: 2823791 - RNA, 16 nt, Mycobacterium avium subsp. paratuberculosis
ccggagaacaucagcc

SEQ ID NO: 2823792 - RNA, 16 nt, Mycobacterium avium subsp. paratuberculosis
ccggagaaccgcucga

SEQ ID NO: 2823793 - RNA, 22 nt, Mycobacterium avium subsp. paratuberculosis
ccggagaacuaucuggucuggg

SEQ ID NO: 2823794 - RNA, 13 nt, Mycobacterium avium subsp. paratuberculosis
ccggagaccagca

SEQ ID NO: 2823795 - RNA, 14 nt, Mycobacterium avium subsp. paratuberculosis
ccggagaccagcag

SEQ ID NO: 2823796 - RNA, 12 nt, Mycobacterium avium subsp. paratuberculosis
ccggagaccgcc

SEQ ID NO: 2823797 - RNA, 22 nt, Mycobacterium avium subsp. paratuberculosis
ccggagacgacucuuccaggac

SEQ ID NO: 2823798 - RNA, 19 nt, Mycobacterium avium subsp. paratuberculosis
ccggagagcccgucgucgg

SEQ ID NO: 2823799 - RNA, 20 nt, Mycobacterium avium subsp. paratuberculosis
ccggagaucccguaggucgc

SEQ ID NO: 2823800 - RNA, 15 nt, Mycobacterium avium subsp. paratuberculosis
ccggagauccggccg

SEQ ID NO: 2823801 - RNA, 16 nt, Mycobacterium avium subsp. paratuberculosis
ccggagauccggccgc

SEQ ID NO: 2823802 - RNA, 20 nt, Mycobacterium avium subsp. paratuberculosis
ccggagaugaauucggcgau

SEQ ID NO: 2823803 - RNA, 22 nt, Mycobacterium avium subsp. paratuberculosis
ccggagaugaauucggcgaucu

SEQ ID NO: 2823804 - RNA, 18 nt, Mycobacterium avium subsp. paratuberculosis
ccggagaugaucaugucg

SEQ ID NO: 2823805 - RNA, 21 nt, Mycobacterium avium subsp. paratuberculosis
ccggagaugaucaugucgucc

SEQ ID NO: 2823806 - RNA, 23 nt, Mycobacterium avium subsp. paratuberculosis
ccggagaugaucaugucguccuc

SEQ ID NO: 2823807 - RNA, 22 nt, Mycobacterium avium subsp. paratuberculosis
ccggagcaaagguaguccagca

SEQ ID NO: 2823808 - RNA, 20 nt, Mycobacterium avium subsp. paratuberculosis
ccggagcccagcuuggcgcc

SEQ ID NO: 2823809 - RNA, 16 nt, Mycobacterium avium subsp. paratuberculosis
ccggagccgaucgccu

SEQ ID NO: 2823810 - RNA, 18 nt, Mycobacterium avium subsp. paratuberculosis
ccggagccgaucgccucc

SEQ ID NO: 2823811 - RNA, 19 nt, Mycobacterium avium subsp. paratuberculosis
ccggagccgaucgccuccg

SEQ ID NO: 2823812 - RNA, 11 nt, Mycobacterium avium subsp. paratuberculosis
ccggagccggc

SEQ ID NO: 2823813 - RNA, 16 nt, Mycobacterium avium subsp. paratuberculosis
ccggagccggccucgc

SEQ ID NO: 2823814 - RNA, 18 nt, Mycobacterium avium subsp. paratuberculosis
ccggagccuucuucgccg

SEQ ID NO: 2823815 - RNA, 22 nt, Mycobacterium avium subsp. paratuberculosis
ccggagccuucuucgccgcagc

SEQ ID NO: 2823816 - RNA, 14 nt, Mycobacterium avium subsp. paratuberculosis
ccggagccuugguc

SEQ ID NO: 2823817 - RNA, 16 nt, Mycobacterium avium subsp. paratuberculosis
ccggagccuuggucgc

SEQ ID NO: 2823818 - RNA, 17 nt, Mycobacterium avium subsp. paratuberculosis
ccggagccuuggucgcg

SEQ ID NO: 2823819 - RNA, 19 nt, Mycobacterium avium subsp. paratuberculosis
ccggagccuuggucgcggc

SEQ ID NO: 2823820 - RNA, 21 nt, Mycobacterium avium subsp. paratuberculosis
ccggagccuuggucgcggccu

SEQ ID NO: 2823821 - RNA, 18 nt, Mycobacterium avium subsp. paratuberculosis
ccggagcgaaggugccgc

SEQ ID NO: 2823822 - RNA, 22 nt, Mycobacterium avium subsp. paratuberculosis
ccggagcgaaggugccgcgaug

SEQ ID NO: 2823823 - RNA, 13 nt, Mycobacterium avium subsp. paratuberculosis
ccggagcgcgguc

SEQ ID NO: 2823824 - RNA, 21 nt, Mycobacterium avium subsp. paratuberculosis
ccggagcgcgguccacggugg

SEQ ID NO: 2823825 - RNA, 18 nt, Mycobacterium avium subsp. paratuberculosis
ccggagcggauggcgccg

SEQ ID NO: 2823826 - RNA, 19 nt, Mycobacterium avium subsp. paratuberculosis
ccggagcggauggcgccgu

SEQ ID NO: 2823827 - RNA, 20 nt, Mycobacterium avium subsp. paratuberculosis
ccggagcggauggcgccguc

SEQ ID NO: 2823828 - RNA, 14 nt, Mycobacterium avium subsp. paratuberculosis
ccggagcggcggua

SEQ ID NO: 2823829 - RNA, 13 nt, Mycobacterium avium subsp. paratuberculosis
ccggagcugucgg

SEQ ID NO: 2823830 - RNA, 18 nt, Mycobacterium avium subsp. paratuberculosis
ccggagcugucggugacg

SEQ ID NO: 2823831 - RNA, 16 nt, Mycobacterium avium subsp. paratuberculosis
ccggaggccagcucga

SEQ ID NO: 2823832 - RNA, 18 nt, Mycobacterium avium subsp. paratuberculosis
ccggaggccagcucgacc

SEQ ID NO: 2823833 - RNA, 20 nt, Mycobacterium avium subsp. paratuberculosis
ccggaggccagcucgaccgc

SEQ ID NO: 2823834 - RNA, 23 nt, Mycobacterium avium subsp. paratuberculosis
ccggaggccagcucgaccgcggc

SEQ ID NO: 2823835 - RNA, 13 nt, Mycobacterium avium subsp. paratuberculosis
ccggaggccgcgg

SEQ ID NO: 2823836 - RNA, 19 nt, Mycobacterium avium subsp. paratuberculosis
ccggaggcgaucagguggg

SEQ ID NO: 2823837 - RNA, 14 nt, Mycobacterium avium subsp. paratuberculosis
ccggaggcggcggg

SEQ ID NO: 2823838 - RNA, 15 nt, Mycobacterium avium subsp. paratuberculosis
ccggaggcggcgggg

SEQ ID NO: 2823839 - RNA, 23 nt, Mycobacterium avium subsp. paratuberculosis
ccggaggcggcgggggcgggccc

SEQ ID NO: 2823840 - RNA, 19 nt, Mycobacterium avium subsp. paratuberculosis
ccggaggggcgacgggccg

SEQ ID NO: 2823841 - RNA, 18 nt, Mycobacterium avium subsp. paratuberculosis
ccggaggguauucgugug

SEQ ID NO: 2823842 - RNA, 19 nt, Mycobacterium avium subsp. paratuberculosis
ccggaggguauucgugugc

SEQ ID NO: 2823843 - RNA, 20 nt, Mycobacterium avium subsp. paratuberculosis
ccggauuacucgccggcggc

SEQ ID NO: 2823844 - RNA, 22 nt, Mycobacterium avium subsp. paratuberculosis
ccggauuacucgccggcggcgc

SEQ ID NO: 2823845 - RNA, 23 nt, Mycobacterium avium subsp. paratuberculosis
ccggauuacucgccggcggcgcc

SEQ ID NO: 2823846 - RNA, 19 nt, Mycobacterium avium subsp. paratuberculosis
ccggauucgcggcggcgcc

SEQ ID NO: 2823847 - RNA, 21 nt, Mycobacterium avium subsp. paratuberculosis
ccggauucgcggcggcgccgc

SEQ ID NO: 2823848 - RNA, 12 nt, Mycobacterium avium subsp. paratuberculosis
ccggauucggcg

SEQ ID NO: 2823849 - RNA, 24 nt, Mycobacterium avium subsp. paratuberculosis
ccggauucggcuccugccguucgg

SEQ ID NO: 2823850 - RNA, 17 nt, Mycobacterium avium subsp. paratuberculosis
ccggauucucgcccggc

SEQ ID NO: 2823851 - RNA, 20 nt, Mycobacterium avium subsp. paratuberculosis
ccggauucucgcccggcucc

SEQ ID NO: 2823852 - RNA, 15 nt, Mycobacterium avium subsp. paratuberculosis
ccggauuggcgucgg

SEQ ID NO: 2823853 - RNA, 20 nt, Mycobacterium avium subsp. paratuberculosis
ccggauuucgccagugccgc

SEQ ID NO: 2823854 - RNA, 23 nt, Mycobacterium avium subsp. paratuberculosis
ccggauuucgucccaguccagcc

SEQ ID NO: 2823855 - RNA, 14 nt, Mycobacterium avium subsp. paratuberculosis
ccggcaacacagcc

SEQ ID NO: 2823856 - RNA, 16 nt, Mycobacterium avium subsp. paratuberculosis
ccggcaacaccggcgg

SEQ ID NO: 2823857 - RNA, 17 nt, Mycobacterium avium subsp. paratuberculosis
ccggcaacaccggcggc

SEQ ID NO: 2823858 - RNA, 21 nt, Mycobacterium avium subsp. paratuberculosis
ccggcaacaccggcggcgacg

SEQ ID NO: 2823859 - RNA, 21 nt, Mycobacterium avium subsp. paratuberculosis
ccggcaacacguagucgccga

SEQ ID NO: 2823860 - RNA, 22 nt, Mycobacterium avium subsp. paratuberculosis
ccggcaacacguagucgccgau

SEQ ID NO: 2823861 - RNA, 23 nt, Mycobacterium avium subsp. paratuberculosis
ccggcaacacguagucgccgaug

SEQ ID NO: 2823862 - RNA, 15 nt, Mycobacterium avium subsp. paratuberculosis
ccggcaaccgccacg

SEQ ID NO: 2823863 - RNA, 17 nt, Mycobacterium avium subsp. paratuberculosis
ccggcaaccgccacgac

SEQ ID NO: 2823864 - RNA, 20 nt, Mycobacterium avium subsp. paratuberculosis
ccggcaaccgccacgacgcg

SEQ ID NO: 2823865 - RNA, 22 nt, Mycobacterium avium subsp. paratuberculosis
ccggcaaccgccacgacgcggc

SEQ ID NO: 2823866 - RNA, 22 nt, Mycobacterium avium subsp. paratuberculosis
ccggcaacgacccgucggggug

SEQ ID NO: 2823867 - RNA, 16 nt, Mycobacterium avium subsp. paratuberculosis
ccggcaacuggccgcc

SEQ ID NO: 2823868 - RNA, 20 nt, Mycobacterium avium subsp. paratuberculosis
ccggcaaggugccguccggg

SEQ ID NO: 2823869 - RNA, 15 nt, Mycobacterium avium subsp. paratuberculosis
ccggcaaucgggacg

SEQ ID NO: 2823870 - RNA, 16 nt, Mycobacterium avium subsp. paratuberculosis
ccggcaaucgggacgc

SEQ ID NO: 2823871 - RNA, 18 nt, Mycobacterium avium subsp. paratuberculosis
ccggcaaucgggacgcca

SEQ ID NO: 2823872 - RNA, 16 nt, Mycobacterium avium subsp. paratuberculosis
ccggcaccacgaucac

SEQ ID NO: 2823873 - RNA, 12 nt, Mycobacterium avium subsp. paratuberculosis
ccggcaccagca

SEQ ID NO: 2823874 - RNA, 13 nt, Mycobacterium avium subsp. paratuberculosis
ccggcaccagcag

SEQ ID NO: 2823875 - RNA, 14 nt, Mycobacterium avium subsp. paratuberculosis
ccggcaccagcagc

SEQ ID NO: 2823876 - RNA, 17 nt, Mycobacterium avium subsp. paratuberculosis
ccggcaccagcaggccc

SEQ ID NO: 2823877 - RNA, 22 nt, Mycobacterium avium subsp. paratuberculosis
ccggcacccccaauugccgggc

SEQ ID NO: 2823878 - RNA, 15 nt, Mycobacterium avium subsp. paratuberculosis
ccggcacccgccagc

SEQ ID NO: 2823879 - RNA, 16 nt, Mycobacterium avium subsp. paratuberculosis
ccggcacccgccagcc

SEQ ID NO: 2823880 - RNA, 19 nt, Mycobacterium avium subsp. paratuberculosis
ccggcacccgccagcccga

SEQ ID NO: 2823881 - RNA, 11 nt, Mycobacterium avium subsp. paratuberculosis
ccggcaccgcc

SEQ ID NO: 2823882 - RNA, 12 nt, Mycobacterium avium subsp. paratuberculosis
ccggcaccgcca

SEQ ID NO: 2823883 - RNA, 14 nt, Mycobacterium avium subsp. paratuberculosis
ccggcaccgccagc

SEQ ID NO: 2823884 - RNA, 17 nt, Mycobacterium avium subsp. paratuberculosis
ccggcaccgccagccac

SEQ ID NO: 2823885 - RNA, 18 nt, Mycobacterium avium subsp. paratuberculosis
ccggcaccgccagccacc

SEQ ID NO: 2823886 - RNA, 13 nt, Mycobacterium avium subsp. paratuberculosis
ccggcaccgcccc

SEQ ID NO: 2823887 - RNA, 15 nt, Mycobacterium avium subsp. paratuberculosis
ccggcaccgcccccg

SEQ ID NO: 2823888 - RNA, 22 nt, Mycobacterium avium subsp. paratuberculosis
ccggcaccgcccccgcggcggc

SEQ ID NO: 2823889 - RNA, 12 nt, Mycobacterium avium subsp. paratuberculosis
ccggcaccgcgg

SEQ ID NO: 2823890 - RNA, 13 nt, Mycobacterium avium subsp. paratuberculosis
ccggcaccgcggc

SEQ ID NO: 2823891 - RNA, 15 nt, Mycobacterium avium subsp. paratuberculosis
ccggcaccgcggcga

SEQ ID NO: 2823892 - RNA, 18 nt, Mycobacterium avium subsp. paratuberculosis
ccggcaccgcggcgauga

SEQ ID NO: 2823893 - RNA, 20 nt, Mycobacterium avium subsp. paratuberculosis
ccggcaccgcggcgaugauc

SEQ ID NO: 2823894 - RNA, 16 nt, Mycobacterium avium subsp. paratuberculosis
ccggcaccgcggucug

SEQ ID NO: 2823895 - RNA, 16 nt, Mycobacterium avium subsp. paratuberculosis
ccggcaccggugcggc

SEQ ID NO: 2823896 - RNA, 21 nt, Mycobacterium avium subsp. paratuberculosis
ccggcaccucgaagggcgcca

SEQ ID NO: 2823897 - RNA, 14 nt, Mycobacterium avium subsp. paratuberculosis
ccggcacgaacgcg

SEQ ID NO: 2823898 - RNA, 22 nt, Mycobacterium avium subsp. paratuberculosis
ccggcacgaacgcgacgaucag

SEQ ID NO: 2823899 - RNA, 20 nt, Mycobacterium avium subsp. paratuberculosis
ccggcacgaucgucgccgcc

SEQ ID NO: 2823900 - RNA, 21 nt, Mycobacterium avium subsp. paratuberculosis
ccggcacgaucgucgccgcca

SEQ ID NO: 2823901 - RNA, 13 nt, Mycobacterium avium subsp. paratuberculosis
ccggcacgauggc

SEQ ID NO: 2823902 - RNA, 16 nt, Mycobacterium avium subsp. paratuberculosis
ccggcacgauggcgcg

SEQ ID NO: 2823903 - RNA, 22 nt, Mycobacterium avium subsp. paratuberculosis
ccggcacgauggcgcggcgcac

SEQ ID NO: 2823904 - RNA, 16 nt, Mycobacterium avium subsp. paratuberculosis
ccggcacgcaccuugg

SEQ ID NO: 2823905 - RNA, 13 nt, Mycobacterium avium subsp. paratuberculosis
ccggcacgcgcgc

SEQ ID NO: 2823906 - RNA, 15 nt, Mycobacterium avium subsp. paratuberculosis
ccggcacggcaccgc

SEQ ID NO: 2823907 - RNA, 16 nt, Mycobacterium avium subsp. paratuberculosis
ccggcacggcaccgcg

SEQ ID NO: 2823908 - RNA, 14 nt, Mycobacterium avium subsp. paratuberculosis
ccggcacggccggc

SEQ ID NO: 2823909 - RNA, 17 nt, Mycobacterium avium subsp. paratuberculosis
ccggcacggugcacacg

SEQ ID NO: 2823910 - RNA, 19 nt, Mycobacterium avium subsp. paratuberculosis
ccggcacggugcacacgcc

SEQ ID NO: 2823911 - RNA, 20 nt, Mycobacterium avium subsp. paratuberculosis
ccggcacggugcacacgccg

SEQ ID NO: 2823912 - RNA, 15 nt, Mycobacterium avium subsp. paratuberculosis
ccggcacgucgagcu

SEQ ID NO: 2823913 - RNA, 13 nt, Mycobacterium avium subsp. paratuberculosis
ccggcacgucggc

SEQ ID NO: 2823914 - RNA, 15 nt, Mycobacterium avium subsp. paratuberculosis
ccggcacgucggcca

SEQ ID NO: 2823915 - RNA, 16 nt, Mycobacterium avium subsp. paratuberculosis
ccggcacgucggccac

SEQ ID NO: 2823916 - RNA, 17 nt, Mycobacterium avium subsp. paratuberculosis
ccggcacgucggccacg

SEQ ID NO: 2823917 - RNA, 18 nt, Mycobacterium avium subsp. paratuberculosis
ccggcacgucggccacgc

SEQ ID NO: 2823918 - RNA, 21 nt, Mycobacterium avium subsp. paratuberculosis
ccggcacgugcggguuggcgc

SEQ ID NO: 2823919 - RNA, 16 nt, Mycobacterium avium subsp. paratuberculosis
ccggcacuaccgccuc

SEQ ID NO: 2823920 - RNA, 16 nt, Mycobacterium avium subsp. paratuberculosis
ccggcacucgccucgg

SEQ ID NO: 2823921 - RNA, 21 nt, Mycobacterium avium subsp. paratuberculosis
ccggcacucgccucggaggcc

SEQ ID NO: 2823922 - RNA, 14 nt, Mycobacterium avium subsp. paratuberculosis
ccggcacucgucgu

SEQ ID NO: 2823923 - RNA, 20 nt, Mycobacterium avium subsp. paratuberculosis
ccggcacucgucguggcggu

SEQ ID NO: 2823924 - RNA, 19 nt, Mycobacterium avium subsp. paratuberculosis
ccggcacugcugcccgcga

SEQ ID NO: 2823925 - RNA, 15 nt, Mycobacterium avium subsp. paratuberculosis
ccggcagaucgcggc

SEQ ID NO: 2823926 - RNA, 17 nt, Mycobacterium avium subsp. paratuberculosis
ccggcagaucgcggccc

SEQ ID NO: 2823927 - RNA, 19 nt, Mycobacterium avium subsp. paratuberculosis
ccggcagaucgcggcccgc

SEQ ID NO: 2823928 - RNA, 17 nt, Mycobacterium avium subsp. paratuberculosis
ccggcaucggcucguag

SEQ ID NO: 2823929 - RNA, 22 nt, Mycobacterium avium subsp. paratuberculosis
ccggcaucggcucguagcgggc

SEQ ID NO: 2823930 - RNA, 22 nt, Mycobacterium avium subsp. paratuberculosis
ccggcaucgguggcaccccgcg

SEQ ID NO: 2823931 - RNA, 18 nt, Mycobacterium avium subsp. paratuberculosis
ccggcaugggcggcaagc

SEQ ID NO: 2823932 - RNA, 19 nt, Mycobacterium avium subsp. paratuberculosis
ccggcaugggcggcaagcc

SEQ ID NO: 2823933 - RNA, 13 nt, Mycobacterium avium subsp. paratuberculosis
ccggcaugguucc

SEQ ID NO: 2823934 - RNA, 23 nt, Mycobacterium avium subsp. paratuberculosis
ccggcauguacaggaucaacucg

SEQ ID NO: 2823935 - RNA, 14 nt, Mycobacterium avium subsp. paratuberculosis
ccggcauucgugug

SEQ ID NO: 2823936 - RNA, 18 nt, Mycobacterium avium subsp. paratuberculosis
ccggcauucguguggcgc

SEQ ID NO: 2823937 - RNA, 22 nt, Mycobacterium avium subsp. paratuberculosis
ccggccaacagcagcgccgcgg

SEQ ID NO: 2823938 - RNA, 22 nt, Mycobacterium avium subsp. paratuberculosis
ccggccaaggcaagucgucggu

SEQ ID NO: 2823939 - RNA, 12 nt, Mycobacterium avium subsp. paratuberculosis
ccggccaccaac

SEQ ID NO: 2823940 - RNA, 19 nt, Mycobacterium avium subsp. paratuberculosis
ccggccaccaacaggucgg

SEQ ID NO: 2823941 - RNA, 12 nt, Mycobacterium avium subsp. paratuberculosis
ccggccaccagg

SEQ ID NO: 2823942 - RNA, 20 nt, Mycobacterium avium subsp. paratuberculosis
ccggccaccagggcgaccgc

SEQ ID NO: 2823943 - RNA, 23 nt, Mycobacterium avium subsp. paratuberculosis
ccggccaccagggucucgcgcag

SEQ ID NO: 2823944 - RNA, 22 nt, Mycobacterium avium subsp. paratuberculosis
ccggccaccaggucgcacacca

SEQ ID NO: 2823945 - RNA, 16 nt, Mycobacterium avium subsp. paratuberculosis
ccggccaccccgcaga

SEQ ID NO: 2823946 - RNA, 14 nt, Mycobacterium avium subsp. paratuberculosis
ccggccaccgcccc

SEQ ID NO: 2823947 - RNA, 17 nt, Mycobacterium avium subsp. paratuberculosis
ccggccaccgccccagc

SEQ ID NO: 2823948 - RNA, 13 nt, Mycobacterium avium subsp. paratuberculosis
ccggccaccgccg

SEQ ID NO: 2823949 - RNA, 16 nt, Mycobacterium avium subsp. paratuberculosis
ccggccaccgccgcca

SEQ ID NO: 2823950 - RNA, 20 nt, Mycobacterium avium subsp. paratuberculosis
ccggccaccgccgccagcag

SEQ ID NO: 2823951 - RNA, 12 nt, Mycobacterium avium subsp. paratuberculosis
ccggccaccggc

SEQ ID NO: 2823952 - RNA, 14 nt, Mycobacterium avium subsp. paratuberculosis
ccggccaccggcgc

SEQ ID NO: 2823953 - RNA, 15 nt, Mycobacterium avium subsp. paratuberculosis
ccggccaccggcgcg

SEQ ID NO: 2823954 - RNA, 17 nt, Mycobacterium avium subsp. paratuberculosis
ccggccaccggcgcgac

SEQ ID NO: 2823955 - RNA, 16 nt, Mycobacterium avium subsp. paratuberculosis
ccggccaccucguccc

SEQ ID NO: 2823956 - RNA, 18 nt, Mycobacterium avium subsp. paratuberculosis
ccggccaccucgucccag

SEQ ID NO: 2823957 - RNA, 23 nt, Mycobacterium avium subsp. paratuberculosis
ccggccaccucgucggcggucaa

SEQ ID NO: 2823958 - RNA, 12 nt, Mycobacterium avium subsp. paratuberculosis
ccggccaccugg

SEQ ID NO: 2823959 - RNA, 14 nt, Mycobacterium avium subsp. paratuberculosis
ccggccaccuggcc

SEQ ID NO: 2823960 - RNA, 16 nt, Mycobacterium avium subsp. paratuberculosis
ccggccacgaccucgg

SEQ ID NO: 2823961 - RNA, 12 nt, Mycobacterium avium subsp. paratuberculosis
ccggccacgccg

SEQ ID NO: 2823962 - RNA, 11 nt, Mycobacterium avium subsp. paratuberculosis
ccggccacgcu

SEQ ID NO: 2823963 - RNA, 20 nt, Mycobacterium avium subsp. paratuberculosis
ccggccacgcucggcggcgc

SEQ ID NO: 2823964 - RNA, 23 nt, Mycobacterium avium subsp. paratuberculosis
ccggccacgcucggcggcgcgca

SEQ ID NO: 2823965 - RNA, 16 nt, Mycobacterium avium subsp. paratuberculosis
ccggccacgucgaugc

SEQ ID NO: 2823966 - RNA, 15 nt, Mycobacterium avium subsp. paratuberculosis
ccggccacucgccgc

SEQ ID NO: 2823967 - RNA, 20 nt, Mycobacterium avium subsp. paratuberculosis
ccggccacucgccgcgaacg

SEQ ID NO: 2823968 - RNA, 17 nt, Mycobacterium avium subsp. paratuberculosis
ccggccacucgcguccc

SEQ ID NO: 2823969 - RNA, 12 nt, Mycobacterium avium subsp. paratuberculosis
ccggccagaccg

SEQ ID NO: 2823970 - RNA, 21 nt, Mycobacterium avium subsp. paratuberculosis
ccggccagaucgacgccgcgg

SEQ ID NO: 2823971 - RNA, 12 nt, Mycobacterium avium subsp. paratuberculosis
ccggccagcaca

SEQ ID NO: 2823972 - RNA, 13 nt, Mycobacterium avium subsp. paratuberculosis
ccggccagcacac

SEQ ID NO: 2823973 - RNA, 22 nt, Mycobacterium avium subsp. paratuberculosis
ccggccagcacacccucgaccc

SEQ ID NO: 2823974 - RNA, 12 nt, Mycobacterium avium subsp. paratuberculosis
ccggccagcacc

SEQ ID NO: 2823975 - RNA, 13 nt, Mycobacterium avium subsp. paratuberculosis
ccggccagcacca

SEQ ID NO: 2823976 - RNA, 13 nt, Mycobacterium avium subsp. paratuberculosis
ccggccagcaccc

SEQ ID NO: 2823977 - RNA, 14 nt, Mycobacterium avium subsp. paratuberculosis
ccggccagcacccg

SEQ ID NO: 2823978 - RNA, 19 nt, Mycobacterium avium subsp. paratuberculosis
ccggccagcacccgcucgc

SEQ ID NO: 2823979 - RNA, 13 nt, Mycobacterium avium subsp. paratuberculosis
ccggccagcacga

SEQ ID NO: 2823980 - RNA, 16 nt, Mycobacterium avium subsp. paratuberculosis
ccggccagcacgccgu

SEQ ID NO: 2823981 - RNA, 15 nt, Mycobacterium avium subsp. paratuberculosis
ccggccagcacgccu

SEQ ID NO: 2823982 - RNA, 20 nt, Mycobacterium avium subsp. paratuberculosis
ccggccagcacggccagcca

SEQ ID NO: 2823983 - RNA, 19 nt, Mycobacterium avium subsp. paratuberculosis
ccggccagcagcagcccgc

SEQ ID NO: 2823984 - RNA, 19 nt, Mycobacterium avium subsp. paratuberculosis
ccggccagcagcagguagc

SEQ ID NO: 2823985 - RNA, 14 nt, Mycobacterium avium subsp. paratuberculosis
ccggccagcagccg

SEQ ID NO: 2823986 - RNA, 17 nt, Mycobacterium avium subsp. paratuberculosis
ccggccagcagccgcuc

SEQ ID NO: 2823987 - RNA, 21 nt, Mycobacterium avium subsp. paratuberculosis
ccggccagcagccgguacagc

SEQ ID NO: 2823988 - RNA, 13 nt, Mycobacterium avium subsp. paratuberculosis
ccggccagcagcg

SEQ ID NO: 2823989 - RNA, 15 nt, Mycobacterium avium subsp. paratuberculosis
ccggccagcagcggc

SEQ ID NO: 2823990 - RNA, 17 nt, Mycobacterium avium subsp. paratuberculosis
ccggccagcagcggcuu

SEQ ID NO: 2823991 - RNA, 13 nt, Mycobacterium avium subsp. paratuberculosis
ccggccagcaggu

SEQ ID NO: 2823992 - RNA, 14 nt, Mycobacterium avium subsp. paratuberculosis
ccggccagcaggua

SEQ ID NO: 2823993 - RNA, 17 nt, Mycobacterium avium subsp. paratuberculosis
ccggccagccgcgcgac

SEQ ID NO: 2823994 - RNA, 12 nt, Mycobacterium avium subsp. paratuberculosis
ccggccagccgg

SEQ ID NO: 2823995 - RNA, 18 nt, Mycobacterium avium subsp. paratuberculosis
ccggccagccggccgcug

SEQ ID NO: 2823996 - RNA, 19 nt, Mycobacterium avium subsp. paratuberculosis
ccggccagccggccgcuga

SEQ ID NO: 2823997 - RNA, 15 nt, Mycobacterium avium subsp. paratuberculosis
ccggccagccggcuc

SEQ ID NO: 2823998 - RNA, 14 nt, Mycobacterium avium subsp. paratuberculosis
ccggccagccgggc

SEQ ID NO: 2823999 - RNA, 16 nt, Mycobacterium avium subsp. paratuberculosis
ccggccagccgggcgg

SEQ ID NO: 2824000 - RNA, 17 nt, Mycobacterium avium subsp. paratuberculosis
ccggccagccgggcggc

SEQ ID NO: 2824001 - RNA, 20 nt, Mycobacterium avium subsp. paratuberculosis
ccggccagccgggcggccag

SEQ ID NO: 2824002 - RNA, 20 nt, Mycobacterium avium subsp. paratuberculosis
ccggccagccgguaugcgau

SEQ ID NO: 2824003 - RNA, 12 nt, Mycobacterium avium subsp. paratuberculosis
ccggccagcggc

SEQ ID NO: 2824004 - RNA, 15 nt, Mycobacterium avium subsp. paratuberculosis
ccggccagcggcagc

SEQ ID NO: 2824005 - RNA, 16 nt, Mycobacterium avium subsp. paratuberculosis
ccggccagcggcagcg

SEQ ID NO: 2824006 - RNA, 22 nt, Mycobacterium avium subsp. paratuberculosis
ccggccagcggcagcggcgucg

SEQ ID NO: 2824007 - RNA, 15 nt, Mycobacterium avium subsp. paratuberculosis
ccggccagcggcauc

SEQ ID NO: 2824008 - RNA, 15 nt, Mycobacterium avium subsp. paratuberculosis
ccggccagcggccag

SEQ ID NO: 2824009 - RNA, 17 nt, Mycobacterium avium subsp. paratuberculosis
ccggccagcggccagcc

SEQ ID NO: 2824010 - RNA, 20 nt, Mycobacterium avium subsp. paratuberculosis
ccggccagcggccagcccgc

SEQ ID NO: 2824011 - RNA, 13 nt, Mycobacterium avium subsp. paratuberculosis
ccggccagcggcu

SEQ ID NO: 2824012 - RNA, 14 nt, Mycobacterium avium subsp. paratuberculosis
ccggccagcggcuu

SEQ ID NO: 2824013 - RNA, 13 nt, Mycobacterium avium subsp. paratuberculosis
ccggccccggccg

SEQ ID NO: 2824014 - RNA, 15 nt, Mycobacterium avium subsp. paratuberculosis
ccggccccggccggc

SEQ ID NO: 2824015 - RNA, 17 nt, Mycobacterium avium subsp. paratuberculosis
ccggccccggccggcgg

SEQ ID NO: 2824016 - RNA, 19 nt, Mycobacterium avium subsp. paratuberculosis
ccggccccggccggcgggu

SEQ ID NO: 2824017 - RNA, 14 nt, Mycobacterium avium subsp. paratuberculosis
ccggccccggcgac

SEQ ID NO: 2824018 - RNA, 15 nt, Mycobacterium avium subsp. paratuberculosis
ccggccccggcgacg

SEQ ID NO: 2824019 - RNA, 16 nt, Mycobacterium avium subsp. paratuberculosis
ccggccccggcgacgg

SEQ ID NO: 2824020 - RNA, 14 nt, Mycobacterium avium subsp. paratuberculosis
ccggcccgaccgga

SEQ ID NO: 2824021 - RNA, 17 nt, Mycobacterium avium subsp. paratuberculosis
ccggcccgagcaccacc

SEQ ID NO: 2824022 - RNA, 22 nt, Mycobacterium avium subsp. paratuberculosis
ccggcccgagcaccaccaggcc

SEQ ID NO: 2824023 - RNA, 15 nt, Mycobacterium avium subsp. paratuberculosis
ccggcccgagcccug

SEQ ID NO: 2824024 - RNA, 22 nt, Mycobacterium avium subsp. paratuberculosis
ccggcccgagcccugcgccagc

SEQ ID NO: 2824025 - RNA, 13 nt, Mycobacterium avium subsp. paratuberculosis
ccggcccgauagc

SEQ ID NO: 2824026 - RNA, 19 nt, Mycobacterium avium subsp. paratuberculosis
ccggcccgaucgcggcgag

SEQ ID NO: 2824027 - RNA, 20 nt, Mycobacterium avium subsp. paratuberculosis
ccggcccgaucgcggcgagc

SEQ ID NO: 2824028 - RNA, 21 nt, Mycobacterium avium subsp. paratuberculosis
ccggcccgcagccagcgcagc

SEQ ID NO: 2824029 - RNA, 13 nt, Mycobacterium avium subsp. paratuberculosis
ccggcccgcagcg

SEQ ID NO: 2824030 - RNA, 13 nt, Mycobacterium avium subsp. paratuberculosis
ccggcccgcaucg

SEQ ID NO: 2824031 - RNA, 17 nt, Mycobacterium avium subsp. paratuberculosis
ccggcccgcaucgcggc

SEQ ID NO: 2824032 - RNA, 19 nt, Mycobacterium avium subsp. paratuberculosis
ccggcccgcaucgcggcga

SEQ ID NO: 2824033 - RNA, 17 nt, Mycobacterium avium subsp. paratuberculosis
ccggcccgcaugcaccg

SEQ ID NO: 2824034 - RNA, 15 nt, Mycobacterium avium subsp. paratuberculosis
ccggcccgcccggcg

SEQ ID NO: 2824035 - RNA, 16 nt, Mycobacterium avium subsp. paratuberculosis
ccggcccgcccggcgg

SEQ ID NO: 2824036 - RNA, 13 nt, Mycobacterium avium subsp. paratuberculosis
ccggcccgcccgu

SEQ ID NO: 2824037 - RNA, 12 nt, Mycobacterium avium subsp. paratuberculosis
ccggcccgccgc

SEQ ID NO: 2824038 - RNA, 20 nt, Mycobacterium avium subsp. paratuberculosis
ccggcccgccgcugcagcug

SEQ ID NO: 2824039 - RNA, 14 nt, Mycobacterium avium subsp. paratuberculosis
ccggcccgcucggc

SEQ ID NO: 2824040 - RNA, 16 nt, Mycobacterium avium subsp. paratuberculosis
ccggcccgcucggcgg

SEQ ID NO: 2824041 - RNA, 16 nt, Mycobacterium avium subsp. paratuberculosis
ccggcccgcuggccgc

SEQ ID NO: 2824042 - RNA, 18 nt, Mycobacterium avium subsp. paratuberculosis
ccggcccgcuggccgccg

SEQ ID NO: 2824043 - RNA, 20 nt, Mycobacterium avium subsp. paratuberculosis
ccggcccgcuggccgccgcu

SEQ ID NO: 2824044 - RNA, 19 nt, Mycobacterium avium subsp. paratuberculosis
ccggcccggaacgcgucgc

SEQ ID NO: 2824045 - RNA, 21 nt, Mycobacterium avium subsp. paratuberculosis
ccggcccggaacgcgucgccc

SEQ ID NO: 2824046 - RNA, 13 nt, Mycobacterium avium subsp. paratuberculosis
ccggcccggcccg

SEQ ID NO: 2824047 - RNA, 17 nt, Mycobacterium avium subsp. paratuberculosis
ccggcccggcccgacgg

SEQ ID NO: 2824048 - RNA, 15 nt, Mycobacterium avium subsp. paratuberculosis
ccggcccggccggcg

SEQ ID NO: 2824049 - RNA, 13 nt, Mycobacterium avium subsp. paratuberculosis
ccggcccggcgau

SEQ ID NO: 2824050 - RNA, 16 nt, Mycobacterium avium subsp. paratuberculosis
ccggcccggcgcggcc

SEQ ID NO: 2824051 - RNA, 17 nt, Mycobacterium avium subsp. paratuberculosis
ccggcccggcgcggccg

SEQ ID NO: 2824052 - RNA, 19 nt, Mycobacterium avium subsp. paratuberculosis
ccggcccggcgcggccggu

SEQ ID NO: 2824053 - RNA, 20 nt, Mycobacterium avium subsp. paratuberculosis
ccggcccggcgcggccggug

SEQ ID NO: 2824054 - RNA, 12 nt, Mycobacterium avium subsp. paratuberculosis
ccggcccggcgg

SEQ ID NO: 2824055 - RNA, 14 nt, Mycobacterium avium subsp. paratuberculosis
ccggcccggcggcc

SEQ ID NO: 2824056 - RNA, 21 nt, Mycobacterium avium subsp. paratuberculosis
ccggcccggcggccggccgcg

SEQ ID NO: 2824057 - RNA, 18 nt, Mycobacterium avium subsp. paratuberculosis
ccggcccggcgggucagc

SEQ ID NO: 2824058 - RNA, 13 nt, Mycobacterium avium subsp. paratuberculosis
ccggcccggcguc

SEQ ID NO: 2824059 - RNA, 14 nt, Mycobacterium avium subsp. paratuberculosis
ccggcccggcgucg

SEQ ID NO: 2824060 - RNA, 15 nt, Mycobacterium avium subsp. paratuberculosis
ccggcccggcgucgu

SEQ ID NO: 2824061 - RNA, 22 nt, Mycobacterium avium subsp. paratuberculosis
ccggcccgucaggccucgagga

SEQ ID NO: 2824062 - RNA, 22 nt, Mycobacterium avium subsp. paratuberculosis
ccggcccguccagaucggccag

SEQ ID NO: 2824063 - RNA, 20 nt, Mycobacterium avium subsp. paratuberculosis
ccggcccgucgagcggcuug

SEQ ID NO: 2824064 - RNA, 18 nt, Mycobacterium avium subsp. paratuberculosis
ccggcccuauggcaucgc

SEQ ID NO: 2824065 - RNA, 16 nt, Mycobacterium avium subsp. paratuberculosis
ccggcccugcacgcaa

SEQ ID NO: 2824066 - RNA, 16 nt, Mycobacterium avium subsp. paratuberculosis
ccggcccugcggccag

SEQ ID NO: 2824067 - RNA, 21 nt, Mycobacterium avium subsp. paratuberculosis
ccggcccugcggccagugccg

SEQ ID NO: 2824068 - RNA, 18 nt, Mycobacterium avium subsp. paratuberculosis
ccggcccuggucggccag

SEQ ID NO: 2824069 - RNA, 19 nt, Mycobacterium avium subsp. paratuberculosis
ccggccgaacacggccgcc

SEQ ID NO: 2824070 - RNA, 21 nt, Mycobacterium avium subsp. paratuberculosis
ccggccgaacacggccgccuc

SEQ ID NO: 2824071 - RNA, 22 nt, Mycobacterium avium subsp. paratuberculosis
ccggccgaacacggccgccucc

SEQ ID NO: 2824072 - RNA, 18 nt, Mycobacterium avium subsp. paratuberculosis
ccggccgaagaccgccga

SEQ ID NO: 2824073 - RNA, 17 nt, Mycobacterium avium subsp. paratuberculosis
ccggccgacaccccgau

SEQ ID NO: 2824074 - RNA, 19 nt, Mycobacterium avium subsp. paratuberculosis
ccggccgacauggacgcgg

SEQ ID NO: 2824075 - RNA, 21 nt, Mycobacterium avium subsp. paratuberculosis
ccggccgacauggacgcggcc

SEQ ID NO: 2824076 - RNA, 16 nt, Mycobacterium avium subsp. paratuberculosis
ccggccgaccgccucg

SEQ ID NO: 2824077 - RNA, 17 nt, Mycobacterium avium subsp. paratuberculosis
ccggccgaccgccucga

SEQ ID NO: 2824078 - RNA, 12 nt, Mycobacterium avium subsp. paratuberculosis
ccggccgacgau

SEQ ID NO: 2824079 - RNA, 16 nt, Mycobacterium avium subsp. paratuberculosis
ccggccgacgaugaac

SEQ ID NO: 2824080 - RNA, 14 nt, Mycobacterium avium subsp. paratuberculosis
ccggccgacgcggc

SEQ ID NO: 2824081 - RNA, 13 nt, Mycobacterium avium subsp. paratuberculosis
ccggccgacgggc

SEQ ID NO: 2824082 - RNA, 15 nt, Mycobacterium avium subsp. paratuberculosis
ccggccgacgggcgu

SEQ ID NO: 2824083 - RNA, 12 nt, Mycobacterium avium subsp. paratuberculosis
ccggccgagccg

SEQ ID NO: 2824084 - RNA, 14 nt, Mycobacterium avium subsp. paratuberculosis
ccggccgagccggc

SEQ ID NO: 2824085 - RNA, 15 nt, Mycobacterium avium subsp. paratuberculosis
ccggccgagcgcagc

SEQ ID NO: 2824086 - RNA, 16 nt, Mycobacterium avium subsp. paratuberculosis
ccggccgagcgcgccg

SEQ ID NO: 2824087 - RNA, 17 nt, Mycobacterium avium subsp. paratuberculosis
ccggccgagcgcgccga

SEQ ID NO: 2824088 - RNA, 18 nt, Mycobacterium avium subsp. paratuberculosis
ccggccgagcgcgccgag

SEQ ID NO: 2824089 - RNA, 19 nt, Mycobacterium avium subsp. paratuberculosis
ccggccgagcgcgccgagc

SEQ ID NO: 2824090 - RNA, 22 nt, Mycobacterium avium subsp. paratuberculosis
ccggccgagcgcgccgagcagc

SEQ ID NO: 2824091 - RNA, 18 nt, Mycobacterium avium subsp. paratuberculosis
ccggccgaggucaccacc

SEQ ID NO: 2824092 - RNA, 19 nt, Mycobacterium avium subsp. paratuberculosis
ccggccgaggucaccaccg

SEQ ID NO: 2824093 - RNA, 13 nt, Mycobacterium avium subsp. paratuberculosis
ccggccgaugacc

SEQ ID NO: 2824094 - RNA, 18 nt, Mycobacterium avium subsp. paratuberculosis
ccggccgauggcccaggc

SEQ ID NO: 2824095 - RNA, 19 nt, Mycobacterium avium subsp. paratuberculosis
ccggccgauggcccaggcc

SEQ ID NO: 2824096 - RNA, 21 nt, Mycobacterium avium subsp. paratuberculosis
ccggccgauggcccaggccgc

SEQ ID NO: 2824097 - RNA, 23 nt, Mycobacterium avium subsp. paratuberculosis
ccggccgauggcccaggccgcgg

SEQ ID NO: 2824098 - RNA, 17 nt, Mycobacterium avium subsp. paratuberculosis
ccggccgguggccggug

SEQ ID NO: 2824099 - RNA, 22 nt, Mycobacterium avium subsp. paratuberculosis
ccggccgguggccggugggcgg

SEQ ID NO: 2824100 - RNA, 18 nt, Mycobacterium avium subsp. paratuberculosis
ccggccgguuggcggccg

SEQ ID NO: 2824101 - RNA, 21 nt, Mycobacterium avium subsp. paratuberculosis
ccggccgguuguugcggucca

SEQ ID NO: 2824102 - RNA, 22 nt, Mycobacterium avium subsp. paratuberculosis
ccggccgguuguugcgguccag

SEQ ID NO: 2824103 - RNA, 16 nt, Mycobacterium avium subsp. paratuberculosis
ccggccgucacgcugg

SEQ ID NO: 2824104 - RNA, 17 nt, Mycobacterium avium subsp. paratuberculosis
ccggccgucacgcuggc

SEQ ID NO: 2824105 - RNA, 20 nt, Mycobacterium avium subsp. paratuberculosis
ccggccgucacgcuggcgug

SEQ ID NO: 2824106 - RNA, 21 nt, Mycobacterium avium subsp. paratuberculosis
ccggccgucaggaacgccggc

SEQ ID NO: 2824107 - RNA, 19 nt, Mycobacterium avium subsp. paratuberculosis
ccggccgugaugcgccggc

SEQ ID NO: 2824108 - RNA, 21 nt, Mycobacterium avium subsp. paratuberculosis
ccggccgugaugcgccggcgg

SEQ ID NO: 2824109 - RNA, 23 nt, Mycobacterium avium subsp. paratuberculosis
ccggccgugaugcgccggcgguc

SEQ ID NO: 2824110 - RNA, 14 nt, Mycobacterium avium subsp. paratuberculosis
ccggccgugccggc

SEQ ID NO: 2824111 - RNA, 22 nt, Mycobacterium avium subsp. paratuberculosis
ccggccgugccggcucggcggc

SEQ ID NO: 2824112 - RNA, 23 nt, Mycobacterium avium subsp. paratuberculosis
ccggccgugccggcucggcggcu

SEQ ID NO: 2824113 - RNA, 14 nt, Mycobacterium avium subsp. paratuberculosis
ccggccgugccgug

SEQ ID NO: 2824114 - RNA, 15 nt, Mycobacterium avium subsp. paratuberculosis
ccggccgugccgugg

SEQ ID NO: 2824115 - RNA, 22 nt, Mycobacterium avium subsp. paratuberculosis
ccggccgugccguggucggugc

SEQ ID NO: 2824116 - RNA, 16 nt, Mycobacterium avium subsp. paratuberculosis
ccggccguucgccggc

SEQ ID NO: 2824117 - RNA, 17 nt, Mycobacterium avium subsp. paratuberculosis
ccggccguucgccggcc

SEQ ID NO: 2824118 - RNA, 23 nt, Mycobacterium avium subsp. paratuberculosis
ccggccguucgccggccagcacg

SEQ ID NO: 2824119 - RNA, 17 nt, Mycobacterium avium subsp. paratuberculosis
ccggccguucuugcggg

SEQ ID NO: 2824120 - RNA, 20 nt, Mycobacterium avium subsp. paratuberculosis
ccggccguugggccagcggc

SEQ ID NO: 2824121 - RNA, 22 nt, Mycobacterium avium subsp. paratuberculosis
ccggccuaccugguugacgccc

SEQ ID NO: 2824122 - RNA, 22 nt, Mycobacterium avium subsp. paratuberculosis
ccggccucgaugucgucgauga

SEQ ID NO: 2824123 - RNA, 19 nt, Mycobacterium avium subsp. paratuberculosis
ccggccucgccggcgccgg

SEQ ID NO: 2824124 - RNA, 21 nt, Mycobacterium avium subsp. paratuberculosis
ccggccucgccggcgccgggc

SEQ ID NO: 2824125 - RNA, 14 nt, Mycobacterium avium subsp. paratuberculosis
ccggccucgucggc

SEQ ID NO: 2824126 - RNA, 15 nt, Mycobacterium avium subsp. paratuberculosis
ccggccucgucggcg

SEQ ID NO: 2824127 - RNA, 16 nt, Mycobacterium avium subsp. paratuberculosis
ccggccucgucggcga

SEQ ID NO: 2824128 - RNA, 17 nt, Mycobacterium avium subsp. paratuberculosis
ccggccucgucggcgag

SEQ ID NO: 2824129 - RNA, 23 nt, Mycobacterium avium subsp. paratuberculosis
ccggccucgugcaaggccugcgc

SEQ ID NO: 2824130 - RNA, 19 nt, Mycobacterium avium subsp. paratuberculosis
ccggccucucgucgacgau

SEQ ID NO: 2824131 - RNA, 22 nt, Mycobacterium avium subsp. paratuberculosis
ccggccucucgucgacgauggc

SEQ ID NO: 2824132 - RNA, 19 nt, Mycobacterium avium subsp. paratuberculosis
ccggccugagacgacgcca

SEQ ID NO: 2824133 - RNA, 15 nt, Mycobacterium avium subsp. paratuberculosis
ccggccugcagcgcg

SEQ ID NO: 2824134 - RNA, 16 nt, Mycobacterium avium subsp. paratuberculosis
ccggccugcagcgcgg

SEQ ID NO: 2824135 - RNA, 19 nt, Mycobacterium avium subsp. paratuberculosis
ccggccugcagcgcgguca

SEQ ID NO: 2824136 - RNA, 22 nt, Mycobacterium avium subsp. paratuberculosis
ccggccugcagcgcggucaucg

SEQ ID NO: 2824137 - RNA, 13 nt, Mycobacterium avium subsp. paratuberculosis
ccggccugccacc

SEQ ID NO: 2824138 - RNA, 14 nt, Mycobacterium avium subsp. paratuberculosis
ccggccugccaccg

SEQ ID NO: 2824139 - RNA, 17 nt, Mycobacterium avium subsp. paratuberculosis
ccggccugccaccgcga

SEQ ID NO: 2824140 - RNA, 18 nt, Mycobacterium avium subsp. paratuberculosis
ccggccugccaccgcgaa

SEQ ID NO: 2824141 - RNA, 12 nt, Mycobacterium avium subsp. paratuberculosis
ccggccugcccg

SEQ ID NO: 2824142 - RNA, 17 nt, Mycobacterium avium subsp. paratuberculosis
ccggccugcccgccgcg

SEQ ID NO: 2824143 - RNA, 20 nt, Mycobacterium avium subsp. paratuberculosis
ccggccugcccgccgcggcc

SEQ ID NO: 2824144 - RNA, 16 nt, Mycobacterium avium subsp. paratuberculosis
ccggccuggcccagcc

SEQ ID NO: 2824145 - RNA, 19 nt, Mycobacterium avium subsp. paratuberculosis
ccggccuucaccagggugc

SEQ ID NO: 2824146 - RNA, 23 nt, Mycobacterium avium subsp. paratuberculosis
ccggccuucaccagggugccccg

SEQ ID NO: 2824147 - RNA, 17 nt, Mycobacterium avium subsp. paratuberculosis
ccggccuucucgcgcac

SEQ ID NO: 2824148 - RNA, 21 nt, Mycobacterium avium subsp. paratuberculosis
ccggccuucucgcgcaccgcg

SEQ ID NO: 2824149 - RNA, 16 nt, Mycobacterium avium subsp. paratuberculosis
ccggccuugcucgccg

SEQ ID NO: 2824150 - RNA, 17 nt, Mycobacterium avium subsp. paratuberculosis
ccggccuugcucgccgc

SEQ ID NO: 2824151 - RNA, 18 nt, Mycobacterium avium subsp. paratuberculosis
ccggccuuggcccgcgcc

SEQ ID NO: 2824152 - RNA, 21 nt, Mycobacterium avium subsp. paratuberculosis
ccggccuuggcccgcgcccgc

SEQ ID NO: 2824153 - RNA, 16 nt, Mycobacterium avium subsp. paratuberculosis
ccggcgaaacacagca

SEQ ID NO: 2824154 - RNA, 20 nt, Mycobacterium avium subsp. paratuberculosis
ccggcgaaacacagcagcac

SEQ ID NO: 2824155 - RNA, 21 nt, Mycobacterium avium subsp. paratuberculosis
ccggcgaaacacagcagcacg

SEQ ID NO: 2824156 - RNA, 23 nt, Mycobacterium avium subsp. paratuberculosis
ccggcgaaacacagcagcacgcc

SEQ ID NO: 2824157 - RNA, 15 nt, Mycobacterium avium subsp. paratuberculosis
ccggcgaaccgccgc

SEQ ID NO: 2824158 - RNA, 18 nt, Mycobacterium avium subsp. paratuberculosis
ccggcgaaccgccgcacc

SEQ ID NO: 2824159 - RNA, 21 nt, Mycobacterium avium subsp. paratuberculosis
ccggcgaaccgccgcacccag

SEQ ID NO: 2824160 - RNA, 22 nt, Mycobacterium avium subsp. paratuberculosis
ccggcgaaccgccgcacccagc

SEQ ID NO: 2824161 - RNA, 19 nt, Mycobacterium avium subsp. paratuberculosis
ccggcgaaccgggacagcc

SEQ ID NO: 2824162 - RNA, 23 nt, Mycobacterium avium subsp. paratuberculosis
ccggcgaaccgggacagccgcgc

SEQ ID NO: 2824163 - RNA, 18 nt, Mycobacterium avium subsp. paratuberculosis
ccggcgaaccucacccau

SEQ ID NO: 2824164 - RNA, 14 nt, Mycobacterium avium subsp. paratuberculosis
ccggcgaacgccuc

SEQ ID NO: 2824165 - RNA, 16 nt, Mycobacterium avium subsp. paratuberculosis
ccggcgaacgccucgg

SEQ ID NO: 2824166 - RNA, 18 nt, Mycobacterium avium subsp. paratuberculosis
ccggcgaacuccacccug

SEQ ID NO: 2824167 - RNA, 20 nt, Mycobacterium avium subsp. paratuberculosis
ccggcgaacuccacccugcc

SEQ ID NO: 2824168 - RNA, 16 nt, Mycobacterium avium subsp. paratuberculosis
ccggcgaacucgcggc

SEQ ID NO: 2824169 - RNA, 19 nt, Mycobacterium avium subsp. paratuberculosis
ccggcgaacucgcggcggg

SEQ ID NO: 2824170 - RNA, 21 nt, Mycobacterium avium subsp. paratuberculosis
ccggcgaagcuaaaccccacg

SEQ ID NO: 2824171 - RNA, 18 nt, Mycobacterium avium subsp. paratuberculosis
ccggcgaagcucgacgau

SEQ ID NO: 2824172 - RNA, 20 nt, Mycobacterium avium subsp. paratuberculosis
ccggcgaagcucgacgauga

SEQ ID NO: 2824173 - RNA, 16 nt, Mycobacterium avium subsp. paratuberculosis
ccggcgaaggacagcc

SEQ ID NO: 2824174 - RNA, 16 nt, Mycobacterium avium subsp. paratuberculosis
ccggcgaauccgaccg

SEQ ID NO: 2824175 - RNA, 18 nt, Mycobacterium avium subsp. paratuberculosis
ccggcgaauccgaccggc

SEQ ID NO: 2824176 - RNA, 19 nt, Mycobacterium avium subsp. paratuberculosis
ccggcgaauccgaccggcu

SEQ ID NO: 2824177 - RNA, 23 nt, Mycobacterium avium subsp. paratuberculosis
ccggcgaauccgaccggcucagc

SEQ ID NO: 2824178 - RNA, 18 nt, Mycobacterium avium subsp. paratuberculosis
ccggcgacaugcgcagcg

SEQ ID NO: 2824179 - RNA, 21 nt, Mycobacterium avium subsp. paratuberculosis
ccggcgacaugcgcagcgccc

SEQ ID NO: 2824180 - RNA, 15 nt, Mycobacterium avium subsp. paratuberculosis
ccggcgaccacccuc

SEQ ID NO: 2824181 - RNA, 12 nt, Mycobacterium avium subsp. paratuberculosis
ccggcgaccagc

SEQ ID NO: 2824182 - RNA, 16 nt, Mycobacterium avium subsp. paratuberculosis
ccggcgaugaucaggc

SEQ ID NO: 2824183 - RNA, 20 nt, Mycobacterium avium subsp. paratuberculosis
ccggcgaugaucaggccgga

SEQ ID NO: 2824184 - RNA, 16 nt, Mycobacterium avium subsp. paratuberculosis
ccggcgaugcagauca

SEQ ID NO: 2824185 - RNA, 20 nt, Mycobacterium avium subsp. paratuberculosis
ccggcgaugccagcgcaccg

SEQ ID NO: 2824186 - RNA, 18 nt, Mycobacterium avium subsp. paratuberculosis
ccggcgaugcccgugauc

SEQ ID NO: 2824187 - RNA, 19 nt, Mycobacterium avium subsp. paratuberculosis
ccggcgaugcgcacgucgg

SEQ ID NO: 2824188 - RNA, 21 nt, Mycobacterium avium subsp. paratuberculosis
ccggcgaugcgcacgucggcc

SEQ ID NO: 2824189 - RNA, 23 nt, Mycobacterium avium subsp. paratuberculosis
ccggcgaugcgcacgucggccgc

SEQ ID NO: 2824190 - RNA, 16 nt, Mycobacterium avium subsp. paratuberculosis
ccggcgauggcgcggc

SEQ ID NO: 2824191 - RNA, 17 nt, Mycobacterium avium subsp. paratuberculosis
ccggcgauggcgcggcc

SEQ ID NO: 2824192 - RNA, 18 nt, Mycobacterium avium subsp. paratuberculosis
ccggcgauggcgcggccg

SEQ ID NO: 2824193 - RNA, 23 nt, Mycobacterium avium subsp. paratuberculosis
ccggcgauggcgcggccggccga

SEQ ID NO: 2824194 - RNA, 21 nt, Mycobacterium avium subsp. paratuberculosis
ccggcgaugguggcgcugccg

SEQ ID NO: 2824195 - RNA, 13 nt, Mycobacterium avium subsp. paratuberculosis
ccggcgaugucgg

SEQ ID NO: 2824196 - RNA, 22 nt, Mycobacterium avium subsp. paratuberculosis
ccggcgauuaggucgguggcca

SEQ ID NO: 2824197 - RNA, 16 nt, Mycobacterium avium subsp. paratuberculosis
ccggcgauuucggccg

SEQ ID NO: 2824198 - RNA, 18 nt, Mycobacterium avium subsp. paratuberculosis
ccggcgauuucggccgug

SEQ ID NO: 2824199 - RNA, 16 nt, Mycobacterium avium subsp. paratuberculosis
ccggcgcaacucgucc

SEQ ID NO: 2824200 - RNA, 21 nt, Mycobacterium avium subsp. paratuberculosis
ccggcgcaacucguccagcgu

SEQ ID NO: 2824201 - RNA, 22 nt, Mycobacterium avium subsp. paratuberculosis
ccggcgcacaggaacgcgucga

SEQ ID NO: 2824202 - RNA, 23 nt, Mycobacterium avium subsp. paratuberculosis
ccggcgcacaggaacgcgucgac

SEQ ID NO: 2824203 - RNA, 18 nt, Mycobacterium avium subsp. paratuberculosis
ccggcgcacaucguggcg

SEQ ID NO: 2824204 - RNA, 12 nt, Mycobacterium avium subsp. paratuberculosis
ccggcgcaccag

SEQ ID NO: 2824205 - RNA, 13 nt, Mycobacterium avium subsp. paratuberculosis
ccggcgcaccagg

SEQ ID NO: 2824206 - RNA, 14 nt, Mycobacterium avium subsp. paratuberculosis
ccggcgcaccaggc

SEQ ID NO: 2824207 - RNA, 18 nt, Mycobacterium avium subsp. paratuberculosis
ccggcgcaccaggcgcca

SEQ ID NO: 2824208 - RNA, 22 nt, Mycobacterium avium subsp. paratuberculosis
ccggcgcaccaggcgccacagc

SEQ ID NO: 2824209 - RNA, 23 nt, Mycobacterium avium subsp. paratuberculosis
ccggcgcaccaggcgccacagca

SEQ ID NO: 2824210 - RNA, 23 nt, Mycobacterium avium subsp. paratuberculosis
ccggcgcaccagggugucgucgc

SEQ ID NO: 2824211 - RNA, 12 nt, Mycobacterium avium subsp. paratuberculosis
ccggcgcacccg

SEQ ID NO: 2824212 - RNA, 19 nt, Mycobacterium avium subsp. paratuberculosis
ccggcgcacccgcacgaug

SEQ ID NO: 2824213 - RNA, 14 nt, Mycobacterium avium subsp. paratuberculosis
ccggcgcaccgcgu

SEQ ID NO: 2824214 - RNA, 18 nt, Mycobacterium avium subsp. paratuberculosis
ccggcgcaccgcgucgac

SEQ ID NO: 2824215 - RNA, 22 nt, Mycobacterium avium subsp. paratuberculosis
ccggcgcaccgcgucgaccacc

SEQ ID NO: 2824216 - RNA, 18 nt, Mycobacterium avium subsp. paratuberculosis
ccggcgcaccgcgucgau

SEQ ID NO: 2824217 - RNA, 19 nt, Mycobacterium avium subsp. paratuberculosis
ccggcgcaccgcgucgaug

SEQ ID NO: 2824218 - RNA, 13 nt, Mycobacterium avium subsp. paratuberculosis
ccggcgcacggcg

SEQ ID NO: 2824219 - RNA, 14 nt, Mycobacterium avium subsp. paratuberculosis
ccggcgcacggcgc

SEQ ID NO: 2824220 - RNA, 15 nt, Mycobacterium avium subsp. paratuberculosis
ccggcgcacggcgcc

SEQ ID NO: 2824221 - RNA, 17 nt, Mycobacterium avium subsp. paratuberculosis
ccggcgcacggcgccca

SEQ ID NO: 2824222 - RNA, 15 nt, Mycobacterium avium subsp. paratuberculosis
ccggcgcacucccgc

SEQ ID NO: 2824223 - RNA, 16 nt, Mycobacterium avium subsp. paratuberculosis
ccggcgcacucccgcg

SEQ ID NO: 2824224 - RNA, 15 nt, Mycobacterium avium subsp. paratuberculosis
ccggcgcagcaacuc

SEQ ID NO: 2824225 - RNA, 13 nt, Mycobacterium avium subsp. paratuberculosis
ccggcgcagccgg

SEQ ID NO: 2824226 - RNA, 14 nt, Mycobacterium avium subsp. paratuberculosis
ccggcgcagccggc

SEQ ID NO: 2824227 - RNA, 16 nt, Mycobacterium avium subsp. paratuberculosis
ccggcgcagccggcca

SEQ ID NO: 2824228 - RNA, 18 nt, Mycobacterium avium subsp. paratuberculosis
ccggcgcagccggccacc

SEQ ID NO: 2824229 - RNA, 13 nt, Mycobacterium avium subsp. paratuberculosis
ccggcgcagcgcc

SEQ ID NO: 2824230 - RNA, 15 nt, Mycobacterium avium subsp. paratuberculosis
ccggcgcagcgccgc

SEQ ID NO: 2824231 - RNA, 17 nt, Mycobacterium avium subsp. paratuberculosis
ccggcgcagcgccgcgc

SEQ ID NO: 2824232 - RNA, 18 nt, Mycobacterium avium subsp. paratuberculosis
ccggcgcagcgccgcgcc

SEQ ID NO: 2824233 - RNA, 19 nt, Mycobacterium avium subsp. paratuberculosis
ccggcgcagcgccgcgccg

SEQ ID NO: 2824234 - RNA, 21 nt, Mycobacterium avium subsp. paratuberculosis
ccggcgcagcgccgcgccgac

SEQ ID NO: 2824235 - RNA, 14 nt, Mycobacterium avium subsp. paratuberculosis
ccggcgcagcgcgu

SEQ ID NO: 2824236 - RNA, 17 nt, Mycobacterium avium subsp. paratuberculosis
ccggcgcagcgcgucgc

SEQ ID NO: 2824237 - RNA, 19 nt, Mycobacterium avium subsp. paratuberculosis
ccggcgcagcgcgucgcgc

SEQ ID NO: 2824238 - RNA, 20 nt, Mycobacterium avium subsp. paratuberculosis
ccggcgcagcgcgucgcgcc

SEQ ID NO: 2824239 - RNA, 22 nt, Mycobacterium avium subsp. paratuberculosis
ccggcgcagcgcgucgcgcccg

SEQ ID NO: 2824240 - RNA, 23 nt, Mycobacterium avium subsp. paratuberculosis
ccggcgcagcgcgucgcgcccgg

SEQ ID NO: 2824241 - RNA, 16 nt, Mycobacterium avium subsp. paratuberculosis
ccggcgcagcggcccg

SEQ ID NO: 2824242 - RNA, 18 nt, Mycobacterium avium subsp. paratuberculosis
ccggcgcaguccagggug

SEQ ID NO: 2824243 - RNA, 22 nt, Mycobacterium avium subsp. paratuberculosis
ccggcgcaguccaggguggugg

SEQ ID NO: 2824244 - RNA, 15 nt, Mycobacterium avium subsp. paratuberculosis
ccggcgccacgacug

SEQ ID NO: 2824245 - RNA, 21 nt, Mycobacterium avium subsp. paratuberculosis
ccggcgccacgacugcgcggc

SEQ ID NO: 2824246 - RNA, 23 nt, Mycobacterium avium subsp. paratuberculosis
ccggcgccacgacugcgcggccg

SEQ ID NO: 2824247 - RNA, 18 nt, Mycobacterium avium subsp. paratuberculosis
ccggcgccacgcacaccg

SEQ ID NO: 2824248 - RNA, 19 nt, Mycobacterium avium subsp. paratuberculosis
ccggcgccacgcacaccgc

SEQ ID NO: 2824249 - RNA, 14 nt, Mycobacterium avium subsp. paratuberculosis
ccggcgccacgccg

SEQ ID NO: 2824250 - RNA, 15 nt, Mycobacterium avium subsp. paratuberculosis
ccggcgccacgccgc

SEQ ID NO: 2824251 - RNA, 17 nt, Mycobacterium avium subsp. paratuberculosis
ccggcgccacgccgcga

SEQ ID NO: 2824252 - RNA, 13 nt, Mycobacterium avium subsp. paratuberculosis
ccggcgccagccc

SEQ ID NO: 2824253 - RNA, 16 nt, Mycobacterium avium subsp. paratuberculosis
ccggcgccagcccggu

SEQ ID NO: 2824254 - RNA, 17 nt, Mycobacterium avium subsp. paratuberculosis
ccggcgccagcccggug

SEQ ID NO: 2824255 - RNA, 21 nt, Mycobacterium avium subsp. paratuberculosis
ccggcgccagcccggugaucg

SEQ ID NO: 2824256 - RNA, 14 nt, Mycobacterium avium subsp. paratuberculosis
ccggcgccaggccg

SEQ ID NO: 2824257 - RNA, 16 nt, Mycobacterium avium subsp. paratuberculosis
ccggcgccaggccggc

SEQ ID NO: 2824258 - RNA, 20 nt, Mycobacterium avium subsp. paratuberculosis
ccggcgccaggccggcgacg

SEQ ID NO: 2824259 - RNA, 15 nt, Mycobacterium avium subsp. paratuberculosis
ccggcgcccagcggc

SEQ ID NO: 2824260 - RNA, 20 nt, Mycobacterium avium subsp. paratuberculosis
ccggcgcccagcggcgaugc

SEQ ID NO: 2824261 - RNA, 12 nt, Mycobacterium avium subsp. paratuberculosis
ccggcgcccgau

SEQ ID NO: 2824262 - RNA, 21 nt, Mycobacterium avium subsp. paratuberculosis
ccggcgcccgaucggcacccg

SEQ ID NO: 2824263 - RNA, 23 nt, Mycobacterium avium subsp. paratuberculosis
ccggcgcccgaugaaguacccgg

SEQ ID NO: 2824264 - RNA, 13 nt, Mycobacterium avium subsp. paratuberculosis
ccggcgcccgcag

SEQ ID NO: 2824265 - RNA, 17 nt, Mycobacterium avium subsp. paratuberculosis
ccggcgcccgcaggccg

SEQ ID NO: 2824266 - RNA, 16 nt, Mycobacterium avium subsp. paratuberculosis
ccggcgcgccugcgcg

SEQ ID NO: 2824267 - RNA, 18 nt, Mycobacterium avium subsp. paratuberculosis
ccggcgcgccugcgcggc

SEQ ID NO: 2824268 - RNA, 20 nt, Mycobacterium avium subsp. paratuberculosis
ccggcgcgcgagcgucacgc

SEQ ID NO: 2824269 - RNA, 18 nt, Mycobacterium avium subsp. paratuberculosis
ccggcgcgcugaagcgcg

SEQ ID NO: 2824270 - RNA, 21 nt, Mycobacterium avium subsp. paratuberculosis
ccggcgcgcugaagcgcgacc

SEQ ID NO: 2824271 - RNA, 14 nt, Mycobacterium avium subsp. paratuberculosis
ccggcgcggaacgc

SEQ ID NO: 2824272 - RNA, 20 nt, Mycobacterium avium subsp. paratuberculosis
ccggcgcggaacgcgccggg

SEQ ID NO: 2824273 - RNA, 22 nt, Mycobacterium avium subsp. paratuberculosis
ccggcgcggaacgcgccgggca

SEQ ID NO: 2824274 - RNA, 24 nt, Mycobacterium avium subsp. paratuberculosis
ccggcgcggaacgcgccgggcaac

SEQ ID NO: 2824275 - RNA, 16 nt, Mycobacterium avium subsp. paratuberculosis
ccggcgcggacagcgc

SEQ ID NO: 2824276 - RNA, 18 nt, Mycobacterium avium subsp. paratuberculosis
ccggcgcggacagcgcgg

SEQ ID NO: 2824277 - RNA, 20 nt, Mycobacterium avium subsp. paratuberculosis
ccggcgcggacagcgcggug

SEQ ID NO: 2824278 - RNA, 13 nt, Mycobacterium avium subsp. paratuberculosis
ccggcgcggacgg

SEQ ID NO: 2824279 - RNA, 20 nt, Mycobacterium avium subsp. paratuberculosis
ccggcgcggacggaucgagu

SEQ ID NO: 2824280 - RNA, 20 nt, Mycobacterium avium subsp. paratuberculosis
ccggcgcggcaucggcgacg

SEQ ID NO: 2824281 - RNA, 14 nt, Mycobacterium avium subsp. paratuberculosis
ccggcgcggccgcc

SEQ ID NO: 2824282 - RNA, 18 nt, Mycobacterium avium subsp. paratuberculosis
ccggcgcggccgcccagc

SEQ ID NO: 2824283 - RNA, 13 nt, Mycobacterium avium subsp. paratuberculosis
ccggcgcggcggc

SEQ ID NO: 2824284 - RNA, 14 nt, Mycobacterium avium subsp. paratuberculosis
ccggcgcggcggcg

SEQ ID NO: 2824285 - RNA, 17 nt, Mycobacterium avium subsp. paratuberculosis
ccggcgcggcggcgacg

SEQ ID NO: 2824286 - RNA, 15 nt, Mycobacterium avium subsp. paratuberculosis
ccggcgcggcggcgc

SEQ ID NO: 2824287 - RNA, 20 nt, Mycobacterium avium subsp. paratuberculosis
ccggcgcggcggcgccgcgg

SEQ ID NO: 2824288 - RNA, 12 nt, Mycobacterium avium subsp. paratuberculosis
ccggcgcgggca

SEQ ID NO: 2824289 - RNA, 20 nt, Mycobacterium avium subsp. paratuberculosis
ccggcgcgggccgcagcgcg

SEQ ID NO: 2824290 - RNA, 16 nt, Mycobacterium avium subsp. paratuberculosis
ccggcgcgggggcggc

SEQ ID NO: 2824291 - RNA, 14 nt, Mycobacterium avium subsp. paratuberculosis
ccggcgcggugauu

SEQ ID NO: 2824292 - RNA, 16 nt, Mycobacterium avium subsp. paratuberculosis
ccggcgcggugcucgg

SEQ ID NO: 2824293 - RNA, 12 nt, Mycobacterium avium subsp. paratuberculosis
ccggcgcggugg

SEQ ID NO: 2824294 - RNA, 13 nt, Mycobacterium avium subsp. paratuberculosis
ccggcgcgguggg

SEQ ID NO: 2824295 - RNA, 20 nt, Mycobacterium avium subsp. paratuberculosis
ccggcgcgguucuugcgcca

SEQ ID NO: 2824296 - RNA, 21 nt, Mycobacterium avium subsp. paratuberculosis
ccggcgcgguucuugcgccau

SEQ ID NO: 2824297 - RNA, 23 nt, Mycobacterium avium subsp. paratuberculosis
ccggcgcguccggaggugccggc

SEQ ID NO: 2824298 - RNA, 17 nt, Mycobacterium avium subsp. paratuberculosis
ccggcgcgugcgcgacg

SEQ ID NO: 2824299 - RNA, 20 nt, Mycobacterium avium subsp. paratuberculosis
ccggcgcguuccaucagcgc

SEQ ID NO: 2824300 - RNA, 17 nt, Mycobacterium avium subsp. paratuberculosis
ccggcgcguuggcccgu

SEQ ID NO: 2824301 - RNA, 23 nt, Mycobacterium avium subsp. paratuberculosis
ccggcgcuaaagccgaccgcccc

SEQ ID NO: 2824302 - RNA, 14 nt, Mycobacterium avium subsp. paratuberculosis
ccggcgcucaccgc

SEQ ID NO: 2824303 - RNA, 16 nt, Mycobacterium avium subsp. paratuberculosis
ccggcgcucaccgcga

SEQ ID NO: 2824304 - RNA, 19 nt, Mycobacterium avium subsp. paratuberculosis
ccggcgcucaccgcgauga

SEQ ID NO: 2824305 - RNA, 13 nt, Mycobacterium avium subsp. paratuberculosis
ccggcgcucgucg

SEQ ID NO: 2824306 - RNA, 17 nt, Mycobacterium avium subsp. paratuberculosis
ccggcgcucgucgucgc

SEQ ID NO: 2824307 - RNA, 19 nt, Mycobacterium avium subsp. paratuberculosis
ccggcgcucgucgucgccg

SEQ ID NO: 2824308 - RNA, 21 nt, Mycobacterium avium subsp. paratuberculosis
ccggcgcugaagugcagcgca

SEQ ID NO: 2824309 - RNA, 18 nt, Mycobacterium avium subsp. paratuberculosis
ccggcgcugcccgucgac

SEQ ID NO: 2824310 - RNA, 19 nt, Mycobacterium avium subsp. paratuberculosis
ccggcgcugcccgucgacc

SEQ ID NO: 2824311 - RNA, 21 nt, Mycobacterium avium subsp. paratuberculosis
ccggcgcugcccgucgaccuc

SEQ ID NO: 2824312 - RNA, 16 nt, Mycobacterium avium subsp. paratuberculosis
ccggcgcugcgcccgg

SEQ ID NO: 2824313 - RNA, 16 nt, Mycobacterium avium subsp. paratuberculosis
ccggcgcuggaacagg

SEQ ID NO: 2824314 - RNA, 15 nt, Mycobacterium avium subsp. paratuberculosis
ccggcgcuggcgcgc

SEQ ID NO: 2824315 - RNA, 18 nt, Mycobacterium avium subsp. paratuberculosis
ccggcgcuggcgcgccgu

SEQ ID NO: 2824316 - RNA, 15 nt, Mycobacterium avium subsp. paratuberculosis
ccggcgcuggcgugc

SEQ ID NO: 2824317 - RNA, 16 nt, Mycobacterium avium subsp. paratuberculosis
ccggcgcuggcgugcu

SEQ ID NO: 2824318 - RNA, 20 nt, Mycobacterium avium subsp. paratuberculosis
ccggcggaaguagcccggag

SEQ ID NO: 2824319 - RNA, 16 nt, Mycobacterium avium subsp. paratuberculosis
ccggcggacagccccg

SEQ ID NO: 2824320 - RNA, 19 nt, Mycobacterium avium subsp. paratuberculosis
ccggcggacagccccgagc

SEQ ID NO: 2824321 - RNA, 23 nt, Mycobacterium avium subsp. paratuberculosis
ccggcggacagccccgagccgcg

SEQ ID NO: 2824322 - RNA, 13 nt, Mycobacterium avium subsp. paratuberculosis
ccggcggacccag

SEQ ID NO: 2824323 - RNA, 14 nt, Mycobacterium avium subsp. paratuberculosis
ccggcggacccagc

SEQ ID NO: 2824324 - RNA, 17 nt, Mycobacterium avium subsp. paratuberculosis
ccggcggacccagcucc

SEQ ID NO: 2824325 - RNA, 13 nt, Mycobacterium avium subsp. paratuberculosis
ccggcggacccgg

SEQ ID NO: 2824326 - RNA, 22 nt, Mycobacterium avium subsp. paratuberculosis
ccggcggacgcggccagcgccc

SEQ ID NO: 2824327 - RNA, 19 nt, Mycobacterium avium subsp. paratuberculosis
ccggcggacggucccgacg

SEQ ID NO: 2824328 - RNA, 16 nt, Mycobacterium avium subsp. paratuberculosis
ccggcggaucgcgugc

SEQ ID NO: 2824329 - RNA, 11 nt, Mycobacterium avium subsp. paratuberculosis
ccggcggcacc

SEQ ID NO: 2824330 - RNA, 15 nt, Mycobacterium avium subsp. paratuberculosis
ccggcggcaccaccc

SEQ ID NO: 2824331 - RNA, 16 nt, Mycobacterium avium subsp. paratuberculosis
ccggcggcaccacccg

SEQ ID NO: 2824332 - RNA, 22 nt, Mycobacterium avium subsp. paratuberculosis
ccggcggcaccacccgcggccg

SEQ ID NO: 2824333 - RNA, 13 nt, Mycobacterium avium subsp. paratuberculosis
ccggcggcaccgc

SEQ ID NO: 2824334 - RNA, 14 nt, Mycobacterium avium subsp. paratuberculosis
ccggcggcaccgcc

SEQ ID NO: 2824335 - RNA, 16 nt, Mycobacterium avium subsp. paratuberculosis
ccggcggcaccgccgc

SEQ ID NO: 2824336 - RNA, 18 nt, Mycobacterium avium subsp. paratuberculosis
ccggcggcaccgcggcuc

SEQ ID NO: 2824337 - RNA, 19 nt, Mycobacterium avium subsp. paratuberculosis
ccggcggcaccgcggcucg

SEQ ID NO: 2824338 - RNA, 23 nt, Mycobacterium avium subsp. paratuberculosis
ccggcggcagauagaucagcagg

SEQ ID NO: 2824339 - RNA, 12 nt, Mycobacterium avium subsp. paratuberculosis
ccggcggcagcg

SEQ ID NO: 2824340 - RNA, 12 nt, Mycobacterium avium subsp. paratuberculosis
ccggcggcaggu

SEQ ID NO: 2824341 - RNA, 15 nt, Mycobacterium avium subsp. paratuberculosis
ccggcggcaggugaa

SEQ ID NO: 2824342 - RNA, 14 nt, Mycobacterium avium subsp. paratuberculosis
ccggcggcaggugg

SEQ ID NO: 2824343 - RNA, 23 nt, Mycobacterium avium subsp. paratuberculosis
ccggcggcagguggucggugaag

SEQ ID NO: 2824344 - RNA, 17 nt, Mycobacterium avium subsp. paratuberculosis
ccggcggcagugcgccg

SEQ ID NO: 2824345 - RNA, 18 nt, Mycobacterium avium subsp. paratuberculosis
ccggcggcagugcgccgu

SEQ ID NO: 2824346 - RNA, 13 nt, Mycobacterium avium subsp. paratuberculosis
ccggcggccacca

SEQ ID NO: 2824347 - RNA, 20 nt, Mycobacterium avium subsp. paratuberculosis
ccggcggccaccaugggcgg

SEQ ID NO: 2824348 - RNA, 13 nt, Mycobacterium avium subsp. paratuberculosis
ccggcggccacga

SEQ ID NO: 2824349 - RNA, 14 nt, Mycobacterium avium subsp. paratuberculosis
ccggcggccacgau

SEQ ID NO: 2824350 - RNA, 20 nt, Mycobacterium avium subsp. paratuberculosis
ccggcggccacgaucgcggc

SEQ ID NO: 2824351 - RNA, 16 nt, Mycobacterium avium subsp. paratuberculosis
ccggcgggcucgccgg

SEQ ID NO: 2824352 - RNA, 21 nt, Mycobacterium avium subsp. paratuberculosis
ccggcgggcucgccggcccga

SEQ ID NO: 2824353 - RNA, 17 nt, Mycobacterium avium subsp. paratuberculosis
ccggcgggcuggugcgc

SEQ ID NO: 2824354 - RNA, 14 nt, Mycobacterium avium subsp. paratuberculosis
ccggcggggacgug

SEQ ID NO: 2824355 - RNA, 17 nt, Mycobacterium avium subsp. paratuberculosis
ccggcggggacgugucg

SEQ ID NO: 2824356 - RNA, 18 nt, Mycobacterium avium subsp. paratuberculosis
ccggcggggacgugucgg

SEQ ID NO: 2824357 - RNA, 23 nt, Mycobacterium avium subsp. paratuberculosis
ccggcggggacgugucggggugg

SEQ ID NO: 2824358 - RNA, 17 nt, Mycobacterium avium subsp. paratuberculosis
ccggcgggggcgcgucc

SEQ ID NO: 2824359 - RNA, 18 nt, Mycobacterium avium subsp. paratuberculosis
ccggcgggggcgcguccg

SEQ ID NO: 2824360 - RNA, 15 nt, Mycobacterium avium subsp. paratuberculosis
ccggcggggguucga

SEQ ID NO: 2824361 - RNA, 20 nt, Mycobacterium avium subsp. paratuberculosis
ccggcggggguucgacguca

SEQ ID NO: 2824362 - RNA, 14 nt, Mycobacterium avium subsp. paratuberculosis
ccggcgggucagca

SEQ ID NO: 2824363 - RNA, 15 nt, Mycobacterium avium subsp. paratuberculosis
ccggcgggucagcac

SEQ ID NO: 2824364 - RNA, 18 nt, Mycobacterium avium subsp. paratuberculosis
ccggcgggucagcaccgc

SEQ ID NO: 2824365 - RNA, 20 nt, Mycobacterium avium subsp. paratuberculosis
ccggcgggucagcaccgcgg

SEQ ID NO: 2824366 - RNA, 19 nt, Mycobacterium avium subsp. paratuberculosis
ccggcgggucugugaccac

SEQ ID NO: 2824367 - RNA, 20 nt, Mycobacterium avium subsp. paratuberculosis
ccggcgggucugugaccacg

SEQ ID NO: 2824368 - RNA, 17 nt, Mycobacterium avium subsp. paratuberculosis
ccggcgguaccgccgau

SEQ ID NO: 2824369 - RNA, 18 nt, Mycobacterium avium subsp. paratuberculosis
ccggcgguaccgccgauc

SEQ ID NO: 2824370 - RNA, 18 nt, Mycobacterium avium subsp. paratuberculosis
ccggcgguaugcccgggc

SEQ ID NO: 2824371 - RNA, 19 nt, Mycobacterium avium subsp. paratuberculosis
ccggcgguaugcccgggcc

SEQ ID NO: 2824372 - RNA, 20 nt, Mycobacterium avium subsp. paratuberculosis
ccggcgguaugcccgggccg

SEQ ID NO: 2824373 - RNA, 12 nt, Mycobacterium avium subsp. paratuberculosis
ccggcggucagc

SEQ ID NO: 2824374 - RNA, 13 nt, Mycobacterium avium subsp. paratuberculosis
ccggcggucagca

SEQ ID NO: 2824375 - RNA, 15 nt, Mycobacterium avium subsp. paratuberculosis
ccggcggucagcacc

SEQ ID NO: 2824376 - RNA, 19 nt, Mycobacterium avium subsp. paratuberculosis
ccggcggucagcaccguca

SEQ ID NO: 2824377 - RNA, 20 nt, Mycobacterium avium subsp. paratuberculosis
ccggcggucagcaccgucac

SEQ ID NO: 2824378 - RNA, 23 nt, Mycobacterium avium subsp. paratuberculosis
ccggcggucagcaccgucaccgc

SEQ ID NO: 2824379 - RNA, 15 nt, Mycobacterium avium subsp. paratuberculosis
ccggcggucaggccg

SEQ ID NO: 2824380 - RNA, 16 nt, Mycobacterium avium subsp. paratuberculosis
ccggcggucaggccgu

SEQ ID NO: 2824381 - RNA, 14 nt, Mycobacterium avium subsp. paratuberculosis
ccggcgguccugcg

SEQ ID NO: 2824382 - RNA, 18 nt, Mycobacterium avium subsp. paratuberculosis
ccggcgguccugcggcga

SEQ ID NO: 2824383 - RNA, 20 nt, Mycobacterium avium subsp. paratuberculosis
ccggcgguccugcggcgaca

SEQ ID NO: 2824384 - RNA, 13 nt, Mycobacterium avium subsp. paratuberculosis
ccggcggucgaca

SEQ ID NO: 2824385 - RNA, 15 nt, Mycobacterium avium subsp. paratuberculosis
ccggcggucgccgaa

SEQ ID NO: 2824386 - RNA, 16 nt, Mycobacterium avium subsp. paratuberculosis
ccggcggucgcugcag

SEQ ID NO: 2824387 - RNA, 17 nt, Mycobacterium avium subsp. paratuberculosis
ccggcggucgcugcagc

SEQ ID NO: 2824388 - RNA, 17 nt, Mycobacterium avium subsp. paratuberculosis
ccggcggucggaucgag

SEQ ID NO: 2824389 - RNA, 15 nt, Mycobacterium avium subsp. paratuberculosis
ccggcggugauccgc

SEQ ID NO: 2824390 - RNA, 18 nt, Mycobacterium avium subsp. paratuberculosis
ccggcggugauccgcccg

SEQ ID NO: 2824391 - RNA, 22 nt, Mycobacterium avium subsp. paratuberculosis
ccggcggugauccgcccggccc

SEQ ID NO: 2824392 - RNA, 14 nt, Mycobacterium avium subsp. paratuberculosis
ccggcggugcaggg

SEQ ID NO: 2824393 - RNA, 17 nt, Mycobacterium avium subsp. paratuberculosis
ccggcggugcaggguca

SEQ ID NO: 2824394 - RNA, 20 nt, Mycobacterium avium subsp. paratuberculosis
ccggcggugccggccagauc

SEQ ID NO: 2824395 - RNA, 21 nt, Mycobacterium avium subsp. paratuberculosis
ccggcggugccggccagaucg

SEQ ID NO: 2824396 - RNA, 20 nt, Mycobacterium avium subsp. paratuberculosis
ccggcggugcggacccguug

SEQ ID NO: 2824397 - RNA, 15 nt, Mycobacterium avium subsp. paratuberculosis
ccggcggugcggcgg

SEQ ID NO: 2824398 - RNA, 17 nt, Mycobacterium avium subsp. paratuberculosis
ccggcggugcggcgggg

SEQ ID NO: 2824399 - RNA, 14 nt, Mycobacterium avium subsp. paratuberculosis
ccggcggugcgggu

SEQ ID NO: 2824400 - RNA, 21 nt, Mycobacterium avium subsp. paratuberculosis
ccggcggugcggguggugugg

SEQ ID NO: 2824401 - RNA, 18 nt, Mycobacterium avium subsp. paratuberculosis
ccggcggugcgucgaauc

SEQ ID NO: 2824402 - RNA, 21 nt, Mycobacterium avium subsp. paratuberculosis
ccggcggugcgucgaaucaca

SEQ ID NO: 2824403 - RNA, 22 nt, Mycobacterium avium subsp. paratuberculosis
ccggcgguggugccgccgucga

SEQ ID NO: 2824404 - RNA, 14 nt, Mycobacterium avium subsp. paratuberculosis
ccggcgguguccac

SEQ ID NO: 2824405 - RNA, 22 nt, Mycobacterium avium subsp. paratuberculosis
ccggcgguguccacgaugcggu

SEQ ID NO: 2824406 - RNA, 18 nt, Mycobacterium avium subsp. paratuberculosis
ccggcggugucggugccg

SEQ ID NO: 2824407 - RNA, 16 nt, Mycobacterium avium subsp. paratuberculosis
ccggcgguucggcggg

SEQ ID NO: 2824408 - RNA, 14 nt, Mycobacterium avium subsp. paratuberculosis
ccggcguacccgcc

SEQ ID NO: 2824409 - RNA, 19 nt, Mycobacterium avium subsp. paratuberculosis
ccggcguacgacaucucga

SEQ ID NO: 2824410 - RNA, 23 nt, Mycobacterium avium subsp. paratuberculosis
ccggcguacgacaucucgacggu

SEQ ID NO: 2824411 - RNA, 18 nt, Mycobacterium avium subsp. paratuberculosis
ccggcguacucgcacagc

SEQ ID NO: 2824412 - RNA, 15 nt, Mycobacterium avium subsp. paratuberculosis
ccggcguagaacacc

SEQ ID NO: 2824413 - RNA, 20 nt, Mycobacterium avium subsp. paratuberculosis
ccggcguagaacaccgaauu

SEQ ID NO: 2824414 - RNA, 16 nt, Mycobacterium avium subsp. paratuberculosis
ccggcguagaccagcg

SEQ ID NO: 2824415 - RNA, 21 nt, Mycobacterium avium subsp. paratuberculosis
ccggcguagaccagcgacgcc

SEQ ID NO: 2824416 - RNA, 16 nt, Mycobacterium avium subsp. paratuberculosis
ccggcguagcagucgg

SEQ ID NO: 2824417 - RNA, 18 nt, Mycobacterium avium subsp. paratuberculosis
ccggcguagcagucggcc

SEQ ID NO: 2824418 - RNA, 18 nt, Mycobacterium avium subsp. paratuberculosis
ccggcguaguucgucgaa

SEQ ID NO: 2824419 - RNA, 23 nt, Mycobacterium avium subsp. paratuberculosis
ccggcguaucuccaccgucgaug

SEQ ID NO: 2824420 - RNA, 21 nt, Mycobacterium avium subsp. paratuberculosis
ccggcgucacauacgccucac

SEQ ID NO: 2824421 - RNA, 15 nt, Mycobacterium avium subsp. paratuberculosis
ccggcgucacgcugg

SEQ ID NO: 2824422 - RNA, 20 nt, Mycobacterium avium subsp. paratuberculosis
ccggcgucacgcuggcguga

SEQ ID NO: 2824423 - RNA, 22 nt, Mycobacterium avium subsp. paratuberculosis
ccggcgucacgcuggcgugacg

SEQ ID NO: 2824424 - RNA, 19 nt, Mycobacterium avium subsp. paratuberculosis
ccggcgucacucuggcgug

SEQ ID NO: 2824425 - RNA, 22 nt, Mycobacterium avium subsp. paratuberculosis
ccggcgucacucuggcgugacg

SEQ ID NO: 2824426 - RNA, 14 nt, Mycobacterium avium subsp. paratuberculosis
ccggcguccaccgg

SEQ ID NO: 2824427 - RNA, 14 nt, Mycobacterium avium subsp. paratuberculosis
ccggcguccagcgc

SEQ ID NO: 2824428 - RNA, 16 nt, Mycobacterium avium subsp. paratuberculosis
ccggcguccagcgccg

SEQ ID NO: 2824429 - RNA, 17 nt, Mycobacterium avium subsp. paratuberculosis
ccggcguccagcgccgc

SEQ ID NO: 2824430 - RNA, 19 nt, Mycobacterium avium subsp. paratuberculosis
ccggcguccagcgccgcca

SEQ ID NO: 2824431 - RNA, 15 nt, Mycobacterium avium subsp. paratuberculosis
ccggcguccaggcgc

SEQ ID NO: 2824432 - RNA, 19 nt, Mycobacterium avium subsp. paratuberculosis
ccggcguccaguagccgcc

SEQ ID NO: 2824433 - RNA, 21 nt, Mycobacterium avium subsp. paratuberculosis
ccggcguccaguagccgccgg

SEQ ID NO: 2824434 - RNA, 23 nt, Mycobacterium avium subsp. paratuberculosis
ccggcguccaguagccgccgggc

SEQ ID NO: 2824435 - RNA, 13 nt, Mycobacterium avium subsp. paratuberculosis
ccggcuccccgac

SEQ ID NO: 2824436 - RNA, 19 nt, Mycobacterium avium subsp. paratuberculosis
ccggcuccccgaccacacc

SEQ ID NO: 2824437 - RNA, 22 nt, Mycobacterium avium subsp. paratuberculosis
ccggcuccccgaccacaccggc

SEQ ID NO: 2824438 - RNA, 18 nt, Mycobacterium avium subsp. paratuberculosis
ccggcucgaaguggcagc

SEQ ID NO: 2824439 - RNA, 21 nt, Mycobacterium avium subsp. paratuberculosis
ccggcucgaaguggcagcgcu

SEQ ID NO: 2824440 - RNA, 20 nt, Mycobacterium avium subsp. paratuberculosis
ccggcucgaccucaccccgc

SEQ ID NO: 2824441 - RNA, 14 nt, Mycobacterium avium subsp. paratuberculosis
ccggcucgagcagu

SEQ ID NO: 2824442 - RNA, 13 nt, Mycobacterium avium subsp. paratuberculosis
ccggcucgaucgc

SEQ ID NO: 2824443 - RNA, 14 nt, Mycobacterium avium subsp. paratuberculosis
ccggcucgaucgcg

SEQ ID NO: 2824444 - RNA, 16 nt, Mycobacterium avium subsp. paratuberculosis
ccggcucgaucgcggu

SEQ ID NO: 2824445 - RNA, 19 nt, Mycobacterium avium subsp. paratuberculosis
ccggcucgaucgcggucac

SEQ ID NO: 2824446 - RNA, 13 nt, Mycobacterium avium subsp. paratuberculosis
ccggcucgccggc

SEQ ID NO: 2824447 - RNA, 14 nt, Mycobacterium avium subsp. paratuberculosis
ccggcucgccgggc

SEQ ID NO: 2824448 - RNA, 23 nt, Mycobacterium avium subsp. paratuberculosis
ccggcucgccguugcgggucggc

SEQ ID NO: 2824449 - RNA, 17 nt, Mycobacterium avium subsp. paratuberculosis
ccggcucgcugaucugc

SEQ ID NO: 2824450 - RNA, 22 nt, Mycobacterium avium subsp. paratuberculosis
ccggcucgcugaucugcggcac

SEQ ID NO: 2824451 - RNA, 19 nt, Mycobacterium avium subsp. paratuberculosis
ccggcucggcggcucagca

SEQ ID NO: 2824452 - RNA, 16 nt, Mycobacterium avium subsp. paratuberculosis
ccggcucgggaacggu

SEQ ID NO: 2824453 - RNA, 23 nt, Mycobacterium avium subsp. paratuberculosis
ccggcucgggaacggucagccgc

SEQ ID NO: 2824454 - RNA, 20 nt, Mycobacterium avium subsp. paratuberculosis
ccggcucgguaugcggcgac

SEQ ID NO: 2824455 - RNA, 22 nt, Mycobacterium avium subsp. paratuberculosis
ccggcucgguaugcggcgacga

SEQ ID NO: 2824456 - RNA, 16 nt, Mycobacterium avium subsp. paratuberculosis
ccggcucggucuccuc

SEQ ID NO: 2824457 - RNA, 13 nt, Mycobacterium avium subsp. paratuberculosis
ccggcucggugcg

SEQ ID NO: 2824458 - RNA, 14 nt, Mycobacterium avium subsp. paratuberculosis
ccggcucucagccg

SEQ ID NO: 2824459 - RNA, 17 nt, Mycobacterium avium subsp. paratuberculosis
ccggcucucagccggaa

SEQ ID NO: 2824460 - RNA, 19 nt, Mycobacterium avium subsp. paratuberculosis
ccggcucuccaucuucggc

SEQ ID NO: 2824461 - RNA, 16 nt, Mycobacterium avium subsp. paratuberculosis
ccggcucuuggcgacc

SEQ ID NO: 2824462 - RNA, 18 nt, Mycobacterium avium subsp. paratuberculosis
ccggcucuuggcgaccuc

SEQ ID NO: 2824463 - RNA, 17 nt, Mycobacterium avium subsp. paratuberculosis
ccggcugaaccugcugg

SEQ ID NO: 2824464 - RNA, 20 nt, Mycobacterium avium subsp. paratuberculosis
ccggcugaaccugcugggcg

SEQ ID NO: 2824465 - RNA, 14 nt, Mycobacterium avium subsp. paratuberculosis
ccggcugaacgcca

SEQ ID NO: 2824466 - RNA, 19 nt, Mycobacterium avium subsp. paratuberculosis
ccggcugaacgccagcagc

SEQ ID NO: 2824467 - RNA, 20 nt, Mycobacterium avium subsp. paratuberculosis
ccggcugaacgccagcagcc

SEQ ID NO: 2824468 - RNA, 21 nt, Mycobacterium avium subsp. paratuberculosis
ccggcugaacgccagcagccg

SEQ ID NO: 2824469 - RNA, 15 nt, Mycobacterium avium subsp. paratuberculosis
ccggcugaccggcgg

SEQ ID NO: 2824470 - RNA, 18 nt, Mycobacterium avium subsp. paratuberculosis
ccggcugaccggcggugc

SEQ ID NO: 2824471 - RNA, 16 nt, Mycobacterium avium subsp. paratuberculosis
ccggcugacugccggc

SEQ ID NO: 2824472 - RNA, 18 nt, Mycobacterium avium subsp. paratuberculosis
ccggcugacugccggcga

SEQ ID NO: 2824473 - RNA, 20 nt, Mycobacterium avium subsp. paratuberculosis
ccggcugacugccggcgacg

SEQ ID NO: 2824474 - RNA, 20 nt, Mycobacterium avium subsp. paratuberculosis
ccggcugagcagccagucgg

SEQ ID NO: 2824475 - RNA, 15 nt, Mycobacterium avium subsp. paratuberculosis
ccggcugagcgucgg

SEQ ID NO: 2824476 - RNA, 17 nt, Mycobacterium avium subsp. paratuberculosis
ccggcugagcgucgguc

SEQ ID NO: 2824477 - RNA, 15 nt, Mycobacterium avium subsp. paratuberculosis
ccggcugcccgaccc

SEQ ID NO: 2824478 - RNA, 16 nt, Mycobacterium avium subsp. paratuberculosis
ccggcugcccgacccg

SEQ ID NO: 2824479 - RNA, 17 nt, Mycobacterium avium subsp. paratuberculosis
ccggcugcccgacccgc

SEQ ID NO: 2824480 - RNA, 23 nt, Mycobacterium avium subsp. paratuberculosis
ccggcugcccgacccgcaccacc

SEQ ID NO: 2824481 - RNA, 17 nt, Mycobacterium avium subsp. paratuberculosis
ccggcugcgcagcgcag

SEQ ID NO: 2824482 - RNA, 19 nt, Mycobacterium avium subsp. paratuberculosis
ccggcugcgcagcgcagca

SEQ ID NO: 2824483 - RNA, 19 nt, Mycobacterium avium subsp. paratuberculosis
ccggcugcucgcgcugccg

SEQ ID NO: 2824484 - RNA, 21 nt, Mycobacterium avium subsp. paratuberculosis
ccggcugcucgcgcugccgcg

SEQ ID NO: 2824485 - RNA, 16 nt, Mycobacterium avium subsp. paratuberculosis
ccggcugcugcacgac

SEQ ID NO: 2824486 - RNA, 23 nt, Mycobacterium avium subsp. paratuberculosis
ccggcuggcaggucgcgccggag

SEQ ID NO: 2824487 - RNA, 12 nt, Mycobacterium avium subsp. paratuberculosis
ccggcuggccga

SEQ ID NO: 2824488 - RNA, 14 nt, Mycobacterium avium subsp. paratuberculosis
ccggcuggccgagc

SEQ ID NO: 2824489 - RNA, 15 nt, Mycobacterium avium subsp. paratuberculosis
ccggcuggccgagcg

SEQ ID NO: 2824490 - RNA, 17 nt, Mycobacterium avium subsp. paratuberculosis
ccggcuggccgagcggc

SEQ ID NO: 2824491 - RNA, 13 nt, Mycobacterium avium subsp. paratuberculosis
ccggcuggccgca

SEQ ID NO: 2824492 - RNA, 14 nt, Mycobacterium avium subsp. paratuberculosis
ccggcuggccgcac

SEQ ID NO: 2824493 - RNA, 13 nt, Mycobacterium avium subsp. paratuberculosis
ccggcuggccgga

SEQ ID NO: 2824494 - RNA, 22 nt, Mycobacterium avium subsp. paratuberculosis
ccggcuggccggaaaggcguga

SEQ ID NO: 2824495 - RNA, 14 nt, Mycobacterium avium subsp. paratuberculosis
ccggcuggucggcc

SEQ ID NO: 2824496 - RNA, 19 nt, Mycobacterium avium subsp. paratuberculosis
ccggcuggucggccuggcc

SEQ ID NO: 2824497 - RNA, 15 nt, Mycobacterium avium subsp. paratuberculosis
ccggcuggucggcgg

SEQ ID NO: 2824498 - RNA, 21 nt, Mycobacterium avium subsp. paratuberculosis
ccggcuggucggcggguaugu

SEQ ID NO: 2824499 - RNA, 16 nt, Mycobacterium avium subsp. paratuberculosis
ccggcuggugcagcag

SEQ ID NO: 2824500 - RNA, 15 nt, Mycobacterium avium subsp. paratuberculosis
ccggcuuaccgaccu

SEQ ID NO: 2824501 - RNA, 18 nt, Mycobacterium avium subsp. paratuberculosis
ccggcuuaccgaccucga

SEQ ID NO: 2824502 - RNA, 15 nt, Mycobacterium avium subsp. paratuberculosis
ccggcuucaccguca

SEQ ID NO: 2824503 - RNA, 16 nt, Mycobacterium avium subsp. paratuberculosis
ccggcuucaccgucag

SEQ ID NO: 2824504 - RNA, 14 nt, Mycobacterium avium subsp. paratuberculosis
ccggcuuccgagac

SEQ ID NO: 2824505 - RNA, 16 nt, Mycobacterium avium subsp. paratuberculosis
ccggcuuccucgcgga

SEQ ID NO: 2824506 - RNA, 13 nt, Mycobacterium avium subsp. paratuberculosis
ccggcuucgccgc

SEQ ID NO: 2824507 - RNA, 14 nt, Mycobacterium avium subsp. paratuberculosis
ccggcuucgccgcc

SEQ ID NO: 2824508 - RNA, 15 nt, Mycobacterium avium subsp. paratuberculosis
ccggcuucgccgccg

SEQ ID NO: 2824509 - RNA, 22 nt, Mycobacterium avium subsp. paratuberculosis
ccggcuucgccgccgcaccggc

SEQ ID NO: 2824510 - RNA, 15 nt, Mycobacterium avium subsp. paratuberculosis
ccggcuucgccgcgc

SEQ ID NO: 2824511 - RNA, 16 nt, Mycobacterium avium subsp. paratuberculosis
ccggcuucgcugcgcc

SEQ ID NO: 2824512 - RNA, 20 nt, Mycobacterium avium subsp. paratuberculosis
ccggcuucgcugcgccggcg

SEQ ID NO: 2824513 - RNA, 19 nt, Mycobacterium avium subsp. paratuberculosis
ccggcuucgggaucagcgg

SEQ ID NO: 2824514 - RNA, 20 nt, Mycobacterium avium subsp. paratuberculosis
ccggcuucgggaucagcggg

SEQ ID NO: 2824515 - RNA, 13 nt, Mycobacterium avium subsp. paratuberculosis
ccggcuucucggc

SEQ ID NO: 2824516 - RNA, 23 nt, Mycobacterium avium subsp. paratuberculosis
ccggcuugaucucgaccuucuug

SEQ ID NO: 2824517 - RNA, 18 nt, Mycobacterium avium subsp. paratuberculosis
ccggcuugccccgguccc

SEQ ID NO: 2824518 - RNA, 19 nt, Mycobacterium avium subsp. paratuberculosis
ccggcuugccgaucgccgc

SEQ ID NO: 2824519 - RNA, 20 nt, Mycobacterium avium subsp. paratuberculosis
ccggcuugccgaucgccgcg

SEQ ID NO: 2824520 - RNA, 18 nt, Mycobacterium avium subsp. paratuberculosis
ccgggaugcgccaccgac

SEQ ID NO: 2824521 - RNA, 15 nt, Mycobacterium avium subsp. paratuberculosis
ccgggauggacgacg

SEQ ID NO: 2824522 - RNA, 17 nt, Mycobacterium avium subsp. paratuberculosis
ccgggauggcguucugc

SEQ ID NO: 2824523 - RNA, 20 nt, Mycobacterium avium subsp. paratuberculosis
ccgggauggcguucugcacc

SEQ ID NO: 2824524 - RNA, 17 nt, Mycobacterium avium subsp. paratuberculosis
ccgggauggugaccagc

SEQ ID NO: 2824525 - RNA, 22 nt, Mycobacterium avium subsp. paratuberculosis
ccgggauggugaccagcgcccc

SEQ ID NO: 2824526 - RNA, 14 nt, Mycobacterium avium subsp. paratuberculosis
ccgggauggugagc

SEQ ID NO: 2824527 - RNA, 21 nt, Mycobacterium avium subsp. paratuberculosis
ccgggauugugcuccaggaug

SEQ ID NO: 2824528 - RNA, 14 nt, Mycobacterium avium subsp. paratuberculosis
ccgggauuucccgg

SEQ ID NO: 2824529 - RNA, 17 nt, Mycobacterium avium subsp. paratuberculosis
ccgggauuucccgggcg

SEQ ID NO: 2824530 - RNA, 19 nt, Mycobacterium avium subsp. paratuberculosis
ccgggauuucccgggcgau

SEQ ID NO: 2824531 - RNA, 14 nt, Mycobacterium avium subsp. paratuberculosis
ccgggcaacagcgc

SEQ ID NO: 2824532 - RNA, 19 nt, Mycobacterium avium subsp. paratuberculosis
ccgggcaacagcgcgccgg

SEQ ID NO: 2824533 - RNA, 21 nt, Mycobacterium avium subsp. paratuberculosis
ccgggcaacagcgcgccggcc

SEQ ID NO: 2824534 - RNA, 22 nt, Mycobacterium avium subsp. paratuberculosis
ccgggcaacagcgcgccggccg

SEQ ID NO: 2824535 - RNA, 18 nt, Mycobacterium avium subsp. paratuberculosis
ccgggcaaccacagcggc

SEQ ID NO: 2824536 - RNA, 20 nt, Mycobacterium avium subsp. paratuberculosis
ccgggcaaccacagcggcgc

SEQ ID NO: 2824537 - RNA, 22 nt, Mycobacterium avium subsp. paratuberculosis
ccgggcaaccacagcggcgcau

SEQ ID NO: 2824538 - RNA, 15 nt, Mycobacterium avium subsp. paratuberculosis
ccgggcaccaccacc

SEQ ID NO: 2824539 - RNA, 18 nt, Mycobacterium avium subsp. paratuberculosis
ccgggcaccaccaccgac

SEQ ID NO: 2824540 - RNA, 20 nt, Mycobacterium avium subsp. paratuberculosis
ccgggcaccaccaccgacac

SEQ ID NO: 2824541 - RNA, 18 nt, Mycobacterium avium subsp. paratuberculosis
ccgggcaccagcgacagc

SEQ ID NO: 2824542 - RNA, 14 nt, Mycobacterium avium subsp. paratuberculosis
ccgggcaccagcgc

SEQ ID NO: 2824543 - RNA, 15 nt, Mycobacterium avium subsp. paratuberculosis
ccgggcaccagcgcg

SEQ ID NO: 2824544 - RNA, 20 nt, Mycobacterium avium subsp. paratuberculosis
ccgggcaccagcgcgacggu

SEQ ID NO: 2824545 - RNA, 17 nt, Mycobacterium avium subsp. paratuberculosis
ccgggcaccccggucac

SEQ ID NO: 2824546 - RNA, 20 nt, Mycobacterium avium subsp. paratuberculosis
ccgggcaccccggucaccgg

SEQ ID NO: 2824547 - RNA, 15 nt, Mycobacterium avium subsp. paratuberculosis
ccgggcacccggcgc

SEQ ID NO: 2824548 - RNA, 20 nt, Mycobacterium avium subsp. paratuberculosis
ccgggcacccggcgcggccg

SEQ ID NO: 2824549 - RNA, 15 nt, Mycobacterium avium subsp. paratuberculosis
ccgggcaccgcgccc

SEQ ID NO: 2824550 - RNA, 17 nt, Mycobacterium avium subsp. paratuberculosis
ccgggcaccgcgcccgc

SEQ ID NO: 2824551 - RNA, 21 nt, Mycobacterium avium subsp. paratuberculosis
ccgggcaccgcgcccgccccg

SEQ ID NO: 2824552 - RNA, 16 nt, Mycobacterium avium subsp. paratuberculosis
ccgggcaccucggcgu

SEQ ID NO: 2824553 - RNA, 18 nt, Mycobacterium avium subsp. paratuberculosis
ccgggcaccucggcgucg

SEQ ID NO: 2824554 - RNA, 20 nt, Mycobacterium avium subsp. paratuberculosis
ccgggcaccucggcgucggc

SEQ ID NO: 2824555 - RNA, 22 nt, Mycobacterium avium subsp. paratuberculosis
ccgggcacgaauucgguggcga

SEQ ID NO: 2824556 - RNA, 17 nt, Mycobacterium avium subsp. paratuberculosis
ccgggcacgacggucag

SEQ ID NO: 2824557 - RNA, 18 nt, Mycobacterium avium subsp. paratuberculosis
ccgggcacgacggucagc

SEQ ID NO: 2824558 - RNA, 14 nt, Mycobacterium avium subsp. paratuberculosis
ccgggcacgcagcg

SEQ ID NO: 2824559 - RNA, 16 nt, Mycobacterium avium subsp. paratuberculosis
ccgggcacgcagcggc

SEQ ID NO: 2824560 - RNA, 18 nt, Mycobacterium avium subsp. paratuberculosis
ccgggcacgcagcggcgu

SEQ ID NO: 2824561 - RNA, 19 nt, Mycobacterium avium subsp. paratuberculosis
ccgggcacgcagcggcguc

SEQ ID NO: 2824562 - RNA, 20 nt, Mycobacterium avium subsp. paratuberculosis
ccgggcacgcagcggcguca

SEQ ID NO: 2824563 - RNA, 22 nt, Mycobacterium avium subsp. paratuberculosis
ccgggcacgcgagacgagccgc

SEQ ID NO: 2824564 - RNA, 15 nt, Mycobacterium avium subsp. paratuberculosis
ccgggcagcccgccg

SEQ ID NO: 2824565 - RNA, 17 nt, Mycobacterium avium subsp. paratuberculosis
ccgggcagcccgccgcg

SEQ ID NO: 2824566 - RNA, 18 nt, Mycobacterium avium subsp. paratuberculosis
ccgggcagccgcacaccg

SEQ ID NO: 2824567 - RNA, 20 nt, Mycobacterium avium subsp. paratuberculosis
ccgggcagccgcacaccgcg

SEQ ID NO: 2824568 - RNA, 14 nt, Mycobacterium avium subsp. paratuberculosis
ccgggcagcgcgcg

SEQ ID NO: 2824569 - RNA, 21 nt, Mycobacterium avium subsp. paratuberculosis
ccgggcagcgcgcgagacacc

SEQ ID NO: 2824570 - RNA, 23 nt, Mycobacterium avium subsp. paratuberculosis
ccgggcagcgcgcgagacaccuc

SEQ ID NO: 2824571 - RNA, 15 nt, Mycobacterium avium subsp. paratuberculosis
ccgggcagcggcccc

SEQ ID NO: 2824572 - RNA, 17 nt, Mycobacterium avium subsp. paratuberculosis
ccgggcagcggccccac

SEQ ID NO: 2824573 - RNA, 19 nt, Mycobacterium avium subsp. paratuberculosis
ccgggcagcuuccgccucg

SEQ ID NO: 2824574 - RNA, 20 nt, Mycobacterium avium subsp. paratuberculosis
ccgggcagcuuccgccucgg

SEQ ID NO: 2824575 - RNA, 21 nt, Mycobacterium avium subsp. paratuberculosis
ccgggcagcuuccgccucggc

SEQ ID NO: 2824576 - RNA, 22 nt, Mycobacterium avium subsp. paratuberculosis
ccgggcagcuuccgccucggcg

SEQ ID NO: 2824577 - RNA, 19 nt, Mycobacterium avium subsp. paratuberculosis
ccgggcaggaugccgcguu

SEQ ID NO: 2824578 - RNA, 19 nt, Mycobacterium avium subsp. paratuberculosis
ccgggcagguggucggcga

SEQ ID NO: 2824579 - RNA, 22 nt, Mycobacterium avium subsp. paratuberculosis
ccgggcagguggucggcgaacu

SEQ ID NO: 2824580 - RNA, 17 nt, Mycobacterium avium subsp. paratuberculosis
ccgggcaguagaacggc

SEQ ID NO: 2824581 - RNA, 16 nt, Mycobacterium avium subsp. paratuberculosis
ccgggcagugcgcggc

SEQ ID NO: 2824582 - RNA, 17 nt, Mycobacterium avium subsp. paratuberculosis
ccgggcagugcgcggcg

SEQ ID NO: 2824583 - RNA, 22 nt, Mycobacterium avium subsp. paratuberculosis
ccgggcaguuccuugcgcagca

SEQ ID NO: 2824584 - RNA, 16 nt, Mycobacterium avium subsp. paratuberculosis
ccgggcauccgcccgu

SEQ ID NO: 2824585 - RNA, 18 nt, Mycobacterium avium subsp. paratuberculosis
ccgggcauccgcccguag

SEQ ID NO: 2824586 - RNA, 18 nt, Mycobacterium avium subsp. paratuberculosis
ccgggcauccgggccgcc

SEQ ID NO: 2824587 - RNA, 19 nt, Mycobacterium avium subsp. paratuberculosis
ccgggcauccgggccgccg

SEQ ID NO: 2824588 - RNA, 21 nt, Mycobacterium avium subsp. paratuberculosis
ccgggcauccgggccgccgcg

SEQ ID NO: 2824589 - RNA, 16 nt, Mycobacterium avium subsp. paratuberculosis
ccgggcaugcccguag

SEQ ID NO: 2824590 - RNA, 17 nt, Mycobacterium avium subsp. paratuberculosis
ccgggcauggucaccgg

SEQ ID NO: 2824591 - RNA, 21 nt, Mycobacterium avium subsp. paratuberculosis
ccgggccaacgguucggccgc

SEQ ID NO: 2824592 - RNA, 12 nt, Mycobacterium avium subsp. paratuberculosis
ccgggccacacc

SEQ ID NO: 2824593 - RNA, 12 nt, Mycobacterium avium subsp. paratuberculosis
ccgggccaccac

SEQ ID NO: 2824594 - RNA, 15 nt, Mycobacterium avium subsp. paratuberculosis
ccgggccaccaccac

SEQ ID NO: 2824595 - RNA, 16 nt, Mycobacterium avium subsp. paratuberculosis
ccgggccaccaccacg

SEQ ID NO: 2824596 - RNA, 17 nt, Mycobacterium avium subsp. paratuberculosis
ccgggccaccaccacgg

SEQ ID NO: 2824597 - RNA, 19 nt, Mycobacterium avium subsp. paratuberculosis
ccgggccaccaccacggcc

SEQ ID NO: 2824598 - RNA, 22 nt, Mycobacterium avium subsp. paratuberculosis
ccgggccaccaccacggccgcc

SEQ ID NO: 2824599 - RNA, 18 nt, Mycobacterium avium subsp. paratuberculosis
ccgggccacccgcgaucg

SEQ ID NO: 2824600 - RNA, 19 nt, Mycobacterium avium subsp. paratuberculosis
ccgggccacccgcgaucgg

SEQ ID NO: 2824601 - RNA, 19 nt, Mycobacterium avium subsp. paratuberculosis
ccgggccagcaacagcagc

SEQ ID NO: 2824602 - RNA, 22 nt, Mycobacterium avium subsp. paratuberculosis
ccgggccagcaacagcagcggc

SEQ ID NO: 2824603 - RNA, 13 nt, Mycobacterium avium subsp. paratuberculosis
ccgggccagcagc

SEQ ID NO: 2824604 - RNA, 20 nt, Mycobacterium avium subsp. paratuberculosis
ccgggccugcggcggccgca

SEQ ID NO: 2824605 - RNA, 22 nt, Mycobacterium avium subsp. paratuberculosis
ccgggccugcggcggccgcagc

SEQ ID NO: 2824606 - RNA, 24 nt, Mycobacterium avium subsp. paratuberculosis
ccgggccugcggcggccgcagcgu

SEQ ID NO: 2824607 - RNA, 18 nt, Mycobacterium avium subsp. paratuberculosis
ccgggccuguccagccgg

SEQ ID NO: 2824608 - RNA, 20 nt, Mycobacterium avium subsp. paratuberculosis
ccgggccuugacggccuggg

SEQ ID NO: 2824609 - RNA, 16 nt, Mycobacterium avium subsp. paratuberculosis
ccgggccuuggccaac

SEQ ID NO: 2824610 - RNA, 15 nt, Mycobacterium avium subsp. paratuberculosis
ccgggcgaaccacgg

SEQ ID NO: 2824611 - RNA, 21 nt, Mycobacterium avium subsp. paratuberculosis
ccgggcgaagucgccggccag

SEQ ID NO: 2824612 - RNA, 18 nt, Mycobacterium avium subsp. paratuberculosis
ccgggcgacaugcccgcg

SEQ ID NO: 2824613 - RNA, 21 nt, Mycobacterium avium subsp. paratuberculosis
ccgggcgaccccggccaggau

SEQ ID NO: 2824614 - RNA, 17 nt, Mycobacterium avium subsp. paratuberculosis
ccgggcgacugcgugcu

SEQ ID NO: 2824615 - RNA, 18 nt, Mycobacterium avium subsp. paratuberculosis
ccgggcgacugcgugcug

SEQ ID NO: 2824616 - RNA, 16 nt, Mycobacterium avium subsp. paratuberculosis
ccgggcgacuucguug

SEQ ID NO: 2824617 - RNA, 13 nt, Mycobacterium avium subsp. paratuberculosis
ccgggcgaucagc

SEQ ID NO: 2824618 - RNA, 16 nt, Mycobacterium avium subsp. paratuberculosis
ccgggcgaucagcccg

SEQ ID NO: 2824619 - RNA, 17 nt, Mycobacterium avium subsp. paratuberculosis
ccgggcgaucagcccgc

SEQ ID NO: 2824620 - RNA, 19 nt, Mycobacterium avium subsp. paratuberculosis
ccgggcgaucagcccgccc

SEQ ID NO: 2824621 - RNA, 21 nt, Mycobacterium avium subsp. paratuberculosis
ccgggcgaucagcccgcccac

SEQ ID NO: 2824622 - RNA, 20 nt, Mycobacterium avium subsp. paratuberculosis
ccgggcgaucauccagguga

SEQ ID NO: 2824623 - RNA, 14 nt, Mycobacterium avium subsp. paratuberculosis
ccgggcgauggugc

SEQ ID NO: 2824624 - RNA, 21 nt, Mycobacterium avium subsp. paratuberculosis
ccgggcgauggugccgccggu

SEQ ID NO: 2824625 - RNA, 19 nt, Mycobacterium avium subsp. paratuberculosis
ccgggcgauucgucgucgu

SEQ ID NO: 2824626 - RNA, 14 nt, Mycobacterium avium subsp. paratuberculosis
ccgggcgccacccg

SEQ ID NO: 2824627 - RNA, 17 nt, Mycobacterium avium subsp. paratuberculosis
ccgggcgccacgcuggc

SEQ ID NO: 2824628 - RNA, 15 nt, Mycobacterium avium subsp. paratuberculosis
ccgggcgccauccgc

SEQ ID NO: 2824629 - RNA, 18 nt, Mycobacterium avium subsp. paratuberculosis
ccgggcgccauccgcagc

SEQ ID NO: 2824630 - RNA, 18 nt, Mycobacterium avium subsp. paratuberculosis
ccgggcgccauccgccac

SEQ ID NO: 2824631 - RNA, 13 nt, Mycobacterium avium subsp. paratuberculosis
ccgggcgcccaga

SEQ ID NO: 2824632 - RNA, 12 nt, Mycobacterium avium subsp. paratuberculosis
ccgggcgccccg

SEQ ID NO: 2824633 - RNA, 14 nt, Mycobacterium avium subsp. paratuberculosis
ccgggcgccccgac

SEQ ID NO: 2824634 - RNA, 17 nt, Mycobacterium avium subsp. paratuberculosis
ccgggcgccccgacauc

SEQ ID NO: 2824635 - RNA, 13 nt, Mycobacterium avium subsp. paratuberculosis
ccgggcgcccgag

SEQ ID NO: 2824636 - RNA, 13 nt, Mycobacterium avium subsp. paratuberculosis
ccgggcgcccgcg

SEQ ID NO: 2824637 - RNA, 14 nt, Mycobacterium avium subsp. paratuberculosis
ccgggcgcccgcgg

SEQ ID NO: 2824638 - RNA, 19 nt, Mycobacterium avium subsp. paratuberculosis
ccgggcgccgagaacaggc

SEQ ID NO: 2824639 - RNA, 11 nt, Mycobacterium avium subsp. paratuberculosis
ccgggcgccgg

SEQ ID NO: 2824640 - RNA, 17 nt, Mycobacterium avium subsp. paratuberculosis
ccgggcgccggccggcg

SEQ ID NO: 2824641 - RNA, 18 nt, Mycobacterium avium subsp. paratuberculosis
ccgggcgccggccggcgc

SEQ ID NO: 2824642 - RNA, 15 nt, Mycobacterium avium subsp. paratuberculosis
ccgggcgccggcgau

SEQ ID NO: 2824643 - RNA, 22 nt, Mycobacterium avium subsp. paratuberculosis
ccgggcgcgaauuccucagcgc

SEQ ID NO: 2824644 - RNA, 19 nt, Mycobacterium avium subsp. paratuberculosis
ccgggcgcgcagaucgucg

SEQ ID NO: 2824645 - RNA, 20 nt, Mycobacterium avium subsp. paratuberculosis
ccgggcgcgcagaucgucga

SEQ ID NO: 2824646 - RNA, 13 nt, Mycobacterium avium subsp. paratuberculosis
ccgggcgcgccca

SEQ ID NO: 2824647 - RNA, 16 nt, Mycobacterium avium subsp. paratuberculosis
ccgggcgcgcccaccc

SEQ ID NO: 2824648 - RNA, 24 nt, Mycobacterium avium subsp. paratuberculosis
ccgggcgcgcccacccgcgccggc

SEQ ID NO: 2824649 - RNA, 12 nt, Mycobacterium avium subsp. paratuberculosis
ccgggcgcgugc

SEQ ID NO: 2824650 - RNA, 18 nt, Mycobacterium avium subsp. paratuberculosis
ccgggcgcgugcacaccg

SEQ ID NO: 2824651 - RNA, 20 nt, Mycobacterium avium subsp. paratuberculosis
ccgggcgcgugcacaccggc

SEQ ID NO: 2824652 - RNA, 22 nt, Mycobacterium avium subsp. paratuberculosis
ccgggcgcucuucgggcugcgc

SEQ ID NO: 2824653 - RNA, 16 nt, Mycobacterium avium subsp. paratuberculosis
ccgggcgcugagcacg

SEQ ID NO: 2824654 - RNA, 21 nt, Mycobacterium avium subsp. paratuberculosis
ccgggcgcugcgcgguggcgc

SEQ ID NO: 2824655 - RNA, 14 nt, Mycobacterium avium subsp. paratuberculosis
ccgggcgcuggccg

SEQ ID NO: 2824656 - RNA, 13 nt, Mycobacterium avium subsp. paratuberculosis
ccgggcgcuggcg

SEQ ID NO: 2824657 - RNA, 16 nt, Mycobacterium avium subsp. paratuberculosis
ccgggcgcuggcgaug

SEQ ID NO: 2824658 - RNA, 14 nt, Mycobacterium avium subsp. paratuberculosis
ccgggcggacggca

SEQ ID NO: 2824659 - RNA, 17 nt, Mycobacterium avium subsp. paratuberculosis
ccgggcggacggcaccg

SEQ ID NO: 2824660 - RNA, 22 nt, Mycobacterium avium subsp. paratuberculosis
ccgggcggacggcaccgacgga

SEQ ID NO: 2824661 - RNA, 19 nt, Mycobacterium avium subsp. paratuberculosis
ccgggcggcaccgcugccg

SEQ ID NO: 2824662 - RNA, 22 nt, Mycobacterium avium subsp. paratuberculosis
ccgggcggcaccgcugccggcc

SEQ ID NO: 2824663 - RNA, 12 nt, Mycobacterium avium subsp. paratuberculosis
ccgggcggcagc

SEQ ID NO: 2824664 - RNA, 18 nt, Mycobacterium avium subsp. paratuberculosis
ccgggcggcaucgcgcgc

SEQ ID NO: 2824665 - RNA, 21 nt, Mycobacterium avium subsp. paratuberculosis
ccgggcggcaucgcgcgcggc

SEQ ID NO: 2824666 - RNA, 13 nt, Mycobacterium avium subsp. paratuberculosis
ccgggcggccagc

SEQ ID NO: 2824667 - RNA, 16 nt, Mycobacterium avium subsp. paratuberculosis
ccgggcggccagccgc

SEQ ID NO: 2824668 - RNA, 18 nt, Mycobacterium avium subsp. paratuberculosis
ccgggcggccagccgcgc

SEQ ID NO: 2824669 - RNA, 19 nt, Mycobacterium avium subsp. paratuberculosis
ccgggcggccagccgcgcg

SEQ ID NO: 2824670 - RNA, 21 nt, Mycobacterium avium subsp. paratuberculosis
ccgggcggccagccgcgcggc

SEQ ID NO: 2824671 - RNA, 14 nt, Mycobacterium avium subsp. paratuberculosis
ccgggcggccagcg

SEQ ID NO: 2824672 - RNA, 15 nt, Mycobacterium avium subsp. paratuberculosis
ccgggcggccagcgu

SEQ ID NO: 2824673 - RNA, 20 nt, Mycobacterium avium subsp. paratuberculosis
ccgggcggccagcguggcgc

SEQ ID NO: 2824674 - RNA, 22 nt, Mycobacterium avium subsp. paratuberculosis
ccgggcggccagcguggcgcgc

SEQ ID NO: 2824675 - RNA, 15 nt, Mycobacterium avium subsp. paratuberculosis
ccgggcggcccgcau

SEQ ID NO: 2824676 - RNA, 14 nt, Mycobacterium avium subsp. paratuberculosis
ccgggcggcccgcc

SEQ ID NO: 2824677 - RNA, 17 nt, Mycobacterium avium subsp. paratuberculosis
ccgggcggcccgccucg

SEQ ID NO: 2824678 - RNA, 18 nt, Mycobacterium avium subsp. paratuberculosis
ccgggcggcccgccucgg

SEQ ID NO: 2824679 - RNA, 20 nt, Mycobacterium avium subsp. paratuberculosis
ccgggcggcccgccucggcg

SEQ ID NO: 2824680 - RNA, 17 nt, Mycobacterium avium subsp. paratuberculosis
ccgggcggcccgggugg

SEQ ID NO: 2824681 - RNA, 17 nt, Mycobacterium avium subsp. paratuberculosis
ccgggcggccggagccg

SEQ ID NO: 2824682 - RNA, 18 nt, Mycobacterium avium subsp. paratuberculosis
ccgggcggccgggccgga

SEQ ID NO: 2824683 - RNA, 13 nt, Mycobacterium avium subsp. paratuberculosis
ccgggcggccgug

SEQ ID NO: 2824684 - RNA, 16 nt, Mycobacterium avium subsp. paratuberculosis
ccgggcggccgugguc

SEQ ID NO: 2824685 - RNA, 12 nt, Mycobacterium avium subsp. paratuberculosis
ccgggcggccug

SEQ ID NO: 2824686 - RNA, 17 nt, Mycobacterium avium subsp. paratuberculosis
ccgggcggccugcugca

SEQ ID NO: 2824687 - RNA, 17 nt, Mycobacterium avium subsp. paratuberculosis
ccgggcggcgacgucgu

SEQ ID NO: 2824688 - RNA, 21 nt, Mycobacterium avium subsp. paratuberculosis
ccgggcggcgaguccggccag

SEQ ID NO: 2824689 - RNA, 20 nt, Mycobacterium avium subsp. paratuberculosis
ccggggccaacuccggcggc

SEQ ID NO: 2824690 - RNA, 21 nt, Mycobacterium avium subsp. paratuberculosis
ccggggccaacuccggcggca

SEQ ID NO: 2824691 - RNA, 12 nt, Mycobacterium avium subsp. paratuberculosis
ccggggccagca

SEQ ID NO: 2824692 - RNA, 14 nt, Mycobacterium avium subsp. paratuberculosis
ccggggccagcacc

SEQ ID NO: 2824693 - RNA, 21 nt, Mycobacterium avium subsp. paratuberculosis
ccggggccagcacccagaugc

SEQ ID NO: 2824694 - RNA, 17 nt, Mycobacterium avium subsp. paratuberculosis
ccggggccgcggcucgc

SEQ ID NO: 2824695 - RNA, 18 nt, Mycobacterium avium subsp. paratuberculosis
ccggggccgcggcucgcg

SEQ ID NO: 2824696 - RNA, 12 nt, Mycobacterium avium subsp. paratuberculosis
ccggggccggcg

SEQ ID NO: 2824697 - RNA, 14 nt, Mycobacterium avium subsp. paratuberculosis
ccggggccggugcg

SEQ ID NO: 2824698 - RNA, 19 nt, Mycobacterium avium subsp. paratuberculosis
ccggggccggugcguccgc

SEQ ID NO: 2824699 - RNA, 22 nt, Mycobacterium avium subsp. paratuberculosis
ccggggccggugcguccgccgg

SEQ ID NO: 2824700 - RNA, 16 nt, Mycobacterium avium subsp. paratuberculosis
ccggggccuccagcca

SEQ ID NO: 2824701 - RNA, 17 nt, Mycobacterium avium subsp. paratuberculosis
ccggggccuccagccag

SEQ ID NO: 2824702 - RNA, 22 nt, Mycobacterium avium subsp. paratuberculosis
ccggggccuccagccagcgcgc

SEQ ID NO: 2824703 - RNA, 22 nt, Mycobacterium avium subsp. paratuberculosis
ccggggccuucuuggcggcggc

SEQ ID NO: 2824704 - RNA, 16 nt, Mycobacterium avium subsp. paratuberculosis
ccggggcgcagauggg

SEQ ID NO: 2824705 - RNA, 14 nt, Mycobacterium avium subsp. paratuberculosis
ccggggcgcagcug

SEQ ID NO: 2824706 - RNA, 13 nt, Mycobacterium avium subsp. paratuberculosis
ccggggcgccccg

SEQ ID NO: 2824707 - RNA, 15 nt, Mycobacterium avium subsp. paratuberculosis
ccggggcgccccgcu

SEQ ID NO: 2824708 - RNA, 12 nt, Mycobacterium avium subsp. paratuberculosis
ccggggcgccgc

SEQ ID NO: 2824709 - RNA, 14 nt, Mycobacterium avium subsp. paratuberculosis
ccggggcgccgccg

SEQ ID NO: 2824710 - RNA, 20 nt, Mycobacterium avium subsp. paratuberculosis
ccggggcggauccccgcgcu

SEQ ID NO: 2824711 - RNA, 15 nt, Mycobacterium avium subsp. paratuberculosis
ccggggcggcgaugc

SEQ ID NO: 2824712 - RNA, 22 nt, Mycobacterium avium subsp. paratuberculosis
ccggggcggcgaugcgcggccc

SEQ ID NO: 2824713 - RNA, 19 nt, Mycobacterium avium subsp. paratuberculosis
ccggggcgggcagcaccag

SEQ ID NO: 2824714 - RNA, 23 nt, Mycobacterium avium subsp. paratuberculosis
ccggggcgggcagcaccagcggc

SEQ ID NO: 2824715 - RNA, 16 nt, Mycobacterium avium subsp. paratuberculosis
ccggggcucgacaggc

SEQ ID NO: 2824716 - RNA, 18 nt, Mycobacterium avium subsp. paratuberculosis
ccggggcucgacaggcag

SEQ ID NO: 2824717 - RNA, 18 nt, Mycobacterium avium subsp. paratuberculosis
ccggggcuucgaacgccc

SEQ ID NO: 2824718 - RNA, 22 nt, Mycobacterium avium subsp. paratuberculosis
ccggggcuucgaacgcccgcac

SEQ ID NO: 2824719 - RNA, 22 nt, Mycobacterium avium subsp. paratuberculosis
ccgggggaagcccagcacccgc

SEQ ID NO: 2824720 - RNA, 13 nt, Mycobacterium avium subsp. paratuberculosis
ccgggggaccagc

SEQ ID NO: 2824721 - RNA, 18 nt, Mycobacterium avium subsp. paratuberculosis
ccgggggagucggggugc

SEQ ID NO: 2824722 - RNA, 23 nt, Mycobacterium avium subsp. paratuberculosis
ccgggggaucaccucaucgccca

SEQ ID NO: 2824723 - RNA, 22 nt, Mycobacterium avium subsp. paratuberculosis
ccgggggccgucacaggccgcc

SEQ ID NO: 2824724 - RNA, 14 nt, Mycobacterium avium subsp. paratuberculosis
ccgggggcgcgggc

SEQ ID NO: 2824725 - RNA, 13 nt, Mycobacterium avium subsp. paratuberculosis
ccgggggcggcgg

SEQ ID NO: 2824726 - RNA, 16 nt, Mycobacterium avium subsp. paratuberculosis
ccgggggcggcggcgc

SEQ ID NO: 2824727 - RNA, 17 nt, Mycobacterium avium subsp. paratuberculosis
ccgggggcggcggcgcg

SEQ ID NO: 2824728 - RNA, 15 nt, Mycobacterium avium subsp. paratuberculosis
ccgggggcggugcag

SEQ ID NO: 2824729 - RNA, 21 nt, Mycobacterium avium subsp. paratuberculosis
ccgggggcggugcagccgggg

SEQ ID NO: 2824730 - RNA, 15 nt, Mycobacterium avium subsp. paratuberculosis
ccggggggaggucgc

SEQ ID NO: 2824731 - RNA, 17 nt, Mycobacterium avium subsp. paratuberculosis
ccggggggcggggucga

SEQ ID NO: 2824732 - RNA, 13 nt, Mycobacterium avium subsp. paratuberculosis
ccggggguagcgg

SEQ ID NO: 2824733 - RNA, 19 nt, Mycobacterium avium subsp. paratuberculosis
ccggggguccagggugccg

SEQ ID NO: 2824734 - RNA, 15 nt, Mycobacterium avium subsp. paratuberculosis
ccggggguggcgguc

SEQ ID NO: 2824735 - RNA, 16 nt, Mycobacterium avium subsp. paratuberculosis
ccgggguagaggccgc

SEQ ID NO: 2824736 - RNA, 18 nt, Mycobacterium avium subsp. paratuberculosis
ccgggguagaggccgcgg

SEQ ID NO: 2824737 - RNA, 14 nt, Mycobacterium avium subsp. paratuberculosis
ccggggucaccuug

SEQ ID NO: 2824738 - RNA, 22 nt, Mycobacterium avium subsp. paratuberculosis
ccggggucaccuuggccggauc

SEQ ID NO: 2824739 - RNA, 14 nt, Mycobacterium avium subsp. paratuberculosis
ccggggucagggcg

SEQ ID NO: 2824740 - RNA, 15 nt, Mycobacterium avium subsp. paratuberculosis
ccggggucagggcgc

SEQ ID NO: 2824741 - RNA, 18 nt, Mycobacterium avium subsp. paratuberculosis
ccgggguccucucggcgc

SEQ ID NO: 2824742 - RNA, 20 nt, Mycobacterium avium subsp. paratuberculosis
ccggggucgacagccugacc

SEQ ID NO: 2824743 - RNA, 23 nt, Mycobacterium avium subsp. paratuberculosis
ccggggucgacagccugaccgcg

SEQ ID NO: 2824744 - RNA, 13 nt, Mycobacterium avium subsp. paratuberculosis
ccggggucggcgc

SEQ ID NO: 2824745 - RNA, 19 nt, Mycobacterium avium subsp. paratuberculosis
ccggggucggcgcccucgg

SEQ ID NO: 2824746 - RNA, 21 nt, Mycobacterium avium subsp. paratuberculosis
ccggggucggcgcccucggcg

SEQ ID NO: 2824747 - RNA, 22 nt, Mycobacterium avium subsp. paratuberculosis
ccggggucggcgcccucggcga

SEQ ID NO: 2824748 - RNA, 12 nt, Mycobacterium avium subsp. paratuberculosis
ccggggugagca

SEQ ID NO: 2824749 - RNA, 19 nt, Mycobacterium avium subsp. paratuberculosis
ccggggugagcagggccag

SEQ ID NO: 2824750 - RNA, 22 nt, Mycobacterium avium subsp. paratuberculosis
ccggggugagcagggccagcgg

SEQ ID NO: 2824751 - RNA, 17 nt, Mycobacterium avium subsp. paratuberculosis
ccggggugaugccggcg

SEQ ID NO: 2824752 - RNA, 21 nt, Mycobacterium avium subsp. paratuberculosis
ccggggugcagcaccacgaac

SEQ ID NO: 2824753 - RNA, 12 nt, Mycobacterium avium subsp. paratuberculosis
ccggggugccgc

SEQ ID NO: 2824754 - RNA, 14 nt, Mycobacterium avium subsp. paratuberculosis
ccggggugcuggcg

SEQ ID NO: 2824755 - RNA, 19 nt, Mycobacterium avium subsp. paratuberculosis
ccggggugggcacgucggc

SEQ ID NO: 2824756 - RNA, 20 nt, Mycobacterium avium subsp. paratuberculosis
ccggggugggcacgucggcc

SEQ ID NO: 2824757 - RNA, 21 nt, Mycobacterium avium subsp. paratuberculosis
ccgggguggugugcaaggcga

SEQ ID NO: 2824758 - RNA, 19 nt, Mycobacterium avium subsp. paratuberculosis
ccgggguguagcggauggc

SEQ ID NO: 2824759 - RNA, 21 nt, Mycobacterium avium subsp. paratuberculosis
ccgggguguagcggauggcga

SEQ ID NO: 2824760 - RNA, 18 nt, Mycobacterium avium subsp. paratuberculosis
ccgggguguaggcgucgg

SEQ ID NO: 2824761 - RNA, 19 nt, Mycobacterium avium subsp. paratuberculosis
ccgggguguaggcgucggc

SEQ ID NO: 2824762 - RNA, 21 nt, Mycobacterium avium subsp. paratuberculosis
ccgggguguaggcgucggcgg

SEQ ID NO: 2824763 - RNA, 22 nt, Mycobacterium avium subsp. paratuberculosis
ccgggguguaggcgucggcgga

SEQ ID NO: 2824764 - RNA, 17 nt, Mycobacterium avium subsp. paratuberculosis
ccgggguguccagcggg

SEQ ID NO: 2824765 - RNA, 17 nt, Mycobacterium avium subsp. paratuberculosis
ccgggguuuucgugguc

SEQ ID NO: 2824766 - RNA, 21 nt, Mycobacterium avium subsp. paratuberculosis
ccgggguuuucguggucucgc

SEQ ID NO: 2824767 - RNA, 14 nt, Mycobacterium avium subsp. paratuberculosis
ccggguacaccgac

SEQ ID NO: 2824768 - RNA, 16 nt, Mycobacterium avium subsp. paratuberculosis
ccggguacaccgacuu

SEQ ID NO: 2824769 - RNA, 17 nt, Mycobacterium avium subsp. paratuberculosis
ccggguacaccgacuuc

SEQ ID NO: 2824770 - RNA, 18 nt, Mycobacterium avium subsp. paratuberculosis
ccggguacaccggcucgc

SEQ ID NO: 2824771 - RNA, 14 nt, Mycobacterium avium subsp. paratuberculosis
ccggguagcgccgc

SEQ ID NO: 2824772 - RNA, 15 nt, Mycobacterium avium subsp. paratuberculosis
ccggguaggacaccg

SEQ ID NO: 2824773 - RNA, 15 nt, Mycobacterium avium subsp. paratuberculosis
ccggguggacaccgc

SEQ ID NO: 2824774 - RNA, 16 nt, Mycobacterium avium subsp. paratuberculosis
ccggguggacaccgcg

SEQ ID NO: 2824775 - RNA, 17 nt, Mycobacterium avium subsp. paratuberculosis
ccggguggacaccgcga

SEQ ID NO: 2824776 - RNA, 19 nt, Mycobacterium avium subsp. paratuberculosis
ccggguggacaccgcgauc

SEQ ID NO: 2824777 - RNA, 16 nt, Mycobacterium avium subsp. paratuberculosis
ccggguggacgcccgc

SEQ ID NO: 2824778 - RNA, 19 nt, Mycobacterium avium subsp. paratuberculosis
ccggguggacgcccgcgag

SEQ ID NO: 2824779 - RNA, 20 nt, Mycobacterium avium subsp. paratuberculosis
ccggguggccagcaccagcc

SEQ ID NO: 2824780 - RNA, 13 nt, Mycobacterium avium subsp. paratuberculosis
ccggguggcccgc

SEQ ID NO: 2824781 - RNA, 15 nt, Mycobacterium avium subsp. paratuberculosis
ccggguggcccgcac

SEQ ID NO: 2824782 - RNA, 24 nt, Mycobacterium avium subsp. paratuberculosis
ccggguggcccgcacguagacggu

SEQ ID NO: 2824783 - RNA, 15 nt, Mycobacterium avium subsp. paratuberculosis
ccggguggcccgccc

SEQ ID NO: 2824784 - RNA, 22 nt, Mycobacterium avium subsp. paratuberculosis
ccggguggcccgcgcgcugacc

SEQ ID NO: 2824785 - RNA, 13 nt, Mycobacterium avium subsp. paratuberculosis
ccggguggccgcc

SEQ ID NO: 2824786 - RNA, 12 nt, Mycobacterium avium subsp. paratuberculosis
ccggguggccgg

SEQ ID NO: 2824787 - RNA, 20 nt, Mycobacterium avium subsp. paratuberculosis
ccggguggccggggccaucu

SEQ ID NO: 2824788 - RNA, 16 nt, Mycobacterium avium subsp. paratuberculosis
ccgggugggcagcccc

SEQ ID NO: 2824789 - RNA, 23 nt, Mycobacterium avium subsp. paratuberculosis
ccgggugggcagccccagcgagc

SEQ ID NO: 2824790 - RNA, 19 nt, Mycobacterium avium subsp. paratuberculosis
ccgggugggcagcgcgauc

SEQ ID NO: 2824791 - RNA, 23 nt, Mycobacterium avium subsp. paratuberculosis
ccgggugggcagcgcgauccgcg

SEQ ID NO: 2824792 - RNA, 14 nt, Mycobacterium avium subsp. paratuberculosis
ccgggugggcggca

SEQ ID NO: 2824793 - RNA, 22 nt, Mycobacterium avium subsp. paratuberculosis
ccgggugggcggcacaccgcgc

SEQ ID NO: 2824794 - RNA, 14 nt, Mycobacterium avium subsp. paratuberculosis
ccgggugucgacgc

SEQ ID NO: 2824795 - RNA, 19 nt, Mycobacterium avium subsp. paratuberculosis
ccgggugucgacgccgggc

SEQ ID NO: 2824796 - RNA, 15 nt, Mycobacterium avium subsp. paratuberculosis
ccgggugugggcgcc

SEQ ID NO: 2824797 - RNA, 17 nt, Mycobacterium avium subsp. paratuberculosis
ccgggugugggcgccgu

SEQ ID NO: 2824798 - RNA, 19 nt, Mycobacterium avium subsp. paratuberculosis
ccgggugugggcgccguca

SEQ ID NO: 2824799 - RNA, 22 nt, Mycobacterium avium subsp. paratuberculosis
ccggguguugcggcagggccac

SEQ ID NO: 2824800 - RNA, 18 nt, Mycobacterium avium subsp. paratuberculosis
ccggguucgacgccucgg

SEQ ID NO: 2824801 - RNA, 19 nt, Mycobacterium avium subsp. paratuberculosis
ccggguugagcaggucagc

SEQ ID NO: 2824802 - RNA, 13 nt, Mycobacterium avium subsp. paratuberculosis
ccggguugcaggc

SEQ ID NO: 2824803 - RNA, 16 nt, Mycobacterium avium subsp. paratuberculosis
ccggguugcaggcgcc

SEQ ID NO: 2824804 - RNA, 22 nt, Mycobacterium avium subsp. paratuberculosis
ccggguuggcauccaggaucgc

SEQ ID NO: 2824805 - RNA, 22 nt, Mycobacterium avium subsp. paratuberculosis
ccggguugggcgccugcgguga

SEQ ID NO: 2824806 - RNA, 18 nt, Mycobacterium avium subsp. paratuberculosis
ccggguuguagcaggcgg

SEQ ID NO: 2824807 - RNA, 15 nt, Mycobacterium avium subsp. paratuberculosis
ccggguuguccuggc

SEQ ID NO: 2824808 - RNA, 18 nt, Mycobacterium avium subsp. paratuberculosis
ccggguuguccuggcccu

SEQ ID NO: 2824809 - RNA, 19 nt, Mycobacterium avium subsp. paratuberculosis
ccggguuucgaagacgccc

SEQ ID NO: 2824810 - RNA, 17 nt, Mycobacterium avium subsp. paratuberculosis
ccggguuucggcccggc

SEQ ID NO: 2824811 - RNA, 17 nt, Mycobacterium avium subsp. paratuberculosis
ccggguuuucgggccgg

SEQ ID NO: 2824812 - RNA, 22 nt, Mycobacterium avium subsp. paratuberculosis
ccgguaaugggcgaucgauccc

SEQ ID NO: 2824813 - RNA, 23 nt, Mycobacterium avium subsp. paratuberculosis
ccgguacagcgacuccagcgcga

SEQ ID NO: 2824814 - RNA, 17 nt, Mycobacterium avium subsp. paratuberculosis
ccgguacagcgccgcgg

SEQ ID NO: 2824815 - RNA, 18 nt, Mycobacterium avium subsp. paratuberculosis
ccgguacagcgccgcggc

SEQ ID NO: 2824816 - RNA, 20 nt, Mycobacterium avium subsp. paratuberculosis
ccgguacagcgccgcggcca

SEQ ID NO: 2824817 - RNA, 22 nt, Mycobacterium avium subsp. paratuberculosis
ccgguacagcgccgcggccagc

SEQ ID NO: 2824818 - RNA, 20 nt, Mycobacterium avium subsp. paratuberculosis
ccgguacaggccccacgcgc

SEQ ID NO: 2824819 - RNA, 13 nt, Mycobacterium avium subsp. paratuberculosis
ccgguacaggucg

SEQ ID NO: 2824820 - RNA, 22 nt, Mycobacterium avium subsp. paratuberculosis
ccgguacaggucgcugcccggc

SEQ ID NO: 2824821 - RNA, 22 nt, Mycobacterium avium subsp. paratuberculosis
ccgguacaucgacgcgaccggc

SEQ ID NO: 2824822 - RNA, 20 nt, Mycobacterium avium subsp. paratuberculosis
ccgguaccacgccgucgacg

SEQ ID NO: 2824823 - RNA, 13 nt, Mycobacterium avium subsp. paratuberculosis
ccgguaccgccgg

SEQ ID NO: 2824824 - RNA, 22 nt, Mycobacterium avium subsp. paratuberculosis
ccgguaccgccggccaggcgac

SEQ ID NO: 2824825 - RNA, 18 nt, Mycobacterium avium subsp. paratuberculosis
ccgguacggaucgccgga

SEQ ID NO: 2824826 - RNA, 22 nt, Mycobacterium avium subsp. paratuberculosis
ccgguacggaucgccggacagc

SEQ ID NO: 2824827 - RNA, 16 nt, Mycobacterium avium subsp. paratuberculosis
ccgguacggccgacgc

SEQ ID NO: 2824828 - RNA, 13 nt, Mycobacterium avium subsp. paratuberculosis
ccgguacggcucg

SEQ ID NO: 2824829 - RNA, 14 nt, Mycobacterium avium subsp. paratuberculosis
ccgguacggcucgu

SEQ ID NO: 2824830 - RNA, 20 nt, Mycobacterium avium subsp. paratuberculosis
ccgguagaagaccaccucgg

SEQ ID NO: 2824831 - RNA, 22 nt, Mycobacterium avium subsp. paratuberculosis
ccgguagagcggcaccagguuc

SEQ ID NO: 2824832 - RNA, 17 nt, Mycobacterium avium subsp. paratuberculosis
ccgguagauauggcccu

SEQ ID NO: 2824833 - RNA, 15 nt, Mycobacterium avium subsp. paratuberculosis
ccgguagaucagcgc

SEQ ID NO: 2824834 - RNA, 20 nt, Mycobacterium avium subsp. paratuberculosis
ccgguagaucagcgccuggu

SEQ ID NO: 2824835 - RNA, 15 nt, Mycobacterium avium subsp. paratuberculosis
ccgguagaucgccgg

SEQ ID NO: 2824836 - RNA, 19 nt, Mycobacterium avium subsp. paratuberculosis
ccgguagaucgccggaucg

SEQ ID NO: 2824837 - RNA, 17 nt, Mycobacterium avium subsp. paratuberculosis
ccgguagccagcaccgc

SEQ ID NO: 2824838 - RNA, 20 nt, Mycobacterium avium subsp. paratuberculosis
ccgguagccgcucgcccagc

SEQ ID NO: 2824839 - RNA, 22 nt, Mycobacterium avium subsp. paratuberculosis
ccgguagcgacacggaaaccgc

SEQ ID NO: 2824840 - RNA, 14 nt, Mycobacterium avium subsp. paratuberculosis
ccgguagcgcagca

SEQ ID NO: 2824841 - RNA, 14 nt, Mycobacterium avium subsp. paratuberculosis
ccgguaggccgccg

SEQ ID NO: 2824842 - RNA, 18 nt, Mycobacterium avium subsp. paratuberculosis
ccgguaggccgccgcgac

SEQ ID NO: 2824843 - RNA, 19 nt, Mycobacterium avium subsp. paratuberculosis
ccgguaggccgccgcgacc

SEQ ID NO: 2824844 - RNA, 14 nt, Mycobacterium avium subsp. paratuberculosis
ccgguaggccgcgc

SEQ ID NO: 2824845 - RNA, 17 nt, Mycobacterium avium subsp. paratuberculosis
ccgguaggccggccgca

SEQ ID NO: 2824846 - RNA, 14 nt, Mycobacterium avium subsp. paratuberculosis
ccgguaggcgcacc

SEQ ID NO: 2824847 - RNA, 19 nt, Mycobacterium avium subsp. paratuberculosis
ccgguaggcgcaccgccgg

SEQ ID NO: 2824848 - RNA, 15 nt, Mycobacterium avium subsp. paratuberculosis
ccgguaggcggccag

SEQ ID NO: 2824849 - RNA, 18 nt, Mycobacterium avium subsp. paratuberculosis
ccgguaggcggccagcgc

SEQ ID NO: 2824850 - RNA, 21 nt, Mycobacterium avium subsp. paratuberculosis
ccgguaggcggccagcgcccg

SEQ ID NO: 2824851 - RNA, 23 nt, Mycobacterium avium subsp. paratuberculosis
ccgguaggcggccagcgcccgcg

SEQ ID NO: 2824852 - RNA, 15 nt, Mycobacterium avium subsp. paratuberculosis
ccgguagggccgguc

SEQ ID NO: 2824853 - RNA, 16 nt, Mycobacterium avium subsp. paratuberculosis
ccgguagggccgguca

SEQ ID NO: 2824854 - RNA, 17 nt, Mycobacterium avium subsp. paratuberculosis
ccgguagggccggucac

SEQ ID NO: 2824855 - RNA, 21 nt, Mycobacterium avium subsp. paratuberculosis
ccgguagggccggucaccggu

SEQ ID NO: 2824856 - RNA, 20 nt, Mycobacterium avium subsp. paratuberculosis
ccgguaggugaucgccucga

SEQ ID NO: 2824857 - RNA, 20 nt, Mycobacterium avium subsp. paratuberculosis
ccgguccgcugugcggcccg

SEQ ID NO: 2824858 - RNA, 14 nt, Mycobacterium avium subsp. paratuberculosis
ccgguccggcccgg

SEQ ID NO: 2824859 - RNA, 20 nt, Mycobacterium avium subsp. paratuberculosis
ccgguccggcccuggucggc

SEQ ID NO: 2824860 - RNA, 22 nt, Mycobacterium avium subsp. paratuberculosis
ccgguccggcccuggucggcca

SEQ ID NO: 2824861 - RNA, 13 nt, Mycobacterium avium subsp. paratuberculosis
ccgguccggccgu

SEQ ID NO: 2824862 - RNA, 15 nt, Mycobacterium avium subsp. paratuberculosis
ccgguccggcggcac

SEQ ID NO: 2824863 - RNA, 22 nt, Mycobacterium avium subsp. paratuberculosis
ccgguccggcggcaccacccgc

SEQ ID NO: 2824864 - RNA, 13 nt, Mycobacterium avium subsp. paratuberculosis
ccgguccggcugg

SEQ ID NO: 2824865 - RNA, 19 nt, Mycobacterium avium subsp. paratuberculosis
ccgguccggcuggucggcc

SEQ ID NO: 2824866 - RNA, 21 nt, Mycobacterium avium subsp. paratuberculosis
ccgguccggcuggucggccug

SEQ ID NO: 2824867 - RNA, 16 nt, Mycobacterium avium subsp. paratuberculosis
ccgguccgugcacggc

SEQ ID NO: 2824868 - RNA, 17 nt, Mycobacterium avium subsp. paratuberculosis
ccgguccgugccacggc

SEQ ID NO: 2824869 - RNA, 21 nt, Mycobacterium avium subsp. paratuberculosis
ccgguccgugccacggccgcg

SEQ ID NO: 2824870 - RNA, 15 nt, Mycobacterium avium subsp. paratuberculosis
ccgguccuccccgcu

SEQ ID NO: 2824871 - RNA, 15 nt, Mycobacterium avium subsp. paratuberculosis
ccgguccucugcgac

SEQ ID NO: 2824872 - RNA, 22 nt, Mycobacterium avium subsp. paratuberculosis
ccgguccucugcgaccacccgg

SEQ ID NO: 2824873 - RNA, 13 nt, Mycobacterium avium subsp. paratuberculosis
ccgguccuggcca

SEQ ID NO: 2824874 - RNA, 14 nt, Mycobacterium avium subsp. paratuberculosis
ccgguccugggccu

SEQ ID NO: 2824875 - RNA, 17 nt, Mycobacterium avium subsp. paratuberculosis
ccgguccugggccuccg

SEQ ID NO: 2824876 - RNA, 20 nt, Mycobacterium avium subsp. paratuberculosis
ccggucgaacgccagcgccg

SEQ ID NO: 2824877 - RNA, 17 nt, Mycobacterium avium subsp. paratuberculosis
ccggucgaaggccccgg

SEQ ID NO: 2824878 - RNA, 14 nt, Mycobacterium avium subsp. paratuberculosis
ccggucgacgacga

SEQ ID NO: 2824879 - RNA, 18 nt, Mycobacterium avium subsp. paratuberculosis
ccggucgacgauggcccg

SEQ ID NO: 2824880 - RNA, 19 nt, Mycobacterium avium subsp. paratuberculosis
ccggucgacgauggcccgg

SEQ ID NO: 2824881 - RNA, 21 nt, Mycobacterium avium subsp. paratuberculosis
ccggucgacgauggcccgggc

SEQ ID NO: 2824882 - RNA, 14 nt, Mycobacterium avium subsp. paratuberculosis
ccggucgaggucgc

SEQ ID NO: 2824883 - RNA, 16 nt, Mycobacterium avium subsp. paratuberculosis
ccggucgaggucgccg

SEQ ID NO: 2824884 - RNA, 16 nt, Mycobacterium avium subsp. paratuberculosis
ccggucgaggucggcc

SEQ ID NO: 2824885 - RNA, 17 nt, Mycobacterium avium subsp. paratuberculosis
ccggucgaggucggcca

SEQ ID NO: 2824886 - RNA, 21 nt, Mycobacterium avium subsp. paratuberculosis
ccggucgaugaucuggcgguc

SEQ ID NO: 2824887 - RNA, 15 nt, Mycobacterium avium subsp. paratuberculosis
ccggucgaugucggc

SEQ ID NO: 2824888 - RNA, 17 nt, Mycobacterium avium subsp. paratuberculosis
ccggucgaugucggcga

SEQ ID NO: 2824889 - RNA, 23 nt, Mycobacterium avium subsp. paratuberculosis
ccggucgaugucggcgaaccagg

SEQ ID NO: 2824890 - RNA, 17 nt, Mycobacterium avium subsp. paratuberculosis
ccggucgccgaugguga

SEQ ID NO: 2824891 - RNA, 15 nt, Mycobacterium avium subsp. paratuberculosis
ccggucgccgggccg

SEQ ID NO: 2824892 - RNA, 17 nt, Mycobacterium avium subsp. paratuberculosis
ccggucgccgggccggc

SEQ ID NO: 2824893 - RNA, 12 nt, Mycobacterium avium subsp. paratuberculosis
ccggucgccggu

SEQ ID NO: 2824894 - RNA, 13 nt, Mycobacterium avium subsp. paratuberculosis
ccggucgccggug

SEQ ID NO: 2824895 - RNA, 13 nt, Mycobacterium avium subsp. paratuberculosis
ccggucgcggccg

SEQ ID NO: 2824896 - RNA, 20 nt, Mycobacterium avium subsp. paratuberculosis
ccggucgcgucgugcggccg

SEQ ID NO: 2824897 - RNA, 22 nt, Mycobacterium avium subsp. paratuberculosis
ccggucgcgucgugcggccggc

SEQ ID NO: 2824898 - RNA, 23 nt, Mycobacterium avium subsp. paratuberculosis
ccggucggaggccuuggugaugg

SEQ ID NO: 2824899 - RNA, 17 nt, Mycobacterium avium subsp. paratuberculosis
ccggucggaguccagca

SEQ ID NO: 2824900 - RNA, 19 nt, Mycobacterium avium subsp. paratuberculosis
ccggucggaguccagcacg

SEQ ID NO: 2824901 - RNA, 14 nt, Mycobacterium avium subsp. paratuberculosis
ccggucggcccgcu

SEQ ID NO: 2824902 - RNA, 18 nt, Mycobacterium avium subsp. paratuberculosis
ccggucggcccgcucccc

SEQ ID NO: 2824903 - RNA, 19 nt, Mycobacterium avium subsp. paratuberculosis
ccggucggcgcucgcgggu

SEQ ID NO: 2824904 - RNA, 20 nt, Mycobacterium avium subsp. paratuberculosis
ccggucggcgcucgcgggug

SEQ ID NO: 2824905 - RNA, 14 nt, Mycobacterium avium subsp. paratuberculosis
ccggucgggccaac

SEQ ID NO: 2824906 - RNA, 16 nt, Mycobacterium avium subsp. paratuberculosis
ccggucggucagucgc

SEQ ID NO: 2824907 - RNA, 21 nt, Mycobacterium avium subsp. paratuberculosis
ccggucggucagucgcgccgc

SEQ ID NO: 2824908 - RNA, 23 nt, Mycobacterium avium subsp. paratuberculosis
ccggucggucagucgcgccgcca

SEQ ID NO: 2824909 - RNA, 13 nt, Mycobacterium avium subsp. paratuberculosis
ccggucggugagc

SEQ ID NO: 2824910 - RNA, 20 nt, Mycobacterium avium subsp. paratuberculosis
ccggucggugagcuggccgc

SEQ ID NO: 2824911 - RNA, 23 nt, Mycobacterium avium subsp. paratuberculosis
ccggucggugagcuggccgcgca

SEQ ID NO: 2824912 - RNA, 17 nt, Mycobacterium avium subsp. paratuberculosis
ccggucggugcccagca

SEQ ID NO: 2824913 - RNA, 23 nt, Mycobacterium avium subsp. paratuberculosis
ccggucggugcgaugguggucgc

SEQ ID NO: 2824914 - RNA, 18 nt, Mycobacterium avium subsp. paratuberculosis
ccggucguagcgucgggg

SEQ ID NO: 2824915 - RNA, 14 nt, Mycobacterium avium subsp. paratuberculosis
ccggucguagucgg

SEQ ID NO: 2824916 - RNA, 15 nt, Mycobacterium avium subsp. paratuberculosis
ccggucguagucggc

SEQ ID NO: 2824917 - RNA, 16 nt, Mycobacterium avium subsp. paratuberculosis
ccggucguagucggcc

SEQ ID NO: 2824918 - RNA, 21 nt, Mycobacterium avium subsp. paratuberculosis
ccggucguagucggcccgccg

SEQ ID NO: 2824919 - RNA, 18 nt, Mycobacterium avium subsp. paratuberculosis
ccggucgucggggcaucg

SEQ ID NO: 2824920 - RNA, 13 nt, Mycobacterium avium subsp. paratuberculosis
ccggucguggggc

SEQ ID NO: 2824921 - RNA, 22 nt, Mycobacterium avium subsp. paratuberculosis
ccggucgugucaugugccucgc

SEQ ID NO: 2824922 - RNA, 21 nt, Mycobacterium avium subsp. paratuberculosis
ccggucguuguuuuggccgug

SEQ ID NO: 2824923 - RNA, 19 nt, Mycobacterium avium subsp. paratuberculosis
ccggucguuucggccggcc

SEQ ID NO: 2824924 - RNA, 21 nt, Mycobacterium avium subsp. paratuberculosis
ccggucguuucggccggcccc

SEQ ID NO: 2824925 - RNA, 22 nt, Mycobacterium avium subsp. paratuberculosis
ccggucuccaugucgucggcgg

SEQ ID NO: 2824926 - RNA, 23 nt, Mycobacterium avium subsp. paratuberculosis
ccggucuccaugucgucggcgga

SEQ ID NO: 2824927 - RNA, 13 nt, Mycobacterium avium subsp. paratuberculosis
ccggucucgaccg

SEQ ID NO: 2824928 - RNA, 18 nt, Mycobacterium avium subsp. paratuberculosis
ccggucucgaccgcggcg

SEQ ID NO: 2824929 - RNA, 19 nt, Mycobacterium avium subsp. paratuberculosis
ccggucucgaccgcggcgc

SEQ ID NO: 2824930 - RNA, 21 nt, Mycobacterium avium subsp. paratuberculosis
ccggucucggucgcggcgucg

SEQ ID NO: 2824931 - RNA, 20 nt, Mycobacterium avium subsp. paratuberculosis
ccggucugaucgcccagcac

SEQ ID NO: 2824932 - RNA, 21 nt, Mycobacterium avium subsp. paratuberculosis
ccggucugaucgcccagcacc

SEQ ID NO: 2824933 - RNA, 22 nt, Mycobacterium avium subsp. paratuberculosis
ccggucugaucgcccagcaccg

SEQ ID NO: 2824934 - RNA, 14 nt, Mycobacterium avium subsp. paratuberculosis
ccggucugcggccg

SEQ ID NO: 2824935 - RNA, 19 nt, Mycobacterium avium subsp. paratuberculosis
ccggucugcggccgcgacu

SEQ ID NO: 2824936 - RNA, 19 nt, Mycobacterium avium subsp. paratuberculosis
ccggucuucucggccaggc

SEQ ID NO: 2824937 - RNA, 21 nt, Mycobacterium avium subsp. paratuberculosis
ccggucuucucggccaggcuc

SEQ ID NO: 2824938 - RNA, 16 nt, Mycobacterium avium subsp. paratuberculosis
ccggucuugccggcuu

SEQ ID NO: 2824939 - RNA, 22 nt, Mycobacterium avium subsp. paratuberculosis
ccggucuuggacagcagcagcu

SEQ ID NO: 2824940 - RNA, 16 nt, Mycobacterium avium subsp. paratuberculosis
ccggucuugggcucgg

SEQ ID NO: 2824941 - RNA, 11 nt, Mycobacterium avium subsp. paratuberculosis
ccgguggcagc

SEQ ID NO: 2824942 - RNA, 17 nt, Mycobacterium avium subsp. paratuberculosis
ccgguggcagcccggcu

SEQ ID NO: 2824943 - RNA, 19 nt, Mycobacterium avium subsp. paratuberculosis
ccgguggcccggucgucga

SEQ ID NO: 2824944 - RNA, 22 nt, Mycobacterium avium subsp. paratuberculosis
ccgguggcccggucgucgagca

SEQ ID NO: 2824945 - RNA, 13 nt, Mycobacterium avium subsp. paratuberculosis
ccgguggccgccg

SEQ ID NO: 2824946 - RNA, 13 nt, Mycobacterium avium subsp. paratuberculosis
ccgguggccgcgc

SEQ ID NO: 2824947 - RNA, 14 nt, Mycobacterium avium subsp. paratuberculosis
ccgguggccgcgcu

SEQ ID NO: 2824948 - RNA, 13 nt, Mycobacterium avium subsp. paratuberculosis
ccgguggccgcgu

SEQ ID NO: 2824949 - RNA, 17 nt, Mycobacterium avium subsp. paratuberculosis
ccgguggccgcgucgac

SEQ ID NO: 2824950 - RNA, 19 nt, Mycobacterium avium subsp. paratuberculosis
ccgguggccgcgucgacca

SEQ ID NO: 2824951 - RNA, 13 nt, Mycobacterium avium subsp. paratuberculosis
ccgguggccggga

SEQ ID NO: 2824952 - RNA, 18 nt, Mycobacterium avium subsp. paratuberculosis
ccgguggccgggagugcu

SEQ ID NO: 2824953 - RNA, 21 nt, Mycobacterium avium subsp. paratuberculosis
ccgguggcgaaguugaucggu

SEQ ID NO: 2824954 - RNA, 21 nt, Mycobacterium avium subsp. paratuberculosis
ccgguggcgcgaaucccggcc

SEQ ID NO: 2824955 - RNA, 15 nt, Mycobacterium avium subsp. paratuberculosis
ccgguggcggcgaca

SEQ ID NO: 2824956 - RNA, 15 nt, Mycobacterium avium subsp. paratuberculosis
ccgguggcggcgagg

SEQ ID NO: 2824957 - RNA, 23 nt, Mycobacterium avium subsp. paratuberculosis
ccgguggcgucggugaugccgga

SEQ ID NO: 2824958 - RNA, 20 nt, Mycobacterium avium subsp. paratuberculosis
ccggugggacugggcgccgc

SEQ ID NO: 2824959 - RNA, 14 nt, Mycobacterium avium subsp. paratuberculosis
ccggugggcggcgc

SEQ ID NO: 2824960 - RNA, 16 nt, Mycobacterium avium subsp. paratuberculosis
ccggugggcggcgccc

SEQ ID NO: 2824961 - RNA, 21 nt, Mycobacterium avium subsp. paratuberculosis
ccgguggggugaugaggucgc

SEQ ID NO: 2824962 - RNA, 15 nt, Mycobacterium avium subsp. paratuberculosis
ccgguggucaacgcg

SEQ ID NO: 2824963 - RNA, 14 nt, Mycobacterium avium subsp. paratuberculosis
ccgguggucccggu

SEQ ID NO: 2824964 - RNA, 21 nt, Mycobacterium avium subsp. paratuberculosis
ccgguggucccggucagcguc

SEQ ID NO: 2824965 - RNA, 16 nt, Mycobacterium avium subsp. paratuberculosis
ccgguggugagacccu

SEQ ID NO: 2824966 - RNA, 20 nt, Mycobacterium avium subsp. paratuberculosis
ccgguguaucccaucagugc

SEQ ID NO: 2824967 - RNA, 20 nt, Mycobacterium avium subsp. paratuberculosis
ccggugucacgcuggcguga

SEQ ID NO: 2824968 - RNA, 21 nt, Mycobacterium avium subsp. paratuberculosis
ccggugucacgcuggcgugac

SEQ ID NO: 2824969 - RNA, 15 nt, Mycobacterium avium subsp. paratuberculosis
ccgguguccacgucg

SEQ ID NO: 2824970 - RNA, 21 nt, Mycobacterium avium subsp. paratuberculosis
ccgguguccacgucgcccagc

SEQ ID NO: 2824971 - RNA, 14 nt, Mycobacterium avium subsp. paratuberculosis
ccggugucgccguc

SEQ ID NO: 2824972 - RNA, 15 nt, Mycobacterium avium subsp. paratuberculosis
ccggugucgccgucg

SEQ ID NO: 2824973 - RNA, 16 nt, Mycobacterium avium subsp. paratuberculosis
ccggugucgccgucgc

SEQ ID NO: 2824974 - RNA, 17 nt, Mycobacterium avium subsp. paratuberculosis
ccggugucgccgucgcc

SEQ ID NO: 2824975 - RNA, 18 nt, Mycobacterium avium subsp. paratuberculosis
ccggugucgccgucgccg

SEQ ID NO: 2824976 - RNA, 19 nt, Mycobacterium avium subsp. paratuberculosis
ccggugucgccgucgccgc

SEQ ID NO: 2824977 - RNA, 14 nt, Mycobacterium avium subsp. paratuberculosis
ccggugucggcgac

SEQ ID NO: 2824978 - RNA, 15 nt, Mycobacterium avium subsp. paratuberculosis
ccggugucggcgacc

SEQ ID NO: 2824979 - RNA, 20 nt, Mycobacterium avium subsp. paratuberculosis
ccggugucggggucgucgac

SEQ ID NO: 2824980 - RNA, 23 nt, Mycobacterium avium subsp. paratuberculosis
ccggugucggggucgucgacggc

SEQ ID NO: 2824981 - RNA, 16 nt, Mycobacterium avium subsp. paratuberculosis
ccggugucugaccucg

SEQ ID NO: 2824982 - RNA, 14 nt, Mycobacterium avium subsp. paratuberculosis
ccggugugcagcca

SEQ ID NO: 2824983 - RNA, 15 nt, Mycobacterium avium subsp. paratuberculosis
ccggugugcagccac

SEQ ID NO: 2824984 - RNA, 18 nt, Mycobacterium avium subsp. paratuberculosis
ccggugugccgaagggca

SEQ ID NO: 2824985 - RNA, 16 nt, Mycobacterium avium subsp. paratuberculosis
ccggugugccuggcuc

SEQ ID NO: 2824986 - RNA, 21 nt, Mycobacterium avium subsp. paratuberculosis
ccgguguucaagccggcgugg

SEQ ID NO: 2824987 - RNA, 13 nt, Mycobacterium avium subsp. paratuberculosis
ccgguguucggcg

SEQ ID NO: 2824988 - RNA, 14 nt, Mycobacterium avium subsp. paratuberculosis
ccgguguucggcgc

SEQ ID NO: 2824989 - RNA, 20 nt, Mycobacterium avium subsp. paratuberculosis
ccgguguucggcgccagccg

SEQ ID NO: 2824990 - RNA, 16 nt, Mycobacterium avium subsp. paratuberculosis
ccgguguugccgacgg

SEQ ID NO: 2824991 - RNA, 17 nt, Mycobacterium avium subsp. paratuberculosis
ccgguguugccgacggc

SEQ ID NO: 2824992 - RNA, 19 nt, Mycobacterium avium subsp. paratuberculosis
ccgguguugccgacggcgc

SEQ ID NO: 2824993 - RNA, 22 nt, Mycobacterium avium subsp. paratuberculosis
ccgguguugccgacggcgccgg

SEQ ID NO: 2824994 - RNA, 18 nt, Mycobacterium avium subsp. paratuberculosis
ccgguuccaaccaccgug

SEQ ID NO: 2824995 - RNA, 20 nt, Mycobacterium avium subsp. paratuberculosis
ccgguuccaaccaccguggc

SEQ ID NO: 2824996 - RNA, 22 nt, Mycobacterium avium subsp. paratuberculosis
ccgguuccaaccaccguggccc

SEQ ID NO: 2824997 - RNA, 18 nt, Mycobacterium avium subsp. paratuberculosis
ccgguuccaccgggccgc

SEQ ID NO: 2824998 - RNA, 21 nt, Mycobacterium avium subsp. paratuberculosis
ccgguuccaccgggccgccau

SEQ ID NO: 2824999 - RNA, 14 nt, Mycobacterium avium subsp. paratuberculosis
ccgguuccagcggc

SEQ ID NO: 2825000 - RNA, 17 nt, Mycobacterium avium subsp. paratuberculosis
ccgguucccgugcuggc

SEQ ID NO: 2825001 - RNA, 13 nt, Mycobacterium avium subsp. paratuberculosis
ccgguuccgcgac

SEQ ID NO: 2825002 - RNA, 14 nt, Mycobacterium avium subsp. paratuberculosis
ccgguuccgcgaca

SEQ ID NO: 2825003 - RNA, 12 nt, Mycobacterium avium subsp. paratuberculosis
ccgguuccgggc

SEQ ID NO: 2825004 - RNA, 17 nt, Mycobacterium avium subsp. paratuberculosis
ccgguuccucggcgugu

SEQ ID NO: 2825005 - RNA, 18 nt, Mycobacterium avium subsp. paratuberculosis
ccgguucggacacggcgc

SEQ ID NO: 2825006 - RNA, 17 nt, Mycobacterium avium subsp. paratuberculosis
ccgguucggcggcauag

SEQ ID NO: 2825007 - RNA, 22 nt, Mycobacterium avium subsp. paratuberculosis
ccgguucgucaacgccccgguc

SEQ ID NO: 2825008 - RNA, 15 nt, Mycobacterium avium subsp. paratuberculosis
ccgguucgucccgcg

SEQ ID NO: 2825009 - RNA, 16 nt, Mycobacterium avium subsp. paratuberculosis
ccgguugaaggccgcg

SEQ ID NO: 2825010 - RNA, 17 nt, Mycobacterium avium subsp. paratuberculosis
ccgguugaaggccgcgc

SEQ ID NO: 2825011 - RNA, 13 nt, Mycobacterium avium subsp. paratuberculosis
ccgguugaccccg

SEQ ID NO: 2825012 - RNA, 14 nt, Mycobacterium avium subsp. paratuberculosis
ccgguugaccccgg

SEQ ID NO: 2825013 - RNA, 20 nt, Mycobacterium avium subsp. paratuberculosis
ccgguugaccccggccccgg

SEQ ID NO: 2825014 - RNA, 21 nt, Mycobacterium avium subsp. paratuberculosis
ccgguugaccccggccccggc

SEQ ID NO: 2825015 - RNA, 15 nt, Mycobacterium avium subsp. paratuberculosis
ccgguugagcaccgc

SEQ ID NO: 2825016 - RNA, 17 nt, Mycobacterium avium subsp. paratuberculosis
ccgguugauccggaucg

SEQ ID NO: 2825017 - RNA, 19 nt, Mycobacterium avium subsp. paratuberculosis
ccgguugauccggaucggg

SEQ ID NO: 2825018 - RNA, 13 nt, Mycobacterium avium subsp. paratuberculosis
ccgguugcaccgc

SEQ ID NO: 2825019 - RNA, 19 nt, Mycobacterium avium subsp. paratuberculosis
ccgguugccuuuccgcgcg

SEQ ID NO: 2825020 - RNA, 23 nt, Mycobacterium avium subsp. paratuberculosis
ccgguugccuuuccgcgcggcgg

SEQ ID NO: 2825021 - RNA, 15 nt, Mycobacterium avium subsp. paratuberculosis
ccgguugcggcgaac

SEQ ID NO: 2825022 - RNA, 17 nt, Mycobacterium avium subsp. paratuberculosis
ccgguugcgguggccga

SEQ ID NO: 2825023 - RNA, 20 nt, Mycobacterium avium subsp. paratuberculosis
ccgguugcgguugccccacc

SEQ ID NO: 2825024 - RNA, 15 nt, Mycobacterium avium subsp. paratuberculosis
ccgguuggccaggug

SEQ ID NO: 2825025 - RNA, 17 nt, Mycobacterium avium subsp. paratuberculosis
ccgguuggccagguggc

SEQ ID NO: 2825026 - RNA, 20 nt, Mycobacterium avium subsp. paratuberculosis
ccgucacggcugccgaccuc

SEQ ID NO: 2825027 - RNA, 22 nt, Mycobacterium avium subsp. paratuberculosis
ccgucacgggcugaccgccagg

SEQ ID NO: 2825028 - RNA, 19 nt, Mycobacterium avium subsp. paratuberculosis
ccgucacguagcgcggccg

SEQ ID NO: 2825029 - RNA, 20 nt, Mycobacterium avium subsp. paratuberculosis
ccgucacguagcgcggccgc

SEQ ID NO: 2825030 - RNA, 17 nt, Mycobacterium avium subsp. paratuberculosis
ccgucacgucauuucgg

SEQ ID NO: 2825031 - RNA, 22 nt, Mycobacterium avium subsp. paratuberculosis
ccgucacgucauuucggucggc

SEQ ID NO: 2825032 - RNA, 17 nt, Mycobacterium avium subsp. paratuberculosis
ccgucacugcacgcacg

SEQ ID NO: 2825033 - RNA, 18 nt, Mycobacterium avium subsp. paratuberculosis
ccgucacugcacgcacgg

SEQ ID NO: 2825034 - RNA, 16 nt, Mycobacterium avium subsp. paratuberculosis
ccgucacugucggcgc

SEQ ID NO: 2825035 - RNA, 12 nt, Mycobacterium avium subsp. paratuberculosis
ccgucagccagg

SEQ ID NO: 2825036 - RNA, 14 nt, Mycobacterium avium subsp. paratuberculosis
ccgucagcgccgcc

SEQ ID NO: 2825037 - RNA, 17 nt, Mycobacterium avium subsp. paratuberculosis
ccgucagcgccgcccgc

SEQ ID NO: 2825038 - RNA, 18 nt, Mycobacterium avium subsp. paratuberculosis
ccgucagcgucagcacgu

SEQ ID NO: 2825039 - RNA, 17 nt, Mycobacterium avium subsp. paratuberculosis
ccgucaggaacgccggc

SEQ ID NO: 2825040 - RNA, 21 nt, Mycobacterium avium subsp. paratuberculosis
ccgucaggaacgccggcuugc

SEQ ID NO: 2825041 - RNA, 18 nt, Mycobacterium avium subsp. paratuberculosis
ccgucaggagugcucggc

SEQ ID NO: 2825042 - RNA, 14 nt, Mycobacterium avium subsp. paratuberculosis
ccgucaggccucga

SEQ ID NO: 2825043 - RNA, 21 nt, Mycobacterium avium subsp. paratuberculosis
ccgucagggugacguggcggc

SEQ ID NO: 2825044 - RNA, 15 nt, Mycobacterium avium subsp. paratuberculosis
ccgucaggguggugc

SEQ ID NO: 2825045 - RNA, 21 nt, Mycobacterium avium subsp. paratuberculosis
ccgucagugcgcauucggcga

SEQ ID NO: 2825046 - RNA, 24 nt, Mycobacterium avium subsp. paratuberculosis
ccgucagugcgcauucggcgacgc

SEQ ID NO: 2825047 - RNA, 15 nt, Mycobacterium avium subsp. paratuberculosis
ccgucaguucguaga

SEQ ID NO: 2825048 - RNA, 17 nt, Mycobacterium avium subsp. paratuberculosis
ccgucaguucguagauc

SEQ ID NO: 2825049 - RNA, 14 nt, Mycobacterium avium subsp. paratuberculosis
ccgucaucaccgcc

SEQ ID NO: 2825050 - RNA, 16 nt, Mycobacterium avium subsp. paratuberculosis
ccgucaucaccgccga

SEQ ID NO: 2825051 - RNA, 17 nt, Mycobacterium avium subsp. paratuberculosis
ccgucaucaccgccgag

SEQ ID NO: 2825052 - RNA, 15 nt, Mycobacterium avium subsp. paratuberculosis
ccgucaucaucaccg

SEQ ID NO: 2825053 - RNA, 21 nt, Mycobacterium avium subsp. paratuberculosis
ccgucaucaucaccgggaugg

SEQ ID NO: 2825054 - RNA, 13 nt, Mycobacterium avium subsp. paratuberculosis
ccgucauccccau

SEQ ID NO: 2825055 - RNA, 14 nt, Mycobacterium avium subsp. paratuberculosis
ccgucaucgacacc

SEQ ID NO: 2825056 - RNA, 21 nt, Mycobacterium avium subsp. paratuberculosis
ccgucaucgccgacggugagc

SEQ ID NO: 2825057 - RNA, 16 nt, Mycobacterium avium subsp. paratuberculosis
ccgucaucgcggcgaa

SEQ ID NO: 2825058 - RNA, 14 nt, Mycobacterium avium subsp. paratuberculosis
ccgucaucggcgga

SEQ ID NO: 2825059 - RNA, 15 nt, Mycobacterium avium subsp. paratuberculosis
ccgucaucggcggaa

SEQ ID NO: 2825060 - RNA, 14 nt, Mycobacterium avium subsp. paratuberculosis
ccgucaucuccgac

SEQ ID NO: 2825061 - RNA, 15 nt, Mycobacterium avium subsp. paratuberculosis
ccgucaugccguuga

SEQ ID NO: 2825062 - RNA, 14 nt, Mycobacterium avium subsp. paratuberculosis
ccguccacaccguu

SEQ ID NO: 2825063 - RNA, 15 nt, Mycobacterium avium subsp. paratuberculosis
ccguccacagccggc

SEQ ID NO: 2825064 - RNA, 15 nt, Mycobacterium avium subsp. paratuberculosis
ccguccacccggccc

SEQ ID NO: 2825065 - RNA, 13 nt, Mycobacterium avium subsp. paratuberculosis
ccguccaccggca

SEQ ID NO: 2825066 - RNA, 14 nt, Mycobacterium avium subsp. paratuberculosis
ccguccaccggcac

SEQ ID NO: 2825067 - RNA, 15 nt, Mycobacterium avium subsp. paratuberculosis
ccguccaccggcacg

SEQ ID NO: 2825068 - RNA, 21 nt, Mycobacterium avium subsp. paratuberculosis
ccguccaccggcacggcaccg

SEQ ID NO: 2825069 - RNA, 17 nt, Mycobacterium avium subsp. paratuberculosis
ccguccacggcgguggg

SEQ ID NO: 2825070 - RNA, 15 nt, Mycobacterium avium subsp. paratuberculosis
ccguccacgggucgc

SEQ ID NO: 2825071 - RNA, 23 nt, Mycobacterium avium subsp. paratuberculosis
ccguccagaucggccagcgcggc

SEQ ID NO: 2825072 - RNA, 15 nt, Mycobacterium avium subsp. paratuberculosis
ccguccagcaacgcc

SEQ ID NO: 2825073 - RNA, 12 nt, Mycobacterium avium subsp. paratuberculosis
ccguccagcagc

SEQ ID NO: 2825074 - RNA, 15 nt, Mycobacterium avium subsp. paratuberculosis
ccguccagcagcagc

SEQ ID NO: 2825075 - RNA, 19 nt, Mycobacterium avium subsp. paratuberculosis
ccguccagcagcagcgcgc

SEQ ID NO: 2825076 - RNA, 17 nt, Mycobacterium avium subsp. paratuberculosis
ccguccagcccagcgcc

SEQ ID NO: 2825077 - RNA, 18 nt, Mycobacterium avium subsp. paratuberculosis
ccguccagcccagcgccc

SEQ ID NO: 2825078 - RNA, 20 nt, Mycobacterium avium subsp. paratuberculosis
ccguccagccgugcggcacg

SEQ ID NO: 2825079 - RNA, 17 nt, Mycobacterium avium subsp. paratuberculosis
ccguccagcgcaugcca

SEQ ID NO: 2825080 - RNA, 22 nt, Mycobacterium avium subsp. paratuberculosis
ccguccagcgcaugccacuugc

SEQ ID NO: 2825081 - RNA, 14 nt, Mycobacterium avium subsp. paratuberculosis
ccguccagcgcgag

SEQ ID NO: 2825082 - RNA, 14 nt, Mycobacterium avium subsp. paratuberculosis
ccguccagcgucac

SEQ ID NO: 2825083 - RNA, 22 nt, Mycobacterium avium subsp. paratuberculosis
ccguccagcgugugcguggugg

SEQ ID NO: 2825084 - RNA, 16 nt, Mycobacterium avium subsp. paratuberculosis
ccguccagcucagcgc

SEQ ID NO: 2825085 - RNA, 20 nt, Mycobacterium avium subsp. paratuberculosis
ccguccagcucagcgcgcac

SEQ ID NO: 2825086 - RNA, 16 nt, Mycobacterium avium subsp. paratuberculosis
ccguccagcuccgccg

SEQ ID NO: 2825087 - RNA, 18 nt, Mycobacterium avium subsp. paratuberculosis
ccguccagcuccgccgac

SEQ ID NO: 2825088 - RNA, 23 nt, Mycobacterium avium subsp. paratuberculosis
ccguccagcuccgccgacaccag

SEQ ID NO: 2825089 - RNA, 23 nt, Mycobacterium avium subsp. paratuberculosis
ccguccagcucgcguucgggccc

SEQ ID NO: 2825090 - RNA, 12 nt, Mycobacterium avium subsp. paratuberculosis
ccguccaggccg

SEQ ID NO: 2825091 - RNA, 13 nt, Mycobacterium avium subsp. paratuberculosis
ccguccaggccgc

SEQ ID NO: 2825092 - RNA, 15 nt, Mycobacterium avium subsp. paratuberculosis
ccguccaggccgcug

SEQ ID NO: 2825093 - RNA, 14 nt, Mycobacterium avium subsp. paratuberculosis
ccguccaggcgcca

SEQ ID NO: 2825094 - RNA, 15 nt, Mycobacterium avium subsp. paratuberculosis
ccguccaggcgccau

SEQ ID NO: 2825095 - RNA, 14 nt, Mycobacterium avium subsp. paratuberculosis
ccguccaucgccgc

SEQ ID NO: 2825096 - RNA, 22 nt, Mycobacterium avium subsp. paratuberculosis
ccguccaucgccgcgcacccgg

SEQ ID NO: 2825097 - RNA, 12 nt, Mycobacterium avium subsp. paratuberculosis
ccgucccacacg

SEQ ID NO: 2825098 - RNA, 13 nt, Mycobacterium avium subsp. paratuberculosis
ccguccccgcgcg

SEQ ID NO: 2825099 - RNA, 16 nt, Mycobacterium avium subsp. paratuberculosis
ccguccccgcgcggcu

SEQ ID NO: 2825100 - RNA, 18 nt, Mycobacterium avium subsp. paratuberculosis
ccguccccgcgcggcucg

SEQ ID NO: 2825101 - RNA, 13 nt, Mycobacterium avium subsp. paratuberculosis
ccguccccguccg

SEQ ID NO: 2825102 - RNA, 21 nt, Mycobacterium avium subsp. paratuberculosis
ccgucccgccgacggagacga

SEQ ID NO: 2825103 - RNA, 13 nt, Mycobacterium avium subsp. paratuberculosis
ccgucccggacgc

SEQ ID NO: 2825104 - RNA, 15 nt, Mycobacterium avium subsp. paratuberculosis
ccgucccggugucgc

SEQ ID NO: 2825105 - RNA, 21 nt, Mycobacterium avium subsp. paratuberculosis
ccgucccggugucgccgucgc

SEQ ID NO: 2825106 - RNA, 19 nt, Mycobacterium avium subsp. paratuberculosis
ccgucccgguugaccccgg

SEQ ID NO: 2825107 - RNA, 18 nt, Mycobacterium avium subsp. paratuberculosis
ccgucccgucacggcugc

SEQ ID NO: 2825108 - RNA, 19 nt, Mycobacterium avium subsp. paratuberculosis
ccgucccuguucgcgccgg

SEQ ID NO: 2825109 - RNA, 21 nt, Mycobacterium avium subsp. paratuberculosis
ccguccgaaucguugagcacc

SEQ ID NO: 2825110 - RNA, 21 nt, Mycobacterium avium subsp. paratuberculosis
ccguccgaccguugaccgacg

SEQ ID NO: 2825111 - RNA, 14 nt, Mycobacterium avium subsp. paratuberculosis
ccgucgaucccgga

SEQ ID NO: 2825112 - RNA, 15 nt, Mycobacterium avium subsp. paratuberculosis
ccgucgaucgcccgc

SEQ ID NO: 2825113 - RNA, 16 nt, Mycobacterium avium subsp. paratuberculosis
ccgucgaucgcccgcu

SEQ ID NO: 2825114 - RNA, 17 nt, Mycobacterium avium subsp. paratuberculosis
ccgucgaucgcccgcuc

SEQ ID NO: 2825115 - RNA, 20 nt, Mycobacterium avium subsp. paratuberculosis
ccgucgaucuugucguccag

SEQ ID NO: 2825116 - RNA, 23 nt, Mycobacterium avium subsp. paratuberculosis
ccgucgaucuugucguccaguga

SEQ ID NO: 2825117 - RNA, 17 nt, Mycobacterium avium subsp. paratuberculosis
ccgucgaugccggcgac

SEQ ID NO: 2825118 - RNA, 20 nt, Mycobacterium avium subsp. paratuberculosis
ccgucgauggacagggcgac

SEQ ID NO: 2825119 - RNA, 18 nt, Mycobacterium avium subsp. paratuberculosis
ccgucgauggcgcggccc

SEQ ID NO: 2825120 - RNA, 21 nt, Mycobacterium avium subsp. paratuberculosis
ccgucgauuucaaggggccgg

SEQ ID NO: 2825121 - RNA, 23 nt, Mycobacterium avium subsp. paratuberculosis
ccgucgauuucaaggggccgggc

SEQ ID NO: 2825122 - RNA, 24 nt, Mycobacterium avium subsp. paratuberculosis
ccgucgauuucaaggggccgggcu

SEQ ID NO: 2825123 - RNA, 13 nt, Mycobacterium avium subsp. paratuberculosis
ccgucgcaccgcc

SEQ ID NO: 2825124 - RNA, 19 nt, Mycobacterium avium subsp. paratuberculosis
ccgucgcacuagguccggc

SEQ ID NO: 2825125 - RNA, 21 nt, Mycobacterium avium subsp. paratuberculosis
ccgucgcacuagguccggcgc

SEQ ID NO: 2825126 - RNA, 22 nt, Mycobacterium avium subsp. paratuberculosis
ccgucgcacuagguccggcgcg

SEQ ID NO: 2825127 - RNA, 23 nt, Mycobacterium avium subsp. paratuberculosis
ccgucgcacuagguccggcgcga

SEQ ID NO: 2825128 - RNA, 15 nt, Mycobacterium avium subsp. paratuberculosis
ccgucgcaucagcuc

SEQ ID NO: 2825129 - RNA, 17 nt, Mycobacterium avium subsp. paratuberculosis
ccgucgcaucagcucgg

SEQ ID NO: 2825130 - RNA, 15 nt, Mycobacterium avium subsp. paratuberculosis
ccgucgccaccaccg

SEQ ID NO: 2825131 - RNA, 18 nt, Mycobacterium avium subsp. paratuberculosis
ccgucgccaccaccgcgc

SEQ ID NO: 2825132 - RNA, 22 nt, Mycobacterium avium subsp. paratuberculosis
ccgucgccaccaccgcgccguc

SEQ ID NO: 2825133 - RNA, 14 nt, Mycobacterium avium subsp. paratuberculosis
ccgucgccaccacg

SEQ ID NO: 2825134 - RNA, 15 nt, Mycobacterium avium subsp. paratuberculosis
ccgucgccaccacgg

SEQ ID NO: 2825135 - RNA, 16 nt, Mycobacterium avium subsp. paratuberculosis
ccgucgccaccacggc

SEQ ID NO: 2825136 - RNA, 18 nt, Mycobacterium avium subsp. paratuberculosis
ccgucgccaccacggcgc

SEQ ID NO: 2825137 - RNA, 13 nt, Mycobacterium avium subsp. paratuberculosis
ccgucgccaccga

SEQ ID NO: 2825138 - RNA, 20 nt, Mycobacterium avium subsp. paratuberculosis
ccgucgccaccgagucgcgc

SEQ ID NO: 2825139 - RNA, 23 nt, Mycobacterium avium subsp. paratuberculosis
ccgucgccaccgagucgcgcgac

SEQ ID NO: 2825140 - RNA, 12 nt, Mycobacterium avium subsp. paratuberculosis
ccgucgccacga

SEQ ID NO: 2825141 - RNA, 19 nt, Mycobacterium avium subsp. paratuberculosis
ccgucgccacgaucaccac

SEQ ID NO: 2825142 - RNA, 19 nt, Mycobacterium avium subsp. paratuberculosis
ccgucgccccgcaccgagc

SEQ ID NO: 2825143 - RNA, 15 nt, Mycobacterium avium subsp. paratuberculosis
ccgucgcccgcccag

SEQ ID NO: 2825144 - RNA, 11 nt, Mycobacterium avium subsp. paratuberculosis
ccgucgccgaa

SEQ ID NO: 2825145 - RNA, 18 nt, Mycobacterium avium subsp. paratuberculosis
ccgucgccgaccagccga

SEQ ID NO: 2825146 - RNA, 16 nt, Mycobacterium avium subsp. paratuberculosis
ccgucgccgaucaccu

SEQ ID NO: 2825147 - RNA, 14 nt, Mycobacterium avium subsp. paratuberculosis
ccgucgccgaucag

SEQ ID NO: 2825148 - RNA, 20 nt, Mycobacterium avium subsp. paratuberculosis
ccgucgccgaucagcaccag

SEQ ID NO: 2825149 - RNA, 21 nt, Mycobacterium avium subsp. paratuberculosis
ccgucgccgaucagcaccagg

SEQ ID NO: 2825150 - RNA, 12 nt, Mycobacterium avium subsp. paratuberculosis
ccgucgccgcac

SEQ ID NO: 2825151 - RNA, 18 nt, Mycobacterium avium subsp. paratuberculosis
ccgucgccgcacgcccac

SEQ ID NO: 2825152 - RNA, 12 nt, Mycobacterium avium subsp. paratuberculosis
ccgucgccgccg

SEQ ID NO: 2825153 - RNA, 15 nt, Mycobacterium avium subsp. paratuberculosis
ccgucgccgcgcccg

SEQ ID NO: 2825154 - RNA, 18 nt, Mycobacterium avium subsp. paratuberculosis
ccgucgccgcgcccgccg

SEQ ID NO: 2825155 - RNA, 19 nt, Mycobacterium avium subsp. paratuberculosis
ccgucgccgcgcccgccgg

SEQ ID NO: 2825156 - RNA, 12 nt, Mycobacterium avium subsp. paratuberculosis
ccgucgccggag

SEQ ID NO: 2825157 - RNA, 16 nt, Mycobacterium avium subsp. paratuberculosis
ccgucgccggaggcga

SEQ ID NO: 2825158 - RNA, 17 nt, Mycobacterium avium subsp. paratuberculosis
ccgucgccggaggcgau

SEQ ID NO: 2825159 - RNA, 21 nt, Mycobacterium avium subsp. paratuberculosis
ccgucgccggaggcgaucagg

SEQ ID NO: 2825160 - RNA, 16 nt, Mycobacterium avium subsp. paratuberculosis
ccgucgccggcgcgca

SEQ ID NO: 2825161 - RNA, 14 nt, Mycobacterium avium subsp. paratuberculosis
ccgucgccggcuga

SEQ ID NO: 2825162 - RNA, 18 nt, Mycobacterium avium subsp. paratuberculosis
ccgucgccggcugacugc

SEQ ID NO: 2825163 - RNA, 14 nt, Mycobacterium avium subsp. paratuberculosis
ccgucgccgggcgg

SEQ ID NO: 2825164 - RNA, 16 nt, Mycobacterium avium subsp. paratuberculosis
ccgucgccgugaucug

SEQ ID NO: 2825165 - RNA, 13 nt, Mycobacterium avium subsp. paratuberculosis
ccgucgccgugcg

SEQ ID NO: 2825166 - RNA, 17 nt, Mycobacterium avium subsp. paratuberculosis
ccgucgccuccgagaug

SEQ ID NO: 2825167 - RNA, 18 nt, Mycobacterium avium subsp. paratuberculosis
ccgucgcgaucacaccac

SEQ ID NO: 2825168 - RNA, 16 nt, Mycobacterium avium subsp. paratuberculosis
ccgucgcgaucgcggu

SEQ ID NO: 2825169 - RNA, 18 nt, Mycobacterium avium subsp. paratuberculosis
ccgucgcgaucgcggucc

SEQ ID NO: 2825170 - RNA, 23 nt, Mycobacterium avium subsp. paratuberculosis
ccgucgcgcaaacugacaggcgg

SEQ ID NO: 2825171 - RNA, 16 nt, Mycobacterium avium subsp. paratuberculosis
ccgucgcgcacccaga

SEQ ID NO: 2825172 - RNA, 14 nt, Mycobacterium avium subsp. paratuberculosis
ccgucgcgcagccu

SEQ ID NO: 2825173 - RNA, 13 nt, Mycobacterium avium subsp. paratuberculosis
ccgucgcgccagg

SEQ ID NO: 2825174 - RNA, 16 nt, Mycobacterium avium subsp. paratuberculosis
ccgucgcgcucgacga

SEQ ID NO: 2825175 - RNA, 23 nt, Mycobacterium avium subsp. paratuberculosis
ccgucgcggacccuggccagcac

SEQ ID NO: 2825176 - RNA, 23 nt, Mycobacterium avium subsp. paratuberculosis
ccgucgcggcgaucgcgagcagg

SEQ ID NO: 2825177 - RNA, 22 nt, Mycobacterium avium subsp. paratuberculosis
ccgucgcggcuucagucccgcg

SEQ ID NO: 2825178 - RNA, 22 nt, Mycobacterium avium subsp. paratuberculosis
ccgucgcgggaaucccacccgc

SEQ ID NO: 2825179 - RNA, 23 nt, Mycobacterium avium subsp. paratuberculosis
ccgucgcgggaaucccacccgca

SEQ ID NO: 2825180 - RNA, 23 nt, Mycobacterium avium subsp. paratuberculosis
ccgucgcgggagagcgcgggcac

SEQ ID NO: 2825181 - RNA, 18 nt, Mycobacterium avium subsp. paratuberculosis
ccgucgcgggcgucgggc

SEQ ID NO: 2825182 - RNA, 15 nt, Mycobacterium avium subsp. paratuberculosis
ccgucgcgggucagc

SEQ ID NO: 2825183 - RNA, 20 nt, Mycobacterium avium subsp. paratuberculosis
ccgucgcgggucagcgucgc

SEQ ID NO: 2825184 - RNA, 13 nt, Mycobacterium avium subsp. paratuberculosis
ccgucgcgggugg

SEQ ID NO: 2825185 - RNA, 12 nt, Mycobacterium avium subsp. paratuberculosis
ccgucgcgguca

SEQ ID NO: 2825186 - RNA, 18 nt, Mycobacterium avium subsp. paratuberculosis
ccgucgcggucagcucga

SEQ ID NO: 2825187 - RNA, 23 nt, Mycobacterium avium subsp. paratuberculosis
ccgucgcggucagcucgaucgcc

SEQ ID NO: 2825188 - RNA, 16 nt, Mycobacterium avium subsp. paratuberculosis
ccgucgcgucccuggc

SEQ ID NO: 2825189 - RNA, 20 nt, Mycobacterium avium subsp. paratuberculosis
ccgucgcuguuggcgacggc

SEQ ID NO: 2825190 - RNA, 23 nt, Mycobacterium avium subsp. paratuberculosis
ccgucgcuguuggcgacggcgcu

SEQ ID NO: 2825191 - RNA, 22 nt, Mycobacterium avium subsp. paratuberculosis
ccgucggaggacaacgcgucga

SEQ ID NO: 2825192 - RNA, 18 nt, Mycobacterium avium subsp. paratuberculosis
ccgucggcaacgccgggu

SEQ ID NO: 2825193 - RNA, 19 nt, Mycobacterium avium subsp. paratuberculosis
ccgucggcaacgccggguc

SEQ ID NO: 2825194 - RNA, 12 nt, Mycobacterium avium subsp. paratuberculosis
ccgucggcaucc

SEQ ID NO: 2825195 - RNA, 19 nt, Mycobacterium avium subsp. paratuberculosis
ccgucgucgucggccgggc

SEQ ID NO: 2825196 - RNA, 22 nt, Mycobacterium avium subsp. paratuberculosis
ccgucgucgucggccgggccgg

SEQ ID NO: 2825197 - RNA, 17 nt, Mycobacterium avium subsp. paratuberculosis
ccgucgucgugcaccac

SEQ ID NO: 2825198 - RNA, 18 nt, Mycobacterium avium subsp. paratuberculosis
ccgucgucgugcaccacg

SEQ ID NO: 2825199 - RNA, 20 nt, Mycobacterium avium subsp. paratuberculosis
ccgucgucgugcaccacgac

SEQ ID NO: 2825200 - RNA, 16 nt, Mycobacterium avium subsp. paratuberculosis
ccgucgugcucggcga

SEQ ID NO: 2825201 - RNA, 18 nt, Mycobacterium avium subsp. paratuberculosis
ccgucgugcucggcgagc

SEQ ID NO: 2825202 - RNA, 21 nt, Mycobacterium avium subsp. paratuberculosis
ccgucgugcucggcgagcacc

SEQ ID NO: 2825203 - RNA, 22 nt, Mycobacterium avium subsp. paratuberculosis
ccgucgugcucggcgagcaccg

SEQ ID NO: 2825204 - RNA, 22 nt, Mycobacterium avium subsp. paratuberculosis
ccgucguggguauccgccgcca

SEQ ID NO: 2825205 - RNA, 16 nt, Mycobacterium avium subsp. paratuberculosis
ccgucgugguggccgc

SEQ ID NO: 2825206 - RNA, 21 nt, Mycobacterium avium subsp. paratuberculosis
ccgucgugguggccgcgaaaa

SEQ ID NO: 2825207 - RNA, 20 nt, Mycobacterium avium subsp. paratuberculosis
ccgucguugacgcccuccug

SEQ ID NO: 2825208 - RNA, 21 nt, Mycobacterium avium subsp. paratuberculosis
ccgucguugacgcccuccugg

SEQ ID NO: 2825209 - RNA, 23 nt, Mycobacterium avium subsp. paratuberculosis
ccgucguugacgcccuccuggcg

SEQ ID NO: 2825210 - RNA, 15 nt, Mycobacterium avium subsp. paratuberculosis
ccgucguugccgugg

SEQ ID NO: 2825211 - RNA, 20 nt, Mycobacterium avium subsp. paratuberculosis
ccgucguugcgggcggcgcg

SEQ ID NO: 2825212 - RNA, 14 nt, Mycobacterium avium subsp. paratuberculosis
ccgucucaggaauu

SEQ ID NO: 2825213 - RNA, 14 nt, Mycobacterium avium subsp. paratuberculosis
ccgucuccaacugc

SEQ ID NO: 2825214 - RNA, 16 nt, Mycobacterium avium subsp. paratuberculosis
ccgucuccggcgcggu

SEQ ID NO: 2825215 - RNA, 16 nt, Mycobacterium avium subsp. paratuberculosis
ccgucuccucgaccag

SEQ ID NO: 2825216 - RNA, 17 nt, Mycobacterium avium subsp. paratuberculosis
ccgucuccucgaccagc

SEQ ID NO: 2825217 - RNA, 22 nt, Mycobacterium avium subsp. paratuberculosis
ccgucuccucgaccagcgcgcc

SEQ ID NO: 2825218 - RNA, 22 nt, Mycobacterium avium subsp. paratuberculosis
ccgucucgaccacccggcgggc

SEQ ID NO: 2825219 - RNA, 14 nt, Mycobacterium avium subsp. paratuberculosis
ccgucucgacccgg

SEQ ID NO: 2825220 - RNA, 14 nt, Mycobacterium avium subsp. paratuberculosis
ccgucucgagccgg

SEQ ID NO: 2825221 - RNA, 16 nt, Mycobacterium avium subsp. paratuberculosis
ccgucucgagccggcg

SEQ ID NO: 2825222 - RNA, 17 nt, Mycobacterium avium subsp. paratuberculosis
ccgucucgagccggcgc

SEQ ID NO: 2825223 - RNA, 17 nt, Mycobacterium avium subsp. paratuberculosis
ccgucucgucggccgcg

SEQ ID NO: 2825224 - RNA, 16 nt, Mycobacterium avium subsp. paratuberculosis
ccgucugcuggcccgg

SEQ ID NO: 2825225 - RNA, 13 nt, Mycobacterium avium subsp. paratuberculosis
ccgucuuccgggc

SEQ ID NO: 2825226 - RNA, 14 nt, Mycobacterium avium subsp. paratuberculosis
ccgucuucgaccgc

SEQ ID NO: 2825227 - RNA, 15 nt, Mycobacterium avium subsp. paratuberculosis
ccgucuucgaccgca

SEQ ID NO: 2825228 - RNA, 15 nt, Mycobacterium avium subsp. paratuberculosis
ccgucuucggggccg

SEQ ID NO: 2825229 - RNA, 16 nt, Mycobacterium avium subsp. paratuberculosis
ccgucuucggggccgc

SEQ ID NO: 2825230 - RNA, 18 nt, Mycobacterium avium subsp. paratuberculosis
ccgucuugcccggcgagc

SEQ ID NO: 2825231 - RNA, 15 nt, Mycobacterium avium subsp. paratuberculosis
ccgucuuggccaggc

SEQ ID NO: 2825232 - RNA, 17 nt, Mycobacterium avium subsp. paratuberculosis
ccgucuuggccaggccc

SEQ ID NO: 2825233 - RNA, 22 nt, Mycobacterium avium subsp. paratuberculosis
ccgucuuggccaggcccugcca

SEQ ID NO: 2825234 - RNA, 15 nt, Mycobacterium avium subsp. paratuberculosis
ccgucuuggucucgc

SEQ ID NO: 2825235 - RNA, 16 nt, Mycobacterium avium subsp. paratuberculosis
ccgucuuggucucgcc

SEQ ID NO: 2825236 - RNA, 17 nt, Mycobacterium avium subsp. paratuberculosis
ccgucuuguuggucagc

SEQ ID NO: 2825237 - RNA, 17 nt, Mycobacterium avium subsp. paratuberculosis
ccgugaaauaucccgau

SEQ ID NO: 2825238 - RNA, 16 nt, Mycobacterium avium subsp. paratuberculosis
ccgugaagggcccgcc

SEQ ID NO: 2825239 - RNA, 17 nt, Mycobacterium avium subsp. paratuberculosis
ccgugaagggcccgccg

SEQ ID NO: 2825240 - RNA, 23 nt, Mycobacterium avium subsp. paratuberculosis
ccgugaagggcccgccgguggcc

SEQ ID NO: 2825241 - RNA, 13 nt, Mycobacterium avium subsp. paratuberculosis
ccgugacccgccg

SEQ ID NO: 2825242 - RNA, 20 nt, Mycobacterium avium subsp. paratuberculosis
ccgugacccgccgugaccgg

SEQ ID NO: 2825243 - RNA, 13 nt, Mycobacterium avium subsp. paratuberculosis
ccgugaccggcga

SEQ ID NO: 2825244 - RNA, 20 nt, Mycobacterium avium subsp. paratuberculosis
ccgugacgccgauccgcugc

SEQ ID NO: 2825245 - RNA, 18 nt, Mycobacterium avium subsp. paratuberculosis
ccgugacggcaucggcgc

SEQ ID NO: 2825246 - RNA, 12 nt, Mycobacterium avium subsp. paratuberculosis
ccgugacguugu

SEQ ID NO: 2825247 - RNA, 16 nt, Mycobacterium avium subsp. paratuberculosis
ccgugaggcccggcgu

SEQ ID NO: 2825248 - RNA, 20 nt, Mycobacterium avium subsp. paratuberculosis
ccgugaggcccggcgugggc

SEQ ID NO: 2825249 - RNA, 18 nt, Mycobacterium avium subsp. paratuberculosis
ccgugagggaccuccagc

SEQ ID NO: 2825250 - RNA, 19 nt, Mycobacterium avium subsp. paratuberculosis
ccgugaguucgcugaccgc

SEQ ID NO: 2825251 - RNA, 20 nt, Mycobacterium avium subsp. paratuberculosis
ccgugaguucgcugaccgcc

SEQ ID NO: 2825252 - RNA, 22 nt, Mycobacterium avium subsp. paratuberculosis
ccgugaucgccaccaccagcgg

SEQ ID NO: 2825253 - RNA, 16 nt, Mycobacterium avium subsp. paratuberculosis
ccgugaucgccacggc

SEQ ID NO: 2825254 - RNA, 18 nt, Mycobacterium avium subsp. paratuberculosis
ccgugaucgccacggcgg

SEQ ID NO: 2825255 - RNA, 11 nt, Mycobacterium avium subsp. paratuberculosis
ccgugaucggc

SEQ ID NO: 2825256 - RNA, 16 nt, Mycobacterium avium subsp. paratuberculosis
ccgugaucggccagcc

SEQ ID NO: 2825257 - RNA, 14 nt, Mycobacterium avium subsp. paratuberculosis
ccgugaugccgggc

SEQ ID NO: 2825258 - RNA, 15 nt, Mycobacterium avium subsp. paratuberculosis
ccgugaugccgggca

SEQ ID NO: 2825259 - RNA, 21 nt, Mycobacterium avium subsp. paratuberculosis
ccgugaugcgcaagcaccggc

SEQ ID NO: 2825260 - RNA, 17 nt, Mycobacterium avium subsp. paratuberculosis
ccgugaugggccgucag

SEQ ID NO: 2825261 - RNA, 16 nt, Mycobacterium avium subsp. paratuberculosis
ccgugcaccgucgccg

SEQ ID NO: 2825262 - RNA, 16 nt, Mycobacterium avium subsp. paratuberculosis
ccgugcacgaacaggg

SEQ ID NO: 2825263 - RNA, 14 nt, Mycobacterium avium subsp. paratuberculosis
ccgugcacgccguc

SEQ ID NO: 2825264 - RNA, 16 nt, Mycobacterium avium subsp. paratuberculosis
ccgugcagcaccucga

SEQ ID NO: 2825265 - RNA, 18 nt, Mycobacterium avium subsp. paratuberculosis
ccgugcagcacgccgcgg

SEQ ID NO: 2825266 - RNA, 14 nt, Mycobacterium avium subsp. paratuberculosis
ccgugcagccgggc

SEQ ID NO: 2825267 - RNA, 18 nt, Mycobacterium avium subsp. paratuberculosis
ccgugcagggggcgcagc

SEQ ID NO: 2825268 - RNA, 20 nt, Mycobacterium avium subsp. paratuberculosis
ccgugcagggggcgcagccg

SEQ ID NO: 2825269 - RNA, 16 nt, Mycobacterium avium subsp. paratuberculosis
ccgugcaucgggcgcu

SEQ ID NO: 2825270 - RNA, 22 nt, Mycobacterium avium subsp. paratuberculosis
ccgugcauguagguggcgacca

SEQ ID NO: 2825271 - RNA, 15 nt, Mycobacterium avium subsp. paratuberculosis
ccgugccacggccgc

SEQ ID NO: 2825272 - RNA, 12 nt, Mycobacterium avium subsp. paratuberculosis
ccgugccagccg

SEQ ID NO: 2825273 - RNA, 20 nt, Mycobacterium avium subsp. paratuberculosis
ccgugccagccggccgcuga

SEQ ID NO: 2825274 - RNA, 14 nt, Mycobacterium avium subsp. paratuberculosis
ccgugcccaccagc

SEQ ID NO: 2825275 - RNA, 16 nt, Mycobacterium avium subsp. paratuberculosis
ccgugcccaccagccg

SEQ ID NO: 2825276 - RNA, 22 nt, Mycobacterium avium subsp. paratuberculosis
ccgugcccaccagccggccggc

SEQ ID NO: 2825277 - RNA, 12 nt, Mycobacterium avium subsp. paratuberculosis
ccgugcccgagg

SEQ ID NO: 2825278 - RNA, 14 nt, Mycobacterium avium subsp. paratuberculosis
ccgugcccgcggga

SEQ ID NO: 2825279 - RNA, 19 nt, Mycobacterium avium subsp. paratuberculosis
ccgugcccgcgggacacgg

SEQ ID NO: 2825280 - RNA, 20 nt, Mycobacterium avium subsp. paratuberculosis
ccguggucaacggcaccgac

SEQ ID NO: 2825281 - RNA, 14 nt, Mycobacterium avium subsp. paratuberculosis
ccgugguccagccg

SEQ ID NO: 2825282 - RNA, 19 nt, Mycobacterium avium subsp. paratuberculosis
ccgugguccagccggucgc

SEQ ID NO: 2825283 - RNA, 15 nt, Mycobacterium avium subsp. paratuberculosis
ccguggucgaugaac

SEQ ID NO: 2825284 - RNA, 14 nt, Mycobacterium avium subsp. paratuberculosis
ccguggucggcagc

SEQ ID NO: 2825285 - RNA, 22 nt, Mycobacterium avium subsp. paratuberculosis
ccguggucggcagcaccggcag

SEQ ID NO: 2825286 - RNA, 15 nt, Mycobacterium avium subsp. paratuberculosis
ccguggucggcgaac

SEQ ID NO: 2825287 - RNA, 21 nt, Mycobacterium avium subsp. paratuberculosis
ccguggucggcgaacgcccgg

SEQ ID NO: 2825288 - RNA, 15 nt, Mycobacterium avium subsp. paratuberculosis
ccguggucggcgaug

SEQ ID NO: 2825289 - RNA, 13 nt, Mycobacterium avium subsp. paratuberculosis
ccguggugacccg

SEQ ID NO: 2825290 - RNA, 18 nt, Mycobacterium avium subsp. paratuberculosis
ccguggugacccggaccg

SEQ ID NO: 2825291 - RNA, 16 nt, Mycobacterium avium subsp. paratuberculosis
ccguggugaucgccgc

SEQ ID NO: 2825292 - RNA, 17 nt, Mycobacterium avium subsp. paratuberculosis
ccguggugaucgccgcg

SEQ ID NO: 2825293 - RNA, 18 nt, Mycobacterium avium subsp. paratuberculosis
ccguggugaucgccgcgg

SEQ ID NO: 2825294 - RNA, 17 nt, Mycobacterium avium subsp. paratuberculosis
ccgugguggcggcgaau

SEQ ID NO: 2825295 - RNA, 14 nt, Mycobacterium avium subsp. paratuberculosis
ccguggugggcgaa

SEQ ID NO: 2825296 - RNA, 15 nt, Mycobacterium avium subsp. paratuberculosis
ccguggugugcccgc

SEQ ID NO: 2825297 - RNA, 13 nt, Mycobacterium avium subsp. paratuberculosis
ccgugguuggcga

SEQ ID NO: 2825298 - RNA, 15 nt, Mycobacterium avium subsp. paratuberculosis
ccguguagccgaccg

SEQ ID NO: 2825299 - RNA, 17 nt, Mycobacterium avium subsp. paratuberculosis
ccguguagccgaccgac

SEQ ID NO: 2825300 - RNA, 15 nt, Mycobacterium avium subsp. paratuberculosis
ccguguaggccgcgc

SEQ ID NO: 2825301 - RNA, 16 nt, Mycobacterium avium subsp. paratuberculosis
ccguguaggccgcgcu

SEQ ID NO: 2825302 - RNA, 17 nt, Mycobacterium avium subsp. paratuberculosis
ccgugucccggauggag

SEQ ID NO: 2825303 - RNA, 18 nt, Mycobacterium avium subsp. paratuberculosis
ccgugucgcccguggccc

SEQ ID NO: 2825304 - RNA, 15 nt, Mycobacterium avium subsp. paratuberculosis
ccgugucgcggccuc

SEQ ID NO: 2825305 - RNA, 23 nt, Mycobacterium avium subsp. paratuberculosis
ccgugucgcggccuccgagcggc

SEQ ID NO: 2825306 - RNA, 13 nt, Mycobacterium avium subsp. paratuberculosis
ccgugucggcggg

SEQ ID NO: 2825307 - RNA, 17 nt, Mycobacterium avium subsp. paratuberculosis
ccgugucggcgggcggg

SEQ ID NO: 2825308 - RNA, 16 nt, Mycobacterium avium subsp. paratuberculosis
ccgugucgucgcugac

SEQ ID NO: 2825309 - RNA, 15 nt, Mycobacterium avium subsp. paratuberculosis
ccguguucaccagcg

SEQ ID NO: 2825310 - RNA, 21 nt, Mycobacterium avium subsp. paratuberculosis
ccguguucaccagcggggugu

SEQ ID NO: 2825311 - RNA, 14 nt, Mycobacterium avium subsp. paratuberculosis
ccguguuccaggua

SEQ ID NO: 2825312 - RNA, 18 nt, Mycobacterium avium subsp. paratuberculosis
ccguguugacguaacacc

SEQ ID NO: 2825313 - RNA, 20 nt, Mycobacterium avium subsp. paratuberculosis
ccguguugaucucgucgaug

SEQ ID NO: 2825314 - RNA, 21 nt, Mycobacterium avium subsp. paratuberculosis
ccguucaccucuucgggcagc

SEQ ID NO: 2825315 - RNA, 16 nt, Mycobacterium avium subsp. paratuberculosis
ccguucagcgcggcca

SEQ ID NO: 2825316 - RNA, 21 nt, Mycobacterium avium subsp. paratuberculosis
ccguucaggucgaucagcggu

SEQ ID NO: 2825317 - RNA, 16 nt, Mycobacterium avium subsp. paratuberculosis
ccguuccagccggccc

SEQ ID NO: 2825318 - RNA, 17 nt, Mycobacterium avium subsp. paratuberculosis
ccguuccagccggcccg

SEQ ID NO: 2825319 - RNA, 20 nt, Mycobacterium avium subsp. paratuberculosis
ccguuccagccggcccgcau

SEQ ID NO: 2825320 - RNA, 17 nt, Mycobacterium avium subsp. paratuberculosis
ccguuccaucgggccca

SEQ ID NO: 2825321 - RNA, 14 nt, Mycobacterium avium subsp. paratuberculosis
ccguucccaccggc

SEQ ID NO: 2825322 - RNA, 14 nt, Mycobacterium avium subsp. paratuberculosis
ccguuccccggccg

SEQ ID NO: 2825323 - RNA, 21 nt, Mycobacterium avium subsp. paratuberculosis
ccguuccgaugaagaacaccc

SEQ ID NO: 2825324 - RNA, 14 nt, Mycobacterium avium subsp. paratuberculosis
ccguuccucgacgu

SEQ ID NO: 2825325 - RNA, 16 nt, Mycobacterium avium subsp. paratuberculosis
ccguucgagcgccgga

SEQ ID NO: 2825326 - RNA, 18 nt, Mycobacterium avium subsp. paratuberculosis
ccguucgagcgccggacg

SEQ ID NO: 2825327 - RNA, 18 nt, Mycobacterium avium subsp. paratuberculosis
ccguucgaugaugggcga

SEQ ID NO: 2825328 - RNA, 15 nt, Mycobacterium avium subsp. paratuberculosis
ccguucgccgacagc

SEQ ID NO: 2825329 - RNA, 15 nt, Mycobacterium avium subsp. paratuberculosis
ccguucgccggccag

SEQ ID NO: 2825330 - RNA, 15 nt, Mycobacterium avium subsp. paratuberculosis
ccguucgccggcgac

SEQ ID NO: 2825331 - RNA, 16 nt, Mycobacterium avium subsp. paratuberculosis
ccguucgccggcgacg

SEQ ID NO: 2825332 - RNA, 15 nt, Mycobacterium avium subsp. paratuberculosis
ccguucgcugcccuc

SEQ ID NO: 2825333 - RNA, 20 nt, Mycobacterium avium subsp. paratuberculosis
ccguucggccagcgccgcca

SEQ ID NO: 2825334 - RNA, 22 nt, Mycobacterium avium subsp. paratuberculosis
ccguucggccagcgccgccagc

SEQ ID NO: 2825335 - RNA, 19 nt, Mycobacterium avium subsp. paratuberculosis
ccguucgguggccaccgcg

SEQ ID NO: 2825336 - RNA, 22 nt, Mycobacterium avium subsp. paratuberculosis
ccguucgguggccaccgcgacg

SEQ ID NO: 2825337 - RNA, 22 nt, Mycobacterium avium subsp. paratuberculosis
ccguucguagggacugcgccgg

SEQ ID NO: 2825338 - RNA, 14 nt, Mycobacterium avium subsp. paratuberculosis
ccguucuccgaggc

SEQ ID NO: 2825339 - RNA, 15 nt, Mycobacterium avium subsp. paratuberculosis
ccguucucgcgcagg

SEQ ID NO: 2825340 - RNA, 18 nt, Mycobacterium avium subsp. paratuberculosis
ccguucucgcgcagguca

SEQ ID NO: 2825341 - RNA, 13 nt, Mycobacterium avium subsp. paratuberculosis
ccguucucgggaa

SEQ ID NO: 2825342 - RNA, 22 nt, Mycobacterium avium subsp. paratuberculosis
ccguucucgggaaaugcgucgc

SEQ ID NO: 2825343 - RNA, 21 nt, Mycobacterium avium subsp. paratuberculosis
ccguucuugcgggugauccag

SEQ ID NO: 2825344 - RNA, 13 nt, Mycobacterium avium subsp. paratuberculosis
ccguucuugucga

SEQ ID NO: 2825345 - RNA, 15 nt, Mycobacterium avium subsp. paratuberculosis
ccguugaccccgacg

SEQ ID NO: 2825346 - RNA, 15 nt, Mycobacterium avium subsp. paratuberculosis
ccguugaccgacgcc

SEQ ID NO: 2825347 - RNA, 18 nt, Mycobacterium avium subsp. paratuberculosis
ccguugaccgacgccucc

SEQ ID NO: 2825348 - RNA, 17 nt, Mycobacterium avium subsp. paratuberculosis
ccguugaccggccgguc

SEQ ID NO: 2825349 - RNA, 13 nt, Mycobacterium avium subsp. paratuberculosis
ccguugacggugu

SEQ ID NO: 2825350 - RNA, 15 nt, Mycobacterium avium subsp. paratuberculosis
ccguugagcaccgcg

SEQ ID NO: 2825351 - RNA, 21 nt, Mycobacterium avium subsp. paratuberculosis
ccguugagcguggacaccgca

SEQ ID NO: 2825352 - RNA, 19 nt, Mycobacterium avium subsp. paratuberculosis
ccguugaucagggcggcgc

SEQ ID NO: 2825353 - RNA, 14 nt, Mycobacterium avium subsp. paratuberculosis
ccguugaucgagca

SEQ ID NO: 2825354 - RNA, 19 nt, Mycobacterium avium subsp. paratuberculosis
ccguugaucuugaccgucg

SEQ ID NO: 2825355 - RNA, 17 nt, Mycobacterium avium subsp. paratuberculosis
ccguugaugaagaccug

SEQ ID NO: 2825356 - RNA, 16 nt, Mycobacterium avium subsp. paratuberculosis
ccguugaugcgcaccg

SEQ ID NO: 2825357 - RNA, 17 nt, Mycobacterium avium subsp. paratuberculosis
ccguugaugcgcaccgc

SEQ ID NO: 2825358 - RNA, 20 nt, Mycobacterium avium subsp. paratuberculosis
ccguugaugcgcaccgcggc

SEQ ID NO: 2825359 - RNA, 15 nt, Mycobacterium avium subsp. paratuberculosis
ccguugauggaagcg

SEQ ID NO: 2825360 - RNA, 13 nt, Mycobacterium avium subsp. paratuberculosis
ccguugcagcaca

SEQ ID NO: 2825361 - RNA, 14 nt, Mycobacterium avium subsp. paratuberculosis
ccguugcagcacag

SEQ ID NO: 2825362 - RNA, 17 nt, Mycobacterium avium subsp. paratuberculosis
ccguugccaggccgcga

SEQ ID NO: 2825363 - RNA, 20 nt, Mycobacterium avium subsp. paratuberculosis
ccguugccaggccgcgagca

SEQ ID NO: 2825364 - RNA, 19 nt, Mycobacterium avium subsp. paratuberculosis
ccguugcccgaucagccgg

SEQ ID NO: 2825365 - RNA, 21 nt, Mycobacterium avium subsp. paratuberculosis
ccuccucuucgcugccgccgc

SEQ ID NO: 2825366 - RNA, 20 nt, Mycobacterium avium subsp. paratuberculosis
ccuccugcuggcgcugccag

SEQ ID NO: 2825367 - RNA, 23 nt, Mycobacterium avium subsp. paratuberculosis
ccuccugcuggcguucgccgagg

SEQ ID NO: 2825368 - RNA, 21 nt, Mycobacterium avium subsp. paratuberculosis
ccuccuggcggguggcgauga

SEQ ID NO: 2825369 - RNA, 15 nt, Mycobacterium avium subsp. paratuberculosis
ccuccuuggccaggc

SEQ ID NO: 2825370 - RNA, 16 nt, Mycobacterium avium subsp. paratuberculosis
ccuccuuggccaggcg

SEQ ID NO: 2825371 - RNA, 15 nt, Mycobacterium avium subsp. paratuberculosis
ccucgaaagccgcug

SEQ ID NO: 2825372 - RNA, 20 nt, Mycobacterium avium subsp. paratuberculosis
ccucgaacacaucguggcgc

SEQ ID NO: 2825373 - RNA, 20 nt, Mycobacterium avium subsp. paratuberculosis
ccucgaacaccgcaccgguc

SEQ ID NO: 2825374 - RNA, 17 nt, Mycobacterium avium subsp. paratuberculosis
ccucgaacaggcuggcc

SEQ ID NO: 2825375 - RNA, 17 nt, Mycobacterium avium subsp. paratuberculosis
ccucgaaccucgcggcg

SEQ ID NO: 2825376 - RNA, 18 nt, Mycobacterium avium subsp. paratuberculosis
ccucgaaccucgcggcgg

SEQ ID NO: 2825377 - RNA, 19 nt, Mycobacterium avium subsp. paratuberculosis
ccucgaaccucgcggcggc

SEQ ID NO: 2825378 - RNA, 18 nt, Mycobacterium avium subsp. paratuberculosis
ccucgaagaagagggcgu

SEQ ID NO: 2825379 - RNA, 21 nt, Mycobacterium avium subsp. paratuberculosis
ccucgaagaguugggucgcgu

SEQ ID NO: 2825380 - RNA, 14 nt, Mycobacterium avium subsp. paratuberculosis
ccucgaagaucucc

SEQ ID NO: 2825381 - RNA, 22 nt, Mycobacterium avium subsp. paratuberculosis
ccucgaagauggucgcgccgcg

SEQ ID NO: 2825382 - RNA, 16 nt, Mycobacterium avium subsp. paratuberculosis
ccucgaagccgaucgc

SEQ ID NO: 2825383 - RNA, 16 nt, Mycobacterium avium subsp. paratuberculosis
ccucgaagggcgccag

SEQ ID NO: 2825384 - RNA, 20 nt, Mycobacterium avium subsp. paratuberculosis
ccucgaagggcgccagccgu

SEQ ID NO: 2825385 - RNA, 18 nt, Mycobacterium avium subsp. paratuberculosis
ccucgaaguagagccgcu

SEQ ID NO: 2825386 - RNA, 21 nt, Mycobacterium avium subsp. paratuberculosis
ccucgaaguagagccgcugca

SEQ ID NO: 2825387 - RNA, 16 nt, Mycobacterium avium subsp. paratuberculosis
ccucgaagucgccggc

SEQ ID NO: 2825388 - RNA, 20 nt, Mycobacterium avium subsp. paratuberculosis
ccucgaagucgccggccucc

SEQ ID NO: 2825389 - RNA, 18 nt, Mycobacterium avium subsp. paratuberculosis
ccucgaaguucuccucgc

SEQ ID NO: 2825390 - RNA, 17 nt, Mycobacterium avium subsp. paratuberculosis
ccucgaauccgcgggcg

SEQ ID NO: 2825391 - RNA, 13 nt, Mycobacterium avium subsp. paratuberculosis
ccucgacaccggu

SEQ ID NO: 2825392 - RNA, 16 nt, Mycobacterium avium subsp. paratuberculosis
ccucgacacgggccgc

SEQ ID NO: 2825393 - RNA, 19 nt, Mycobacterium avium subsp. paratuberculosis
ccucgacacgggccgcgcc

SEQ ID NO: 2825394 - RNA, 21 nt, Mycobacterium avium subsp. paratuberculosis
ccucgacacgggccgcgccga

SEQ ID NO: 2825395 - RNA, 22 nt, Mycobacterium avium subsp. paratuberculosis
ccucgacacgggccgcgccgag

SEQ ID NO: 2825396 - RNA, 12 nt, Mycobacterium avium subsp. paratuberculosis
ccucgaccaccu

SEQ ID NO: 2825397 - RNA, 21 nt, Mycobacterium avium subsp. paratuberculosis
ccucgaccaccucuucgcggu

SEQ ID NO: 2825398 - RNA, 17 nt, Mycobacterium avium subsp. paratuberculosis
ccucgaccacgcacacc

SEQ ID NO: 2825399 - RNA, 20 nt, Mycobacterium avium subsp. paratuberculosis
ccucgaccacgcacaccacc

SEQ ID NO: 2825400 - RNA, 21 nt, Mycobacterium avium subsp. paratuberculosis
ccucgaccacgcacaccaccg

SEQ ID NO: 2825401 - RNA, 17 nt, Mycobacterium avium subsp. paratuberculosis
ccucgaccagcaccgca

SEQ ID NO: 2825402 - RNA, 13 nt, Mycobacterium avium subsp. paratuberculosis
ccucgaccagccg

SEQ ID NO: 2825403 - RNA, 13 nt, Mycobacterium avium subsp. paratuberculosis
ccucgaccagcgc

SEQ ID NO: 2825404 - RNA, 19 nt, Mycobacterium avium subsp. paratuberculosis
ccucgaccagcgcgccgcc

SEQ ID NO: 2825405 - RNA, 22 nt, Mycobacterium avium subsp. paratuberculosis
ccucgaccagcgcgccgcccag

SEQ ID NO: 2825406 - RNA, 13 nt, Mycobacterium avium subsp. paratuberculosis
ccucgaccaggcu

SEQ ID NO: 2825407 - RNA, 22 nt, Mycobacterium avium subsp. paratuberculosis
ccucgaccaggcuuggcccgcc

SEQ ID NO: 2825408 - RNA, 16 nt, Mycobacterium avium subsp. paratuberculosis
ccucgacccgaagcca

SEQ ID NO: 2825409 - RNA, 19 nt, Mycobacterium avium subsp. paratuberculosis
ccucgacccguuccggcga

SEQ ID NO: 2825410 - RNA, 16 nt, Mycobacterium avium subsp. paratuberculosis
ccucgaccucuucggc

SEQ ID NO: 2825411 - RNA, 20 nt, Mycobacterium avium subsp. paratuberculosis
ccucgaccucuucggcgccg

SEQ ID NO: 2825412 - RNA, 18 nt, Mycobacterium avium subsp. paratuberculosis
ccucgacgaacgcggcgg

SEQ ID NO: 2825413 - RNA, 19 nt, Mycobacterium avium subsp. paratuberculosis
ccucgacgaacgcggcgga

SEQ ID NO: 2825414 - RNA, 16 nt, Mycobacterium avium subsp. paratuberculosis
ccucgacgaucagcac

SEQ ID NO: 2825415 - RNA, 17 nt, Mycobacterium avium subsp. paratuberculosis
ccucgacgaucagcacg

SEQ ID NO: 2825416 - RNA, 22 nt, Mycobacterium avium subsp. paratuberculosis
ccucgacgauugucggggccgc

SEQ ID NO: 2825417 - RNA, 20 nt, Mycobacterium avium subsp. paratuberculosis
ccucgacgccgggcagcgcg

SEQ ID NO: 2825418 - RNA, 12 nt, Mycobacterium avium subsp. paratuberculosis
ccucgacggcga

SEQ ID NO: 2825419 - RNA, 15 nt, Mycobacterium avium subsp. paratuberculosis
ccucgacggcgaagc

SEQ ID NO: 2825420 - RNA, 10 nt, Mycobacterium avium subsp. paratuberculosis
ccucgacggu

SEQ ID NO: 2825421 - RNA, 14 nt, Mycobacterium avium subsp. paratuberculosis
ccucgacggugacc

SEQ ID NO: 2825422 - RNA, 18 nt, Mycobacterium avium subsp. paratuberculosis
ccucgacggugaccucgu

SEQ ID NO: 2825423 - RNA, 17 nt, Mycobacterium avium subsp. paratuberculosis
ccucgacggugcugccg

SEQ ID NO: 2825424 - RNA, 18 nt, Mycobacterium avium subsp. paratuberculosis
ccucgacguccaggccgg

SEQ ID NO: 2825425 - RNA, 23 nt, Mycobacterium avium subsp. paratuberculosis
ccucgacguccaggccggcgccg

SEQ ID NO: 2825426 - RNA, 24 nt, Mycobacterium avium subsp. paratuberculosis
ccucgacguccaggccggcgccgc

SEQ ID NO: 2825427 - RNA, 20 nt, Mycobacterium avium subsp. paratuberculosis
ccucgagagucgcuggcgcg

SEQ ID NO: 2825428 - RNA, 21 nt, Mycobacterium avium subsp. paratuberculosis
ccucgagagucgcuggcgcgc

SEQ ID NO: 2825429 - RNA, 18 nt, Mycobacterium avium subsp. paratuberculosis
ccucgagauucugcagcc

SEQ ID NO: 2825430 - RNA, 17 nt, Mycobacterium avium subsp. paratuberculosis
ccucgagcaacggccgc

SEQ ID NO: 2825431 - RNA, 19 nt, Mycobacterium avium subsp. paratuberculosis
ccucgagcaacggccgcag

SEQ ID NO: 2825432 - RNA, 13 nt, Mycobacterium avium subsp. paratuberculosis
ccucgagcaccac

SEQ ID NO: 2825433 - RNA, 16 nt, Mycobacterium avium subsp. paratuberculosis
ccucgagcaccacggc

SEQ ID NO: 2825434 - RNA, 20 nt, Mycobacterium avium subsp. paratuberculosis
ccucgagcaccacggcccgc

SEQ ID NO: 2825435 - RNA, 19 nt, Mycobacterium avium subsp. paratuberculosis
ccucgagcaccggcggcag

SEQ ID NO: 2825436 - RNA, 22 nt, Mycobacterium avium subsp. paratuberculosis
ccucgagcaccggcggcagcga

SEQ ID NO: 2825437 - RNA, 18 nt, Mycobacterium avium subsp. paratuberculosis
ccucgagcacucgcggga

SEQ ID NO: 2825438 - RNA, 12 nt, Mycobacterium avium subsp. paratuberculosis
ccucgagcagcg

SEQ ID NO: 2825439 - RNA, 14 nt, Mycobacterium avium subsp. paratuberculosis
ccucgagcagcgcg

SEQ ID NO: 2825440 - RNA, 18 nt, Mycobacterium avium subsp. paratuberculosis
ccucgagcagcgcgcgcu

SEQ ID NO: 2825441 - RNA, 23 nt, Mycobacterium avium subsp. paratuberculosis
ccucgagccauaaaccggccggc

SEQ ID NO: 2825442 - RNA, 15 nt, Mycobacterium avium subsp. paratuberculosis
ccucgagcgcgucga

SEQ ID NO: 2825443 - RNA, 13 nt, Mycobacterium avium subsp. paratuberculosis
ccucgagcgucac

SEQ ID NO: 2825444 - RNA, 14 nt, Mycobacterium avium subsp. paratuberculosis
ccucgagcgucacg

SEQ ID NO: 2825445 - RNA, 17 nt, Mycobacterium avium subsp. paratuberculosis
ccucgagcuugccgucg

SEQ ID NO: 2825446 - RNA, 22 nt, Mycobacterium avium subsp. paratuberculosis
ccucgaggaucgcggccacgcc

SEQ ID NO: 2825447 - RNA, 16 nt, Mycobacterium avium subsp. paratuberculosis
ccucgaggccgacgug

SEQ ID NO: 2825448 - RNA, 15 nt, Mycobacterium avium subsp. paratuberculosis
ccucgaggccgaggu

SEQ ID NO: 2825449 - RNA, 14 nt, Mycobacterium avium subsp. paratuberculosis
ccucgcgccgcgau

SEQ ID NO: 2825450 - RNA, 23 nt, Mycobacterium avium subsp. paratuberculosis
ccucgcgccgcgaucucggcgga

SEQ ID NO: 2825451 - RNA, 16 nt, Mycobacterium avium subsp. paratuberculosis
ccucgcgccguggccc

SEQ ID NO: 2825452 - RNA, 15 nt, Mycobacterium avium subsp. paratuberculosis
ccucgcgcggcacca

SEQ ID NO: 2825453 - RNA, 19 nt, Mycobacterium avium subsp. paratuberculosis
ccucgcgcggggcggccgc

SEQ ID NO: 2825454 - RNA, 20 nt, Mycobacterium avium subsp. paratuberculosis
ccucgcgcggggcggccgcc

SEQ ID NO: 2825455 - RNA, 22 nt, Mycobacterium avium subsp. paratuberculosis
ccucgcgcggggcggccgccgg

SEQ ID NO: 2825456 - RNA, 14 nt, Mycobacterium avium subsp. paratuberculosis
ccucgcgcgucacg

SEQ ID NO: 2825457 - RNA, 20 nt, Mycobacterium avium subsp. paratuberculosis
ccucgcgcucuugggcggcc

SEQ ID NO: 2825458 - RNA, 23 nt, Mycobacterium avium subsp. paratuberculosis
ccucgcgcucuugggcggccggc

SEQ ID NO: 2825459 - RNA, 13 nt, Mycobacterium avium subsp. paratuberculosis
ccucgcggaaccg

SEQ ID NO: 2825460 - RNA, 16 nt, Mycobacterium avium subsp. paratuberculosis
ccucgcggaacugcuc

SEQ ID NO: 2825461 - RNA, 20 nt, Mycobacterium avium subsp. paratuberculosis
ccucgcggaacugcucccag

SEQ ID NO: 2825462 - RNA, 21 nt, Mycobacterium avium subsp. paratuberculosis
ccucgcggaacugcucccagg

SEQ ID NO: 2825463 - RNA, 15 nt, Mycobacterium avium subsp. paratuberculosis
ccucgcggcggcguc

SEQ ID NO: 2825464 - RNA, 17 nt, Mycobacterium avium subsp. paratuberculosis
ccucgcggcggcgucgg

SEQ ID NO: 2825465 - RNA, 17 nt, Mycobacterium avium subsp. paratuberculosis
ccucgcgggcgaccugg

SEQ ID NO: 2825466 - RNA, 22 nt, Mycobacterium avium subsp. paratuberculosis
ccucgcgggcgaucuccagcgg

SEQ ID NO: 2825467 - RNA, 23 nt, Mycobacterium avium subsp. paratuberculosis
ccucgcgggcgaucuccagcggc

SEQ ID NO: 2825468 - RNA, 14 nt, Mycobacterium avium subsp. paratuberculosis
ccucgcggucgacg

SEQ ID NO: 2825469 - RNA, 20 nt, Mycobacterium avium subsp. paratuberculosis
ccucgcggucuucgaacauc

SEQ ID NO: 2825470 - RNA, 19 nt, Mycobacterium avium subsp. paratuberculosis
ccucgcgguugcggguggc

SEQ ID NO: 2825471 - RNA, 14 nt, Mycobacterium avium subsp. paratuberculosis
ccucgcguacccgg

SEQ ID NO: 2825472 - RNA, 17 nt, Mycobacterium avium subsp. paratuberculosis
ccucgcuaaucgccgcg

SEQ ID NO: 2825473 - RNA, 19 nt, Mycobacterium avium subsp. paratuberculosis
ccucgcuaaucgccgcgcg

SEQ ID NO: 2825474 - RNA, 13 nt, Mycobacterium avium subsp. paratuberculosis
ccucgcuacgcga

SEQ ID NO: 2825475 - RNA, 15 nt, Mycobacterium avium subsp. paratuberculosis
ccucgcuacgcgagc

SEQ ID NO: 2825476 - RNA, 18 nt, Mycobacterium avium subsp. paratuberculosis
ccucgcuacgcgagcugc

SEQ ID NO: 2825477 - RNA, 20 nt, Mycobacterium avium subsp. paratuberculosis
ccucgcuacgcgagcugcuu

SEQ ID NO: 2825478 - RNA, 19 nt, Mycobacterium avium subsp. paratuberculosis
ccucgcucaacccgucgcg

SEQ ID NO: 2825479 - RNA, 14 nt, Mycobacterium avium subsp. paratuberculosis
ccucgcucagcccg

SEQ ID NO: 2825480 - RNA, 14 nt, Mycobacterium avium subsp. paratuberculosis
ccucgcugaccucg

SEQ ID NO: 2825481 - RNA, 19 nt, Mycobacterium avium subsp. paratuberculosis
ccucgcugaccucgacacg

SEQ ID NO: 2825482 - RNA, 13 nt, Mycobacterium avium subsp. paratuberculosis
ccucgcugacguc

SEQ ID NO: 2825483 - RNA, 14 nt, Mycobacterium avium subsp. paratuberculosis
ccucgcugacgucg

SEQ ID NO: 2825484 - RNA, 17 nt, Mycobacterium avium subsp. paratuberculosis
ccucgcugccggccggg

SEQ ID NO: 2825485 - RNA, 17 nt, Mycobacterium avium subsp. paratuberculosis
ccucgcuggaaaccucu

SEQ ID NO: 2825486 - RNA, 17 nt, Mycobacterium avium subsp. paratuberculosis
ccucgcuggcgaucacc

SEQ ID NO: 2825487 - RNA, 18 nt, Mycobacterium avium subsp. paratuberculosis
ccucgcuggcgaucaccu

SEQ ID NO: 2825488 - RNA, 19 nt, Mycobacterium avium subsp. paratuberculosis
ccucgcuggcgaucaccuu

SEQ ID NO: 2825489 - RNA, 14 nt, Mycobacterium avium subsp. paratuberculosis
ccucggaagggcuu

SEQ ID NO: 2825490 - RNA, 12 nt, Mycobacterium avium subsp. paratuberculosis
ccucggaccggu

SEQ ID NO: 2825491 - RNA, 22 nt, Mycobacterium avium subsp. paratuberculosis
ccucggaggugccgcgcggcag

SEQ ID NO: 2825492 - RNA, 16 nt, Mycobacterium avium subsp. paratuberculosis
ccucggauuccgcgga

SEQ ID NO: 2825493 - RNA, 22 nt, Mycobacterium avium subsp. paratuberculosis
ccucggcauaacgcaaccgguc

SEQ ID NO: 2825494 - RNA, 22 nt, Mycobacterium avium subsp. paratuberculosis
ccucggccaccaccucgcgggc

SEQ ID NO: 2825495 - RNA, 13 nt, Mycobacterium avium subsp. paratuberculosis
ccucggccaccag

SEQ ID NO: 2825496 - RNA, 17 nt, Mycobacterium avium subsp. paratuberculosis
ccucggccaccagaugc

SEQ ID NO: 2825497 - RNA, 23 nt, Mycobacterium avium subsp. paratuberculosis
ccucggccaccagaugccgggcu

SEQ ID NO: 2825498 - RNA, 14 nt, Mycobacterium avium subsp. paratuberculosis
ccucggccagcacc

SEQ ID NO: 2825499 - RNA, 17 nt, Mycobacterium avium subsp. paratuberculosis
ccucggccagcaccagc

SEQ ID NO: 2825500 - RNA, 20 nt, Mycobacterium avium subsp. paratuberculosis
ccucggccagcaccagcagc

SEQ ID NO: 2825501 - RNA, 23 nt, Mycobacterium avium subsp. paratuberculosis
ccucggccagcaccagcagccgg

SEQ ID NO: 2825502 - RNA, 14 nt, Mycobacterium avium subsp. paratuberculosis
ccucggccagcccc

SEQ ID NO: 2825503 - RNA, 16 nt, Mycobacterium avium subsp. paratuberculosis
ccucggccagccccac

SEQ ID NO: 2825504 - RNA, 15 nt, Mycobacterium avium subsp. paratuberculosis
ccucggccagcgccg

SEQ ID NO: 2825505 - RNA, 19 nt, Mycobacterium avium subsp. paratuberculosis
ccucggccagcgccgcgcg

SEQ ID NO: 2825506 - RNA, 17 nt, Mycobacterium avium subsp. paratuberculosis
ccucggccagcucaccg

SEQ ID NO: 2825507 - RNA, 18 nt, Mycobacterium avium subsp. paratuberculosis
ccucggccagcucaccgg

SEQ ID NO: 2825508 - RNA, 20 nt, Mycobacterium avium subsp. paratuberculosis
ccucggccagcucaccggcc

SEQ ID NO: 2825509 - RNA, 23 nt, Mycobacterium avium subsp. paratuberculosis
ccucggccagguacugaucaccg

SEQ ID NO: 2825510 - RNA, 13 nt, Mycobacterium avium subsp. paratuberculosis
ccucggccccaaa

SEQ ID NO: 2825511 - RNA, 15 nt, Mycobacterium avium subsp. paratuberculosis
ccucggccgccaccg

SEQ ID NO: 2825512 - RNA, 19 nt, Mycobacterium avium subsp. paratuberculosis
ccucggccgccaccgccau

SEQ ID NO: 2825513 - RNA, 21 nt, Mycobacterium avium subsp. paratuberculosis
ccucggccgccaccgccaucu

SEQ ID NO: 2825514 - RNA, 18 nt, Mycobacterium avium subsp. paratuberculosis
ccucggccgcggucucga

SEQ ID NO: 2825515 - RNA, 18 nt, Mycobacterium avium subsp. paratuberculosis
ccucggccggguccugga

SEQ ID NO: 2825516 - RNA, 15 nt, Mycobacterium avium subsp. paratuberculosis
ccucggccguaccgg

SEQ ID NO: 2825517 - RNA, 18 nt, Mycobacterium avium subsp. paratuberculosis
ccucggccguaccggcgu

SEQ ID NO: 2825518 - RNA, 18 nt, Mycobacterium avium subsp. paratuberculosis
ccucggccucgucgacgu

SEQ ID NO: 2825519 - RNA, 17 nt, Mycobacterium avium subsp. paratuberculosis
ccucggccugcgcccgg

SEQ ID NO: 2825520 - RNA, 22 nt, Mycobacterium avium subsp. paratuberculosis
ccucggccuugaccacggugcg

SEQ ID NO: 2825521 - RNA, 15 nt, Mycobacterium avium subsp. paratuberculosis
ccucggccuuggcca

SEQ ID NO: 2825522 - RNA, 22 nt, Mycobacterium avium subsp. paratuberculosis
ccucggccuuggccaccgccug

SEQ ID NO: 2825523 - RNA, 16 nt, Mycobacterium avium subsp. paratuberculosis
ccucggcgaccacguc

SEQ ID NO: 2825524 - RNA, 19 nt, Mycobacterium avium subsp. paratuberculosis
ccucggcgaccacguccaa

SEQ ID NO: 2825525 - RNA, 18 nt, Mycobacterium avium subsp. paratuberculosis
ccucggcgaccagcgacg

SEQ ID NO: 2825526 - RNA, 15 nt, Mycobacterium avium subsp. paratuberculosis
ccucggcgaccgccc

SEQ ID NO: 2825527 - RNA, 17 nt, Mycobacterium avium subsp. paratuberculosis
ccucggcgaccgcccgg

SEQ ID NO: 2825528 - RNA, 15 nt, Mycobacterium avium subsp. paratuberculosis
ccucggcgaccucgg

SEQ ID NO: 2825529 - RNA, 21 nt, Mycobacterium avium subsp. paratuberculosis
ccucggcgacgauggccaggc

SEQ ID NO: 2825530 - RNA, 14 nt, Mycobacterium avium subsp. paratuberculosis
ccucggcgacgucc

SEQ ID NO: 2825531 - RNA, 13 nt, Mycobacterium avium subsp. paratuberculosis
ccucggcgagccg

SEQ ID NO: 2825532 - RNA, 14 nt, Mycobacterium avium subsp. paratuberculosis
ccucggcgagccgc

SEQ ID NO: 2825533 - RNA, 15 nt, Mycobacterium avium subsp. paratuberculosis
ccucggcgagccgcu

SEQ ID NO: 2825534 - RNA, 14 nt, Mycobacterium avium subsp. paratuberculosis
ccucgucaccgugg

SEQ ID NO: 2825535 - RNA, 12 nt, Mycobacterium avium subsp. paratuberculosis
ccucgucccagc

SEQ ID NO: 2825536 - RNA, 15 nt, Mycobacterium avium subsp. paratuberculosis
ccucgucccagcgca

SEQ ID NO: 2825537 - RNA, 16 nt, Mycobacterium avium subsp. paratuberculosis
ccucguccgacagcgc

SEQ ID NO: 2825538 - RNA, 23 nt, Mycobacterium avium subsp. paratuberculosis
ccucgucgaagccgaucaccggc

SEQ ID NO: 2825539 - RNA, 14 nt, Mycobacterium avium subsp. paratuberculosis
ccucgucgaccagg

SEQ ID NO: 2825540 - RNA, 17 nt, Mycobacterium avium subsp. paratuberculosis
ccucgucgaccagggcg

SEQ ID NO: 2825541 - RNA, 23 nt, Mycobacterium avium subsp. paratuberculosis
ccucgucgaccagggcgaucacc

SEQ ID NO: 2825542 - RNA, 19 nt, Mycobacterium avium subsp. paratuberculosis
ccucgucgaccgcggccug

SEQ ID NO: 2825543 - RNA, 20 nt, Mycobacterium avium subsp. paratuberculosis
ccucgucgaccgcggccugg

SEQ ID NO: 2825544 - RNA, 20 nt, Mycobacterium avium subsp. paratuberculosis
ccucgucgagccgggcccgg

SEQ ID NO: 2825545 - RNA, 23 nt, Mycobacterium avium subsp. paratuberculosis
ccucgucgagccgggcccgggug

SEQ ID NO: 2825546 - RNA, 12 nt, Mycobacterium avium subsp. paratuberculosis
ccucgucgaucg

SEQ ID NO: 2825547 - RNA, 18 nt, Mycobacterium avium subsp. paratuberculosis
ccucgucgaucgcggcga

SEQ ID NO: 2825548 - RNA, 21 nt, Mycobacterium avium subsp. paratuberculosis
ccucgucgaucgcggcgaugg

SEQ ID NO: 2825549 - RNA, 14 nt, Mycobacterium avium subsp. paratuberculosis
ccucgucgaugacg

SEQ ID NO: 2825550 - RNA, 20 nt, Mycobacterium avium subsp. paratuberculosis
ccucgucgaugucggcggcc

SEQ ID NO: 2825551 - RNA, 15 nt, Mycobacterium avium subsp. paratuberculosis
ccucgucgccaucgu

SEQ ID NO: 2825552 - RNA, 14 nt, Mycobacterium avium subsp. paratuberculosis
ccucgucgcccggc

SEQ ID NO: 2825553 - RNA, 15 nt, Mycobacterium avium subsp. paratuberculosis
ccucgucgcccggcg

SEQ ID NO: 2825554 - RNA, 13 nt, Mycobacterium avium subsp. paratuberculosis
ccucgucgccguc

SEQ ID NO: 2825555 - RNA, 15 nt, Mycobacterium avium subsp. paratuberculosis
ccucgucggaggcgu

SEQ ID NO: 2825556 - RNA, 12 nt, Mycobacterium avium subsp. paratuberculosis
ccucgucggcga

SEQ ID NO: 2825557 - RNA, 13 nt, Mycobacterium avium subsp. paratuberculosis
ccucgucggcgag

SEQ ID NO: 2825558 - RNA, 17 nt, Mycobacterium avium subsp. paratuberculosis
ccucgucggcgagcagc

SEQ ID NO: 2825559 - RNA, 16 nt, Mycobacterium avium subsp. paratuberculosis
ccucgucggcgccguc

SEQ ID NO: 2825560 - RNA, 14 nt, Mycobacterium avium subsp. paratuberculosis
ccucgucggcgguc

SEQ ID NO: 2825561 - RNA, 17 nt, Mycobacterium avium subsp. paratuberculosis
ccucgucggcggugccg

SEQ ID NO: 2825562 - RNA, 13 nt, Mycobacterium avium subsp. paratuberculosis
ccucgucggcucc

SEQ ID NO: 2825563 - RNA, 12 nt, Mycobacterium avium subsp. paratuberculosis
ccucgucgggaa

SEQ ID NO: 2825564 - RNA, 19 nt, Mycobacterium avium subsp. paratuberculosis
ccucgucgggaacgcgaac

SEQ ID NO: 2825565 - RNA, 16 nt, Mycobacterium avium subsp. paratuberculosis
ccucgucgggcgccag

SEQ ID NO: 2825566 - RNA, 20 nt, Mycobacterium avium subsp. paratuberculosis
ccucgucgggcgccagcccg

SEQ ID NO: 2825567 - RNA, 23 nt, Mycobacterium avium subsp. paratuberculosis
ccucgucggggaacuccugcagg

SEQ ID NO: 2825568 - RNA, 14 nt, Mycobacterium avium subsp. paratuberculosis
ccucgucgguccag

SEQ ID NO: 2825569 - RNA, 17 nt, Mycobacterium avium subsp. paratuberculosis
ccucgucgucgaugaac

SEQ ID NO: 2825570 - RNA, 19 nt, Mycobacterium avium subsp. paratuberculosis
ccucgucuccggcggcagg

SEQ ID NO: 2825571 - RNA, 23 nt, Mycobacterium avium subsp. paratuberculosis
ccucgugcaugugcucggcgagg

SEQ ID NO: 2825572 - RNA, 19 nt, Mycobacterium avium subsp. paratuberculosis
ccucguggaaaucgagcgc

SEQ ID NO: 2825573 - RNA, 19 nt, Mycobacterium avium subsp. paratuberculosis
ccucguggucccaggacca

SEQ ID NO: 2825574 - RNA, 20 nt, Mycobacterium avium subsp. paratuberculosis
ccucguggucccaggaccac

SEQ ID NO: 2825575 - RNA, 20 nt, Mycobacterium avium subsp. paratuberculosis
ccucgugguggacggucagc

SEQ ID NO: 2825576 - RNA, 20 nt, Mycobacterium avium subsp. paratuberculosis
ccucguugaccgggucgccg

SEQ ID NO: 2825577 - RNA, 17 nt, Mycobacterium avium subsp. paratuberculosis
ccucguuggccagcucg

SEQ ID NO: 2825578 - RNA, 18 nt, Mycobacterium avium subsp. paratuberculosis
ccucguuggccagcucgg

SEQ ID NO: 2825579 - RNA, 13 nt, Mycobacterium avium subsp. paratuberculosis
ccucucacggcgg

SEQ ID NO: 2825580 - RNA, 17 nt, Mycobacterium avium subsp. paratuberculosis
ccucucggcgccgucca

SEQ ID NO: 2825581 - RNA, 18 nt, Mycobacterium avium subsp. paratuberculosis
ccucucggcgccguccag

SEQ ID NO: 2825582 - RNA, 14 nt, Mycobacterium avium subsp. paratuberculosis
ccucugcgaccacc

SEQ ID NO: 2825583 - RNA, 20 nt, Mycobacterium avium subsp. paratuberculosis
ccucuucgaaagccacccgc

SEQ ID NO: 2825584 - RNA, 22 nt, Mycobacterium avium subsp. paratuberculosis
ccucuucgaaagccacccgcgc

SEQ ID NO: 2825585 - RNA, 18 nt, Mycobacterium avium subsp. paratuberculosis
ccucuucgcugccgccgc

SEQ ID NO: 2825586 - RNA, 13 nt, Mycobacterium avium subsp. paratuberculosis
ccucuucgcugga

SEQ ID NO: 2825587 - RNA, 18 nt, Mycobacterium avium subsp. paratuberculosis
ccucuucggggguggcca

SEQ ID NO: 2825588 - RNA, 12 nt, Mycobacterium avium subsp. paratuberculosis
ccucuucgucgg

SEQ ID NO: 2825589 - RNA, 19 nt, Mycobacterium avium subsp. paratuberculosis
ccucuucgucggccggcag

SEQ ID NO: 2825590 - RNA, 24 nt, Mycobacterium avium subsp. paratuberculosis
ccucuugaacgcguacagcgcccg

SEQ ID NO: 2825591 - RNA, 13 nt, Mycobacterium avium subsp. paratuberculosis
ccucuugcggcgc

SEQ ID NO: 2825592 - RNA, 16 nt, Mycobacterium avium subsp. paratuberculosis
ccugaaccagcucgug

SEQ ID NO: 2825593 - RNA, 13 nt, Mycobacterium avium subsp. paratuberculosis
ccugaacggccgc

SEQ ID NO: 2825594 - RNA, 18 nt, Mycobacterium avium subsp. paratuberculosis
ccugaagaagcggccgua

SEQ ID NO: 2825595 - RNA, 15 nt, Mycobacterium avium subsp. paratuberculosis
ccugacacagcaccg

SEQ ID NO: 2825596 - RNA, 17 nt, Mycobacterium avium subsp. paratuberculosis
ccugacacagcaccggc

SEQ ID NO: 2825597 - RNA, 15 nt, Mycobacterium avium subsp. paratuberculosis
ccugacacgaccgcc

SEQ ID NO: 2825598 - RNA, 18 nt, Mycobacterium avium subsp. paratuberculosis
ccugacagacccgaucga

SEQ ID NO: 2825599 - RNA, 16 nt, Mycobacterium avium subsp. paratuberculosis
ccugacccggccgugc

SEQ ID NO: 2825600 - RNA, 18 nt, Mycobacterium avium subsp. paratuberculosis
ccugaccgcgggcccgcc

SEQ ID NO: 2825601 - RNA, 17 nt, Mycobacterium avium subsp. paratuberculosis
ccugaccgucggccaga

SEQ ID NO: 2825602 - RNA, 17 nt, Mycobacterium avium subsp. paratuberculosis
ccugaccgugcuuggcg

SEQ ID NO: 2825603 - RNA, 18 nt, Mycobacterium avium subsp. paratuberculosis
ccugacgcaucaccacgc

SEQ ID NO: 2825604 - RNA, 15 nt, Mycobacterium avium subsp. paratuberculosis
ccugacgcucggucg

SEQ ID NO: 2825605 - RNA, 23 nt, Mycobacterium avium subsp. paratuberculosis
ccugacgcucggucgccacggcc

SEQ ID NO: 2825606 - RNA, 17 nt, Mycobacterium avium subsp. paratuberculosis
ccugacgggagucgggc

SEQ ID NO: 2825607 - RNA, 22 nt, Mycobacterium avium subsp. paratuberculosis
ccugacgggagucgggcccgcc

SEQ ID NO: 2825608 - RNA, 18 nt, Mycobacterium avium subsp. paratuberculosis
ccugacuaagucaccagg

SEQ ID NO: 2825609 - RNA, 20 nt, Mycobacterium avium subsp. paratuberculosis
ccugacugagucaagccggc

SEQ ID NO: 2825610 - RNA, 17 nt, Mycobacterium avium subsp. paratuberculosis
ccugacuucugaaccga

SEQ ID NO: 2825611 - RNA, 20 nt, Mycobacterium avium subsp. paratuberculosis
ccugagacgacgccaccauc

SEQ ID NO: 2825612 - RNA, 22 nt, Mycobacterium avium subsp. paratuberculosis
ccugagagguuagguacgcggc

SEQ ID NO: 2825613 - RNA, 12 nt, Mycobacterium avium subsp. paratuberculosis
ccugagcccgcc

SEQ ID NO: 2825614 - RNA, 14 nt, Mycobacterium avium subsp. paratuberculosis
ccugagcccgccuc

SEQ ID NO: 2825615 - RNA, 17 nt, Mycobacterium avium subsp. paratuberculosis
ccugagccgccggggcg

SEQ ID NO: 2825616 - RNA, 18 nt, Mycobacterium avium subsp. paratuberculosis
ccugagccgccggggcgc

SEQ ID NO: 2825617 - RNA, 14 nt, Mycobacterium avium subsp. paratuberculosis
ccugaggcccggug

SEQ ID NO: 2825618 - RNA, 16 nt, Mycobacterium avium subsp. paratuberculosis
ccugaggcccggugag

SEQ ID NO: 2825619 - RNA, 17 nt, Mycobacterium avium subsp. paratuberculosis
ccugcccggucugcggc

SEQ ID NO: 2825620 - RNA, 14 nt, Mycobacterium avium subsp. paratuberculosis
ccugccgcacaccg

SEQ ID NO: 2825621 - RNA, 13 nt, Mycobacterium avium subsp. paratuberculosis
ccugccgccaccg

SEQ ID NO: 2825622 - RNA, 17 nt, Mycobacterium avium subsp. paratuberculosis
ccugccggaugccgcgc

SEQ ID NO: 2825623 - RNA, 12 nt, Mycobacterium avium subsp. paratuberculosis
ccugccggcgcc

SEQ ID NO: 2825624 - RNA, 13 nt, Mycobacterium avium subsp. paratuberculosis
ccugccggcgccg

SEQ ID NO: 2825625 - RNA, 17 nt, Mycobacterium avium subsp. paratuberculosis
ccugccggcgccggauc

SEQ ID NO: 2825626 - RNA, 13 nt, Mycobacterium avium subsp. paratuberculosis
ccugccgggcguc

SEQ ID NO: 2825627 - RNA, 16 nt, Mycobacterium avium subsp. paratuberculosis
ccugccgggcgucgac

SEQ ID NO: 2825628 - RNA, 15 nt, Mycobacterium avium subsp. paratuberculosis
ccugccgucaccggc

SEQ ID NO: 2825629 - RNA, 20 nt, Mycobacterium avium subsp. paratuberculosis
ccugccguucggccagcgcc

SEQ ID NO: 2825630 - RNA, 22 nt, Mycobacterium avium subsp. paratuberculosis
ccugccuccacgucaccgacgc

SEQ ID NO: 2825631 - RNA, 19 nt, Mycobacterium avium subsp. paratuberculosis
ccugcgaauacccgcccag

SEQ ID NO: 2825632 - RNA, 22 nt, Mycobacterium avium subsp. paratuberculosis
ccugcgaauacccgcccagcac

SEQ ID NO: 2825633 - RNA, 23 nt, Mycobacterium avium subsp. paratuberculosis
ccugcgaauacccgcccagcacc

SEQ ID NO: 2825634 - RNA, 13 nt, Mycobacterium avium subsp. paratuberculosis
ccugcgaccgccg

SEQ ID NO: 2825635 - RNA, 14 nt, Mycobacterium avium subsp. paratuberculosis
ccugcgaccgccgc

SEQ ID NO: 2825636 - RNA, 13 nt, Mycobacterium avium subsp. paratuberculosis
ccugcgacggcag

SEQ ID NO: 2825637 - RNA, 19 nt, Mycobacterium avium subsp. paratuberculosis
ccugcgacuucuacggcgg

SEQ ID NO: 2825638 - RNA, 20 nt, Mycobacterium avium subsp. paratuberculosis
ccugcgacuucuacggcggg

SEQ ID NO: 2825639 - RNA, 13 nt, Mycobacterium avium subsp. paratuberculosis
ccugcgagcacac

SEQ ID NO: 2825640 - RNA, 16 nt, Mycobacterium avium subsp. paratuberculosis
ccugcgccagcagcag

SEQ ID NO: 2825641 - RNA, 19 nt, Mycobacterium avium subsp. paratuberculosis
ccugcgccagcagcagcgc

SEQ ID NO: 2825642 - RNA, 23 nt, Mycobacterium avium subsp. paratuberculosis
ccugcgccagcagcagcgcggca

SEQ ID NO: 2825643 - RNA, 14 nt, Mycobacterium avium subsp. paratuberculosis
ccugcgccaggauc

SEQ ID NO: 2825644 - RNA, 13 nt, Mycobacterium avium subsp. paratuberculosis
ccugcgccgcggu

SEQ ID NO: 2825645 - RNA, 15 nt, Mycobacterium avium subsp. paratuberculosis
ccugcgccgcggugc

SEQ ID NO: 2825646 - RNA, 20 nt, Mycobacterium avium subsp. paratuberculosis
ccugcgccgcggugcgccac

SEQ ID NO: 2825647 - RNA, 18 nt, Mycobacterium avium subsp. paratuberculosis
ccugcgcgaaaggcccac

SEQ ID NO: 2825648 - RNA, 21 nt, Mycobacterium avium subsp. paratuberculosis
ccugcgcgaaaggcccaccgc

SEQ ID NO: 2825649 - RNA, 17 nt, Mycobacterium avium subsp. paratuberculosis
ccugcgcgacggcgcug

SEQ ID NO: 2825650 - RNA, 16 nt, Mycobacterium avium subsp. paratuberculosis
ccugcgcgaucgccgg

SEQ ID NO: 2825651 - RNA, 19 nt, Mycobacterium avium subsp. paratuberculosis
ccugcgcgaucgccggauc

SEQ ID NO: 2825652 - RNA, 21 nt, Mycobacterium avium subsp. paratuberculosis
ccugcgcgaucgccggaucgg

SEQ ID NO: 2825653 - RNA, 14 nt, Mycobacterium avium subsp. paratuberculosis
ccugcgcgccgaug

SEQ ID NO: 2825654 - RNA, 22 nt, Mycobacterium avium subsp. paratuberculosis
ccugcgcgccgauguggccggc

SEQ ID NO: 2825655 - RNA, 14 nt, Mycobacterium avium subsp. paratuberculosis
ccugcgcgccguug

SEQ ID NO: 2825656 - RNA, 22 nt, Mycobacterium avium subsp. paratuberculosis
ccugcgcggaaguggaccgcgu

SEQ ID NO: 2825657 - RNA, 13 nt, Mycobacterium avium subsp. paratuberculosis
ccugcgcggccgc

SEQ ID NO: 2825658 - RNA, 15 nt, Mycobacterium avium subsp. paratuberculosis
ccugcgcggcgaugc

SEQ ID NO: 2825659 - RNA, 14 nt, Mycobacterium avium subsp. paratuberculosis
ccugcgcggcggcg

SEQ ID NO: 2825660 - RNA, 16 nt, Mycobacterium avium subsp. paratuberculosis
ccugcgcggcggcguc

SEQ ID NO: 2825661 - RNA, 14 nt, Mycobacterium avium subsp. paratuberculosis
ccugcgcgugcuug

SEQ ID NO: 2825662 - RNA, 20 nt, Mycobacterium avium subsp. paratuberculosis
ccugcgcgugcuugccgaug

SEQ ID NO: 2825663 - RNA, 16 nt, Mycobacterium avium subsp. paratuberculosis
ccugcgcuaccaggcg

SEQ ID NO: 2825664 - RNA, 16 nt, Mycobacterium avium subsp. paratuberculosis
ccugcgcucagcacgc

SEQ ID NO: 2825665 - RNA, 18 nt, Mycobacterium avium subsp. paratuberculosis
ccugcgcucagcacgcgg

SEQ ID NO: 2825666 - RNA, 24 nt, Mycobacterium avium subsp. paratuberculosis
ccugcggcaacagcaccagcacca

SEQ ID NO: 2825667 - RNA, 23 nt, Mycobacterium avium subsp. paratuberculosis
ccugcggcaggucggccagcgcc

SEQ ID NO: 2825668 - RNA, 20 nt, Mycobacterium avium subsp. paratuberculosis
ccugcggccagugccgggcc

SEQ ID NO: 2825669 - RNA, 20 nt, Mycobacterium avium subsp. paratuberculosis
ccugcggccccugcggggug

SEQ ID NO: 2825670 - RNA, 12 nt, Mycobacterium avium subsp. paratuberculosis
ccugcggcgaca

SEQ ID NO: 2825671 - RNA, 17 nt, Mycobacterium avium subsp. paratuberculosis
ccugcggcgcggccacc

SEQ ID NO: 2825672 - RNA, 21 nt, Mycobacterium avium subsp. paratuberculosis
ccugcggcgcggccaccccgg

SEQ ID NO: 2825673 - RNA, 14 nt, Mycobacterium avium subsp. paratuberculosis
ccugcggcggccgc

SEQ ID NO: 2825674 - RNA, 18 nt, Mycobacterium avium subsp. paratuberculosis
ccugcggcggccgcagcg

SEQ ID NO: 2825675 - RNA, 15 nt, Mycobacterium avium subsp. paratuberculosis
ccugcggcucgucgg

SEQ ID NO: 2825676 - RNA, 15 nt, Mycobacterium avium subsp. paratuberculosis
ccugcggcugguaga

SEQ ID NO: 2825677 - RNA, 19 nt, Mycobacterium avium subsp. paratuberculosis
ccugcggcugguagaugcc

SEQ ID NO: 2825678 - RNA, 14 nt, Mycobacterium avium subsp. paratuberculosis
ccugcgggacgccg

SEQ ID NO: 2825679 - RNA, 17 nt, Mycobacterium avium subsp. paratuberculosis
ccugcgggacgccguug

SEQ ID NO: 2825680 - RNA, 13 nt, Mycobacterium avium subsp. paratuberculosis
ccugcgggcccac

SEQ ID NO: 2825681 - RNA, 14 nt, Mycobacterium avium subsp. paratuberculosis
ccugcgggcgccgg

SEQ ID NO: 2825682 - RNA, 15 nt, Mycobacterium avium subsp. paratuberculosis
ccugcgggcgccggc

SEQ ID NO: 2825683 - RNA, 17 nt, Mycobacterium avium subsp. paratuberculosis
ccugcgggcgccggcug

SEQ ID NO: 2825684 - RNA, 19 nt, Mycobacterium avium subsp. paratuberculosis
ccugcgggcgccggcugcc

SEQ ID NO: 2825685 - RNA, 22 nt, Mycobacterium avium subsp. paratuberculosis
ccugcgggugcaacgugaugcc

SEQ ID NO: 2825686 - RNA, 18 nt, Mycobacterium avium subsp. paratuberculosis
ccugcggguucuggccgu

SEQ ID NO: 2825687 - RNA, 20 nt, Mycobacterium avium subsp. paratuberculosis
ccugcggugagcugaucgcg

SEQ ID NO: 2825688 - RNA, 18 nt, Mycobacterium avium subsp. paratuberculosis
ccugcggugaugcgcggc

SEQ ID NO: 2825689 - RNA, 18 nt, Mycobacterium avium subsp. paratuberculosis
ccugcgguucgggcccca

SEQ ID NO: 2825690 - RNA, 22 nt, Mycobacterium avium subsp. paratuberculosis
ccugcgguucgucgcggcggcc

SEQ ID NO: 2825691 - RNA, 17 nt, Mycobacterium avium subsp. paratuberculosis
ccugcgucacuccucga

SEQ ID NO: 2825692 - RNA, 19 nt, Mycobacterium avium subsp. paratuberculosis
ccugcucaccgagcugggc

SEQ ID NO: 2825693 - RNA, 21 nt, Mycobacterium avium subsp. paratuberculosis
ccugcucaccgagcugggccg

SEQ ID NO: 2825694 - RNA, 13 nt, Mycobacterium avium subsp. paratuberculosis
ccugcucagcggc

SEQ ID NO: 2825695 - RNA, 21 nt, Mycobacterium avium subsp. paratuberculosis
ccugcucagcggccaucgccg

SEQ ID NO: 2825696 - RNA, 16 nt, Mycobacterium avium subsp. paratuberculosis
ccugcucgcgggccac

SEQ ID NO: 2825697 - RNA, 19 nt, Mycobacterium avium subsp. paratuberculosis
ccugcucgcuugccagccg

SEQ ID NO: 2825698 - RNA, 17 nt, Mycobacterium avium subsp. paratuberculosis
ccugcucggccagcggg

SEQ ID NO: 2825699 - RNA, 14 nt, Mycobacterium avium subsp. paratuberculosis
ccugcucggcgacg

SEQ ID NO: 2825700 - RNA, 17 nt, Mycobacterium avium subsp. paratuberculosis
ccugcucggcgacgcug

SEQ ID NO: 2825701 - RNA, 14 nt, Mycobacterium avium subsp. paratuberculosis
ccugcucggugaug

SEQ ID NO: 2825702 - RNA, 16 nt, Mycobacterium avium subsp. paratuberculosis
ccugcucggugaugcc

SEQ ID NO: 2825703 - RNA, 22 nt, Mycobacterium avium subsp. paratuberculosis
ccugcucggugaugccgagcgc

SEQ ID NO: 2825704 - RNA, 20 nt, Mycobacterium avium subsp. paratuberculosis
ccuggccgucgguggccggu

SEQ ID NO: 2825705 - RNA, 18 nt, Mycobacterium avium subsp. paratuberculosis
ccuggccuggucggccgg

SEQ ID NO: 2825706 - RNA, 19 nt, Mycobacterium avium subsp. paratuberculosis
ccuggccuggucggccggc

SEQ ID NO: 2825707 - RNA, 21 nt, Mycobacterium avium subsp. paratuberculosis
ccuggccuggucggccggcag

SEQ ID NO: 2825708 - RNA, 16 nt, Mycobacterium avium subsp. paratuberculosis
ccuggcgaaccgcggc

SEQ ID NO: 2825709 - RNA, 18 nt, Mycobacterium avium subsp. paratuberculosis
ccuggcgaaccgcggcgg

SEQ ID NO: 2825710 - RNA, 23 nt, Mycobacterium avium subsp. paratuberculosis
ccuggcgaugaucaacaggauuc

SEQ ID NO: 2825711 - RNA, 13 nt, Mycobacterium avium subsp. paratuberculosis
ccuggcgcaccgc

SEQ ID NO: 2825712 - RNA, 18 nt, Mycobacterium avium subsp. paratuberculosis
ccuggcgcaccgccgcgg

SEQ ID NO: 2825713 - RNA, 15 nt, Mycobacterium avium subsp. paratuberculosis
ccuggcgcagcaccg

SEQ ID NO: 2825714 - RNA, 17 nt, Mycobacterium avium subsp. paratuberculosis
ccuggcgcuccagccac

SEQ ID NO: 2825715 - RNA, 18 nt, Mycobacterium avium subsp. paratuberculosis
ccuggcgcuccagccacu

SEQ ID NO: 2825716 - RNA, 20 nt, Mycobacterium avium subsp. paratuberculosis
ccuggcgcuccagccacucc

SEQ ID NO: 2825717 - RNA, 15 nt, Mycobacterium avium subsp. paratuberculosis
ccuggcggcgacccg

SEQ ID NO: 2825718 - RNA, 16 nt, Mycobacterium avium subsp. paratuberculosis
ccuggcggcgacccgg

SEQ ID NO: 2825719 - RNA, 17 nt, Mycobacterium avium subsp. paratuberculosis
ccuggcggcgacccgga

SEQ ID NO: 2825720 - RNA, 14 nt, Mycobacterium avium subsp. paratuberculosis
ccuggcgggccagc

SEQ ID NO: 2825721 - RNA, 12 nt, Mycobacterium avium subsp. paratuberculosis
ccuggcgggcgg

SEQ ID NO: 2825722 - RNA, 19 nt, Mycobacterium avium subsp. paratuberculosis
ccuggcgggcggcccgcac

SEQ ID NO: 2825723 - RNA, 18 nt, Mycobacterium avium subsp. paratuberculosis
ccuggcggguacagccgc

SEQ ID NO: 2825724 - RNA, 20 nt, Mycobacterium avium subsp. paratuberculosis
ccuggcggguacagccgcag

SEQ ID NO: 2825725 - RNA, 16 nt, Mycobacterium avium subsp. paratuberculosis
ccuggcgguggcccgg

SEQ ID NO: 2825726 - RNA, 15 nt, Mycobacterium avium subsp. paratuberculosis
ccuggcuccccggcg

SEQ ID NO: 2825727 - RNA, 22 nt, Mycobacterium avium subsp. paratuberculosis
ccuggcuccccggcgaucucga

SEQ ID NO: 2825728 - RNA, 11 nt, Mycobacterium avium subsp. paratuberculosis
ccuggcugccu

SEQ ID NO: 2825729 - RNA, 16 nt, Mycobacterium avium subsp. paratuberculosis
ccuggcuguagcgguc

SEQ ID NO: 2825730 - RNA, 12 nt, Mycobacterium avium subsp. paratuberculosis
ccugggacagcc

SEQ ID NO: 2825731 - RNA, 18 nt, Mycobacterium avium subsp. paratuberculosis
ccugggacagccggucga

SEQ ID NO: 2825732 - RNA, 16 nt, Mycobacterium avium subsp. paratuberculosis
ccugggacagcgagaa

SEQ ID NO: 2825733 - RNA, 19 nt, Mycobacterium avium subsp. paratuberculosis
ccugggaugucuagccgcc

SEQ ID NO: 2825734 - RNA, 21 nt, Mycobacterium avium subsp. paratuberculosis
ccugggaugucuagccgccga

SEQ ID NO: 2825735 - RNA, 22 nt, Mycobacterium avium subsp. paratuberculosis
ccugggaugucuagccgccgag

SEQ ID NO: 2825736 - RNA, 16 nt, Mycobacterium avium subsp. paratuberculosis
ccugggauugccgggc

SEQ ID NO: 2825737 - RNA, 22 nt, Mycobacterium avium subsp. paratuberculosis
ccugggauugccgggcaccagc

SEQ ID NO: 2825738 - RNA, 18 nt, Mycobacterium avium subsp. paratuberculosis
ccugggccagaucgaccc

SEQ ID NO: 2825739 - RNA, 23 nt, Mycobacterium avium subsp. paratuberculosis
ccugggccagaucgacccccacc

SEQ ID NO: 2825740 - RNA, 18 nt, Mycobacterium avium subsp. paratuberculosis
ccugggccuccggcggca

SEQ ID NO: 2825741 - RNA, 22 nt, Mycobacterium avium subsp. paratuberculosis
ccugggcggccaccgcgccccg

SEQ ID NO: 2825742 - RNA, 23 nt, Mycobacterium avium subsp. paratuberculosis
ccugggcggccaccgcgccccgg

SEQ ID NO: 2825743 - RNA, 24 nt, Mycobacterium avium subsp. paratuberculosis
ccugggcggccaccgcgccccggc

SEQ ID NO: 2825744 - RNA, 18 nt, Mycobacterium avium subsp. paratuberculosis
ccugggcggcgacacgcc

SEQ ID NO: 2825745 - RNA, 16 nt, Mycobacterium avium subsp. paratuberculosis
ccugggcggcggcggg

SEQ ID NO: 2825746 - RNA, 13 nt, Mycobacterium avium subsp. paratuberculosis
ccugggcgucguc

SEQ ID NO: 2825747 - RNA, 18 nt, Mycobacterium avium subsp. paratuberculosis
ccuggggcagaucgucgg

SEQ ID NO: 2825748 - RNA, 17 nt, Mycobacterium avium subsp. paratuberculosis
ccugggggucggugacc

SEQ ID NO: 2825749 - RNA, 18 nt, Mycobacterium avium subsp. paratuberculosis
ccugggucaucaccuugu

SEQ ID NO: 2825750 - RNA, 17 nt, Mycobacterium avium subsp. paratuberculosis
ccugggucugcggccgg

SEQ ID NO: 2825751 - RNA, 19 nt, Mycobacterium avium subsp. paratuberculosis
ccugggugagcggcgcguc

SEQ ID NO: 2825752 - RNA, 21 nt, Mycobacterium avium subsp. paratuberculosis
ccugggugagcggcgcgucca

SEQ ID NO: 2825753 - RNA, 19 nt, Mycobacterium avium subsp. paratuberculosis
ccugggugaguucgucggc

SEQ ID NO: 2825754 - RNA, 14 nt, Mycobacterium avium subsp. paratuberculosis
ccugggugaucuug

SEQ ID NO: 2825755 - RNA, 16 nt, Mycobacterium avium subsp. paratuberculosis
ccugggugcgccacug

SEQ ID NO: 2825756 - RNA, 19 nt, Mycobacterium avium subsp. paratuberculosis
ccugggugcgcggcgccgu

SEQ ID NO: 2825757 - RNA, 14 nt, Mycobacterium avium subsp. paratuberculosis
ccuggguuccggug

SEQ ID NO: 2825758 - RNA, 16 nt, Mycobacterium avium subsp. paratuberculosis
ccugguacagcaccgc

SEQ ID NO: 2825759 - RNA, 18 nt, Mycobacterium avium subsp. paratuberculosis
ccugguacagcaccgccg

SEQ ID NO: 2825760 - RNA, 18 nt, Mycobacterium avium subsp. paratuberculosis
ccugguaccccagcaaaa

SEQ ID NO: 2825761 - RNA, 20 nt, Mycobacterium avium subsp. paratuberculosis
ccugguaccccagcaaaacc

SEQ ID NO: 2825762 - RNA, 13 nt, Mycobacterium avium subsp. paratuberculosis
ccugguacgcgcc

SEQ ID NO: 2825763 - RNA, 23 nt, Mycobacterium avium subsp. paratuberculosis
ccugguaggccgccuugggccgg

SEQ ID NO: 2825764 - RNA, 18 nt, Mycobacterium avium subsp. paratuberculosis
ccuggucaaggugcugaa

SEQ ID NO: 2825765 - RNA, 12 nt, Mycobacterium avium subsp. paratuberculosis
ccugguccggcg

SEQ ID NO: 2825766 - RNA, 22 nt, Mycobacterium avium subsp. paratuberculosis
ccugguccggcgcccgaucggc

SEQ ID NO: 2825767 - RNA, 13 nt, Mycobacterium avium subsp. paratuberculosis
ccugguccugccc

SEQ ID NO: 2825768 - RNA, 15 nt, Mycobacterium avium subsp. paratuberculosis
ccugguccugccccg

SEQ ID NO: 2825769 - RNA, 14 nt, Mycobacterium avium subsp. paratuberculosis
ccuggucgaacagc

SEQ ID NO: 2825770 - RNA, 19 nt, Mycobacterium avium subsp. paratuberculosis
ccuggucgaacagcacgcc

SEQ ID NO: 2825771 - RNA, 21 nt, Mycobacterium avium subsp. paratuberculosis
ccuggucgaacagcacgccgg

SEQ ID NO: 2825772 - RNA, 22 nt, Mycobacterium avium subsp. paratuberculosis
ccuggucgaacagcacgccggc

SEQ ID NO: 2825773 - RNA, 13 nt, Mycobacterium avium subsp. paratuberculosis
ccuggucgaagau

SEQ ID NO: 2825774 - RNA, 14 nt, Mycobacterium avium subsp. paratuberculosis
ccuggucgccgccg

SEQ ID NO: 2825775 - RNA, 20 nt, Mycobacterium avium subsp. paratuberculosis
ccuggucggccagggcgugg

SEQ ID NO: 2825776 - RNA, 12 nt, Mycobacterium avium subsp. paratuberculosis
ccuggucggccg

SEQ ID NO: 2825777 - RNA, 19 nt, Mycobacterium avium subsp. paratuberculosis
ccuggucggccggcaggcc

SEQ ID NO: 2825778 - RNA, 14 nt, Mycobacterium avium subsp. paratuberculosis
ccuggucggcgacc

SEQ ID NO: 2825779 - RNA, 16 nt, Mycobacterium avium subsp. paratuberculosis
ccuggugaccgacgac

SEQ ID NO: 2825780 - RNA, 21 nt, Mycobacterium avium subsp. paratuberculosis
ccuggugaugaaucgucccgu

SEQ ID NO: 2825781 - RNA, 14 nt, Mycobacterium avium subsp. paratuberculosis
ccuggugcaacacc

SEQ ID NO: 2825782 - RNA, 21 nt, Mycobacterium avium subsp. paratuberculosis
ccuggugcaacaccgaaagcc

SEQ ID NO: 2825783 - RNA, 12 nt, Mycobacterium avium subsp. paratuberculosis
ccuggugcacca

SEQ ID NO: 2825784 - RNA, 16 nt, Mycobacterium avium subsp. paratuberculosis
ccuggugcaccaggua

SEQ ID NO: 2825785 - RNA, 14 nt, Mycobacterium avium subsp. paratuberculosis
ccuggugcucgcgc

SEQ ID NO: 2825786 - RNA, 17 nt, Mycobacterium avium subsp. paratuberculosis
ccugguggcccaggcag

SEQ ID NO: 2825787 - RNA, 22 nt, Mycobacterium avium subsp. paratuberculosis
ccugguugaacggcaccccgcg

SEQ ID NO: 2825788 - RNA, 17 nt, Mycobacterium avium subsp. paratuberculosis
ccugguugacgcccccg

SEQ ID NO: 2825789 - RNA, 18 nt, Mycobacterium avium subsp. paratuberculosis
ccuucuuggcggcggucu

SEQ ID NO: 2825790 - RNA, 19 nt, Mycobacterium avium subsp. paratuberculosis
ccuucuugggcucgcgggu

SEQ ID NO: 2825791 - RNA, 21 nt, Mycobacterium avium subsp. paratuberculosis
ccuugaaccggcuggacaccc

SEQ ID NO: 2825792 - RNA, 22 nt, Mycobacterium avium subsp. paratuberculosis
ccuugaacgcguccgacggcug

SEQ ID NO: 2825793 - RNA, 17 nt, Mycobacterium avium subsp. paratuberculosis
ccuugaacggcaccagc

SEQ ID NO: 2825794 - RNA, 14 nt, Mycobacterium avium subsp. paratuberculosis
ccuugaccaccgag

SEQ ID NO: 2825795 - RNA, 23 nt, Mycobacterium avium subsp. paratuberculosis
ccuugaccaccgagccgggcagc

SEQ ID NO: 2825796 - RNA, 21 nt, Mycobacterium avium subsp. paratuberculosis
ccuugaccacggugcgcucgu

SEQ ID NO: 2825797 - RNA, 14 nt, Mycobacterium avium subsp. paratuberculosis
ccuugaccagcugc

SEQ ID NO: 2825798 - RNA, 16 nt, Mycobacterium avium subsp. paratuberculosis
ccuugaccagcugcga

SEQ ID NO: 2825799 - RNA, 22 nt, Mycobacterium avium subsp. paratuberculosis
ccuugacccgcaaggccgccag

SEQ ID NO: 2825800 - RNA, 20 nt, Mycobacterium avium subsp. paratuberculosis
ccuugacccggccgcacacc

SEQ ID NO: 2825801 - RNA, 18 nt, Mycobacterium avium subsp. paratuberculosis
ccuugaccgccuuggcca

SEQ ID NO: 2825802 - RNA, 19 nt, Mycobacterium avium subsp. paratuberculosis
ccuugacgacggccaccgc

SEQ ID NO: 2825803 - RNA, 23 nt, Mycobacterium avium subsp. paratuberculosis
ccuugacggccugggcgaccacg

SEQ ID NO: 2825804 - RNA, 17 nt, Mycobacterium avium subsp. paratuberculosis
ccuugacuaccgcgccc

SEQ ID NO: 2825805 - RNA, 12 nt, Mycobacterium avium subsp. paratuberculosis
ccuugagccgcc

SEQ ID NO: 2825806 - RNA, 13 nt, Mycobacterium avium subsp. paratuberculosis
ccuugagccgccg

SEQ ID NO: 2825807 - RNA, 12 nt, Mycobacterium avium subsp. paratuberculosis
ccuugagccggu

SEQ ID NO: 2825808 - RNA, 20 nt, Mycobacterium avium subsp. paratuberculosis
ccuugagccgguccgacggc

SEQ ID NO: 2825809 - RNA, 16 nt, Mycobacterium avium subsp. paratuberculosis
ccuugagcuccgguga

SEQ ID NO: 2825810 - RNA, 19 nt, Mycobacterium avium subsp. paratuberculosis
ccuugagcuucccggcggu

SEQ ID NO: 2825811 - RNA, 20 nt, Mycobacterium avium subsp. paratuberculosis
ccuugagcuucccggcgguc

SEQ ID NO: 2825812 - RNA, 11 nt, Mycobacterium avium subsp. paratuberculosis
ccuugauccgg

SEQ ID NO: 2825813 - RNA, 15 nt, Mycobacterium avium subsp. paratuberculosis
ccuugauccggccgc

SEQ ID NO: 2825814 - RNA, 13 nt, Mycobacterium avium subsp. paratuberculosis
ccuugauccgggc

SEQ ID NO: 2825815 - RNA, 15 nt, Mycobacterium avium subsp. paratuberculosis
ccuugaucucgucgc

SEQ ID NO: 2825816 - RNA, 15 nt, Mycobacterium avium subsp. paratuberculosis
ccuugcagcacaccg

SEQ ID NO: 2825817 - RNA, 21 nt, Mycobacterium avium subsp. paratuberculosis
ccuugcagcccgcguccagca

SEQ ID NO: 2825818 - RNA, 18 nt, Mycobacterium avium subsp. paratuberculosis
ccuugcccaacaacucgg

SEQ ID NO: 2825819 - RNA, 14 nt, Mycobacterium avium subsp. paratuberculosis
ccuugccccaccac

SEQ ID NO: 2825820 - RNA, 18 nt, Mycobacterium avium subsp. paratuberculosis
ccuugccccaccaccgcc

SEQ ID NO: 2825821 - RNA, 20 nt, Mycobacterium avium subsp. paratuberculosis
ccuugccccaccaccgccgg

SEQ ID NO: 2825822 - RNA, 21 nt, Mycobacterium avium subsp. paratuberculosis
ccuugccccaccaccgccggc

SEQ ID NO: 2825823 - RNA, 13 nt, Mycobacterium avium subsp. paratuberculosis
ccuugcccggcuc

SEQ ID NO: 2825824 - RNA, 17 nt, Mycobacterium avium subsp. paratuberculosis
ccuugcccggcucggug

SEQ ID NO: 2825825 - RNA, 17 nt, Mycobacterium avium subsp. paratuberculosis
ccuugccgaucagcugg

SEQ ID NO: 2825826 - RNA, 16 nt, Mycobacterium avium subsp. paratuberculosis
ccuugccgaugccggc

SEQ ID NO: 2825827 - RNA, 13 nt, Mycobacterium avium subsp. paratuberculosis
ccuugccgccgaa

SEQ ID NO: 2825828 - RNA, 13 nt, Mycobacterium avium subsp. paratuberculosis
ccuugccggcggc

SEQ ID NO: 2825829 - RNA, 16 nt, Mycobacterium avium subsp. paratuberculosis
ccuugccggcggcggg

SEQ ID NO: 2825830 - RNA, 18 nt, Mycobacterium avium subsp. paratuberculosis
ccuugcgcaccacgucgg

SEQ ID NO: 2825831 - RNA, 14 nt, Mycobacterium avium subsp. paratuberculosis
ccuugcgcagcacc

SEQ ID NO: 2825832 - RNA, 15 nt, Mycobacterium avium subsp. paratuberculosis
ccuugcgcagcaccu

SEQ ID NO: 2825833 - RNA, 13 nt, Mycobacterium avium subsp. paratuberculosis
ccuugcgcagccg

SEQ ID NO: 2825834 - RNA, 18 nt, Mycobacterium avium subsp. paratuberculosis
ccuugcgcagccggcagc

SEQ ID NO: 2825835 - RNA, 19 nt, Mycobacterium avium subsp. paratuberculosis
ccuugcgcagccggcagca

SEQ ID NO: 2825836 - RNA, 21 nt, Mycobacterium avium subsp. paratuberculosis
ccuugcgcccacaguccgccc

SEQ ID NO: 2825837 - RNA, 17 nt, Mycobacterium avium subsp. paratuberculosis
ccuugcgccccggcggg

SEQ ID NO: 2825838 - RNA, 16 nt, Mycobacterium avium subsp. paratuberculosis
ccuugcgcgccgcgac

SEQ ID NO: 2825839 - RNA, 21 nt, Mycobacterium avium subsp. paratuberculosis
ccuugcgcgccgcgacgucgg

SEQ ID NO: 2825840 - RNA, 16 nt, Mycobacterium avium subsp. paratuberculosis
ccuugcggccgccgau

SEQ ID NO: 2825841 - RNA, 14 nt, Mycobacterium avium subsp. paratuberculosis
ccuugcggccggcg

SEQ ID NO: 2825842 - RNA, 15 nt, Mycobacterium avium subsp. paratuberculosis
ccuugcgggccggag

SEQ ID NO: 2825843 - RNA, 23 nt, Mycobacterium avium subsp. paratuberculosis
ccuugcgggccggagccuucuug

SEQ ID NO: 2825844 - RNA, 20 nt, Mycobacterium avium subsp. paratuberculosis
ccuugcuccacacuggcucu

SEQ ID NO: 2825845 - RNA, 14 nt, Mycobacterium avium subsp. paratuberculosis
ccuugcugacgccg

SEQ ID NO: 2825846 - RNA, 15 nt, Mycobacterium avium subsp. paratuberculosis
ccuugcugagccggc

SEQ ID NO: 2825847 - RNA, 18 nt, Mycobacterium avium subsp. paratuberculosis
ccuugcugagccggcccu

SEQ ID NO: 2825848 - RNA, 15 nt, Mycobacterium avium subsp. paratuberculosis
ccuugcugaucccca

SEQ ID NO: 2825849 - RNA, 17 nt, Mycobacterium avium subsp. paratuberculosis
ccuugcugauccccagc

SEQ ID NO: 2825850 - RNA, 19 nt, Mycobacterium avium subsp. paratuberculosis
ccuugcugauccccagcgg

SEQ ID NO: 2825851 - RNA, 18 nt, Mycobacterium avium subsp. paratuberculosis
ccuugcuggcggccuucu

SEQ ID NO: 2825852 - RNA, 23 nt, Mycobacterium avium subsp. paratuberculosis
ccuugcuggcggccuucuuggcc

SEQ ID NO: 2825853 - RNA, 16 nt, Mycobacterium avium subsp. paratuberculosis
ccuuggacaccugcag

SEQ ID NO: 2825854 - RNA, 17 nt, Mycobacterium avium subsp. paratuberculosis
ccuuggacaccugcagu

SEQ ID NO: 2825855 - RNA, 19 nt, Mycobacterium avium subsp. paratuberculosis
ccuuggacaggcccagcgg

SEQ ID NO: 2825856 - RNA, 13 nt, Mycobacterium avium subsp. paratuberculosis
ccuuggccagcag

SEQ ID NO: 2825857 - RNA, 16 nt, Mycobacterium avium subsp. paratuberculosis
ccuuggccaggcgggc

SEQ ID NO: 2825858 - RNA, 15 nt, Mycobacterium avium subsp. paratuberculosis
ccuuggcccgcgccc

SEQ ID NO: 2825859 - RNA, 21 nt, Mycobacterium avium subsp. paratuberculosis
ccuuggcccgcgcggccgcca

SEQ ID NO: 2825860 - RNA, 12 nt, Mycobacterium avium subsp. paratuberculosis
ccuuggccgcag

SEQ ID NO: 2825861 - RNA, 15 nt, Mycobacterium avium subsp. paratuberculosis
ccuuggccgcaggcg

SEQ ID NO: 2825862 - RNA, 18 nt, Mycobacterium avium subsp. paratuberculosis
ccuuggccgcaggcggcc

SEQ ID NO: 2825863 - RNA, 19 nt, Mycobacterium avium subsp. paratuberculosis
ccuuggccgcaggcggcca

SEQ ID NO: 2825864 - RNA, 22 nt, Mycobacterium avium subsp. paratuberculosis
ccuuggccgcaggcggccagca

SEQ ID NO: 2825865 - RNA, 13 nt, Mycobacterium avium subsp. paratuberculosis
ccuuggccugcuu

SEQ ID NO: 2825866 - RNA, 14 nt, Mycobacterium avium subsp. paratuberculosis
ccuuggcgcccagc

SEQ ID NO: 2825867 - RNA, 18 nt, Mycobacterium avium subsp. paratuberculosis
ccuuggcgcccagcgugg

SEQ ID NO: 2825868 - RNA, 19 nt, Mycobacterium avium subsp. paratuberculosis
ccuuggcgcccagcguggu

SEQ ID NO: 2825869 - RNA, 11 nt, Mycobacterium avium subsp. paratuberculosis
ccuuggcggca

SEQ ID NO: 2825870 - RNA, 18 nt, Mycobacterium avium subsp. paratuberculosis
ccuuggcggcaagcccuu

SEQ ID NO: 2825871 - RNA, 16 nt, Mycobacterium avium subsp. paratuberculosis
ccuuggcggccacgac

SEQ ID NO: 2825872 - RNA, 15 nt, Mycobacterium avium subsp. paratuberculosis
ccuuggcggcggcca

SEQ ID NO: 2825873 - RNA, 14 nt, Mycobacterium avium subsp. paratuberculosis
ccuuggcggcgugg

SEQ ID NO: 2825874 - RNA, 15 nt, Mycobacterium avium subsp. paratuberculosis
cgaacaccacggucc

SEQ ID NO: 2825875 - RNA, 20 nt, Mycobacterium avium subsp. paratuberculosis
cgaacaccacguagccgacc

SEQ ID NO: 2825876 - RNA, 12 nt, Mycobacterium avium subsp. paratuberculosis
cgaacaccagca

SEQ ID NO: 2825877 - RNA, 13 nt, Mycobacterium avium subsp. paratuberculosis
cgaacaccagcac

SEQ ID NO: 2825878 - RNA, 17 nt, Mycobacterium avium subsp. paratuberculosis
cgaacaccagcacccag

SEQ ID NO: 2825879 - RNA, 19 nt, Mycobacterium avium subsp. paratuberculosis
cgaacaccagcccggccga

SEQ ID NO: 2825880 - RNA, 21 nt, Mycobacterium avium subsp. paratuberculosis
cgaacacccggcuucgcugcg

SEQ ID NO: 2825881 - RNA, 20 nt, Mycobacterium avium subsp. paratuberculosis
cgaacaccgcaccggucucc

SEQ ID NO: 2825882 - RNA, 14 nt, Mycobacterium avium subsp. paratuberculosis
cgaacaccggcagc

SEQ ID NO: 2825883 - RNA, 18 nt, Mycobacterium avium subsp. paratuberculosis
cgaacaccggcagcgcca

SEQ ID NO: 2825884 - RNA, 17 nt, Mycobacterium avium subsp. paratuberculosis
cgaacaccggcgcgacc

SEQ ID NO: 2825885 - RNA, 13 nt, Mycobacterium avium subsp. paratuberculosis
cgaacaccggcgg

SEQ ID NO: 2825886 - RNA, 19 nt, Mycobacterium avium subsp. paratuberculosis
cgaacaccgugccgucacg

SEQ ID NO: 2825887 - RNA, 12 nt, Mycobacterium avium subsp. paratuberculosis
cgaacaccucgg

SEQ ID NO: 2825888 - RNA, 14 nt, Mycobacterium avium subsp. paratuberculosis
cgaacacgccgucg

SEQ ID NO: 2825889 - RNA, 23 nt, Mycobacterium avium subsp. paratuberculosis
cgaacacgcgaugaucagcucgc

SEQ ID NO: 2825890 - RNA, 15 nt, Mycobacterium avium subsp. paratuberculosis
cgaacacggccgccu

SEQ ID NO: 2825891 - RNA, 18 nt, Mycobacterium avium subsp. paratuberculosis
cgaacacggccgccucca

SEQ ID NO: 2825892 - RNA, 20 nt, Mycobacterium avium subsp. paratuberculosis
cgaacacggccgccuccagc

SEQ ID NO: 2825893 - RNA, 14 nt, Mycobacterium avium subsp. paratuberculosis
cgaacacggcgcug

SEQ ID NO: 2825894 - RNA, 15 nt, Mycobacterium avium subsp. paratuberculosis
cgaacacgggcggca

SEQ ID NO: 2825895 - RNA, 18 nt, Mycobacterium avium subsp. paratuberculosis
cgaacacguacagcggcg

SEQ ID NO: 2825896 - RNA, 21 nt, Mycobacterium avium subsp. paratuberculosis
cgaacacguacagcggcggcc

SEQ ID NO: 2825897 - RNA, 16 nt, Mycobacterium avium subsp. paratuberculosis
cgaacagcacgccggc

SEQ ID NO: 2825898 - RNA, 17 nt, Mycobacterium avium subsp. paratuberculosis
cgaacagcacgccggcc

SEQ ID NO: 2825899 - RNA, 18 nt, Mycobacterium avium subsp. paratuberculosis
cgaacagcacgccggccg

SEQ ID NO: 2825900 - RNA, 19 nt, Mycobacterium avium subsp. paratuberculosis
cgaacagcacgccggccgg

SEQ ID NO: 2825901 - RNA, 15 nt, Mycobacterium avium subsp. paratuberculosis
cgaacagcagcaccc

SEQ ID NO: 2825902 - RNA, 16 nt, Mycobacterium avium subsp. paratuberculosis
cgaacagcagcacccg

SEQ ID NO: 2825903 - RNA, 12 nt, Mycobacterium avium subsp. paratuberculosis
cgaacagcagcg

SEQ ID NO: 2825904 - RNA, 15 nt, Mycobacterium avium subsp. paratuberculosis
cgaacagcagcgcgc

SEQ ID NO: 2825905 - RNA, 20 nt, Mycobacterium avium subsp. paratuberculosis
cgaacagcagcgcgccgacc

SEQ ID NO: 2825906 - RNA, 12 nt, Mycobacterium avium subsp. paratuberculosis
cgaacagcaggc

SEQ ID NO: 2825907 - RNA, 21 nt, Mycobacterium avium subsp. paratuberculosis
cgaacagccgggccagcagcu

SEQ ID NO: 2825908 - RNA, 16 nt, Mycobacterium avium subsp. paratuberculosis
cgaacagccgggccgc

SEQ ID NO: 2825909 - RNA, 19 nt, Mycobacterium avium subsp. paratuberculosis
cgaacagccgggccgcccg

SEQ ID NO: 2825910 - RNA, 20 nt, Mycobacterium avium subsp. paratuberculosis
cgaacagccgggccgcccgc

SEQ ID NO: 2825911 - RNA, 21 nt, Mycobacterium avium subsp. paratuberculosis
cgaacagccgggccgcccgcg

SEQ ID NO: 2825912 - RNA, 23 nt, Mycobacterium avium subsp. paratuberculosis
cgaacagccgggccgcccgcgcg

SEQ ID NO: 2825913 - RNA, 14 nt, Mycobacterium avium subsp. paratuberculosis
cgaacagccgggcg

SEQ ID NO: 2825914 - RNA, 17 nt, Mycobacterium avium subsp. paratuberculosis
cgaacagccgggcggcc

SEQ ID NO: 2825915 - RNA, 18 nt, Mycobacterium avium subsp. paratuberculosis
cgaacagccgggcggccg

SEQ ID NO: 2825916 - RNA, 17 nt, Mycobacterium avium subsp. paratuberculosis
cgaacagcgacgucugc

SEQ ID NO: 2825917 - RNA, 24 nt, Mycobacterium avium subsp. paratuberculosis
cgaacagcgacgucugcggcucgg

SEQ ID NO: 2825918 - RNA, 15 nt, Mycobacterium avium subsp. paratuberculosis
cgaacagcgccgacu

SEQ ID NO: 2825919 - RNA, 12 nt, Mycobacterium avium subsp. paratuberculosis
cgaacagcgcgc

SEQ ID NO: 2825920 - RNA, 14 nt, Mycobacterium avium subsp. paratuberculosis
cgaacagcgcgccc

SEQ ID NO: 2825921 - RNA, 18 nt, Mycobacterium avium subsp. paratuberculosis
cgaacagcgcgcccgacg

SEQ ID NO: 2825922 - RNA, 15 nt, Mycobacterium avium subsp. paratuberculosis
cgaacagcgcggcca

SEQ ID NO: 2825923 - RNA, 17 nt, Mycobacterium avium subsp. paratuberculosis
cgaacagcgcggccacc

SEQ ID NO: 2825924 - RNA, 18 nt, Mycobacterium avium subsp. paratuberculosis
cgaacagcgcggccacca

SEQ ID NO: 2825925 - RNA, 12 nt, Mycobacterium avium subsp. paratuberculosis
cgaacagcgggg

SEQ ID NO: 2825926 - RNA, 15 nt, Mycobacterium avium subsp. paratuberculosis
cgaacagcggggugc

SEQ ID NO: 2825927 - RNA, 13 nt, Mycobacterium avium subsp. paratuberculosis
cgaacagcucgac

SEQ ID NO: 2825928 - RNA, 15 nt, Mycobacterium avium subsp. paratuberculosis
cgaacaggaugcagc

SEQ ID NO: 2825929 - RNA, 17 nt, Mycobacterium avium subsp. paratuberculosis
cgaacaggaugcagccg

SEQ ID NO: 2825930 - RNA, 21 nt, Mycobacterium avium subsp. paratuberculosis
cgaacaggaugcagccggcca

SEQ ID NO: 2825931 - RNA, 20 nt, Mycobacterium avium subsp. paratuberculosis
cgaacaggcccugcugcagc

SEQ ID NO: 2825932 - RNA, 22 nt, Mycobacterium avium subsp. paratuberculosis
cgaacaggcgcaacagcaccuc

SEQ ID NO: 2825933 - RNA, 18 nt, Mycobacterium avium subsp. paratuberculosis
cgaacagggcgacggcgg

SEQ ID NO: 2825934 - RNA, 20 nt, Mycobacterium avium subsp. paratuberculosis
cgaacagggcgacggcggcg

SEQ ID NO: 2825935 - RNA, 21 nt, Mycobacterium avium subsp. paratuberculosis
cgaacagggcgacggcggcga

SEQ ID NO: 2825936 - RNA, 17 nt, Mycobacterium avium subsp. paratuberculosis
cgaacagggcggcgggc

SEQ ID NO: 2825937 - RNA, 17 nt, Mycobacterium avium subsp. paratuberculosis
cgaacagguccuugccc

SEQ ID NO: 2825938 - RNA, 18 nt, Mycobacterium avium subsp. paratuberculosis
cgaacaucacccggcggc

SEQ ID NO: 2825939 - RNA, 12 nt, Mycobacterium avium subsp. paratuberculosis
cgaacaucagcc

SEQ ID NO: 2825940 - RNA, 14 nt, Mycobacterium avium subsp. paratuberculosis
cgaacaucagccga

SEQ ID NO: 2825941 - RNA, 14 nt, Mycobacterium avium subsp. paratuberculosis
cgaacaucgacgac

SEQ ID NO: 2825942 - RNA, 18 nt, Mycobacterium avium subsp. paratuberculosis
cgaacaucgacgacgggu

SEQ ID NO: 2825943 - RNA, 17 nt, Mycobacterium avium subsp. paratuberculosis
cgaacaucgagcccacc

SEQ ID NO: 2825944 - RNA, 19 nt, Mycobacterium avium subsp. paratuberculosis
cgaacaucgagcccaccgc

SEQ ID NO: 2825945 - RNA, 23 nt, Mycobacterium avium subsp. paratuberculosis
cgaacaucgagcccaccgcgccc

SEQ ID NO: 2825946 - RNA, 17 nt, Mycobacterium avium subsp. paratuberculosis
cgaacaucgccagcaac

SEQ ID NO: 2825947 - RNA, 18 nt, Mycobacterium avium subsp. paratuberculosis
cgaacaucgccagcaacg

SEQ ID NO: 2825948 - RNA, 22 nt, Mycobacterium avium subsp. paratuberculosis
cgaacaucuccagauugcggau

SEQ ID NO: 2825949 - RNA, 18 nt, Mycobacterium avium subsp. paratuberculosis
cgaacaucuuggucagcc

SEQ ID NO: 2825950 - RNA, 16 nt, Mycobacterium avium subsp. paratuberculosis
cgaacaugcugccgcc

SEQ ID NO: 2825951 - RNA, 17 nt, Mycobacterium avium subsp. paratuberculosis
cgaacaugcugccgccg

SEQ ID NO: 2825952 - RNA, 18 nt, Mycobacterium avium subsp. paratuberculosis
cgaacaugcugccgccgg

SEQ ID NO: 2825953 - RNA, 20 nt, Mycobacterium avium subsp. paratuberculosis
cgaacaugcugccgccggcg

SEQ ID NO: 2825954 - RNA, 21 nt, Mycobacterium avium subsp. paratuberculosis
cgaacaugcugccgccggcga

SEQ ID NO: 2825955 - RNA, 22 nt, Mycobacterium avium subsp. paratuberculosis
cgaacaugcugccgccggcgaa

SEQ ID NO: 2825956 - RNA, 23 nt, Mycobacterium avium subsp. paratuberculosis
cgaacaugcugccgccggcgaau

SEQ ID NO: 2825957 - RNA, 14 nt, Mycobacterium avium subsp. paratuberculosis
cgaacauggcggcc

SEQ ID NO: 2825958 - RNA, 16 nt, Mycobacterium avium subsp. paratuberculosis
cgaacauggcggccag

SEQ ID NO: 2825959 - RNA, 19 nt, Mycobacterium avium subsp. paratuberculosis
cgaacauggcggccagccg

SEQ ID NO: 2825960 - RNA, 14 nt, Mycobacterium avium subsp. paratuberculosis
cgaaccacgcggcg

SEQ ID NO: 2825961 - RNA, 20 nt, Mycobacterium avium subsp. paratuberculosis
cgaaccacgcggcggcggug

SEQ ID NO: 2825962 - RNA, 13 nt, Mycobacterium avium subsp. paratuberculosis
cgaaccacggguc

SEQ ID NO: 2825963 - RNA, 16 nt, Mycobacterium avium subsp. paratuberculosis
cgaaccagaucggcgg

SEQ ID NO: 2825964 - RNA, 14 nt, Mycobacterium avium subsp. paratuberculosis
cgaaccagcaugcg

SEQ ID NO: 2825965 - RNA, 12 nt, Mycobacterium avium subsp. paratuberculosis
cgaaccagcgcc

SEQ ID NO: 2825966 - RNA, 13 nt, Mycobacterium avium subsp. paratuberculosis
cgaaccagcgccc

SEQ ID NO: 2825967 - RNA, 17 nt, Mycobacterium avium subsp. paratuberculosis
cgaaccagcgcccgcuu

SEQ ID NO: 2825968 - RNA, 18 nt, Mycobacterium avium subsp. paratuberculosis
cgaaccagcgcccgcuug

SEQ ID NO: 2825969 - RNA, 15 nt, Mycobacterium avium subsp. paratuberculosis
cgaaccaggcgccgg

SEQ ID NO: 2825970 - RNA, 18 nt, Mycobacterium avium subsp. paratuberculosis
cgaaccaggcgccggcca

SEQ ID NO: 2825971 - RNA, 16 nt, Mycobacterium avium subsp. paratuberculosis
cgaaccagggcagcca

SEQ ID NO: 2825972 - RNA, 17 nt, Mycobacterium avium subsp. paratuberculosis
cgaaccaguucgccacc

SEQ ID NO: 2825973 - RNA, 19 nt, Mycobacterium avium subsp. paratuberculosis
cgaaccaguucgccaccac

SEQ ID NO: 2825974 - RNA, 22 nt, Mycobacterium avium subsp. paratuberculosis
cgaaccaguucgccaccacggu

SEQ ID NO: 2825975 - RNA, 15 nt, Mycobacterium avium subsp. paratuberculosis
cgaaccauucguggc

SEQ ID NO: 2825976 - RNA, 14 nt, Mycobacterium avium subsp. paratuberculosis
cgaacccagcgccu

SEQ ID NO: 2825977 - RNA, 15 nt, Mycobacterium avium subsp. paratuberculosis
cgaaccccagcuccg

SEQ ID NO: 2825978 - RNA, 21 nt, Mycobacterium avium subsp. paratuberculosis
cgaacccgaaaagcaccaggc

SEQ ID NO: 2825979 - RNA, 13 nt, Mycobacterium avium subsp. paratuberculosis
cgaacccgccagg

SEQ ID NO: 2825980 - RNA, 14 nt, Mycobacterium avium subsp. paratuberculosis
cgaacccgcccucg

SEQ ID NO: 2825981 - RNA, 17 nt, Mycobacterium avium subsp. paratuberculosis
cgaacccgcccucgccc

SEQ ID NO: 2825982 - RNA, 14 nt, Mycobacterium avium subsp. paratuberculosis
cgaacccgccgcgg

SEQ ID NO: 2825983 - RNA, 13 nt, Mycobacterium avium subsp. paratuberculosis
cgaacccggccag

SEQ ID NO: 2825984 - RNA, 16 nt, Mycobacterium avium subsp. paratuberculosis
cgaacccggccagcgu

SEQ ID NO: 2825985 - RNA, 18 nt, Mycobacterium avium subsp. paratuberculosis
cgaacccggccagcgucu

SEQ ID NO: 2825986 - RNA, 13 nt, Mycobacterium avium subsp. paratuberculosis
cgaacccggcgcc

SEQ ID NO: 2825987 - RNA, 17 nt, Mycobacterium avium subsp. paratuberculosis
cgaacccggcgcccggc

SEQ ID NO: 2825988 - RNA, 21 nt, Mycobacterium avium subsp. paratuberculosis
cgaacccggcgcccggccggu

SEQ ID NO: 2825989 - RNA, 14 nt, Mycobacterium avium subsp. paratuberculosis
cgaacccggcggcc

SEQ ID NO: 2825990 - RNA, 21 nt, Mycobacterium avium subsp. paratuberculosis
cgaacccggcggccccgguag

SEQ ID NO: 2825991 - RNA, 13 nt, Mycobacterium avium subsp. paratuberculosis
cgaacccgggcgc

SEQ ID NO: 2825992 - RNA, 20 nt, Mycobacterium avium subsp. paratuberculosis
cgaacccgggcgcgcccacc

SEQ ID NO: 2825993 - RNA, 17 nt, Mycobacterium avium subsp. paratuberculosis
cgaacccguggauggac

SEQ ID NO: 2825994 - RNA, 17 nt, Mycobacterium avium subsp. paratuberculosis
cgaaccgaucaccggca

SEQ ID NO: 2825995 - RNA, 20 nt, Mycobacterium avium subsp. paratuberculosis
cgaaccgaucaccggcagca

SEQ ID NO: 2825996 - RNA, 23 nt, Mycobacterium avium subsp. paratuberculosis
cgaaccgaucaccggcagcagcg

SEQ ID NO: 2825997 - RNA, 16 nt, Mycobacterium avium subsp. paratuberculosis
cgaaccgccccgcgcg

SEQ ID NO: 2825998 - RNA, 17 nt, Mycobacterium avium subsp. paratuberculosis
cgaaccgccccgcgcga

SEQ ID NO: 2825999 - RNA, 14 nt, Mycobacterium avium subsp. paratuberculosis
cgaaccgccgcacc

SEQ ID NO: 2826000 - RNA, 16 nt, Mycobacterium avium subsp. paratuberculosis
cgaaccgccgcaccca

SEQ ID NO: 2826001 - RNA, 16 nt, Mycobacterium avium subsp. paratuberculosis
cgaaccgcgagcgcgc

SEQ ID NO: 2826002 - RNA, 18 nt, Mycobacterium avium subsp. paratuberculosis
cgaaccgcgagcgcgcgg

SEQ ID NO: 2826003 - RNA, 15 nt, Mycobacterium avium subsp. paratuberculosis
cgaaccgcggcggca

SEQ ID NO: 2826004 - RNA, 21 nt, Mycobacterium avium subsp. paratuberculosis
cgaaccgcuccccgagcacgu

SEQ ID NO: 2826005 - RNA, 22 nt, Mycobacterium avium subsp. paratuberculosis
cgaaccgcuccccgagcacguc

SEQ ID NO: 2826006 - RNA, 14 nt, Mycobacterium avium subsp. paratuberculosis
cgaaccgcucgaac

SEQ ID NO: 2826007 - RNA, 21 nt, Mycobacterium avium subsp. paratuberculosis
cgaaccgcucgaacacccggc

SEQ ID NO: 2826008 - RNA, 22 nt, Mycobacterium avium subsp. paratuberculosis
cgaaccgcucgucgggaacgcc

SEQ ID NO: 2826009 - RNA, 15 nt, Mycobacterium avium subsp. paratuberculosis
cgaaccgcugcggau

SEQ ID NO: 2826010 - RNA, 18 nt, Mycobacterium avium subsp. paratuberculosis
cgaaccggaagaucagca

SEQ ID NO: 2826011 - RNA, 20 nt, Mycobacterium avium subsp. paratuberculosis
cgaaccggaucuggcccugg

SEQ ID NO: 2826012 - RNA, 23 nt, Mycobacterium avium subsp. paratuberculosis
cgaaccggaucuggcccuggcag

SEQ ID NO: 2826013 - RNA, 15 nt, Mycobacterium avium subsp. paratuberculosis
cgaaccgggccagga

SEQ ID NO: 2826014 - RNA, 13 nt, Mycobacterium avium subsp. paratuberculosis
cgaaccgggcgcg

SEQ ID NO: 2826015 - RNA, 16 nt, Mycobacterium avium subsp. paratuberculosis
cgaaccgggcgcgcag

SEQ ID NO: 2826016 - RNA, 23 nt, Mycobacterium avium subsp. paratuberculosis
cgaaccgggcggugaccacgccg

SEQ ID NO: 2826017 - RNA, 12 nt, Mycobacterium avium subsp. paratuberculosis
cgaaccggggca

SEQ ID NO: 2826018 - RNA, 16 nt, Mycobacterium avium subsp. paratuberculosis
cgaaccggggccgcac

SEQ ID NO: 2826019 - RNA, 17 nt, Mycobacterium avium subsp. paratuberculosis
cgaaccgguugcgggcc

SEQ ID NO: 2826020 - RNA, 23 nt, Mycobacterium avium subsp. paratuberculosis
cgaaccgugcacgaucgcgguga

SEQ ID NO: 2826021 - RNA, 15 nt, Mycobacterium avium subsp. paratuberculosis
cgaaccucgcggcgg

SEQ ID NO: 2826022 - RNA, 23 nt, Mycobacterium avium subsp. paratuberculosis
cgaaccucgcggcggcgucggcg

SEQ ID NO: 2826023 - RNA, 16 nt, Mycobacterium avium subsp. paratuberculosis
cgaaccuggcugccug

SEQ ID NO: 2826024 - RNA, 13 nt, Mycobacterium avium subsp. paratuberculosis
cgaacgaccgggu

SEQ ID NO: 2826025 - RNA, 14 nt, Mycobacterium avium subsp. paratuberculosis
cgaacgacgagccg

SEQ ID NO: 2826026 - RNA, 17 nt, Mycobacterium avium subsp. paratuberculosis
cgaacgacgagccgucg

SEQ ID NO: 2826027 - RNA, 13 nt, Mycobacterium avium subsp. paratuberculosis
cgaacgacgcggc

SEQ ID NO: 2826028 - RNA, 14 nt, Mycobacterium avium subsp. paratuberculosis
cgaacgacgcggca

SEQ ID NO: 2826029 - RNA, 15 nt, Mycobacterium avium subsp. paratuberculosis
cgaacgacgcggcac

SEQ ID NO: 2826030 - RNA, 16 nt, Mycobacterium avium subsp. paratuberculosis
cgaacgacgcggcacg

SEQ ID NO: 2826031 - RNA, 22 nt, Mycobacterium avium subsp. paratuberculosis
cgaacgacgcggcacgccgcuc

SEQ ID NO: 2826032 - RNA, 15 nt, Mycobacterium avium subsp. paratuberculosis
cgaacgacgucgagg

SEQ ID NO: 2826033 - RNA, 20 nt, Mycobacterium avium subsp. paratuberculosis
cgaacgagaaggcggcgucg

SEQ ID NO: 2826034 - RNA, 14 nt, Mycobacterium avium subsp. paratuberculosis
cgaacgaguugccc

SEQ ID NO: 2826035 - RNA, 19 nt, Mycobacterium avium subsp. paratuberculosis
cgaacgauggugugcagca

SEQ ID NO: 2826036 - RNA, 13 nt, Mycobacterium avium subsp. paratuberculosis
cgaacgccaccac

SEQ ID NO: 2826037 - RNA, 14 nt, Mycobacterium avium subsp. paratuberculosis
cgaacgccaccacc

SEQ ID NO: 2826038 - RNA, 17 nt, Mycobacterium avium subsp. paratuberculosis
cgaacgccaccacggcg

SEQ ID NO: 2826039 - RNA, 18 nt, Mycobacterium avium subsp. paratuberculosis
cgaacgccaccacggcgu

SEQ ID NO: 2826040 - RNA, 12 nt, Mycobacterium avium subsp. paratuberculosis
cgaacgccaccu

SEQ ID NO: 2826041 - RNA, 21 nt, Mycobacterium avium subsp. paratuberculosis
cgaacgccaccuucaccgcgc

SEQ ID NO: 2826042 - RNA, 15 nt, Mycobacterium avium subsp. paratuberculosis
cgaacgccagcgccg

SEQ ID NO: 2826043 - RNA, 14 nt, Mycobacterium avium subsp. paratuberculosis
cgaacgcccggucg

SEQ ID NO: 2826044 - RNA, 20 nt, Mycobacterium avium subsp. paratuberculosis
cgaacgugcacucagggcga

SEQ ID NO: 2826045 - RNA, 16 nt, Mycobacterium avium subsp. paratuberculosis
cgaacgugcagcuucc

SEQ ID NO: 2826046 - RNA, 17 nt, Mycobacterium avium subsp. paratuberculosis
cgaacgugcgcggcgcg

SEQ ID NO: 2826047 - RNA, 20 nt, Mycobacterium avium subsp. paratuberculosis
cgaacgugcgcggcgcgcga

SEQ ID NO: 2826048 - RNA, 19 nt, Mycobacterium avium subsp. paratuberculosis
cgaacgugcugugcgggcg

SEQ ID NO: 2826049 - RNA, 18 nt, Mycobacterium avium subsp. paratuberculosis
cgaacuacuucgucagca

SEQ ID NO: 2826050 - RNA, 21 nt, Mycobacterium avium subsp. paratuberculosis
cgaacuacuucgucagcagcg

SEQ ID NO: 2826051 - RNA, 17 nt, Mycobacterium avium subsp. paratuberculosis
cgaacucaagggcguca

SEQ ID NO: 2826052 - RNA, 19 nt, Mycobacterium avium subsp. paratuberculosis
cgaacucaagggcgucacg

SEQ ID NO: 2826053 - RNA, 21 nt, Mycobacterium avium subsp. paratuberculosis
cgaacucaccgguggccgcgu

SEQ ID NO: 2826054 - RNA, 22 nt, Mycobacterium avium subsp. paratuberculosis
cgaacucaccgguggccgcguc

SEQ ID NO: 2826055 - RNA, 23 nt, Mycobacterium avium subsp. paratuberculosis
cgaacucaccgguggccgcgucg

SEQ ID NO: 2826056 - RNA, 13 nt, Mycobacterium avium subsp. paratuberculosis
cgaacucaggcgc

SEQ ID NO: 2826057 - RNA, 20 nt, Mycobacterium avium subsp. paratuberculosis
cgaacuccacccugccgacc

SEQ ID NO: 2826058 - RNA, 14 nt, Mycobacterium avium subsp. paratuberculosis
cgaacuccagaucg

SEQ ID NO: 2826059 - RNA, 21 nt, Mycobacterium avium subsp. paratuberculosis
cgaacuccagaucgccgccca

SEQ ID NO: 2826060 - RNA, 17 nt, Mycobacterium avium subsp. paratuberculosis
cgaacuccauccgccgu

SEQ ID NO: 2826061 - RNA, 15 nt, Mycobacterium avium subsp. paratuberculosis
cgaacuccgagccgg

SEQ ID NO: 2826062 - RNA, 13 nt, Mycobacterium avium subsp. paratuberculosis
cgaacuccgccga

SEQ ID NO: 2826063 - RNA, 12 nt, Mycobacterium avium subsp. paratuberculosis
cgaacuccgcgc

SEQ ID NO: 2826064 - RNA, 19 nt, Mycobacterium avium subsp. paratuberculosis
cgaacuccugcucgcgggc

SEQ ID NO: 2826065 - RNA, 21 nt, Mycobacterium avium subsp. paratuberculosis
cgaacuccugcucgcgggcca

SEQ ID NO: 2826066 - RNA, 16 nt, Mycobacterium avium subsp. paratuberculosis
cgaacuccuugacccg

SEQ ID NO: 2826067 - RNA, 17 nt, Mycobacterium avium subsp. paratuberculosis
cgaacucgaugggggug

SEQ ID NO: 2826068 - RNA, 21 nt, Mycobacterium avium subsp. paratuberculosis
cgaacucgaugggggugccgc

SEQ ID NO: 2826069 - RNA, 14 nt, Mycobacterium avium subsp. paratuberculosis
cgaacucgcggcgg

SEQ ID NO: 2826070 - RNA, 16 nt, Mycobacterium avium subsp. paratuberculosis
cgaacucggcgccgcc

SEQ ID NO: 2826071 - RNA, 21 nt, Mycobacterium avium subsp. paratuberculosis
cgaacucgucgaugcacgccg

SEQ ID NO: 2826072 - RNA, 18 nt, Mycobacterium avium subsp. paratuberculosis
cgaacucguuggcguggc

SEQ ID NO: 2826073 - RNA, 15 nt, Mycobacterium avium subsp. paratuberculosis
cgaacugcaccagca

SEQ ID NO: 2826074 - RNA, 17 nt, Mycobacterium avium subsp. paratuberculosis
cgaacugcagccggcca

SEQ ID NO: 2826075 - RNA, 17 nt, Mycobacterium avium subsp. paratuberculosis
cgaacugcaucaugucc

SEQ ID NO: 2826076 - RNA, 23 nt, Mycobacterium avium subsp. paratuberculosis
cgaacugccaucccucguucagc

SEQ ID NO: 2826077 - RNA, 16 nt, Mycobacterium avium subsp. paratuberculosis
cgaacugccggcauag

SEQ ID NO: 2826078 - RNA, 20 nt, Mycobacterium avium subsp. paratuberculosis
cgaacugggugggcagcgga

SEQ ID NO: 2826079 - RNA, 23 nt, Mycobacterium avium subsp. paratuberculosis
cgaacugguuguagucgucgacc

SEQ ID NO: 2826080 - RNA, 13 nt, Mycobacterium avium subsp. paratuberculosis
cgaacuucagcgc

SEQ ID NO: 2826081 - RNA, 16 nt, Mycobacterium avium subsp. paratuberculosis
cgaacuucagcgcguc

SEQ ID NO: 2826082 - RNA, 23 nt, Mycobacterium avium subsp. paratuberculosis
cgaacuugaccgggcuccagcgg

SEQ ID NO: 2826083 - RNA, 15 nt, Mycobacterium avium subsp. paratuberculosis
cgaacuugcuggccg

SEQ ID NO: 2826084 - RNA, 18 nt, Mycobacterium avium subsp. paratuberculosis
cgaacuugcuggccgagu

SEQ ID NO: 2826085 - RNA, 17 nt, Mycobacterium avium subsp. paratuberculosis
cgaagaacgacuggcgg

SEQ ID NO: 2826086 - RNA, 20 nt, Mycobacterium avium subsp. paratuberculosis
cgaagaacuugucgucgucg

SEQ ID NO: 2826087 - RNA, 20 nt, Mycobacterium avium subsp. paratuberculosis
cgaagaagagggcgugacgc

SEQ ID NO: 2826088 - RNA, 21 nt, Mycobacterium avium subsp. paratuberculosis
cgaagaagagggcgugacgcc

SEQ ID NO: 2826089 - RNA, 14 nt, Mycobacterium avium subsp. paratuberculosis
cgaagaagcggccg

SEQ ID NO: 2826090 - RNA, 17 nt, Mycobacterium avium subsp. paratuberculosis
cgaagaagcggccgacg

SEQ ID NO: 2826091 - RNA, 18 nt, Mycobacterium avium subsp. paratuberculosis
cgaagaagcggccgacga

SEQ ID NO: 2826092 - RNA, 15 nt, Mycobacterium avium subsp. paratuberculosis
cgaagaaggcgugcg

SEQ ID NO: 2826093 - RNA, 20 nt, Mycobacterium avium subsp. paratuberculosis
cgaagaaguauucgccgucg

SEQ ID NO: 2826094 - RNA, 21 nt, Mycobacterium avium subsp. paratuberculosis
cgaagaaguauucgccgucgu

SEQ ID NO: 2826095 - RNA, 23 nt, Mycobacterium avium subsp. paratuberculosis
cgaagaaguauucgccgucgugg

SEQ ID NO: 2826096 - RNA, 15 nt, Mycobacterium avium subsp. paratuberculosis
cgaagaccagcgugu

SEQ ID NO: 2826097 - RNA, 21 nt, Mycobacterium avium subsp. paratuberculosis
cgaagaccagcgugucgccgg

SEQ ID NO: 2826098 - RNA, 13 nt, Mycobacterium avium subsp. paratuberculosis
cgaagacccgaaa

SEQ ID NO: 2826099 - RNA, 14 nt, Mycobacterium avium subsp. paratuberculosis
cgaagacccgaaac

SEQ ID NO: 2826100 - RNA, 15 nt, Mycobacterium avium subsp. paratuberculosis
cgaagaccgggucgu

SEQ ID NO: 2826101 - RNA, 16 nt, Mycobacterium avium subsp. paratuberculosis
cgaagaccggugcgcg

SEQ ID NO: 2826102 - RNA, 22 nt, Mycobacterium avium subsp. paratuberculosis
cgaagaccggugcgcgcaccag

SEQ ID NO: 2826103 - RNA, 24 nt, Mycobacterium avium subsp. paratuberculosis
cgaagaccggugcgcgcaccaggc

SEQ ID NO: 2826104 - RNA, 13 nt, Mycobacterium avium subsp. paratuberculosis
cgaagacgcccca

SEQ ID NO: 2826105 - RNA, 15 nt, Mycobacterium avium subsp. paratuberculosis
cgaagacggcgaggu

SEQ ID NO: 2826106 - RNA, 20 nt, Mycobacterium avium subsp. paratuberculosis
cgaagacguacggaugcccc

SEQ ID NO: 2826107 - RNA, 15 nt, Mycobacterium avium subsp. paratuberculosis
cgaagagccggcguu

SEQ ID NO: 2826108 - RNA, 17 nt, Mycobacterium avium subsp. paratuberculosis
cgaagagcggcacgauc

SEQ ID NO: 2826109 - RNA, 23 nt, Mycobacterium avium subsp. paratuberculosis
cgaagagcggcacgaucggcagc

SEQ ID NO: 2826110 - RNA, 20 nt, Mycobacterium avium subsp. paratuberculosis
cgaagagcuggucgcccacc

SEQ ID NO: 2826111 - RNA, 16 nt, Mycobacterium avium subsp. paratuberculosis
cgaagaggugcucgac

SEQ ID NO: 2826112 - RNA, 15 nt, Mycobacterium avium subsp. paratuberculosis
cgaagaucaccgcga

SEQ ID NO: 2826113 - RNA, 15 nt, Mycobacterium avium subsp. paratuberculosis
cgaagaucagcgcgu

SEQ ID NO: 2826114 - RNA, 15 nt, Mycobacterium avium subsp. paratuberculosis
cgaagaucggagccg

SEQ ID NO: 2826115 - RNA, 23 nt, Mycobacterium avium subsp. paratuberculosis
cgaagaucuccgggaacgcggcg

SEQ ID NO: 2826116 - RNA, 17 nt, Mycobacterium avium subsp. paratuberculosis
cgaagaugaucagcgcg

SEQ ID NO: 2826117 - RNA, 21 nt, Mycobacterium avium subsp. paratuberculosis
cgaagaugaucagcgcgccca

SEQ ID NO: 2826118 - RNA, 18 nt, Mycobacterium avium subsp. paratuberculosis
cgaagauggccagcgcgg

SEQ ID NO: 2826119 - RNA, 20 nt, Mycobacterium avium subsp. paratuberculosis
cgaagauggccagcgcggcg

SEQ ID NO: 2826120 - RNA, 15 nt, Mycobacterium avium subsp. paratuberculosis
cgaagauggccaggu

SEQ ID NO: 2826121 - RNA, 21 nt, Mycobacterium avium subsp. paratuberculosis
cgaagauggucgcgccgcggc

SEQ ID NO: 2826122 - RNA, 17 nt, Mycobacterium avium subsp. paratuberculosis
cgaagaugucgcggcgc

SEQ ID NO: 2826123 - RNA, 14 nt, Mycobacterium avium subsp. paratuberculosis
cgaagaugucggug

SEQ ID NO: 2826124 - RNA, 14 nt, Mycobacterium avium subsp. paratuberculosis
cgaagcacgaccac

SEQ ID NO: 2826125 - RNA, 17 nt, Mycobacterium avium subsp. paratuberculosis
cgaagcagaacuucucc

SEQ ID NO: 2826126 - RNA, 23 nt, Mycobacterium avium subsp. paratuberculosis
cgaagcagaacuucuccgccggc

SEQ ID NO: 2826127 - RNA, 18 nt, Mycobacterium avium subsp. paratuberculosis
cgaagcccaagugcccgc

SEQ ID NO: 2826128 - RNA, 18 nt, Mycobacterium avium subsp. paratuberculosis
cgaaggugggcagcgcca

SEQ ID NO: 2826129 - RNA, 21 nt, Mycobacterium avium subsp. paratuberculosis
cgaaggugggcagcgccacca

SEQ ID NO: 2826130 - RNA, 23 nt, Mycobacterium avium subsp. paratuberculosis
cgaaggugguggcguuggcgauc

SEQ ID NO: 2826131 - RNA, 23 nt, Mycobacterium avium subsp. paratuberculosis
cgaagguguccucgagcugcacg

SEQ ID NO: 2826132 - RNA, 12 nt, Mycobacterium avium subsp. paratuberculosis
cgaaguacgccg

SEQ ID NO: 2826133 - RNA, 20 nt, Mycobacterium avium subsp. paratuberculosis
cgaaguagaagaucagcgcc

SEQ ID NO: 2826134 - RNA, 21 nt, Mycobacterium avium subsp. paratuberculosis
cgaaguagaagaucagcgcca

SEQ ID NO: 2826135 - RNA, 17 nt, Mycobacterium avium subsp. paratuberculosis
cgaaguagagccgcugc

SEQ ID NO: 2826136 - RNA, 15 nt, Mycobacterium avium subsp. paratuberculosis
cgaaguagggccgca

SEQ ID NO: 2826137 - RNA, 17 nt, Mycobacterium avium subsp. paratuberculosis
cgaaguagggccgcagc

SEQ ID NO: 2826138 - RNA, 17 nt, Mycobacterium avium subsp. paratuberculosis
cgaaguagucggcgucc

SEQ ID NO: 2826139 - RNA, 14 nt, Mycobacterium avium subsp. paratuberculosis
cgaaguauccgguc

SEQ ID NO: 2826140 - RNA, 21 nt, Mycobacterium avium subsp. paratuberculosis
cgaaguauccggucagcgcca

SEQ ID NO: 2826141 - RNA, 22 nt, Mycobacterium avium subsp. paratuberculosis
cgaaguauccggucagcgccag

SEQ ID NO: 2826142 - RNA, 23 nt, Mycobacterium avium subsp. paratuberculosis
cgaagucaaaccccuuggcgucc

SEQ ID NO: 2826143 - RNA, 17 nt, Mycobacterium avium subsp. paratuberculosis
cgaagucaucaccgggg

SEQ ID NO: 2826144 - RNA, 22 nt, Mycobacterium avium subsp. paratuberculosis
cgaagucaucaccggggaucac

SEQ ID NO: 2826145 - RNA, 16 nt, Mycobacterium avium subsp. paratuberculosis
cgaagucccacugccc

SEQ ID NO: 2826146 - RNA, 14 nt, Mycobacterium avium subsp. paratuberculosis
cgaaguccgacgag

SEQ ID NO: 2826147 - RNA, 14 nt, Mycobacterium avium subsp. paratuberculosis
cgaaguccgccagg

SEQ ID NO: 2826148 - RNA, 17 nt, Mycobacterium avium subsp. paratuberculosis
cgaaguccugcgccgcg

SEQ ID NO: 2826149 - RNA, 20 nt, Mycobacterium avium subsp. paratuberculosis
cgaaguccugcgccgcggug

SEQ ID NO: 2826150 - RNA, 14 nt, Mycobacterium avium subsp. paratuberculosis
cgaagucgagcagg

SEQ ID NO: 2826151 - RNA, 15 nt, Mycobacterium avium subsp. paratuberculosis
cgaagucgaucccgg

SEQ ID NO: 2826152 - RNA, 19 nt, Mycobacterium avium subsp. paratuberculosis
cgaagucgaucccgggugc

SEQ ID NO: 2826153 - RNA, 20 nt, Mycobacterium avium subsp. paratuberculosis
cgaagucgccgcccgggccg

SEQ ID NO: 2826154 - RNA, 23 nt, Mycobacterium avium subsp. paratuberculosis
cgaagucgccgcccgggccgcgc

SEQ ID NO: 2826155 - RNA, 14 nt, Mycobacterium avium subsp. paratuberculosis
cgaagucgccggcc

SEQ ID NO: 2826156 - RNA, 16 nt, Mycobacterium avium subsp. paratuberculosis
cgaagugacgccgcuc

SEQ ID NO: 2826157 - RNA, 23 nt, Mycobacterium avium subsp. paratuberculosis
cgaagugacgccgcucggccagc

SEQ ID NO: 2826158 - RNA, 15 nt, Mycobacterium avium subsp. paratuberculosis
cgaagugaugcuguu

SEQ ID NO: 2826159 - RNA, 15 nt, Mycobacterium avium subsp. paratuberculosis
cgaagugcccgccuu

SEQ ID NO: 2826160 - RNA, 14 nt, Mycobacterium avium subsp. paratuberculosis
cgaagugcccggcg

SEQ ID NO: 2826161 - RNA, 17 nt, Mycobacterium avium subsp. paratuberculosis
cgaagugcccggcgccg

SEQ ID NO: 2826162 - RNA, 23 nt, Mycobacterium avium subsp. paratuberculosis
cgaagugcucgaacgcgccgauc

SEQ ID NO: 2826163 - RNA, 15 nt, Mycobacterium avium subsp. paratuberculosis
cgaaguggacaugca

SEQ ID NO: 2826164 - RNA, 21 nt, Mycobacterium avium subsp. paratuberculosis
cgaaguggacaugcagccgcc

SEQ ID NO: 2826165 - RNA, 22 nt, Mycobacterium avium subsp. paratuberculosis
cgaaguggacaugcagccgccg

SEQ ID NO: 2826166 - RNA, 15 nt, Mycobacterium avium subsp. paratuberculosis
cgaaguggcagcgcu

SEQ ID NO: 2826167 - RNA, 17 nt, Mycobacterium avium subsp. paratuberculosis
cgaaguuccagccgauc

SEQ ID NO: 2826168 - RNA, 18 nt, Mycobacterium avium subsp. paratuberculosis
cgaaguucgacacgguga

SEQ ID NO: 2826169 - RNA, 15 nt, Mycobacterium avium subsp. paratuberculosis
cgaaguucggcaucc

SEQ ID NO: 2826170 - RNA, 15 nt, Mycobacterium avium subsp. paratuberculosis
cgaaguucggcaucu

SEQ ID NO: 2826171 - RNA, 22 nt, Mycobacterium avium subsp. paratuberculosis
cgaaguucggcaucucggccgg

SEQ ID NO: 2826172 - RNA, 14 nt, Mycobacterium avium subsp. paratuberculosis
cgaaguuggcgucg

SEQ ID NO: 2826173 - RNA, 15 nt, Mycobacterium avium subsp. paratuberculosis
cgaaguuggcgucgg

SEQ ID NO: 2826174 - RNA, 18 nt, Mycobacterium avium subsp. paratuberculosis
cgaaguuggcgucgggca

SEQ ID NO: 2826175 - RNA, 18 nt, Mycobacterium avium subsp. paratuberculosis
cgaaguuggucaccacca

SEQ ID NO: 2826176 - RNA, 18 nt, Mycobacterium avium subsp. paratuberculosis
cgaauacccgcccagcac

SEQ ID NO: 2826177 - RNA, 21 nt, Mycobacterium avium subsp. paratuberculosis
cgaauacccgcccagcaccag

SEQ ID NO: 2826178 - RNA, 17 nt, Mycobacterium avium subsp. paratuberculosis
cgaauacccuccgggcg

SEQ ID NO: 2826179 - RNA, 18 nt, Mycobacterium avium subsp. paratuberculosis
cgaauacccuccgggcgg

SEQ ID NO: 2826180 - RNA, 20 nt, Mycobacterium avium subsp. paratuberculosis
cgaauacccuccgggcggca

SEQ ID NO: 2826181 - RNA, 23 nt, Mycobacterium avium subsp. paratuberculosis
cgaauacccuucggccggcagcg

SEQ ID NO: 2826182 - RNA, 19 nt, Mycobacterium avium subsp. paratuberculosis
cgaauacgccaucagcacc

SEQ ID NO: 2826183 - RNA, 16 nt, Mycobacterium avium subsp. paratuberculosis
cgaauauuucgccgau

SEQ ID NO: 2826184 - RNA, 11 nt, Mycobacterium avium subsp. paratuberculosis
cgaaucaccca

SEQ ID NO: 2826185 - RNA, 18 nt, Mycobacterium avium subsp. paratuberculosis
cgaaucacccacggccac

SEQ ID NO: 2826186 - RNA, 15 nt, Mycobacterium avium subsp. paratuberculosis
cgaaucaucguggcg

SEQ ID NO: 2826187 - RNA, 12 nt, Mycobacterium avium subsp. paratuberculosis
cgaauccacaca

SEQ ID NO: 2826188 - RNA, 14 nt, Mycobacterium avium subsp. paratuberculosis
cgaauccagcgcgc

SEQ ID NO: 2826189 - RNA, 15 nt, Mycobacterium avium subsp. paratuberculosis
cgaauccagcgcgcc

SEQ ID NO: 2826190 - RNA, 15 nt, Mycobacterium avium subsp. paratuberculosis
cgaaucccggccucg

SEQ ID NO: 2826191 - RNA, 16 nt, Mycobacterium avium subsp. paratuberculosis
cgaaucccggccucgu

SEQ ID NO: 2826192 - RNA, 15 nt, Mycobacterium avium subsp. paratuberculosis
cgaauccgaccggcu

SEQ ID NO: 2826193 - RNA, 21 nt, Mycobacterium avium subsp. paratuberculosis
cgaauccgaguuggccggcac

SEQ ID NO: 2826194 - RNA, 17 nt, Mycobacterium avium subsp. paratuberculosis
cgaauccgauugcggcg

SEQ ID NO: 2826195 - RNA, 22 nt, Mycobacterium avium subsp. paratuberculosis
cgaauccgauugcggcgcaggc

SEQ ID NO: 2826196 - RNA, 14 nt, Mycobacterium avium subsp. paratuberculosis
cgaauccgcgggcg

SEQ ID NO: 2826197 - RNA, 13 nt, Mycobacterium avium subsp. paratuberculosis
cgaauccggcggc

SEQ ID NO: 2826198 - RNA, 15 nt, Mycobacterium avium subsp. paratuberculosis
cgaauccggcggcgc

SEQ ID NO: 2826199 - RNA, 18 nt, Mycobacterium avium subsp. paratuberculosis
cgaauccgggugucgacg

SEQ ID NO: 2826200 - RNA, 19 nt, Mycobacterium avium subsp. paratuberculosis
cgaauccgggugucgacgc

SEQ ID NO: 2826201 - RNA, 23 nt, Mycobacterium avium subsp. paratuberculosis
cgaauccuguugguagcccagga

SEQ ID NO: 2826202 - RNA, 14 nt, Mycobacterium avium subsp. paratuberculosis
cgaaucgccgagcu

SEQ ID NO: 2826203 - RNA, 17 nt, Mycobacterium avium subsp. paratuberculosis
cgaaucgccgagcucga

SEQ ID NO: 2826204 - RNA, 23 nt, Mycobacterium avium subsp. paratuberculosis
cgaaucgccuuggcucgggccau

SEQ ID NO: 2826205 - RNA, 17 nt, Mycobacterium avium subsp. paratuberculosis
cgaaucgggcugggucc

SEQ ID NO: 2826206 - RNA, 17 nt, Mycobacterium avium subsp. paratuberculosis
cgaaucgucgccgucca

SEQ ID NO: 2826207 - RNA, 17 nt, Mycobacterium avium subsp. paratuberculosis
cgaaucguugagcacca

SEQ ID NO: 2826208 - RNA, 19 nt, Mycobacterium avium subsp. paratuberculosis
cgaaucguugagcaccacg

SEQ ID NO: 2826209 - RNA, 20 nt, Mycobacterium avium subsp. paratuberculosis
cgaaucguugagcaccacga

SEQ ID NO: 2826210 - RNA, 23 nt, Mycobacterium avium subsp. paratuberculosis
cgaaucguugagcaccacgaggc

SEQ ID NO: 2826211 - RNA, 15 nt, Mycobacterium avium subsp. paratuberculosis
cgaaugacgcgcauc

SEQ ID NO: 2826212 - RNA, 24 nt, Mycobacterium avium subsp. paratuberculosis
cgacagauacuucgucgaacucca

SEQ ID NO: 2826213 - RNA, 16 nt, Mycobacterium avium subsp. paratuberculosis
cgacagaugcggcacc

SEQ ID NO: 2826214 - RNA, 20 nt, Mycobacterium avium subsp. paratuberculosis
cgacagaugcggcaccagcc

SEQ ID NO: 2826215 - RNA, 20 nt, Mycobacterium avium subsp. paratuberculosis
cgacagcaaaccgaccgccg

SEQ ID NO: 2826216 - RNA, 22 nt, Mycobacterium avium subsp. paratuberculosis
cgacagcaaaccgaccgccgcg

SEQ ID NO: 2826217 - RNA, 23 nt, Mycobacterium avium subsp. paratuberculosis
cgacagcaaaccgaccgccgcgg

SEQ ID NO: 2826218 - RNA, 23 nt, Mycobacterium avium subsp. paratuberculosis
cgacagcaacgccagggccccgu

SEQ ID NO: 2826219 - RNA, 16 nt, Mycobacterium avium subsp. paratuberculosis
cgacagcacccgcugc

SEQ ID NO: 2826220 - RNA, 14 nt, Mycobacterium avium subsp. paratuberculosis
cgacagcacccggc

SEQ ID NO: 2826221 - RNA, 19 nt, Mycobacterium avium subsp. paratuberculosis
cgacagcaccucgcccugc

SEQ ID NO: 2826222 - RNA, 22 nt, Mycobacterium avium subsp. paratuberculosis
cgacagcaccucgcccugcagc

SEQ ID NO: 2826223 - RNA, 14 nt, Mycobacterium avium subsp. paratuberculosis
cgacagcacgccgg

SEQ ID NO: 2826224 - RNA, 17 nt, Mycobacterium avium subsp. paratuberculosis
cgacagcacgccgggca

SEQ ID NO: 2826225 - RNA, 16 nt, Mycobacterium avium subsp. paratuberculosis
cgacagcacgggcggg

SEQ ID NO: 2826226 - RNA, 16 nt, Mycobacterium avium subsp. paratuberculosis
cgacagcagcgugguc

SEQ ID NO: 2826227 - RNA, 14 nt, Mycobacterium avium subsp. paratuberculosis
cgacagcagcucau

SEQ ID NO: 2826228 - RNA, 20 nt, Mycobacterium avium subsp. paratuberculosis
cgacagcagcucauacagcg

SEQ ID NO: 2826229 - RNA, 23 nt, Mycobacterium avium subsp. paratuberculosis
cgacagcagcucauacagcggcg

SEQ ID NO: 2826230 - RNA, 21 nt, Mycobacterium avium subsp. paratuberculosis
cgacagcaggaucuccggccg

SEQ ID NO: 2826231 - RNA, 22 nt, Mycobacterium avium subsp. paratuberculosis
cgacagcaggaucuccggccgg

SEQ ID NO: 2826232 - RNA, 24 nt, Mycobacterium avium subsp. paratuberculosis
cgacagcaggaucuccggccggug

SEQ ID NO: 2826233 - RNA, 18 nt, Mycobacterium avium subsp. paratuberculosis
cgacagccaaacagguug

SEQ ID NO: 2826234 - RNA, 16 nt, Mycobacterium avium subsp. paratuberculosis
cgacagcccccgcagc

SEQ ID NO: 2826235 - RNA, 13 nt, Mycobacterium avium subsp. paratuberculosis
cgacagcccgccc

SEQ ID NO: 2826236 - RNA, 14 nt, Mycobacterium avium subsp. paratuberculosis
cgacagcccgccca

SEQ ID NO: 2826237 - RNA, 15 nt, Mycobacterium avium subsp. paratuberculosis
cgacagccgcaccag

SEQ ID NO: 2826238 - RNA, 16 nt, Mycobacterium avium subsp. paratuberculosis
cgacagccgcaccaga

SEQ ID NO: 2826239 - RNA, 19 nt, Mycobacterium avium subsp. paratuberculosis
cgacagccgcaccggcgcc

SEQ ID NO: 2826240 - RNA, 21 nt, Mycobacterium avium subsp. paratuberculosis
cgacagccgcaccggcgccgc

SEQ ID NO: 2826241 - RNA, 22 nt, Mycobacterium avium subsp. paratuberculosis
cgacagccgcaccggcgccgcc

SEQ ID NO: 2826242 - RNA, 14 nt, Mycobacterium avium subsp. paratuberculosis
cgacagccgcccgg

SEQ ID NO: 2826243 - RNA, 15 nt, Mycobacterium avium subsp. paratuberculosis
cgacagccgcccggc

SEQ ID NO: 2826244 - RNA, 21 nt, Mycobacterium avium subsp. paratuberculosis
cgacagccgcccggcgccccg

SEQ ID NO: 2826245 - RNA, 14 nt, Mycobacterium avium subsp. paratuberculosis
cgacagccggacgg

SEQ ID NO: 2826246 - RNA, 23 nt, Mycobacterium avium subsp. paratuberculosis
cgacagccgggaaucgagggcgc

SEQ ID NO: 2826247 - RNA, 19 nt, Mycobacterium avium subsp. paratuberculosis
cgacagccugaccgcgggu

SEQ ID NO: 2826248 - RNA, 18 nt, Mycobacterium avium subsp. paratuberculosis
cgacagcgacaaucucgg

SEQ ID NO: 2826249 - RNA, 19 nt, Mycobacterium avium subsp. paratuberculosis
cgacagcgccugcccggag

SEQ ID NO: 2826250 - RNA, 13 nt, Mycobacterium avium subsp. paratuberculosis
cgacagcgcgucg

SEQ ID NO: 2826251 - RNA, 17 nt, Mycobacterium avium subsp. paratuberculosis
cgacagcgcgucggcga

SEQ ID NO: 2826252 - RNA, 22 nt, Mycobacterium avium subsp. paratuberculosis
cgacagcgggauguagccgguc

SEQ ID NO: 2826253 - RNA, 14 nt, Mycobacterium avium subsp. paratuberculosis
cgacagcuccaaca

SEQ ID NO: 2826254 - RNA, 16 nt, Mycobacterium avium subsp. paratuberculosis
cgacagcuccaacagc

SEQ ID NO: 2826255 - RNA, 20 nt, Mycobacterium avium subsp. paratuberculosis
cgacagcuccaacagccggu

SEQ ID NO: 2826256 - RNA, 15 nt, Mycobacterium avium subsp. paratuberculosis
cgacagcugagcagc

SEQ ID NO: 2826257 - RNA, 18 nt, Mycobacterium avium subsp. paratuberculosis
cgacagcugagcagcccg

SEQ ID NO: 2826258 - RNA, 22 nt, Mycobacterium avium subsp. paratuberculosis
cgacaggaaccuggucggggug

SEQ ID NO: 2826259 - RNA, 21 nt, Mycobacterium avium subsp. paratuberculosis
cgacaggaggguuuucggggc

SEQ ID NO: 2826260 - RNA, 22 nt, Mycobacterium avium subsp. paratuberculosis
cgacaggaggguuuucggggcg

SEQ ID NO: 2826261 - RNA, 17 nt, Mycobacterium avium subsp. paratuberculosis
cgacaggaucgacaacg

SEQ ID NO: 2826262 - RNA, 19 nt, Mycobacterium avium subsp. paratuberculosis
cgacaggaugcuggggucg

SEQ ID NO: 2826263 - RNA, 20 nt, Mycobacterium avium subsp. paratuberculosis
cgacaggaugcuggggucgg

SEQ ID NO: 2826264 - RNA, 14 nt, Mycobacterium avium subsp. paratuberculosis
cgacaggcagcccg

SEQ ID NO: 2826265 - RNA, 17 nt, Mycobacterium avium subsp. paratuberculosis
cgacaggcagcccggcu

SEQ ID NO: 2826266 - RNA, 19 nt, Mycobacterium avium subsp. paratuberculosis
cgacaggcagcccggcugc

SEQ ID NO: 2826267 - RNA, 20 nt, Mycobacterium avium subsp. paratuberculosis
cgacaggcagcccggcugcg

SEQ ID NO: 2826268 - RNA, 21 nt, Mycobacterium avium subsp. paratuberculosis
cgacaggcagcccggcugcgc

SEQ ID NO: 2826269 - RNA, 21 nt, Mycobacterium avium subsp. paratuberculosis
cgacaggcccacccacucgga

SEQ ID NO: 2826270 - RNA, 15 nt, Mycobacterium avium subsp. paratuberculosis
cgacagggccagcgc

SEQ ID NO: 2826271 - RNA, 22 nt, Mycobacterium avium subsp. paratuberculosis
cgacagggccagcgccaugccg

SEQ ID NO: 2826272 - RNA, 21 nt, Mycobacterium avium subsp. paratuberculosis
cgacagggugccaaggucgcc

SEQ ID NO: 2826273 - RNA, 23 nt, Mycobacterium avium subsp. paratuberculosis
cgacagggugccaaggucgccgg

SEQ ID NO: 2826274 - RNA, 18 nt, Mycobacterium avium subsp. paratuberculosis
cgacagggugccgaacag

SEQ ID NO: 2826275 - RNA, 19 nt, Mycobacterium avium subsp. paratuberculosis
cgacagggugccgaacagc

SEQ ID NO: 2826276 - RNA, 20 nt, Mycobacterium avium subsp. paratuberculosis
cgacagggugccgaacagcg

SEQ ID NO: 2826277 - RNA, 18 nt, Mycobacterium avium subsp. paratuberculosis
cgacagguagcaggcgcg

SEQ ID NO: 2826278 - RNA, 21 nt, Mycobacterium avium subsp. paratuberculosis
cgacagguagcaggcgcgcag

SEQ ID NO: 2826279 - RNA, 17 nt, Mycobacterium avium subsp. paratuberculosis
cgacaggucgaagggca

SEQ ID NO: 2826280 - RNA, 14 nt, Mycobacterium avium subsp. paratuberculosis
cgacaggucgagca

SEQ ID NO: 2826281 - RNA, 15 nt, Mycobacterium avium subsp. paratuberculosis
cgacaggucgagcac

SEQ ID NO: 2826282 - RNA, 17 nt, Mycobacterium avium subsp. paratuberculosis
cgacaggucgagcacca

SEQ ID NO: 2826283 - RNA, 21 nt, Mycobacterium avium subsp. paratuberculosis
cgacaggucgagcaccagguc

SEQ ID NO: 2826284 - RNA, 13 nt, Mycobacterium avium subsp. paratuberculosis
cgacaggucggcg

SEQ ID NO: 2826285 - RNA, 14 nt, Mycobacterium avium subsp. paratuberculosis
cgacaggucggcgg

SEQ ID NO: 2826286 - RNA, 17 nt, Mycobacterium avium subsp. paratuberculosis
cgacaggucggcggucg

SEQ ID NO: 2826287 - RNA, 22 nt, Mycobacterium avium subsp. paratuberculosis
cgacagguucuuggcggccugc

SEQ ID NO: 2826288 - RNA, 23 nt, Mycobacterium avium subsp. paratuberculosis
cgacagguucuuggcggccugcu

SEQ ID NO: 2826289 - RNA, 22 nt, Mycobacterium avium subsp. paratuberculosis
cgacagucccgcguugugcacc

SEQ ID NO: 2826290 - RNA, 14 nt, Mycobacterium avium subsp. paratuberculosis
cgacagucgcgggc

SEQ ID NO: 2826291 - RNA, 15 nt, Mycobacterium avium subsp. paratuberculosis
cgacagucgcgggca

SEQ ID NO: 2826292 - RNA, 16 nt, Mycobacterium avium subsp. paratuberculosis
cgacagucgcgggcga

SEQ ID NO: 2826293 - RNA, 16 nt, Mycobacterium avium subsp. paratuberculosis
cgacagucgcgggcgg

SEQ ID NO: 2826294 - RNA, 20 nt, Mycobacterium avium subsp. paratuberculosis
cgacagucgcgggcggggcg

SEQ ID NO: 2826295 - RNA, 21 nt, Mycobacterium avium subsp. paratuberculosis
cgacagucgcgggcggggcgc

SEQ ID NO: 2826296 - RNA, 13 nt, Mycobacterium avium subsp. paratuberculosis
cgaccaccgccgg

SEQ ID NO: 2826297 - RNA, 20 nt, Mycobacterium avium subsp. paratuberculosis
cgaccaccgccggcccggcg

SEQ ID NO: 2826298 - RNA, 14 nt, Mycobacterium avium subsp. paratuberculosis
cgaccaccggccga

SEQ ID NO: 2826299 - RNA, 15 nt, Mycobacterium avium subsp. paratuberculosis
cgaccaccggccgac

SEQ ID NO: 2826300 - RNA, 21 nt, Mycobacterium avium subsp. paratuberculosis
cgaccaccggguagcccgcgu

SEQ ID NO: 2826301 - RNA, 23 nt, Mycobacterium avium subsp. paratuberculosis
cgaccaccggguagcccgcgugc

SEQ ID NO: 2826302 - RNA, 17 nt, Mycobacterium avium subsp. paratuberculosis
cgaccaccucaccugcg

SEQ ID NO: 2826303 - RNA, 16 nt, Mycobacterium avium subsp. paratuberculosis
cgaccaccucggcgac

SEQ ID NO: 2826304 - RNA, 17 nt, Mycobacterium avium subsp. paratuberculosis
cgaccaccucggcgacg

SEQ ID NO: 2826305 - RNA, 20 nt, Mycobacterium avium subsp. paratuberculosis
cgaccaccucuucgcggucc

SEQ ID NO: 2826306 - RNA, 24 nt, Mycobacterium avium subsp. paratuberculosis
cgaccaccucuucgcgguccaucu

SEQ ID NO: 2826307 - RNA, 19 nt, Mycobacterium avium subsp. paratuberculosis
cgaccaccuugcgcagcag

SEQ ID NO: 2826308 - RNA, 17 nt, Mycobacterium avium subsp. paratuberculosis
cgaccacgaacaccggc

SEQ ID NO: 2826309 - RNA, 20 nt, Mycobacterium avium subsp. paratuberculosis
cgaccacgaacaccggcgcg

SEQ ID NO: 2826310 - RNA, 21 nt, Mycobacterium avium subsp. paratuberculosis
cgaccacgaacaccggcgcga

SEQ ID NO: 2826311 - RNA, 17 nt, Mycobacterium avium subsp. paratuberculosis
cgaccacgaagggcgcc

SEQ ID NO: 2826312 - RNA, 19 nt, Mycobacterium avium subsp. paratuberculosis
cgaccacgaagggcgccag

SEQ ID NO: 2826313 - RNA, 20 nt, Mycobacterium avium subsp. paratuberculosis
cgaccacgaagggcgccagc

SEQ ID NO: 2826314 - RNA, 22 nt, Mycobacterium avium subsp. paratuberculosis
cgaccacgaagggcgccagcac

SEQ ID NO: 2826315 - RNA, 14 nt, Mycobacterium avium subsp. paratuberculosis
cgaccacgaccggg

SEQ ID NO: 2826316 - RNA, 17 nt, Mycobacterium avium subsp. paratuberculosis
cgaccacgaccgggucu

SEQ ID NO: 2826317 - RNA, 19 nt, Mycobacterium avium subsp. paratuberculosis
cgaccacgaccgggucugc

SEQ ID NO: 2826318 - RNA, 18 nt, Mycobacterium avium subsp. paratuberculosis
cgaccacgcacaccaccg

SEQ ID NO: 2826319 - RNA, 19 nt, Mycobacterium avium subsp. paratuberculosis
cgaccacgcacaccaccga

SEQ ID NO: 2826320 - RNA, 23 nt, Mycobacterium avium subsp. paratuberculosis
cgaccacgcacaccaccgacgcg

SEQ ID NO: 2826321 - RNA, 14 nt, Mycobacterium avium subsp. paratuberculosis
cgaccacgccgcgc

SEQ ID NO: 2826322 - RNA, 20 nt, Mycobacterium avium subsp. paratuberculosis
cgaccacgccgcgcuugacg

SEQ ID NO: 2826323 - RNA, 15 nt, Mycobacterium avium subsp. paratuberculosis
cgaccacgccgcggu

SEQ ID NO: 2826324 - RNA, 17 nt, Mycobacterium avium subsp. paratuberculosis
cgaccacgccgcggucg

SEQ ID NO: 2826325 - RNA, 15 nt, Mycobacterium avium subsp. paratuberculosis
cgaccacggccccag

SEQ ID NO: 2826326 - RNA, 16 nt, Mycobacterium avium subsp. paratuberculosis
cgaccacggccccagc

SEQ ID NO: 2826327 - RNA, 14 nt, Mycobacterium avium subsp. paratuberculosis
cgaccacggccggu

SEQ ID NO: 2826328 - RNA, 17 nt, Mycobacterium avium subsp. paratuberculosis
cgaccacggccgguccg

SEQ ID NO: 2826329 - RNA, 17 nt, Mycobacterium avium subsp. paratuberculosis
cgaccacguccagcugg

SEQ ID NO: 2826330 - RNA, 18 nt, Mycobacterium avium subsp. paratuberculosis
cgaccagauaggccagcg

SEQ ID NO: 2826331 - RNA, 23 nt, Mycobacterium avium subsp. paratuberculosis
cgaccagauugcggcaccagucg

SEQ ID NO: 2826332 - RNA, 12 nt, Mycobacterium avium subsp. paratuberculosis
cgaccagcaccc

SEQ ID NO: 2826333 - RNA, 13 nt, Mycobacterium avium subsp. paratuberculosis
cgaccagcaccgc

SEQ ID NO: 2826334 - RNA, 16 nt, Mycobacterium avium subsp. paratuberculosis
cgaccagcaccgcauc

SEQ ID NO: 2826335 - RNA, 14 nt, Mycobacterium avium subsp. paratuberculosis
cgaccagcaccgcg

SEQ ID NO: 2826336 - RNA, 16 nt, Mycobacterium avium subsp. paratuberculosis
cgaccagcaccgcggc

SEQ ID NO: 2826337 - RNA, 17 nt, Mycobacterium avium subsp. paratuberculosis
cgaccagcaccgcggcg

SEQ ID NO: 2826338 - RNA, 19 nt, Mycobacterium avium subsp. paratuberculosis
cgaccagcaccgcggcgua

SEQ ID NO: 2826339 - RNA, 11 nt, Mycobacterium avium subsp. paratuberculosis
cgaccagcagg

SEQ ID NO: 2826340 - RNA, 18 nt, Mycobacterium avium subsp. paratuberculosis
cgaccagcaggacgcgcc

SEQ ID NO: 2826341 - RNA, 22 nt, Mycobacterium avium subsp. paratuberculosis
cgaccagcaggacgcgcccggc

SEQ ID NO: 2826342 - RNA, 17 nt, Mycobacterium avium subsp. paratuberculosis
cgaccagcccccgcggg

SEQ ID NO: 2826343 - RNA, 21 nt, Mycobacterium avium subsp. paratuberculosis
cgaccagcccggccgccgagg

SEQ ID NO: 2826344 - RNA, 15 nt, Mycobacterium avium subsp. paratuberculosis
cgaccagccgaggcg

SEQ ID NO: 2826345 - RNA, 22 nt, Mycobacterium avium subsp. paratuberculosis
cgaccagccgaggcgcucgcac

SEQ ID NO: 2826346 - RNA, 14 nt, Mycobacterium avium subsp. paratuberculosis
cgaccagccgcauc

SEQ ID NO: 2826347 - RNA, 13 nt, Mycobacterium avium subsp. paratuberculosis
cgaccagccgggu

SEQ ID NO: 2826348 - RNA, 16 nt, Mycobacterium avium subsp. paratuberculosis
cgaccagccggguccg

SEQ ID NO: 2826349 - RNA, 14 nt, Mycobacterium avium subsp. paratuberculosis
cgaccagccggugg

SEQ ID NO: 2826350 - RNA, 14 nt, Mycobacterium avium subsp. paratuberculosis
cgaccagcgacggc

SEQ ID NO: 2826351 - RNA, 15 nt, Mycobacterium avium subsp. paratuberculosis
cgaccagcgacggca

SEQ ID NO: 2826352 - RNA, 16 nt, Mycobacterium avium subsp. paratuberculosis
cgaccagcgacggcag

SEQ ID NO: 2826353 - RNA, 17 nt, Mycobacterium avium subsp. paratuberculosis
cgaccagcgacggcagg

SEQ ID NO: 2826354 - RNA, 14 nt, Mycobacterium avium subsp. paratuberculosis
cgaccagcgagccc

SEQ ID NO: 2826355 - RNA, 15 nt, Mycobacterium avium subsp. paratuberculosis
cgaccagcgagccca

SEQ ID NO: 2826356 - RNA, 22 nt, Mycobacterium avium subsp. paratuberculosis
cgaccagcgagcccagcugcgc

SEQ ID NO: 2826357 - RNA, 12 nt, Mycobacterium avium subsp. paratuberculosis
cgaccagcgccg

SEQ ID NO: 2826358 - RNA, 14 nt, Mycobacterium avium subsp. paratuberculosis
cgaccagcgccgag

SEQ ID NO: 2826359 - RNA, 23 nt, Mycobacterium avium subsp. paratuberculosis
cgaccagcgccgagaccagccag

SEQ ID NO: 2826360 - RNA, 12 nt, Mycobacterium avium subsp. paratuberculosis
cgaccagcgcga

SEQ ID NO: 2826361 - RNA, 12 nt, Mycobacterium avium subsp. paratuberculosis
cgaccagcgcgc

SEQ ID NO: 2826362 - RNA, 13 nt, Mycobacterium avium subsp. paratuberculosis
cgaccagcgcgcc

SEQ ID NO: 2826363 - RNA, 16 nt, Mycobacterium avium subsp. paratuberculosis
cgaccagcgcgccgcc

SEQ ID NO: 2826364 - RNA, 19 nt, Mycobacterium avium subsp. paratuberculosis
cgaccagcgcgccgcccag

SEQ ID NO: 2826365 - RNA, 20 nt, Mycobacterium avium subsp. paratuberculosis
cgaccagcgcgccgcccagc

SEQ ID NO: 2826366 - RNA, 22 nt, Mycobacterium avium subsp. paratuberculosis
cgaccagcgcgccgcccagcgg

SEQ ID NO: 2826367 - RNA, 20 nt, Mycobacterium avium subsp. paratuberculosis
cgaccagcgcgccggccagc

SEQ ID NO: 2826368 - RNA, 15 nt, Mycobacterium avium subsp. paratuberculosis
cgaccagcgcguuga

SEQ ID NO: 2826369 - RNA, 20 nt, Mycobacterium avium subsp. paratuberculosis
cgaccagcgcguugaugacg

SEQ ID NO: 2826370 - RNA, 12 nt, Mycobacterium avium subsp. paratuberculosis
cgaccagcggca

SEQ ID NO: 2826371 - RNA, 17 nt, Mycobacterium avium subsp. paratuberculosis
cgaccagcggcagcacg

SEQ ID NO: 2826372 - RNA, 18 nt, Mycobacterium avium subsp. paratuberculosis
cgaccagcggcagcacgu

SEQ ID NO: 2826373 - RNA, 16 nt, Mycobacterium avium subsp. paratuberculosis
cgaccagcggcagcag

SEQ ID NO: 2826374 - RNA, 18 nt, Mycobacterium avium subsp. paratuberculosis
cgaccagcggcagcagca

SEQ ID NO: 2826375 - RNA, 20 nt, Mycobacterium avium subsp. paratuberculosis
cgaccagcggcagcagcacc

SEQ ID NO: 2826376 - RNA, 21 nt, Mycobacterium avium subsp. paratuberculosis
cgaccagcggcagcagcacca

SEQ ID NO: 2826377 - RNA, 22 nt, Mycobacterium avium subsp. paratuberculosis
cgaccagcggcagcagcaccag

SEQ ID NO: 2826378 - RNA, 14 nt, Mycobacterium avium subsp. paratuberculosis
cgaccagcgggaug

SEQ ID NO: 2826379 - RNA, 20 nt, Mycobacterium avium subsp. paratuberculosis
cgaccagcgggccgacagca

SEQ ID NO: 2826380 - RNA, 22 nt, Mycobacterium avium subsp. paratuberculosis
cgaccagcgggccgacagcacg

SEQ ID NO: 2826381 - RNA, 17 nt, Mycobacterium avium subsp. paratuberculosis
cgaccgacccggccagc

SEQ ID NO: 2826382 - RNA, 21 nt, Mycobacterium avium subsp. paratuberculosis
cgaccgacccggccagcggca

SEQ ID NO: 2826383 - RNA, 19 nt, Mycobacterium avium subsp. paratuberculosis
cgaccgacgcggucaccgg

SEQ ID NO: 2826384 - RNA, 13 nt, Mycobacterium avium subsp. paratuberculosis
cgaccgagggcgc

SEQ ID NO: 2826385 - RNA, 14 nt, Mycobacterium avium subsp. paratuberculosis
cgaccgagggcgcg

SEQ ID NO: 2826386 - RNA, 15 nt, Mycobacterium avium subsp. paratuberculosis
cgaccgaucagcgga

SEQ ID NO: 2826387 - RNA, 18 nt, Mycobacterium avium subsp. paratuberculosis
cgaccgcaagugcgguca

SEQ ID NO: 2826388 - RNA, 18 nt, Mycobacterium avium subsp. paratuberculosis
cgaccgcaccgaccagcg

SEQ ID NO: 2826389 - RNA, 19 nt, Mycobacterium avium subsp. paratuberculosis
cgaccgcaccgaccagcgg

SEQ ID NO: 2826390 - RNA, 14 nt, Mycobacterium avium subsp. paratuberculosis
cgaccgcagcaggc

SEQ ID NO: 2826391 - RNA, 17 nt, Mycobacterium avium subsp. paratuberculosis
cgaccgcaggucgaugg

SEQ ID NO: 2826392 - RNA, 15 nt, Mycobacterium avium subsp. paratuberculosis
cgaccgccaccaccc

SEQ ID NO: 2826393 - RNA, 16 nt, Mycobacterium avium subsp. paratuberculosis
cgaccgccaccacccg

SEQ ID NO: 2826394 - RNA, 17 nt, Mycobacterium avium subsp. paratuberculosis
cgaccgccaccacccgg

SEQ ID NO: 2826395 - RNA, 19 nt, Mycobacterium avium subsp. paratuberculosis
cgaccgccaccacccggcg

SEQ ID NO: 2826396 - RNA, 20 nt, Mycobacterium avium subsp. paratuberculosis
cgaccgccaccacccggcga

SEQ ID NO: 2826397 - RNA, 18 nt, Mycobacterium avium subsp. paratuberculosis
cgaccgccagcagcagcc

SEQ ID NO: 2826398 - RNA, 21 nt, Mycobacterium avium subsp. paratuberculosis
cgaccgccagcagcagccgcg

SEQ ID NO: 2826399 - RNA, 23 nt, Mycobacterium avium subsp. paratuberculosis
cgaccgccagcagcagccgcgcc

SEQ ID NO: 2826400 - RNA, 14 nt, Mycobacterium avium subsp. paratuberculosis
cgaccgccccgccg

SEQ ID NO: 2826401 - RNA, 15 nt, Mycobacterium avium subsp. paratuberculosis
cgaccgccccgccgg

SEQ ID NO: 2826402 - RNA, 22 nt, Mycobacterium avium subsp. paratuberculosis
cgaccgccccgccggugucggc

SEQ ID NO: 2826403 - RNA, 14 nt, Mycobacterium avium subsp. paratuberculosis
cgaccgccccgcua

SEQ ID NO: 2826404 - RNA, 12 nt, Mycobacterium avium subsp. paratuberculosis
cgaccgcccggg

SEQ ID NO: 2826405 - RNA, 16 nt, Mycobacterium avium subsp. paratuberculosis
cgaccgcccgggccag

SEQ ID NO: 2826406 - RNA, 21 nt, Mycobacterium avium subsp. paratuberculosis
cgaccgcccgggccaggcgcg

SEQ ID NO: 2826407 - RNA, 15 nt, Mycobacterium avium subsp. paratuberculosis
cgaccgcccggggcg

SEQ ID NO: 2826408 - RNA, 20 nt, Mycobacterium avium subsp. paratuberculosis
cgaccgccgagcgggcgauc

SEQ ID NO: 2826409 - RNA, 21 nt, Mycobacterium avium subsp. paratuberculosis
cgaccgccgagcgggcgaucu

SEQ ID NO: 2826410 - RNA, 12 nt, Mycobacterium avium subsp. paratuberculosis
cgaccgccgcca

SEQ ID NO: 2826411 - RNA, 14 nt, Mycobacterium avium subsp. paratuberculosis
cgaccgccgccgcg

SEQ ID NO: 2826412 - RNA, 15 nt, Mycobacterium avium subsp. paratuberculosis
cgaccgccgccgcga

SEQ ID NO: 2826413 - RNA, 17 nt, Mycobacterium avium subsp. paratuberculosis
cgaccgccgccgcgacc

SEQ ID NO: 2826414 - RNA, 12 nt, Mycobacterium avium subsp. paratuberculosis
cgaccgccgcgg

SEQ ID NO: 2826415 - RNA, 13 nt, Mycobacterium avium subsp. paratuberculosis
cgaccgccgcggc

SEQ ID NO: 2826416 - RNA, 14 nt, Mycobacterium avium subsp. paratuberculosis
cgaccgccgcggcc

SEQ ID NO: 2826417 - RNA, 15 nt, Mycobacterium avium subsp. paratuberculosis
cgaccgccgcggccg

SEQ ID NO: 2826418 - RNA, 16 nt, Mycobacterium avium subsp. paratuberculosis
cgaccgccgcggccgc

SEQ ID NO: 2826419 - RNA, 19 nt, Mycobacterium avium subsp. paratuberculosis
cgaccgccgcggccgccuu

SEQ ID NO: 2826420 - RNA, 19 nt, Mycobacterium avium subsp. paratuberculosis
cgaccgccgcuagaccgau

SEQ ID NO: 2826421 - RNA, 20 nt, Mycobacterium avium subsp. paratuberculosis
cgaccgccgcuagguuuggc

SEQ ID NO: 2826422 - RNA, 14 nt, Mycobacterium avium subsp. paratuberculosis
cgaccgccggacac

SEQ ID NO: 2826423 - RNA, 18 nt, Mycobacterium avium subsp. paratuberculosis
cgaccgccggacaccacc

SEQ ID NO: 2826424 - RNA, 22 nt, Mycobacterium avium subsp. paratuberculosis
cgaccgccggacaccaccgcgg

SEQ ID NO: 2826425 - RNA, 13 nt, Mycobacterium avium subsp. paratuberculosis
cgaccgccggugg

SEQ ID NO: 2826426 - RNA, 15 nt, Mycobacterium avium subsp. paratuberculosis
cgaccgccucgaugg

SEQ ID NO: 2826427 - RNA, 20 nt, Mycobacterium avium subsp. paratuberculosis
cgaccgccucgauggcccgc

SEQ ID NO: 2826428 - RNA, 24 nt, Mycobacterium avium subsp. paratuberculosis
cgaccgccucgauggcccgcucgg

SEQ ID NO: 2826429 - RNA, 24 nt, Mycobacterium avium subsp. paratuberculosis
cgaccgccucggauuccgcggaac

SEQ ID NO: 2826430 - RNA, 14 nt, Mycobacterium avium subsp. paratuberculosis
cgaccgccucgucg

SEQ ID NO: 2826431 - RNA, 16 nt, Mycobacterium avium subsp. paratuberculosis
cgaccgccucgucggg

SEQ ID NO: 2826432 - RNA, 14 nt, Mycobacterium avium subsp. paratuberculosis
cgaccgcgacgacc

SEQ ID NO: 2826433 - RNA, 15 nt, Mycobacterium avium subsp. paratuberculosis
cgaccgcgacgauca

SEQ ID NO: 2826434 - RNA, 16 nt, Mycobacterium avium subsp. paratuberculosis
cgaccgcgacgaucac

SEQ ID NO: 2826435 - RNA, 21 nt, Mycobacterium avium subsp. paratuberculosis
cgaccgcgacgaucacggugu

SEQ ID NO: 2826436 - RNA, 14 nt, Mycobacterium avium subsp. paratuberculosis
cgaccgcgacggcg

SEQ ID NO: 2826437 - RNA, 17 nt, Mycobacterium avium subsp. paratuberculosis
cgaccgcgacggcgccc

SEQ ID NO: 2826438 - RNA, 15 nt, Mycobacterium avium subsp. paratuberculosis
cgaccgcgacggugg

SEQ ID NO: 2826439 - RNA, 18 nt, Mycobacterium avium subsp. paratuberculosis
cgaccgcgacgguggacc

SEQ ID NO: 2826440 - RNA, 20 nt, Mycobacterium avium subsp. paratuberculosis
cgaccgcgacgguggacccg

SEQ ID NO: 2826441 - RNA, 21 nt, Mycobacterium avium subsp. paratuberculosis
cgaccgcgaucagggccgcgg

SEQ ID NO: 2826442 - RNA, 22 nt, Mycobacterium avium subsp. paratuberculosis
cgaccgcgaucagggccgcggc

SEQ ID NO: 2826443 - RNA, 11 nt, Mycobacterium avium subsp. paratuberculosis
cgaccgcgaug

SEQ ID NO: 2826444 - RNA, 14 nt, Mycobacterium avium subsp. paratuberculosis
cgaccgcgaugcag

SEQ ID NO: 2826445 - RNA, 15 nt, Mycobacterium avium subsp. paratuberculosis
cgaccgcgaugcaga

SEQ ID NO: 2826446 - RNA, 22 nt, Mycobacterium avium subsp. paratuberculosis
cgaccgcgaugcagaacagccg

SEQ ID NO: 2826447 - RNA, 19 nt, Mycobacterium avium subsp. paratuberculosis
cgaccgcgaugcgacaccg

SEQ ID NO: 2826448 - RNA, 13 nt, Mycobacterium avium subsp. paratuberculosis
cgaccgcgcaccg

SEQ ID NO: 2826449 - RNA, 14 nt, Mycobacterium avium subsp. paratuberculosis
cgaccgcgcaccgg

SEQ ID NO: 2826450 - RNA, 15 nt, Mycobacterium avium subsp. paratuberculosis
cgaccgcgcaccggc

SEQ ID NO: 2826451 - RNA, 19 nt, Mycobacterium avium subsp. paratuberculosis
cgaccgcgcaggcggcgac

SEQ ID NO: 2826452 - RNA, 22 nt, Mycobacterium avium subsp. paratuberculosis
cgaccgcgcaggcggcgacggc

SEQ ID NO: 2826453 - RNA, 23 nt, Mycobacterium avium subsp. paratuberculosis
cgaccgcgcaggcggcgacggcc

SEQ ID NO: 2826454 - RNA, 13 nt, Mycobacterium avium subsp. paratuberculosis
cgaccgcgccgaa

SEQ ID NO: 2826455 - RNA, 14 nt, Mycobacterium avium subsp. paratuberculosis
cgaccgcgccgggg

SEQ ID NO: 2826456 - RNA, 21 nt, Mycobacterium avium subsp. paratuberculosis
cgaccgcgccggggugggcca

SEQ ID NO: 2826457 - RNA, 14 nt, Mycobacterium avium subsp. paratuberculosis
cgaccgcgcgcggc

SEQ ID NO: 2826458 - RNA, 16 nt, Mycobacterium avium subsp. paratuberculosis
cgaccgcgcgcggcgc

SEQ ID NO: 2826459 - RNA, 21 nt, Mycobacterium avium subsp. paratuberculosis
cgaccgcgcgcggcgccgcgu

SEQ ID NO: 2826460 - RNA, 23 nt, Mycobacterium avium subsp. paratuberculosis
cgaccgcgcgcggcgccgcguac

SEQ ID NO: 2826461 - RNA, 13 nt, Mycobacterium avium subsp. paratuberculosis
cgaccgcgcggcg

SEQ ID NO: 2826462 - RNA, 14 nt, Mycobacterium avium subsp. paratuberculosis
cgaccgcggaugac

SEQ ID NO: 2826463 - RNA, 15 nt, Mycobacterium avium subsp. paratuberculosis
cgaccgcggccgcga

SEQ ID NO: 2826464 - RNA, 17 nt, Mycobacterium avium subsp. paratuberculosis
cgaccgcggccgcgacg

SEQ ID NO: 2826465 - RNA, 18 nt, Mycobacterium avium subsp. paratuberculosis
cgaccgcggccuggguga

SEQ ID NO: 2826466 - RNA, 16 nt, Mycobacterium avium subsp. paratuberculosis
cgaccuccacgagccg

SEQ ID NO: 2826467 - RNA, 20 nt, Mycobacterium avium subsp. paratuberculosis
cgaccuccacgagccggucg

SEQ ID NO: 2826468 - RNA, 13 nt, Mycobacterium avium subsp. paratuberculosis
cgaccucccccga

SEQ ID NO: 2826469 - RNA, 18 nt, Mycobacterium avium subsp. paratuberculosis
cgaccucccccgacgccg

SEQ ID NO: 2826470 - RNA, 17 nt, Mycobacterium avium subsp. paratuberculosis
cgaccuccgugccgaug

SEQ ID NO: 2826471 - RNA, 18 nt, Mycobacterium avium subsp. paratuberculosis
cgaccuccgugccgaugg

SEQ ID NO: 2826472 - RNA, 17 nt, Mycobacterium avium subsp. paratuberculosis
cgaccuccucgaccccg

SEQ ID NO: 2826473 - RNA, 13 nt, Mycobacterium avium subsp. paratuberculosis
cgaccucgaacac

SEQ ID NO: 2826474 - RNA, 22 nt, Mycobacterium avium subsp. paratuberculosis
cgaccucgaagaagagggcgug

SEQ ID NO: 2826475 - RNA, 17 nt, Mycobacterium avium subsp. paratuberculosis
cgaccucgagcgucacg

SEQ ID NO: 2826476 - RNA, 13 nt, Mycobacterium avium subsp. paratuberculosis
cgaccucgaggcc

SEQ ID NO: 2826477 - RNA, 16 nt, Mycobacterium avium subsp. paratuberculosis
cgaccucgaucagucg

SEQ ID NO: 2826478 - RNA, 15 nt, Mycobacterium avium subsp. paratuberculosis
cgaccucgcccgccg

SEQ ID NO: 2826479 - RNA, 18 nt, Mycobacterium avium subsp. paratuberculosis
cgaccucgcccgccgcga

SEQ ID NO: 2826480 - RNA, 20 nt, Mycobacterium avium subsp. paratuberculosis
cgaccucgcccgccgcgacg

SEQ ID NO: 2826481 - RNA, 14 nt, Mycobacterium avium subsp. paratuberculosis
cgaccucgccgacg

SEQ ID NO: 2826482 - RNA, 15 nt, Mycobacterium avium subsp. paratuberculosis
cgaccucgccgacgu

SEQ ID NO: 2826483 - RNA, 17 nt, Mycobacterium avium subsp. paratuberculosis
cgaccucgcgcgucacg

SEQ ID NO: 2826484 - RNA, 12 nt, Mycobacterium avium subsp. paratuberculosis
cgaccucggcca

SEQ ID NO: 2826485 - RNA, 16 nt, Mycobacterium avium subsp. paratuberculosis
cgaccucggccaccac

SEQ ID NO: 2826486 - RNA, 22 nt, Mycobacterium avium subsp. paratuberculosis
cgaccucggccaccaccucgcg

SEQ ID NO: 2826487 - RNA, 15 nt, Mycobacterium avium subsp. paratuberculosis
cgaccucggccagcg

SEQ ID NO: 2826488 - RNA, 16 nt, Mycobacterium avium subsp. paratuberculosis
cgaccucggccagcgu

SEQ ID NO: 2826489 - RNA, 17 nt, Mycobacterium avium subsp. paratuberculosis
cgaccucggccagcgug

SEQ ID NO: 2826490 - RNA, 12 nt, Mycobacterium avium subsp. paratuberculosis
cgaccucggcga

SEQ ID NO: 2826491 - RNA, 23 nt, Mycobacterium avium subsp. paratuberculosis
cgaccucggcgaccagcgacggc

SEQ ID NO: 2826492 - RNA, 14 nt, Mycobacterium avium subsp. paratuberculosis
cgaccucggcgacg

SEQ ID NO: 2826493 - RNA, 15 nt, Mycobacterium avium subsp. paratuberculosis
cgaccucggcgacga

SEQ ID NO: 2826494 - RNA, 13 nt, Mycobacterium avium subsp. paratuberculosis
cgaccucggcggc

SEQ ID NO: 2826495 - RNA, 14 nt, Mycobacterium avium subsp. paratuberculosis
cgaccucggcggcc

SEQ ID NO: 2826496 - RNA, 15 nt, Mycobacterium avium subsp. paratuberculosis
cgaccucggcggcca

SEQ ID NO: 2826497 - RNA, 21 nt, Mycobacterium avium subsp. paratuberculosis
cgaccucggcggccagcgcga

SEQ ID NO: 2826498 - RNA, 18 nt, Mycobacterium avium subsp. paratuberculosis
cgaccucggggucggccg

SEQ ID NO: 2826499 - RNA, 22 nt, Mycobacterium avium subsp. paratuberculosis
cgaccucggggucggccggauc

SEQ ID NO: 2826500 - RNA, 23 nt, Mycobacterium avium subsp. paratuberculosis
cgaccucggggucggccggaucg

SEQ ID NO: 2826501 - RNA, 13 nt, Mycobacterium avium subsp. paratuberculosis
cgaccucgggugu

SEQ ID NO: 2826502 - RNA, 23 nt, Mycobacterium avium subsp. paratuberculosis
cgaccucggugucgaggucgucg

SEQ ID NO: 2826503 - RNA, 13 nt, Mycobacterium avium subsp. paratuberculosis
cgaccucgucgac

SEQ ID NO: 2826504 - RNA, 21 nt, Mycobacterium avium subsp. paratuberculosis
cgaccucgucgacggcggcgu

SEQ ID NO: 2826505 - RNA, 14 nt, Mycobacterium avium subsp. paratuberculosis
cgaccucgucggcg

SEQ ID NO: 2826506 - RNA, 18 nt, Mycobacterium avium subsp. paratuberculosis
cgaccucgucggcggugc

SEQ ID NO: 2826507 - RNA, 14 nt, Mycobacterium avium subsp. paratuberculosis
cgaccucgucgucg

SEQ ID NO: 2826508 - RNA, 18 nt, Mycobacterium avium subsp. paratuberculosis
cgaccucgucgucgauga

SEQ ID NO: 2826509 - RNA, 16 nt, Mycobacterium avium subsp. paratuberculosis
cgaccucuucgcugga

SEQ ID NO: 2826510 - RNA, 21 nt, Mycobacterium avium subsp. paratuberculosis
cgaccucuucgcuggacagcc

SEQ ID NO: 2826511 - RNA, 14 nt, Mycobacterium avium subsp. paratuberculosis
cgaccucuucggcg

SEQ ID NO: 2826512 - RNA, 19 nt, Mycobacterium avium subsp. paratuberculosis
cgaccucuucggcgccggc

SEQ ID NO: 2826513 - RNA, 21 nt, Mycobacterium avium subsp. paratuberculosis
cgaccucuucggcgccggcau

SEQ ID NO: 2826514 - RNA, 23 nt, Mycobacterium avium subsp. paratuberculosis
cgaccugaucuucgagacacgcg

SEQ ID NO: 2826515 - RNA, 18 nt, Mycobacterium avium subsp. paratuberculosis
cgaccugauuucaucgcg

SEQ ID NO: 2826516 - RNA, 20 nt, Mycobacterium avium subsp. paratuberculosis
cgaccugauuucaucgcggc

SEQ ID NO: 2826517 - RNA, 21 nt, Mycobacterium avium subsp. paratuberculosis
cgaccugauuucaucgcggcg

SEQ ID NO: 2826518 - RNA, 24 nt, Mycobacterium avium subsp. paratuberculosis
cgaccugauuucaucgcggcgacc

SEQ ID NO: 2826519 - RNA, 16 nt, Mycobacterium avium subsp. paratuberculosis
cgaccugcccgggccc

SEQ ID NO: 2826520 - RNA, 17 nt, Mycobacterium avium subsp. paratuberculosis
cgaccugcccgggcccg

SEQ ID NO: 2826521 - RNA, 18 nt, Mycobacterium avium subsp. paratuberculosis
cgaccugcccgggcccga

SEQ ID NO: 2826522 - RNA, 14 nt, Mycobacterium avium subsp. paratuberculosis
cgaccugcgcgacg

SEQ ID NO: 2826523 - RNA, 15 nt, Mycobacterium avium subsp. paratuberculosis
cgaccugcgcgacgg

SEQ ID NO: 2826524 - RNA, 19 nt, Mycobacterium avium subsp. paratuberculosis
cgaccugcgcgacggcgcu

SEQ ID NO: 2826525 - RNA, 20 nt, Mycobacterium avium subsp. paratuberculosis
cgaccugcggcucgucggcg

SEQ ID NO: 2826526 - RNA, 11 nt, Mycobacterium avium subsp. paratuberculosis
cgaccugcggg

SEQ ID NO: 2826527 - RNA, 19 nt, Mycobacterium avium subsp. paratuberculosis
cgaccugcgggcccaccgc

SEQ ID NO: 2826528 - RNA, 22 nt, Mycobacterium avium subsp. paratuberculosis
cgaccugcgggcccaccgcgcg

SEQ ID NO: 2826529 - RNA, 23 nt, Mycobacterium avium subsp. paratuberculosis
cgaccugcgggcccaccgcgcgc

SEQ ID NO: 2826530 - RNA, 19 nt, Mycobacterium avium subsp. paratuberculosis
cgaccugcucgucggugac

SEQ ID NO: 2826531 - RNA, 17 nt, Mycobacterium avium subsp. paratuberculosis
cgaccugcuuggcggcc

SEQ ID NO: 2826532 - RNA, 16 nt, Mycobacterium avium subsp. paratuberculosis
cgaccuggacgccgca

SEQ ID NO: 2826533 - RNA, 17 nt, Mycobacterium avium subsp. paratuberculosis
cgaccuggacgccgcac

SEQ ID NO: 2826534 - RNA, 20 nt, Mycobacterium avium subsp. paratuberculosis
cgaccuggacgccgcacgcg

SEQ ID NO: 2826535 - RNA, 15 nt, Mycobacterium avium subsp. paratuberculosis
cgaccuggcggccgg

SEQ ID NO: 2826536 - RNA, 16 nt, Mycobacterium avium subsp. paratuberculosis
cgaccuggcggccgga

SEQ ID NO: 2826537 - RNA, 13 nt, Mycobacterium avium subsp. paratuberculosis
cgaccuggcgggc

SEQ ID NO: 2826538 - RNA, 15 nt, Mycobacterium avium subsp. paratuberculosis
cgaccuggcgggcca

SEQ ID NO: 2826539 - RNA, 18 nt, Mycobacterium avium subsp. paratuberculosis
cgaccuggcgggccagcu

SEQ ID NO: 2826540 - RNA, 20 nt, Mycobacterium avium subsp. paratuberculosis
cgaccuggcgggccagcuug

SEQ ID NO: 2826541 - RNA, 17 nt, Mycobacterium avium subsp. paratuberculosis
cgaccugggcgccgucg

SEQ ID NO: 2826542 - RNA, 16 nt, Mycobacterium avium subsp. paratuberculosis
cgaccugggcggccac

SEQ ID NO: 2826543 - RNA, 18 nt, Mycobacterium avium subsp. paratuberculosis
cgaccugggcggccaccg

SEQ ID NO: 2826544 - RNA, 23 nt, Mycobacterium avium subsp. paratuberculosis
cgaccugggcggccaccgcgccc

SEQ ID NO: 2826545 - RNA, 18 nt, Mycobacterium avium subsp. paratuberculosis
cgaccugguccaccgcgg

SEQ ID NO: 2826546 - RNA, 21 nt, Mycobacterium avium subsp. paratuberculosis
cgaccugguccaccgcggcgg

SEQ ID NO: 2826547 - RNA, 22 nt, Mycobacterium avium subsp. paratuberculosis
cgaccugguccaccgcggcggc

SEQ ID NO: 2826548 - RNA, 15 nt, Mycobacterium avium subsp. paratuberculosis
cgaccuggucgccga

SEQ ID NO: 2826549 - RNA, 20 nt, Mycobacterium avium subsp. paratuberculosis
cgaccuggucgccgaacgug

SEQ ID NO: 2826550 - RNA, 16 nt, Mycobacterium avium subsp. paratuberculosis
cgaccuggucgccgcc

SEQ ID NO: 2826551 - RNA, 14 nt, Mycobacterium avium subsp. paratuberculosis
cgacgacgccguca

SEQ ID NO: 2826552 - RNA, 15 nt, Mycobacterium avium subsp. paratuberculosis
cgacgacgccgucac

SEQ ID NO: 2826553 - RNA, 16 nt, Mycobacterium avium subsp. paratuberculosis
cgacgacgccgucacg

SEQ ID NO: 2826554 - RNA, 18 nt, Mycobacterium avium subsp. paratuberculosis
cgacgacgccgucacgga

SEQ ID NO: 2826555 - RNA, 14 nt, Mycobacterium avium subsp. paratuberculosis
cgacgacgcggucg

SEQ ID NO: 2826556 - RNA, 18 nt, Mycobacterium avium subsp. paratuberculosis
cgacgacggcgaacgucg

SEQ ID NO: 2826557 - RNA, 16 nt, Mycobacterium avium subsp. paratuberculosis
cgacgacggcgccgcg

SEQ ID NO: 2826558 - RNA, 19 nt, Mycobacterium avium subsp. paratuberculosis
cgacgacggcgccgcgucg

SEQ ID NO: 2826559 - RNA, 12 nt, Mycobacterium avium subsp. paratuberculosis
cgacgacggcgg

SEQ ID NO: 2826560 - RNA, 16 nt, Mycobacterium avium subsp. paratuberculosis
cgacgacggcggaguc

SEQ ID NO: 2826561 - RNA, 23 nt, Mycobacterium avium subsp. paratuberculosis
cgacgacggucuucccgccgccg

SEQ ID NO: 2826562 - RNA, 13 nt, Mycobacterium avium subsp. paratuberculosis
cgacgacgucgac

SEQ ID NO: 2826563 - RNA, 14 nt, Mycobacterium avium subsp. paratuberculosis
cgacgacgucgacg

SEQ ID NO: 2826564 - RNA, 15 nt, Mycobacterium avium subsp. paratuberculosis
cgacgacgucgacga

SEQ ID NO: 2826565 - RNA, 21 nt, Mycobacterium avium subsp. paratuberculosis
cgacgacgucgacgacccgua

SEQ ID NO: 2826566 - RNA, 14 nt, Mycobacterium avium subsp. paratuberculosis
cgacgacgucgcgc

SEQ ID NO: 2826567 - RNA, 17 nt, Mycobacterium avium subsp. paratuberculosis
cgacgacgugacgaccu

SEQ ID NO: 2826568 - RNA, 20 nt, Mycobacterium avium subsp. paratuberculosis
cgacgacgugacgaccuggu

SEQ ID NO: 2826569 - RNA, 22 nt, Mycobacterium avium subsp. paratuberculosis
cgacgacgugacgaccuggucg

SEQ ID NO: 2826570 - RNA, 14 nt, Mycobacterium avium subsp. paratuberculosis
cgacgacguggugg

SEQ ID NO: 2826571 - RNA, 14 nt, Mycobacterium avium subsp. paratuberculosis
cgacgacguugcgg

SEQ ID NO: 2826572 - RNA, 11 nt, Mycobacterium avium subsp. paratuberculosis
cgacgacuggg

SEQ ID NO: 2826573 - RNA, 20 nt, Mycobacterium avium subsp. paratuberculosis
cgacgacugggugcgcgggc

SEQ ID NO: 2826574 - RNA, 23 nt, Mycobacterium avium subsp. paratuberculosis
cgacgacugggugcgcgggcgcc

SEQ ID NO: 2826575 - RNA, 14 nt, Mycobacterium avium subsp. paratuberculosis
cgacgacuucggcc

SEQ ID NO: 2826576 - RNA, 20 nt, Mycobacterium avium subsp. paratuberculosis
cgacgagagcggaucggcgg

SEQ ID NO: 2826577 - RNA, 22 nt, Mycobacterium avium subsp. paratuberculosis
cgacgagagcggaucggcggcg

SEQ ID NO: 2826578 - RNA, 16 nt, Mycobacterium avium subsp. paratuberculosis
cgacgagaucagcacc

SEQ ID NO: 2826579 - RNA, 18 nt, Mycobacterium avium subsp. paratuberculosis
cgacgagaucagcaccag

SEQ ID NO: 2826580 - RNA, 20 nt, Mycobacterium avium subsp. paratuberculosis
cgacgagaucagcaccaggu

SEQ ID NO: 2826581 - RNA, 22 nt, Mycobacterium avium subsp. paratuberculosis
cgacgagaucagcaccaggugg

SEQ ID NO: 2826582 - RNA, 13 nt, Mycobacterium avium subsp. paratuberculosis
cgacgagcccgcc

SEQ ID NO: 2826583 - RNA, 17 nt, Mycobacterium avium subsp. paratuberculosis
cgacgagcccgccggcg

SEQ ID NO: 2826584 - RNA, 16 nt, Mycobacterium avium subsp. paratuberculosis
cgacgagcccgcgccc

SEQ ID NO: 2826585 - RNA, 15 nt, Mycobacterium avium subsp. paratuberculosis
cgacgagccgacgua

SEQ ID NO: 2826586 - RNA, 13 nt, Mycobacterium avium subsp. paratuberculosis
cgacgagccgggc

SEQ ID NO: 2826587 - RNA, 14 nt, Mycobacterium avium subsp. paratuberculosis
cgacgagcgggccg

SEQ ID NO: 2826588 - RNA, 14 nt, Mycobacterium avium subsp. paratuberculosis
cgacgagcucgccg

SEQ ID NO: 2826589 - RNA, 22 nt, Mycobacterium avium subsp. paratuberculosis
cgacgaggagaccuccugcugg

SEQ ID NO: 2826590 - RNA, 15 nt, Mycobacterium avium subsp. paratuberculosis
cgacgaggcgggcga

SEQ ID NO: 2826591 - RNA, 16 nt, Mycobacterium avium subsp. paratuberculosis
cgacgaggcgggcgau

SEQ ID NO: 2826592 - RNA, 21 nt, Mycobacterium avium subsp. paratuberculosis
cgacgaggcgggcgaucucga

SEQ ID NO: 2826593 - RNA, 20 nt, Mycobacterium avium subsp. paratuberculosis
cgacgaggugaugccgucca

SEQ ID NO: 2826594 - RNA, 20 nt, Mycobacterium avium subsp. paratuberculosis
cgacgagguugucccgggcg

SEQ ID NO: 2826595 - RNA, 22 nt, Mycobacterium avium subsp. paratuberculosis
cgacgagguugucccgggcgaa

SEQ ID NO: 2826596 - RNA, 13 nt, Mycobacterium avium subsp. paratuberculosis
cgacgagucgacg

SEQ ID NO: 2826597 - RNA, 14 nt, Mycobacterium avium subsp. paratuberculosis
cgacgagucgacgc

SEQ ID NO: 2826598 - RNA, 16 nt, Mycobacterium avium subsp. paratuberculosis
cgacgagucgccguug

SEQ ID NO: 2826599 - RNA, 21 nt, Mycobacterium avium subsp. paratuberculosis
cgacgauacgugcucccgccg

SEQ ID NO: 2826600 - RNA, 22 nt, Mycobacterium avium subsp. paratuberculosis
cgacgauacgugcucccgccga

SEQ ID NO: 2826601 - RNA, 15 nt, Mycobacterium avium subsp. paratuberculosis
cgacgauaucggccg

SEQ ID NO: 2826602 - RNA, 16 nt, Mycobacterium avium subsp. paratuberculosis
cgacgauaucggccgc

SEQ ID NO: 2826603 - RNA, 19 nt, Mycobacterium avium subsp. paratuberculosis
cgacgauaucggccgcggg

SEQ ID NO: 2826604 - RNA, 22 nt, Mycobacterium avium subsp. paratuberculosis
cgacgauaucggccgcggggcc

SEQ ID NO: 2826605 - RNA, 23 nt, Mycobacterium avium subsp. paratuberculosis
cgacgauaucggccgcggggccg

SEQ ID NO: 2826606 - RNA, 15 nt, Mycobacterium avium subsp. paratuberculosis
cgacgaucacggugu

SEQ ID NO: 2826607 - RNA, 21 nt, Mycobacterium avium subsp. paratuberculosis
cgacgaucagcagccgggccu

SEQ ID NO: 2826608 - RNA, 22 nt, Mycobacterium avium subsp. paratuberculosis
cgacgaucagcagccgggccug

SEQ ID NO: 2826609 - RNA, 18 nt, Mycobacterium avium subsp. paratuberculosis
cgacgaucccggcgagca

SEQ ID NO: 2826610 - RNA, 21 nt, Mycobacterium avium subsp. paratuberculosis
cgacgaucccggcgagcacgc

SEQ ID NO: 2826611 - RNA, 22 nt, Mycobacterium avium subsp. paratuberculosis
cgacgaucccggcgagcacgcc

SEQ ID NO: 2826612 - RNA, 19 nt, Mycobacterium avium subsp. paratuberculosis
cgacgauccgcgcccuggu

SEQ ID NO: 2826613 - RNA, 18 nt, Mycobacterium avium subsp. paratuberculosis
cgacgauccgcgccgcga

SEQ ID NO: 2826614 - RNA, 14 nt, Mycobacterium avium subsp. paratuberculosis
cgacgauccgggcc

SEQ ID NO: 2826615 - RNA, 16 nt, Mycobacterium avium subsp. paratuberculosis
cgacgauccgggccgg

SEQ ID NO: 2826616 - RNA, 23 nt, Mycobacterium avium subsp. paratuberculosis
cgacgauccgggccggucgguca

SEQ ID NO: 2826617 - RNA, 15 nt, Mycobacterium avium subsp. paratuberculosis
cgacgauccgggcgc

SEQ ID NO: 2826618 - RNA, 19 nt, Mycobacterium avium subsp. paratuberculosis
cgacgaucgcgacggccgg

SEQ ID NO: 2826619 - RNA, 22 nt, Mycobacterium avium subsp. paratuberculosis
cgacgaucgcgacggccggggc

SEQ ID NO: 2826620 - RNA, 16 nt, Mycobacterium avium subsp. paratuberculosis
cgacgaucgcgccggc

SEQ ID NO: 2826621 - RNA, 17 nt, Mycobacterium avium subsp. paratuberculosis
cgacgaucgcgccggcc

SEQ ID NO: 2826622 - RNA, 19 nt, Mycobacterium avium subsp. paratuberculosis
cgacgaucgcgccggccgc

SEQ ID NO: 2826623 - RNA, 17 nt, Mycobacterium avium subsp. paratuberculosis
cgacgaucggcucgagc

SEQ ID NO: 2826624 - RNA, 15 nt, Mycobacterium avium subsp. paratuberculosis
cgacgaucucguggg

SEQ ID NO: 2826625 - RNA, 18 nt, Mycobacterium avium subsp. paratuberculosis
cgacgaucugcacacggg

SEQ ID NO: 2826626 - RNA, 15 nt, Mycobacterium avium subsp. paratuberculosis
cgacgaucuugccga

SEQ ID NO: 2826627 - RNA, 19 nt, Mycobacterium avium subsp. paratuberculosis
cgacgaucuugccgaacag

SEQ ID NO: 2826628 - RNA, 22 nt, Mycobacterium avium subsp. paratuberculosis
cgacgaugaacagucggccggc

SEQ ID NO: 2826629 - RNA, 19 nt, Mycobacterium avium subsp. paratuberculosis
cgacgaugaagacccgccg

SEQ ID NO: 2826630 - RNA, 20 nt, Mycobacterium avium subsp. paratuberculosis
cgacgaugagggccagcagu

SEQ ID NO: 2826631 - RNA, 18 nt, Mycobacterium avium subsp. paratuberculosis
cgacgaugccggccggga

SEQ ID NO: 2826632 - RNA, 19 nt, Mycobacterium avium subsp. paratuberculosis
cgacgaugccggccgggac

SEQ ID NO: 2826633 - RNA, 20 nt, Mycobacterium avium subsp. paratuberculosis
cgacgaugccggccgggacg

SEQ ID NO: 2826634 - RNA, 20 nt, Mycobacterium avium subsp. paratuberculosis
cgacgaugccggcgucgucg

SEQ ID NO: 2826635 - RNA, 15 nt, Mycobacterium avium subsp. paratuberculosis
cgacgccgccgccga

SEQ ID NO: 2826636 - RNA, 14 nt, Mycobacterium avium subsp. paratuberculosis
cgacgccgccgucg

SEQ ID NO: 2826637 - RNA, 21 nt, Mycobacterium avium subsp. paratuberculosis
cgacgccgcgcagcggggcgc

SEQ ID NO: 2826638 - RNA, 17 nt, Mycobacterium avium subsp. paratuberculosis
cgacgccgcgcuggccg

SEQ ID NO: 2826639 - RNA, 12 nt, Mycobacterium avium subsp. paratuberculosis
cgacgccgcgga

SEQ ID NO: 2826640 - RNA, 22 nt, Mycobacterium avium subsp. paratuberculosis
cgacgccgcggaagccccaggc

SEQ ID NO: 2826641 - RNA, 23 nt, Mycobacterium avium subsp. paratuberculosis
cgacgccgcggaagccccaggcc

SEQ ID NO: 2826642 - RNA, 12 nt, Mycobacterium avium subsp. paratuberculosis
cgacgccgcugg

SEQ ID NO: 2826643 - RNA, 14 nt, Mycobacterium avium subsp. paratuberculosis
cgacgccgcugggc

SEQ ID NO: 2826644 - RNA, 15 nt, Mycobacterium avium subsp. paratuberculosis
cgacgccgcugggcg

SEQ ID NO: 2826645 - RNA, 24 nt, Mycobacterium avium subsp. paratuberculosis
cgacgccggaccccacagcgcgcc

SEQ ID NO: 2826646 - RNA, 12 nt, Mycobacterium avium subsp. paratuberculosis
cgacgccggcca

SEQ ID NO: 2826647 - RNA, 14 nt, Mycobacterium avium subsp. paratuberculosis
cgacgccggccacc

SEQ ID NO: 2826648 - RNA, 15 nt, Mycobacterium avium subsp. paratuberculosis
cgacgccggccacca

SEQ ID NO: 2826649 - RNA, 18 nt, Mycobacterium avium subsp. paratuberculosis
cgacgccggccaccaaca

SEQ ID NO: 2826650 - RNA, 14 nt, Mycobacterium avium subsp. paratuberculosis
cgacgccgggcagc

SEQ ID NO: 2826651 - RNA, 18 nt, Mycobacterium avium subsp. paratuberculosis
cgacgccgggcagcgcgc

SEQ ID NO: 2826652 - RNA, 12 nt, Mycobacterium avium subsp. paratuberculosis
cgacgccgggcg

SEQ ID NO: 2826653 - RNA, 14 nt, Mycobacterium avium subsp. paratuberculosis
cgacgccgggcgcc

SEQ ID NO: 2826654 - RNA, 18 nt, Mycobacterium avium subsp. paratuberculosis
cgacgccgggcgcccgcg

SEQ ID NO: 2826655 - RNA, 20 nt, Mycobacterium avium subsp. paratuberculosis
cgacgccggucucgaacacg

SEQ ID NO: 2826656 - RNA, 20 nt, Mycobacterium avium subsp. paratuberculosis
cgacgccguagaucacgccg

SEQ ID NO: 2826657 - RNA, 14 nt, Mycobacterium avium subsp. paratuberculosis
cgacgccgucacgg

SEQ ID NO: 2826658 - RNA, 14 nt, Mycobacterium avium subsp. paratuberculosis
cgacgccgucgagc

SEQ ID NO: 2826659 - RNA, 15 nt, Mycobacterium avium subsp. paratuberculosis
cgacgccgucgagcc

SEQ ID NO: 2826660 - RNA, 20 nt, Mycobacterium avium subsp. paratuberculosis
cgacgccgucgaugacgcgc

SEQ ID NO: 2826661 - RNA, 14 nt, Mycobacterium avium subsp. paratuberculosis
cgacgccgucgggg

SEQ ID NO: 2826662 - RNA, 12 nt, Mycobacterium avium subsp. paratuberculosis
cgacgccgugcu

SEQ ID NO: 2826663 - RNA, 20 nt, Mycobacterium avium subsp. paratuberculosis
cgacgccgugcugccggaac

SEQ ID NO: 2826664 - RNA, 19 nt, Mycobacterium avium subsp. paratuberculosis
cgacgccgugguccagccg

SEQ ID NO: 2826665 - RNA, 23 nt, Mycobacterium avium subsp. paratuberculosis
cgacgccuccacauacgcggcgg

SEQ ID NO: 2826666 - RNA, 14 nt, Mycobacterium avium subsp. paratuberculosis
cgacgccugcgcga

SEQ ID NO: 2826667 - RNA, 19 nt, Mycobacterium avium subsp. paratuberculosis
cgacgcgaacgcgccccgc

SEQ ID NO: 2826668 - RNA, 22 nt, Mycobacterium avium subsp. paratuberculosis
cgacgcgaacgcgccccgccgg

SEQ ID NO: 2826669 - RNA, 18 nt, Mycobacterium avium subsp. paratuberculosis
cgacgcgaccgaggucga

SEQ ID NO: 2826670 - RNA, 15 nt, Mycobacterium avium subsp. paratuberculosis
cgacgcgaccggccc

SEQ ID NO: 2826671 - RNA, 16 nt, Mycobacterium avium subsp. paratuberculosis
cgacgcgaccggcccg

SEQ ID NO: 2826672 - RNA, 17 nt, Mycobacterium avium subsp. paratuberculosis
cgacgcgaccggcccga

SEQ ID NO: 2826673 - RNA, 14 nt, Mycobacterium avium subsp. paratuberculosis
cgacgcgacgcgcu

SEQ ID NO: 2826674 - RNA, 22 nt, Mycobacterium avium subsp. paratuberculosis
cgacgcgacggucgugcugggc

SEQ ID NO: 2826675 - RNA, 24 nt, Mycobacterium avium subsp. paratuberculosis
cgacgcgacggucgugcugggccg

SEQ ID NO: 2826676 - RNA, 16 nt, Mycobacterium avium subsp. paratuberculosis
cgacgcgccacgcccc

SEQ ID NO: 2826677 - RNA, 21 nt, Mycobacterium avium subsp. paratuberculosis
cgacgcgccacgccccggcgc

SEQ ID NO: 2826678 - RNA, 13 nt, Mycobacterium avium subsp. paratuberculosis
cgacgcgccgcac

SEQ ID NO: 2826679 - RNA, 14 nt, Mycobacterium avium subsp. paratuberculosis
cgacgcgccgcacu

SEQ ID NO: 2826680 - RNA, 15 nt, Mycobacterium avium subsp. paratuberculosis
cgacgcgccgucggc

SEQ ID NO: 2826681 - RNA, 22 nt, Mycobacterium avium subsp. paratuberculosis
cgacgcgccgucggcccacggu

SEQ ID NO: 2826682 - RNA, 22 nt, Mycobacterium avium subsp. paratuberculosis
cgacgcgcggucgucuucuugg

SEQ ID NO: 2826683 - RNA, 17 nt, Mycobacterium avium subsp. paratuberculosis
cgacgcgcucagcccca

SEQ ID NO: 2826684 - RNA, 21 nt, Mycobacterium avium subsp. paratuberculosis
cgacgcgcucagccccagcgg

SEQ ID NO: 2826685 - RNA, 22 nt, Mycobacterium avium subsp. paratuberculosis
cgacgcgcucagccccagcgga

SEQ ID NO: 2826686 - RNA, 15 nt, Mycobacterium avium subsp. paratuberculosis
cgacgcgcucggcga

SEQ ID NO: 2826687 - RNA, 16 nt, Mycobacterium avium subsp. paratuberculosis
cgacgcgcucggcgac

SEQ ID NO: 2826688 - RNA, 17 nt, Mycobacterium avium subsp. paratuberculosis
cgacgcgcucggcgacc

SEQ ID NO: 2826689 - RNA, 19 nt, Mycobacterium avium subsp. paratuberculosis
cgacgcgcucggcgaccgc

SEQ ID NO: 2826690 - RNA, 22 nt, Mycobacterium avium subsp. paratuberculosis
cgacgcgcucggcgaccgccgg

SEQ ID NO: 2826691 - RNA, 15 nt, Mycobacterium avium subsp. paratuberculosis
cgacgcgcugcgcgc

SEQ ID NO: 2826692 - RNA, 17 nt, Mycobacterium avium subsp. paratuberculosis
cgacgcgcugcgcgccg

SEQ ID NO: 2826693 - RNA, 20 nt, Mycobacterium avium subsp. paratuberculosis
cgacgcgcugcgcgccgccc

SEQ ID NO: 2826694 - RNA, 16 nt, Mycobacterium avium subsp. paratuberculosis
cgacgcggcacgccgc

SEQ ID NO: 2826695 - RNA, 18 nt, Mycobacterium avium subsp. paratuberculosis
cgacgcggcacgccgcuc

SEQ ID NO: 2826696 - RNA, 19 nt, Mycobacterium avium subsp. paratuberculosis
cgacgcggcacgccgcucg

SEQ ID NO: 2826697 - RNA, 14 nt, Mycobacterium avium subsp. paratuberculosis
cgacgcggcgacca

SEQ ID NO: 2826698 - RNA, 18 nt, Mycobacterium avium subsp. paratuberculosis
cgacgcggcgaccaccac

SEQ ID NO: 2826699 - RNA, 20 nt, Mycobacterium avium subsp. paratuberculosis
cgacgcggcgaccaccaccg

SEQ ID NO: 2826700 - RNA, 13 nt, Mycobacterium avium subsp. paratuberculosis
cgacgcggcgcga

SEQ ID NO: 2826701 - RNA, 15 nt, Mycobacterium avium subsp. paratuberculosis
cgacgcggcgcgaca

SEQ ID NO: 2826702 - RNA, 17 nt, Mycobacterium avium subsp. paratuberculosis
cgacgcggcgcgacacc

SEQ ID NO: 2826703 - RNA, 19 nt, Mycobacterium avium subsp. paratuberculosis
cgacgcggcgcgacaccgc

SEQ ID NO: 2826704 - RNA, 22 nt, Mycobacterium avium subsp. paratuberculosis
cgacgcggcgcgacaccgcggc

SEQ ID NO: 2826705 - RNA, 13 nt, Mycobacterium avium subsp. paratuberculosis
cgacgcggcgcgc

SEQ ID NO: 2826706 - RNA, 14 nt, Mycobacterium avium subsp. paratuberculosis
cgacgcggcgcgcg

SEQ ID NO: 2826707 - RNA, 16 nt, Mycobacterium avium subsp. paratuberculosis
cgacgcggcgcgcgau

SEQ ID NO: 2826708 - RNA, 18 nt, Mycobacterium avium subsp. paratuberculosis
cgacgcggcgcgcgaugg

SEQ ID NO: 2826709 - RNA, 13 nt, Mycobacterium avium subsp. paratuberculosis
cgacgcggcggcc

SEQ ID NO: 2826710 - RNA, 14 nt, Mycobacterium avium subsp. paratuberculosis
cgacgcggcggccg

SEQ ID NO: 2826711 - RNA, 17 nt, Mycobacterium avium subsp. paratuberculosis
cgacgcggcucgcgcgg

SEQ ID NO: 2826712 - RNA, 19 nt, Mycobacterium avium subsp. paratuberculosis
cgacgcggcucgcgcggug

SEQ ID NO: 2826713 - RNA, 17 nt, Mycobacterium avium subsp. paratuberculosis
cgacgcgggcgacguca

SEQ ID NO: 2826714 - RNA, 14 nt, Mycobacterium avium subsp. paratuberculosis
cgacgcggggcggc

SEQ ID NO: 2826715 - RNA, 16 nt, Mycobacterium avium subsp. paratuberculosis
cgacgcggggcggcgg

SEQ ID NO: 2826716 - RNA, 18 nt, Mycobacterium avium subsp. paratuberculosis
cgacgcggggcggcggcg

SEQ ID NO: 2826717 - RNA, 20 nt, Mycobacterium avium subsp. paratuberculosis
cgacgcggggcggcggcgcc

SEQ ID NO: 2826718 - RNA, 22 nt, Mycobacterium avium subsp. paratuberculosis
cgacgcggggcggcggcgccgg

SEQ ID NO: 2826719 - RNA, 23 nt, Mycobacterium avium subsp. paratuberculosis
cgacgcggggcggcggcgccggg

SEQ ID NO: 2826720 - RNA, 13 nt, Mycobacterium avium subsp. paratuberculosis
cgacggccgccga

SEQ ID NO: 2826721 - RNA, 22 nt, Mycobacterium avium subsp. paratuberculosis
cgacggccgccgauuccggccg

SEQ ID NO: 2826722 - RNA, 20 nt, Mycobacterium avium subsp. paratuberculosis
cgacggccgccgcgacgccg

SEQ ID NO: 2826723 - RNA, 12 nt, Mycobacterium avium subsp. paratuberculosis
cgacggccgcgc

SEQ ID NO: 2826724 - RNA, 13 nt, Mycobacterium avium subsp. paratuberculosis
cgacggccgcgcc

SEQ ID NO: 2826725 - RNA, 14 nt, Mycobacterium avium subsp. paratuberculosis
cgacggccggcccu

SEQ ID NO: 2826726 - RNA, 16 nt, Mycobacterium avium subsp. paratuberculosis
cgacggccggcccugc

SEQ ID NO: 2826727 - RNA, 20 nt, Mycobacterium avium subsp. paratuberculosis
cgacggccggcgucacucug

SEQ ID NO: 2826728 - RNA, 13 nt, Mycobacterium avium subsp. paratuberculosis
cgacggccggggc

SEQ ID NO: 2826729 - RNA, 15 nt, Mycobacterium avium subsp. paratuberculosis
cgacggccggggcca

SEQ ID NO: 2826730 - RNA, 20 nt, Mycobacterium avium subsp. paratuberculosis
cgacggccggggccagcacc

SEQ ID NO: 2826731 - RNA, 21 nt, Mycobacterium avium subsp. paratuberculosis
cgacggccggggccagcaccc

SEQ ID NO: 2826732 - RNA, 15 nt, Mycobacterium avium subsp. paratuberculosis
cgacggccgggucag

SEQ ID NO: 2826733 - RNA, 13 nt, Mycobacterium avium subsp. paratuberculosis
cgacggccgguga

SEQ ID NO: 2826734 - RNA, 18 nt, Mycobacterium avium subsp. paratuberculosis
cgacggccguccggucgc

SEQ ID NO: 2826735 - RNA, 21 nt, Mycobacterium avium subsp. paratuberculosis
cgacggccguccggucgcugg

SEQ ID NO: 2826736 - RNA, 14 nt, Mycobacterium avium subsp. paratuberculosis
cgacggccucgccg

SEQ ID NO: 2826737 - RNA, 17 nt, Mycobacterium avium subsp. paratuberculosis
cgacggccucgccgucg

SEQ ID NO: 2826738 - RNA, 18 nt, Mycobacterium avium subsp. paratuberculosis
cgacggccucgccgucgc

SEQ ID NO: 2826739 - RNA, 19 nt, Mycobacterium avium subsp. paratuberculosis
cgacggccucgccgucgcg

SEQ ID NO: 2826740 - RNA, 14 nt, Mycobacterium avium subsp. paratuberculosis
cgacggccugcacg

SEQ ID NO: 2826741 - RNA, 13 nt, Mycobacterium avium subsp. paratuberculosis
cgacggcgaacgg

SEQ ID NO: 2826742 - RNA, 18 nt, Mycobacterium avium subsp. paratuberculosis
cgacggcgaacgucgaug

SEQ ID NO: 2826743 - RNA, 14 nt, Mycobacterium avium subsp. paratuberculosis
cgacggcgaagccg

SEQ ID NO: 2826744 - RNA, 15 nt, Mycobacterium avium subsp. paratuberculosis
cgacggcgaagccgg

SEQ ID NO: 2826745 - RNA, 20 nt, Mycobacterium avium subsp. paratuberculosis
cgacggcgaagccggcguca

SEQ ID NO: 2826746 - RNA, 16 nt, Mycobacterium avium subsp. paratuberculosis
cgacggcgaccacacc

SEQ ID NO: 2826747 - RNA, 17 nt, Mycobacterium avium subsp. paratuberculosis
cgacggcgaccacaccg

SEQ ID NO: 2826748 - RNA, 22 nt, Mycobacterium avium subsp. paratuberculosis
cgacggcgaccacaccgucgac

SEQ ID NO: 2826749 - RNA, 14 nt, Mycobacterium avium subsp. paratuberculosis
cgacggcgaccauc

SEQ ID NO: 2826750 - RNA, 15 nt, Mycobacterium avium subsp. paratuberculosis
cgacggcgacggcgu

SEQ ID NO: 2826751 - RNA, 17 nt, Mycobacterium avium subsp. paratuberculosis
cgacggcgacggcgucc

SEQ ID NO: 2826752 - RNA, 13 nt, Mycobacterium avium subsp. paratuberculosis
cgacggcgagccg

SEQ ID NO: 2826753 - RNA, 14 nt, Mycobacterium avium subsp. paratuberculosis
cgacggcgagccgg

SEQ ID NO: 2826754 - RNA, 16 nt, Mycobacterium avium subsp. paratuberculosis
cgacggcgagccgggc

SEQ ID NO: 2826755 - RNA, 17 nt, Mycobacterium avium subsp. paratuberculosis
cgacggcgagccgggcc

SEQ ID NO: 2826756 - RNA, 19 nt, Mycobacterium avium subsp. paratuberculosis
cgacggcgagccgggccgg

SEQ ID NO: 2826757 - RNA, 15 nt, Mycobacterium avium subsp. paratuberculosis
cgacggcgcccgccc

SEQ ID NO: 2826758 - RNA, 20 nt, Mycobacterium avium subsp. paratuberculosis
cgacggcgcccgccccgacg

SEQ ID NO: 2826759 - RNA, 12 nt, Mycobacterium avium subsp. paratuberculosis
cgacggcgccga

SEQ ID NO: 2826760 - RNA, 18 nt, Mycobacterium avium subsp. paratuberculosis
cgacggcgccgacgaugc

SEQ ID NO: 2826761 - RNA, 14 nt, Mycobacterium avium subsp. paratuberculosis
cgacggcgccgccc

SEQ ID NO: 2826762 - RNA, 21 nt, Mycobacterium avium subsp. paratuberculosis
cgacggcgccgcccgggcccg

SEQ ID NO: 2826763 - RNA, 15 nt, Mycobacterium avium subsp. paratuberculosis
cgacggcgccgcggc

SEQ ID NO: 2826764 - RNA, 16 nt, Mycobacterium avium subsp. paratuberculosis
cgacggcgccgcggcc

SEQ ID NO: 2826765 - RNA, 17 nt, Mycobacterium avium subsp. paratuberculosis
cgacggcgccgcggccg

SEQ ID NO: 2826766 - RNA, 18 nt, Mycobacterium avium subsp. paratuberculosis
cgacggcgccgcgucgga

SEQ ID NO: 2826767 - RNA, 13 nt, Mycobacterium avium subsp. paratuberculosis
cgacggcgccgga

SEQ ID NO: 2826768 - RNA, 14 nt, Mycobacterium avium subsp. paratuberculosis
cgacggcgccggug

SEQ ID NO: 2826769 - RNA, 20 nt, Mycobacterium avium subsp. paratuberculosis
cgacggcgccggugcccacg

SEQ ID NO: 2826770 - RNA, 23 nt, Mycobacterium avium subsp. paratuberculosis
cgacggcgccggugcccacgccg

SEQ ID NO: 2826771 - RNA, 19 nt, Mycobacterium avium subsp. paratuberculosis
cgacggcgccugauccgcg

SEQ ID NO: 2826772 - RNA, 14 nt, Mycobacterium avium subsp. paratuberculosis
cgacggcgcgcccg

SEQ ID NO: 2826773 - RNA, 16 nt, Mycobacterium avium subsp. paratuberculosis
cgacggcgcgcccgac

SEQ ID NO: 2826774 - RNA, 14 nt, Mycobacterium avium subsp. paratuberculosis
cgacggcgcuggcc

SEQ ID NO: 2826775 - RNA, 15 nt, Mycobacterium avium subsp. paratuberculosis
cgacggcgcuggccg

SEQ ID NO: 2826776 - RNA, 16 nt, Mycobacterium avium subsp. paratuberculosis
cgacggcgcuggccgc

SEQ ID NO: 2826777 - RNA, 17 nt, Mycobacterium avium subsp. paratuberculosis
cgacggcgcuggccgcg

SEQ ID NO: 2826778 - RNA, 18 nt, Mycobacterium avium subsp. paratuberculosis
cgacggcgcuggccgcgg

SEQ ID NO: 2826779 - RNA, 21 nt, Mycobacterium avium subsp. paratuberculosis
cgacggcgcuggccgcggcca

SEQ ID NO: 2826780 - RNA, 18 nt, Mycobacterium avium subsp. paratuberculosis
cgacggcgcuguaccgcg

SEQ ID NO: 2826781 - RNA, 14 nt, Mycobacterium avium subsp. paratuberculosis
cgacggcgcugugg

SEQ ID NO: 2826782 - RNA, 17 nt, Mycobacterium avium subsp. paratuberculosis
cgacggcgcuguggccg

SEQ ID NO: 2826783 - RNA, 18 nt, Mycobacterium avium subsp. paratuberculosis
cgacggcgcuguggccgu

SEQ ID NO: 2826784 - RNA, 12 nt, Mycobacterium avium subsp. paratuberculosis
cgacggcggccg

SEQ ID NO: 2826785 - RNA, 16 nt, Mycobacterium avium subsp. paratuberculosis
cgacggcggcgaagac

SEQ ID NO: 2826786 - RNA, 21 nt, Mycobacterium avium subsp. paratuberculosis
cgacggcggcgaagacgucgg

SEQ ID NO: 2826787 - RNA, 14 nt, Mycobacterium avium subsp. paratuberculosis
cgacggcggcgacg

SEQ ID NO: 2826788 - RNA, 17 nt, Mycobacterium avium subsp. paratuberculosis
cgacggcggcgacguga

SEQ ID NO: 2826789 - RNA, 15 nt, Mycobacterium avium subsp. paratuberculosis
cgacggcggcguccc

SEQ ID NO: 2826790 - RNA, 13 nt, Mycobacterium avium subsp. paratuberculosis
cgacggcggggug

SEQ ID NO: 2826791 - RNA, 18 nt, Mycobacterium avium subsp. paratuberculosis
cgacggcggggugcgcgg

SEQ ID NO: 2826792 - RNA, 20 nt, Mycobacterium avium subsp. paratuberculosis
cgacggcggggugcgcggcg

SEQ ID NO: 2826793 - RNA, 23 nt, Mycobacterium avium subsp. paratuberculosis
cgacggcggggugcgcggcgagc

SEQ ID NO: 2826794 - RNA, 14 nt, Mycobacterium avium subsp. paratuberculosis
cgacggcggugacg

SEQ ID NO: 2826795 - RNA, 22 nt, Mycobacterium avium subsp. paratuberculosis
cgacggcggugacguuccagcc

SEQ ID NO: 2826796 - RNA, 23 nt, Mycobacterium avium subsp. paratuberculosis
cgacggcggugacguuccagccg

SEQ ID NO: 2826797 - RNA, 17 nt, Mycobacterium avium subsp. paratuberculosis
cgacggcggugggcucg

SEQ ID NO: 2826798 - RNA, 22 nt, Mycobacterium avium subsp. paratuberculosis
cgacggcggugggcucggccau

SEQ ID NO: 2826799 - RNA, 23 nt, Mycobacterium avium subsp. paratuberculosis
cgacggcgguucgaagcgcagcg

SEQ ID NO: 2826800 - RNA, 12 nt, Mycobacterium avium subsp. paratuberculosis
cgacggcgucca

SEQ ID NO: 2826801 - RNA, 23 nt, Mycobacterium avium subsp. paratuberculosis
cgacggcguccagcugcgcgccg

SEQ ID NO: 2826802 - RNA, 16 nt, Mycobacterium avium subsp. paratuberculosis
cgacggcguccgggcg

SEQ ID NO: 2826803 - RNA, 18 nt, Mycobacterium avium subsp. paratuberculosis
cgacggcguccgggcgcu

SEQ ID NO: 2826804 - RNA, 14 nt, Mycobacterium avium subsp. paratuberculosis
cgacggcgucggcg

SEQ ID NO: 2826805 - RNA, 16 nt, Mycobacterium avium subsp. paratuberculosis
cgacggugagcaccgc

SEQ ID NO: 2826806 - RNA, 20 nt, Mycobacterium avium subsp. paratuberculosis
cgacggugaugucgccggcg

SEQ ID NO: 2826807 - RNA, 22 nt, Mycobacterium avium subsp. paratuberculosis
cgacggugaugucgccggcggc

SEQ ID NO: 2826808 - RNA, 23 nt, Mycobacterium avium subsp. paratuberculosis
cgacggugaugucgccggcggcg

SEQ ID NO: 2826809 - RNA, 16 nt, Mycobacterium avium subsp. paratuberculosis
cgacggugcaugcgcu

SEQ ID NO: 2826810 - RNA, 20 nt, Mycobacterium avium subsp. paratuberculosis
cgacggugcaugcgcuggcg

SEQ ID NO: 2826811 - RNA, 21 nt, Mycobacterium avium subsp. paratuberculosis
cgacggugcaugcgcuggcga

SEQ ID NO: 2826812 - RNA, 22 nt, Mycobacterium avium subsp. paratuberculosis
cgacggugcgcccgucgucgcc

SEQ ID NO: 2826813 - RNA, 21 nt, Mycobacterium avium subsp. paratuberculosis
cgacggugcgugccagcagcu

SEQ ID NO: 2826814 - RNA, 15 nt, Mycobacterium avium subsp. paratuberculosis
cgacgguggagcggc

SEQ ID NO: 2826815 - RNA, 19 nt, Mycobacterium avium subsp. paratuberculosis
cgacgguggcccccaccac

SEQ ID NO: 2826816 - RNA, 21 nt, Mycobacterium avium subsp. paratuberculosis
cgacgguggcccccaccacga

SEQ ID NO: 2826817 - RNA, 16 nt, Mycobacterium avium subsp. paratuberculosis
cgacgguggccucggc

SEQ ID NO: 2826818 - RNA, 20 nt, Mycobacterium avium subsp. paratuberculosis
cgacgguggccucggcgcug

SEQ ID NO: 2826819 - RNA, 21 nt, Mycobacterium avium subsp. paratuberculosis
cgacgguggccucggcgcugc

SEQ ID NO: 2826820 - RNA, 21 nt, Mycobacterium avium subsp. paratuberculosis
cgacgguggcgaagcacgacc

SEQ ID NO: 2826821 - RNA, 19 nt, Mycobacterium avium subsp. paratuberculosis
cgacgguggcgcccagcga

SEQ ID NO: 2826822 - RNA, 18 nt, Mycobacterium avium subsp. paratuberculosis
cgacgguggcggcgaugu

SEQ ID NO: 2826823 - RNA, 18 nt, Mycobacterium avium subsp. paratuberculosis
cgacgguggcgggccgcc

SEQ ID NO: 2826824 - RNA, 19 nt, Mycobacterium avium subsp. paratuberculosis
cgacgguggcgggccgccg

SEQ ID NO: 2826825 - RNA, 16 nt, Mycobacterium avium subsp. paratuberculosis
cgacgguguaggacgc

SEQ ID NO: 2826826 - RNA, 17 nt, Mycobacterium avium subsp. paratuberculosis
cgacgguguaggacgcc

SEQ ID NO: 2826827 - RNA, 20 nt, Mycobacterium avium subsp. paratuberculosis
cgacgguguaggacgccgug

SEQ ID NO: 2826828 - RNA, 22 nt, Mycobacterium avium subsp. paratuberculosis
cgacgguguaggacgccgugca

SEQ ID NO: 2826829 - RNA, 23 nt, Mycobacterium avium subsp. paratuberculosis
cgacgguguaggacgccgugcag

SEQ ID NO: 2826830 - RNA, 16 nt, Mycobacterium avium subsp. paratuberculosis
cgacgguguccgcggc

SEQ ID NO: 2826831 - RNA, 20 nt, Mycobacterium avium subsp. paratuberculosis
cgacgguguccgcggcgucg

SEQ ID NO: 2826832 - RNA, 17 nt, Mycobacterium avium subsp. paratuberculosis
cgacgguguccgcgggc

SEQ ID NO: 2826833 - RNA, 19 nt, Mycobacterium avium subsp. paratuberculosis
cgacgguguccgcgggcag

SEQ ID NO: 2826834 - RNA, 19 nt, Mycobacterium avium subsp. paratuberculosis
cgacggugucguagacgac

SEQ ID NO: 2826835 - RNA, 18 nt, Mycobacterium avium subsp. paratuberculosis
cgacgguugccucggcca

SEQ ID NO: 2826836 - RNA, 19 nt, Mycobacterium avium subsp. paratuberculosis
cgacgguugccucggccag

SEQ ID NO: 2826837 - RNA, 15 nt, Mycobacterium avium subsp. paratuberculosis
cgacgguuguucagc

SEQ ID NO: 2826838 - RNA, 20 nt, Mycobacterium avium subsp. paratuberculosis
cgacgguuguucagcccggu

SEQ ID NO: 2826839 - RNA, 23 nt, Mycobacterium avium subsp. paratuberculosis
cgacgguuguucagcccggucag

SEQ ID NO: 2826840 - RNA, 16 nt, Mycobacterium avium subsp. paratuberculosis
cgacgguuugcccggc

SEQ ID NO: 2826841 - RNA, 17 nt, Mycobacterium avium subsp. paratuberculosis
cgacgguuugcccggcg

SEQ ID NO: 2826842 - RNA, 18 nt, Mycobacterium avium subsp. paratuberculosis
cgacgguuugcccggcga

SEQ ID NO: 2826843 - RNA, 18 nt, Mycobacterium avium subsp. paratuberculosis
cgacguaaccguacggcc

SEQ ID NO: 2826844 - RNA, 17 nt, Mycobacterium avium subsp. paratuberculosis
cgacguacagcgagccg

SEQ ID NO: 2826845 - RNA, 21 nt, Mycobacterium avium subsp. paratuberculosis
cgacguacagcgagccgucga

SEQ ID NO: 2826846 - RNA, 22 nt, Mycobacterium avium subsp. paratuberculosis
cgacguacagcgagccgucgac

SEQ ID NO: 2826847 - RNA, 19 nt, Mycobacterium avium subsp. paratuberculosis
cgacguacccccgcacgcc

SEQ ID NO: 2826848 - RNA, 17 nt, Mycobacterium avium subsp. paratuberculosis
cgacguagacgagccgg

SEQ ID NO: 2826849 - RNA, 14 nt, Mycobacterium avium subsp. paratuberculosis
cgacguagcccgcc

SEQ ID NO: 2826850 - RNA, 17 nt, Mycobacterium avium subsp. paratuberculosis
cgacguagcccgccgaa

SEQ ID NO: 2826851 - RNA, 15 nt, Mycobacterium avium subsp. paratuberculosis
cgacguaggacagca

SEQ ID NO: 2826852 - RNA, 18 nt, Mycobacterium avium subsp. paratuberculosis
cgacguaggacagcacca

SEQ ID NO: 2826853 - RNA, 19 nt, Mycobacterium avium subsp. paratuberculosis
cgacguaggugagcaacgc

SEQ ID NO: 2826854 - RNA, 21 nt, Mycobacterium avium subsp. paratuberculosis
cgacguaggugagcaacgcca

SEQ ID NO: 2826855 - RNA, 14 nt, Mycobacterium avium subsp. paratuberculosis
cgacguaguccggc

SEQ ID NO: 2826856 - RNA, 16 nt, Mycobacterium avium subsp. paratuberculosis
cgacguaguccggcca

SEQ ID NO: 2826857 - RNA, 17 nt, Mycobacterium avium subsp. paratuberculosis
cgacguaguccggccag

SEQ ID NO: 2826858 - RNA, 16 nt, Mycobacterium avium subsp. paratuberculosis
cgacguagucgcgcac

SEQ ID NO: 2826859 - RNA, 17 nt, Mycobacterium avium subsp. paratuberculosis
cgacgucaacaccgugg

SEQ ID NO: 2826860 - RNA, 20 nt, Mycobacterium avium subsp. paratuberculosis
cgacgucaacaccguggugg

SEQ ID NO: 2826861 - RNA, 15 nt, Mycobacterium avium subsp. paratuberculosis
cgacgucaccaccgg

SEQ ID NO: 2826862 - RNA, 18 nt, Mycobacterium avium subsp. paratuberculosis
cgacgucaccaccggguc

SEQ ID NO: 2826863 - RNA, 14 nt, Mycobacterium avium subsp. paratuberculosis
cgacgucacgacgg

SEQ ID NO: 2826864 - RNA, 19 nt, Mycobacterium avium subsp. paratuberculosis
cgacgucaggggugccgga

SEQ ID NO: 2826865 - RNA, 21 nt, Mycobacterium avium subsp. paratuberculosis
cgacgucaggguggccucguc

SEQ ID NO: 2826866 - RNA, 14 nt, Mycobacterium avium subsp. paratuberculosis
cgacgucaggucga

SEQ ID NO: 2826867 - RNA, 18 nt, Mycobacterium avium subsp. paratuberculosis
cgacgucaggucgaccgg

SEQ ID NO: 2826868 - RNA, 20 nt, Mycobacterium avium subsp. paratuberculosis
cgacgucaggucgaccggcu

SEQ ID NO: 2826869 - RNA, 21 nt, Mycobacterium avium subsp. paratuberculosis
cgacgucauccggcugcccug

SEQ ID NO: 2826870 - RNA, 14 nt, Mycobacterium avium subsp. paratuberculosis
cgacguccaccgga

SEQ ID NO: 2826871 - RNA, 12 nt, Mycobacterium avium subsp. paratuberculosis
cgacguccacgu

SEQ ID NO: 2826872 - RNA, 15 nt, Mycobacterium avium subsp. paratuberculosis
cgacguccacguuga

SEQ ID NO: 2826873 - RNA, 20 nt, Mycobacterium avium subsp. paratuberculosis
cgacguccacguugaugccg

SEQ ID NO: 2826874 - RNA, 14 nt, Mycobacterium avium subsp. paratuberculosis
cgacguccaggccg

SEQ ID NO: 2826875 - RNA, 15 nt, Mycobacterium avium subsp. paratuberculosis
cgacguccaggccgg

SEQ ID NO: 2826876 - RNA, 16 nt, Mycobacterium avium subsp. paratuberculosis
cgacguccaggccggc

SEQ ID NO: 2826877 - RNA, 19 nt, Mycobacterium avium subsp. paratuberculosis
cgacguccaggccggcgcc

SEQ ID NO: 2826878 - RNA, 20 nt, Mycobacterium avium subsp. paratuberculosis
cgacguccaggccggcgccg

SEQ ID NO: 2826879 - RNA, 14 nt, Mycobacterium avium subsp. paratuberculosis
cgacgucccagcac

SEQ ID NO: 2826880 - RNA, 17 nt, Mycobacterium avium subsp. paratuberculosis
cgacgucccagcacaac

SEQ ID NO: 2826881 - RNA, 14 nt, Mycobacterium avium subsp. paratuberculosis
cgacguccgggccg

SEQ ID NO: 2826882 - RNA, 21 nt, Mycobacterium avium subsp. paratuberculosis
cgacguccucgacgaucagca

SEQ ID NO: 2826883 - RNA, 17 nt, Mycobacterium avium subsp. paratuberculosis
cgacguccucgaugccg

SEQ ID NO: 2826884 - RNA, 20 nt, Mycobacterium avium subsp. paratuberculosis
cgacguccucgaugccgacc

SEQ ID NO: 2826885 - RNA, 23 nt, Mycobacterium avium subsp. paratuberculosis
cgacguccucgcccgggugcugc

SEQ ID NO: 2826886 - RNA, 21 nt, Mycobacterium avium subsp. paratuberculosis
cgacguccuggaucgcgcagg

SEQ ID NO: 2826887 - RNA, 19 nt, Mycobacterium avium subsp. paratuberculosis
cgacguccuugaucagcau

SEQ ID NO: 2826888 - RNA, 21 nt, Mycobacterium avium subsp. paratuberculosis
cgacguccuugaucagcaugu

SEQ ID NO: 2826889 - RNA, 17 nt, Mycobacterium avium subsp. paratuberculosis
cgacguucgagucggcc

SEQ ID NO: 2826890 - RNA, 14 nt, Mycobacterium avium subsp. paratuberculosis
cgacguucgccgcc

SEQ ID NO: 2826891 - RNA, 19 nt, Mycobacterium avium subsp. paratuberculosis
cgacguucgccgccagcac

SEQ ID NO: 2826892 - RNA, 20 nt, Mycobacterium avium subsp. paratuberculosis
cgacguucgccgccagcacg

SEQ ID NO: 2826893 - RNA, 11 nt, Mycobacterium avium subsp. paratuberculosis
cgacguucggc

SEQ ID NO: 2826894 - RNA, 15 nt, Mycobacterium avium subsp. paratuberculosis
cgacguucggcgggc

SEQ ID NO: 2826895 - RNA, 18 nt, Mycobacterium avium subsp. paratuberculosis
cgacguucggcgggcagg

SEQ ID NO: 2826896 - RNA, 14 nt, Mycobacterium avium subsp. paratuberculosis
cgacguucuuguag

SEQ ID NO: 2826897 - RNA, 18 nt, Mycobacterium avium subsp. paratuberculosis
cgacguugccgcugguca

SEQ ID NO: 2826898 - RNA, 15 nt, Mycobacterium avium subsp. paratuberculosis
cgacguugcgggcca

SEQ ID NO: 2826899 - RNA, 17 nt, Mycobacterium avium subsp. paratuberculosis
cgacguugcgggccagg

SEQ ID NO: 2826900 - RNA, 20 nt, Mycobacterium avium subsp. paratuberculosis
cgacguugcgggccaggucg

SEQ ID NO: 2826901 - RNA, 16 nt, Mycobacterium avium subsp. paratuberculosis
cgacguuggccagcac

SEQ ID NO: 2826902 - RNA, 17 nt, Mycobacterium avium subsp. paratuberculosis
cgacguuggccagcacc

SEQ ID NO: 2826903 - RNA, 19 nt, Mycobacterium avium subsp. paratuberculosis
cgacguuggccagcaccgc

SEQ ID NO: 2826904 - RNA, 22 nt, Mycobacterium avium subsp. paratuberculosis
cgacguuggccagcaccgcggc

SEQ ID NO: 2826905 - RNA, 14 nt, Mycobacterium avium subsp. paratuberculosis
cgacuagcgcggcg

SEQ ID NO: 2826906 - RNA, 21 nt, Mycobacterium avium subsp. paratuberculosis
cgacuagcgcggcggccucgg

SEQ ID NO: 2826907 - RNA, 17 nt, Mycobacterium avium subsp. paratuberculosis
cgacucauucgacuccg

SEQ ID NO: 2826908 - RNA, 22 nt, Mycobacterium avium subsp. paratuberculosis
cgacucauucgacuccggcgac

SEQ ID NO: 2826909 - RNA, 16 nt, Mycobacterium avium subsp. paratuberculosis
cgacuccagcaccggc

SEQ ID NO: 2826910 - RNA, 18 nt, Mycobacterium avium subsp. paratuberculosis
cgacuccagcaccggcgc

SEQ ID NO: 2826911 - RNA, 19 nt, Mycobacterium avium subsp. paratuberculosis
cgacuccagcaccggcgcc

SEQ ID NO: 2826912 - RNA, 20 nt, Mycobacterium avium subsp. paratuberculosis
cgacuccagcaccggcgcca

SEQ ID NO: 2826913 - RNA, 14 nt, Mycobacterium avium subsp. paratuberculosis
cgacuccagcagcg

SEQ ID NO: 2826914 - RNA, 17 nt, Mycobacterium avium subsp. paratuberculosis
cgacuccagcagcgcca

SEQ ID NO: 2826915 - RNA, 17 nt, Mycobacterium avium subsp. paratuberculosis
cgacuccagcagcgccu

SEQ ID NO: 2826916 - RNA, 14 nt, Mycobacterium avium subsp. paratuberculosis
cgacuccagcgcga

SEQ ID NO: 2826917 - RNA, 15 nt, Mycobacterium avium subsp. paratuberculosis
cgacuccccgcccgg

SEQ ID NO: 2826918 - RNA, 13 nt, Mycobacterium avium subsp. paratuberculosis
cgacuccggcgcc

SEQ ID NO: 2826919 - RNA, 14 nt, Mycobacterium avium subsp. paratuberculosis
cgacuccggcgccg

SEQ ID NO: 2826920 - RNA, 15 nt, Mycobacterium avium subsp. paratuberculosis
cgacuccggcgccgg

SEQ ID NO: 2826921 - RNA, 18 nt, Mycobacterium avium subsp. paratuberculosis
cgacuccggcgccgguca

SEQ ID NO: 2826922 - RNA, 20 nt, Mycobacterium avium subsp. paratuberculosis
cgacuccggcgccggucagc

SEQ ID NO: 2826923 - RNA, 19 nt, Mycobacterium avium subsp. paratuberculosis
cgacuccucacaccucgcu

SEQ ID NO: 2826924 - RNA, 16 nt, Mycobacterium avium subsp. paratuberculosis
cgacuccuccggcccg

SEQ ID NO: 2826925 - RNA, 13 nt, Mycobacterium avium subsp. paratuberculosis
cgacuccuggccg

SEQ ID NO: 2826926 - RNA, 14 nt, Mycobacterium avium subsp. paratuberculosis
cgacuccuggccga

SEQ ID NO: 2826927 - RNA, 16 nt, Mycobacterium avium subsp. paratuberculosis
cgacuccuggccgaac

SEQ ID NO: 2826928 - RNA, 17 nt, Mycobacterium avium subsp. paratuberculosis
cgacuccuugggcaugg

SEQ ID NO: 2826929 - RNA, 16 nt, Mycobacterium avium subsp. paratuberculosis
cgacucgaccccgccc

SEQ ID NO: 2826930 - RNA, 17 nt, Mycobacterium avium subsp. paratuberculosis
cgacucgaccccgccca

SEQ ID NO: 2826931 - RNA, 19 nt, Mycobacterium avium subsp. paratuberculosis
cgacucgaccccgcccagc

SEQ ID NO: 2826932 - RNA, 17 nt, Mycobacterium avium subsp. paratuberculosis
cgacucgaugcgcguga

SEQ ID NO: 2826933 - RNA, 20 nt, Mycobacterium avium subsp. paratuberculosis
cgacucgaugcgcgugacgc

SEQ ID NO: 2826934 - RNA, 14 nt, Mycobacterium avium subsp. paratuberculosis
cgacucgcaggugc

SEQ ID NO: 2826935 - RNA, 13 nt, Mycobacterium avium subsp. paratuberculosis
cgacucggccagg

SEQ ID NO: 2826936 - RNA, 18 nt, Mycobacterium avium subsp. paratuberculosis
cgacucggccuccgcgcg

SEQ ID NO: 2826937 - RNA, 21 nt, Mycobacterium avium subsp. paratuberculosis
cgacucggccuccgcgcgcgg

SEQ ID NO: 2826938 - RNA, 14 nt, Mycobacterium avium subsp. paratuberculosis
cgacucggcggugc

SEQ ID NO: 2826939 - RNA, 17 nt, Mycobacterium avium subsp. paratuberculosis
cgacucggugucgcuca

SEQ ID NO: 2826940 - RNA, 16 nt, Mycobacterium avium subsp. paratuberculosis
cgacucguucgacgcc

SEQ ID NO: 2826941 - RNA, 18 nt, Mycobacterium avium subsp. paratuberculosis
cgacucguuggccggcuc

SEQ ID NO: 2826942 - RNA, 21 nt, Mycobacterium avium subsp. paratuberculosis
cgacucugcacucagagcagc

SEQ ID NO: 2826943 - RNA, 17 nt, Mycobacterium avium subsp. paratuberculosis
cgacugaucgacgagcc

SEQ ID NO: 2826944 - RNA, 18 nt, Mycobacterium avium subsp. paratuberculosis
cgacugaucgacgagccg

SEQ ID NO: 2826945 - RNA, 19 nt, Mycobacterium avium subsp. paratuberculosis
cgacugaucgacgagccgg

SEQ ID NO: 2826946 - RNA, 21 nt, Mycobacterium avium subsp. paratuberculosis
cgacugcacccgaacggaccg

SEQ ID NO: 2826947 - RNA, 17 nt, Mycobacterium avium subsp. paratuberculosis
cgacugcacccggguca

SEQ ID NO: 2826948 - RNA, 23 nt, Mycobacterium avium subsp. paratuberculosis
cgacugcacccgggucaggucga

SEQ ID NO: 2826949 - RNA, 14 nt, Mycobacterium avium subsp. paratuberculosis
cgacugcaggaaca

SEQ ID NO: 2826950 - RNA, 19 nt, Mycobacterium avium subsp. paratuberculosis
cgacugcaggaacaaccgc

SEQ ID NO: 2826951 - RNA, 22 nt, Mycobacterium avium subsp. paratuberculosis
cgacugcaggaacaaccgcagc

SEQ ID NO: 2826952 - RNA, 13 nt, Mycobacterium avium subsp. paratuberculosis
cgacugcgacacc

SEQ ID NO: 2826953 - RNA, 15 nt, Mycobacterium avium subsp. paratuberculosis
cgacugcgcggccgg

SEQ ID NO: 2826954 - RNA, 18 nt, Mycobacterium avium subsp. paratuberculosis
cgacugcgcggccggcgu

SEQ ID NO: 2826955 - RNA, 16 nt, Mycobacterium avium subsp. paratuberculosis
cgacugcgugcugggc

SEQ ID NO: 2826956 - RNA, 17 nt, Mycobacterium avium subsp. paratuberculosis
cgacugcgugcugggca

SEQ ID NO: 2826957 - RNA, 16 nt, Mycobacterium avium subsp. paratuberculosis
cgacuggaccaccaug

SEQ ID NO: 2826958 - RNA, 19 nt, Mycobacterium avium subsp. paratuberculosis
cgacuggcccucggaggug

SEQ ID NO: 2826959 - RNA, 18 nt, Mycobacterium avium subsp. paratuberculosis
cgacuggcggcggcgguc

SEQ ID NO: 2826960 - RNA, 14 nt, Mycobacterium avium subsp. paratuberculosis
cgacugggcgccca

SEQ ID NO: 2826961 - RNA, 18 nt, Mycobacterium avium subsp. paratuberculosis
cgacugggugcucccgcc

SEQ ID NO: 2826962 - RNA, 15 nt, Mycobacterium avium subsp. paratuberculosis
cgacuggucgucgag

SEQ ID NO: 2826963 - RNA, 16 nt, Mycobacterium avium subsp. paratuberculosis
cgacuggucgucgagc

SEQ ID NO: 2826964 - RNA, 17 nt, Mycobacterium avium subsp. paratuberculosis
cgacuggucgucgagcu

SEQ ID NO: 2826965 - RNA, 16 nt, Mycobacterium avium subsp. paratuberculosis
cgacuguccaggccga

SEQ ID NO: 2826966 - RNA, 15 nt, Mycobacterium avium subsp. paratuberculosis
cgacugucggcgccc

SEQ ID NO: 2826967 - RNA, 18 nt, Mycobacterium avium subsp. paratuberculosis
cgacugucggcgccccgc

SEQ ID NO: 2826968 - RNA, 15 nt, Mycobacterium avium subsp. paratuberculosis
cgacugucggcucgc

SEQ ID NO: 2826969 - RNA, 15 nt, Mycobacterium avium subsp. paratuberculosis
cgacuuacggcguga

SEQ ID NO: 2826970 - RNA, 23 nt, Mycobacterium avium subsp. paratuberculosis
cgacuucccaguccggccagcgu

SEQ ID NO: 2826971 - RNA, 14 nt, Mycobacterium avium subsp. paratuberculosis
cgacuucggccucg

SEQ ID NO: 2826972 - RNA, 16 nt, Mycobacterium avium subsp. paratuberculosis
cgacuucggcucggcg

SEQ ID NO: 2826973 - RNA, 17 nt, Mycobacterium avium subsp. paratuberculosis
cgacuucggcucggcga

SEQ ID NO: 2826974 - RNA, 13 nt, Mycobacterium avium subsp. paratuberculosis
cgagaucgcgggc

SEQ ID NO: 2826975 - RNA, 20 nt, Mycobacterium avium subsp. paratuberculosis
cgagaucgcgggcugcggcg

SEQ ID NO: 2826976 - RNA, 21 nt, Mycobacterium avium subsp. paratuberculosis
cgagaucgcgggcugcggcga

SEQ ID NO: 2826977 - RNA, 14 nt, Mycobacterium avium subsp. paratuberculosis
cgagaucgcggugg

SEQ ID NO: 2826978 - RNA, 15 nt, Mycobacterium avium subsp. paratuberculosis
cgagaucgucgugga

SEQ ID NO: 2826979 - RNA, 16 nt, Mycobacterium avium subsp. paratuberculosis
cgagaucucgucgaug

SEQ ID NO: 2826980 - RNA, 17 nt, Mycobacterium avium subsp. paratuberculosis
cgagaucucgucgaugg

SEQ ID NO: 2826981 - RNA, 17 nt, Mycobacterium avium subsp. paratuberculosis
cgagaucuucuccccgc

SEQ ID NO: 2826982 - RNA, 20 nt, Mycobacterium avium subsp. paratuberculosis
cgagaucuucuccccgccuc

SEQ ID NO: 2826983 - RNA, 21 nt, Mycobacterium avium subsp. paratuberculosis
cgagaucuucuccccgccucg

SEQ ID NO: 2826984 - RNA, 22 nt, Mycobacterium avium subsp. paratuberculosis
cgagaucuucuccccgccucgg

SEQ ID NO: 2826985 - RNA, 21 nt, Mycobacterium avium subsp. paratuberculosis
cgagaugaagacccggccgug

SEQ ID NO: 2826986 - RNA, 16 nt, Mycobacterium avium subsp. paratuberculosis
cgagaugaucagccgc

SEQ ID NO: 2826987 - RNA, 17 nt, Mycobacterium avium subsp. paratuberculosis
cgagaugaucagccgcc

SEQ ID NO: 2826988 - RNA, 16 nt, Mycobacterium avium subsp. paratuberculosis
cgagaugcccacccgc

SEQ ID NO: 2826989 - RNA, 20 nt, Mycobacterium avium subsp. paratuberculosis
cgagaugcccacccgcucgg

SEQ ID NO: 2826990 - RNA, 16 nt, Mycobacterium avium subsp. paratuberculosis
cgagaugccccaggcg

SEQ ID NO: 2826991 - RNA, 14 nt, Mycobacterium avium subsp. paratuberculosis
cgagaugccgggaa

SEQ ID NO: 2826992 - RNA, 18 nt, Mycobacterium avium subsp. paratuberculosis
cgagaugccgggaagcga

SEQ ID NO: 2826993 - RNA, 20 nt, Mycobacterium avium subsp. paratuberculosis
cgagaugcguucggccgcag

SEQ ID NO: 2826994 - RNA, 21 nt, Mycobacterium avium subsp. paratuberculosis
cgagaugcguucggccgcagc

SEQ ID NO: 2826995 - RNA, 22 nt, Mycobacterium avium subsp. paratuberculosis
cgagaugcguucggccgcagcg

SEQ ID NO: 2826996 - RNA, 13 nt, Mycobacterium avium subsp. paratuberculosis
cgagauggacagc

SEQ ID NO: 2826997 - RNA, 14 nt, Mycobacterium avium subsp. paratuberculosis
cgagauggacagca

SEQ ID NO: 2826998 - RNA, 13 nt, Mycobacterium avium subsp. paratuberculosis
cgagauggcaaca

SEQ ID NO: 2826999 - RNA, 16 nt, Mycobacterium avium subsp. paratuberculosis
cgagauggccaccauc

SEQ ID NO: 2827000 - RNA, 19 nt, Mycobacterium avium subsp. paratuberculosis
cgagauggcgaucagaugc

SEQ ID NO: 2827001 - RNA, 18 nt, Mycobacterium avium subsp. paratuberculosis
cgagcaacaccaccuugg

SEQ ID NO: 2827002 - RNA, 17 nt, Mycobacterium avium subsp. paratuberculosis
cgagcaacagcccgacc

SEQ ID NO: 2827003 - RNA, 14 nt, Mycobacterium avium subsp. paratuberculosis
cgagcaaccgcacc

SEQ ID NO: 2827004 - RNA, 21 nt, Mycobacterium avium subsp. paratuberculosis
cgagcaaccgcaccuugcgcc

SEQ ID NO: 2827005 - RNA, 23 nt, Mycobacterium avium subsp. paratuberculosis
cgagcaaccgcaccuugcgcccg

SEQ ID NO: 2827006 - RNA, 15 nt, Mycobacterium avium subsp. paratuberculosis
cgagcaacggccgca

SEQ ID NO: 2827007 - RNA, 18 nt, Mycobacterium avium subsp. paratuberculosis
cgagcaacggccgcagcg

SEQ ID NO: 2827008 - RNA, 15 nt, Mycobacterium avium subsp. paratuberculosis
cgagcaacuggguga

SEQ ID NO: 2827009 - RNA, 16 nt, Mycobacterium avium subsp. paratuberculosis
cgagcaaggcgagcac

SEQ ID NO: 2827010 - RNA, 20 nt, Mycobacterium avium subsp. paratuberculosis
cgagcaaggcgagcacggca

SEQ ID NO: 2827011 - RNA, 21 nt, Mycobacterium avium subsp. paratuberculosis
cgagcaauuaaccggcaggcc

SEQ ID NO: 2827012 - RNA, 22 nt, Mycobacterium avium subsp. paratuberculosis
cgagcaauuaaccggcaggccg

SEQ ID NO: 2827013 - RNA, 22 nt, Mycobacterium avium subsp. paratuberculosis
cgagcacacccucaccccgccc

SEQ ID NO: 2827014 - RNA, 14 nt, Mycobacterium avium subsp. paratuberculosis
cgagcacaccgucg

SEQ ID NO: 2827015 - RNA, 17 nt, Mycobacterium avium subsp. paratuberculosis
cgagcacaccgucgccc

SEQ ID NO: 2827016 - RNA, 18 nt, Mycobacterium avium subsp. paratuberculosis
cgagcacaccgucgcccg

SEQ ID NO: 2827017 - RNA, 19 nt, Mycobacterium avium subsp. paratuberculosis
cgagcacaccgucgcccgc

SEQ ID NO: 2827018 - RNA, 21 nt, Mycobacterium avium subsp. paratuberculosis
cgagcacaccgucgcccgccc

SEQ ID NO: 2827019 - RNA, 14 nt, Mycobacterium avium subsp. paratuberculosis
cgagcacagcggcg

SEQ ID NO: 2827020 - RNA, 15 nt, Mycobacterium avium subsp. paratuberculosis
cgagcacaggaacgc

SEQ ID NO: 2827021 - RNA, 16 nt, Mycobacterium avium subsp. paratuberculosis
cgagcacaggaacgcg

SEQ ID NO: 2827022 - RNA, 14 nt, Mycobacterium avium subsp. paratuberculosis
cgagcacaucggcg

SEQ ID NO: 2827023 - RNA, 15 nt, Mycobacterium avium subsp. paratuberculosis
cgagcaccaccaggc

SEQ ID NO: 2827024 - RNA, 14 nt, Mycobacterium avium subsp. paratuberculosis
cgagcaccagcaac

SEQ ID NO: 2827025 - RNA, 12 nt, Mycobacterium avium subsp. paratuberculosis
cgagcaccagcg

SEQ ID NO: 2827026 - RNA, 15 nt, Mycobacterium avium subsp. paratuberculosis
cgagcaccagcggac

SEQ ID NO: 2827027 - RNA, 15 nt, Mycobacterium avium subsp. paratuberculosis
cgagcaccagcgucg

SEQ ID NO: 2827028 - RNA, 16 nt, Mycobacterium avium subsp. paratuberculosis
cgagcaccagcgucga

SEQ ID NO: 2827029 - RNA, 19 nt, Mycobacterium avium subsp. paratuberculosis
cgagcaccagcgucgacgc

SEQ ID NO: 2827030 - RNA, 14 nt, Mycobacterium avium subsp. paratuberculosis
cgagcaccaggcgc

SEQ ID NO: 2827031 - RNA, 13 nt, Mycobacterium avium subsp. paratuberculosis
cgagcaccccggc

SEQ ID NO: 2827032 - RNA, 17 nt, Mycobacterium avium subsp. paratuberculosis
cgagcaccccggcggcc

SEQ ID NO: 2827033 - RNA, 19 nt, Mycobacterium avium subsp. paratuberculosis
cgagcaccccggcggccgc

SEQ ID NO: 2827034 - RNA, 21 nt, Mycobacterium avium subsp. paratuberculosis
cgagcaccccggcggccgcgu

SEQ ID NO: 2827035 - RNA, 15 nt, Mycobacterium avium subsp. paratuberculosis
cgagcaccccgucga

SEQ ID NO: 2827036 - RNA, 22 nt, Mycobacterium avium subsp. paratuberculosis
cgagcaccccgucgagcagccg

SEQ ID NO: 2827037 - RNA, 15 nt, Mycobacterium avium subsp. paratuberculosis
cgagcacccggcggg

SEQ ID NO: 2827038 - RNA, 18 nt, Mycobacterium avium subsp. paratuberculosis
cgagcacccggcggggac

SEQ ID NO: 2827039 - RNA, 19 nt, Mycobacterium avium subsp. paratuberculosis
cgagcacccggcggggacc

SEQ ID NO: 2827040 - RNA, 20 nt, Mycobacterium avium subsp. paratuberculosis
cgagcaccgcgaccacgccg

SEQ ID NO: 2827041 - RNA, 16 nt, Mycobacterium avium subsp. paratuberculosis
cgagcaccgcgaucac

SEQ ID NO: 2827042 - RNA, 19 nt, Mycobacterium avium subsp. paratuberculosis
cgagcaccgcgaucaccga

SEQ ID NO: 2827043 - RNA, 19 nt, Mycobacterium avium subsp. paratuberculosis
cgagcaccgcgaucgccga

SEQ ID NO: 2827044 - RNA, 20 nt, Mycobacterium avium subsp. paratuberculosis
cgagcaccgcgaucgccgac

SEQ ID NO: 2827045 - RNA, 18 nt, Mycobacterium avium subsp. paratuberculosis
cgagcaccgcguccgcgu

SEQ ID NO: 2827046 - RNA, 20 nt, Mycobacterium avium subsp. paratuberculosis
cgagcaccgcguccgcgucg

SEQ ID NO: 2827047 - RNA, 17 nt, Mycobacterium avium subsp. paratuberculosis
cgagcaccggcagcacc

SEQ ID NO: 2827048 - RNA, 22 nt, Mycobacterium avium subsp. paratuberculosis
cgagcaccggcagcaccgccga

SEQ ID NO: 2827049 - RNA, 20 nt, Mycobacterium avium subsp. paratuberculosis
cgagcaccggcagccgcagc

SEQ ID NO: 2827050 - RNA, 21 nt, Mycobacterium avium subsp. paratuberculosis
cgagcaccggcagccgcagcg

SEQ ID NO: 2827051 - RNA, 23 nt, Mycobacterium avium subsp. paratuberculosis
cgagcaccggcagccgcagcgac

SEQ ID NO: 2827052 - RNA, 14 nt, Mycobacterium avium subsp. paratuberculosis
cgagcaccggcggc

SEQ ID NO: 2827053 - RNA, 15 nt, Mycobacterium avium subsp. paratuberculosis
cgagcaccggcggca

SEQ ID NO: 2827054 - RNA, 18 nt, Mycobacterium avium subsp. paratuberculosis
cgagcaccggcggcagcg

SEQ ID NO: 2827055 - RNA, 19 nt, Mycobacterium avium subsp. paratuberculosis
cgagcaccggcggcagcga

SEQ ID NO: 2827056 - RNA, 21 nt, Mycobacterium avium subsp. paratuberculosis
cgagcaccggcuggugcagca

SEQ ID NO: 2827057 - RNA, 13 nt, Mycobacterium avium subsp. paratuberculosis
cgagcaccgggcc

SEQ ID NO: 2827058 - RNA, 17 nt, Mycobacterium avium subsp. paratuberculosis
cgagcaccgggcgucgg

SEQ ID NO: 2827059 - RNA, 16 nt, Mycobacterium avium subsp. paratuberculosis
cgagcaggcggaucgg

SEQ ID NO: 2827060 - RNA, 18 nt, Mycobacterium avium subsp. paratuberculosis
cgagcaggcggaucggcc

SEQ ID NO: 2827061 - RNA, 20 nt, Mycobacterium avium subsp. paratuberculosis
cgagcaggcggaucggcccg

SEQ ID NO: 2827062 - RNA, 21 nt, Mycobacterium avium subsp. paratuberculosis
cgagcaggcggaucggcccga

SEQ ID NO: 2827063 - RNA, 21 nt, Mycobacterium avium subsp. paratuberculosis
cgagcaggcugaucucggcgg

SEQ ID NO: 2827064 - RNA, 23 nt, Mycobacterium avium subsp. paratuberculosis
cgagcaggcugaucucggcgguc

SEQ ID NO: 2827065 - RNA, 16 nt, Mycobacterium avium subsp. paratuberculosis
cgagcagggcgggcag

SEQ ID NO: 2827066 - RNA, 19 nt, Mycobacterium avium subsp. paratuberculosis
cgagcagggcgggcaggcc

SEQ ID NO: 2827067 - RNA, 19 nt, Mycobacterium avium subsp. paratuberculosis
cgagcaguagacgccgccg

SEQ ID NO: 2827068 - RNA, 19 nt, Mycobacterium avium subsp. paratuberculosis
cgagcagugcaucgcugcc

SEQ ID NO: 2827069 - RNA, 24 nt, Mycobacterium avium subsp. paratuberculosis
cgagcagugcaucgcugccgucca

SEQ ID NO: 2827070 - RNA, 12 nt, Mycobacterium avium subsp. paratuberculosis
cgagcaucaccg

SEQ ID NO: 2827071 - RNA, 17 nt, Mycobacterium avium subsp. paratuberculosis
cgagcaucacgaacccg

SEQ ID NO: 2827072 - RNA, 14 nt, Mycobacterium avium subsp. paratuberculosis
cgagcauccggcgc

SEQ ID NO: 2827073 - RNA, 16 nt, Mycobacterium avium subsp. paratuberculosis
cgagcauccggcgcac

SEQ ID NO: 2827074 - RNA, 19 nt, Mycobacterium avium subsp. paratuberculosis
cgagcauccggcgcacggc

SEQ ID NO: 2827075 - RNA, 16 nt, Mycobacterium avium subsp. paratuberculosis
cgagcauccggugccg

SEQ ID NO: 2827076 - RNA, 22 nt, Mycobacterium avium subsp. paratuberculosis
cgagcauccggugccgagcgcg

SEQ ID NO: 2827077 - RNA, 23 nt, Mycobacterium avium subsp. paratuberculosis
cgagcaucggguugccggcggcc

SEQ ID NO: 2827078 - RNA, 13 nt, Mycobacterium avium subsp. paratuberculosis
cgagcaucuccag

SEQ ID NO: 2827079 - RNA, 19 nt, Mycobacterium avium subsp. paratuberculosis
cgagcaucuccagccggcg

SEQ ID NO: 2827080 - RNA, 14 nt, Mycobacterium avium subsp. paratuberculosis
cgagcaugcgggug

SEQ ID NO: 2827081 - RNA, 14 nt, Mycobacterium avium subsp. paratuberculosis
cgagcauuucgcgc

SEQ ID NO: 2827082 - RNA, 22 nt, Mycobacterium avium subsp. paratuberculosis
cgagcauuucgcgcacgucgag

SEQ ID NO: 2827083 - RNA, 15 nt, Mycobacterium avium subsp. paratuberculosis
cgagccaccacugcg

SEQ ID NO: 2827084 - RNA, 17 nt, Mycobacterium avium subsp. paratuberculosis
cgagccaccacugcgcc

SEQ ID NO: 2827085 - RNA, 21 nt, Mycobacterium avium subsp. paratuberculosis
cgagccaccacugcgccguca

SEQ ID NO: 2827086 - RNA, 22 nt, Mycobacterium avium subsp. paratuberculosis
cgagccaccucgaucagcggca

SEQ ID NO: 2827087 - RNA, 19 nt, Mycobacterium avium subsp. paratuberculosis
cgagccagcugcgcgucgg

SEQ ID NO: 2827088 - RNA, 17 nt, Mycobacterium avium subsp. paratuberculosis
cgagccauaaaccggcc

SEQ ID NO: 2827089 - RNA, 18 nt, Mycobacterium avium subsp. paratuberculosis
cgagccauaaaccggccg

SEQ ID NO: 2827090 - RNA, 19 nt, Mycobacterium avium subsp. paratuberculosis
cgagccauaaaccggccgg

SEQ ID NO: 2827091 - RNA, 21 nt, Mycobacterium avium subsp. paratuberculosis
cgagccauaaaccggccggcg

SEQ ID NO: 2827092 - RNA, 13 nt, Mycobacterium avium subsp. paratuberculosis
cgagcccaccgcg

SEQ ID NO: 2827093 - RNA, 14 nt, Mycobacterium avium subsp. paratuberculosis
cgagcccaccgcgc

SEQ ID NO: 2827094 - RNA, 16 nt, Mycobacterium avium subsp. paratuberculosis
cgagcccaccgcgccc

SEQ ID NO: 2827095 - RNA, 17 nt, Mycobacterium avium subsp. paratuberculosis
cgagcccaccgcgccca

SEQ ID NO: 2827096 - RNA, 19 nt, Mycobacterium avium subsp. paratuberculosis
cgagcccaccgcgcccagc

SEQ ID NO: 2827097 - RNA, 12 nt, Mycobacterium avium subsp. paratuberculosis
cgagcccagccg

SEQ ID NO: 2827098 - RNA, 14 nt, Mycobacterium avium subsp. paratuberculosis
cgagcccagcugcg

SEQ ID NO: 2827099 - RNA, 20 nt, Mycobacterium avium subsp. paratuberculosis
cgagcccagcugcgcggagc

SEQ ID NO: 2827100 - RNA, 17 nt, Mycobacterium avium subsp. paratuberculosis
cgagcccgacggcagca

SEQ ID NO: 2827101 - RNA, 20 nt, Mycobacterium avium subsp. paratuberculosis
cgagcccgacggcagcaccg

SEQ ID NO: 2827102 - RNA, 23 nt, Mycobacterium avium subsp. paratuberculosis
cgagcccgcaaaucagccgagcc

SEQ ID NO: 2827103 - RNA, 14 nt, Mycobacterium avium subsp. paratuberculosis
cgagcccgccggcg

SEQ ID NO: 2827104 - RNA, 15 nt, Mycobacterium avium subsp. paratuberculosis
cgagcccgccggcgg

SEQ ID NO: 2827105 - RNA, 17 nt, Mycobacterium avium subsp. paratuberculosis
cgagcccgccggcggcg

SEQ ID NO: 2827106 - RNA, 18 nt, Mycobacterium avium subsp. paratuberculosis
cgagcccgccggcggcga

SEQ ID NO: 2827107 - RNA, 21 nt, Mycobacterium avium subsp. paratuberculosis
cgagcccgccggcggguuggc

SEQ ID NO: 2827108 - RNA, 13 nt, Mycobacterium avium subsp. paratuberculosis
cgagcccgcgccc

SEQ ID NO: 2827109 - RNA, 16 nt, Mycobacterium avium subsp. paratuberculosis
cgagcccgcgcccaug

SEQ ID NO: 2827110 - RNA, 13 nt, Mycobacterium avium subsp. paratuberculosis
cgagcccggccag

SEQ ID NO: 2827111 - RNA, 18 nt, Mycobacterium avium subsp. paratuberculosis
cgagcccggccaguccgg

SEQ ID NO: 2827112 - RNA, 16 nt, Mycobacterium avium subsp. paratuberculosis
cgagcccgggaacguc

SEQ ID NO: 2827113 - RNA, 18 nt, Mycobacterium avium subsp. paratuberculosis
cgagcccguucagugacc

SEQ ID NO: 2827114 - RNA, 19 nt, Mycobacterium avium subsp. paratuberculosis
cgagcccugcgccagcagc

SEQ ID NO: 2827115 - RNA, 20 nt, Mycobacterium avium subsp. paratuberculosis
cgagcccugcgccagcagca

SEQ ID NO: 2827116 - RNA, 21 nt, Mycobacterium avium subsp. paratuberculosis
cgagcccugcgccagcagcag

SEQ ID NO: 2827117 - RNA, 16 nt, Mycobacterium avium subsp. paratuberculosis
cgagcccuucgcggug

SEQ ID NO: 2827118 - RNA, 17 nt, Mycobacterium avium subsp. paratuberculosis
cgagcccuucgcggugu

SEQ ID NO: 2827119 - RNA, 18 nt, Mycobacterium avium subsp. paratuberculosis
cgagcccuuugcgcugcc

SEQ ID NO: 2827120 - RNA, 19 nt, Mycobacterium avium subsp. paratuberculosis
cgagcccuuugcgcugccc

SEQ ID NO: 2827121 - RNA, 15 nt, Mycobacterium avium subsp. paratuberculosis
cgagccgaagcgggu

SEQ ID NO: 2827122 - RNA, 19 nt, Mycobacterium avium subsp. paratuberculosis
cgagccgacagucgcgggc

SEQ ID NO: 2827123 - RNA, 21 nt, Mycobacterium avium subsp. paratuberculosis
cgagccgacagucgcgggcgg

SEQ ID NO: 2827124 - RNA, 22 nt, Mycobacterium avium subsp. paratuberculosis
cgagccgacagucgcgggcggg

SEQ ID NO: 2827125 - RNA, 15 nt, Mycobacterium avium subsp. paratuberculosis
cgagccgacccgggc

SEQ ID NO: 2827126 - RNA, 18 nt, Mycobacterium avium subsp. paratuberculosis
cgagccgacccgggcuag

SEQ ID NO: 2827127 - RNA, 12 nt, Mycobacterium avium subsp. paratuberculosis
cgagccgagcac

SEQ ID NO: 2827128 - RNA, 16 nt, Mycobacterium avium subsp. paratuberculosis
cgagccgagcaccggc

SEQ ID NO: 2827129 - RNA, 17 nt, Mycobacterium avium subsp. paratuberculosis
cgagccgagcacgcagc

SEQ ID NO: 2827130 - RNA, 19 nt, Mycobacterium avium subsp. paratuberculosis
cgagccgagcacgcagccg

SEQ ID NO: 2827131 - RNA, 24 nt, Mycobacterium avium subsp. paratuberculosis
cgagccgagcacgcagccgcgccc

SEQ ID NO: 2827132 - RNA, 13 nt, Mycobacterium avium subsp. paratuberculosis
cgagccgagccga

SEQ ID NO: 2827133 - RNA, 14 nt, Mycobacterium avium subsp. paratuberculosis
cgagccgagccgac

SEQ ID NO: 2827134 - RNA, 16 nt, Mycobacterium avium subsp. paratuberculosis
cgagccgagccggucc

SEQ ID NO: 2827135 - RNA, 16 nt, Mycobacterium avium subsp. paratuberculosis
cgagccgaggccgaug

SEQ ID NO: 2827136 - RNA, 17 nt, Mycobacterium avium subsp. paratuberculosis
cgagccgaggccgaugg

SEQ ID NO: 2827137 - RNA, 16 nt, Mycobacterium avium subsp. paratuberculosis
cgagccgaugcccagc

SEQ ID NO: 2827138 - RNA, 18 nt, Mycobacterium avium subsp. paratuberculosis
cgagccgaugcccagcag

SEQ ID NO: 2827139 - RNA, 20 nt, Mycobacterium avium subsp. paratuberculosis
cgagccgaugcccagcagcg

SEQ ID NO: 2827140 - RNA, 22 nt, Mycobacterium avium subsp. paratuberculosis
cgagccgauggaacgcaagaag

SEQ ID NO: 2827141 - RNA, 13 nt, Mycobacterium avium subsp. paratuberculosis
cgagccgcaccgc

SEQ ID NO: 2827142 - RNA, 14 nt, Mycobacterium avium subsp. paratuberculosis
cgagccgcaccgcc

SEQ ID NO: 2827143 - RNA, 24 nt, Mycobacterium avium subsp. paratuberculosis
cgagccggugguuuugcggcccug

SEQ ID NO: 2827144 - RNA, 22 nt, Mycobacterium avium subsp. paratuberculosis
cgagccgguugacccucagcag

SEQ ID NO: 2827145 - RNA, 17 nt, Mycobacterium avium subsp. paratuberculosis
cgagccguaggccaggu

SEQ ID NO: 2827146 - RNA, 13 nt, Mycobacterium avium subsp. paratuberculosis
cgagccgucgaag

SEQ ID NO: 2827147 - RNA, 16 nt, Mycobacterium avium subsp. paratuberculosis
cgagccgucgaccggg

SEQ ID NO: 2827148 - RNA, 12 nt, Mycobacterium avium subsp. paratuberculosis
cgagccgucgcg

SEQ ID NO: 2827149 - RNA, 13 nt, Mycobacterium avium subsp. paratuberculosis
cgagccgucgucg

SEQ ID NO: 2827150 - RNA, 16 nt, Mycobacterium avium subsp. paratuberculosis
cgagccguuugaugcc

SEQ ID NO: 2827151 - RNA, 17 nt, Mycobacterium avium subsp. paratuberculosis
cgagccguuugaugccg

SEQ ID NO: 2827152 - RNA, 19 nt, Mycobacterium avium subsp. paratuberculosis
cgagccguuugaugccguc

SEQ ID NO: 2827153 - RNA, 20 nt, Mycobacterium avium subsp. paratuberculosis
cgagccugggauugccgggc

SEQ ID NO: 2827154 - RNA, 21 nt, Mycobacterium avium subsp. paratuberculosis
cgagccugggauugccgggca

SEQ ID NO: 2827155 - RNA, 20 nt, Mycobacterium avium subsp. paratuberculosis
cgagccuggugauccucguc

SEQ ID NO: 2827156 - RNA, 19 nt, Mycobacterium avium subsp. paratuberculosis
cgagcgaacacgugcagcu

SEQ ID NO: 2827157 - RNA, 22 nt, Mycobacterium avium subsp. paratuberculosis
cgagcgaacacgugcagcucgg

SEQ ID NO: 2827158 - RNA, 22 nt, Mycobacterium avium subsp. paratuberculosis
cgagcgacgccacggggcugcg

SEQ ID NO: 2827159 - RNA, 12 nt, Mycobacterium avium subsp. paratuberculosis
cgagcgagccga

SEQ ID NO: 2827160 - RNA, 16 nt, Mycobacterium avium subsp. paratuberculosis
cgagcgagcgcaccag

SEQ ID NO: 2827161 - RNA, 16 nt, Mycobacterium avium subsp. paratuberculosis
cgagcgcaagggccga

SEQ ID NO: 2827162 - RNA, 19 nt, Mycobacterium avium subsp. paratuberculosis
cgagcgcaagggccgacau

SEQ ID NO: 2827163 - RNA, 12 nt, Mycobacterium avium subsp. paratuberculosis
cgagcgcaccag

SEQ ID NO: 2827164 - RNA, 13 nt, Mycobacterium avium subsp. paratuberculosis
cgagcgcaccgcc

SEQ ID NO: 2827165 - RNA, 14 nt, Mycobacterium avium subsp. paratuberculosis
cgagcgcaccgccc

SEQ ID NO: 2827166 - RNA, 16 nt, Mycobacterium avium subsp. paratuberculosis
cgagcgcaccgcccaa

SEQ ID NO: 2827167 - RNA, 14 nt, Mycobacterium avium subsp. paratuberculosis
cgagcgcaccgcgg

SEQ ID NO: 2827168 - RNA, 19 nt, Mycobacterium avium subsp. paratuberculosis
cgagcgcagcgccaggcag

SEQ ID NO: 2827169 - RNA, 13 nt, Mycobacterium avium subsp. paratuberculosis
cgagcgcagcggg

SEQ ID NO: 2827170 - RNA, 22 nt, Mycobacterium avium subsp. paratuberculosis
cgagcgcaucgacugcgacacc

SEQ ID NO: 2827171 - RNA, 14 nt, Mycobacterium avium subsp. paratuberculosis
cgagcgcccgggcg

SEQ ID NO: 2827172 - RNA, 15 nt, Mycobacterium avium subsp. paratuberculosis
cgagcgcccgggcgu

SEQ ID NO: 2827173 - RNA, 14 nt, Mycobacterium avium subsp. paratuberculosis
cgagcgccggacgc

SEQ ID NO: 2827174 - RNA, 13 nt, Mycobacterium avium subsp. paratuberculosis
cgagcgcgccgag

SEQ ID NO: 2827175 - RNA, 14 nt, Mycobacterium avium subsp. paratuberculosis
cgagcgcgccgaga

SEQ ID NO: 2827176 - RNA, 15 nt, Mycobacterium avium subsp. paratuberculosis
cgagcgcgccgagau

SEQ ID NO: 2827177 - RNA, 17 nt, Mycobacterium avium subsp. paratuberculosis
cgagcgcgccgagcagc

SEQ ID NO: 2827178 - RNA, 20 nt, Mycobacterium avium subsp. paratuberculosis
cgagcgcgccgagcagcugg

SEQ ID NO: 2827179 - RNA, 15 nt, Mycobacterium avium subsp. paratuberculosis
cgagcgcgccgaggu

SEQ ID NO: 2827180 - RNA, 21 nt, Mycobacterium avium subsp. paratuberculosis
cgagcgcgccgagguggcccg

SEQ ID NO: 2827181 - RNA, 13 nt, Mycobacterium avium subsp. paratuberculosis
cgagcgcgccgcc

SEQ ID NO: 2827182 - RNA, 14 nt, Mycobacterium avium subsp. paratuberculosis
cgagcgcgccgccg

SEQ ID NO: 2827183 - RNA, 21 nt, Mycobacterium avium subsp. paratuberculosis
cgagcgcgccgccgccgccca

SEQ ID NO: 2827184 - RNA, 22 nt, Mycobacterium avium subsp. paratuberculosis
cgagcgcgcgaucuccgucacc

SEQ ID NO: 2827185 - RNA, 19 nt, Mycobacterium avium subsp. paratuberculosis
cgagcgcgcucaaccgccc

SEQ ID NO: 2827186 - RNA, 12 nt, Mycobacterium avium subsp. paratuberculosis
cgagcgcgcuga

SEQ ID NO: 2827187 - RNA, 18 nt, Mycobacterium avium subsp. paratuberculosis
cgagcgcgcugaucgccg

SEQ ID NO: 2827188 - RNA, 19 nt, Mycobacterium avium subsp. paratuberculosis
cgagcgcgcuguaggucgc

SEQ ID NO: 2827189 - RNA, 14 nt, Mycobacterium avium subsp. paratuberculosis
cgagcgcggcccgc

SEQ ID NO: 2827190 - RNA, 16 nt, Mycobacterium avium subsp. paratuberculosis
cgagcgcggcccgccg

SEQ ID NO: 2827191 - RNA, 17 nt, Mycobacterium avium subsp. paratuberculosis
cgagcgcggcccgccga

SEQ ID NO: 2827192 - RNA, 19 nt, Mycobacterium avium subsp. paratuberculosis
cgagcgcggcccgccgaac

SEQ ID NO: 2827193 - RNA, 13 nt, Mycobacterium avium subsp. paratuberculosis
cgagcgcgucgac

SEQ ID NO: 2827194 - RNA, 14 nt, Mycobacterium avium subsp. paratuberculosis
cgagcgcgucgacc

SEQ ID NO: 2827195 - RNA, 19 nt, Mycobacterium avium subsp. paratuberculosis
cgagcgcgucgaccagccg

SEQ ID NO: 2827196 - RNA, 20 nt, Mycobacterium avium subsp. paratuberculosis
cgagcgcgucgaccagccgc

SEQ ID NO: 2827197 - RNA, 18 nt, Mycobacterium avium subsp. paratuberculosis
cgagcgcgugcacgaacg

SEQ ID NO: 2827198 - RNA, 19 nt, Mycobacterium avium subsp. paratuberculosis
cgagcgcguucuccaccgc

SEQ ID NO: 2827199 - RNA, 14 nt, Mycobacterium avium subsp. paratuberculosis
cgagcgcuaccgcg

SEQ ID NO: 2827200 - RNA, 15 nt, Mycobacterium avium subsp. paratuberculosis
cgagcgcuaccgcgc

SEQ ID NO: 2827201 - RNA, 20 nt, Mycobacterium avium subsp. paratuberculosis
cgagcgcuaccgcgcucacc

SEQ ID NO: 2827202 - RNA, 22 nt, Mycobacterium avium subsp. paratuberculosis
cgagcgcugcccgugccgcacc

SEQ ID NO: 2827203 - RNA, 19 nt, Mycobacterium avium subsp. paratuberculosis
cgagcgcugguugucgacg

SEQ ID NO: 2827204 - RNA, 23 nt, Mycobacterium avium subsp. paratuberculosis
cgagcgcugguugucgacgcugc

SEQ ID NO: 2827205 - RNA, 15 nt, Mycobacterium avium subsp. paratuberculosis
cgagcggcaccuugg

SEQ ID NO: 2827206 - RNA, 20 nt, Mycobacterium avium subsp. paratuberculosis
cgagcggcccgucgccgauc

SEQ ID NO: 2827207 - RNA, 21 nt, Mycobacterium avium subsp. paratuberculosis
cgagcggcccgucgccgauca

SEQ ID NO: 2827208 - RNA, 13 nt, Mycobacterium avium subsp. paratuberculosis
cgagcggcccugc

SEQ ID NO: 2827209 - RNA, 18 nt, Mycobacterium avium subsp. paratuberculosis
cgagcggcccugcgcggc

SEQ ID NO: 2827210 - RNA, 20 nt, Mycobacterium avium subsp. paratuberculosis
cgagcggcccugcgcggccu

SEQ ID NO: 2827211 - RNA, 12 nt, Mycobacterium avium subsp. paratuberculosis
cgagcggccguc

SEQ ID NO: 2827212 - RNA, 19 nt, Mycobacterium avium subsp. paratuberculosis
cgagcggccguccaccacc

SEQ ID NO: 2827213 - RNA, 22 nt, Mycobacterium avium subsp. paratuberculosis
cgagcggcgacuccagcagcgc

SEQ ID NO: 2827214 - RNA, 14 nt, Mycobacterium avium subsp. paratuberculosis
cgagcggcgcaggc

SEQ ID NO: 2827215 - RNA, 15 nt, Mycobacterium avium subsp. paratuberculosis
cgagcggcgcaggcc

SEQ ID NO: 2827216 - RNA, 17 nt, Mycobacterium avium subsp. paratuberculosis
cgagcggcgcaggccgg

SEQ ID NO: 2827217 - RNA, 19 nt, Mycobacterium avium subsp. paratuberculosis
cgagcggcgcaggccgguc

SEQ ID NO: 2827218 - RNA, 13 nt, Mycobacterium avium subsp. paratuberculosis
cgagcggcgccac

SEQ ID NO: 2827219 - RNA, 17 nt, Mycobacterium avium subsp. paratuberculosis
cgagcggcgccacgugg

SEQ ID NO: 2827220 - RNA, 13 nt, Mycobacterium avium subsp. paratuberculosis
cgagcggcgcugc

SEQ ID NO: 2827221 - RNA, 16 nt, Mycobacterium avium subsp. paratuberculosis
cgagcggcgcugcagc

SEQ ID NO: 2827222 - RNA, 20 nt, Mycobacterium avium subsp. paratuberculosis
cgagcggcgcugcagcagcc

SEQ ID NO: 2827223 - RNA, 22 nt, Mycobacterium avium subsp. paratuberculosis
cgagcggcgcugcagcagcccg

SEQ ID NO: 2827224 - RNA, 23 nt, Mycobacterium avium subsp. paratuberculosis
cgagcggcgcugcagcagcccga

SEQ ID NO: 2827225 - RNA, 14 nt, Mycobacterium avium subsp. paratuberculosis
cgagcggcugcugg

SEQ ID NO: 2827226 - RNA, 21 nt, Mycobacterium avium subsp. paratuberculosis
cgagcggcugcuggucgacgu

SEQ ID NO: 2827227 - RNA, 18 nt, Mycobacterium avium subsp. paratuberculosis
cgagcggcuugccgccgc

SEQ ID NO: 2827228 - RNA, 15 nt, Mycobacterium avium subsp. paratuberculosis
cgagcugggccggcg

SEQ ID NO: 2827229 - RNA, 17 nt, Mycobacterium avium subsp. paratuberculosis
cgagcugggccggcgcc

SEQ ID NO: 2827230 - RNA, 19 nt, Mycobacterium avium subsp. paratuberculosis
cgagcugggccggcgccga

SEQ ID NO: 2827231 - RNA, 14 nt, Mycobacterium avium subsp. paratuberculosis
cgagcuugccgucg

SEQ ID NO: 2827232 - RNA, 15 nt, Mycobacterium avium subsp. paratuberculosis
cgagcuugccgucgu

SEQ ID NO: 2827233 - RNA, 18 nt, Mycobacterium avium subsp. paratuberculosis
cgagcuugccuugcgccc

SEQ ID NO: 2827234 - RNA, 14 nt, Mycobacterium avium subsp. paratuberculosis
cgagcuuggcgggc

SEQ ID NO: 2827235 - RNA, 20 nt, Mycobacterium avium subsp. paratuberculosis
cgagcuuggcgggcgucacg

SEQ ID NO: 2827236 - RNA, 19 nt, Mycobacterium avium subsp. paratuberculosis
cgagcuugggccggugcag

SEQ ID NO: 2827237 - RNA, 18 nt, Mycobacterium avium subsp. paratuberculosis
cgagcuuguccugcaccg

SEQ ID NO: 2827238 - RNA, 18 nt, Mycobacterium avium subsp. paratuberculosis
cgaggaacccgaccgcga

SEQ ID NO: 2827239 - RNA, 19 nt, Mycobacterium avium subsp. paratuberculosis
cgaggaacccgaccgcgau

SEQ ID NO: 2827240 - RNA, 16 nt, Mycobacterium avium subsp. paratuberculosis
cgaggaaccggcagcc

SEQ ID NO: 2827241 - RNA, 20 nt, Mycobacterium avium subsp. paratuberculosis
cgaggaaccggcagccggcg

SEQ ID NO: 2827242 - RNA, 21 nt, Mycobacterium avium subsp. paratuberculosis
cgaggaacucagcgcccagga

SEQ ID NO: 2827243 - RNA, 17 nt, Mycobacterium avium subsp. paratuberculosis
cgaggaacuugcgccgg

SEQ ID NO: 2827244 - RNA, 19 nt, Mycobacterium avium subsp. paratuberculosis
cgaggaacuugcgccgggu

SEQ ID NO: 2827245 - RNA, 20 nt, Mycobacterium avium subsp. paratuberculosis
cgaggaacuugcgccgggug

SEQ ID NO: 2827246 - RNA, 18 nt, Mycobacterium avium subsp. paratuberculosis
cgaggaaguccggcgcgc

SEQ ID NO: 2827247 - RNA, 20 nt, Mycobacterium avium subsp. paratuberculosis
cgaggaaguccggcgcgccc

SEQ ID NO: 2827248 - RNA, 15 nt, Mycobacterium avium subsp. paratuberculosis
cgaggaauccggucc

SEQ ID NO: 2827249 - RNA, 22 nt, Mycobacterium avium subsp. paratuberculosis
cgaggaauugcgcuacggcaga

SEQ ID NO: 2827250 - RNA, 13 nt, Mycobacterium avium subsp. paratuberculosis
cgaggaccagcau

SEQ ID NO: 2827251 - RNA, 14 nt, Mycobacterium avium subsp. paratuberculosis
cgaggaccggcgcc

SEQ ID NO: 2827252 - RNA, 16 nt, Mycobacterium avium subsp. paratuberculosis
cgaggaccggcgccgg

SEQ ID NO: 2827253 - RNA, 17 nt, Mycobacterium avium subsp. paratuberculosis
cgaggaccggcgccggc

SEQ ID NO: 2827254 - RNA, 18 nt, Mycobacterium avium subsp. paratuberculosis
cgaggaccggcgccggcc

SEQ ID NO: 2827255 - RNA, 20 nt, Mycobacterium avium subsp. paratuberculosis
cgaggaccggcgccggccgc

SEQ ID NO: 2827256 - RNA, 21 nt, Mycobacterium avium subsp. paratuberculosis
cgaggaccggcgccggccgcc

SEQ ID NO: 2827257 - RNA, 19 nt, Mycobacterium avium subsp. paratuberculosis
cgaggacggcuugggugug

SEQ ID NO: 2827258 - RNA, 17 nt, Mycobacterium avium subsp. paratuberculosis
cgaggacgucgagcggc

SEQ ID NO: 2827259 - RNA, 18 nt, Mycobacterium avium subsp. paratuberculosis
cgaggacgucgagcggcg

SEQ ID NO: 2827260 - RNA, 15 nt, Mycobacterium avium subsp. paratuberculosis
cgaggacgucgucga

SEQ ID NO: 2827261 - RNA, 16 nt, Mycobacterium avium subsp. paratuberculosis
cgaggacgucgucgac

SEQ ID NO: 2827262 - RNA, 21 nt, Mycobacterium avium subsp. paratuberculosis
cgaggacgucgucgacgucca

SEQ ID NO: 2827263 - RNA, 18 nt, Mycobacterium avium subsp. paratuberculosis
cgaggagacgucggccgg

SEQ ID NO: 2827264 - RNA, 13 nt, Mycobacterium avium subsp. paratuberculosis
cgaggaggccgcg

SEQ ID NO: 2827265 - RNA, 14 nt, Mycobacterium avium subsp. paratuberculosis
cgaggaggccgcgg

SEQ ID NO: 2827266 - RNA, 20 nt, Mycobacterium avium subsp. paratuberculosis
cgaggaggccgcggcgacac

SEQ ID NO: 2827267 - RNA, 17 nt, Mycobacterium avium subsp. paratuberculosis
cgaggaggggucggugc

SEQ ID NO: 2827268 - RNA, 12 nt, Mycobacterium avium subsp. paratuberculosis
cgaggaucgcca

SEQ ID NO: 2827269 - RNA, 20 nt, Mycobacterium avium subsp. paratuberculosis
cgaggaucgcgaugucgacg

SEQ ID NO: 2827270 - RNA, 21 nt, Mycobacterium avium subsp. paratuberculosis
cgaggaucgcgaugucgacgg

SEQ ID NO: 2827271 - RNA, 16 nt, Mycobacterium avium subsp. paratuberculosis
cgaggaucugggcggc

SEQ ID NO: 2827272 - RNA, 22 nt, Mycobacterium avium subsp. paratuberculosis
cgaggaucuugaucgcgaagac

SEQ ID NO: 2827273 - RNA, 16 nt, Mycobacterium avium subsp. paratuberculosis
cgaggaugaccgcggc

SEQ ID NO: 2827274 - RNA, 13 nt, Mycobacterium avium subsp. paratuberculosis
cgaggaugccgcc

SEQ ID NO: 2827275 - RNA, 14 nt, Mycobacterium avium subsp. paratuberculosis
cgaggaugccgccc

SEQ ID NO: 2827276 - RNA, 16 nt, Mycobacterium avium subsp. paratuberculosis
cgaggaugccgcccac

SEQ ID NO: 2827277 - RNA, 17 nt, Mycobacterium avium subsp. paratuberculosis
cgaggaugccgcccacc

SEQ ID NO: 2827278 - RNA, 18 nt, Mycobacterium avium subsp. paratuberculosis
cgaggaugccgcccacca

SEQ ID NO: 2827279 - RNA, 22 nt, Mycobacterium avium subsp. paratuberculosis
cgaggaugccgcccaccaccgg

SEQ ID NO: 2827280 - RNA, 20 nt, Mycobacterium avium subsp. paratuberculosis
cgaggauggggucgcgggcg

SEQ ID NO: 2827281 - RNA, 18 nt, Mycobacterium avium subsp. paratuberculosis
cgaggauuucgcgaucga

SEQ ID NO: 2827282 - RNA, 12 nt, Mycobacterium avium subsp. paratuberculosis
cgaggcacagca

SEQ ID NO: 2827283 - RNA, 15 nt, Mycobacterium avium subsp. paratuberculosis
cgaggcacggcccgc

SEQ ID NO: 2827284 - RNA, 23 nt, Mycobacterium avium subsp. paratuberculosis
cgaggcacggcccgcucgggcca

SEQ ID NO: 2827285 - RNA, 19 nt, Mycobacterium avium subsp. paratuberculosis
cgaggcagaaaugcaggcc

SEQ ID NO: 2827286 - RNA, 18 nt, Mycobacterium avium subsp. paratuberculosis
cgaggcaguuccaugucg

SEQ ID NO: 2827287 - RNA, 14 nt, Mycobacterium avium subsp. paratuberculosis
cgaggccaacucgc

SEQ ID NO: 2827288 - RNA, 18 nt, Mycobacterium avium subsp. paratuberculosis
cgaggccaacucgcgaag

SEQ ID NO: 2827289 - RNA, 19 nt, Mycobacterium avium subsp. paratuberculosis
cgaggccagcacgccgguc

SEQ ID NO: 2827290 - RNA, 22 nt, Mycobacterium avium subsp. paratuberculosis
cgaggccagcacgccggucagc

SEQ ID NO: 2827291 - RNA, 21 nt, Mycobacterium avium subsp. paratuberculosis
cgaggccagcagauacuccuc

SEQ ID NO: 2827292 - RNA, 12 nt, Mycobacterium avium subsp. paratuberculosis
cgaggccagcgc

SEQ ID NO: 2827293 - RNA, 13 nt, Mycobacterium avium subsp. paratuberculosis
cgaggccagcgcg

SEQ ID NO: 2827294 - RNA, 14 nt, Mycobacterium avium subsp. paratuberculosis
cgaggccagcgcga

SEQ ID NO: 2827295 - RNA, 18 nt, Mycobacterium avium subsp. paratuberculosis
cgaggccagggcccgcag

SEQ ID NO: 2827296 - RNA, 19 nt, Mycobacterium avium subsp. paratuberculosis
cgaggccagggcccgcagc

SEQ ID NO: 2827297 - RNA, 16 nt, Mycobacterium avium subsp. paratuberculosis
cgaggccaucaucccg

SEQ ID NO: 2827298 - RNA, 16 nt, Mycobacterium avium subsp. paratuberculosis
cgaggccccgccagau

SEQ ID NO: 2827299 - RNA, 15 nt, Mycobacterium avium subsp. paratuberculosis
cgaggccccgcguga

SEQ ID NO: 2827300 - RNA, 17 nt, Mycobacterium avium subsp. paratuberculosis
cgaggccccgcgugacg

SEQ ID NO: 2827301 - RNA, 20 nt, Mycobacterium avium subsp. paratuberculosis
cgaggccccgcgugacggcc

SEQ ID NO: 2827302 - RNA, 17 nt, Mycobacterium avium subsp. paratuberculosis
cgaggcccggacggcca

SEQ ID NO: 2827303 - RNA, 16 nt, Mycobacterium avium subsp. paratuberculosis
cgaggcccucgacacc

SEQ ID NO: 2827304 - RNA, 17 nt, Mycobacterium avium subsp. paratuberculosis
cgaggccgaaccgcagc

SEQ ID NO: 2827305 - RNA, 14 nt, Mycobacterium avium subsp. paratuberculosis
cgaggccgacgugg

SEQ ID NO: 2827306 - RNA, 23 nt, Mycobacterium avium subsp. paratuberculosis
cgaggccgcccgcuccugcaggc

SEQ ID NO: 2827307 - RNA, 13 nt, Mycobacterium avium subsp. paratuberculosis
cgaggccgcgccg

SEQ ID NO: 2827308 - RNA, 14 nt, Mycobacterium avium subsp. paratuberculosis
cgaggccgcgccgu

SEQ ID NO: 2827309 - RNA, 16 nt, Mycobacterium avium subsp. paratuberculosis
cgaggccgcgccgugc

SEQ ID NO: 2827310 - RNA, 17 nt, Mycobacterium avium subsp. paratuberculosis
cgaggccgcgccgugcg

SEQ ID NO: 2827311 - RNA, 22 nt, Mycobacterium avium subsp. paratuberculosis
cgaggccgcgggcguucaucac

SEQ ID NO: 2827312 - RNA, 17 nt, Mycobacterium avium subsp. paratuberculosis
cgaggccgcugacaagc

SEQ ID NO: 2827313 - RNA, 17 nt, Mycobacterium avium subsp. paratuberculosis
cgaggucaccaacgcga

SEQ ID NO: 2827314 - RNA, 15 nt, Mycobacterium avium subsp. paratuberculosis
cgaggucaccaccga

SEQ ID NO: 2827315 - RNA, 22 nt, Mycobacterium avium subsp. paratuberculosis
cgaggucaccaccgagccggug

SEQ ID NO: 2827316 - RNA, 14 nt, Mycobacterium avium subsp. paratuberculosis
cgaggucaccgcga

SEQ ID NO: 2827317 - RNA, 14 nt, Mycobacterium avium subsp. paratuberculosis
cgaggucaccgcgg

SEQ ID NO: 2827318 - RNA, 17 nt, Mycobacterium avium subsp. paratuberculosis
cgaggucaccgcgggaa

SEQ ID NO: 2827319 - RNA, 14 nt, Mycobacterium avium subsp. paratuberculosis
cgaggucagcgcgu

SEQ ID NO: 2827320 - RNA, 20 nt, Mycobacterium avium subsp. paratuberculosis
cgaggucauaucgacggccc

SEQ ID NO: 2827321 - RNA, 12 nt, Mycobacterium avium subsp. paratuberculosis
cgaggucaucga

SEQ ID NO: 2827322 - RNA, 16 nt, Mycobacterium avium subsp. paratuberculosis
cgaggucaucgagccg

SEQ ID NO: 2827323 - RNA, 17 nt, Mycobacterium avium subsp. paratuberculosis
cgaggucaucgagccga

SEQ ID NO: 2827324 - RNA, 17 nt, Mycobacterium avium subsp. paratuberculosis
cgagguccucggcgaug

SEQ ID NO: 2827325 - RNA, 23 nt, Mycobacterium avium subsp. paratuberculosis
cgagguccuugcggaaccgcugc

SEQ ID NO: 2827326 - RNA, 17 nt, Mycobacterium avium subsp. paratuberculosis
cgaggucgaaccacgcg

SEQ ID NO: 2827327 - RNA, 12 nt, Mycobacterium avium subsp. paratuberculosis
cgaggucgacgg

SEQ ID NO: 2827328 - RNA, 22 nt, Mycobacterium avium subsp. paratuberculosis
cgaggucgacggagucgucggc

SEQ ID NO: 2827329 - RNA, 23 nt, Mycobacterium avium subsp. paratuberculosis
cgaggucgacggagucgucggcg

SEQ ID NO: 2827330 - RNA, 16 nt, Mycobacterium avium subsp. paratuberculosis
cgaggucgccgacagc

SEQ ID NO: 2827331 - RNA, 20 nt, Mycobacterium avium subsp. paratuberculosis
cgaggucgccgacagcgucg

SEQ ID NO: 2827332 - RNA, 18 nt, Mycobacterium avium subsp. paratuberculosis
cgaggucgccgacgccgu

SEQ ID NO: 2827333 - RNA, 20 nt, Mycobacterium avium subsp. paratuberculosis
cgaggucgccgacgccgucg

SEQ ID NO: 2827334 - RNA, 17 nt, Mycobacterium avium subsp. paratuberculosis
cgaggucgccgguguca

SEQ ID NO: 2827335 - RNA, 14 nt, Mycobacterium avium subsp. paratuberculosis
cgaggucgcgcagc

SEQ ID NO: 2827336 - RNA, 16 nt, Mycobacterium avium subsp. paratuberculosis
cgaggucgcgcagcac

SEQ ID NO: 2827337 - RNA, 17 nt, Mycobacterium avium subsp. paratuberculosis
cgaggucgcgcagcacc

SEQ ID NO: 2827338 - RNA, 16 nt, Mycobacterium avium subsp. paratuberculosis
cgaggucgcggcggcc

SEQ ID NO: 2827339 - RNA, 21 nt, Mycobacterium avium subsp. paratuberculosis
cgaggucgcggcggccggcgc

SEQ ID NO: 2827340 - RNA, 23 nt, Mycobacterium avium subsp. paratuberculosis
cgaggucgcggcggccggcgccg

SEQ ID NO: 2827341 - RNA, 16 nt, Mycobacterium avium subsp. paratuberculosis
cgaggucggacgccuc

SEQ ID NO: 2827342 - RNA, 17 nt, Mycobacterium avium subsp. paratuberculosis
cgaggucggacgccucc

SEQ ID NO: 2827343 - RNA, 11 nt, Mycobacterium avium subsp. paratuberculosis
cgaggucggcc

SEQ ID NO: 2827344 - RNA, 14 nt, Mycobacterium avium subsp. paratuberculosis
cgaggucggccagc

SEQ ID NO: 2827345 - RNA, 15 nt, Mycobacterium avium subsp. paratuberculosis
cgaggucggccagca

SEQ ID NO: 2827346 - RNA, 22 nt, Mycobacterium avium subsp. paratuberculosis
cgaggucggccagcaggucguc

SEQ ID NO: 2827347 - RNA, 19 nt, Mycobacterium avium subsp. paratuberculosis
cgaggucggucgcggcauc

SEQ ID NO: 2827348 - RNA, 20 nt, Mycobacterium avium subsp. paratuberculosis
cgaggucggucgcggcaucc

SEQ ID NO: 2827349 - RNA, 12 nt, Mycobacterium avium subsp. paratuberculosis
cgaggucgguga

SEQ ID NO: 2827350 - RNA, 19 nt, Mycobacterium avium subsp. paratuberculosis
cgaggucggugaggcuggg

SEQ ID NO: 2827351 - RNA, 24 nt, Mycobacterium avium subsp. paratuberculosis
cgaggucguagaugguccgcagau

SEQ ID NO: 2827352 - RNA, 12 nt, Mycobacterium avium subsp. paratuberculosis
cgaggucgucga

SEQ ID NO: 2827353 - RNA, 16 nt, Mycobacterium avium subsp. paratuberculosis
cgaggucgucgagggc

SEQ ID NO: 2827354 - RNA, 23 nt, Mycobacterium avium subsp. paratuberculosis
cgaggucgucgagggccaccggc

SEQ ID NO: 2827355 - RNA, 14 nt, Mycobacterium avium subsp. paratuberculosis
cgaggucgucggcc

SEQ ID NO: 2827356 - RNA, 15 nt, Mycobacterium avium subsp. paratuberculosis
cgaggucgucggcca

SEQ ID NO: 2827357 - RNA, 16 nt, Mycobacterium avium subsp. paratuberculosis
cgaggucgucggccag

SEQ ID NO: 2827358 - RNA, 19 nt, Mycobacterium avium subsp. paratuberculosis
cgaggucgucgggcgccgg

SEQ ID NO: 2827359 - RNA, 20 nt, Mycobacterium avium subsp. paratuberculosis
cgaggucguucgacaugcug

SEQ ID NO: 2827360 - RNA, 20 nt, Mycobacterium avium subsp. paratuberculosis
cgaggucuucggucccggcg

SEQ ID NO: 2827361 - RNA, 22 nt, Mycobacterium avium subsp. paratuberculosis
cgaggucuuggugaugcgcugc

SEQ ID NO: 2827362 - RNA, 17 nt, Mycobacterium avium subsp. paratuberculosis
cgaggugaaccgcgacg

SEQ ID NO: 2827363 - RNA, 20 nt, Mycobacterium avium subsp. paratuberculosis
cgaggugaaccgcgacgcga

SEQ ID NO: 2827364 - RNA, 22 nt, Mycobacterium avium subsp. paratuberculosis
cgaggugaaccgcgacgcgauc

SEQ ID NO: 2827365 - RNA, 22 nt, Mycobacterium avium subsp. paratuberculosis
cgaggugaagccguugucgagu

SEQ ID NO: 2827366 - RNA, 16 nt, Mycobacterium avium subsp. paratuberculosis
cgaggugaagucgucc

SEQ ID NO: 2827367 - RNA, 20 nt, Mycobacterium avium subsp. paratuberculosis
cgaggugaagucguccagcg

SEQ ID NO: 2827368 - RNA, 23 nt, Mycobacterium avium subsp. paratuberculosis
cgaggugaagucguccagcgucg

SEQ ID NO: 2827369 - RNA, 24 nt, Mycobacterium avium subsp. paratuberculosis
cgaggugaagucguccagcgucga

SEQ ID NO: 2827370 - RNA, 17 nt, Mycobacterium avium subsp. paratuberculosis
cgaggugaccggcgagg

SEQ ID NO: 2827371 - RNA, 15 nt, Mycobacterium avium subsp. paratuberculosis
cgaggugacgucgcg

SEQ ID NO: 2827372 - RNA, 18 nt, Mycobacterium avium subsp. paratuberculosis
cgaggugacgucgcgccg

SEQ ID NO: 2827373 - RNA, 23 nt, Mycobacterium avium subsp. paratuberculosis
cgaggugacgucgcgccgcucgg

SEQ ID NO: 2827374 - RNA, 22 nt, Mycobacterium avium subsp. paratuberculosis
cgaggugaucgcgaacgcgccg

SEQ ID NO: 2827375 - RNA, 17 nt, Mycobacterium avium subsp. paratuberculosis
cgaggugaugccgucca

SEQ ID NO: 2827376 - RNA, 20 nt, Mycobacterium avium subsp. paratuberculosis
cgaggugauguuggccgcga

SEQ ID NO: 2827377 - RNA, 22 nt, Mycobacterium avium subsp. paratuberculosis
cgaggugauguuggccgcgacg

SEQ ID NO: 2827378 - RNA, 21 nt, Mycobacterium avium subsp. paratuberculosis
cgaggugcaacacucgagcgc

SEQ ID NO: 2827379 - RNA, 22 nt, Mycobacterium avium subsp. paratuberculosis
cgaggugcaacacucgagcgcg

SEQ ID NO: 2827380 - RNA, 16 nt, Mycobacterium avium subsp. paratuberculosis
cgaggugcacgcccag

SEQ ID NO: 2827381 - RNA, 17 nt, Mycobacterium avium subsp. paratuberculosis
cgaggugcacgcccaga

SEQ ID NO: 2827382 - RNA, 16 nt, Mycobacterium avium subsp. paratuberculosis
cgagguggcccagccg

SEQ ID NO: 2827383 - RNA, 13 nt, Mycobacterium avium subsp. paratuberculosis
cgagguggcccgc

SEQ ID NO: 2827384 - RNA, 18 nt, Mycobacterium avium subsp. paratuberculosis
cgagguggcccgccacgu

SEQ ID NO: 2827385 - RNA, 13 nt, Mycobacterium avium subsp. paratuberculosis
cgagguggccgcc

SEQ ID NO: 2827386 - RNA, 14 nt, Mycobacterium avium subsp. paratuberculosis
cgagguggccgcca

SEQ ID NO: 2827387 - RNA, 20 nt, Mycobacterium avium subsp. paratuberculosis
cgaggugggcaccagcugcg

SEQ ID NO: 2827388 - RNA, 23 nt, Mycobacterium avium subsp. paratuberculosis
cgaggugguuucggggucgccgu

SEQ ID NO: 2827389 - RNA, 17 nt, Mycobacterium avium subsp. paratuberculosis
cgaggugucgacgcuga

SEQ ID NO: 2827390 - RNA, 16 nt, Mycobacterium avium subsp. paratuberculosis
cgaggugugaggaguc

SEQ ID NO: 2827391 - RNA, 20 nt, Mycobacterium avium subsp. paratuberculosis
cgaggugugaggagucggga

SEQ ID NO: 2827392 - RNA, 21 nt, Mycobacterium avium subsp. paratuberculosis
cgaggugugaggagucgggca

SEQ ID NO: 2827393 - RNA, 22 nt, Mycobacterium avium subsp. paratuberculosis
cgagguguugucgugccgggug

SEQ ID NO: 2827394 - RNA, 22 nt, Mycobacterium avium subsp. paratuberculosis
cgagguucauguggaagccgcg

SEQ ID NO: 2827395 - RNA, 16 nt, Mycobacterium avium subsp. paratuberculosis
cgagguucucgaacgg

SEQ ID NO: 2827396 - RNA, 20 nt, Mycobacterium avium subsp. paratuberculosis
cgagguucucgaacgggucg

SEQ ID NO: 2827397 - RNA, 15 nt, Mycobacterium avium subsp. paratuberculosis
cgaguucgccgucga

SEQ ID NO: 2827398 - RNA, 17 nt, Mycobacterium avium subsp. paratuberculosis
cgaguucgccgucgacg

SEQ ID NO: 2827399 - RNA, 16 nt, Mycobacterium avium subsp. paratuberculosis
cgaguucggccagauc

SEQ ID NO: 2827400 - RNA, 16 nt, Mycobacterium avium subsp. paratuberculosis
cgaguucggcggcccg

SEQ ID NO: 2827401 - RNA, 17 nt, Mycobacterium avium subsp. paratuberculosis
cgaguucggcggcccgc

SEQ ID NO: 2827402 - RNA, 14 nt, Mycobacterium avium subsp. paratuberculosis
cgaguucgucgacc

SEQ ID NO: 2827403 - RNA, 19 nt, Mycobacterium avium subsp. paratuberculosis
cgaguucgucgaccagcgg

SEQ ID NO: 2827404 - RNA, 21 nt, Mycobacterium avium subsp. paratuberculosis
cgaguucgucgaccagcgggc

SEQ ID NO: 2827405 - RNA, 18 nt, Mycobacterium avium subsp. paratuberculosis
cgaguucugguaggcggc

SEQ ID NO: 2827406 - RNA, 13 nt, Mycobacterium avium subsp. paratuberculosis
cgaguugaacgcg

SEQ ID NO: 2827407 - RNA, 21 nt, Mycobacterium avium subsp. paratuberculosis
cgaguugauaggucacgccgg

SEQ ID NO: 2827408 - RNA, 14 nt, Mycobacterium avium subsp. paratuberculosis
cgaguugccguugu

SEQ ID NO: 2827409 - RNA, 17 nt, Mycobacterium avium subsp. paratuberculosis
cgaguuguugggccgaa

SEQ ID NO: 2827410 - RNA, 15 nt, Mycobacterium avium subsp. paratuberculosis
cgaguuucccgucgu

SEQ ID NO: 2827411 - RNA, 20 nt, Mycobacterium avium subsp. paratuberculosis
cgaguuucccgucgucgaug

SEQ ID NO: 2827412 - RNA, 15 nt, Mycobacterium avium subsp. paratuberculosis
cgaguuuggccagcu

SEQ ID NO: 2827413 - RNA, 23 nt, Mycobacterium avium subsp. paratuberculosis
cgaguuuggccugaaccagcucg

SEQ ID NO: 2827414 - RNA, 18 nt, Mycobacterium avium subsp. paratuberculosis
cgauaaccucggcggcgg

SEQ ID NO: 2827415 - RNA, 22 nt, Mycobacterium avium subsp. paratuberculosis
cgauaaccucggcggcggcgcg

SEQ ID NO: 2827416 - RNA, 20 nt, Mycobacterium avium subsp. paratuberculosis
cgauaacgcgcgcgccgucu

SEQ ID NO: 2827417 - RNA, 15 nt, Mycobacterium avium subsp. paratuberculosis
cgauaauggcggccg

SEQ ID NO: 2827418 - RNA, 18 nt, Mycobacterium avium subsp. paratuberculosis
cgauaccagccgcggacg

SEQ ID NO: 2827419 - RNA, 21 nt, Mycobacterium avium subsp. paratuberculosis
cgauaccagccgcggacggcc

SEQ ID NO: 2827420 - RNA, 14 nt, Mycobacterium avium subsp. paratuberculosis
cgauacccgggagc

SEQ ID NO: 2827421 - RNA, 20 nt, Mycobacterium avium subsp. paratuberculosis
cgauaccguccgcgcccacc

SEQ ID NO: 2827422 - RNA, 19 nt, Mycobacterium avium subsp. paratuberculosis
cgauacgugcucccgccga

SEQ ID NO: 2827423 - RNA, 16 nt, Mycobacterium avium subsp. paratuberculosis
cgauagaccucacggu

SEQ ID NO: 2827424 - RNA, 22 nt, Mycobacterium avium subsp. paratuberculosis
cgauagccccgccaggcggcga

SEQ ID NO: 2827425 - RNA, 15 nt, Mycobacterium avium subsp. paratuberculosis
cgauagucgcgggug

SEQ ID NO: 2827426 - RNA, 15 nt, Mycobacterium avium subsp. paratuberculosis
cgauaucggccgcgg

SEQ ID NO: 2827427 - RNA, 22 nt, Mycobacterium avium subsp. paratuberculosis
cgauaugcugcaacggcuggcg

SEQ ID NO: 2827428 - RNA, 17 nt, Mycobacterium avium subsp. paratuberculosis
cgauauggaucagaccc

SEQ ID NO: 2827429 - RNA, 20 nt, Mycobacterium avium subsp. paratuberculosis
cgaucaacaccaacgacagc

SEQ ID NO: 2827430 - RNA, 21 nt, Mycobacterium avium subsp. paratuberculosis
cgaucaacaccaacgacagcg

SEQ ID NO: 2827431 - RNA, 19 nt, Mycobacterium avium subsp. paratuberculosis
cgaucaacaccgccagcac

SEQ ID NO: 2827432 - RNA, 20 nt, Mycobacterium avium subsp. paratuberculosis
cgaucaacaccgccagcacc

SEQ ID NO: 2827433 - RNA, 21 nt, Mycobacterium avium subsp. paratuberculosis
cgaucaacaccgccagcaccg

SEQ ID NO: 2827434 - RNA, 23 nt, Mycobacterium avium subsp. paratuberculosis
cgaucaacaccgccagcaccgcc

SEQ ID NO: 2827435 - RNA, 21 nt, Mycobacterium avium subsp. paratuberculosis
cgaucaacaccgguccggccg

SEQ ID NO: 2827436 - RNA, 17 nt, Mycobacterium avium subsp. paratuberculosis
cgaucaacaggcccagc

SEQ ID NO: 2827437 - RNA, 18 nt, Mycobacterium avium subsp. paratuberculosis
cgaucaacaggcccagca

SEQ ID NO: 2827438 - RNA, 20 nt, Mycobacterium avium subsp. paratuberculosis
cgaucaacaggcccagcagc

SEQ ID NO: 2827439 - RNA, 21 nt, Mycobacterium avium subsp. paratuberculosis
cgaucaacaggcccagcagcg

SEQ ID NO: 2827440 - RNA, 22 nt, Mycobacterium avium subsp. paratuberculosis
cgaucaacgccgggucgacgcc

SEQ ID NO: 2827441 - RNA, 23 nt, Mycobacterium avium subsp. paratuberculosis
cgaucaacgccgggucgacgccg

SEQ ID NO: 2827442 - RNA, 16 nt, Mycobacterium avium subsp. paratuberculosis
cgaucaacggcagcga

SEQ ID NO: 2827443 - RNA, 17 nt, Mycobacterium avium subsp. paratuberculosis
cgaucaacgggucgagc

SEQ ID NO: 2827444 - RNA, 23 nt, Mycobacterium avium subsp. paratuberculosis
cgaucaacugaucgagcucggcc

SEQ ID NO: 2827445 - RNA, 16 nt, Mycobacterium avium subsp. paratuberculosis
cgaucacaccaccacg

SEQ ID NO: 2827446 - RNA, 15 nt, Mycobacterium avium subsp. paratuberculosis
cgaucaccaccaccg

SEQ ID NO: 2827447 - RNA, 18 nt, Mycobacterium avium subsp. paratuberculosis
cgaucaccaccaccgccg

SEQ ID NO: 2827448 - RNA, 19 nt, Mycobacterium avium subsp. paratuberculosis
cgaucaccaccaccgccgu

SEQ ID NO: 2827449 - RNA, 21 nt, Mycobacterium avium subsp. paratuberculosis
cgaucaccaccaccgccguca

SEQ ID NO: 2827450 - RNA, 19 nt, Mycobacterium avium subsp. paratuberculosis
cgaucaccaccccggugcc

SEQ ID NO: 2827451 - RNA, 12 nt, Mycobacterium avium subsp. paratuberculosis
cgaucacccagg

SEQ ID NO: 2827452 - RNA, 13 nt, Mycobacterium avium subsp. paratuberculosis
cgaucaccccggc

SEQ ID NO: 2827453 - RNA, 15 nt, Mycobacterium avium subsp. paratuberculosis
cgaucaccccggcga

SEQ ID NO: 2827454 - RNA, 18 nt, Mycobacterium avium subsp. paratuberculosis
cgaucaccccggcgacgg

SEQ ID NO: 2827455 - RNA, 19 nt, Mycobacterium avium subsp. paratuberculosis
cgaucaccccggcgacggc

SEQ ID NO: 2827456 - RNA, 20 nt, Mycobacterium avium subsp. paratuberculosis
cgaucaccccggcgacggcg

SEQ ID NO: 2827457 - RNA, 21 nt, Mycobacterium avium subsp. paratuberculosis
cgaucaccccggcgacggcgg

SEQ ID NO: 2827458 - RNA, 22 nt, Mycobacterium avium subsp. paratuberculosis
cgaucaccccggcgacggcggu

SEQ ID NO: 2827459 - RNA, 23 nt, Mycobacterium avium subsp. paratuberculosis
cgaucaccccggcgacggcggug

SEQ ID NO: 2827460 - RNA, 11 nt, Mycobacterium avium subsp. paratuberculosis
cgaucaccgac

SEQ ID NO: 2827461 - RNA, 14 nt, Mycobacterium avium subsp. paratuberculosis
cgaucaccgacagc

SEQ ID NO: 2827462 - RNA, 12 nt, Mycobacterium avium subsp. paratuberculosis
cgaucaccgccg

SEQ ID NO: 2827463 - RNA, 14 nt, Mycobacterium avium subsp. paratuberculosis
cgaucaccgccgcg

SEQ ID NO: 2827464 - RNA, 17 nt, Mycobacterium avium subsp. paratuberculosis
cgaucaccgccgcggcg

SEQ ID NO: 2827465 - RNA, 19 nt, Mycobacterium avium subsp. paratuberculosis
cgaucaccgccgcggcgac

SEQ ID NO: 2827466 - RNA, 20 nt, Mycobacterium avium subsp. paratuberculosis
cgaucaccgcggccaccacc

SEQ ID NO: 2827467 - RNA, 22 nt, Mycobacterium avium subsp. paratuberculosis
cgaucaccgcggccaccaccgc

SEQ ID NO: 2827468 - RNA, 14 nt, Mycobacterium avium subsp. paratuberculosis
cgaucaccgcggcg

SEQ ID NO: 2827469 - RNA, 17 nt, Mycobacterium avium subsp. paratuberculosis
cgaucaccgcggcgagc

SEQ ID NO: 2827470 - RNA, 12 nt, Mycobacterium avium subsp. paratuberculosis
cgaucaccgcgu

SEQ ID NO: 2827471 - RNA, 21 nt, Mycobacterium avium subsp. paratuberculosis
cgaucaccgcguucucggcgg

SEQ ID NO: 2827472 - RNA, 22 nt, Mycobacterium avium subsp. paratuberculosis
cgaucaccgcguucucggcgga

SEQ ID NO: 2827473 - RNA, 20 nt, Mycobacterium avium subsp. paratuberculosis
cgaucaccgcguugucggcg

SEQ ID NO: 2827474 - RNA, 23 nt, Mycobacterium avium subsp. paratuberculosis
cgaucaccgcguugucggcgacg

SEQ ID NO: 2827475 - RNA, 14 nt, Mycobacterium avium subsp. paratuberculosis
cgaucaccgcugcc

SEQ ID NO: 2827476 - RNA, 15 nt, Mycobacterium avium subsp. paratuberculosis
cgaucaccgcugcca

SEQ ID NO: 2827477 - RNA, 13 nt, Mycobacterium avium subsp. paratuberculosis
cgaucaccggcac

SEQ ID NO: 2827478 - RNA, 14 nt, Mycobacterium avium subsp. paratuberculosis
cgaucaccggcagc

SEQ ID NO: 2827479 - RNA, 19 nt, Mycobacterium avium subsp. paratuberculosis
cgaucaccggcagcagcgc

SEQ ID NO: 2827480 - RNA, 13 nt, Mycobacterium avium subsp. paratuberculosis
cgaucaccggcgc

SEQ ID NO: 2827481 - RNA, 17 nt, Mycobacterium avium subsp. paratuberculosis
cgaucagggccgcggcc

SEQ ID NO: 2827482 - RNA, 22 nt, Mycobacterium avium subsp. paratuberculosis
cgaucagggccgcggccgccgc

SEQ ID NO: 2827483 - RNA, 16 nt, Mycobacterium avium subsp. paratuberculosis
cgaucagggcggcgcc

SEQ ID NO: 2827484 - RNA, 17 nt, Mycobacterium avium subsp. paratuberculosis
cgaucagggcggcgccg

SEQ ID NO: 2827485 - RNA, 15 nt, Mycobacterium avium subsp. paratuberculosis
cgaucaggguccagg

SEQ ID NO: 2827486 - RNA, 21 nt, Mycobacterium avium subsp. paratuberculosis
cgaucagggugucgaacagca

SEQ ID NO: 2827487 - RNA, 17 nt, Mycobacterium avium subsp. paratuberculosis
cgaucaguauggagaaa

SEQ ID NO: 2827488 - RNA, 13 nt, Mycobacterium avium subsp. paratuberculosis
cgaucagucgucc

SEQ ID NO: 2827489 - RNA, 15 nt, Mycobacterium avium subsp. paratuberculosis
cgaucagugccgcgc

SEQ ID NO: 2827490 - RNA, 18 nt, Mycobacterium avium subsp. paratuberculosis
cgaucagugccgcgccaa

SEQ ID NO: 2827491 - RNA, 14 nt, Mycobacterium avium subsp. paratuberculosis
cgaucaucaccacc

SEQ ID NO: 2827492 - RNA, 20 nt, Mycobacterium avium subsp. paratuberculosis
cgaucaucaccaccgccgcc

SEQ ID NO: 2827493 - RNA, 18 nt, Mycobacterium avium subsp. paratuberculosis
cgaucauccaggugaaca

SEQ ID NO: 2827494 - RNA, 17 nt, Mycobacterium avium subsp. paratuberculosis
cgaucaucgcgucggug

SEQ ID NO: 2827495 - RNA, 18 nt, Mycobacterium avium subsp. paratuberculosis
cgaucaucgcgucggugu

SEQ ID NO: 2827496 - RNA, 13 nt, Mycobacterium avium subsp. paratuberculosis
cgaucaucgucgu

SEQ ID NO: 2827497 - RNA, 14 nt, Mycobacterium avium subsp. paratuberculosis
cgaucaucgucguc

SEQ ID NO: 2827498 - RNA, 14 nt, Mycobacterium avium subsp. paratuberculosis
cgaucauggucggc

SEQ ID NO: 2827499 - RNA, 18 nt, Mycobacterium avium subsp. paratuberculosis
cgaucauggucggcgacg

SEQ ID NO: 2827500 - RNA, 18 nt, Mycobacterium avium subsp. paratuberculosis
cgaucauguagcgcuggu

SEQ ID NO: 2827501 - RNA, 23 nt, Mycobacterium avium subsp. paratuberculosis
cgaucauuccgccgaaacccgcu

SEQ ID NO: 2827502 - RNA, 19 nt, Mycobacterium avium subsp. paratuberculosis
cgauccaaccgagucgcug

SEQ ID NO: 2827503 - RNA, 13 nt, Mycobacterium avium subsp. paratuberculosis
cgauccacagcgc

SEQ ID NO: 2827504 - RNA, 15 nt, Mycobacterium avium subsp. paratuberculosis
cgauccacagcgcga

SEQ ID NO: 2827505 - RNA, 16 nt, Mycobacterium avium subsp. paratuberculosis
cgauccacccaccggc

SEQ ID NO: 2827506 - RNA, 15 nt, Mycobacterium avium subsp. paratuberculosis
cgauccacggcgacc

SEQ ID NO: 2827507 - RNA, 17 nt, Mycobacterium avium subsp. paratuberculosis
cgauccacggcgacccc

SEQ ID NO: 2827508 - RNA, 16 nt, Mycobacterium avium subsp. paratuberculosis
cgauccacucccgcgc

SEQ ID NO: 2827509 - RNA, 20 nt, Mycobacterium avium subsp. paratuberculosis
cgauccacucccgcgcgcug

SEQ ID NO: 2827510 - RNA, 16 nt, Mycobacterium avium subsp. paratuberculosis
cgauccacuggaugcc

SEQ ID NO: 2827511 - RNA, 21 nt, Mycobacterium avium subsp. paratuberculosis
cgauccagacggucuuggcgu

SEQ ID NO: 2827512 - RNA, 18 nt, Mycobacterium avium subsp. paratuberculosis
cgauccagcgcuggccgg

SEQ ID NO: 2827513 - RNA, 22 nt, Mycobacterium avium subsp. paratuberculosis
cgauccagcgcuggccggccac

SEQ ID NO: 2827514 - RNA, 16 nt, Mycobacterium avium subsp. paratuberculosis
cgauccagggcccgcu

SEQ ID NO: 2827515 - RNA, 12 nt, Mycobacterium avium subsp. paratuberculosis
cgaucccagacc

SEQ ID NO: 2827516 - RNA, 22 nt, Mycobacterium avium subsp. paratuberculosis
cgaucccagacccagcaucgcc

SEQ ID NO: 2827517 - RNA, 13 nt, Mycobacterium avium subsp. paratuberculosis
cgauccccgcagc

SEQ ID NO: 2827518 - RNA, 14 nt, Mycobacterium avium subsp. paratuberculosis
cgauccccgcagcu

SEQ ID NO: 2827519 - RNA, 21 nt, Mycobacterium avium subsp. paratuberculosis
cgauccccgcagcucccccgg

SEQ ID NO: 2827520 - RNA, 22 nt, Mycobacterium avium subsp. paratuberculosis
cgauccccgcagcucccccggc

SEQ ID NO: 2827521 - RNA, 17 nt, Mycobacterium avium subsp. paratuberculosis
cgaucccgaugcggacg

SEQ ID NO: 2827522 - RNA, 12 nt, Mycobacterium avium subsp. paratuberculosis
cgaucccgccgc

SEQ ID NO: 2827523 - RNA, 14 nt, Mycobacterium avium subsp. paratuberculosis
cgaucccgccgccc

SEQ ID NO: 2827524 - RNA, 16 nt, Mycobacterium avium subsp. paratuberculosis
cgaucccgccgcccgc

SEQ ID NO: 2827525 - RNA, 14 nt, Mycobacterium avium subsp. paratuberculosis
cgaucccgccggcg

SEQ ID NO: 2827526 - RNA, 17 nt, Mycobacterium avium subsp. paratuberculosis
cgaucccgccggcgauc

SEQ ID NO: 2827527 - RNA, 18 nt, Mycobacterium avium subsp. paratuberculosis
cgaucccgccggcgaucg

SEQ ID NO: 2827528 - RNA, 20 nt, Mycobacterium avium subsp. paratuberculosis
cgaucccggccacgucgaug

SEQ ID NO: 2827529 - RNA, 13 nt, Mycobacterium avium subsp. paratuberculosis
cgaucccggccag

SEQ ID NO: 2827530 - RNA, 14 nt, Mycobacterium avium subsp. paratuberculosis
cgaucccggccagc

SEQ ID NO: 2827531 - RNA, 15 nt, Mycobacterium avium subsp. paratuberculosis
cgaucccggccagca

SEQ ID NO: 2827532 - RNA, 18 nt, Mycobacterium avium subsp. paratuberculosis
cgaucccggcgagcacgc

SEQ ID NO: 2827533 - RNA, 21 nt, Mycobacterium avium subsp. paratuberculosis
cgaucccggcgagcacgccgc

SEQ ID NO: 2827534 - RNA, 16 nt, Mycobacterium avium subsp. paratuberculosis
cgaucccgggccguuc

SEQ ID NO: 2827535 - RNA, 19 nt, Mycobacterium avium subsp. paratuberculosis
cgaucccgggccguucagc

SEQ ID NO: 2827536 - RNA, 14 nt, Mycobacterium avium subsp. paratuberculosis
cgaucccgucggcc

SEQ ID NO: 2827537 - RNA, 15 nt, Mycobacterium avium subsp. paratuberculosis
cgaucccgucggcca

SEQ ID NO: 2827538 - RNA, 18 nt, Mycobacterium avium subsp. paratuberculosis
cgaucccgucggccauca

SEQ ID NO: 2827539 - RNA, 22 nt, Mycobacterium avium subsp. paratuberculosis
cgaucccgucggccaucagccg

SEQ ID NO: 2827540 - RNA, 15 nt, Mycobacterium avium subsp. paratuberculosis
cgaucccgucgucgg

SEQ ID NO: 2827541 - RNA, 16 nt, Mycobacterium avium subsp. paratuberculosis
cgaucccgucgucggc

SEQ ID NO: 2827542 - RNA, 19 nt, Mycobacterium avium subsp. paratuberculosis
cgaucccgucgucggcgcc

SEQ ID NO: 2827543 - RNA, 16 nt, Mycobacterium avium subsp. paratuberculosis
cgaucccuuggcggcg

SEQ ID NO: 2827544 - RNA, 19 nt, Mycobacterium avium subsp. paratuberculosis
cgaucccuuggcggcggcc

SEQ ID NO: 2827545 - RNA, 20 nt, Mycobacterium avium subsp. paratuberculosis
cgaucccuuggcggcggcca

SEQ ID NO: 2827546 - RNA, 21 nt, Mycobacterium avium subsp. paratuberculosis
cgaucccuuggcggcggccag

SEQ ID NO: 2827547 - RNA, 17 nt, Mycobacterium avium subsp. paratuberculosis
cgauccgcaccggacgc

SEQ ID NO: 2827548 - RNA, 12 nt, Mycobacterium avium subsp. paratuberculosis
cgauccgcagcc

SEQ ID NO: 2827549 - RNA, 14 nt, Mycobacterium avium subsp. paratuberculosis
cgauccgcagccgc

SEQ ID NO: 2827550 - RNA, 16 nt, Mycobacterium avium subsp. paratuberculosis
cgauccgcagccgcug

SEQ ID NO: 2827551 - RNA, 21 nt, Mycobacterium avium subsp. paratuberculosis
cgauccgcaggaaagcgucac

SEQ ID NO: 2827552 - RNA, 17 nt, Mycobacterium avium subsp. paratuberculosis
cgauccgcaggccgucg

SEQ ID NO: 2827553 - RNA, 20 nt, Mycobacterium avium subsp. paratuberculosis
cgauccgcaggccgucgccg

SEQ ID NO: 2827554 - RNA, 17 nt, Mycobacterium avium subsp. paratuberculosis
cgauccgccggcgaagc

SEQ ID NO: 2827555 - RNA, 14 nt, Mycobacterium avium subsp. paratuberculosis
cgauccgccggugc

SEQ ID NO: 2827556 - RNA, 22 nt, Mycobacterium avium subsp. paratuberculosis
cgauccgccggugccguugauc

SEQ ID NO: 2827557 - RNA, 13 nt, Mycobacterium avium subsp. paratuberculosis
cgauccgcgccgc

SEQ ID NO: 2827558 - RNA, 14 nt, Mycobacterium avium subsp. paratuberculosis
cgauccgcgccgcc

SEQ ID NO: 2827559 - RNA, 18 nt, Mycobacterium avium subsp. paratuberculosis
cgauccgcgccgccgcca

SEQ ID NO: 2827560 - RNA, 22 nt, Mycobacterium avium subsp. paratuberculosis
cgauccgcgccgcgaugcaaca

SEQ ID NO: 2827561 - RNA, 21 nt, Mycobacterium avium subsp. paratuberculosis
cgauccgcgcggccaccagcg

SEQ ID NO: 2827562 - RNA, 23 nt, Mycobacterium avium subsp. paratuberculosis
cgauccgcgcggccaccagcgcg

SEQ ID NO: 2827563 - RNA, 20 nt, Mycobacterium avium subsp. paratuberculosis
cgauccgcgcggcgacgauc

SEQ ID NO: 2827564 - RNA, 20 nt, Mycobacterium avium subsp. paratuberculosis
cgauccgcggguacggucgg

SEQ ID NO: 2827565 - RNA, 22 nt, Mycobacterium avium subsp. paratuberculosis
cgauccgcggguacggucggcc

SEQ ID NO: 2827566 - RNA, 15 nt, Mycobacterium avium subsp. paratuberculosis
cgaucgcgccggccg

SEQ ID NO: 2827567 - RNA, 16 nt, Mycobacterium avium subsp. paratuberculosis
cgaucgcgccggccgc

SEQ ID NO: 2827568 - RNA, 20 nt, Mycobacterium avium subsp. paratuberculosis
cgaucgcgccggccgccgcg

SEQ ID NO: 2827569 - RNA, 21 nt, Mycobacterium avium subsp. paratuberculosis
cgaucgcgccggccgccgcga

SEQ ID NO: 2827570 - RNA, 14 nt, Mycobacterium avium subsp. paratuberculosis
cgaucgcggccacc

SEQ ID NO: 2827571 - RNA, 12 nt, Mycobacterium avium subsp. paratuberculosis
cgaucgcggccc

SEQ ID NO: 2827572 - RNA, 13 nt, Mycobacterium avium subsp. paratuberculosis
cgaucgcggcccc

SEQ ID NO: 2827573 - RNA, 16 nt, Mycobacterium avium subsp. paratuberculosis
cgaucgcggcccccug

SEQ ID NO: 2827574 - RNA, 22 nt, Mycobacterium avium subsp. paratuberculosis
cgaucgcggcgagcucaacagc

SEQ ID NO: 2827575 - RNA, 17 nt, Mycobacterium avium subsp. paratuberculosis
cgaucgcggcgaucagc

SEQ ID NO: 2827576 - RNA, 14 nt, Mycobacterium avium subsp. paratuberculosis
cgaucgcggcgaug

SEQ ID NO: 2827577 - RNA, 12 nt, Mycobacterium avium subsp. paratuberculosis
cgaucgcgguga

SEQ ID NO: 2827578 - RNA, 16 nt, Mycobacterium avium subsp. paratuberculosis
cgaucgcggugacgcg

SEQ ID NO: 2827579 - RNA, 12 nt, Mycobacterium avium subsp. paratuberculosis
cgaucgcggugc

SEQ ID NO: 2827580 - RNA, 22 nt, Mycobacterium avium subsp. paratuberculosis
cgaucgcggugcggggccgcgg

SEQ ID NO: 2827581 - RNA, 14 nt, Mycobacterium avium subsp. paratuberculosis
cgaucgcgucgacg

SEQ ID NO: 2827582 - RNA, 24 nt, Mycobacterium avium subsp. paratuberculosis
cgaucgcguucugcaccagcucgg

SEQ ID NO: 2827583 - RNA, 20 nt, Mycobacterium avium subsp. paratuberculosis
cgaucggcacccgcaacacc

SEQ ID NO: 2827584 - RNA, 22 nt, Mycobacterium avium subsp. paratuberculosis
cgaucggcacccgcaacaccac

SEQ ID NO: 2827585 - RNA, 13 nt, Mycobacterium avium subsp. paratuberculosis
cgaucggcagcgc

SEQ ID NO: 2827586 - RNA, 16 nt, Mycobacterium avium subsp. paratuberculosis
cgaucggcagcgccaa

SEQ ID NO: 2827587 - RNA, 19 nt, Mycobacterium avium subsp. paratuberculosis
cgaucggcagcgccaacau

SEQ ID NO: 2827588 - RNA, 19 nt, Mycobacterium avium subsp. paratuberculosis
cgaucggcaggucgucgac

SEQ ID NO: 2827589 - RNA, 20 nt, Mycobacterium avium subsp. paratuberculosis
cgaucggcaggucgucgacg

SEQ ID NO: 2827590 - RNA, 13 nt, Mycobacterium avium subsp. paratuberculosis
cgaucggcccggc

SEQ ID NO: 2827591 - RNA, 16 nt, Mycobacterium avium subsp. paratuberculosis
cgaucggcccggccaa

SEQ ID NO: 2827592 - RNA, 12 nt, Mycobacterium avium subsp. paratuberculosis
cgaucggccgcu

SEQ ID NO: 2827593 - RNA, 13 nt, Mycobacterium avium subsp. paratuberculosis
cgaucggccgcug

SEQ ID NO: 2827594 - RNA, 17 nt, Mycobacterium avium subsp. paratuberculosis
cgaucggccgcugcccg

SEQ ID NO: 2827595 - RNA, 20 nt, Mycobacterium avium subsp. paratuberculosis
cgaucggccgcugcgggcgg

SEQ ID NO: 2827596 - RNA, 15 nt, Mycobacterium avium subsp. paratuberculosis
cgaucggcgagccgg

SEQ ID NO: 2827597 - RNA, 22 nt, Mycobacterium avium subsp. paratuberculosis
cgaucggcgccacgaccagcgg

SEQ ID NO: 2827598 - RNA, 15 nt, Mycobacterium avium subsp. paratuberculosis
cgaucggcgcgccga

SEQ ID NO: 2827599 - RNA, 17 nt, Mycobacterium avium subsp. paratuberculosis
cgaucggcgcgccgaag

SEQ ID NO: 2827600 - RNA, 14 nt, Mycobacterium avium subsp. paratuberculosis
cgaucggcgcggcg

SEQ ID NO: 2827601 - RNA, 21 nt, Mycobacterium avium subsp. paratuberculosis
cgaucggcggcucgccggcgu

SEQ ID NO: 2827602 - RNA, 12 nt, Mycobacterium avium subsp. paratuberculosis
cgaucggcgguc

SEQ ID NO: 2827603 - RNA, 14 nt, Mycobacterium avium subsp. paratuberculosis
cgaucggcgguccg

SEQ ID NO: 2827604 - RNA, 17 nt, Mycobacterium avium subsp. paratuberculosis
cgaucggcgguccgccg

SEQ ID NO: 2827605 - RNA, 18 nt, Mycobacterium avium subsp. paratuberculosis
cgaucggcgguccgccgc

SEQ ID NO: 2827606 - RNA, 14 nt, Mycobacterium avium subsp. paratuberculosis
cgaucggcuccagc

SEQ ID NO: 2827607 - RNA, 15 nt, Mycobacterium avium subsp. paratuberculosis
cgaucggcuccagcg

SEQ ID NO: 2827608 - RNA, 23 nt, Mycobacterium avium subsp. paratuberculosis
cgaucggcuccagcgcccgccgc

SEQ ID NO: 2827609 - RNA, 14 nt, Mycobacterium avium subsp. paratuberculosis
cgaucggcucgagc

SEQ ID NO: 2827610 - RNA, 20 nt, Mycobacterium avium subsp. paratuberculosis
cgaucggcucgagcucgucg

SEQ ID NO: 2827611 - RNA, 14 nt, Mycobacterium avium subsp. paratuberculosis
cgaucggcucggcg

SEQ ID NO: 2827612 - RNA, 21 nt, Mycobacterium avium subsp. paratuberculosis
cgaucggcucggcgccccacg

SEQ ID NO: 2827613 - RNA, 12 nt, Mycobacterium avium subsp. paratuberculosis
cgaucgggaaca

SEQ ID NO: 2827614 - RNA, 16 nt, Mycobacterium avium subsp. paratuberculosis
cgaucgggaacagccc

SEQ ID NO: 2827615 - RNA, 20 nt, Mycobacterium avium subsp. paratuberculosis
cgaucgggaacagcccgccc

SEQ ID NO: 2827616 - RNA, 21 nt, Mycobacterium avium subsp. paratuberculosis
cgaucgggaacagcccgcccu

SEQ ID NO: 2827617 - RNA, 14 nt, Mycobacterium avium subsp. paratuberculosis
cgaucgggcgucgc

SEQ ID NO: 2827618 - RNA, 20 nt, Mycobacterium avium subsp. paratuberculosis
cgaucggggaauccuggccg

SEQ ID NO: 2827619 - RNA, 23 nt, Mycobacterium avium subsp. paratuberculosis
cgaucggggaauccuggccgaug

SEQ ID NO: 2827620 - RNA, 15 nt, Mycobacterium avium subsp. paratuberculosis
cgaucggggcgcagc

SEQ ID NO: 2827621 - RNA, 17 nt, Mycobacterium avium subsp. paratuberculosis
cgaucggggcgcagccc

SEQ ID NO: 2827622 - RNA, 15 nt, Mycobacterium avium subsp. paratuberculosis
cgaucggguagacgu

SEQ ID NO: 2827623 - RNA, 18 nt, Mycobacterium avium subsp. paratuberculosis
cgaucggguagacgucgg

SEQ ID NO: 2827624 - RNA, 21 nt, Mycobacterium avium subsp. paratuberculosis
cgaucggguagacgucgggcu

SEQ ID NO: 2827625 - RNA, 23 nt, Mycobacterium avium subsp. paratuberculosis
cgaucggguagacgucgggcugg

SEQ ID NO: 2827626 - RNA, 16 nt, Mycobacterium avium subsp. paratuberculosis
cgaucgggucaccggc

SEQ ID NO: 2827627 - RNA, 18 nt, Mycobacterium avium subsp. paratuberculosis
cgaucgggucaccggccg

SEQ ID NO: 2827628 - RNA, 19 nt, Mycobacterium avium subsp. paratuberculosis
cgaucgggucaccggccga

SEQ ID NO: 2827629 - RNA, 17 nt, Mycobacterium avium subsp. paratuberculosis
cgaucgguguccagccg

SEQ ID NO: 2827630 - RNA, 18 nt, Mycobacterium avium subsp. paratuberculosis
cgaucgguguccagccgc

SEQ ID NO: 2827631 - RNA, 21 nt, Mycobacterium avium subsp. paratuberculosis
cgaucgguguccagccgcacg

SEQ ID NO: 2827632 - RNA, 21 nt, Mycobacterium avium subsp. paratuberculosis
cgaucgucaccgugccgucgc

SEQ ID NO: 2827633 - RNA, 15 nt, Mycobacterium avium subsp. paratuberculosis
cgaucgucaggucuu

SEQ ID NO: 2827634 - RNA, 13 nt, Mycobacterium avium subsp. paratuberculosis
cgaucgucaugcc

SEQ ID NO: 2827635 - RNA, 16 nt, Mycobacterium avium subsp. paratuberculosis
cgaucguccggcgcca

SEQ ID NO: 2827636 - RNA, 17 nt, Mycobacterium avium subsp. paratuberculosis
cgaucguccggcgccac

SEQ ID NO: 2827637 - RNA, 17 nt, Mycobacterium avium subsp. paratuberculosis
cgaucgucgaccaccac

SEQ ID NO: 2827638 - RNA, 13 nt, Mycobacterium avium subsp. paratuberculosis
cgaucgucgacgu

SEQ ID NO: 2827639 - RNA, 21 nt, Mycobacterium avium subsp. paratuberculosis
cgaucgucgacgucaacaccg

SEQ ID NO: 2827640 - RNA, 18 nt, Mycobacterium avium subsp. paratuberculosis
cgaucgugaauucggccg

SEQ ID NO: 2827641 - RNA, 19 nt, Mycobacterium avium subsp. paratuberculosis
cgaucgugaauucggccgg

SEQ ID NO: 2827642 - RNA, 21 nt, Mycobacterium avium subsp. paratuberculosis
cgaucgugaauucggccgggu

SEQ ID NO: 2827643 - RNA, 14 nt, Mycobacterium avium subsp. paratuberculosis
cgaucgugacgccg

SEQ ID NO: 2827644 - RNA, 15 nt, Mycobacterium avium subsp. paratuberculosis
cgaucgugacgccgu

SEQ ID NO: 2827645 - RNA, 21 nt, Mycobacterium avium subsp. paratuberculosis
cgaucgugacgccguccgacg

SEQ ID NO: 2827646 - RNA, 22 nt, Mycobacterium avium subsp. paratuberculosis
cgaucgugcgcccauccggcgc

SEQ ID NO: 2827647 - RNA, 15 nt, Mycobacterium avium subsp. paratuberculosis
cgaucgugggcaaca

SEQ ID NO: 2827648 - RNA, 14 nt, Mycobacterium avium subsp. paratuberculosis
cgaucuccaccgag

SEQ ID NO: 2827649 - RNA, 21 nt, Mycobacterium avium subsp. paratuberculosis
cgaucuccaccgagugcggcg

SEQ ID NO: 2827650 - RNA, 22 nt, Mycobacterium avium subsp. paratuberculosis
cgaucuccaccgagugcggcgc

SEQ ID NO: 2827651 - RNA, 14 nt, Mycobacterium avium subsp. paratuberculosis
cgaucuugucgucc

SEQ ID NO: 2827652 - RNA, 16 nt, Mycobacterium avium subsp. paratuberculosis
cgaucuugugcucgag

SEQ ID NO: 2827653 - RNA, 21 nt, Mycobacterium avium subsp. paratuberculosis
cgaucuuugcggccguggcga

SEQ ID NO: 2827654 - RNA, 19 nt, Mycobacterium avium subsp. paratuberculosis
cgaugaaaccccagccggc

SEQ ID NO: 2827655 - RNA, 21 nt, Mycobacterium avium subsp. paratuberculosis
cgaugaaaccccagccggccg

SEQ ID NO: 2827656 - RNA, 19 nt, Mycobacterium avium subsp. paratuberculosis
cgaugaaauccgggaccgg

SEQ ID NO: 2827657 - RNA, 20 nt, Mycobacterium avium subsp. paratuberculosis
cgaugaaauccgggaccggc

SEQ ID NO: 2827658 - RNA, 16 nt, Mycobacterium avium subsp. paratuberculosis
cgaugaacagucggcc

SEQ ID NO: 2827659 - RNA, 17 nt, Mycobacterium avium subsp. paratuberculosis
cgaugaacagucggccg

SEQ ID NO: 2827660 - RNA, 18 nt, Mycobacterium avium subsp. paratuberculosis
cgaugaacagucggccgg

SEQ ID NO: 2827661 - RNA, 20 nt, Mycobacterium avium subsp. paratuberculosis
cgaugaacagucggccggcg

SEQ ID NO: 2827662 - RNA, 17 nt, Mycobacterium avium subsp. paratuberculosis
cgaugaacaucgccggu

SEQ ID NO: 2827663 - RNA, 16 nt, Mycobacterium avium subsp. paratuberculosis
cgaugaacucgcgggc

SEQ ID NO: 2827664 - RNA, 19 nt, Mycobacterium avium subsp. paratuberculosis
cgaugaacucgcgggcgag

SEQ ID NO: 2827665 - RNA, 23 nt, Mycobacterium avium subsp. paratuberculosis
cgaugaacucgcgggcgagcagc

SEQ ID NO: 2827666 - RNA, 19 nt, Mycobacterium avium subsp. paratuberculosis
cgaugaacuugccgaucac

SEQ ID NO: 2827667 - RNA, 15 nt, Mycobacterium avium subsp. paratuberculosis
cgaugaagacccgcc

SEQ ID NO: 2827668 - RNA, 19 nt, Mycobacterium avium subsp. paratuberculosis
cgaugaagccccggaccgg

SEQ ID NO: 2827669 - RNA, 15 nt, Mycobacterium avium subsp. paratuberculosis
cgaugaagccggcga

SEQ ID NO: 2827670 - RNA, 19 nt, Mycobacterium avium subsp. paratuberculosis
cgaugaagccgugcccgcg

SEQ ID NO: 2827671 - RNA, 21 nt, Mycobacterium avium subsp. paratuberculosis
cgaugaauccgcgcagcagcg

SEQ ID NO: 2827672 - RNA, 16 nt, Mycobacterium avium subsp. paratuberculosis
cgaugaauuccggugu

SEQ ID NO: 2827673 - RNA, 22 nt, Mycobacterium avium subsp. paratuberculosis
cgaugacauggaucggacccau

SEQ ID NO: 2827674 - RNA, 22 nt, Mycobacterium avium subsp. paratuberculosis
cgaugaccacccucagggagcu

SEQ ID NO: 2827675 - RNA, 19 nt, Mycobacterium avium subsp. paratuberculosis
cgaugaccaccgcugugga

SEQ ID NO: 2827676 - RNA, 17 nt, Mycobacterium avium subsp. paratuberculosis
cgaugaccagcgcgaac

SEQ ID NO: 2827677 - RNA, 15 nt, Mycobacterium avium subsp. paratuberculosis
cgaugacccaccagc

SEQ ID NO: 2827678 - RNA, 18 nt, Mycobacterium avium subsp. paratuberculosis
cgaugacccaccagccga

SEQ ID NO: 2827679 - RNA, 14 nt, Mycobacterium avium subsp. paratuberculosis
cgaugacccagccc

SEQ ID NO: 2827680 - RNA, 16 nt, Mycobacterium avium subsp. paratuberculosis
cgaugacccagcccag

SEQ ID NO: 2827681 - RNA, 14 nt, Mycobacterium avium subsp. paratuberculosis
cgaugaccgcggcg

SEQ ID NO: 2827682 - RNA, 15 nt, Mycobacterium avium subsp. paratuberculosis
cgaugaccgcggcgg

SEQ ID NO: 2827683 - RNA, 16 nt, Mycobacterium avium subsp. paratuberculosis
cgaugaccgcggcggg

SEQ ID NO: 2827684 - RNA, 17 nt, Mycobacterium avium subsp. paratuberculosis
cgaugaccgcggcgggc

SEQ ID NO: 2827685 - RNA, 20 nt, Mycobacterium avium subsp. paratuberculosis
cgaugaccgcggcgggcagg

SEQ ID NO: 2827686 - RNA, 23 nt, Mycobacterium avium subsp. paratuberculosis
cgaugaccggacgauucgcgauc

SEQ ID NO: 2827687 - RNA, 14 nt, Mycobacterium avium subsp. paratuberculosis
cgaugaccggcccg

SEQ ID NO: 2827688 - RNA, 17 nt, Mycobacterium avium subsp. paratuberculosis
cgaugaccggcccggcg

SEQ ID NO: 2827689 - RNA, 18 nt, Mycobacterium avium subsp. paratuberculosis
cgaugaccggcccggcgg

SEQ ID NO: 2827690 - RNA, 19 nt, Mycobacterium avium subsp. paratuberculosis
cgaugaccggcccggcggc

SEQ ID NO: 2827691 - RNA, 20 nt, Mycobacterium avium subsp. paratuberculosis
cgaugaccggcccggcggcc

SEQ ID NO: 2827692 - RNA, 17 nt, Mycobacterium avium subsp. paratuberculosis
cgaugaccucgcacagc

SEQ ID NO: 2827693 - RNA, 15 nt, Mycobacterium avium subsp. paratuberculosis
cgaugaccucgcgcc

SEQ ID NO: 2827694 - RNA, 16 nt, Mycobacterium avium subsp. paratuberculosis
cgaugaccucgcgccc

SEQ ID NO: 2827695 - RNA, 24 nt, Mycobacterium avium subsp. paratuberculosis
cgaugaccucgcgcccggcgccgg

SEQ ID NO: 2827696 - RNA, 14 nt, Mycobacterium avium subsp. paratuberculosis
cgaugacgagcagc

SEQ ID NO: 2827697 - RNA, 18 nt, Mycobacterium avium subsp. paratuberculosis
cgaugacgagcagcgugc

SEQ ID NO: 2827698 - RNA, 16 nt, Mycobacterium avium subsp. paratuberculosis
cgaugacgccgcgccg

SEQ ID NO: 2827699 - RNA, 17 nt, Mycobacterium avium subsp. paratuberculosis
cgaugacgccgcgccgc

SEQ ID NO: 2827700 - RNA, 18 nt, Mycobacterium avium subsp. paratuberculosis
cgaugacgccgcgccgcc

SEQ ID NO: 2827701 - RNA, 17 nt, Mycobacterium avium subsp. paratuberculosis
cgaugacgccggacagc

SEQ ID NO: 2827702 - RNA, 21 nt, Mycobacterium avium subsp. paratuberculosis
cgaugacgccggacagcuggc

SEQ ID NO: 2827703 - RNA, 23 nt, Mycobacterium avium subsp. paratuberculosis
cgaugacgcgcuuguacaggucg

SEQ ID NO: 2827704 - RNA, 19 nt, Mycobacterium avium subsp. paratuberculosis
cgaugacgcugccgcgccg

SEQ ID NO: 2827705 - RNA, 14 nt, Mycobacterium avium subsp. paratuberculosis
cgaugacggcgcga

SEQ ID NO: 2827706 - RNA, 16 nt, Mycobacterium avium subsp. paratuberculosis
cgaugacggcgcgaac

SEQ ID NO: 2827707 - RNA, 23 nt, Mycobacterium avium subsp. paratuberculosis
cgaugacggugguggccuugacg

SEQ ID NO: 2827708 - RNA, 20 nt, Mycobacterium avium subsp. paratuberculosis
cgaugacgucgcgcugccgg

SEQ ID NO: 2827709 - RNA, 21 nt, Mycobacterium avium subsp. paratuberculosis
cgaugacgucgcgcugccggc

SEQ ID NO: 2827710 - RNA, 13 nt, Mycobacterium avium subsp. paratuberculosis
cgaugacgucguc

SEQ ID NO: 2827711 - RNA, 15 nt, Mycobacterium avium subsp. paratuberculosis
cgaugacgucgucgc

SEQ ID NO: 2827712 - RNA, 19 nt, Mycobacterium avium subsp. paratuberculosis
cgaugacgucgucgcggcg

SEQ ID NO: 2827713 - RNA, 21 nt, Mycobacterium avium subsp. paratuberculosis
cgaugacgucgucgcggcgcu

SEQ ID NO: 2827714 - RNA, 23 nt, Mycobacterium avium subsp. paratuberculosis
cgaugacgucgucgcggcgcugc

SEQ ID NO: 2827715 - RNA, 23 nt, Mycobacterium avium subsp. paratuberculosis
cgaugacgugguugcguucgccg

SEQ ID NO: 2827716 - RNA, 14 nt, Mycobacterium avium subsp. paratuberculosis
cgaugacguugcgc

SEQ ID NO: 2827717 - RNA, 15 nt, Mycobacterium avium subsp. paratuberculosis
cgaugacguugcgcg

SEQ ID NO: 2827718 - RNA, 20 nt, Mycobacterium avium subsp. paratuberculosis
cgaugagcgagaugaucagc

SEQ ID NO: 2827719 - RNA, 22 nt, Mycobacterium avium subsp. paratuberculosis
cgaugagcgagaugaucagccg

SEQ ID NO: 2827720 - RNA, 18 nt, Mycobacterium avium subsp. paratuberculosis
cgaugagcuggugcagcg

SEQ ID NO: 2827721 - RNA, 22 nt, Mycobacterium avium subsp. paratuberculosis
cgaugagcuggugcagcgacuc

SEQ ID NO: 2827722 - RNA, 20 nt, Mycobacterium avium subsp. paratuberculosis
cgaugaucagcucgcgcauc

SEQ ID NO: 2827723 - RNA, 23 nt, Mycobacterium avium subsp. paratuberculosis
cgaugaucagcucgcgcaucagc

SEQ ID NO: 2827724 - RNA, 17 nt, Mycobacterium avium subsp. paratuberculosis
cgaugauccgcggcgcc

SEQ ID NO: 2827725 - RNA, 18 nt, Mycobacterium avium subsp. paratuberculosis
cgaugauccgcggcgccg

SEQ ID NO: 2827726 - RNA, 19 nt, Mycobacterium avium subsp. paratuberculosis
cgaugauccgcggcgccgg

SEQ ID NO: 2827727 - RNA, 23 nt, Mycobacterium avium subsp. paratuberculosis
cgaugauccuggccuggucggcc

SEQ ID NO: 2827728 - RNA, 12 nt, Mycobacterium avium subsp. paratuberculosis
cgaugaucgccg

SEQ ID NO: 2827729 - RNA, 15 nt, Mycobacterium avium subsp. paratuberculosis
cgaugaucgccggcg

SEQ ID NO: 2827730 - RNA, 18 nt, Mycobacterium avium subsp. paratuberculosis
cgaugaucgccggcgccg

SEQ ID NO: 2827731 - RNA, 15 nt, Mycobacterium avium subsp. paratuberculosis
cgaugaucgucggca

SEQ ID NO: 2827732 - RNA, 15 nt, Mycobacterium avium subsp. paratuberculosis
cgaugauggcgucga

SEQ ID NO: 2827733 - RNA, 16 nt, Mycobacterium avium subsp. paratuberculosis
cgaugauggcgucgac

SEQ ID NO: 2827734 - RNA, 17 nt, Mycobacterium avium subsp. paratuberculosis
cgaugauggcgucgacg

SEQ ID NO: 2827735 - RNA, 22 nt, Mycobacterium avium subsp. paratuberculosis
cgaugcgcccgcgccaccccga

SEQ ID NO: 2827736 - RNA, 19 nt, Mycobacterium avium subsp. paratuberculosis
cgaugcgcccgcugcggcg

SEQ ID NO: 2827737 - RNA, 12 nt, Mycobacterium avium subsp. paratuberculosis
cgaugcgccgca

SEQ ID NO: 2827738 - RNA, 13 nt, Mycobacterium avium subsp. paratuberculosis
cgaugcgccgcac

SEQ ID NO: 2827739 - RNA, 14 nt, Mycobacterium avium subsp. paratuberculosis
cgaugcgccgcacc

SEQ ID NO: 2827740 - RNA, 16 nt, Mycobacterium avium subsp. paratuberculosis
cgaugcgcgccagcag

SEQ ID NO: 2827741 - RNA, 17 nt, Mycobacterium avium subsp. paratuberculosis
cgaugcgcgccagcagc

SEQ ID NO: 2827742 - RNA, 18 nt, Mycobacterium avium subsp. paratuberculosis
cgaugcgcgccagcagcg

SEQ ID NO: 2827743 - RNA, 23 nt, Mycobacterium avium subsp. paratuberculosis
cgaugcgcgccagcagcgcgccg

SEQ ID NO: 2827744 - RNA, 12 nt, Mycobacterium avium subsp. paratuberculosis
cgaugcgcgccu

SEQ ID NO: 2827745 - RNA, 14 nt, Mycobacterium avium subsp. paratuberculosis
cgaugcgcgguaac

SEQ ID NO: 2827746 - RNA, 15 nt, Mycobacterium avium subsp. paratuberculosis
cgaugcgcgguaaca

SEQ ID NO: 2827747 - RNA, 15 nt, Mycobacterium avium subsp. paratuberculosis
cgaugcgcuccagca

SEQ ID NO: 2827748 - RNA, 16 nt, Mycobacterium avium subsp. paratuberculosis
cgaugcgcuccagcag

SEQ ID NO: 2827749 - RNA, 18 nt, Mycobacterium avium subsp. paratuberculosis
cgaugcgcuccagcaggc

SEQ ID NO: 2827750 - RNA, 19 nt, Mycobacterium avium subsp. paratuberculosis
cgaugcgcuccagcaggcu

SEQ ID NO: 2827751 - RNA, 14 nt, Mycobacterium avium subsp. paratuberculosis
cgaugcgcucggcg

SEQ ID NO: 2827752 - RNA, 17 nt, Mycobacterium avium subsp. paratuberculosis
cgaugcgcucggcgacc

SEQ ID NO: 2827753 - RNA, 20 nt, Mycobacterium avium subsp. paratuberculosis
cgaugcgcucggcgaccugc

SEQ ID NO: 2827754 - RNA, 21 nt, Mycobacterium avium subsp. paratuberculosis
cgaugcgcugcuguugcucgg

SEQ ID NO: 2827755 - RNA, 13 nt, Mycobacterium avium subsp. paratuberculosis
cgaugcgcugugc

SEQ ID NO: 2827756 - RNA, 22 nt, Mycobacterium avium subsp. paratuberculosis
cgaugcgcugugcgggugaggc

SEQ ID NO: 2827757 - RNA, 20 nt, Mycobacterium avium subsp. paratuberculosis
cgaugcggaucucggugccg

SEQ ID NO: 2827758 - RNA, 16 nt, Mycobacterium avium subsp. paratuberculosis
cgaugcggcagcuuga

SEQ ID NO: 2827759 - RNA, 22 nt, Mycobacterium avium subsp. paratuberculosis
cgaugcggcagcuugaugcugg

SEQ ID NO: 2827760 - RNA, 13 nt, Mycobacterium avium subsp. paratuberculosis
cgaugcggcccgg

SEQ ID NO: 2827761 - RNA, 14 nt, Mycobacterium avium subsp. paratuberculosis
cgaugcggcccugg

SEQ ID NO: 2827762 - RNA, 12 nt, Mycobacterium avium subsp. paratuberculosis
cgaugcggccgg

SEQ ID NO: 2827763 - RNA, 13 nt, Mycobacterium avium subsp. paratuberculosis
cgaugcggccggc

SEQ ID NO: 2827764 - RNA, 14 nt, Mycobacterium avium subsp. paratuberculosis
cgaugcggccggcg

SEQ ID NO: 2827765 - RNA, 15 nt, Mycobacterium avium subsp. paratuberculosis
cgaugcggccggcgg

SEQ ID NO: 2827766 - RNA, 13 nt, Mycobacterium avium subsp. paratuberculosis
cgaugcggccguc

SEQ ID NO: 2827767 - RNA, 14 nt, Mycobacterium avium subsp. paratuberculosis
cgaugcggccgucg

SEQ ID NO: 2827768 - RNA, 15 nt, Mycobacterium avium subsp. paratuberculosis
cgaugcggccgucgg

SEQ ID NO: 2827769 - RNA, 15 nt, Mycobacterium avium subsp. paratuberculosis
cgaugcggcucacca

SEQ ID NO: 2827770 - RNA, 13 nt, Mycobacterium avium subsp. paratuberculosis
cgaugcgggccag

SEQ ID NO: 2827771 - RNA, 14 nt, Mycobacterium avium subsp. paratuberculosis
cgaugcgggcccgc

SEQ ID NO: 2827772 - RNA, 16 nt, Mycobacterium avium subsp. paratuberculosis
cgaugcggggccggcg

SEQ ID NO: 2827773 - RNA, 19 nt, Mycobacterium avium subsp. paratuberculosis
cgaugcggggccggcggcg

SEQ ID NO: 2827774 - RNA, 16 nt, Mycobacterium avium subsp. paratuberculosis
cgaugcggggcggcgg

SEQ ID NO: 2827775 - RNA, 16 nt, Mycobacterium avium subsp. paratuberculosis
cgaugcgggucacggu

SEQ ID NO: 2827776 - RNA, 17 nt, Mycobacterium avium subsp. paratuberculosis
cgaugcggucccgcggg

SEQ ID NO: 2827777 - RNA, 14 nt, Mycobacterium avium subsp. paratuberculosis
cgaugcggugccgg

SEQ ID NO: 2827778 - RNA, 19 nt, Mycobacterium avium subsp. paratuberculosis
cgaugcggugccgggccag

SEQ ID NO: 2827779 - RNA, 17 nt, Mycobacterium avium subsp. paratuberculosis
cgaugcggugccgggug

SEQ ID NO: 2827780 - RNA, 15 nt, Mycobacterium avium subsp. paratuberculosis
cgaugcgguugauca

SEQ ID NO: 2827781 - RNA, 19 nt, Mycobacterium avium subsp. paratuberculosis
cgaugcguugcgccagcac

SEQ ID NO: 2827782 - RNA, 18 nt, Mycobacterium avium subsp. paratuberculosis
cgaugcugagcgggucgg

SEQ ID NO: 2827783 - RNA, 23 nt, Mycobacterium avium subsp. paratuberculosis
cgaugcugagcgggucggccggc

SEQ ID NO: 2827784 - RNA, 21 nt, Mycobacterium avium subsp. paratuberculosis
cgaugcugauacccgcgcggc

SEQ ID NO: 2827785 - RNA, 14 nt, Mycobacterium avium subsp. paratuberculosis
cgaugcugucgcgg

SEQ ID NO: 2827786 - RNA, 15 nt, Mycobacterium avium subsp. paratuberculosis
cgauggaagcgcccg

SEQ ID NO: 2827787 - RNA, 16 nt, Mycobacterium avium subsp. paratuberculosis
cgauggaagcgcccgc

SEQ ID NO: 2827788 - RNA, 18 nt, Mycobacterium avium subsp. paratuberculosis
cgauggaagcgcccgcgc

SEQ ID NO: 2827789 - RNA, 19 nt, Mycobacterium avium subsp. paratuberculosis
cgauggaagcgcccgcgcg

SEQ ID NO: 2827790 - RNA, 15 nt, Mycobacterium avium subsp. paratuberculosis
cgauggaaggugcug

SEQ ID NO: 2827791 - RNA, 17 nt, Mycobacterium avium subsp. paratuberculosis
cgauggaauucgucggc

SEQ ID NO: 2827792 - RNA, 18 nt, Mycobacterium avium subsp. paratuberculosis
cgauggaauucgucggcg

SEQ ID NO: 2827793 - RNA, 21 nt, Mycobacterium avium subsp. paratuberculosis
cgauggaauucgucggcggug

SEQ ID NO: 2827794 - RNA, 15 nt, Mycobacterium avium subsp. paratuberculosis
cgauggacacgcugc

SEQ ID NO: 2827795 - RNA, 17 nt, Mycobacterium avium subsp. paratuberculosis
cgauggacacgcugccg

SEQ ID NO: 2827796 - RNA, 18 nt, Mycobacterium avium subsp. paratuberculosis
cgauggacacgcugccga

SEQ ID NO: 2827797 - RNA, 15 nt, Mycobacterium avium subsp. paratuberculosis
cgauggacagcagcc

SEQ ID NO: 2827798 - RNA, 19 nt, Mycobacterium avium subsp. paratuberculosis
cgauggacaggcacucgcc

SEQ ID NO: 2827799 - RNA, 15 nt, Mycobacterium avium subsp. paratuberculosis
cgauggacagggcga

SEQ ID NO: 2827800 - RNA, 19 nt, Mycobacterium avium subsp. paratuberculosis
cgauggaccgggugguggg

SEQ ID NO: 2827801 - RNA, 20 nt, Mycobacterium avium subsp. paratuberculosis
cgauggaccggguggugggc

SEQ ID NO: 2827802 - RNA, 15 nt, Mycobacterium avium subsp. paratuberculosis
cgauggacgccagca

SEQ ID NO: 2827803 - RNA, 14 nt, Mycobacterium avium subsp. paratuberculosis
cgauggagaccucu

SEQ ID NO: 2827804 - RNA, 18 nt, Mycobacterium avium subsp. paratuberculosis
cgauggagaccucuucga

SEQ ID NO: 2827805 - RNA, 19 nt, Mycobacterium avium subsp. paratuberculosis
cgauggaguagcugaccga

SEQ ID NO: 2827806 - RNA, 18 nt, Mycobacterium avium subsp. paratuberculosis
cgauggcaacgccggucu

SEQ ID NO: 2827807 - RNA, 13 nt, Mycobacterium avium subsp. paratuberculosis
cgauggccaccgg

SEQ ID NO: 2827808 - RNA, 17 nt, Mycobacterium avium subsp. paratuberculosis
cgauggccaccgggcgu

SEQ ID NO: 2827809 - RNA, 14 nt, Mycobacterium avium subsp. paratuberculosis
cgauggccagcgcg

SEQ ID NO: 2827810 - RNA, 16 nt, Mycobacterium avium subsp. paratuberculosis
cgauggccagcgcguc

SEQ ID NO: 2827811 - RNA, 17 nt, Mycobacterium avium subsp. paratuberculosis
cgauggccagcgcgucg

SEQ ID NO: 2827812 - RNA, 17 nt, Mycobacterium avium subsp. paratuberculosis
cgauggccaucgucgaa

SEQ ID NO: 2827813 - RNA, 18 nt, Mycobacterium avium subsp. paratuberculosis
cgauggcccaggccgcgg

SEQ ID NO: 2827814 - RNA, 19 nt, Mycobacterium avium subsp. paratuberculosis
cgauggcccaggccgcggu

SEQ ID NO: 2827815 - RNA, 14 nt, Mycobacterium avium subsp. paratuberculosis
cgauggcccgcgcg

SEQ ID NO: 2827816 - RNA, 15 nt, Mycobacterium avium subsp. paratuberculosis
cgauggcccgcucgg

SEQ ID NO: 2827817 - RNA, 13 nt, Mycobacterium avium subsp. paratuberculosis
cgauggcccgcug

SEQ ID NO: 2827818 - RNA, 14 nt, Mycobacterium avium subsp. paratuberculosis
cgauggcccgcugc

SEQ ID NO: 2827819 - RNA, 21 nt, Mycobacterium avium subsp. paratuberculosis
cgauggcccgcugcgccgacu

SEQ ID NO: 2827820 - RNA, 20 nt, Mycobacterium avium subsp. paratuberculosis
cgauggugggcagccggcaa

SEQ ID NO: 2827821 - RNA, 22 nt, Mycobacterium avium subsp. paratuberculosis
cgaugguguagccgugccccag

SEQ ID NO: 2827822 - RNA, 16 nt, Mycobacterium avium subsp. paratuberculosis
cgaugguguaguccug

SEQ ID NO: 2827823 - RNA, 14 nt, Mycobacterium avium subsp. paratuberculosis
cgauggugugcagc

SEQ ID NO: 2827824 - RNA, 15 nt, Mycobacterium avium subsp. paratuberculosis
cgauggugugcagca

SEQ ID NO: 2827825 - RNA, 14 nt, Mycobacterium avium subsp. paratuberculosis
cgauguaccaggcc

SEQ ID NO: 2827826 - RNA, 18 nt, Mycobacterium avium subsp. paratuberculosis
cgauguacugggccgucg

SEQ ID NO: 2827827 - RNA, 14 nt, Mycobacterium avium subsp. paratuberculosis
cgauguagagcggg

SEQ ID NO: 2827828 - RNA, 22 nt, Mycobacterium avium subsp. paratuberculosis
cgauguagagcgggauccccac

SEQ ID NO: 2827829 - RNA, 15 nt, Mycobacterium avium subsp. paratuberculosis
cgauguagccgggcu

SEQ ID NO: 2827830 - RNA, 23 nt, Mycobacterium avium subsp. paratuberculosis
cgauguagccgggcucgagcacc

SEQ ID NO: 2827831 - RNA, 23 nt, Mycobacterium avium subsp. paratuberculosis
cgaugucccauugcacaucccga

SEQ ID NO: 2827832 - RNA, 14 nt, Mycobacterium avium subsp. paratuberculosis
cgauguccccgcgg

SEQ ID NO: 2827833 - RNA, 18 nt, Mycobacterium avium subsp. paratuberculosis
cgauguccgacagcccgc

SEQ ID NO: 2827834 - RNA, 20 nt, Mycobacterium avium subsp. paratuberculosis
cgauguccgacagcccgccc

SEQ ID NO: 2827835 - RNA, 13 nt, Mycobacterium avium subsp. paratuberculosis
cgauguccgccgg

SEQ ID NO: 2827836 - RNA, 16 nt, Mycobacterium avium subsp. paratuberculosis
cgauguccgccggccg

SEQ ID NO: 2827837 - RNA, 20 nt, Mycobacterium avium subsp. paratuberculosis
cgauguccgccggccggucc

SEQ ID NO: 2827838 - RNA, 17 nt, Mycobacterium avium subsp. paratuberculosis
cgaugucgacccgcggc

SEQ ID NO: 2827839 - RNA, 20 nt, Mycobacterium avium subsp. paratuberculosis
cgaugucgacccgcggcgcc

SEQ ID NO: 2827840 - RNA, 21 nt, Mycobacterium avium subsp. paratuberculosis
cgaugucgacccgcggcgccg

SEQ ID NO: 2827841 - RNA, 15 nt, Mycobacterium avium subsp. paratuberculosis
cgaugucgacgccgu

SEQ ID NO: 2827842 - RNA, 20 nt, Mycobacterium avium subsp. paratuberculosis
cgaugucgacgccgugcugc

SEQ ID NO: 2827843 - RNA, 12 nt, Mycobacterium avium subsp. paratuberculosis
cgaugucgacgu

SEQ ID NO: 2827844 - RNA, 16 nt, Mycobacterium avium subsp. paratuberculosis
cgaugucgacgugggc

SEQ ID NO: 2827845 - RNA, 18 nt, Mycobacterium avium subsp. paratuberculosis
cgaugucgaugacggcgg

SEQ ID NO: 2827846 - RNA, 19 nt, Mycobacterium avium subsp. paratuberculosis
cgaugucgaugacggcggc

SEQ ID NO: 2827847 - RNA, 22 nt, Mycobacterium avium subsp. paratuberculosis
cgaugucgcccggcgcggcauc

SEQ ID NO: 2827848 - RNA, 14 nt, Mycobacterium avium subsp. paratuberculosis
cgaugucgccggcg

SEQ ID NO: 2827849 - RNA, 15 nt, Mycobacterium avium subsp. paratuberculosis
cgaugucgccggcga

SEQ ID NO: 2827850 - RNA, 16 nt, Mycobacterium avium subsp. paratuberculosis
cgaugucgccggcgac

SEQ ID NO: 2827851 - RNA, 17 nt, Mycobacterium avium subsp. paratuberculosis
cgaugucgccggcgacc

SEQ ID NO: 2827852 - RNA, 23 nt, Mycobacterium avium subsp. paratuberculosis
cgaugucggacuucugguugacg

SEQ ID NO: 2827853 - RNA, 12 nt, Mycobacterium avium subsp. paratuberculosis
cgaugucggcca

SEQ ID NO: 2827854 - RNA, 16 nt, Mycobacterium avium subsp. paratuberculosis
cgaugucggccagcgc

SEQ ID NO: 2827855 - RNA, 17 nt, Mycobacterium avium subsp. paratuberculosis
cgaugucggccagcgcg

SEQ ID NO: 2827856 - RNA, 13 nt, Mycobacterium avium subsp. paratuberculosis
cgaugucggccgg

SEQ ID NO: 2827857 - RNA, 14 nt, Mycobacterium avium subsp. paratuberculosis
cgaugucggccggu

SEQ ID NO: 2827858 - RNA, 16 nt, Mycobacterium avium subsp. paratuberculosis
cgaugucggccggucc

SEQ ID NO: 2827859 - RNA, 20 nt, Mycobacterium avium subsp. paratuberculosis
cgaugucggccgguccgugc

SEQ ID NO: 2827860 - RNA, 17 nt, Mycobacterium avium subsp. paratuberculosis
cgaugucggcggcccgg

SEQ ID NO: 2827861 - RNA, 20 nt, Mycobacterium avium subsp. paratuberculosis
cgaugucggcuucguacggc

SEQ ID NO: 2827862 - RNA, 21 nt, Mycobacterium avium subsp. paratuberculosis
cgaugucggcuucguacggcc

SEQ ID NO: 2827863 - RNA, 17 nt, Mycobacterium avium subsp. paratuberculosis
cgaugucgggcaccugc

SEQ ID NO: 2827864 - RNA, 16 nt, Mycobacterium avium subsp. paratuberculosis
cgaugucggugcggcc

SEQ ID NO: 2827865 - RNA, 12 nt, Mycobacterium avium subsp. paratuberculosis
cgaugucggugg

SEQ ID NO: 2827866 - RNA, 12 nt, Mycobacterium avium subsp. paratuberculosis
cgaugucgucga

SEQ ID NO: 2827867 - RNA, 13 nt, Mycobacterium avium subsp. paratuberculosis
cgaugucgucgaa

SEQ ID NO: 2827868 - RNA, 15 nt, Mycobacterium avium subsp. paratuberculosis
cgaugucgucgacgc

SEQ ID NO: 2827869 - RNA, 16 nt, Mycobacterium avium subsp. paratuberculosis
cgaugucgucgacgcu

SEQ ID NO: 2827870 - RNA, 15 nt, Mycobacterium avium subsp. paratuberculosis
cgaugucgucgccgg

SEQ ID NO: 2827871 - RNA, 17 nt, Mycobacterium avium subsp. paratuberculosis
cgaugucgucgccggug

SEQ ID NO: 2827872 - RNA, 15 nt, Mycobacterium avium subsp. paratuberculosis
cgaugucgucgucga

SEQ ID NO: 2827873 - RNA, 16 nt, Mycobacterium avium subsp. paratuberculosis
cgaugucgucgucgac

SEQ ID NO: 2827874 - RNA, 17 nt, Mycobacterium avium subsp. paratuberculosis
cgaugucgucgucgacg

SEQ ID NO: 2827875 - RNA, 18 nt, Mycobacterium avium subsp. paratuberculosis
cgaugucgucgucgacgc

SEQ ID NO: 2827876 - RNA, 19 nt, Mycobacterium avium subsp. paratuberculosis
cgaugucgucgucgacgcu

SEQ ID NO: 2827877 - RNA, 20 nt, Mycobacterium avium subsp. paratuberculosis
cgaugucgucgucgacgcug

SEQ ID NO: 2827878 - RNA, 21 nt, Mycobacterium avium subsp. paratuberculosis
cgaugucugaucgcguagcgc

SEQ ID NO: 2827879 - RNA, 23 nt, Mycobacterium avium subsp. paratuberculosis
cgaugugaucggcggccaccagc

SEQ ID NO: 2827880 - RNA, 20 nt, Mycobacterium avium subsp. paratuberculosis
cgaugugccacuucgacggc

SEQ ID NO: 2827881 - RNA, 14 nt, Mycobacterium avium subsp. paratuberculosis
cgaugugcucgauc

SEQ ID NO: 2827882 - RNA, 23 nt, Mycobacterium avium subsp. paratuberculosis
cgaugugcucggucaacccgauc

SEQ ID NO: 2827883 - RNA, 15 nt, Mycobacterium avium subsp. paratuberculosis
cgauguggacgaugc

SEQ ID NO: 2827884 - RNA, 14 nt, Mycobacterium avium subsp. paratuberculosis
cgauguggccggcg

SEQ ID NO: 2827885 - RNA, 13 nt, Mycobacterium avium subsp. paratuberculosis
cgaugugggccgc

SEQ ID NO: 2827886 - RNA, 23 nt, Mycobacterium avium subsp. paratuberculosis
cgauguguaacaacucgccggag

SEQ ID NO: 2827887 - RNA, 19 nt, Mycobacterium avium subsp. paratuberculosis
cgauguugaccacccgcag

SEQ ID NO: 2827888 - RNA, 22 nt, Mycobacterium avium subsp. paratuberculosis
cgauguugaucgccaugcuggc

SEQ ID NO: 2827889 - RNA, 19 nt, Mycobacterium avium subsp. paratuberculosis
cgauguugaucguccccac

SEQ ID NO: 2827890 - RNA, 19 nt, Mycobacterium avium subsp. paratuberculosis
cgauguugaugucgcgcgg

SEQ ID NO: 2827891 - RNA, 14 nt, Mycobacterium avium subsp. paratuberculosis
cgauguuggccuca

SEQ ID NO: 2827892 - RNA, 15 nt, Mycobacterium avium subsp. paratuberculosis
cgauuaggugggcuu

SEQ ID NO: 2827893 - RNA, 16 nt, Mycobacterium avium subsp. paratuberculosis
cgauucaaccccgcgc

SEQ ID NO: 2827894 - RNA, 18 nt, Mycobacterium avium subsp. paratuberculosis
cgauucaaccccgcgcgc

SEQ ID NO: 2827895 - RNA, 14 nt, Mycobacterium avium subsp. paratuberculosis
cgauucagccggcg

SEQ ID NO: 2827896 - RNA, 15 nt, Mycobacterium avium subsp. paratuberculosis
cgauucagccggcgg

SEQ ID NO: 2827897 - RNA, 13 nt, Mycobacterium avium subsp. paratuberculosis
cgauucaucgccg

SEQ ID NO: 2827898 - RNA, 14 nt, Mycobacterium avium subsp. paratuberculosis
cgauucaucgccga

SEQ ID NO: 2827899 - RNA, 15 nt, Mycobacterium avium subsp. paratuberculosis
cgauucaucgccgaa

SEQ ID NO: 2827900 - RNA, 16 nt, Mycobacterium avium subsp. paratuberculosis
cgauucaucgccgaac

SEQ ID NO: 2827901 - RNA, 18 nt, Mycobacterium avium subsp. paratuberculosis
cgauucaucgccgaaccg

SEQ ID NO: 2827902 - RNA, 13 nt, Mycobacterium avium subsp. paratuberculosis
cgauucccgccgg

SEQ ID NO: 2827903 - RNA, 16 nt, Mycobacterium avium subsp. paratuberculosis
cgauuccggccggccg

SEQ ID NO: 2827904 - RNA, 21 nt, Mycobacterium avium subsp. paratuberculosis
cgauuccggccggccgccggc

SEQ ID NO: 2827905 - RNA, 17 nt, Mycobacterium avium subsp. paratuberculosis
cgcaagggccgacaucg

SEQ ID NO: 2827906 - RNA, 22 nt, Mycobacterium avium subsp. paratuberculosis
cgcaagggccgacaucgucggc

SEQ ID NO: 2827907 - RNA, 19 nt, Mycobacterium avium subsp. paratuberculosis
cgcaaggugauucgcgcgg

SEQ ID NO: 2827908 - RNA, 20 nt, Mycobacterium avium subsp. paratuberculosis
cgcaaggugauucgcgcggc

SEQ ID NO: 2827909 - RNA, 24 nt, Mycobacterium avium subsp. paratuberculosis
cgcaaggugauucgcgcggcgccc

SEQ ID NO: 2827910 - RNA, 16 nt, Mycobacterium avium subsp. paratuberculosis
cgcaaguagcgcucca

SEQ ID NO: 2827911 - RNA, 14 nt, Mycobacterium avium subsp. paratuberculosis
cgcaagugcgguca

SEQ ID NO: 2827912 - RNA, 15 nt, Mycobacterium avium subsp. paratuberculosis
cgcaagugcggucag

SEQ ID NO: 2827913 - RNA, 15 nt, Mycobacterium avium subsp. paratuberculosis
cgcaauacaccgcga

SEQ ID NO: 2827914 - RNA, 15 nt, Mycobacterium avium subsp. paratuberculosis
cgcaauacccgacca

SEQ ID NO: 2827915 - RNA, 20 nt, Mycobacterium avium subsp. paratuberculosis
cgcaauacccgaccagcacc

SEQ ID NO: 2827916 - RNA, 21 nt, Mycobacterium avium subsp. paratuberculosis
cgcaauacccgaccagcaccg

SEQ ID NO: 2827917 - RNA, 22 nt, Mycobacterium avium subsp. paratuberculosis
cgcaauacggugcccgccgcga

SEQ ID NO: 2827918 - RNA, 18 nt, Mycobacterium avium subsp. paratuberculosis
cgcaaucgcccagucccg

SEQ ID NO: 2827919 - RNA, 16 nt, Mycobacterium avium subsp. paratuberculosis
cgcaaucggcgccggc

SEQ ID NO: 2827920 - RNA, 17 nt, Mycobacterium avium subsp. paratuberculosis
cgcaaucggggccgacc

SEQ ID NO: 2827921 - RNA, 17 nt, Mycobacterium avium subsp. paratuberculosis
cgcaaugccaucgucac

SEQ ID NO: 2827922 - RNA, 14 nt, Mycobacterium avium subsp. paratuberculosis
cgcaaugccgccgc

SEQ ID NO: 2827923 - RNA, 20 nt, Mycobacterium avium subsp. paratuberculosis
cgcaaugccgccgcgacgau

SEQ ID NO: 2827924 - RNA, 13 nt, Mycobacterium avium subsp. paratuberculosis
cgcaaugcgucgc

SEQ ID NO: 2827925 - RNA, 18 nt, Mycobacterium avium subsp. paratuberculosis
cgcaaugcgucgcggcgg

SEQ ID NO: 2827926 - RNA, 19 nt, Mycobacterium avium subsp. paratuberculosis
cgcaaugcgucgcggcggc

SEQ ID NO: 2827927 - RNA, 20 nt, Mycobacterium avium subsp. paratuberculosis
cgcaaugcgucgcggcggcg

SEQ ID NO: 2827928 - RNA, 15 nt, Mycobacterium avium subsp. paratuberculosis
cgcaauugcgccagc

SEQ ID NO: 2827929 - RNA, 16 nt, Mycobacterium avium subsp. paratuberculosis
cgcaauugcgccagca

SEQ ID NO: 2827930 - RNA, 18 nt, Mycobacterium avium subsp. paratuberculosis
cgcaauugcgccagcagc

SEQ ID NO: 2827931 - RNA, 19 nt, Mycobacterium avium subsp. paratuberculosis
cgcaauugcgccagcagca

SEQ ID NO: 2827932 - RNA, 15 nt, Mycobacterium avium subsp. paratuberculosis
cgcacaacagccaug

SEQ ID NO: 2827933 - RNA, 19 nt, Mycobacterium avium subsp. paratuberculosis
cgcacaacccggacagcgc

SEQ ID NO: 2827934 - RNA, 21 nt, Mycobacterium avium subsp. paratuberculosis
cgcacaacccggacagcgcga

SEQ ID NO: 2827935 - RNA, 23 nt, Mycobacterium avium subsp. paratuberculosis
cgcacaaccgggccaacgguucg

SEQ ID NO: 2827936 - RNA, 15 nt, Mycobacterium avium subsp. paratuberculosis
cgcacaacgaggccc

SEQ ID NO: 2827937 - RNA, 18 nt, Mycobacterium avium subsp. paratuberculosis
cgcacaacgaggcccgga

SEQ ID NO: 2827938 - RNA, 20 nt, Mycobacterium avium subsp. paratuberculosis
cgcacaacgaggcccggacg

SEQ ID NO: 2827939 - RNA, 22 nt, Mycobacterium avium subsp. paratuberculosis
cgcacaauccggucagcguggc

SEQ ID NO: 2827940 - RNA, 19 nt, Mycobacterium avium subsp. paratuberculosis
cgcacacaccguaccgagg

SEQ ID NO: 2827941 - RNA, 14 nt, Mycobacterium avium subsp. paratuberculosis
cgcacacagcagca

SEQ ID NO: 2827942 - RNA, 12 nt, Mycobacterium avium subsp. paratuberculosis
cgcacaccacca

SEQ ID NO: 2827943 - RNA, 14 nt, Mycobacterium avium subsp. paratuberculosis
cgcacaccagcacg

SEQ ID NO: 2827944 - RNA, 16 nt, Mycobacterium avium subsp. paratuberculosis
cgcacaccagcacggc

SEQ ID NO: 2827945 - RNA, 21 nt, Mycobacterium avium subsp. paratuberculosis
cgcacaccagcacggcggcgc

SEQ ID NO: 2827946 - RNA, 14 nt, Mycobacterium avium subsp. paratuberculosis
cgcacaccgcggcg

SEQ ID NO: 2827947 - RNA, 15 nt, Mycobacterium avium subsp. paratuberculosis
cgcacaccgcggcgg

SEQ ID NO: 2827948 - RNA, 21 nt, Mycobacterium avium subsp. paratuberculosis
cgcacaccgcggcggcgucgg

SEQ ID NO: 2827949 - RNA, 22 nt, Mycobacterium avium subsp. paratuberculosis
cgcacaccgcggcggcgucggc

SEQ ID NO: 2827950 - RNA, 12 nt, Mycobacterium avium subsp. paratuberculosis
cgcacaccggcc

SEQ ID NO: 2827951 - RNA, 23 nt, Mycobacterium avium subsp. paratuberculosis
cgcacacggccucgcccagcgcc

SEQ ID NO: 2827952 - RNA, 23 nt, Mycobacterium avium subsp. paratuberculosis
cgcacagauacgcgacgaaccgc

SEQ ID NO: 2827953 - RNA, 12 nt, Mycobacterium avium subsp. paratuberculosis
cgcacagcacca

SEQ ID NO: 2827954 - RNA, 22 nt, Mycobacterium avium subsp. paratuberculosis
cgcacagcauguccucggggug

SEQ ID NO: 2827955 - RNA, 18 nt, Mycobacterium avium subsp. paratuberculosis
cgcacagccgcagcagcc

SEQ ID NO: 2827956 - RNA, 14 nt, Mycobacterium avium subsp. paratuberculosis
cgcacagccggcgc

SEQ ID NO: 2827957 - RNA, 18 nt, Mycobacterium avium subsp. paratuberculosis
cgcacagccggcgcgcgg

SEQ ID NO: 2827958 - RNA, 19 nt, Mycobacterium avium subsp. paratuberculosis
cgcacagccggcgcgcggu

SEQ ID NO: 2827959 - RNA, 16 nt, Mycobacterium avium subsp. paratuberculosis
cgcacagccggcggcg

SEQ ID NO: 2827960 - RNA, 17 nt, Mycobacterium avium subsp. paratuberculosis
cgcacagccggcggcgg

SEQ ID NO: 2827961 - RNA, 18 nt, Mycobacterium avium subsp. paratuberculosis
cgcacagccggcggcggc

SEQ ID NO: 2827962 - RNA, 13 nt, Mycobacterium avium subsp. paratuberculosis
cgcacagcgccac

SEQ ID NO: 2827963 - RNA, 14 nt, Mycobacterium avium subsp. paratuberculosis
cgcacagcgccaca

SEQ ID NO: 2827964 - RNA, 17 nt, Mycobacterium avium subsp. paratuberculosis
cgcacagcgccgcguug

SEQ ID NO: 2827965 - RNA, 23 nt, Mycobacterium avium subsp. paratuberculosis
cgcacagcgccgcguugucggcg

SEQ ID NO: 2827966 - RNA, 21 nt, Mycobacterium avium subsp. paratuberculosis
cgcacagcguuauccaccagg

SEQ ID NO: 2827967 - RNA, 22 nt, Mycobacterium avium subsp. paratuberculosis
cgcacagcguuauccaccaggu

SEQ ID NO: 2827968 - RNA, 21 nt, Mycobacterium avium subsp. paratuberculosis
cgcacagcuaggucguggcgc

SEQ ID NO: 2827969 - RNA, 17 nt, Mycobacterium avium subsp. paratuberculosis
cgcacagcuuucgggcg

SEQ ID NO: 2827970 - RNA, 18 nt, Mycobacterium avium subsp. paratuberculosis
cgcacagcuuucgggcgg

SEQ ID NO: 2827971 - RNA, 20 nt, Mycobacterium avium subsp. paratuberculosis
cgcacagcuuucgggcggcc

SEQ ID NO: 2827972 - RNA, 22 nt, Mycobacterium avium subsp. paratuberculosis
cgcacagcuuucgggcggccug

SEQ ID NO: 2827973 - RNA, 18 nt, Mycobacterium avium subsp. paratuberculosis
cgcacaggaacgcgucga

SEQ ID NO: 2827974 - RNA, 20 nt, Mycobacterium avium subsp. paratuberculosis
cgcacaggaugcccaacagc

SEQ ID NO: 2827975 - RNA, 21 nt, Mycobacterium avium subsp. paratuberculosis
cgcacaucacgguggccgcca

SEQ ID NO: 2827976 - RNA, 17 nt, Mycobacterium avium subsp. paratuberculosis
cgcacaucguggcgacg

SEQ ID NO: 2827977 - RNA, 18 nt, Mycobacterium avium subsp. paratuberculosis
cgcacaucguggcgacga

SEQ ID NO: 2827978 - RNA, 20 nt, Mycobacterium avium subsp. paratuberculosis
cgcacaugccgaggcacagc

SEQ ID NO: 2827979 - RNA, 20 nt, Mycobacterium avium subsp. paratuberculosis
cgcaccaaccggccccgagc

SEQ ID NO: 2827980 - RNA, 21 nt, Mycobacterium avium subsp. paratuberculosis
cgcaccaaccggccccgagcg

SEQ ID NO: 2827981 - RNA, 23 nt, Mycobacterium avium subsp. paratuberculosis
cgcaccaccacguugcacggcag

SEQ ID NO: 2827982 - RNA, 13 nt, Mycobacterium avium subsp. paratuberculosis
cgcaccaccagcu

SEQ ID NO: 2827983 - RNA, 21 nt, Mycobacterium avium subsp. paratuberculosis
cgcaccaccagcucgucgccg

SEQ ID NO: 2827984 - RNA, 15 nt, Mycobacterium avium subsp. paratuberculosis
cgcaccacccagccc

SEQ ID NO: 2827985 - RNA, 13 nt, Mycobacterium avium subsp. paratuberculosis
cgcaccaccgccc

SEQ ID NO: 2827986 - RNA, 15 nt, Mycobacterium avium subsp. paratuberculosis
cgcaccaccgcccgg

SEQ ID NO: 2827987 - RNA, 15 nt, Mycobacterium avium subsp. paratuberculosis
cgcaccaccgcggug

SEQ ID NO: 2827988 - RNA, 23 nt, Mycobacterium avium subsp. paratuberculosis
cgcaccaccgcggugagcggccg

SEQ ID NO: 2827989 - RNA, 15 nt, Mycobacterium avium subsp. paratuberculosis
cgcaccgccgcggga

SEQ ID NO: 2827990 - RNA, 14 nt, Mycobacterium avium subsp. paratuberculosis
cgcaccgccgggca

SEQ ID NO: 2827991 - RNA, 15 nt, Mycobacterium avium subsp. paratuberculosis
cgcaccgccgggcau

SEQ ID NO: 2827992 - RNA, 18 nt, Mycobacterium avium subsp. paratuberculosis
cgcaccgccgggcauccg

SEQ ID NO: 2827993 - RNA, 20 nt, Mycobacterium avium subsp. paratuberculosis
cgcaccgccgggcauccggg

SEQ ID NO: 2827994 - RNA, 13 nt, Mycobacterium avium subsp. paratuberculosis
cgcaccgccgucg

SEQ ID NO: 2827995 - RNA, 14 nt, Mycobacterium avium subsp. paratuberculosis
cgcaccgccgucgg

SEQ ID NO: 2827996 - RNA, 15 nt, Mycobacterium avium subsp. paratuberculosis
cgcaccgccgucggg

SEQ ID NO: 2827997 - RNA, 22 nt, Mycobacterium avium subsp. paratuberculosis
cgcaccgccuccucgaugucgg

SEQ ID NO: 2827998 - RNA, 17 nt, Mycobacterium avium subsp. paratuberculosis
cgcaccgccugugcgac

SEQ ID NO: 2827999 - RNA, 16 nt, Mycobacterium avium subsp. paratuberculosis
cgcaccgcgaaacgca

SEQ ID NO: 2828000 - RNA, 12 nt, Mycobacterium avium subsp. paratuberculosis
cgcaccgcgacc

SEQ ID NO: 2828001 - RNA, 13 nt, Mycobacterium avium subsp. paratuberculosis
cgcaccgcgacga

SEQ ID NO: 2828002 - RNA, 15 nt, Mycobacterium avium subsp. paratuberculosis
cgcaccgcgagcaga

SEQ ID NO: 2828003 - RNA, 16 nt, Mycobacterium avium subsp. paratuberculosis
cgcaccgcgcgccagg

SEQ ID NO: 2828004 - RNA, 13 nt, Mycobacterium avium subsp. paratuberculosis
cgcaccgcggagc

SEQ ID NO: 2828005 - RNA, 14 nt, Mycobacterium avium subsp. paratuberculosis
cgcaccgcggagcg

SEQ ID NO: 2828006 - RNA, 22 nt, Mycobacterium avium subsp. paratuberculosis
cgcaccgcggauuccagcgcgu

SEQ ID NO: 2828007 - RNA, 14 nt, Mycobacterium avium subsp. paratuberculosis
cgcaccgcggccuc

SEQ ID NO: 2828008 - RNA, 15 nt, Mycobacterium avium subsp. paratuberculosis
cgcaccgcggccucg

SEQ ID NO: 2828009 - RNA, 22 nt, Mycobacterium avium subsp. paratuberculosis
cgcaccgcggccucggcgucga

SEQ ID NO: 2828010 - RNA, 12 nt, Mycobacterium avium subsp. paratuberculosis
cgcaccgcggcg

SEQ ID NO: 2828011 - RNA, 14 nt, Mycobacterium avium subsp. paratuberculosis
cgcaccgcggcgug

SEQ ID NO: 2828012 - RNA, 15 nt, Mycobacterium avium subsp. paratuberculosis
cgcaccgcggcgugg

SEQ ID NO: 2828013 - RNA, 14 nt, Mycobacterium avium subsp. paratuberculosis
cgcaccgcgggcag

SEQ ID NO: 2828014 - RNA, 15 nt, Mycobacterium avium subsp. paratuberculosis
cgcaccgcgggcagc

SEQ ID NO: 2828015 - RNA, 16 nt, Mycobacterium avium subsp. paratuberculosis
cgcaccgcgggcagca

SEQ ID NO: 2828016 - RNA, 14 nt, Mycobacterium avium subsp. paratuberculosis
cgcaccgcgggcuc

SEQ ID NO: 2828017 - RNA, 15 nt, Mycobacterium avium subsp. paratuberculosis
cgcaccgcgggcucg

SEQ ID NO: 2828018 - RNA, 16 nt, Mycobacterium avium subsp. paratuberculosis
cgcaccgcgggcucga

SEQ ID NO: 2828019 - RNA, 13 nt, Mycobacterium avium subsp. paratuberculosis
cgcaccgcgucga

SEQ ID NO: 2828020 - RNA, 17 nt, Mycobacterium avium subsp. paratuberculosis
cgcaccgcgucgaugcg

SEQ ID NO: 2828021 - RNA, 22 nt, Mycobacterium avium subsp. paratuberculosis
cgcaccgcgucgaugcgggccc

SEQ ID NO: 2828022 - RNA, 14 nt, Mycobacterium avium subsp. paratuberculosis
cgcaccggacgcag

SEQ ID NO: 2828023 - RNA, 16 nt, Mycobacterium avium subsp. paratuberculosis
cgcaccggagccuugg

SEQ ID NO: 2828024 - RNA, 13 nt, Mycobacterium avium subsp. paratuberculosis
cgcaccggccggc

SEQ ID NO: 2828025 - RNA, 15 nt, Mycobacterium avium subsp. paratuberculosis
cgcaccggccggccc

SEQ ID NO: 2828026 - RNA, 13 nt, Mycobacterium avium subsp. paratuberculosis
cgcaccggcgaug

SEQ ID NO: 2828027 - RNA, 16 nt, Mycobacterium avium subsp. paratuberculosis
cgcaccggcgaugcag

SEQ ID NO: 2828028 - RNA, 12 nt, Mycobacterium avium subsp. paratuberculosis
cgcaccggcgcc

SEQ ID NO: 2828029 - RNA, 14 nt, Mycobacterium avium subsp. paratuberculosis
cgcaccggcgccgc

SEQ ID NO: 2828030 - RNA, 15 nt, Mycobacterium avium subsp. paratuberculosis
cgcaccggcgccucg

SEQ ID NO: 2828031 - RNA, 15 nt, Mycobacterium avium subsp. paratuberculosis
cgcaccggcgcuggu

SEQ ID NO: 2828032 - RNA, 16 nt, Mycobacterium avium subsp. paratuberculosis
cgcaccggcugcccca

SEQ ID NO: 2828033 - RNA, 15 nt, Mycobacterium avium subsp. paratuberculosis
cgcaccgggaccagc

SEQ ID NO: 2828034 - RNA, 18 nt, Mycobacterium avium subsp. paratuberculosis
cgcaccgggaccagcgcg

SEQ ID NO: 2828035 - RNA, 12 nt, Mycobacterium avium subsp. paratuberculosis
cgcaccgggccc

SEQ ID NO: 2828036 - RNA, 14 nt, Mycobacterium avium subsp. paratuberculosis
cgcaccgggcccgc

SEQ ID NO: 2828037 - RNA, 15 nt, Mycobacterium avium subsp. paratuberculosis
cgcaccgggcccgcc

SEQ ID NO: 2828038 - RNA, 23 nt, Mycobacterium avium subsp. paratuberculosis
cgcaccgggcccgcccgcagcgg

SEQ ID NO: 2828039 - RNA, 17 nt, Mycobacterium avium subsp. paratuberculosis
cgcaccggucagcgcua

SEQ ID NO: 2828040 - RNA, 12 nt, Mycobacterium avium subsp. paratuberculosis
cgcaccggucca

SEQ ID NO: 2828041 - RNA, 18 nt, Mycobacterium avium subsp. paratuberculosis
cgcaccgguuugucggcg

SEQ ID NO: 2828042 - RNA, 18 nt, Mycobacterium avium subsp. paratuberculosis
cgcaccgucaucgcggcg

SEQ ID NO: 2828043 - RNA, 19 nt, Mycobacterium avium subsp. paratuberculosis
cgcaccgucaucgcggcga

SEQ ID NO: 2828044 - RNA, 20 nt, Mycobacterium avium subsp. paratuberculosis
cgcaccguguagccgaccga

SEQ ID NO: 2828045 - RNA, 21 nt, Mycobacterium avium subsp. paratuberculosis
cgcaccguguagccgaccgac

SEQ ID NO: 2828046 - RNA, 23 nt, Mycobacterium avium subsp. paratuberculosis
cgcaccguguagccgaccgaccc

SEQ ID NO: 2828047 - RNA, 16 nt, Mycobacterium avium subsp. paratuberculosis
cgcaccucgcccggcu

SEQ ID NO: 2828048 - RNA, 16 nt, Mycobacterium avium subsp. paratuberculosis
cgcaccucgccggccg

SEQ ID NO: 2828049 - RNA, 20 nt, Mycobacterium avium subsp. paratuberculosis
cgcaccucgccggccgccgu

SEQ ID NO: 2828050 - RNA, 14 nt, Mycobacterium avium subsp. paratuberculosis
cgcaccucgcucag

SEQ ID NO: 2828051 - RNA, 15 nt, Mycobacterium avium subsp. paratuberculosis
cgcaccucgcucagc

SEQ ID NO: 2828052 - RNA, 18 nt, Mycobacterium avium subsp. paratuberculosis
cgcaccucgcucagcccg

SEQ ID NO: 2828053 - RNA, 17 nt, Mycobacterium avium subsp. paratuberculosis
cgcaccucgcuggcggc

SEQ ID NO: 2828054 - RNA, 13 nt, Mycobacterium avium subsp. paratuberculosis
cgcaccucggccg

SEQ ID NO: 2828055 - RNA, 16 nt, Mycobacterium avium subsp. paratuberculosis
cgcaccucggccgggu

SEQ ID NO: 2828056 - RNA, 18 nt, Mycobacterium avium subsp. paratuberculosis
cgcaccucggccgggucc

SEQ ID NO: 2828057 - RNA, 18 nt, Mycobacterium avium subsp. paratuberculosis
cgcaccucggggcguggc

SEQ ID NO: 2828058 - RNA, 19 nt, Mycobacterium avium subsp. paratuberculosis
cgcaccucggggcguggcg

SEQ ID NO: 2828059 - RNA, 20 nt, Mycobacterium avium subsp. paratuberculosis
cgcaccucggggcguggcgg

SEQ ID NO: 2828060 - RNA, 14 nt, Mycobacterium avium subsp. paratuberculosis
cgcaccugccgucg

SEQ ID NO: 2828061 - RNA, 17 nt, Mycobacterium avium subsp. paratuberculosis
cgcaccugccgucgacg

SEQ ID NO: 2828062 - RNA, 16 nt, Mycobacterium avium subsp. paratuberculosis
cgcaccugcgcgccgu

SEQ ID NO: 2828063 - RNA, 19 nt, Mycobacterium avium subsp. paratuberculosis
cgcaccugcgcgccguugg

SEQ ID NO: 2828064 - RNA, 17 nt, Mycobacterium avium subsp. paratuberculosis
cgcaccugcuccucgaa

SEQ ID NO: 2828065 - RNA, 13 nt, Mycobacterium avium subsp. paratuberculosis
cgcaccuggcagc

SEQ ID NO: 2828066 - RNA, 16 nt, Mycobacterium avium subsp. paratuberculosis
cgcaccuggcagcauc

SEQ ID NO: 2828067 - RNA, 23 nt, Mycobacterium avium subsp. paratuberculosis
cgcaccuggcagcauccgccgac

SEQ ID NO: 2828068 - RNA, 12 nt, Mycobacterium avium subsp. paratuberculosis
cgcaccuggcgc

SEQ ID NO: 2828069 - RNA, 18 nt, Mycobacterium avium subsp. paratuberculosis
cgcaccuggcgcagcacc

SEQ ID NO: 2828070 - RNA, 19 nt, Mycobacterium avium subsp. paratuberculosis
cgcaccuggcgcagcaccg

SEQ ID NO: 2828071 - RNA, 20 nt, Mycobacterium avium subsp. paratuberculosis
cgcaccuggcgcagcaccga

SEQ ID NO: 2828072 - RNA, 17 nt, Mycobacterium avium subsp. paratuberculosis
cgcaccuggucggucag

SEQ ID NO: 2828073 - RNA, 18 nt, Mycobacterium avium subsp. paratuberculosis
cgcaccuggucggucagc

SEQ ID NO: 2828074 - RNA, 22 nt, Mycobacterium avium subsp. paratuberculosis
cgcaccuggucggucagcucga

SEQ ID NO: 2828075 - RNA, 14 nt, Mycobacterium avium subsp. paratuberculosis
cgcacgugucccgu

SEQ ID NO: 2828076 - RNA, 20 nt, Mycobacterium avium subsp. paratuberculosis
cgcacguguucucacggcga

SEQ ID NO: 2828077 - RNA, 16 nt, Mycobacterium avium subsp. paratuberculosis
cgcacguuggcggcca

SEQ ID NO: 2828078 - RNA, 17 nt, Mycobacterium avium subsp. paratuberculosis
cgcacguuggcggccag

SEQ ID NO: 2828079 - RNA, 18 nt, Mycobacterium avium subsp. paratuberculosis
cgcacguuggcggccagc

SEQ ID NO: 2828080 - RNA, 22 nt, Mycobacterium avium subsp. paratuberculosis
cgcacguuggcggccagcgcgc

SEQ ID NO: 2828081 - RNA, 16 nt, Mycobacterium avium subsp. paratuberculosis
cgcacuagguccggcg

SEQ ID NO: 2828082 - RNA, 17 nt, Mycobacterium avium subsp. paratuberculosis
cgcacuagguccggcgc

SEQ ID NO: 2828083 - RNA, 18 nt, Mycobacterium avium subsp. paratuberculosis
cgcacuagguccggcgcg

SEQ ID NO: 2828084 - RNA, 19 nt, Mycobacterium avium subsp. paratuberculosis
cgcacuagguccggcgcga

SEQ ID NO: 2828085 - RNA, 14 nt, Mycobacterium avium subsp. paratuberculosis
cgcacuccgucgcg

SEQ ID NO: 2828086 - RNA, 18 nt, Mycobacterium avium subsp. paratuberculosis
cgcacuccgucgcgauca

SEQ ID NO: 2828087 - RNA, 21 nt, Mycobacterium avium subsp. paratuberculosis
cgcacucgaacggcccggacg

SEQ ID NO: 2828088 - RNA, 14 nt, Mycobacterium avium subsp. paratuberculosis
cgcacucggugugg

SEQ ID NO: 2828089 - RNA, 20 nt, Mycobacterium avium subsp. paratuberculosis
cgcacugcaucucgaccugg

SEQ ID NO: 2828090 - RNA, 21 nt, Mycobacterium avium subsp. paratuberculosis
cgcacugcaucucgaccuggg

SEQ ID NO: 2828091 - RNA, 21 nt, Mycobacterium avium subsp. paratuberculosis
cgcacugcuucgggucgccgg

SEQ ID NO: 2828092 - RNA, 22 nt, Mycobacterium avium subsp. paratuberculosis
cgcacuggagugcugcagaccg

SEQ ID NO: 2828093 - RNA, 18 nt, Mycobacterium avium subsp. paratuberculosis
cgcacuggucgugcugga

SEQ ID NO: 2828094 - RNA, 16 nt, Mycobacterium avium subsp. paratuberculosis
cgcacuucgcgggcgg

SEQ ID NO: 2828095 - RNA, 19 nt, Mycobacterium avium subsp. paratuberculosis
cgcacuucgcgggcggcgc

SEQ ID NO: 2828096 - RNA, 18 nt, Mycobacterium avium subsp. paratuberculosis
cgcacuuggccucgggcg

SEQ ID NO: 2828097 - RNA, 21 nt, Mycobacterium avium subsp. paratuberculosis
cgcacuuggccucgggcgacg

SEQ ID NO: 2828098 - RNA, 18 nt, Mycobacterium avium subsp. paratuberculosis
cgcagaaaaaggccgccg

SEQ ID NO: 2828099 - RNA, 19 nt, Mycobacterium avium subsp. paratuberculosis
cgcagaaaaaggccgccgc

SEQ ID NO: 2828100 - RNA, 20 nt, Mycobacterium avium subsp. paratuberculosis
cgcagaaaaaggccgccgcu

SEQ ID NO: 2828101 - RNA, 21 nt, Mycobacterium avium subsp. paratuberculosis
cgcagaaaaaggccgccgcug

SEQ ID NO: 2828102 - RNA, 21 nt, Mycobacterium avium subsp. paratuberculosis
cgcagaaaccccacgaucgcg

SEQ ID NO: 2828103 - RNA, 22 nt, Mycobacterium avium subsp. paratuberculosis
cgcagaaaugggccaugccggc

SEQ ID NO: 2828104 - RNA, 18 nt, Mycobacterium avium subsp. paratuberculosis
cgcagaacaccaccgcca

SEQ ID NO: 2828105 - RNA, 18 nt, Mycobacterium avium subsp. paratuberculosis
cgcagaacaccacggugu

SEQ ID NO: 2828106 - RNA, 15 nt, Mycobacterium avium subsp. paratuberculosis
cgcagaacaccagcg

SEQ ID NO: 2828107 - RNA, 16 nt, Mycobacterium avium subsp. paratuberculosis
cgcagaacaccagcgc

SEQ ID NO: 2828108 - RNA, 17 nt, Mycobacterium avium subsp. paratuberculosis
cgcagaagcuaacgcca

SEQ ID NO: 2828109 - RNA, 17 nt, Mycobacterium avium subsp. paratuberculosis
cgcagacguagcaccag

SEQ ID NO: 2828110 - RNA, 18 nt, Mycobacterium avium subsp. paratuberculosis
cgcagacguagcaccagu

SEQ ID NO: 2828111 - RNA, 16 nt, Mycobacterium avium subsp. paratuberculosis
cgcagauacaucucgg

SEQ ID NO: 2828112 - RNA, 18 nt, Mycobacterium avium subsp. paratuberculosis
cgcagaucagggcgaugg

SEQ ID NO: 2828113 - RNA, 15 nt, Mycobacterium avium subsp. paratuberculosis
cgcagaucccgccgg

SEQ ID NO: 2828114 - RNA, 19 nt, Mycobacterium avium subsp. paratuberculosis
cgcagaucccgccggcggc

SEQ ID NO: 2828115 - RNA, 21 nt, Mycobacterium avium subsp. paratuberculosis
cgcagaucccgccggcggcca

SEQ ID NO: 2828116 - RNA, 22 nt, Mycobacterium avium subsp. paratuberculosis
cgcagaucccgccggcggccac

SEQ ID NO: 2828117 - RNA, 22 nt, Mycobacterium avium subsp. paratuberculosis
cgcagaucgagaucagggcgcg

SEQ ID NO: 2828118 - RNA, 24 nt, Mycobacterium avium subsp. paratuberculosis
cgcagaucgagaucagggcgcgca

SEQ ID NO: 2828119 - RNA, 13 nt, Mycobacterium avium subsp. paratuberculosis
cgcagaucgaugg

SEQ ID NO: 2828120 - RNA, 17 nt, Mycobacterium avium subsp. paratuberculosis
cgcagaucgauggggau

SEQ ID NO: 2828121 - RNA, 16 nt, Mycobacterium avium subsp. paratuberculosis
cgcagaucgccagcac

SEQ ID NO: 2828122 - RNA, 18 nt, Mycobacterium avium subsp. paratuberculosis
cgcagaucgccagcaccg

SEQ ID NO: 2828123 - RNA, 15 nt, Mycobacterium avium subsp. paratuberculosis
cgcagaucgcgcauc

SEQ ID NO: 2828124 - RNA, 13 nt, Mycobacterium avium subsp. paratuberculosis
cgcagaucgucga

SEQ ID NO: 2828125 - RNA, 15 nt, Mycobacterium avium subsp. paratuberculosis
cgcagaucgucgaac

SEQ ID NO: 2828126 - RNA, 14 nt, Mycobacterium avium subsp. paratuberculosis
cgcagaucgucgac

SEQ ID NO: 2828127 - RNA, 20 nt, Mycobacterium avium subsp. paratuberculosis
cgcagaucgucgaccugcuc

SEQ ID NO: 2828128 - RNA, 22 nt, Mycobacterium avium subsp. paratuberculosis
cgcagaucgucgaccugcucgu

SEQ ID NO: 2828129 - RNA, 20 nt, Mycobacterium avium subsp. paratuberculosis
cgcagaucuugugccagccg

SEQ ID NO: 2828130 - RNA, 15 nt, Mycobacterium avium subsp. paratuberculosis
cgcagaugaccggcc

SEQ ID NO: 2828131 - RNA, 17 nt, Mycobacterium avium subsp. paratuberculosis
cgcagaugaccggccug

SEQ ID NO: 2828132 - RNA, 22 nt, Mycobacterium avium subsp. paratuberculosis
cgcagaugaccggccugcagcg

SEQ ID NO: 2828133 - RNA, 23 nt, Mycobacterium avium subsp. paratuberculosis
cgcagaugauuucgaagcugucg

SEQ ID NO: 2828134 - RNA, 16 nt, Mycobacterium avium subsp. paratuberculosis
cgcagauggucgggac

SEQ ID NO: 2828135 - RNA, 20 nt, Mycobacterium avium subsp. paratuberculosis
cgcagauggucgggacgucg

SEQ ID NO: 2828136 - RNA, 21 nt, Mycobacterium avium subsp. paratuberculosis
cgcagauggucgggacgucgg

SEQ ID NO: 2828137 - RNA, 14 nt, Mycobacterium avium subsp. paratuberculosis
cgcagcaacgguac

SEQ ID NO: 2828138 - RNA, 21 nt, Mycobacterium avium subsp. paratuberculosis
cgcagcaacgguacgugcgcc

SEQ ID NO: 2828139 - RNA, 22 nt, Mycobacterium avium subsp. paratuberculosis
cgcagcaacgguacgugcgccg

SEQ ID NO: 2828140 - RNA, 23 nt, Mycobacterium avium subsp. paratuberculosis
cgcagcaacgguacgugcgccgg

SEQ ID NO: 2828141 - RNA, 17 nt, Mycobacterium avium subsp. paratuberculosis
cgcagcaauugacgccg

SEQ ID NO: 2828142 - RNA, 19 nt, Mycobacterium avium subsp. paratuberculosis
cgcagcaauugacgccgac

SEQ ID NO: 2828143 - RNA, 20 nt, Mycobacterium avium subsp. paratuberculosis
cgcagcaauugacgccgaca

SEQ ID NO: 2828144 - RNA, 13 nt, Mycobacterium avium subsp. paratuberculosis
cgcagcaccaccu

SEQ ID NO: 2828145 - RNA, 12 nt, Mycobacterium avium subsp. paratuberculosis
cgcagcaccagg

SEQ ID NO: 2828146 - RNA, 18 nt, Mycobacterium avium subsp. paratuberculosis
cgcagcaccaggcccucc

SEQ ID NO: 2828147 - RNA, 16 nt, Mycobacterium avium subsp. paratuberculosis
cgcagcaccauccgcg

SEQ ID NO: 2828148 - RNA, 19 nt, Mycobacterium avium subsp. paratuberculosis
cgcagcaccauccgcgcga

SEQ ID NO: 2828149 - RNA, 22 nt, Mycobacterium avium subsp. paratuberculosis
cgcagcaccauccgcgcgagcg

SEQ ID NO: 2828150 - RNA, 14 nt, Mycobacterium avium subsp. paratuberculosis
cgcagcaccgacuc

SEQ ID NO: 2828151 - RNA, 12 nt, Mycobacterium avium subsp. paratuberculosis
cgcagcaccgau

SEQ ID NO: 2828152 - RNA, 19 nt, Mycobacterium avium subsp. paratuberculosis
cgcagcaccgaugccagac

SEQ ID NO: 2828153 - RNA, 16 nt, Mycobacterium avium subsp. paratuberculosis
cgcagcaccgcgucgg

SEQ ID NO: 2828154 - RNA, 14 nt, Mycobacterium avium subsp. paratuberculosis
cgcagcaccuccga

SEQ ID NO: 2828155 - RNA, 18 nt, Mycobacterium avium subsp. paratuberculosis
cgcagcaccuccgacagc

SEQ ID NO: 2828156 - RNA, 19 nt, Mycobacterium avium subsp. paratuberculosis
cgcagcaccuugccggucg

SEQ ID NO: 2828157 - RNA, 19 nt, Mycobacterium avium subsp. paratuberculosis
cgcagcacgcugaagccca

SEQ ID NO: 2828158 - RNA, 14 nt, Mycobacterium avium subsp. paratuberculosis
cgcagcacggccac

SEQ ID NO: 2828159 - RNA, 18 nt, Mycobacterium avium subsp. paratuberculosis
cgcagcacguguucggga

SEQ ID NO: 2828160 - RNA, 16 nt, Mycobacterium avium subsp. paratuberculosis
cgcagcagcagcccga

SEQ ID NO: 2828161 - RNA, 16 nt, Mycobacterium avium subsp. paratuberculosis
cgcagcagcaggucgg

SEQ ID NO: 2828162 - RNA, 20 nt, Mycobacterium avium subsp. paratuberculosis
cgcagcagcaggucggccag

SEQ ID NO: 2828163 - RNA, 13 nt, Mycobacterium avium subsp. paratuberculosis
cgcagcagccagg

SEQ ID NO: 2828164 - RNA, 14 nt, Mycobacterium avium subsp. paratuberculosis
cgcagcagccagga

SEQ ID NO: 2828165 - RNA, 22 nt, Mycobacterium avium subsp. paratuberculosis
cgcagcagccaggacagcguca

SEQ ID NO: 2828166 - RNA, 13 nt, Mycobacterium avium subsp. paratuberculosis
cgcagcagccgcg

SEQ ID NO: 2828167 - RNA, 14 nt, Mycobacterium avium subsp. paratuberculosis
cgcagcagccgcgc

SEQ ID NO: 2828168 - RNA, 18 nt, Mycobacterium avium subsp. paratuberculosis
cgcagcagccgcgccacc

SEQ ID NO: 2828169 - RNA, 13 nt, Mycobacterium avium subsp. paratuberculosis
cgcagcagcgcca

SEQ ID NO: 2828170 - RNA, 18 nt, Mycobacterium avium subsp. paratuberculosis
cgcagcagcgccagcagc

SEQ ID NO: 2828171 - RNA, 22 nt, Mycobacterium avium subsp. paratuberculosis
cgcagcagcggcuugagcgcca

SEQ ID NO: 2828172 - RNA, 19 nt, Mycobacterium avium subsp. paratuberculosis
cgcagcagcguuccgucgg

SEQ ID NO: 2828173 - RNA, 20 nt, Mycobacterium avium subsp. paratuberculosis
cgcagcagcguuccgucggc

SEQ ID NO: 2828174 - RNA, 13 nt, Mycobacterium avium subsp. paratuberculosis
cgcagcagcugca

SEQ ID NO: 2828175 - RNA, 14 nt, Mycobacterium avium subsp. paratuberculosis
cgcagcaggcgccg

SEQ ID NO: 2828176 - RNA, 17 nt, Mycobacterium avium subsp. paratuberculosis
cgcagcaggcgccgguc

SEQ ID NO: 2828177 - RNA, 19 nt, Mycobacterium avium subsp. paratuberculosis
cgcagcaggcgccggucgu

SEQ ID NO: 2828178 - RNA, 15 nt, Mycobacterium avium subsp. paratuberculosis
cgcagcaggcggacg

SEQ ID NO: 2828179 - RNA, 20 nt, Mycobacterium avium subsp. paratuberculosis
cgcagcaggcggacggcgac

SEQ ID NO: 2828180 - RNA, 19 nt, Mycobacterium avium subsp. paratuberculosis
cgcagcagguaaaccagca

SEQ ID NO: 2828181 - RNA, 22 nt, Mycobacterium avium subsp. paratuberculosis
cgcagcagguaaaccagcagcg

SEQ ID NO: 2828182 - RNA, 18 nt, Mycobacterium avium subsp. paratuberculosis
cgcagcaggugcaucgcc

SEQ ID NO: 2828183 - RNA, 19 nt, Mycobacterium avium subsp. paratuberculosis
cgcagcaggugcaucgcca

SEQ ID NO: 2828184 - RNA, 15 nt, Mycobacterium avium subsp. paratuberculosis
cgcagcaggugcgcc

SEQ ID NO: 2828185 - RNA, 16 nt, Mycobacterium avium subsp. paratuberculosis
cgcagcaucacgucgg

SEQ ID NO: 2828186 - RNA, 20 nt, Mycobacterium avium subsp. paratuberculosis
cgcagcaucacgucggcgag

SEQ ID NO: 2828187 - RNA, 18 nt, Mycobacterium avium subsp. paratuberculosis
cgcagcauccgcaccagg

SEQ ID NO: 2828188 - RNA, 14 nt, Mycobacterium avium subsp. paratuberculosis
cgcagcaucggcag

SEQ ID NO: 2828189 - RNA, 16 nt, Mycobacterium avium subsp. paratuberculosis
cgcagcaucuccgagu

SEQ ID NO: 2828190 - RNA, 22 nt, Mycobacterium avium subsp. paratuberculosis
cgcagcaucuccgagucggcgu

SEQ ID NO: 2828191 - RNA, 19 nt, Mycobacterium avium subsp. paratuberculosis
cgcagccacgagcccagcc

SEQ ID NO: 2828192 - RNA, 12 nt, Mycobacterium avium subsp. paratuberculosis
cgcagccagacc

SEQ ID NO: 2828193 - RNA, 14 nt, Mycobacterium avium subsp. paratuberculosis
cgcagccagaccuc

SEQ ID NO: 2828194 - RNA, 20 nt, Mycobacterium avium subsp. paratuberculosis
cgcagccagaccucgccgac

SEQ ID NO: 2828195 - RNA, 14 nt, Mycobacterium avium subsp. paratuberculosis
cgcagccagcgcag

SEQ ID NO: 2828196 - RNA, 16 nt, Mycobacterium avium subsp. paratuberculosis
cgcagccagcgccgca

SEQ ID NO: 2828197 - RNA, 19 nt, Mycobacterium avium subsp. paratuberculosis
cgcagccagcgccgcacug

SEQ ID NO: 2828198 - RNA, 13 nt, Mycobacterium avium subsp. paratuberculosis
cgcagccagcggu

SEQ ID NO: 2828199 - RNA, 19 nt, Mycobacterium avium subsp. paratuberculosis
cgcagccagcggucacgga

SEQ ID NO: 2828200 - RNA, 14 nt, Mycobacterium avium subsp. paratuberculosis
cgcagccagcucgg

SEQ ID NO: 2828201 - RNA, 15 nt, Mycobacterium avium subsp. paratuberculosis
cgcagccagcucggc

SEQ ID NO: 2828202 - RNA, 17 nt, Mycobacterium avium subsp. paratuberculosis
cgcagccagcucggcgu

SEQ ID NO: 2828203 - RNA, 14 nt, Mycobacterium avium subsp. paratuberculosis
cgcagccaggugaa

SEQ ID NO: 2828204 - RNA, 18 nt, Mycobacterium avium subsp. paratuberculosis
cgcagccaggugaacagg

SEQ ID NO: 2828205 - RNA, 19 nt, Mycobacterium avium subsp. paratuberculosis
cgcagccagucgccggcca

SEQ ID NO: 2828206 - RNA, 15 nt, Mycobacterium avium subsp. paratuberculosis
cgcagcccagccagc

SEQ ID NO: 2828207 - RNA, 16 nt, Mycobacterium avium subsp. paratuberculosis
cgcagcccagccagcg

SEQ ID NO: 2828208 - RNA, 15 nt, Mycobacterium avium subsp. paratuberculosis
cgcagcccaggccca

SEQ ID NO: 2828209 - RNA, 18 nt, Mycobacterium avium subsp. paratuberculosis
cgcagcccaggcccagca

SEQ ID NO: 2828210 - RNA, 20 nt, Mycobacterium avium subsp. paratuberculosis
cgcagcccaggcccagcagc

SEQ ID NO: 2828211 - RNA, 22 nt, Mycobacterium avium subsp. paratuberculosis
cgcagcccaggcccagcagcac

SEQ ID NO: 2828212 - RNA, 17 nt, Mycobacterium avium subsp. paratuberculosis
cgcagcccgagcggcau

SEQ ID NO: 2828213 - RNA, 18 nt, Mycobacterium avium subsp. paratuberculosis
cgcagcccgagcggcauc

SEQ ID NO: 2828214 - RNA, 15 nt, Mycobacterium avium subsp. paratuberculosis
cgcagcccgaucgcc

SEQ ID NO: 2828215 - RNA, 21 nt, Mycobacterium avium subsp. paratuberculosis
cgcagcccgaucgccagcgcc

SEQ ID NO: 2828216 - RNA, 14 nt, Mycobacterium avium subsp. paratuberculosis
cgcagcccgccagg

SEQ ID NO: 2828217 - RNA, 15 nt, Mycobacterium avium subsp. paratuberculosis
cgcagcccgccagga

SEQ ID NO: 2828218 - RNA, 12 nt, Mycobacterium avium subsp. paratuberculosis
cgcagcccgccg

SEQ ID NO: 2828219 - RNA, 13 nt, Mycobacterium avium subsp. paratuberculosis
cgcagcccgccgg

SEQ ID NO: 2828220 - RNA, 13 nt, Mycobacterium avium subsp. paratuberculosis
cgcagcccggcgg

SEQ ID NO: 2828221 - RNA, 14 nt, Mycobacterium avium subsp. paratuberculosis
cgcagcccggcggu

SEQ ID NO: 2828222 - RNA, 15 nt, Mycobacterium avium subsp. paratuberculosis
cgcagcccggcgguu

SEQ ID NO: 2828223 - RNA, 13 nt, Mycobacterium avium subsp. paratuberculosis
cgcagcccgucga

SEQ ID NO: 2828224 - RNA, 12 nt, Mycobacterium avium subsp. paratuberculosis
cgcagccgccgg

SEQ ID NO: 2828225 - RNA, 13 nt, Mycobacterium avium subsp. paratuberculosis
cgcagccgccggg

SEQ ID NO: 2828226 - RNA, 18 nt, Mycobacterium avium subsp. paratuberculosis
cgcagccgcgacggcggg

SEQ ID NO: 2828227 - RNA, 18 nt, Mycobacterium avium subsp. paratuberculosis
cgcagccgcgagucgagg

SEQ ID NO: 2828228 - RNA, 13 nt, Mycobacterium avium subsp. paratuberculosis
cgcagccgcgccc

SEQ ID NO: 2828229 - RNA, 14 nt, Mycobacterium avium subsp. paratuberculosis
cgcagccgcgcccg

SEQ ID NO: 2828230 - RNA, 13 nt, Mycobacterium avium subsp. paratuberculosis
cgcagccgcgcgg

SEQ ID NO: 2828231 - RNA, 17 nt, Mycobacterium avium subsp. paratuberculosis
cgcagccgcgcggccgg

SEQ ID NO: 2828232 - RNA, 18 nt, Mycobacterium avium subsp. paratuberculosis
cgcagccgcgcggccggc

SEQ ID NO: 2828233 - RNA, 21 nt, Mycobacterium avium subsp. paratuberculosis
cgcagccgcgcggccggccac

SEQ ID NO: 2828234 - RNA, 13 nt, Mycobacterium avium subsp. paratuberculosis
cgcagccgcggug

SEQ ID NO: 2828235 - RNA, 14 nt, Mycobacterium avium subsp. paratuberculosis
cgcagccgcggugg

SEQ ID NO: 2828236 - RNA, 20 nt, Mycobacterium avium subsp. paratuberculosis
cgcagccgcgguggcggugu

SEQ ID NO: 2828237 - RNA, 15 nt, Mycobacterium avium subsp. paratuberculosis
cgcagccgcugcagc

SEQ ID NO: 2828238 - RNA, 16 nt, Mycobacterium avium subsp. paratuberculosis
cgcagccgcugcagcg

SEQ ID NO: 2828239 - RNA, 18 nt, Mycobacterium avium subsp. paratuberculosis
cgcagccgcugcagcgcc

SEQ ID NO: 2828240 - RNA, 19 nt, Mycobacterium avium subsp. paratuberculosis
cgcagccgcugcagcgccg

SEQ ID NO: 2828241 - RNA, 23 nt, Mycobacterium avium subsp. paratuberculosis
cgcagccgcugcagcgccgcccg

SEQ ID NO: 2828242 - RNA, 13 nt, Mycobacterium avium subsp. paratuberculosis
cgcagccgcuggc

SEQ ID NO: 2828243 - RNA, 15 nt, Mycobacterium avium subsp. paratuberculosis
cgcagccgcuggccg

SEQ ID NO: 2828244 - RNA, 14 nt, Mycobacterium avium subsp. paratuberculosis
cgcagcgcgucguc

SEQ ID NO: 2828245 - RNA, 13 nt, Mycobacterium avium subsp. paratuberculosis
cgcagcgcucagu

SEQ ID NO: 2828246 - RNA, 13 nt, Mycobacterium avium subsp. paratuberculosis
cgcagcggcaggu

SEQ ID NO: 2828247 - RNA, 15 nt, Mycobacterium avium subsp. paratuberculosis
cgcagcggcaggucg

SEQ ID NO: 2828248 - RNA, 17 nt, Mycobacterium avium subsp. paratuberculosis
cgcagcggcaggucguc

SEQ ID NO: 2828249 - RNA, 18 nt, Mycobacterium avium subsp. paratuberculosis
cgcagcggcccgaacacc

SEQ ID NO: 2828250 - RNA, 15 nt, Mycobacterium avium subsp. paratuberculosis
cgcagcggcgccgca

SEQ ID NO: 2828251 - RNA, 19 nt, Mycobacterium avium subsp. paratuberculosis
cgcagcggcgccgcagcuc

SEQ ID NO: 2828252 - RNA, 14 nt, Mycobacterium avium subsp. paratuberculosis
cgcagcggcgccgg

SEQ ID NO: 2828253 - RNA, 15 nt, Mycobacterium avium subsp. paratuberculosis
cgcagcggcgccggg

SEQ ID NO: 2828254 - RNA, 12 nt, Mycobacterium avium subsp. paratuberculosis
cgcagcggcggc

SEQ ID NO: 2828255 - RNA, 13 nt, Mycobacterium avium subsp. paratuberculosis
cgcagcggcggca

SEQ ID NO: 2828256 - RNA, 15 nt, Mycobacterium avium subsp. paratuberculosis
cgcagcggcggcacg

SEQ ID NO: 2828257 - RNA, 16 nt, Mycobacterium avium subsp. paratuberculosis
cgcagcggcggcacgg

SEQ ID NO: 2828258 - RNA, 13 nt, Mycobacterium avium subsp. paratuberculosis
cgcagcggcggcu

SEQ ID NO: 2828259 - RNA, 12 nt, Mycobacterium avium subsp. paratuberculosis
cgcagcggcguc

SEQ ID NO: 2828260 - RNA, 18 nt, Mycobacterium avium subsp. paratuberculosis
cgcagcggcuugaccggc

SEQ ID NO: 2828261 - RNA, 16 nt, Mycobacterium avium subsp. paratuberculosis
cgcagcgggauuggcg

SEQ ID NO: 2828262 - RNA, 20 nt, Mycobacterium avium subsp. paratuberculosis
cgcagcggggaggcccagcc

SEQ ID NO: 2828263 - RNA, 21 nt, Mycobacterium avium subsp. paratuberculosis
cgcagcggggaggcccagccc

SEQ ID NO: 2828264 - RNA, 13 nt, Mycobacterium avium subsp. paratuberculosis
cgcagcggggcgc

SEQ ID NO: 2828265 - RNA, 16 nt, Mycobacterium avium subsp. paratuberculosis
cgcagcggggcgcgca

SEQ ID NO: 2828266 - RNA, 17 nt, Mycobacterium avium subsp. paratuberculosis
cgcagcggggcgcgcag

SEQ ID NO: 2828267 - RNA, 16 nt, Mycobacterium avium subsp. paratuberculosis
cgcagcggggcgcugu

SEQ ID NO: 2828268 - RNA, 17 nt, Mycobacterium avium subsp. paratuberculosis
cgcagcggugacaccca

SEQ ID NO: 2828269 - RNA, 17 nt, Mycobacterium avium subsp. paratuberculosis
cgcagcggugcagcccc

SEQ ID NO: 2828270 - RNA, 12 nt, Mycobacterium avium subsp. paratuberculosis
cgcagcgucggc

SEQ ID NO: 2828271 - RNA, 22 nt, Mycobacterium avium subsp. paratuberculosis
cgcagcgucggcgugcccgccg

SEQ ID NO: 2828272 - RNA, 17 nt, Mycobacterium avium subsp. paratuberculosis
cgcagcgucucccgggu

SEQ ID NO: 2828273 - RNA, 16 nt, Mycobacterium avium subsp. paratuberculosis
cgcagcgucucgaucg

SEQ ID NO: 2828274 - RNA, 19 nt, Mycobacterium avium subsp. paratuberculosis
cgcagcgucucgaucgacg

SEQ ID NO: 2828275 - RNA, 23 nt, Mycobacterium avium subsp. paratuberculosis
cgcagcgucucgaucgacgacgc

SEQ ID NO: 2828276 - RNA, 21 nt, Mycobacterium avium subsp. paratuberculosis
cgcagcgucuugcccagcggg

SEQ ID NO: 2828277 - RNA, 17 nt, Mycobacterium avium subsp. paratuberculosis
cgcagcgugggcaccgg

SEQ ID NO: 2828278 - RNA, 18 nt, Mycobacterium avium subsp. paratuberculosis
cgcagcgugucggggucg

SEQ ID NO: 2828279 - RNA, 21 nt, Mycobacterium avium subsp. paratuberculosis
cgcagcgugucggggucggcg

SEQ ID NO: 2828280 - RNA, 16 nt, Mycobacterium avium subsp. paratuberculosis
cgcagcuccagcgagu

SEQ ID NO: 2828281 - RNA, 21 nt, Mycobacterium avium subsp. paratuberculosis
cgcagcucccccggcgugagc

SEQ ID NO: 2828282 - RNA, 23 nt, Mycobacterium avium subsp. paratuberculosis
cgcagcucccccggcgugagcga

SEQ ID NO: 2828283 - RNA, 23 nt, Mycobacterium avium subsp. paratuberculosis
cgcagcucgacgaccucgccgac

SEQ ID NO: 2828284 - RNA, 14 nt, Mycobacterium avium subsp. paratuberculosis
cgcagcucgcccag

SEQ ID NO: 2828285 - RNA, 18 nt, Mycobacterium avium subsp. paratuberculosis
cgcagcucgcccagcacc

SEQ ID NO: 2828286 - RNA, 21 nt, Mycobacterium avium subsp. paratuberculosis
cgcagcucgcccagcaccguc

SEQ ID NO: 2828287 - RNA, 15 nt, Mycobacterium avium subsp. paratuberculosis
cgcagcucgccgagc

SEQ ID NO: 2828288 - RNA, 15 nt, Mycobacterium avium subsp. paratuberculosis
cgcagcucgccggug

SEQ ID NO: 2828289 - RNA, 15 nt, Mycobacterium avium subsp. paratuberculosis
cgcagcucgcgcagc

SEQ ID NO: 2828290 - RNA, 18 nt, Mycobacterium avium subsp. paratuberculosis
cgcagcucgcgcagccgg

SEQ ID NO: 2828291 - RNA, 16 nt, Mycobacterium avium subsp. paratuberculosis
cgcagcucgcgcagcu

SEQ ID NO: 2828292 - RNA, 19 nt, Mycobacterium avium subsp. paratuberculosis
cgcagcucgcgcagcuggc

SEQ ID NO: 2828293 - RNA, 20 nt, Mycobacterium avium subsp. paratuberculosis
cgcagcucgcgcagcuggcc

SEQ ID NO: 2828294 - RNA, 18 nt, Mycobacterium avium subsp. paratuberculosis
cgcagcucggggucggcg

SEQ ID NO: 2828295 - RNA, 17 nt, Mycobacterium avium subsp. paratuberculosis
cgcagcucgucgugggu

SEQ ID NO: 2828296 - RNA, 18 nt, Mycobacterium avium subsp. paratuberculosis
cgcagcugaucggggccc

SEQ ID NO: 2828297 - RNA, 13 nt, Mycobacterium avium subsp. paratuberculosis
cgcagcugcgccg

SEQ ID NO: 2828298 - RNA, 14 nt, Mycobacterium avium subsp. paratuberculosis
cgcagcugcgccgc

SEQ ID NO: 2828299 - RNA, 19 nt, Mycobacterium avium subsp. paratuberculosis
cgcagcugcgccgcgucga

SEQ ID NO: 2828300 - RNA, 17 nt, Mycobacterium avium subsp. paratuberculosis
cgcagcugcugcggccg

SEQ ID NO: 2828301 - RNA, 18 nt, Mycobacterium avium subsp. paratuberculosis
cgcagcugcugcggccgg

SEQ ID NO: 2828302 - RNA, 19 nt, Mycobacterium avium subsp. paratuberculosis
cgcagcugcugcggccgga

SEQ ID NO: 2828303 - RNA, 20 nt, Mycobacterium avium subsp. paratuberculosis
cgcagcugcugcggccggac

SEQ ID NO: 2828304 - RNA, 15 nt, Mycobacterium avium subsp. paratuberculosis
cgcagcuggccaagu

SEQ ID NO: 2828305 - RNA, 15 nt, Mycobacterium avium subsp. paratuberculosis
cgcagcuggccgugc

SEQ ID NO: 2828306 - RNA, 16 nt, Mycobacterium avium subsp. paratuberculosis
cgcagcugggagaugu

SEQ ID NO: 2828307 - RNA, 16 nt, Mycobacterium avium subsp. paratuberculosis
cgcagcuucugcagcu

SEQ ID NO: 2828308 - RNA, 18 nt, Mycobacterium avium subsp. paratuberculosis
cgcagcuucugcagcucg

SEQ ID NO: 2828309 - RNA, 21 nt, Mycobacterium avium subsp. paratuberculosis
cgcagcuucugcagcucgcug

SEQ ID NO: 2828310 - RNA, 23 nt, Mycobacterium avium subsp. paratuberculosis
cgcaggaacuccagcagcuguug

SEQ ID NO: 2828311 - RNA, 15 nt, Mycobacterium avium subsp. paratuberculosis
cgcaggagaucggcg

SEQ ID NO: 2828312 - RNA, 15 nt, Mycobacterium avium subsp. paratuberculosis
cgcaggaucgagccg

SEQ ID NO: 2828313 - RNA, 16 nt, Mycobacterium avium subsp. paratuberculosis
cgcaggaucgagccgg

SEQ ID NO: 2828314 - RNA, 15 nt, Mycobacterium avium subsp. paratuberculosis
cgcaggaugcccagc

SEQ ID NO: 2828315 - RNA, 18 nt, Mycobacterium avium subsp. paratuberculosis
cgcaggaugcccagcacc

SEQ ID NO: 2828316 - RNA, 20 nt, Mycobacterium avium subsp. paratuberculosis
cgcaggaugcccagcaccac

SEQ ID NO: 2828317 - RNA, 13 nt, Mycobacterium avium subsp. paratuberculosis
cgcaggaugccga

SEQ ID NO: 2828318 - RNA, 20 nt, Mycobacterium avium subsp. paratuberculosis
cgcaggauggccugcacggu

SEQ ID NO: 2828319 - RNA, 14 nt, Mycobacterium avium subsp. paratuberculosis
cgcaggcacucgcg

SEQ ID NO: 2828320 - RNA, 18 nt, Mycobacterium avium subsp. paratuberculosis
cgcaggcacucgcgcagg

SEQ ID NO: 2828321 - RNA, 13 nt, Mycobacterium avium subsp. paratuberculosis
cgcaggcagcagc

SEQ ID NO: 2828322 - RNA, 14 nt, Mycobacterium avium subsp. paratuberculosis
cgcaggcagcagca

SEQ ID NO: 2828323 - RNA, 18 nt, Mycobacterium avium subsp. paratuberculosis
cgcaggcauuuccagguc

SEQ ID NO: 2828324 - RNA, 22 nt, Mycobacterium avium subsp. paratuberculosis
cgcaggcauuuccagguccggg

SEQ ID NO: 2828325 - RNA, 13 nt, Mycobacterium avium subsp. paratuberculosis
cgcaggccccgga

SEQ ID NO: 2828326 - RNA, 13 nt, Mycobacterium avium subsp. paratuberculosis
cgcaggccccggc

SEQ ID NO: 2828327 - RNA, 18 nt, Mycobacterium avium subsp. paratuberculosis
cgcaggccccggcgcgcg

SEQ ID NO: 2828328 - RNA, 19 nt, Mycobacterium avium subsp. paratuberculosis
cgcaggccccggcgcgcgu

SEQ ID NO: 2828329 - RNA, 16 nt, Mycobacterium avium subsp. paratuberculosis
cgcagguguccagccc

SEQ ID NO: 2828330 - RNA, 20 nt, Mycobacterium avium subsp. paratuberculosis
cgcagguguccagcccuacc

SEQ ID NO: 2828331 - RNA, 20 nt, Mycobacterium avium subsp. paratuberculosis
cgcagguuguccagccggug

SEQ ID NO: 2828332 - RNA, 15 nt, Mycobacterium avium subsp. paratuberculosis
cgcagguugucggcc

SEQ ID NO: 2828333 - RNA, 17 nt, Mycobacterium avium subsp. paratuberculosis
cgcagguugucggccaa

SEQ ID NO: 2828334 - RNA, 16 nt, Mycobacterium avium subsp. paratuberculosis
cgcagguuucucgacc

SEQ ID NO: 2828335 - RNA, 22 nt, Mycobacterium avium subsp. paratuberculosis
cgcagguuucucgaccaagaac

SEQ ID NO: 2828336 - RNA, 15 nt, Mycobacterium avium subsp. paratuberculosis
cgcaguagccgacgu

SEQ ID NO: 2828337 - RNA, 21 nt, Mycobacterium avium subsp. paratuberculosis
cgcaguccaaaaacugcgcgu

SEQ ID NO: 2828338 - RNA, 23 nt, Mycobacterium avium subsp. paratuberculosis
cgcaguccaaaaacugcgcgucg

SEQ ID NO: 2828339 - RNA, 14 nt, Mycobacterium avium subsp. paratuberculosis
cgcaguccagggug

SEQ ID NO: 2828340 - RNA, 19 nt, Mycobacterium avium subsp. paratuberculosis
cgcaguccagggugguggu

SEQ ID NO: 2828341 - RNA, 13 nt, Mycobacterium avium subsp. paratuberculosis
cgcagucgaucac

SEQ ID NO: 2828342 - RNA, 14 nt, Mycobacterium avium subsp. paratuberculosis
cgcagucgaucagc

SEQ ID NO: 2828343 - RNA, 18 nt, Mycobacterium avium subsp. paratuberculosis
cgcagucgaucagcgacg

SEQ ID NO: 2828344 - RNA, 16 nt, Mycobacterium avium subsp. paratuberculosis
cgcagucgcuggucga

SEQ ID NO: 2828345 - RNA, 14 nt, Mycobacterium avium subsp. paratuberculosis
cgcagucggcgucg

SEQ ID NO: 2828346 - RNA, 15 nt, Mycobacterium avium subsp. paratuberculosis
cgcagucggcgucgc

SEQ ID NO: 2828347 - RNA, 19 nt, Mycobacterium avium subsp. paratuberculosis
cgcagucggcgucgcggcg

SEQ ID NO: 2828348 - RNA, 20 nt, Mycobacterium avium subsp. paratuberculosis
cgcagucggcgucgcggcgc

SEQ ID NO: 2828349 - RNA, 14 nt, Mycobacterium avium subsp. paratuberculosis
cgcagucguucggc

SEQ ID NO: 2828350 - RNA, 19 nt, Mycobacterium avium subsp. paratuberculosis
cgcagucguucggccagca

SEQ ID NO: 2828351 - RNA, 20 nt, Mycobacterium avium subsp. paratuberculosis
cgcagucguucggccagcac

SEQ ID NO: 2828352 - RNA, 13 nt, Mycobacterium avium subsp. paratuberculosis
cgcagucuuguug

SEQ ID NO: 2828353 - RNA, 12 nt, Mycobacterium avium subsp. paratuberculosis
cgcagugcccgc

SEQ ID NO: 2828354 - RNA, 17 nt, Mycobacterium avium subsp. paratuberculosis
cgcagugcccgcccagc

SEQ ID NO: 2828355 - RNA, 17 nt, Mycobacterium avium subsp. paratuberculosis
cgcagugccgcaccagc

SEQ ID NO: 2828356 - RNA, 16 nt, Mycobacterium avium subsp. paratuberculosis
cgcagugccggcgcac

SEQ ID NO: 2828357 - RNA, 18 nt, Mycobacterium avium subsp. paratuberculosis
cgcagugccggcgcaccg

SEQ ID NO: 2828358 - RNA, 20 nt, Mycobacterium avium subsp. paratuberculosis
cgcagugccggcgcaccgcg

SEQ ID NO: 2828359 - RNA, 18 nt, Mycobacterium avium subsp. paratuberculosis
cgcagugcgucagaaccg

SEQ ID NO: 2828360 - RNA, 17 nt, Mycobacterium avium subsp. paratuberculosis
cgcaguucgaccggcac

SEQ ID NO: 2828361 - RNA, 21 nt, Mycobacterium avium subsp. paratuberculosis
cgcaguucgaccggcaccagc

SEQ ID NO: 2828362 - RNA, 17 nt, Mycobacterium avium subsp. paratuberculosis
cgcaguucggccgccgu

SEQ ID NO: 2828363 - RNA, 22 nt, Mycobacterium avium subsp. paratuberculosis
cgcaguucgggaucgucgccgg

SEQ ID NO: 2828364 - RNA, 16 nt, Mycobacterium avium subsp. paratuberculosis
cgcaguugcgcggcgg

SEQ ID NO: 2828365 - RNA, 13 nt, Mycobacterium avium subsp. paratuberculosis
cgcauacaccuug

SEQ ID NO: 2828366 - RNA, 22 nt, Mycobacterium avium subsp. paratuberculosis
cgcauacaccuugucggcgagc

SEQ ID NO: 2828367 - RNA, 12 nt, Mycobacterium avium subsp. paratuberculosis
cgcauaccagcg

SEQ ID NO: 2828368 - RNA, 16 nt, Mycobacterium avium subsp. paratuberculosis
cgcauaccagcgcugg

SEQ ID NO: 2828369 - RNA, 23 nt, Mycobacterium avium subsp. paratuberculosis
cgcauagaugcuuuggcuaaaca

SEQ ID NO: 2828370 - RNA, 19 nt, Mycobacterium avium subsp. paratuberculosis
cgcauagcgggagccggcc

SEQ ID NO: 2828371 - RNA, 20 nt, Mycobacterium avium subsp. paratuberculosis
cgcauagcgguccauccagc

SEQ ID NO: 2828372 - RNA, 13 nt, Mycobacterium avium subsp. paratuberculosis
cgcauaggccgcg

SEQ ID NO: 2828373 - RNA, 17 nt, Mycobacterium avium subsp. paratuberculosis
cgcauaggccgcgagga

SEQ ID NO: 2828374 - RNA, 21 nt, Mycobacterium avium subsp. paratuberculosis
cgcauaucccauguagagcgg

SEQ ID NO: 2828375 - RNA, 17 nt, Mycobacterium avium subsp. paratuberculosis
cgcaucaacugcaccag

SEQ ID NO: 2828376 - RNA, 19 nt, Mycobacterium avium subsp. paratuberculosis
cgcaucaacugcaccagcg

SEQ ID NO: 2828377 - RNA, 15 nt, Mycobacterium avium subsp. paratuberculosis
cgcaucacccggcgc

SEQ ID NO: 2828378 - RNA, 21 nt, Mycobacterium avium subsp. paratuberculosis
cgcaucaccuucugcgcgccg

SEQ ID NO: 2828379 - RNA, 20 nt, Mycobacterium avium subsp. paratuberculosis
cgcaucaccuucugcgucgg

SEQ ID NO: 2828380 - RNA, 22 nt, Mycobacterium avium subsp. paratuberculosis
cgcaucaccuucugcgucggcu

SEQ ID NO: 2828381 - RNA, 18 nt, Mycobacterium avium subsp. paratuberculosis
cgcaucagcgccaccagc

SEQ ID NO: 2828382 - RNA, 21 nt, Mycobacterium avium subsp. paratuberculosis
cgcaucagcgccaccagcacc

SEQ ID NO: 2828383 - RNA, 13 nt, Mycobacterium avium subsp. paratuberculosis
cgcaucagcgggg

SEQ ID NO: 2828384 - RNA, 15 nt, Mycobacterium avium subsp. paratuberculosis
cgcaucagcucggca

SEQ ID NO: 2828385 - RNA, 19 nt, Mycobacterium avium subsp. paratuberculosis
cgcaucagcucggcagccc

SEQ ID NO: 2828386 - RNA, 13 nt, Mycobacterium avium subsp. paratuberculosis
cgcaucagcucuu

SEQ ID NO: 2828387 - RNA, 17 nt, Mycobacterium avium subsp. paratuberculosis
cgcaucagcucuucgac

SEQ ID NO: 2828388 - RNA, 17 nt, Mycobacterium avium subsp. paratuberculosis
cgcaucagggccagccg

SEQ ID NO: 2828389 - RNA, 18 nt, Mycobacterium avium subsp. paratuberculosis
cgcaucagggccagccga

SEQ ID NO: 2828390 - RNA, 20 nt, Mycobacterium avium subsp. paratuberculosis
cgcaucagggccagccgaug

SEQ ID NO: 2828391 - RNA, 12 nt, Mycobacterium avium subsp. paratuberculosis
cgcaucaucgcc

SEQ ID NO: 2828392 - RNA, 15 nt, Mycobacterium avium subsp. paratuberculosis
cgcaucaucgcccag

SEQ ID NO: 2828393 - RNA, 15 nt, Mycobacterium avium subsp. paratuberculosis
cgcaucaucucggcg

SEQ ID NO: 2828394 - RNA, 13 nt, Mycobacterium avium subsp. paratuberculosis
cgcauccagcgcc

SEQ ID NO: 2828395 - RNA, 14 nt, Mycobacterium avium subsp. paratuberculosis
cgcauccagcgccg

SEQ ID NO: 2828396 - RNA, 19 nt, Mycobacterium avium subsp. paratuberculosis
cgcauccagcgccgccaac

SEQ ID NO: 2828397 - RNA, 23 nt, Mycobacterium avium subsp. paratuberculosis
cgcaucccgucgaccaggacguc

SEQ ID NO: 2828398 - RNA, 12 nt, Mycobacterium avium subsp. paratuberculosis
cgcauccgcacc

SEQ ID NO: 2828399 - RNA, 16 nt, Mycobacterium avium subsp. paratuberculosis
cgcauccgccgggcgg

SEQ ID NO: 2828400 - RNA, 19 nt, Mycobacterium avium subsp. paratuberculosis
cgcauccgccgggcggcgu

SEQ ID NO: 2828401 - RNA, 16 nt, Mycobacterium avium subsp. paratuberculosis
cgcauccgcgagccga

SEQ ID NO: 2828402 - RNA, 20 nt, Mycobacterium avium subsp. paratuberculosis
cgcauccucauagccggccg

SEQ ID NO: 2828403 - RNA, 22 nt, Mycobacterium avium subsp. paratuberculosis
cgcauccucauagccggccgcg

SEQ ID NO: 2828404 - RNA, 15 nt, Mycobacterium avium subsp. paratuberculosis
cgcaucgaaccgccg

SEQ ID NO: 2828405 - RNA, 18 nt, Mycobacterium avium subsp. paratuberculosis
cgcaucgacugcgacacc

SEQ ID NO: 2828406 - RNA, 20 nt, Mycobacterium avium subsp. paratuberculosis
cgcaucgacugcgacacccg

SEQ ID NO: 2828407 - RNA, 23 nt, Mycobacterium avium subsp. paratuberculosis
cgcaucgagcugcaacgcgucgg

SEQ ID NO: 2828408 - RNA, 15 nt, Mycobacterium avium subsp. paratuberculosis
cgcaucgccgaaccg

SEQ ID NO: 2828409 - RNA, 18 nt, Mycobacterium avium subsp. paratuberculosis
cgcaucgccgaaccgggc

SEQ ID NO: 2828410 - RNA, 19 nt, Mycobacterium avium subsp. paratuberculosis
cgcaucgccgaaccgggcg

SEQ ID NO: 2828411 - RNA, 12 nt, Mycobacterium avium subsp. paratuberculosis
cgcaucgccgag

SEQ ID NO: 2828412 - RNA, 18 nt, Mycobacterium avium subsp. paratuberculosis
cgcaucgccgagagcguc

SEQ ID NO: 2828413 - RNA, 14 nt, Mycobacterium avium subsp. paratuberculosis
cgcaucgccgaggg

SEQ ID NO: 2828414 - RNA, 22 nt, Mycobacterium avium subsp. paratuberculosis
cgccaagugcgguguggccgcg

SEQ ID NO: 2828415 - RNA, 23 nt, Mycobacterium avium subsp. paratuberculosis
cgccaagugcgguguggccgcgg

SEQ ID NO: 2828416 - RNA, 23 nt, Mycobacterium avium subsp. paratuberculosis
cgccaauaaagcgggcccgccuu

SEQ ID NO: 2828417 - RNA, 17 nt, Mycobacterium avium subsp. paratuberculosis
cgccaaucaccgcggug

SEQ ID NO: 2828418 - RNA, 15 nt, Mycobacterium avium subsp. paratuberculosis
cgccaauccggcggg

SEQ ID NO: 2828419 - RNA, 18 nt, Mycobacterium avium subsp. paratuberculosis
cgccaauccggcgggccu

SEQ ID NO: 2828420 - RNA, 19 nt, Mycobacterium avium subsp. paratuberculosis
cgccaaugguuuucgucga

SEQ ID NO: 2828421 - RNA, 22 nt, Mycobacterium avium subsp. paratuberculosis
cgccaaugguuuucgucgauca

SEQ ID NO: 2828422 - RNA, 20 nt, Mycobacterium avium subsp. paratuberculosis
cgccacaaacagcgcggccg

SEQ ID NO: 2828423 - RNA, 15 nt, Mycobacterium avium subsp. paratuberculosis
cgccacaacuggccg

SEQ ID NO: 2828424 - RNA, 16 nt, Mycobacterium avium subsp. paratuberculosis
cgccacaacuggccgg

SEQ ID NO: 2828425 - RNA, 17 nt, Mycobacterium avium subsp. paratuberculosis
cgccacaauggauccga

SEQ ID NO: 2828426 - RNA, 22 nt, Mycobacterium avium subsp. paratuberculosis
cgccacaccgaagaaccccgag

SEQ ID NO: 2828427 - RNA, 16 nt, Mycobacterium avium subsp. paratuberculosis
cgccacaccucggcga

SEQ ID NO: 2828428 - RNA, 18 nt, Mycobacterium avium subsp. paratuberculosis
cgccacaccucggcgacc

SEQ ID NO: 2828429 - RNA, 21 nt, Mycobacterium avium subsp. paratuberculosis
cgccacaccucggcgaccucg

SEQ ID NO: 2828430 - RNA, 11 nt, Mycobacterium avium subsp. paratuberculosis
cgccacagcag

SEQ ID NO: 2828431 - RNA, 14 nt, Mycobacterium avium subsp. paratuberculosis
cgccacagcagcac

SEQ ID NO: 2828432 - RNA, 16 nt, Mycobacterium avium subsp. paratuberculosis
cgccacagcagcacca

SEQ ID NO: 2828433 - RNA, 19 nt, Mycobacterium avium subsp. paratuberculosis
cgccacagcagcaccagcg

SEQ ID NO: 2828434 - RNA, 21 nt, Mycobacterium avium subsp. paratuberculosis
cgccacagcagcaccagcgcg

SEQ ID NO: 2828435 - RNA, 13 nt, Mycobacterium avium subsp. paratuberculosis
cgccacagccggg

SEQ ID NO: 2828436 - RNA, 15 nt, Mycobacterium avium subsp. paratuberculosis
cgccacagccgggga

SEQ ID NO: 2828437 - RNA, 14 nt, Mycobacterium avium subsp. paratuberculosis
cgccacagcgccuc

SEQ ID NO: 2828438 - RNA, 16 nt, Mycobacterium avium subsp. paratuberculosis
cgccacagcgccucgc

SEQ ID NO: 2828439 - RNA, 17 nt, Mycobacterium avium subsp. paratuberculosis
cgccacagcgccucgcg

SEQ ID NO: 2828440 - RNA, 21 nt, Mycobacterium avium subsp. paratuberculosis
cgccacagcgccucgcggucg

SEQ ID NO: 2828441 - RNA, 20 nt, Mycobacterium avium subsp. paratuberculosis
cgccacagcgucucgaccgc

SEQ ID NO: 2828442 - RNA, 17 nt, Mycobacterium avium subsp. paratuberculosis
cgccacaucagcucggc

SEQ ID NO: 2828443 - RNA, 18 nt, Mycobacterium avium subsp. paratuberculosis
cgccacaucagcucggcg

SEQ ID NO: 2828444 - RNA, 19 nt, Mycobacterium avium subsp. paratuberculosis
cgccacaucagcucggcgg

SEQ ID NO: 2828445 - RNA, 20 nt, Mycobacterium avium subsp. paratuberculosis
cgccacaucagcucggcggc

SEQ ID NO: 2828446 - RNA, 14 nt, Mycobacterium avium subsp. paratuberculosis
cgccacaucgggau

SEQ ID NO: 2828447 - RNA, 21 nt, Mycobacterium avium subsp. paratuberculosis
cgccaccaccacggggcgggu

SEQ ID NO: 2828448 - RNA, 22 nt, Mycobacterium avium subsp. paratuberculosis
cgccaccaccacggggcggguc

SEQ ID NO: 2828449 - RNA, 12 nt, Mycobacterium avium subsp. paratuberculosis
cgccaccaccag

SEQ ID NO: 2828450 - RNA, 13 nt, Mycobacterium avium subsp. paratuberculosis
cgccaccaccagc

SEQ ID NO: 2828451 - RNA, 16 nt, Mycobacterium avium subsp. paratuberculosis
cgccaccaccagcggg

SEQ ID NO: 2828452 - RNA, 19 nt, Mycobacterium avium subsp. paratuberculosis
cgccaccaccagcgggcug

SEQ ID NO: 2828453 - RNA, 15 nt, Mycobacterium avium subsp. paratuberculosis
cgccaccacccggcg

SEQ ID NO: 2828454 - RNA, 18 nt, Mycobacterium avium subsp. paratuberculosis
cgccaccacccggcgauu

SEQ ID NO: 2828455 - RNA, 15 nt, Mycobacterium avium subsp. paratuberculosis
cgccaccaccgcgcc

SEQ ID NO: 2828456 - RNA, 16 nt, Mycobacterium avium subsp. paratuberculosis
cgccaccaccgcgccg

SEQ ID NO: 2828457 - RNA, 19 nt, Mycobacterium avium subsp. paratuberculosis
cgccaccaccgcgccgucg

SEQ ID NO: 2828458 - RNA, 20 nt, Mycobacterium avium subsp. paratuberculosis
cgccaccaccgcgccgucgu

SEQ ID NO: 2828459 - RNA, 16 nt, Mycobacterium avium subsp. paratuberculosis
cgccaccaccuccucg

SEQ ID NO: 2828460 - RNA, 19 nt, Mycobacterium avium subsp. paratuberculosis
cgccaccaccuucaucgcc

SEQ ID NO: 2828461 - RNA, 15 nt, Mycobacterium avium subsp. paratuberculosis
cgccaccacggcgcc

SEQ ID NO: 2828462 - RNA, 19 nt, Mycobacterium avium subsp. paratuberculosis
cgccaccacggcgcccucg

SEQ ID NO: 2828463 - RNA, 14 nt, Mycobacterium avium subsp. paratuberculosis
cgccaccacggcgu

SEQ ID NO: 2828464 - RNA, 16 nt, Mycobacterium avium subsp. paratuberculosis
cgccaccacggcgucg

SEQ ID NO: 2828465 - RNA, 13 nt, Mycobacterium avium subsp. paratuberculosis
cgccaccagaccg

SEQ ID NO: 2828466 - RNA, 17 nt, Mycobacterium avium subsp. paratuberculosis
cgccaccagaccggcga

SEQ ID NO: 2828467 - RNA, 22 nt, Mycobacterium avium subsp. paratuberculosis
cgccaccagaucguguccgcgc

SEQ ID NO: 2828468 - RNA, 11 nt, Mycobacterium avium subsp. paratuberculosis
cgccaccagca

SEQ ID NO: 2828469 - RNA, 14 nt, Mycobacterium avium subsp. paratuberculosis
cgccaccagcaccg

SEQ ID NO: 2828470 - RNA, 17 nt, Mycobacterium avium subsp. paratuberculosis
cgccaccagcaccggga

SEQ ID NO: 2828471 - RNA, 16 nt, Mycobacterium avium subsp. paratuberculosis
cgccaccagcaggccc

SEQ ID NO: 2828472 - RNA, 19 nt, Mycobacterium avium subsp. paratuberculosis
cgccaccagcaggcccaac

SEQ ID NO: 2828473 - RNA, 23 nt, Mycobacterium avium subsp. paratuberculosis
cgccaccagcaggcccaacguga

SEQ ID NO: 2828474 - RNA, 14 nt, Mycobacterium avium subsp. paratuberculosis
cgccaccagccaca

SEQ ID NO: 2828475 - RNA, 22 nt, Mycobacterium avium subsp. paratuberculosis
cgccaccagccacaccgccgcg

SEQ ID NO: 2828476 - RNA, 13 nt, Mycobacterium avium subsp. paratuberculosis
cgccaccagcgca

SEQ ID NO: 2828477 - RNA, 15 nt, Mycobacterium avium subsp. paratuberculosis
cgccaccagcuccuc

SEQ ID NO: 2828478 - RNA, 13 nt, Mycobacterium avium subsp. paratuberculosis
cgccaccaggcgg

SEQ ID NO: 2828479 - RNA, 13 nt, Mycobacterium avium subsp. paratuberculosis
cgccaccaggcug

SEQ ID NO: 2828480 - RNA, 15 nt, Mycobacterium avium subsp. paratuberculosis
cgccaccccaggcga

SEQ ID NO: 2828481 - RNA, 21 nt, Mycobacterium avium subsp. paratuberculosis
cgccaccccgaacccggccag

SEQ ID NO: 2828482 - RNA, 15 nt, Mycobacterium avium subsp. paratuberculosis
cgccaccccgagcuc

SEQ ID NO: 2828483 - RNA, 19 nt, Mycobacterium avium subsp. paratuberculosis
cgccaccccgagcucgggc

SEQ ID NO: 2828484 - RNA, 20 nt, Mycobacterium avium subsp. paratuberculosis
cgccaccccgagcucgggcg

SEQ ID NO: 2828485 - RNA, 21 nt, Mycobacterium avium subsp. paratuberculosis
cgccaccccgagcucgggcgc

SEQ ID NO: 2828486 - RNA, 13 nt, Mycobacterium avium subsp. paratuberculosis
cgccaccccgcgc

SEQ ID NO: 2828487 - RNA, 16 nt, Mycobacterium avium subsp. paratuberculosis
cgccaccccgcgccac

SEQ ID NO: 2828488 - RNA, 17 nt, Mycobacterium avium subsp. paratuberculosis
cgccaccccgcgccacg

SEQ ID NO: 2828489 - RNA, 13 nt, Mycobacterium avium subsp. paratuberculosis
cgccacccgaggc

SEQ ID NO: 2828490 - RNA, 16 nt, Mycobacterium avium subsp. paratuberculosis
cgccacccgcaccucg

SEQ ID NO: 2828491 - RNA, 12 nt, Mycobacterium avium subsp. paratuberculosis
cgccacccgcau

SEQ ID NO: 2828492 - RNA, 13 nt, Mycobacterium avium subsp. paratuberculosis
cgccacccgcugc

SEQ ID NO: 2828493 - RNA, 18 nt, Mycobacterium avium subsp. paratuberculosis
cgccacccugcgcaccgc

SEQ ID NO: 2828494 - RNA, 19 nt, Mycobacterium avium subsp. paratuberculosis
cgccacccugcgcaccgcg

SEQ ID NO: 2828495 - RNA, 22 nt, Mycobacterium avium subsp. paratuberculosis
cgccacccugcgcaccgcggau

SEQ ID NO: 2828496 - RNA, 22 nt, Mycobacterium avium subsp. paratuberculosis
cgccaccgacaccaccggccgc

SEQ ID NO: 2828497 - RNA, 16 nt, Mycobacterium avium subsp. paratuberculosis
cgccaccgaggccagc

SEQ ID NO: 2828498 - RNA, 14 nt, Mycobacterium avium subsp. paratuberculosis
cgccaccgagucgc

SEQ ID NO: 2828499 - RNA, 17 nt, Mycobacterium avium subsp. paratuberculosis
cgccacggccagcaccg

SEQ ID NO: 2828500 - RNA, 21 nt, Mycobacterium avium subsp. paratuberculosis
cgccacggccagcaccgccag

SEQ ID NO: 2828501 - RNA, 15 nt, Mycobacterium avium subsp. paratuberculosis
cgccacggccggcag

SEQ ID NO: 2828502 - RNA, 16 nt, Mycobacterium avium subsp. paratuberculosis
cgccacggccggcagc

SEQ ID NO: 2828503 - RNA, 17 nt, Mycobacterium avium subsp. paratuberculosis
cgccacggccggcagca

SEQ ID NO: 2828504 - RNA, 20 nt, Mycobacterium avium subsp. paratuberculosis
cgccacggccggcagcaucg

SEQ ID NO: 2828505 - RNA, 13 nt, Mycobacterium avium subsp. paratuberculosis
cgccacggcgaac

SEQ ID NO: 2828506 - RNA, 16 nt, Mycobacterium avium subsp. paratuberculosis
cgccacggcgaacacc

SEQ ID NO: 2828507 - RNA, 21 nt, Mycobacterium avium subsp. paratuberculosis
cgccacggcgaacaccucggg

SEQ ID NO: 2828508 - RNA, 14 nt, Mycobacterium avium subsp. paratuberculosis
cgccacggcgacga

SEQ ID NO: 2828509 - RNA, 17 nt, Mycobacterium avium subsp. paratuberculosis
cgccacggcgacgacca

SEQ ID NO: 2828510 - RNA, 23 nt, Mycobacterium avium subsp. paratuberculosis
cgccacggcgacgaccaccagga

SEQ ID NO: 2828511 - RNA, 13 nt, Mycobacterium avium subsp. paratuberculosis
cgccacggcgcca

SEQ ID NO: 2828512 - RNA, 15 nt, Mycobacterium avium subsp. paratuberculosis
cgccacggcgccaug

SEQ ID NO: 2828513 - RNA, 20 nt, Mycobacterium avium subsp. paratuberculosis
cgccacggcgccaugcgccg

SEQ ID NO: 2828514 - RNA, 14 nt, Mycobacterium avium subsp. paratuberculosis
cgccacggcggccg

SEQ ID NO: 2828515 - RNA, 16 nt, Mycobacterium avium subsp. paratuberculosis
cgccacggcggccgaa

SEQ ID NO: 2828516 - RNA, 13 nt, Mycobacterium avium subsp. paratuberculosis
cgccacggcggug

SEQ ID NO: 2828517 - RNA, 16 nt, Mycobacterium avium subsp. paratuberculosis
cgccacggcggugucg

SEQ ID NO: 2828518 - RNA, 18 nt, Mycobacterium avium subsp. paratuberculosis
cgccacggcggugucggc

SEQ ID NO: 2828519 - RNA, 19 nt, Mycobacterium avium subsp. paratuberculosis
cgccacggcggugucggcg

SEQ ID NO: 2828520 - RNA, 18 nt, Mycobacterium avium subsp. paratuberculosis
cgccacggggcccgcgac

SEQ ID NO: 2828521 - RNA, 14 nt, Mycobacterium avium subsp. paratuberculosis
cgccacggggcgcc

SEQ ID NO: 2828522 - RNA, 18 nt, Mycobacterium avium subsp. paratuberculosis
cgccacggggcgccgcug

SEQ ID NO: 2828523 - RNA, 19 nt, Mycobacterium avium subsp. paratuberculosis
cgccacggggcgccgcugc

SEQ ID NO: 2828524 - RNA, 20 nt, Mycobacterium avium subsp. paratuberculosis
cgccacggggcugcgggcca

SEQ ID NO: 2828525 - RNA, 22 nt, Mycobacterium avium subsp. paratuberculosis
cgccacggguugagccagacgg

SEQ ID NO: 2828526 - RNA, 15 nt, Mycobacterium avium subsp. paratuberculosis
cgccacgguggcggu

SEQ ID NO: 2828527 - RNA, 18 nt, Mycobacterium avium subsp. paratuberculosis
cgccacgguggcggucag

SEQ ID NO: 2828528 - RNA, 16 nt, Mycobacterium avium subsp. paratuberculosis
cgccacguagcagcag

SEQ ID NO: 2828529 - RNA, 23 nt, Mycobacterium avium subsp. paratuberculosis
cgccacguagcagcagaccgcga

SEQ ID NO: 2828530 - RNA, 18 nt, Mycobacterium avium subsp. paratuberculosis
cgccacguaucgcgccug

SEQ ID NO: 2828531 - RNA, 23 nt, Mycobacterium avium subsp. paratuberculosis
cgccacguaucgcgccugcaccg

SEQ ID NO: 2828532 - RNA, 16 nt, Mycobacterium avium subsp. paratuberculosis
cgccacguccggaugc

SEQ ID NO: 2828533 - RNA, 20 nt, Mycobacterium avium subsp. paratuberculosis
cgccacguccggaugcggcg

SEQ ID NO: 2828534 - RNA, 21 nt, Mycobacterium avium subsp. paratuberculosis
cgccacgucgaacccgacccc

SEQ ID NO: 2828535 - RNA, 23 nt, Mycobacterium avium subsp. paratuberculosis
cgccacgucguucaugaucggca

SEQ ID NO: 2828536 - RNA, 17 nt, Mycobacterium avium subsp. paratuberculosis
cgccacucauguucagg

SEQ ID NO: 2828537 - RNA, 13 nt, Mycobacterium avium subsp. paratuberculosis
cgccacucgggcg

SEQ ID NO: 2828538 - RNA, 15 nt, Mycobacterium avium subsp. paratuberculosis
cgccacucgggcggc

SEQ ID NO: 2828539 - RNA, 17 nt, Mycobacterium avium subsp. paratuberculosis
cgccacucgggcggccg

SEQ ID NO: 2828540 - RNA, 19 nt, Mycobacterium avium subsp. paratuberculosis
cgccacucgggcggccgcg

SEQ ID NO: 2828541 - RNA, 20 nt, Mycobacterium avium subsp. paratuberculosis
cgccacucgggcggccgcgg

SEQ ID NO: 2828542 - RNA, 21 nt, Mycobacterium avium subsp. paratuberculosis
cgccacucgggcggccgcgga

SEQ ID NO: 2828543 - RNA, 22 nt, Mycobacterium avium subsp. paratuberculosis
cgccacucgggcggccgcggau

SEQ ID NO: 2828544 - RNA, 14 nt, Mycobacterium avium subsp. paratuberculosis
cgccacucgucgac

SEQ ID NO: 2828545 - RNA, 15 nt, Mycobacterium avium subsp. paratuberculosis
cgccacucgucgacg

SEQ ID NO: 2828546 - RNA, 18 nt, Mycobacterium avium subsp. paratuberculosis
cgccacucgucgacguuc

SEQ ID NO: 2828547 - RNA, 13 nt, Mycobacterium avium subsp. paratuberculosis
cgccacugccgcc

SEQ ID NO: 2828548 - RNA, 14 nt, Mycobacterium avium subsp. paratuberculosis
cgccacugccgccg

SEQ ID NO: 2828549 - RNA, 15 nt, Mycobacterium avium subsp. paratuberculosis
cgccacugccgccgc

SEQ ID NO: 2828550 - RNA, 17 nt, Mycobacterium avium subsp. paratuberculosis
cgccacugccgccgccc

SEQ ID NO: 2828551 - RNA, 14 nt, Mycobacterium avium subsp. paratuberculosis
cgccacuggcuggu

SEQ ID NO: 2828552 - RNA, 15 nt, Mycobacterium avium subsp. paratuberculosis
cgccacuggcugguc

SEQ ID NO: 2828553 - RNA, 12 nt, Mycobacterium avium subsp. paratuberculosis
cgccacugggcg

SEQ ID NO: 2828554 - RNA, 14 nt, Mycobacterium avium subsp. paratuberculosis
cgccacugggcguc

SEQ ID NO: 2828555 - RNA, 15 nt, Mycobacterium avium subsp. paratuberculosis
cgccacugggcgucg

SEQ ID NO: 2828556 - RNA, 16 nt, Mycobacterium avium subsp. paratuberculosis
cgccacugggcgucgg

SEQ ID NO: 2828557 - RNA, 18 nt, Mycobacterium avium subsp. paratuberculosis
cgccacugggcgucggcg

SEQ ID NO: 2828558 - RNA, 20 nt, Mycobacterium avium subsp. paratuberculosis
cgccacugggcgucggcgcc

SEQ ID NO: 2828559 - RNA, 19 nt, Mycobacterium avium subsp. paratuberculosis
cgccacuucuccacgccga

SEQ ID NO: 2828560 - RNA, 21 nt, Mycobacterium avium subsp. paratuberculosis
cgccacuucuccacgccgacg

SEQ ID NO: 2828561 - RNA, 24 nt, Mycobacterium avium subsp. paratuberculosis
cgccacuucuccacgccgacgaac

SEQ ID NO: 2828562 - RNA, 13 nt, Mycobacterium avium subsp. paratuberculosis
cgccagaaccggc

SEQ ID NO: 2828563 - RNA, 12 nt, Mycobacterium avium subsp. paratuberculosis
cgccagaacggg

SEQ ID NO: 2828564 - RNA, 22 nt, Mycobacterium avium subsp. paratuberculosis
cgccagaacggguucggucucg

SEQ ID NO: 2828565 - RNA, 14 nt, Mycobacterium avium subsp. paratuberculosis
cgccagacguccag

SEQ ID NO: 2828566 - RNA, 17 nt, Mycobacterium avium subsp. paratuberculosis
cgccagacguccagcgc

SEQ ID NO: 2828567 - RNA, 16 nt, Mycobacterium avium subsp. paratuberculosis
cgccagacucacggcg

SEQ ID NO: 2828568 - RNA, 17 nt, Mycobacterium avium subsp. paratuberculosis
cgccagacucacggcgg

SEQ ID NO: 2828569 - RNA, 19 nt, Mycobacterium avium subsp. paratuberculosis
cgccagacucacggcggca

SEQ ID NO: 2828570 - RNA, 18 nt, Mycobacterium avium subsp. paratuberculosis
cgccagagcgcgaaaacc

SEQ ID NO: 2828571 - RNA, 19 nt, Mycobacterium avium subsp. paratuberculosis
cgccagauagggcagcguc

SEQ ID NO: 2828572 - RNA, 14 nt, Mycobacterium avium subsp. paratuberculosis
cgccagaucagcgu

SEQ ID NO: 2828573 - RNA, 17 nt, Mycobacterium avium subsp. paratuberculosis
cgccagaucagcguggu

SEQ ID NO: 2828574 - RNA, 21 nt, Mycobacterium avium subsp. paratuberculosis
cgccagaucagcguggucagc

SEQ ID NO: 2828575 - RNA, 23 nt, Mycobacterium avium subsp. paratuberculosis
cgccagaucagcguggucagcgu

SEQ ID NO: 2828576 - RNA, 22 nt, Mycobacterium avium subsp. paratuberculosis
cgccagaucgccaucagggucu

SEQ ID NO: 2828577 - RNA, 15 nt, Mycobacterium avium subsp. paratuberculosis
cgccagaucgccugg

SEQ ID NO: 2828578 - RNA, 19 nt, Mycobacterium avium subsp. paratuberculosis
cgccagaucgcugaugcgc

SEQ ID NO: 2828579 - RNA, 15 nt, Mycobacterium avium subsp. paratuberculosis
cgccagaugcgccgc

SEQ ID NO: 2828580 - RNA, 20 nt, Mycobacterium avium subsp. paratuberculosis
cgccagaugcgccgcggaug

SEQ ID NO: 2828581 - RNA, 13 nt, Mycobacterium avium subsp. paratuberculosis
cgccagcaacacc

SEQ ID NO: 2828582 - RNA, 14 nt, Mycobacterium avium subsp. paratuberculosis
cgccagcaacaccc

SEQ ID NO: 2828583 - RNA, 22 nt, Mycobacterium avium subsp. paratuberculosis
cgccagcaacacccagccgcug

SEQ ID NO: 2828584 - RNA, 23 nt, Mycobacterium avium subsp. paratuberculosis
cgccagcccgccgaaccagaucg

SEQ ID NO: 2828585 - RNA, 13 nt, Mycobacterium avium subsp. paratuberculosis
cgccagcccggcg

SEQ ID NO: 2828586 - RNA, 14 nt, Mycobacterium avium subsp. paratuberculosis
cgccagcccggcgu

SEQ ID NO: 2828587 - RNA, 15 nt, Mycobacterium avium subsp. paratuberculosis
cgccagcccggcgua

SEQ ID NO: 2828588 - RNA, 16 nt, Mycobacterium avium subsp. paratuberculosis
cgccagcccggcguac

SEQ ID NO: 2828589 - RNA, 14 nt, Mycobacterium avium subsp. paratuberculosis
cgccagcccgguga

SEQ ID NO: 2828590 - RNA, 23 nt, Mycobacterium avium subsp. paratuberculosis
cgccagcccggugaucgccgccc

SEQ ID NO: 2828591 - RNA, 18 nt, Mycobacterium avium subsp. paratuberculosis
cgccagccgcaccgcgac

SEQ ID NO: 2828592 - RNA, 15 nt, Mycobacterium avium subsp. paratuberculosis
cgccagccgcagcag

SEQ ID NO: 2828593 - RNA, 15 nt, Mycobacterium avium subsp. paratuberculosis
cgccagccgccgccg

SEQ ID NO: 2828594 - RNA, 16 nt, Mycobacterium avium subsp. paratuberculosis
cgccagccgccgccga

SEQ ID NO: 2828595 - RNA, 17 nt, Mycobacterium avium subsp. paratuberculosis
cgccagccgccgccgac

SEQ ID NO: 2828596 - RNA, 19 nt, Mycobacterium avium subsp. paratuberculosis
cgccagccgccgccgacca

SEQ ID NO: 2828597 - RNA, 22 nt, Mycobacterium avium subsp. paratuberculosis
cgccagccgccgccgaccacau

SEQ ID NO: 2828598 - RNA, 14 nt, Mycobacterium avium subsp. paratuberculosis
cgccagccgccggc

SEQ ID NO: 2828599 - RNA, 22 nt, Mycobacterium avium subsp. paratuberculosis
cgccagccgccggcucagcggc

SEQ ID NO: 2828600 - RNA, 23 nt, Mycobacterium avium subsp. paratuberculosis
cgccagccgccggcucagcggca

SEQ ID NO: 2828601 - RNA, 12 nt, Mycobacterium avium subsp. paratuberculosis
cgccagccgggu

SEQ ID NO: 2828602 - RNA, 13 nt, Mycobacterium avium subsp. paratuberculosis
cgccagccgggug

SEQ ID NO: 2828603 - RNA, 23 nt, Mycobacterium avium subsp. paratuberculosis
cgccagccggguggcccgcgcgc

SEQ ID NO: 2828604 - RNA, 21 nt, Mycobacterium avium subsp. paratuberculosis
cgccagccgguacggaucgcc

SEQ ID NO: 2828605 - RNA, 23 nt, Mycobacterium avium subsp. paratuberculosis
cgccagccgguacggaucgccgg

SEQ ID NO: 2828606 - RNA, 18 nt, Mycobacterium avium subsp. paratuberculosis
cgccagccggucaucgcg

SEQ ID NO: 2828607 - RNA, 15 nt, Mycobacterium avium subsp. paratuberculosis
cgccagccguccugg

SEQ ID NO: 2828608 - RNA, 16 nt, Mycobacterium avium subsp. paratuberculosis
cgccagccguccuggu

SEQ ID NO: 2828609 - RNA, 13 nt, Mycobacterium avium subsp. paratuberculosis
cgccagccgucgc

SEQ ID NO: 2828610 - RNA, 16 nt, Mycobacterium avium subsp. paratuberculosis
cgccagccgucgccgc

SEQ ID NO: 2828611 - RNA, 22 nt, Mycobacterium avium subsp. paratuberculosis
cgccagccgucgccgcgcccgc

SEQ ID NO: 2828612 - RNA, 13 nt, Mycobacterium avium subsp. paratuberculosis
cgccagcgaccgc

SEQ ID NO: 2828613 - RNA, 14 nt, Mycobacterium avium subsp. paratuberculosis
cgccagcgaccgca

SEQ ID NO: 2828614 - RNA, 23 nt, Mycobacterium avium subsp. paratuberculosis
cgccagcgaccgcaggucgaugg

SEQ ID NO: 2828615 - RNA, 18 nt, Mycobacterium avium subsp. paratuberculosis
cgccagcgacggccgggu

SEQ ID NO: 2828616 - RNA, 13 nt, Mycobacterium avium subsp. paratuberculosis
cgccagcgcaccg

SEQ ID NO: 2828617 - RNA, 15 nt, Mycobacterium avium subsp. paratuberculosis
cgccagcgcaccgag

SEQ ID NO: 2828618 - RNA, 19 nt, Mycobacterium avium subsp. paratuberculosis
cgccagcgcaccgagcccg

SEQ ID NO: 2828619 - RNA, 14 nt, Mycobacterium avium subsp. paratuberculosis
cgccagcgccaccc

SEQ ID NO: 2828620 - RNA, 19 nt, Mycobacterium avium subsp. paratuberculosis
cgccagcgccacgcucaug

SEQ ID NO: 2828621 - RNA, 20 nt, Mycobacterium avium subsp. paratuberculosis
cgccagcgccagcguggcca

SEQ ID NO: 2828622 - RNA, 15 nt, Mycobacterium avium subsp. paratuberculosis
cgccagcgcccccag

SEQ ID NO: 2828623 - RNA, 16 nt, Mycobacterium avium subsp. paratuberculosis
cgccagcgcccccagc

SEQ ID NO: 2828624 - RNA, 12 nt, Mycobacterium avium subsp. paratuberculosis
cgccagcgcccg

SEQ ID NO: 2828625 - RNA, 13 nt, Mycobacterium avium subsp. paratuberculosis
cgccagcgcccga

SEQ ID NO: 2828626 - RNA, 14 nt, Mycobacterium avium subsp. paratuberculosis
cgccagcgcccgau

SEQ ID NO: 2828627 - RNA, 18 nt, Mycobacterium avium subsp. paratuberculosis
cgccagcgcccgauucgc

SEQ ID NO: 2828628 - RNA, 22 nt, Mycobacterium avium subsp. paratuberculosis
cgccagcgcccgauucgcggcc

SEQ ID NO: 2828629 - RNA, 24 nt, Mycobacterium avium subsp. paratuberculosis
cgccagcgcccgauucgcggccac

SEQ ID NO: 2828630 - RNA, 13 nt, Mycobacterium avium subsp. paratuberculosis
cgccagcgcccgc

SEQ ID NO: 2828631 - RNA, 14 nt, Mycobacterium avium subsp. paratuberculosis
cgccagcgcccgcg

SEQ ID NO: 2828632 - RNA, 17 nt, Mycobacterium avium subsp. paratuberculosis
cgccagcgcccgcgcgu

SEQ ID NO: 2828633 - RNA, 19 nt, Mycobacterium avium subsp. paratuberculosis
cgccagcgcccgcgcgugg

SEQ ID NO: 2828634 - RNA, 14 nt, Mycobacterium avium subsp. paratuberculosis
cgccagcgccgcaa

SEQ ID NO: 2828635 - RNA, 22 nt, Mycobacterium avium subsp. paratuberculosis
cgccagcgccgcaacggcuccc

SEQ ID NO: 2828636 - RNA, 15 nt, Mycobacterium avium subsp. paratuberculosis
cgccagcgccggcag

SEQ ID NO: 2828637 - RNA, 16 nt, Mycobacterium avium subsp. paratuberculosis
cgccagcgccggcagc

SEQ ID NO: 2828638 - RNA, 13 nt, Mycobacterium avium subsp. paratuberculosis
cgccagcgccggg

SEQ ID NO: 2828639 - RNA, 14 nt, Mycobacterium avium subsp. paratuberculosis
cgccagcgccgggu

SEQ ID NO: 2828640 - RNA, 17 nt, Mycobacterium avium subsp. paratuberculosis
cgccagcgcgacccgcu

SEQ ID NO: 2828641 - RNA, 18 nt, Mycobacterium avium subsp. paratuberculosis
cgccagcgcgacccgcuc

SEQ ID NO: 2828642 - RNA, 17 nt, Mycobacterium avium subsp. paratuberculosis
cgccagcgcgcagaaca

SEQ ID NO: 2828643 - RNA, 14 nt, Mycobacterium avium subsp. paratuberculosis
cgccagcgcgcccg

SEQ ID NO: 2828644 - RNA, 15 nt, Mycobacterium avium subsp. paratuberculosis
cgccagcgcgcccgc

SEQ ID NO: 2828645 - RNA, 17 nt, Mycobacterium avium subsp. paratuberculosis
cgccagcgcgcccgcca

SEQ ID NO: 2828646 - RNA, 18 nt, Mycobacterium avium subsp. paratuberculosis
cgccagcgcgcccgccau

SEQ ID NO: 2828647 - RNA, 15 nt, Mycobacterium avium subsp. paratuberculosis
cgccagcgcgccgau

SEQ ID NO: 2828648 - RNA, 12 nt, Mycobacterium avium subsp. paratuberculosis
cgccagcgcggc

SEQ ID NO: 2828649 - RNA, 15 nt, Mycobacterium avium subsp. paratuberculosis
cgccagcgcggcgau

SEQ ID NO: 2828650 - RNA, 22 nt, Mycobacterium avium subsp. paratuberculosis
cgccagcgcggcgaucagcagc

SEQ ID NO: 2828651 - RNA, 15 nt, Mycobacterium avium subsp. paratuberculosis
cgccagcgcggcggc

SEQ ID NO: 2828652 - RNA, 16 nt, Mycobacterium avium subsp. paratuberculosis
cgccagcgcggcggcg

SEQ ID NO: 2828653 - RNA, 19 nt, Mycobacterium avium subsp. paratuberculosis
cgccagcgcggcggcgccg

SEQ ID NO: 2828654 - RNA, 21 nt, Mycobacterium avium subsp. paratuberculosis
cgccagcgcggcggcgccguc

SEQ ID NO: 2828655 - RNA, 23 nt, Mycobacterium avium subsp. paratuberculosis
cgccagcgcggcggcgccgucgc

SEQ ID NO: 2828656 - RNA, 14 nt, Mycobacterium avium subsp. paratuberculosis
cgccagcgcggggu

SEQ ID NO: 2828657 - RNA, 16 nt, Mycobacterium avium subsp. paratuberculosis
cgccagcgcggggucg

SEQ ID NO: 2828658 - RNA, 21 nt, Mycobacterium avium subsp. paratuberculosis
cgccagcgcggggucggccag

SEQ ID NO: 2828659 - RNA, 12 nt, Mycobacterium avium subsp. paratuberculosis
cgccagcgcggu

SEQ ID NO: 2828660 - RNA, 16 nt, Mycobacterium avium subsp. paratuberculosis
cgccagcgcggugccc

SEQ ID NO: 2828661 - RNA, 15 nt, Mycobacterium avium subsp. paratuberculosis
cgccagcgcgguguc

SEQ ID NO: 2828662 - RNA, 22 nt, Mycobacterium avium subsp. paratuberculosis
cgccagcgcggugucgacgucg

SEQ ID NO: 2828663 - RNA, 23 nt, Mycobacterium avium subsp. paratuberculosis
cgccagcgcggugucgacgucgg

SEQ ID NO: 2828664 - RNA, 20 nt, Mycobacterium avium subsp. paratuberculosis
cgccagcgcgugcggggugu

SEQ ID NO: 2828665 - RNA, 13 nt, Mycobacterium avium subsp. paratuberculosis
cgccagcggcagc

SEQ ID NO: 2828666 - RNA, 14 nt, Mycobacterium avium subsp. paratuberculosis
cgccagcggcagcg

SEQ ID NO: 2828667 - RNA, 17 nt, Mycobacterium avium subsp. paratuberculosis
cgccagcggcagcgcca

SEQ ID NO: 2828668 - RNA, 18 nt, Mycobacterium avium subsp. paratuberculosis
cgccagcggcagcgccag

SEQ ID NO: 2828669 - RNA, 23 nt, Mycobacterium avium subsp. paratuberculosis
cgccagggugccgcugcccgccg

SEQ ID NO: 2828670 - RNA, 14 nt, Mycobacterium avium subsp. paratuberculosis
cgccaggucggggc

SEQ ID NO: 2828671 - RNA, 15 nt, Mycobacterium avium subsp. paratuberculosis
cgccaggugggugaa

SEQ ID NO: 2828672 - RNA, 21 nt, Mycobacterium avium subsp. paratuberculosis
cgccaggugggugaacgccug

SEQ ID NO: 2828673 - RNA, 14 nt, Mycobacterium avium subsp. paratuberculosis
cgccagguuggcgg

SEQ ID NO: 2828674 - RNA, 16 nt, Mycobacterium avium subsp. paratuberculosis
cgccagguuggcggcg

SEQ ID NO: 2828675 - RNA, 17 nt, Mycobacterium avium subsp. paratuberculosis
cgccagguuggcggcgg

SEQ ID NO: 2828676 - RNA, 18 nt, Mycobacterium avium subsp. paratuberculosis
cgccagguuggcggcggc

SEQ ID NO: 2828677 - RNA, 23 nt, Mycobacterium avium subsp. paratuberculosis
cgccagguuggcggcggcccgcg

SEQ ID NO: 2828678 - RNA, 19 nt, Mycobacterium avium subsp. paratuberculosis
cgccaguaguggaucagcc

SEQ ID NO: 2828679 - RNA, 21 nt, Mycobacterium avium subsp. paratuberculosis
cgccagucauggcaguuguuc

SEQ ID NO: 2828680 - RNA, 14 nt, Mycobacterium avium subsp. paratuberculosis
cgccaguccggcgc

SEQ ID NO: 2828681 - RNA, 15 nt, Mycobacterium avium subsp. paratuberculosis
cgccaguccggcgcc

SEQ ID NO: 2828682 - RNA, 16 nt, Mycobacterium avium subsp. paratuberculosis
cgccaguccggcgccg

SEQ ID NO: 2828683 - RNA, 17 nt, Mycobacterium avium subsp. paratuberculosis
cgccaguccggcgccga

SEQ ID NO: 2828684 - RNA, 18 nt, Mycobacterium avium subsp. paratuberculosis
cgccaguccggcgccgac

SEQ ID NO: 2828685 - RNA, 19 nt, Mycobacterium avium subsp. paratuberculosis
cgccaguccggcgccgacc

SEQ ID NO: 2828686 - RNA, 20 nt, Mycobacterium avium subsp. paratuberculosis
cgccaguccggcgccgaccc

SEQ ID NO: 2828687 - RNA, 23 nt, Mycobacterium avium subsp. paratuberculosis
cgccaguccggcgccgacccccg

SEQ ID NO: 2828688 - RNA, 17 nt, Mycobacterium avium subsp. paratuberculosis
cgccagucgcggcgaac

SEQ ID NO: 2828689 - RNA, 21 nt, Mycobacterium avium subsp. paratuberculosis
cgccagucgcggcgaaccagc

SEQ ID NO: 2828690 - RNA, 17 nt, Mycobacterium avium subsp. paratuberculosis
cgccagucugagcccgg

SEQ ID NO: 2828691 - RNA, 19 nt, Mycobacterium avium subsp. paratuberculosis
cgccagucugagcccgggc

SEQ ID NO: 2828692 - RNA, 15 nt, Mycobacterium avium subsp. paratuberculosis
cgccagugccgcgcg

SEQ ID NO: 2828693 - RNA, 16 nt, Mycobacterium avium subsp. paratuberculosis
cgccagugccgcgcgg

SEQ ID NO: 2828694 - RNA, 17 nt, Mycobacterium avium subsp. paratuberculosis
cgccaguguggccgcgg

SEQ ID NO: 2828695 - RNA, 19 nt, Mycobacterium avium subsp. paratuberculosis
cgccaguguggccgcggcg

SEQ ID NO: 2828696 - RNA, 20 nt, Mycobacterium avium subsp. paratuberculosis
cgccaguguggccgcggcgg

SEQ ID NO: 2828697 - RNA, 21 nt, Mycobacterium avium subsp. paratuberculosis
cgccaguguggccgcggcggc

SEQ ID NO: 2828698 - RNA, 22 nt, Mycobacterium avium subsp. paratuberculosis
cgccaguguggccgcggcggcc

SEQ ID NO: 2828699 - RNA, 18 nt, Mycobacterium avium subsp. paratuberculosis
cgccaguucccggccagc

SEQ ID NO: 2828700 - RNA, 14 nt, Mycobacterium avium subsp. paratuberculosis
cgccaguucgucgg

SEQ ID NO: 2828701 - RNA, 16 nt, Mycobacterium avium subsp. paratuberculosis
cgccaguucgucggcc

SEQ ID NO: 2828702 - RNA, 18 nt, Mycobacterium avium subsp. paratuberculosis
cgccaguucgucggccgu

SEQ ID NO: 2828703 - RNA, 19 nt, Mycobacterium avium subsp. paratuberculosis
cgccaguucgucggccguc

SEQ ID NO: 2828704 - RNA, 21 nt, Mycobacterium avium subsp. paratuberculosis
cgccaguucgucggccgucgg

SEQ ID NO: 2828705 - RNA, 18 nt, Mycobacterium avium subsp. paratuberculosis
cgccaguugcucggguga

SEQ ID NO: 2828706 - RNA, 16 nt, Mycobacterium avium subsp. paratuberculosis
cgccaguuguuggccg

SEQ ID NO: 2828707 - RNA, 16 nt, Mycobacterium avium subsp. paratuberculosis
cgccaguuugccgucg

SEQ ID NO: 2828708 - RNA, 18 nt, Mycobacterium avium subsp. paratuberculosis
cgccaguuugccgucggg

SEQ ID NO: 2828709 - RNA, 23 nt, Mycobacterium avium subsp. paratuberculosis
cgccaucaaccgauuucggccag

SEQ ID NO: 2828710 - RNA, 15 nt, Mycobacterium avium subsp. paratuberculosis
cgccaucaccagcgc

SEQ ID NO: 2828711 - RNA, 16 nt, Mycobacterium avium subsp. paratuberculosis
cgccaucaccagcgcg

SEQ ID NO: 2828712 - RNA, 14 nt, Mycobacterium avium subsp. paratuberculosis
cgccaucagcacca

SEQ ID NO: 2828713 - RNA, 22 nt, Mycobacterium avium subsp. paratuberculosis
cgccaucagcagcgccucgccg

SEQ ID NO: 2828714 - RNA, 23 nt, Mycobacterium avium subsp. paratuberculosis
cgccaucagcagcgccucgccgg

SEQ ID NO: 2828715 - RNA, 20 nt, Mycobacterium avium subsp. paratuberculosis
cgccaucagggucuucucga

SEQ ID NO: 2828716 - RNA, 18 nt, Mycobacterium avium subsp. paratuberculosis
cgccauccccgcuucggc

SEQ ID NO: 2828717 - RNA, 13 nt, Mycobacterium avium subsp. paratuberculosis
cgccauccgcagc

SEQ ID NO: 2828718 - RNA, 14 nt, Mycobacterium avium subsp. paratuberculosis
cgccauccgcagcc

SEQ ID NO: 2828719 - RNA, 16 nt, Mycobacterium avium subsp. paratuberculosis
cgccauccgcagcccg

SEQ ID NO: 2828720 - RNA, 19 nt, Mycobacterium avium subsp. paratuberculosis
cgccauccgcagcccgucg

SEQ ID NO: 2828721 - RNA, 16 nt, Mycobacterium avium subsp. paratuberculosis
cgccauccgccacccg

SEQ ID NO: 2828722 - RNA, 19 nt, Mycobacterium avium subsp. paratuberculosis
cgccauccgccacccgcug

SEQ ID NO: 2828723 - RNA, 15 nt, Mycobacterium avium subsp. paratuberculosis
cgccauccgcgccga

SEQ ID NO: 2828724 - RNA, 20 nt, Mycobacterium avium subsp. paratuberculosis
cgccauccguucggcucugc

SEQ ID NO: 2828725 - RNA, 20 nt, Mycobacterium avium subsp. paratuberculosis
cgccauccugucauccgucg

SEQ ID NO: 2828726 - RNA, 22 nt, Mycobacterium avium subsp. paratuberculosis
cgccauccugucauccgucgcc

SEQ ID NO: 2828727 - RNA, 17 nt, Mycobacterium avium subsp. paratuberculosis
cgccaucgaucgggcgu

SEQ ID NO: 2828728 - RNA, 18 nt, Mycobacterium avium subsp. paratuberculosis
cgccaucgcaccgcgagc

SEQ ID NO: 2828729 - RNA, 20 nt, Mycobacterium avium subsp. paratuberculosis
cgccaucgcaccgcgagcag

SEQ ID NO: 2828730 - RNA, 16 nt, Mycobacterium avium subsp. paratuberculosis
cgccaucgcccggugc

SEQ ID NO: 2828731 - RNA, 22 nt, Mycobacterium avium subsp. paratuberculosis
cgccaucgcccggugcgccagc

SEQ ID NO: 2828732 - RNA, 16 nt, Mycobacterium avium subsp. paratuberculosis
cgccaucgccgccgcc

SEQ ID NO: 2828733 - RNA, 17 nt, Mycobacterium avium subsp. paratuberculosis
cgccaucgccgccgcca

SEQ ID NO: 2828734 - RNA, 13 nt, Mycobacterium avium subsp. paratuberculosis
cgccaucgccucg

SEQ ID NO: 2828735 - RNA, 15 nt, Mycobacterium avium subsp. paratuberculosis
cgccaucgccucggc

SEQ ID NO: 2828736 - RNA, 17 nt, Mycobacterium avium subsp. paratuberculosis
cgccaucgccucggcca

SEQ ID NO: 2828737 - RNA, 20 nt, Mycobacterium avium subsp. paratuberculosis
cgccaucgccucggccacca

SEQ ID NO: 2828738 - RNA, 14 nt, Mycobacterium avium subsp. paratuberculosis
cgccaucgccucgu

SEQ ID NO: 2828739 - RNA, 15 nt, Mycobacterium avium subsp. paratuberculosis
cgccaucgccucguc

SEQ ID NO: 2828740 - RNA, 15 nt, Mycobacterium avium subsp. paratuberculosis
cgccaucgcggcguu

SEQ ID NO: 2828741 - RNA, 16 nt, Mycobacterium avium subsp. paratuberculosis
cgccaucgcggcguug

SEQ ID NO: 2828742 - RNA, 12 nt, Mycobacterium avium subsp. paratuberculosis
cgccaucggcau

SEQ ID NO: 2828743 - RNA, 14 nt, Mycobacterium avium subsp. paratuberculosis
cgccaucggcaucg

SEQ ID NO: 2828744 - RNA, 22 nt, Mycobacterium avium subsp. paratuberculosis
cgccaucggcaucgcgcgcggc

SEQ ID NO: 2828745 - RNA, 17 nt, Mycobacterium avium subsp. paratuberculosis
cgccaucguggccgcgu

SEQ ID NO: 2828746 - RNA, 19 nt, Mycobacterium avium subsp. paratuberculosis
cgccaucuccuccgggcug

SEQ ID NO: 2828747 - RNA, 20 nt, Mycobacterium avium subsp. paratuberculosis
cgccaucuccuccgggcuga

SEQ ID NO: 2828748 - RNA, 22 nt, Mycobacterium avium subsp. paratuberculosis
cgccaucucgggagugcggccc

SEQ ID NO: 2828749 - RNA, 18 nt, Mycobacterium avium subsp. paratuberculosis
cgccaucuucacgugcgc

SEQ ID NO: 2828750 - RNA, 22 nt, Mycobacterium avium subsp. paratuberculosis
cgccaucuucacgugcgcggcg

SEQ ID NO: 2828751 - RNA, 15 nt, Mycobacterium avium subsp. paratuberculosis
cgccaugaacggcgg

SEQ ID NO: 2828752 - RNA, 23 nt, Mycobacterium avium subsp. paratuberculosis
cgccaugaacggcggggccucca

SEQ ID NO: 2828753 - RNA, 20 nt, Mycobacterium avium subsp. paratuberculosis
cgcccacguucagcgacuug

SEQ ID NO: 2828754 - RNA, 20 nt, Mycobacterium avium subsp. paratuberculosis
cgcccacugguaaccgcccg

SEQ ID NO: 2828755 - RNA, 18 nt, Mycobacterium avium subsp. paratuberculosis
cgcccagaacgacgcgcu

SEQ ID NO: 2828756 - RNA, 22 nt, Mycobacterium avium subsp. paratuberculosis
cgcccagaacgacgcgcucagc

SEQ ID NO: 2828757 - RNA, 20 nt, Mycobacterium avium subsp. paratuberculosis
cgcccagaacugggccgccg

SEQ ID NO: 2828758 - RNA, 16 nt, Mycobacterium avium subsp. paratuberculosis
cgcccagaagccccgg

SEQ ID NO: 2828759 - RNA, 16 nt, Mycobacterium avium subsp. paratuberculosis
cgcccagauagaucgc

SEQ ID NO: 2828760 - RNA, 22 nt, Mycobacterium avium subsp. paratuberculosis
cgcccagaucgacgccgaccgc

SEQ ID NO: 2828761 - RNA, 15 nt, Mycobacterium avium subsp. paratuberculosis
cgcccagaucgccga

SEQ ID NO: 2828762 - RNA, 17 nt, Mycobacterium avium subsp. paratuberculosis
cgcccagaucgccgacc

SEQ ID NO: 2828763 - RNA, 17 nt, Mycobacterium avium subsp. paratuberculosis
cgcccagaucggccagc

SEQ ID NO: 2828764 - RNA, 17 nt, Mycobacterium avium subsp. paratuberculosis
cgcccagaugccgccgc

SEQ ID NO: 2828765 - RNA, 22 nt, Mycobacterium avium subsp. paratuberculosis
cgcccagaugccgccgccagcg

SEQ ID NO: 2828766 - RNA, 16 nt, Mycobacterium avium subsp. paratuberculosis
cgcccagaugccggcg

SEQ ID NO: 2828767 - RNA, 12 nt, Mycobacterium avium subsp. paratuberculosis
cgcccagauguu

SEQ ID NO: 2828768 - RNA, 21 nt, Mycobacterium avium subsp. paratuberculosis
cgcccagcaaacccagcacca

SEQ ID NO: 2828769 - RNA, 14 nt, Mycobacterium avium subsp. paratuberculosis
cgcccagcacccgg

SEQ ID NO: 2828770 - RNA, 14 nt, Mycobacterium avium subsp. paratuberculosis
cgcccagcaccgag

SEQ ID NO: 2828771 - RNA, 13 nt, Mycobacterium avium subsp. paratuberculosis
cgcccagcaccgc

SEQ ID NO: 2828772 - RNA, 15 nt, Mycobacterium avium subsp. paratuberculosis
cgcccagcaccgcga

SEQ ID NO: 2828773 - RNA, 17 nt, Mycobacterium avium subsp. paratuberculosis
cgcccagcaccgcgacg

SEQ ID NO: 2828774 - RNA, 14 nt, Mycobacterium avium subsp. paratuberculosis
cgcccagcaccguc

SEQ ID NO: 2828775 - RNA, 11 nt, Mycobacterium avium subsp. paratuberculosis
cgcccagcagc

SEQ ID NO: 2828776 - RNA, 14 nt, Mycobacterium avium subsp. paratuberculosis
cgcccagcagcccg

SEQ ID NO: 2828777 - RNA, 16 nt, Mycobacterium avium subsp. paratuberculosis
cgcccagcagcccggc

SEQ ID NO: 2828778 - RNA, 23 nt, Mycobacterium avium subsp. paratuberculosis
cgcccagcagccgcgccgacgcc

SEQ ID NO: 2828779 - RNA, 17 nt, Mycobacterium avium subsp. paratuberculosis
cgcccagcagcgggccc

SEQ ID NO: 2828780 - RNA, 20 nt, Mycobacterium avium subsp. paratuberculosis
cgcccagcagcgggcccggg

SEQ ID NO: 2828781 - RNA, 21 nt, Mycobacterium avium subsp. paratuberculosis
cgcccagcagcgggcccgggc

SEQ ID NO: 2828782 - RNA, 14 nt, Mycobacterium avium subsp. paratuberculosis
cgcccagcaucgcc

SEQ ID NO: 2828783 - RNA, 18 nt, Mycobacterium avium subsp. paratuberculosis
cgcccagcaucgccgcga

SEQ ID NO: 2828784 - RNA, 20 nt, Mycobacterium avium subsp. paratuberculosis
cgcccagcaucgccgcgacc

SEQ ID NO: 2828785 - RNA, 21 nt, Mycobacterium avium subsp. paratuberculosis
cgcccagcaucgccgcgaccc

SEQ ID NO: 2828786 - RNA, 19 nt, Mycobacterium avium subsp. paratuberculosis
cgcccagccccagcacgau

SEQ ID NO: 2828787 - RNA, 23 nt, Mycobacterium avium subsp. paratuberculosis
cgcccagccccagcacgaugacg

SEQ ID NO: 2828788 - RNA, 11 nt, Mycobacterium avium subsp. paratuberculosis
cgcccagcccg

SEQ ID NO: 2828789 - RNA, 13 nt, Mycobacterium avium subsp. paratuberculosis
cgcccagcccgag

SEQ ID NO: 2828790 - RNA, 21 nt, Mycobacterium avium subsp. paratuberculosis
cgcccagcccgagcaccagcg

SEQ ID NO: 2828791 - RNA, 13 nt, Mycobacterium avium subsp. paratuberculosis
cgcccagcccgcg

SEQ ID NO: 2828792 - RNA, 14 nt, Mycobacterium avium subsp. paratuberculosis
cgcccagcccgcgc

SEQ ID NO: 2828793 - RNA, 16 nt, Mycobacterium avium subsp. paratuberculosis
cgcccagcccgcgccg

SEQ ID NO: 2828794 - RNA, 18 nt, Mycobacterium avium subsp. paratuberculosis
cgcccagcccgcgccgag

SEQ ID NO: 2828795 - RNA, 18 nt, Mycobacterium avium subsp. paratuberculosis
cgcccagcccgcgggcgg

SEQ ID NO: 2828796 - RNA, 12 nt, Mycobacterium avium subsp. paratuberculosis
cgcccagccgag

SEQ ID NO: 2828797 - RNA, 19 nt, Mycobacterium avium subsp. paratuberculosis
cgcccagccgagccgggcc

SEQ ID NO: 2828798 - RNA, 21 nt, Mycobacterium avium subsp. paratuberculosis
cgcccagccgagccgggccag

SEQ ID NO: 2828799 - RNA, 15 nt, Mycobacterium avium subsp. paratuberculosis
cgcccagccggcgga

SEQ ID NO: 2828800 - RNA, 16 nt, Mycobacterium avium subsp. paratuberculosis
cgcccagcgacucggc

SEQ ID NO: 2828801 - RNA, 19 nt, Mycobacterium avium subsp. paratuberculosis
cgcccagcgagcugccggc

SEQ ID NO: 2828802 - RNA, 20 nt, Mycobacterium avium subsp. paratuberculosis
cgcccagcgagcugccggcg

SEQ ID NO: 2828803 - RNA, 21 nt, Mycobacterium avium subsp. paratuberculosis
cgcccagcgagcugccggcgg

SEQ ID NO: 2828804 - RNA, 23 nt, Mycobacterium avium subsp. paratuberculosis
cgcccagcgagcugccggcggcc

SEQ ID NO: 2828805 - RNA, 14 nt, Mycobacterium avium subsp. paratuberculosis
cgcccagcgagucg

SEQ ID NO: 2828806 - RNA, 15 nt, Mycobacterium avium subsp. paratuberculosis
cgcccagcgagucga

SEQ ID NO: 2828807 - RNA, 13 nt, Mycobacterium avium subsp. paratuberculosis
cgcccagcgcagc

SEQ ID NO: 2828808 - RNA, 17 nt, Mycobacterium avium subsp. paratuberculosis
cgcccagcgcagcaucg

SEQ ID NO: 2828809 - RNA, 16 nt, Mycobacterium avium subsp. paratuberculosis
cgcccagcgcagcgcc

SEQ ID NO: 2828810 - RNA, 17 nt, Mycobacterium avium subsp. paratuberculosis
cgcccagcgcagcgccu

SEQ ID NO: 2828811 - RNA, 18 nt, Mycobacterium avium subsp. paratuberculosis
cgcccagcgcagcgccuc

SEQ ID NO: 2828812 - RNA, 18 nt, Mycobacterium avium subsp. paratuberculosis
cgcccagcgcauccacca

SEQ ID NO: 2828813 - RNA, 12 nt, Mycobacterium avium subsp. paratuberculosis
cgcccagcgccg

SEQ ID NO: 2828814 - RNA, 13 nt, Mycobacterium avium subsp. paratuberculosis
cgcccagcgccgc

SEQ ID NO: 2828815 - RNA, 17 nt, Mycobacterium avium subsp. paratuberculosis
cgcccagcgccgcggcg

SEQ ID NO: 2828816 - RNA, 22 nt, Mycobacterium avium subsp. paratuberculosis
cgcccagcgccgcguaggucuu

SEQ ID NO: 2828817 - RNA, 14 nt, Mycobacterium avium subsp. paratuberculosis
cgcccagcgcgcga

SEQ ID NO: 2828818 - RNA, 20 nt, Mycobacterium avium subsp. paratuberculosis
cgcccagcgcgcgaucgccg

SEQ ID NO: 2828819 - RNA, 16 nt, Mycobacterium avium subsp. paratuberculosis
cgcccagcgcggcggc

SEQ ID NO: 2828820 - RNA, 18 nt, Mycobacterium avium subsp. paratuberculosis
cgcccagcgcggcggcca

SEQ ID NO: 2828821 - RNA, 19 nt, Mycobacterium avium subsp. paratuberculosis
cgcccagcgcggcggccac

SEQ ID NO: 2828822 - RNA, 20 nt, Mycobacterium avium subsp. paratuberculosis
cgcccagcggcacgaaguug

SEQ ID NO: 2828823 - RNA, 17 nt, Mycobacterium avium subsp. paratuberculosis
cgcccagcggccccggc

SEQ ID NO: 2828824 - RNA, 20 nt, Mycobacterium avium subsp. paratuberculosis
cgcccagcggccccggcucg

SEQ ID NO: 2828825 - RNA, 21 nt, Mycobacterium avium subsp. paratuberculosis
cgcccagcggccccggcucgg

SEQ ID NO: 2828826 - RNA, 18 nt, Mycobacterium avium subsp. paratuberculosis
cgcccagcggcuugagcc

SEQ ID NO: 2828827 - RNA, 19 nt, Mycobacterium avium subsp. paratuberculosis
cgcccagcgucucggcggc

SEQ ID NO: 2828828 - RNA, 13 nt, Mycobacterium avium subsp. paratuberculosis
cgcccagcguggu

SEQ ID NO: 2828829 - RNA, 23 nt, Mycobacterium avium subsp. paratuberculosis
cgcccagcguggucacccgcagc

SEQ ID NO: 2828830 - RNA, 17 nt, Mycobacterium avium subsp. paratuberculosis
cgcccagcgugucggcg

SEQ ID NO: 2828831 - RNA, 18 nt, Mycobacterium avium subsp. paratuberculosis
cgcccagcgugucggcga

SEQ ID NO: 2828832 - RNA, 20 nt, Mycobacterium avium subsp. paratuberculosis
cgcccagcgugucggcgauc

SEQ ID NO: 2828833 - RNA, 21 nt, Mycobacterium avium subsp. paratuberculosis
cgcccagcugcacccaccggc

SEQ ID NO: 2828834 - RNA, 23 nt, Mycobacterium avium subsp. paratuberculosis
cgcccagcugcacccaccggccc

SEQ ID NO: 2828835 - RNA, 13 nt, Mycobacterium avium subsp. paratuberculosis
cgcccagcugggc

SEQ ID NO: 2828836 - RNA, 15 nt, Mycobacterium avium subsp. paratuberculosis
cgcccagcugggcca

SEQ ID NO: 2828837 - RNA, 18 nt, Mycobacterium avium subsp. paratuberculosis
cgcccagcugggccagcg

SEQ ID NO: 2828838 - RNA, 23 nt, Mycobacterium avium subsp. paratuberculosis
cgccccgacgaucgcgccggccg

SEQ ID NO: 2828839 - RNA, 12 nt, Mycobacterium avium subsp. paratuberculosis
cgccccgacgug

SEQ ID NO: 2828840 - RNA, 15 nt, Mycobacterium avium subsp. paratuberculosis
cgccccgacgugcag

SEQ ID NO: 2828841 - RNA, 16 nt, Mycobacterium avium subsp. paratuberculosis
cgccccgacgugcagc

SEQ ID NO: 2828842 - RNA, 19 nt, Mycobacterium avium subsp. paratuberculosis
cgccccgacgugcagcgcc

SEQ ID NO: 2828843 - RNA, 19 nt, Mycobacterium avium subsp. paratuberculosis
cgccccgagaucccagcgg

SEQ ID NO: 2828844 - RNA, 20 nt, Mycobacterium avium subsp. paratuberculosis
cgccccgaguuccagcuccg

SEQ ID NO: 2828845 - RNA, 21 nt, Mycobacterium avium subsp. paratuberculosis
cgccccgaucggauccgccug

SEQ ID NO: 2828846 - RNA, 22 nt, Mycobacterium avium subsp. paratuberculosis
cgccccgaucggauccgccugc

SEQ ID NO: 2828847 - RNA, 22 nt, Mycobacterium avium subsp. paratuberculosis
cgccccgcaaccguucaacggc

SEQ ID NO: 2828848 - RNA, 23 nt, Mycobacterium avium subsp. paratuberculosis
cgccccgcaaccguucaacggcc

SEQ ID NO: 2828849 - RNA, 20 nt, Mycobacterium avium subsp. paratuberculosis
cgccccgcaccgagccuggg

SEQ ID NO: 2828850 - RNA, 12 nt, Mycobacterium avium subsp. paratuberculosis
cgccccgcccgc

SEQ ID NO: 2828851 - RNA, 13 nt, Mycobacterium avium subsp. paratuberculosis
cgccccgcccgcg

SEQ ID NO: 2828852 - RNA, 15 nt, Mycobacterium avium subsp. paratuberculosis
cgccccgcccgcgac

SEQ ID NO: 2828853 - RNA, 13 nt, Mycobacterium avium subsp. paratuberculosis
cgccccgcccggc

SEQ ID NO: 2828854 - RNA, 15 nt, Mycobacterium avium subsp. paratuberculosis
cgccccgcccggcgg

SEQ ID NO: 2828855 - RNA, 17 nt, Mycobacterium avium subsp. paratuberculosis
cgccccgcccggcggcc

SEQ ID NO: 2828856 - RNA, 14 nt, Mycobacterium avium subsp. paratuberculosis
cgccccgcccugcu

SEQ ID NO: 2828857 - RNA, 13 nt, Mycobacterium avium subsp. paratuberculosis
cgccccgccgcgc

SEQ ID NO: 2828858 - RNA, 14 nt, Mycobacterium avium subsp. paratuberculosis
cgccccgccgcggc

SEQ ID NO: 2828859 - RNA, 16 nt, Mycobacterium avium subsp. paratuberculosis
cgccccgccgcggcca

SEQ ID NO: 2828860 - RNA, 17 nt, Mycobacterium avium subsp. paratuberculosis
cgccccgccgcggccag

SEQ ID NO: 2828861 - RNA, 19 nt, Mycobacterium avium subsp. paratuberculosis
cgccccgccgggggagucg

SEQ ID NO: 2828862 - RNA, 13 nt, Mycobacterium avium subsp. paratuberculosis
cgccccgccggug

SEQ ID NO: 2828863 - RNA, 13 nt, Mycobacterium avium subsp. paratuberculosis
cgccccgcgccuc

SEQ ID NO: 2828864 - RNA, 15 nt, Mycobacterium avium subsp. paratuberculosis
cgccccgcgccucgu

SEQ ID NO: 2828865 - RNA, 22 nt, Mycobacterium avium subsp. paratuberculosis
cgccccgcgcgaucaggccggc

SEQ ID NO: 2828866 - RNA, 13 nt, Mycobacterium avium subsp. paratuberculosis
cgccccgcugccg

SEQ ID NO: 2828867 - RNA, 17 nt, Mycobacterium avium subsp. paratuberculosis
cgccccgcugccggacc

SEQ ID NO: 2828868 - RNA, 21 nt, Mycobacterium avium subsp. paratuberculosis
cgccccgcugccggaccucga

SEQ ID NO: 2828869 - RNA, 13 nt, Mycobacterium avium subsp. paratuberculosis
cgccccgcuggaa

SEQ ID NO: 2828870 - RNA, 13 nt, Mycobacterium avium subsp. paratuberculosis
cgccccggagaug

SEQ ID NO: 2828871 - RNA, 13 nt, Mycobacterium avium subsp. paratuberculosis
cgccccggaugac

SEQ ID NO: 2828872 - RNA, 13 nt, Mycobacterium avium subsp. paratuberculosis
cgccccggcccgg

SEQ ID NO: 2828873 - RNA, 15 nt, Mycobacterium avium subsp. paratuberculosis
cgccccggcccggcg

SEQ ID NO: 2828874 - RNA, 20 nt, Mycobacterium avium subsp. paratuberculosis
cgccccggcccggcgaauca

SEQ ID NO: 2828875 - RNA, 21 nt, Mycobacterium avium subsp. paratuberculosis
cgccccggcccguccagaucg

SEQ ID NO: 2828876 - RNA, 13 nt, Mycobacterium avium subsp. paratuberculosis
cgccccggccgcg

SEQ ID NO: 2828877 - RNA, 16 nt, Mycobacterium avium subsp. paratuberculosis
cgccccggccgcgcac

SEQ ID NO: 2828878 - RNA, 15 nt, Mycobacterium avium subsp. paratuberculosis
cgccccggccgcggu

SEQ ID NO: 2828879 - RNA, 23 nt, Mycobacterium avium subsp. paratuberculosis
cgccccggccgcggugaccgcgc

SEQ ID NO: 2828880 - RNA, 17 nt, Mycobacterium avium subsp. paratuberculosis
cgccccggcgacgucgc

SEQ ID NO: 2828881 - RNA, 20 nt, Mycobacterium avium subsp. paratuberculosis
cgccccggcgacgucgccgg

SEQ ID NO: 2828882 - RNA, 17 nt, Mycobacterium avium subsp. paratuberculosis
cgccccggcgcagcgcc

SEQ ID NO: 2828883 - RNA, 16 nt, Mycobacterium avium subsp. paratuberculosis
cgccccggcgccgucg

SEQ ID NO: 2828884 - RNA, 21 nt, Mycobacterium avium subsp. paratuberculosis
cgccccggcgcgccugcgcgg

SEQ ID NO: 2828885 - RNA, 14 nt, Mycobacterium avium subsp. paratuberculosis
cgccccggcggcca

SEQ ID NO: 2828886 - RNA, 16 nt, Mycobacterium avium subsp. paratuberculosis
cgccccggcggccacg

SEQ ID NO: 2828887 - RNA, 17 nt, Mycobacterium avium subsp. paratuberculosis
cgccccggcggccacgc

SEQ ID NO: 2828888 - RNA, 13 nt, Mycobacterium avium subsp. paratuberculosis
cgccccggcgggc

SEQ ID NO: 2828889 - RNA, 18 nt, Mycobacterium avium subsp. paratuberculosis
cgccccggcgggcggccg

SEQ ID NO: 2828890 - RNA, 12 nt, Mycobacterium avium subsp. paratuberculosis
cgccccggcguc

SEQ ID NO: 2828891 - RNA, 13 nt, Mycobacterium avium subsp. paratuberculosis
cgccccggcgucg

SEQ ID NO: 2828892 - RNA, 14 nt, Mycobacterium avium subsp. paratuberculosis
cgccccggcgucgg

SEQ ID NO: 2828893 - RNA, 12 nt, Mycobacterium avium subsp. paratuberculosis
cgccccgggcag

SEQ ID NO: 2828894 - RNA, 23 nt, Mycobacterium avium subsp. paratuberculosis
cgccccggucaccccggccauca

SEQ ID NO: 2828895 - RNA, 17 nt, Mycobacterium avium subsp. paratuberculosis
cgccccggucccgccgg

SEQ ID NO: 2828896 - RNA, 14 nt, Mycobacterium avium subsp. paratuberculosis
cgccccgguccggc

SEQ ID NO: 2828897 - RNA, 15 nt, Mycobacterium avium subsp. paratuberculosis
cgccccgguccggcu

SEQ ID NO: 2828898 - RNA, 12 nt, Mycobacterium avium subsp. paratuberculosis
cgccccggucgu

SEQ ID NO: 2828899 - RNA, 16 nt, Mycobacterium avium subsp. paratuberculosis
cgccccuccaggcaug

SEQ ID NO: 2828900 - RNA, 16 nt, Mycobacterium avium subsp. paratuberculosis
cgccccuggcgucggg

SEQ ID NO: 2828901 - RNA, 16 nt, Mycobacterium avium subsp. paratuberculosis
cgcccgaaccgcgucc

SEQ ID NO: 2828902 - RNA, 22 nt, Mycobacterium avium subsp. paratuberculosis
cgcccgacauccaggaccgcgc

SEQ ID NO: 2828903 - RNA, 15 nt, Mycobacterium avium subsp. paratuberculosis
cgcccgacccgucca

SEQ ID NO: 2828904 - RNA, 19 nt, Mycobacterium avium subsp. paratuberculosis
cgcccgacgaugcggggcg

SEQ ID NO: 2828905 - RNA, 13 nt, Mycobacterium avium subsp. paratuberculosis
cgcccgacgccgg

SEQ ID NO: 2828906 - RNA, 14 nt, Mycobacterium avium subsp. paratuberculosis
cgcccgacgccgga

SEQ ID NO: 2828907 - RNA, 16 nt, Mycobacterium avium subsp. paratuberculosis
cgcccgacgccggacc

SEQ ID NO: 2828908 - RNA, 13 nt, Mycobacterium avium subsp. paratuberculosis
cgcccgacggucg

SEQ ID NO: 2828909 - RNA, 19 nt, Mycobacterium avium subsp. paratuberculosis
cgcccgacggucgccacca

SEQ ID NO: 2828910 - RNA, 20 nt, Mycobacterium avium subsp. paratuberculosis
cgcccgagaguccgccgccg

SEQ ID NO: 2828911 - RNA, 22 nt, Mycobacterium avium subsp. paratuberculosis
cgcccgagaguccgccgccggg

SEQ ID NO: 2828912 - RNA, 23 nt, Mycobacterium avium subsp. paratuberculosis
cgcccgagaguccgccgccgggc

SEQ ID NO: 2828913 - RNA, 15 nt, Mycobacterium avium subsp. paratuberculosis
cgcccgagccgcaca

SEQ ID NO: 2828914 - RNA, 23 nt, Mycobacterium avium subsp. paratuberculosis
cgcccgagcgucauuccgccgcg

SEQ ID NO: 2828915 - RNA, 17 nt, Mycobacterium avium subsp. paratuberculosis
cgcccgagucacccggc

SEQ ID NO: 2828916 - RNA, 18 nt, Mycobacterium avium subsp. paratuberculosis
cgcccgagucacccggcu

SEQ ID NO: 2828917 - RNA, 20 nt, Mycobacterium avium subsp. paratuberculosis
cgcccgagucacccggcugg

SEQ ID NO: 2828918 - RNA, 21 nt, Mycobacterium avium subsp. paratuberculosis
cgcccgagucacccggcuggc

SEQ ID NO: 2828919 - RNA, 21 nt, Mycobacterium avium subsp. paratuberculosis
cgcccgaucaucucaccgacg

SEQ ID NO: 2828920 - RNA, 21 nt, Mycobacterium avium subsp. paratuberculosis
cgcccgaucccgggccguuca

SEQ ID NO: 2828921 - RNA, 18 nt, Mycobacterium avium subsp. paratuberculosis
cgcccgaucccgucgucg

SEQ ID NO: 2828922 - RNA, 18 nt, Mycobacterium avium subsp. paratuberculosis
cgcccgaucugggaucgg

SEQ ID NO: 2828923 - RNA, 20 nt, Mycobacterium avium subsp. paratuberculosis
cgcccgcugaccgccgcgcu

SEQ ID NO: 2828924 - RNA, 16 nt, Mycobacterium avium subsp. paratuberculosis
cgcccgcugcgcgggu

SEQ ID NO: 2828925 - RNA, 19 nt, Mycobacterium avium subsp. paratuberculosis
cgcccgcugcgcgggucgg

SEQ ID NO: 2828926 - RNA, 18 nt, Mycobacterium avium subsp. paratuberculosis
cgcccgcuggggcgcacc

SEQ ID NO: 2828927 - RNA, 20 nt, Mycobacterium avium subsp. paratuberculosis
cgcccgcuggggcgcaccgc

SEQ ID NO: 2828928 - RNA, 19 nt, Mycobacterium avium subsp. paratuberculosis
cgcccggaaagcgcgggca

SEQ ID NO: 2828929 - RNA, 20 nt, Mycobacterium avium subsp. paratuberculosis
cgcccggaaagcgcgggcag

SEQ ID NO: 2828930 - RNA, 18 nt, Mycobacterium avium subsp. paratuberculosis
cgcccggaccaggguggc

SEQ ID NO: 2828931 - RNA, 23 nt, Mycobacterium avium subsp. paratuberculosis
cgcccggaccaggguggccccag

SEQ ID NO: 2828932 - RNA, 13 nt, Mycobacterium avium subsp. paratuberculosis
cgcccggacccgc

SEQ ID NO: 2828933 - RNA, 14 nt, Mycobacterium avium subsp. paratuberculosis
cgcccggacccgcu

SEQ ID NO: 2828934 - RNA, 18 nt, Mycobacterium avium subsp. paratuberculosis
cgcccggacccgcucgcc

SEQ ID NO: 2828935 - RNA, 17 nt, Mycobacterium avium subsp. paratuberculosis
cgcccggaccgcggucg

SEQ ID NO: 2828936 - RNA, 18 nt, Mycobacterium avium subsp. paratuberculosis
cgcccggaccgcggucgg

SEQ ID NO: 2828937 - RNA, 23 nt, Mycobacterium avium subsp. paratuberculosis
cgcccggaccggcucguagcugg

SEQ ID NO: 2828938 - RNA, 16 nt, Mycobacterium avium subsp. paratuberculosis
cgcccggacgcgcaca

SEQ ID NO: 2828939 - RNA, 20 nt, Mycobacterium avium subsp. paratuberculosis
cgcccggacgcgcacacggc

SEQ ID NO: 2828940 - RNA, 14 nt, Mycobacterium avium subsp. paratuberculosis
cgcccggagaacuc

SEQ ID NO: 2828941 - RNA, 15 nt, Mycobacterium avium subsp. paratuberculosis
cgcccggagcugucg

SEQ ID NO: 2828942 - RNA, 18 nt, Mycobacterium avium subsp. paratuberculosis
cgcccggagcugucggug

SEQ ID NO: 2828943 - RNA, 22 nt, Mycobacterium avium subsp. paratuberculosis
cgcccggagcugucggugacga

SEQ ID NO: 2828944 - RNA, 22 nt, Mycobacterium avium subsp. paratuberculosis
cgcccggaggguauucgugugc

SEQ ID NO: 2828945 - RNA, 22 nt, Mycobacterium avium subsp. paratuberculosis
cgcccggaucagcugaccggcg

SEQ ID NO: 2828946 - RNA, 23 nt, Mycobacterium avium subsp. paratuberculosis
cgcccggaucagcugaccggcga

SEQ ID NO: 2828947 - RNA, 17 nt, Mycobacterium avium subsp. paratuberculosis
cgcccggaugccggcgc

SEQ ID NO: 2828948 - RNA, 18 nt, Mycobacterium avium subsp. paratuberculosis
cgcccggaugccggcgcc

SEQ ID NO: 2828949 - RNA, 22 nt, Mycobacterium avium subsp. paratuberculosis
cgcccggaugucgggcgaggug

SEQ ID NO: 2828950 - RNA, 14 nt, Mycobacterium avium subsp. paratuberculosis
cgcccggcaacacg

SEQ ID NO: 2828951 - RNA, 17 nt, Mycobacterium avium subsp. paratuberculosis
cgcccggcaccgcggcg

SEQ ID NO: 2828952 - RNA, 14 nt, Mycobacterium avium subsp. paratuberculosis
cgcccggcaccggg

SEQ ID NO: 2828953 - RNA, 15 nt, Mycobacterium avium subsp. paratuberculosis
cgcccggcaccggga

SEQ ID NO: 2828954 - RNA, 13 nt, Mycobacterium avium subsp. paratuberculosis
cgcccggcagccg

SEQ ID NO: 2828955 - RNA, 15 nt, Mycobacterium avium subsp. paratuberculosis
cgcccggcagccgcu

SEQ ID NO: 2828956 - RNA, 19 nt, Mycobacterium avium subsp. paratuberculosis
cgcccggccagccggccgc

SEQ ID NO: 2828957 - RNA, 20 nt, Mycobacterium avium subsp. paratuberculosis
cgcccggccagccggccgcu

SEQ ID NO: 2828958 - RNA, 19 nt, Mycobacterium avium subsp. paratuberculosis
cgcccggccagccgguaug

SEQ ID NO: 2828959 - RNA, 15 nt, Mycobacterium avium subsp. paratuberculosis
cgcccggccaucugc

SEQ ID NO: 2828960 - RNA, 23 nt, Mycobacterium avium subsp. paratuberculosis
cgcccggccaucugcgcgacgaa

SEQ ID NO: 2828961 - RNA, 21 nt, Mycobacterium avium subsp. paratuberculosis
cgcccggcccaagacccgcgu

SEQ ID NO: 2828962 - RNA, 13 nt, Mycobacterium avium subsp. paratuberculosis
cgcccggcccagc

SEQ ID NO: 2828963 - RNA, 14 nt, Mycobacterium avium subsp. paratuberculosis
cgcccggcccagcc

SEQ ID NO: 2828964 - RNA, 15 nt, Mycobacterium avium subsp. paratuberculosis
cgcccggcccagccg

SEQ ID NO: 2828965 - RNA, 16 nt, Mycobacterium avium subsp. paratuberculosis
cgcccggcccagccgc

SEQ ID NO: 2828966 - RNA, 17 nt, Mycobacterium avium subsp. paratuberculosis
cgcccggcccagccgcu

SEQ ID NO: 2828967 - RNA, 19 nt, Mycobacterium avium subsp. paratuberculosis
cgcccggcccagccgcugc

SEQ ID NO: 2828968 - RNA, 14 nt, Mycobacterium avium subsp. paratuberculosis
cgcccggcccgcau

SEQ ID NO: 2828969 - RNA, 15 nt, Mycobacterium avium subsp. paratuberculosis
cgcccggcccgcaug

SEQ ID NO: 2828970 - RNA, 15 nt, Mycobacterium avium subsp. paratuberculosis
cgcccggcccggcgc

SEQ ID NO: 2828971 - RNA, 17 nt, Mycobacterium avium subsp. paratuberculosis
cgcccggcccggcgcgg

SEQ ID NO: 2828972 - RNA, 22 nt, Mycobacterium avium subsp. paratuberculosis
cgcccggcccggcgcggccggu

SEQ ID NO: 2828973 - RNA, 14 nt, Mycobacterium avium subsp. paratuberculosis
cgcccggccggccc

SEQ ID NO: 2828974 - RNA, 21 nt, Mycobacterium avium subsp. paratuberculosis
cgcccggccggucgccgaugg

SEQ ID NO: 2828975 - RNA, 13 nt, Mycobacterium avium subsp. paratuberculosis
cgcccggcgacca

SEQ ID NO: 2828976 - RNA, 16 nt, Mycobacterium avium subsp. paratuberculosis
cgcccggcgaccacca

SEQ ID NO: 2828977 - RNA, 18 nt, Mycobacterium avium subsp. paratuberculosis
cgcccggcgaccaccagc

SEQ ID NO: 2828978 - RNA, 14 nt, Mycobacterium avium subsp. paratuberculosis
cgcccggcgacgcg

SEQ ID NO: 2828979 - RNA, 15 nt, Mycobacterium avium subsp. paratuberculosis
cgcccggcgacgcgg

SEQ ID NO: 2828980 - RNA, 16 nt, Mycobacterium avium subsp. paratuberculosis
cgcccggcgacgcggc

SEQ ID NO: 2828981 - RNA, 17 nt, Mycobacterium avium subsp. paratuberculosis
cgcccggcgacgcggcg

SEQ ID NO: 2828982 - RNA, 20 nt, Mycobacterium avium subsp. paratuberculosis
cgcccggcgacgcggcggga

SEQ ID NO: 2828983 - RNA, 15 nt, Mycobacterium avium subsp. paratuberculosis
cgcccggcgagcagc

SEQ ID NO: 2828984 - RNA, 18 nt, Mycobacterium avium subsp. paratuberculosis
cgcccggcgauacccggg

SEQ ID NO: 2828985 - RNA, 13 nt, Mycobacterium avium subsp. paratuberculosis
cgcccggcgcccg

SEQ ID NO: 2828986 - RNA, 15 nt, Mycobacterium avium subsp. paratuberculosis
cgcccggcgcccggc

SEQ ID NO: 2828987 - RNA, 18 nt, Mycobacterium avium subsp. paratuberculosis
cgcccggcgcccggccgg

SEQ ID NO: 2828988 - RNA, 20 nt, Mycobacterium avium subsp. paratuberculosis
cgcccggcgcccggccggcc

SEQ ID NO: 2828989 - RNA, 18 nt, Mycobacterium avium subsp. paratuberculosis
cgcccggcgcccggcgcg

SEQ ID NO: 2828990 - RNA, 13 nt, Mycobacterium avium subsp. paratuberculosis
cgcccggcgccga

SEQ ID NO: 2828991 - RNA, 16 nt, Mycobacterium avium subsp. paratuberculosis
cgcccggcgccgaucu

SEQ ID NO: 2828992 - RNA, 17 nt, Mycobacterium avium subsp. paratuberculosis
cgcccggcgccggcccg

SEQ ID NO: 2828993 - RNA, 19 nt, Mycobacterium avium subsp. paratuberculosis
cgcccggcgccggcccgcg

SEQ ID NO: 2828994 - RNA, 16 nt, Mycobacterium avium subsp. paratuberculosis
cgcccggcgccggccg

SEQ ID NO: 2828995 - RNA, 15 nt, Mycobacterium avium subsp. paratuberculosis
cgcccggcgccggcg

SEQ ID NO: 2828996 - RNA, 18 nt, Mycobacterium avium subsp. paratuberculosis
cgcccggcgcgcagccca

SEQ ID NO: 2828997 - RNA, 14 nt, Mycobacterium avium subsp. paratuberculosis
cgcccggcgcgcca

SEQ ID NO: 2828998 - RNA, 16 nt, Mycobacterium avium subsp. paratuberculosis
cgcccggcgcgccgca

SEQ ID NO: 2828999 - RNA, 12 nt, Mycobacterium avium subsp. paratuberculosis
cgcccggcgcgg

SEQ ID NO: 2829000 - RNA, 17 nt, Mycobacterium avium subsp. paratuberculosis
cgcccggcgcggcaucg

SEQ ID NO: 2829001 - RNA, 20 nt, Mycobacterium avium subsp. paratuberculosis
cgcccggcgcggcaucggcg

SEQ ID NO: 2829002 - RNA, 12 nt, Mycobacterium avium subsp. paratuberculosis
cgcccggcggca

SEQ ID NO: 2829003 - RNA, 16 nt, Mycobacterium avium subsp. paratuberculosis
cgcccggcggccacca

SEQ ID NO: 2829004 - RNA, 12 nt, Mycobacterium avium subsp. paratuberculosis
cgcccggcggcg

SEQ ID NO: 2829005 - RNA, 14 nt, Mycobacterium avium subsp. paratuberculosis
cgcccggcggcgcu

SEQ ID NO: 2829006 - RNA, 15 nt, Mycobacterium avium subsp. paratuberculosis
cgcccggcggcgcug

SEQ ID NO: 2829007 - RNA, 16 nt, Mycobacterium avium subsp. paratuberculosis
cgcccggcggcgcugc

SEQ ID NO: 2829008 - RNA, 21 nt, Mycobacterium avium subsp. paratuberculosis
cgcccucaggcguccagcacc

SEQ ID NO: 2829009 - RNA, 23 nt, Mycobacterium avium subsp. paratuberculosis
cgcccucaggcguccagcaccug

SEQ ID NO: 2829010 - RNA, 17 nt, Mycobacterium avium subsp. paratuberculosis
cgcccuccacgucgucg

SEQ ID NO: 2829011 - RNA, 18 nt, Mycobacterium avium subsp. paratuberculosis
cgcccuccacgucgucgg

SEQ ID NO: 2829012 - RNA, 12 nt, Mycobacterium avium subsp. paratuberculosis
cgcccuccccgg

SEQ ID NO: 2829013 - RNA, 13 nt, Mycobacterium avium subsp. paratuberculosis
cgcccuccccggc

SEQ ID NO: 2829014 - RNA, 15 nt, Mycobacterium avium subsp. paratuberculosis
cgcccuccccggcca

SEQ ID NO: 2829015 - RNA, 16 nt, Mycobacterium avium subsp. paratuberculosis
cgcccuccccggccag

SEQ ID NO: 2829016 - RNA, 17 nt, Mycobacterium avium subsp. paratuberculosis
cgcccuccccggccagc

SEQ ID NO: 2829017 - RNA, 19 nt, Mycobacterium avium subsp. paratuberculosis
cgcccuccccggccagcac

SEQ ID NO: 2829018 - RNA, 11 nt, Mycobacterium avium subsp. paratuberculosis
cgcccuccugg

SEQ ID NO: 2829019 - RNA, 12 nt, Mycobacterium avium subsp. paratuberculosis
cgcccuccuggc

SEQ ID NO: 2829020 - RNA, 23 nt, Mycobacterium avium subsp. paratuberculosis
cgcccuccuggcggguggcgaug

SEQ ID NO: 2829021 - RNA, 21 nt, Mycobacterium avium subsp. paratuberculosis
cgcccucgauaauggcggccg

SEQ ID NO: 2829022 - RNA, 22 nt, Mycobacterium avium subsp. paratuberculosis
cgcccucgauaauggcggccgc

SEQ ID NO: 2829023 - RNA, 17 nt, Mycobacterium avium subsp. paratuberculosis
cgcccucgaucgcgacc

SEQ ID NO: 2829024 - RNA, 18 nt, Mycobacterium avium subsp. paratuberculosis
cgcccucgaucgcgacca

SEQ ID NO: 2829025 - RNA, 20 nt, Mycobacterium avium subsp. paratuberculosis
cgcccucgaugcgcaccgug

SEQ ID NO: 2829026 - RNA, 15 nt, Mycobacterium avium subsp. paratuberculosis
cgcccucgccccgga

SEQ ID NO: 2829027 - RNA, 16 nt, Mycobacterium avium subsp. paratuberculosis
cgcccucgccccggau

SEQ ID NO: 2829028 - RNA, 16 nt, Mycobacterium avium subsp. paratuberculosis
cgcccucgccgaaccg

SEQ ID NO: 2829029 - RNA, 13 nt, Mycobacterium avium subsp. paratuberculosis
cgcccucgccggc

SEQ ID NO: 2829030 - RNA, 15 nt, Mycobacterium avium subsp. paratuberculosis
cgcccucgccggcgg

SEQ ID NO: 2829031 - RNA, 16 nt, Mycobacterium avium subsp. paratuberculosis
cgcccucgccggcggc

SEQ ID NO: 2829032 - RNA, 18 nt, Mycobacterium avium subsp. paratuberculosis
cgcccucgccggcggcgc

SEQ ID NO: 2829033 - RNA, 16 nt, Mycobacterium avium subsp. paratuberculosis
cgcccucgcgcagggc

SEQ ID NO: 2829034 - RNA, 17 nt, Mycobacterium avium subsp. paratuberculosis
cgcccucgcgcagggcc

SEQ ID NO: 2829035 - RNA, 18 nt, Mycobacterium avium subsp. paratuberculosis
cgcccucgcgcagggcca

SEQ ID NO: 2829036 - RNA, 14 nt, Mycobacterium avium subsp. paratuberculosis
cgcccucgcugccg

SEQ ID NO: 2829037 - RNA, 17 nt, Mycobacterium avium subsp. paratuberculosis
cgcccucggccguaccg

SEQ ID NO: 2829038 - RNA, 14 nt, Mycobacterium avium subsp. paratuberculosis
cgcccucggcgauc

SEQ ID NO: 2829039 - RNA, 15 nt, Mycobacterium avium subsp. paratuberculosis
cgcccucggcgaucu

SEQ ID NO: 2829040 - RNA, 18 nt, Mycobacterium avium subsp. paratuberculosis
cgcccucggcuuccgagc

SEQ ID NO: 2829041 - RNA, 21 nt, Mycobacterium avium subsp. paratuberculosis
cgcccucgggguacucggcgg

SEQ ID NO: 2829042 - RNA, 23 nt, Mycobacterium avium subsp. paratuberculosis
cgcccucgggguacucggcggcg

SEQ ID NO: 2829043 - RNA, 22 nt, Mycobacterium avium subsp. paratuberculosis
cgcccucgguguucgggucggu

SEQ ID NO: 2829044 - RNA, 19 nt, Mycobacterium avium subsp. paratuberculosis
cgcccucgucuuccgcggc

SEQ ID NO: 2829045 - RNA, 22 nt, Mycobacterium avium subsp. paratuberculosis
cgcccucgucuuccgcggcggc

SEQ ID NO: 2829046 - RNA, 20 nt, Mycobacterium avium subsp. paratuberculosis
cgcccugacacagcaccggc

SEQ ID NO: 2829047 - RNA, 23 nt, Mycobacterium avium subsp. paratuberculosis
cgcccugacacagcaccggcguc

SEQ ID NO: 2829048 - RNA, 16 nt, Mycobacterium avium subsp. paratuberculosis
cgcccugcagccgggu

SEQ ID NO: 2829049 - RNA, 17 nt, Mycobacterium avium subsp. paratuberculosis
cgcccugcagccgggug

SEQ ID NO: 2829050 - RNA, 15 nt, Mycobacterium avium subsp. paratuberculosis
cgcccugcagcgcga

SEQ ID NO: 2829051 - RNA, 17 nt, Mycobacterium avium subsp. paratuberculosis
cgcccugcagcgcgaac

SEQ ID NO: 2829052 - RNA, 14 nt, Mycobacterium avium subsp. paratuberculosis
cgcccugcugggag

SEQ ID NO: 2829053 - RNA, 15 nt, Mycobacterium avium subsp. paratuberculosis
cgcccugcugggagc

SEQ ID NO: 2829054 - RNA, 20 nt, Mycobacterium avium subsp. paratuberculosis
cgcccugcugggagcggccc

SEQ ID NO: 2829055 - RNA, 21 nt, Mycobacterium avium subsp. paratuberculosis
cgcccugcuugaacagcaccc

SEQ ID NO: 2829056 - RNA, 14 nt, Mycobacterium avium subsp. paratuberculosis
cgcccuggaaggcg

SEQ ID NO: 2829057 - RNA, 22 nt, Mycobacterium avium subsp. paratuberculosis
cgcccuggauauccagccuugc

SEQ ID NO: 2829058 - RNA, 14 nt, Mycobacterium avium subsp. paratuberculosis
cgcccuggaucgcg

SEQ ID NO: 2829059 - RNA, 15 nt, Mycobacterium avium subsp. paratuberculosis
cgcccuggcauccgu

SEQ ID NO: 2829060 - RNA, 21 nt, Mycobacterium avium subsp. paratuberculosis
cgcccuggcauccgucggccu

SEQ ID NO: 2829061 - RNA, 13 nt, Mycobacterium avium subsp. paratuberculosis
cgcccuggcccca

SEQ ID NO: 2829062 - RNA, 14 nt, Mycobacterium avium subsp. paratuberculosis
cgcccuggccgccg

SEQ ID NO: 2829063 - RNA, 15 nt, Mycobacterium avium subsp. paratuberculosis
cgcccuggccgcguu

SEQ ID NO: 2829064 - RNA, 20 nt, Mycobacterium avium subsp. paratuberculosis
cgcccuggcuguagcggucg

SEQ ID NO: 2829065 - RNA, 14 nt, Mycobacterium avium subsp. paratuberculosis
cgcccugggggucg

SEQ ID NO: 2829066 - RNA, 15 nt, Mycobacterium avium subsp. paratuberculosis
cgcccugggggucgg

SEQ ID NO: 2829067 - RNA, 18 nt, Mycobacterium avium subsp. paratuberculosis
cgcccugguaggccugga

SEQ ID NO: 2829068 - RNA, 12 nt, Mycobacterium avium subsp. paratuberculosis
cgcccuggugca

SEQ ID NO: 2829069 - RNA, 17 nt, Mycobacterium avium subsp. paratuberculosis
cgcccuggugcaacacc

SEQ ID NO: 2829070 - RNA, 18 nt, Mycobacterium avium subsp. paratuberculosis
cgcccuggugcaacaccg

SEQ ID NO: 2829071 - RNA, 19 nt, Mycobacterium avium subsp. paratuberculosis
cgcccuggugcaacaccga

SEQ ID NO: 2829072 - RNA, 13 nt, Mycobacterium avium subsp. paratuberculosis
cgcccuuccagca

SEQ ID NO: 2829073 - RNA, 16 nt, Mycobacterium avium subsp. paratuberculosis
cgcccuuccagcaccc

SEQ ID NO: 2829074 - RNA, 21 nt, Mycobacterium avium subsp. paratuberculosis
cgcccuuccagcaccccgucg

SEQ ID NO: 2829075 - RNA, 15 nt, Mycobacterium avium subsp. paratuberculosis
cgcccuucccggucg

SEQ ID NO: 2829076 - RNA, 15 nt, Mycobacterium avium subsp. paratuberculosis
cgcccuucggcgccc

SEQ ID NO: 2829077 - RNA, 17 nt, Mycobacterium avium subsp. paratuberculosis
cgcccuucggcgcccgc

SEQ ID NO: 2829078 - RNA, 23 nt, Mycobacterium avium subsp. paratuberculosis
cgcccuucggcgcccgcuccggc

SEQ ID NO: 2829079 - RNA, 15 nt, Mycobacterium avium subsp. paratuberculosis
cgcccuucuucgcgg

SEQ ID NO: 2829080 - RNA, 22 nt, Mycobacterium avium subsp. paratuberculosis
cgcccuucuucgcgggugccuu

SEQ ID NO: 2829081 - RNA, 23 nt, Mycobacterium avium subsp. paratuberculosis
cgcccuugaacggcaccagcgga

SEQ ID NO: 2829082 - RNA, 16 nt, Mycobacterium avium subsp. paratuberculosis
cgcccuugagcacggu

SEQ ID NO: 2829083 - RNA, 22 nt, Mycobacterium avium subsp. paratuberculosis
cgcccuugagcacggugaucag

SEQ ID NO: 2829084 - RNA, 22 nt, Mycobacterium avium subsp. paratuberculosis
cgcccuugagcuucccggcggu

SEQ ID NO: 2829085 - RNA, 14 nt, Mycobacterium avium subsp. paratuberculosis
cgcccuugaucguc

SEQ ID NO: 2829086 - RNA, 23 nt, Mycobacterium avium subsp. paratuberculosis
cgcccuugaucgucuugccgaag

SEQ ID NO: 2829087 - RNA, 15 nt, Mycobacterium avium subsp. paratuberculosis
cgcccuugccgaugc

SEQ ID NO: 2829088 - RNA, 16 nt, Mycobacterium avium subsp. paratuberculosis
cgcccuugcucgcggc

SEQ ID NO: 2829089 - RNA, 19 nt, Mycobacterium avium subsp. paratuberculosis
cgcccuugcucgcggcgua

SEQ ID NO: 2829090 - RNA, 21 nt, Mycobacterium avium subsp. paratuberculosis
cgcccuugcucgcggcguagg

SEQ ID NO: 2829091 - RNA, 23 nt, Mycobacterium avium subsp. paratuberculosis
cgcccuugcucgcggcguaggcg

SEQ ID NO: 2829092 - RNA, 12 nt, Mycobacterium avium subsp. paratuberculosis
cgcccuuguuga

SEQ ID NO: 2829093 - RNA, 22 nt, Mycobacterium avium subsp. paratuberculosis
cgccgacaccaccacgaacugg

SEQ ID NO: 2829094 - RNA, 23 nt, Mycobacterium avium subsp. paratuberculosis
cgccgacaccaccacgaacuggg

SEQ ID NO: 2829095 - RNA, 17 nt, Mycobacterium avium subsp. paratuberculosis
cgccgacaccaccgcgc

SEQ ID NO: 2829096 - RNA, 14 nt, Mycobacterium avium subsp. paratuberculosis
cgccgacaccagcg

SEQ ID NO: 2829097 - RNA, 15 nt, Mycobacterium avium subsp. paratuberculosis
cgccgacaccagcgc

SEQ ID NO: 2829098 - RNA, 16 nt, Mycobacterium avium subsp. paratuberculosis
cgccgacaccagcgcg

SEQ ID NO: 2829099 - RNA, 18 nt, Mycobacterium avium subsp. paratuberculosis
cgccgacaccagcgcgca

SEQ ID NO: 2829100 - RNA, 19 nt, Mycobacterium avium subsp. paratuberculosis
cgccgacaccagcgcgcac

SEQ ID NO: 2829101 - RNA, 22 nt, Mycobacterium avium subsp. paratuberculosis
cgccgacaccagcgcgcacgcg

SEQ ID NO: 2829102 - RNA, 15 nt, Mycobacterium avium subsp. paratuberculosis
cgccgacaccgcauu

SEQ ID NO: 2829103 - RNA, 14 nt, Mycobacterium avium subsp. paratuberculosis
cgccgacaccgucg

SEQ ID NO: 2829104 - RNA, 13 nt, Mycobacterium avium subsp. paratuberculosis
cgccgacagcagc

SEQ ID NO: 2829105 - RNA, 15 nt, Mycobacterium avium subsp. paratuberculosis
cgccgacagcagcuc

SEQ ID NO: 2829106 - RNA, 17 nt, Mycobacterium avium subsp. paratuberculosis
cgccgacagcgacaauc

SEQ ID NO: 2829107 - RNA, 18 nt, Mycobacterium avium subsp. paratuberculosis
cgccgacagcgucgucca

SEQ ID NO: 2829108 - RNA, 19 nt, Mycobacterium avium subsp. paratuberculosis
cgccgacagcugagcagcc

SEQ ID NO: 2829109 - RNA, 15 nt, Mycobacterium avium subsp. paratuberculosis
cgccgacaucgcccg

SEQ ID NO: 2829110 - RNA, 16 nt, Mycobacterium avium subsp. paratuberculosis
cgccgacaucgcccgg

SEQ ID NO: 2829111 - RNA, 13 nt, Mycobacterium avium subsp. paratuberculosis
cgccgacaucgcg

SEQ ID NO: 2829112 - RNA, 18 nt, Mycobacterium avium subsp. paratuberculosis
cgccgacaucgcggcgau

SEQ ID NO: 2829113 - RNA, 20 nt, Mycobacterium avium subsp. paratuberculosis
cgccgacaucgcggcgaucu

SEQ ID NO: 2829114 - RNA, 17 nt, Mycobacterium avium subsp. paratuberculosis
cgccgaccacaugccgu

SEQ ID NO: 2829115 - RNA, 18 nt, Mycobacterium avium subsp. paratuberculosis
cgccgaccacccccagcc

SEQ ID NO: 2829116 - RNA, 19 nt, Mycobacterium avium subsp. paratuberculosis
cgccgaccacccccagccc

SEQ ID NO: 2829117 - RNA, 16 nt, Mycobacterium avium subsp. paratuberculosis
cgccgaccaccuugcg

SEQ ID NO: 2829118 - RNA, 19 nt, Mycobacterium avium subsp. paratuberculosis
cgccgaccaccuugcgcag

SEQ ID NO: 2829119 - RNA, 23 nt, Mycobacterium avium subsp. paratuberculosis
cgccgaccaccuugcgcagcagc

SEQ ID NO: 2829120 - RNA, 13 nt, Mycobacterium avium subsp. paratuberculosis
cgccgaccacggc

SEQ ID NO: 2829121 - RNA, 16 nt, Mycobacterium avium subsp. paratuberculosis
cgccgaccacggcccc

SEQ ID NO: 2829122 - RNA, 19 nt, Mycobacterium avium subsp. paratuberculosis
cgccgaccacggccccagc

SEQ ID NO: 2829123 - RNA, 24 nt, Mycobacterium avium subsp. paratuberculosis
cgccgaccacggccccagccgccg

SEQ ID NO: 2829124 - RNA, 14 nt, Mycobacterium avium subsp. paratuberculosis
cgccgaccagcagg

SEQ ID NO: 2829125 - RNA, 15 nt, Mycobacterium avium subsp. paratuberculosis
cgccgaccagcagga

SEQ ID NO: 2829126 - RNA, 20 nt, Mycobacterium avium subsp. paratuberculosis
cgccgaccagcaggacgcgc

SEQ ID NO: 2829127 - RNA, 13 nt, Mycobacterium avium subsp. paratuberculosis
cgccgaccagccg

SEQ ID NO: 2829128 - RNA, 15 nt, Mycobacterium avium subsp. paratuberculosis
cgccgaccagccgag

SEQ ID NO: 2829129 - RNA, 17 nt, Mycobacterium avium subsp. paratuberculosis
cgccgaccagccgaggc

SEQ ID NO: 2829130 - RNA, 20 nt, Mycobacterium avium subsp. paratuberculosis
cgccgaccagccgaggcgcu

SEQ ID NO: 2829131 - RNA, 14 nt, Mycobacterium avium subsp. paratuberculosis
cgccgaccagcgcg

SEQ ID NO: 2829132 - RNA, 15 nt, Mycobacterium avium subsp. paratuberculosis
cgccgaccagcgcgu

SEQ ID NO: 2829133 - RNA, 17 nt, Mycobacterium avium subsp. paratuberculosis
cgccgaccaggcucgcg

SEQ ID NO: 2829134 - RNA, 19 nt, Mycobacterium avium subsp. paratuberculosis
cgccgaccagguagcgcug

SEQ ID NO: 2829135 - RNA, 20 nt, Mycobacterium avium subsp. paratuberculosis
cgccgaccagguccgguucg

SEQ ID NO: 2829136 - RNA, 21 nt, Mycobacterium avium subsp. paratuberculosis
cgccgaccagguccgguucga

SEQ ID NO: 2829137 - RNA, 17 nt, Mycobacterium avium subsp. paratuberculosis
cgccgaccaguucggcc

SEQ ID NO: 2829138 - RNA, 19 nt, Mycobacterium avium subsp. paratuberculosis
cgccgaccaguucggccac

SEQ ID NO: 2829139 - RNA, 21 nt, Mycobacterium avium subsp. paratuberculosis
cgccgaccaguucggccaccg

SEQ ID NO: 2829140 - RNA, 22 nt, Mycobacterium avium subsp. paratuberculosis
cgccgaccaguucggccaccgc

SEQ ID NO: 2829141 - RNA, 16 nt, Mycobacterium avium subsp. paratuberculosis
cgccgacccccgccgc

SEQ ID NO: 2829142 - RNA, 17 nt, Mycobacterium avium subsp. paratuberculosis
cgccgacccccgccgcg

SEQ ID NO: 2829143 - RNA, 20 nt, Mycobacterium avium subsp. paratuberculosis
cgccgacccccgccgcgucg

SEQ ID NO: 2829144 - RNA, 22 nt, Mycobacterium avium subsp. paratuberculosis
cgccgacccccgccgcgucggu

SEQ ID NO: 2829145 - RNA, 12 nt, Mycobacterium avium subsp. paratuberculosis
cgccgacccgcc

SEQ ID NO: 2829146 - RNA, 15 nt, Mycobacterium avium subsp. paratuberculosis
cgccgacccgcccgc

SEQ ID NO: 2829147 - RNA, 16 nt, Mycobacterium avium subsp. paratuberculosis
cgccgacccgcccgcc

SEQ ID NO: 2829148 - RNA, 18 nt, Mycobacterium avium subsp. paratuberculosis
cgccgacccgcccgccgg

SEQ ID NO: 2829149 - RNA, 19 nt, Mycobacterium avium subsp. paratuberculosis
cgccgacccgcccgccggg

SEQ ID NO: 2829150 - RNA, 14 nt, Mycobacterium avium subsp. paratuberculosis
cgccgaccgcccgc

SEQ ID NO: 2829151 - RNA, 15 nt, Mycobacterium avium subsp. paratuberculosis
cgccgaccgcccgcu

SEQ ID NO: 2829152 - RNA, 15 nt, Mycobacterium avium subsp. paratuberculosis
cgccgaccgccgagc

SEQ ID NO: 2829153 - RNA, 17 nt, Mycobacterium avium subsp. paratuberculosis
cgccgaccgccgagcgg

SEQ ID NO: 2829154 - RNA, 13 nt, Mycobacterium avium subsp. paratuberculosis
cgccgaccgcgag

SEQ ID NO: 2829155 - RNA, 14 nt, Mycobacterium avium subsp. paratuberculosis
cgccgaccgcgagc

SEQ ID NO: 2829156 - RNA, 14 nt, Mycobacterium avium subsp. paratuberculosis
cgccgaccgcgauc

SEQ ID NO: 2829157 - RNA, 15 nt, Mycobacterium avium subsp. paratuberculosis
cgccgaccgcgaucg

SEQ ID NO: 2829158 - RNA, 15 nt, Mycobacterium avium subsp. paratuberculosis
cgccgaccgcggucg

SEQ ID NO: 2829159 - RNA, 16 nt, Mycobacterium avium subsp. paratuberculosis
cgccgaccgcggucgc

SEQ ID NO: 2829160 - RNA, 20 nt, Mycobacterium avium subsp. paratuberculosis
cgccgaccgcggucgcggcg

SEQ ID NO: 2829161 - RNA, 14 nt, Mycobacterium avium subsp. paratuberculosis
cgccgaccgguccg

SEQ ID NO: 2829162 - RNA, 15 nt, Mycobacterium avium subsp. paratuberculosis
cgccgaccgguccgc

SEQ ID NO: 2829163 - RNA, 17 nt, Mycobacterium avium subsp. paratuberculosis
cgccgaccgguccgccg

SEQ ID NO: 2829164 - RNA, 18 nt, Mycobacterium avium subsp. paratuberculosis
cgccgaccgguccgccgc

SEQ ID NO: 2829165 - RNA, 20 nt, Mycobacterium avium subsp. paratuberculosis
cgccgaccgguccgccgccg

SEQ ID NO: 2829166 - RNA, 21 nt, Mycobacterium avium subsp. paratuberculosis
cgccgaccgguccgccgccgg

SEQ ID NO: 2829167 - RNA, 14 nt, Mycobacterium avium subsp. paratuberculosis
cgccgaccucgucg

SEQ ID NO: 2829168 - RNA, 19 nt, Mycobacterium avium subsp. paratuberculosis
cgccgaccucgucggcggu

SEQ ID NO: 2829169 - RNA, 14 nt, Mycobacterium avium subsp. paratuberculosis
cgccgaccuggucg

SEQ ID NO: 2829170 - RNA, 20 nt, Mycobacterium avium subsp. paratuberculosis
cgccgaccuggucgccgaac

SEQ ID NO: 2829171 - RNA, 14 nt, Mycobacterium avium subsp. paratuberculosis
cgccgaccuuggcg

SEQ ID NO: 2829172 - RNA, 14 nt, Mycobacterium avium subsp. paratuberculosis
cgccgacgaccagu

SEQ ID NO: 2829173 - RNA, 12 nt, Mycobacterium avium subsp. paratuberculosis
cgccgacgacga

SEQ ID NO: 2829174 - RNA, 21 nt, Mycobacterium avium subsp. paratuberculosis
cgccgacgacgaagacguacg

SEQ ID NO: 2829175 - RNA, 15 nt, Mycobacterium avium subsp. paratuberculosis
cgccgacgacggcga

SEQ ID NO: 2829176 - RNA, 14 nt, Mycobacterium avium subsp. paratuberculosis
cgccgacgacgucg

SEQ ID NO: 2829177 - RNA, 15 nt, Mycobacterium avium subsp. paratuberculosis
cgccgacgacgucgc

SEQ ID NO: 2829178 - RNA, 14 nt, Mycobacterium avium subsp. paratuberculosis
cgccgagaacaggc

SEQ ID NO: 2829179 - RNA, 17 nt, Mycobacterium avium subsp. paratuberculosis
cgccgagaacaggccga

SEQ ID NO: 2829180 - RNA, 21 nt, Mycobacterium avium subsp. paratuberculosis
cgccgagacacauucgcgugu

SEQ ID NO: 2829181 - RNA, 15 nt, Mycobacterium avium subsp. paratuberculosis
cgccgagaccagcca

SEQ ID NO: 2829182 - RNA, 16 nt, Mycobacterium avium subsp. paratuberculosis
cgccgagaccagccag

SEQ ID NO: 2829183 - RNA, 14 nt, Mycobacterium avium subsp. paratuberculosis
cgccgagacgaucc

SEQ ID NO: 2829184 - RNA, 16 nt, Mycobacterium avium subsp. paratuberculosis
cgccgagacgaucccg

SEQ ID NO: 2829185 - RNA, 13 nt, Mycobacterium avium subsp. paratuberculosis
cgccgagacggcg

SEQ ID NO: 2829186 - RNA, 14 nt, Mycobacterium avium subsp. paratuberculosis
cgccgagacggcgu

SEQ ID NO: 2829187 - RNA, 22 nt, Mycobacterium avium subsp. paratuberculosis
cgccgagacgugguggugcgga

SEQ ID NO: 2829188 - RNA, 12 nt, Mycobacterium avium subsp. paratuberculosis
cgccgagagcgc

SEQ ID NO: 2829189 - RNA, 14 nt, Mycobacterium avium subsp. paratuberculosis
cgccgagagcgcgu

SEQ ID NO: 2829190 - RNA, 18 nt, Mycobacterium avium subsp. paratuberculosis
cgccgagagcgcgucgac

SEQ ID NO: 2829191 - RNA, 19 nt, Mycobacterium avium subsp. paratuberculosis
cgccgagagcgcgucgacg

SEQ ID NO: 2829192 - RNA, 22 nt, Mycobacterium avium subsp. paratuberculosis
cgccgagagcgcgucgacgcgg

SEQ ID NO: 2829193 - RNA, 23 nt, Mycobacterium avium subsp. paratuberculosis
cgccgagagcgcgucgacgcggu

SEQ ID NO: 2829194 - RNA, 21 nt, Mycobacterium avium subsp. paratuberculosis
cgccgagagcucuugcgcccc

SEQ ID NO: 2829195 - RNA, 16 nt, Mycobacterium avium subsp. paratuberculosis
cgccgagauccaccgc

SEQ ID NO: 2829196 - RNA, 17 nt, Mycobacterium avium subsp. paratuberculosis
cgccgagauccaccgcg

SEQ ID NO: 2829197 - RNA, 20 nt, Mycobacterium avium subsp. paratuberculosis
cgccgagauccaccgcgcgg

SEQ ID NO: 2829198 - RNA, 23 nt, Mycobacterium avium subsp. paratuberculosis
cgccgagauccaccgcgcggcca

SEQ ID NO: 2829199 - RNA, 16 nt, Mycobacterium avium subsp. paratuberculosis
cgccgagaucgcggug

SEQ ID NO: 2829200 - RNA, 17 nt, Mycobacterium avium subsp. paratuberculosis
cgccgagaucgcggugg

SEQ ID NO: 2829201 - RNA, 19 nt, Mycobacterium avium subsp. paratuberculosis
cgccgagaucgcgguggcg

SEQ ID NO: 2829202 - RNA, 21 nt, Mycobacterium avium subsp. paratuberculosis
cgccgagaucgcgguggcgcc

SEQ ID NO: 2829203 - RNA, 19 nt, Mycobacterium avium subsp. paratuberculosis
cgccgagauuggacgacac

SEQ ID NO: 2829204 - RNA, 22 nt, Mycobacterium avium subsp. paratuberculosis
cgccgagauuggacgacaccac

SEQ ID NO: 2829205 - RNA, 17 nt, Mycobacterium avium subsp. paratuberculosis
cgccgagcaacagcccg

SEQ ID NO: 2829206 - RNA, 18 nt, Mycobacterium avium subsp. paratuberculosis
cgccgagcaacagcccga

SEQ ID NO: 2829207 - RNA, 15 nt, Mycobacterium avium subsp. paratuberculosis
cgccgagcaaccggg

SEQ ID NO: 2829208 - RNA, 14 nt, Mycobacterium avium subsp. paratuberculosis
cgccgagcacaccg

SEQ ID NO: 2829209 - RNA, 17 nt, Mycobacterium avium subsp. paratuberculosis
cgccgagcacaccgucg

SEQ ID NO: 2829210 - RNA, 22 nt, Mycobacterium avium subsp. paratuberculosis
cgccgagcacaccgucgcccgc

SEQ ID NO: 2829211 - RNA, 13 nt, Mycobacterium avium subsp. paratuberculosis
cgccgagcaccug

SEQ ID NO: 2829212 - RNA, 19 nt, Mycobacterium avium subsp. paratuberculosis
cgccgagcacgaacgcggc

SEQ ID NO: 2829213 - RNA, 21 nt, Mycobacterium avium subsp. paratuberculosis
cgccgagcacgaacgcggccg

SEQ ID NO: 2829214 - RNA, 15 nt, Mycobacterium avium subsp. paratuberculosis
cgccgagcacggcuc

SEQ ID NO: 2829215 - RNA, 16 nt, Mycobacterium avium subsp. paratuberculosis
cgccgagcacggcucg

SEQ ID NO: 2829216 - RNA, 20 nt, Mycobacterium avium subsp. paratuberculosis
cgccgagcacggcucgucca

SEQ ID NO: 2829217 - RNA, 18 nt, Mycobacterium avium subsp. paratuberculosis
cgccgagcagaucacguu

SEQ ID NO: 2829218 - RNA, 20 nt, Mycobacterium avium subsp. paratuberculosis
cgccgagcagaucacguuga

SEQ ID NO: 2829219 - RNA, 16 nt, Mycobacterium avium subsp. paratuberculosis
cgccgagcagaucggg

SEQ ID NO: 2829220 - RNA, 13 nt, Mycobacterium avium subsp. paratuberculosis
cgccgagcagcac

SEQ ID NO: 2829221 - RNA, 15 nt, Mycobacterium avium subsp. paratuberculosis
cgccgagcagcaccg

SEQ ID NO: 2829222 - RNA, 16 nt, Mycobacterium avium subsp. paratuberculosis
cgccgagcagcaccgg

SEQ ID NO: 2829223 - RNA, 17 nt, Mycobacterium avium subsp. paratuberculosis
cgccgagcagcaccggc

SEQ ID NO: 2829224 - RNA, 12 nt, Mycobacterium avium subsp. paratuberculosis
cgccgagcagcu

SEQ ID NO: 2829225 - RNA, 18 nt, Mycobacterium avium subsp. paratuberculosis
cgccgagcagcucagccg

SEQ ID NO: 2829226 - RNA, 13 nt, Mycobacterium avium subsp. paratuberculosis
cgccgagccgcac

SEQ ID NO: 2829227 - RNA, 18 nt, Mycobacterium avium subsp. paratuberculosis
cgccgagccgcaccgccu

SEQ ID NO: 2829228 - RNA, 12 nt, Mycobacterium avium subsp. paratuberculosis
cgccgagccgcg

SEQ ID NO: 2829229 - RNA, 22 nt, Mycobacterium avium subsp. paratuberculosis
cgccgagccgcgccacgcgcag

SEQ ID NO: 2829230 - RNA, 16 nt, Mycobacterium avium subsp. paratuberculosis
cgccgagccgcgggug

SEQ ID NO: 2829231 - RNA, 20 nt, Mycobacterium avium subsp. paratuberculosis
cgccgagccgcgggugacga

SEQ ID NO: 2829232 - RNA, 19 nt, Mycobacterium avium subsp. paratuberculosis
cgccgagccgcuccaccgc

SEQ ID NO: 2829233 - RNA, 14 nt, Mycobacterium avium subsp. paratuberculosis
cgccgagccggcac

SEQ ID NO: 2829234 - RNA, 17 nt, Mycobacterium avium subsp. paratuberculosis
cgccgagccggcacggc

SEQ ID NO: 2829235 - RNA, 21 nt, Mycobacterium avium subsp. paratuberculosis
cgccgagccggcacggccggc

SEQ ID NO: 2829236 - RNA, 14 nt, Mycobacterium avium subsp. paratuberculosis
cgccgagccgucgu

SEQ ID NO: 2829237 - RNA, 16 nt, Mycobacterium avium subsp. paratuberculosis
cgccgagccgucgucg

SEQ ID NO: 2829238 - RNA, 15 nt, Mycobacterium avium subsp. paratuberculosis
cgccgagcgcaucga

SEQ ID NO: 2829239 - RNA, 18 nt, Mycobacterium avium subsp. paratuberculosis
cgccgagcgggcgaucuc

SEQ ID NO: 2829240 - RNA, 12 nt, Mycobacterium avium subsp. paratuberculosis
cgccgagcgggu

SEQ ID NO: 2829241 - RNA, 15 nt, Mycobacterium avium subsp. paratuberculosis
cgccgagcgggucgu

SEQ ID NO: 2829242 - RNA, 17 nt, Mycobacterium avium subsp. paratuberculosis
cgccgagcgggucgucg

SEQ ID NO: 2829243 - RNA, 19 nt, Mycobacterium avium subsp. paratuberculosis
cgccgagcgucacgcuggc

SEQ ID NO: 2829244 - RNA, 15 nt, Mycobacterium avium subsp. paratuberculosis
cgccgagcgugaacu

SEQ ID NO: 2829245 - RNA, 17 nt, Mycobacterium avium subsp. paratuberculosis
cgccgagcucgaugucc

SEQ ID NO: 2829246 - RNA, 16 nt, Mycobacterium avium subsp. paratuberculosis
cgccgagcucggccac

SEQ ID NO: 2829247 - RNA, 20 nt, Mycobacterium avium subsp. paratuberculosis
cgccgagcucggccaccagc

SEQ ID NO: 2829248 - RNA, 22 nt, Mycobacterium avium subsp. paratuberculosis
cgccgagcucggccaccagcgc

SEQ ID NO: 2829249 - RNA, 18 nt, Mycobacterium avium subsp. paratuberculosis
cgccgaggaaccggcagc

SEQ ID NO: 2829250 - RNA, 20 nt, Mycobacterium avium subsp. paratuberculosis
cgccgaggaaccggcagccg

SEQ ID NO: 2829251 - RNA, 16 nt, Mycobacterium avium subsp. paratuberculosis
cgccgaggacacguug

SEQ ID NO: 2829252 - RNA, 17 nt, Mycobacterium avium subsp. paratuberculosis
cgccgaggaggccgcgg

SEQ ID NO: 2829253 - RNA, 18 nt, Mycobacterium avium subsp. paratuberculosis
cgccgaggaggccgcggc

SEQ ID NO: 2829254 - RNA, 22 nt, Mycobacterium avium subsp. paratuberculosis
cgccgaggaggccgcggcgaca

SEQ ID NO: 2829255 - RNA, 20 nt, Mycobacterium avium subsp. paratuberculosis
cgccgaggaucuugaucgcg

SEQ ID NO: 2829256 - RNA, 23 nt, Mycobacterium avium subsp. paratuberculosis
cgccgaggaucuugaucgcgaag

SEQ ID NO: 2829257 - RNA, 14 nt, Mycobacterium avium subsp. paratuberculosis
cgccgaggccagca

SEQ ID NO: 2829258 - RNA, 17 nt, Mycobacterium avium subsp. paratuberculosis
cgccgaggccagcacgc

SEQ ID NO: 2829259 - RNA, 20 nt, Mycobacterium avium subsp. paratuberculosis
cgccgaggccagcacgccgg

SEQ ID NO: 2829260 - RNA, 23 nt, Mycobacterium avium subsp. paratuberculosis
cgccgaggccagcacgccgguca

SEQ ID NO: 2829261 - RNA, 14 nt, Mycobacterium avium subsp. paratuberculosis
cgccgaggcgaugc

SEQ ID NO: 2829262 - RNA, 17 nt, Mycobacterium avium subsp. paratuberculosis
cgccgaggcgaugccgu

SEQ ID NO: 2829263 - RNA, 18 nt, Mycobacterium avium subsp. paratuberculosis
cgccgaucuggcgcagcg

SEQ ID NO: 2829264 - RNA, 21 nt, Mycobacterium avium subsp. paratuberculosis
cgccgaucuggcgcagcguca

SEQ ID NO: 2829265 - RNA, 16 nt, Mycobacterium avium subsp. paratuberculosis
cgccgaucugucgcgc

SEQ ID NO: 2829266 - RNA, 17 nt, Mycobacterium avium subsp. paratuberculosis
cgccgaucuugagccgg

SEQ ID NO: 2829267 - RNA, 21 nt, Mycobacterium avium subsp. paratuberculosis
cgccgaucuugagccggaugc

SEQ ID NO: 2829268 - RNA, 15 nt, Mycobacterium avium subsp. paratuberculosis
cgccgaugaccaccc

SEQ ID NO: 2829269 - RNA, 15 nt, Mycobacterium avium subsp. paratuberculosis
cgccgaugacggcgc

SEQ ID NO: 2829270 - RNA, 16 nt, Mycobacterium avium subsp. paratuberculosis
cgccgaugacggcgcg

SEQ ID NO: 2829271 - RNA, 14 nt, Mycobacterium avium subsp. paratuberculosis
cgccgaugacguug

SEQ ID NO: 2829272 - RNA, 21 nt, Mycobacterium avium subsp. paratuberculosis
cgccgaugacguugcgcgcca

SEQ ID NO: 2829273 - RNA, 16 nt, Mycobacterium avium subsp. paratuberculosis
cgccgaugaugguggc

SEQ ID NO: 2829274 - RNA, 17 nt, Mycobacterium avium subsp. paratuberculosis
cgccgaugaugguggcg

SEQ ID NO: 2829275 - RNA, 19 nt, Mycobacterium avium subsp. paratuberculosis
cgccgaugaugguggcggc

SEQ ID NO: 2829276 - RNA, 22 nt, Mycobacterium avium subsp. paratuberculosis
cgccgaugaugguggcggccac

SEQ ID NO: 2829277 - RNA, 13 nt, Mycobacterium avium subsp. paratuberculosis
cgccgaugcagca

SEQ ID NO: 2829278 - RNA, 15 nt, Mycobacterium avium subsp. paratuberculosis
cgccgaugcccgccc

SEQ ID NO: 2829279 - RNA, 16 nt, Mycobacterium avium subsp. paratuberculosis
cgccgaugcccgcccc

SEQ ID NO: 2829280 - RNA, 18 nt, Mycobacterium avium subsp. paratuberculosis
cgccgaugcccgccccgg

SEQ ID NO: 2829281 - RNA, 21 nt, Mycobacterium avium subsp. paratuberculosis
cgccgaugccgaacgucacca

SEQ ID NO: 2829282 - RNA, 14 nt, Mycobacterium avium subsp. paratuberculosis
cgccgaugccgcgc

SEQ ID NO: 2829283 - RNA, 16 nt, Mycobacterium avium subsp. paratuberculosis
cgccgaugccgcgcug

SEQ ID NO: 2829284 - RNA, 19 nt, Mycobacterium avium subsp. paratuberculosis
cgccgaugccgcgcugcgc

SEQ ID NO: 2829285 - RNA, 22 nt, Mycobacterium avium subsp. paratuberculosis
cgccgaugccgcgcugcgccgg

SEQ ID NO: 2829286 - RNA, 16 nt, Mycobacterium avium subsp. paratuberculosis
cgccgaugcgcccgcu

SEQ ID NO: 2829287 - RNA, 21 nt, Mycobacterium avium subsp. paratuberculosis
cgccgaugcgcccgcugcggc

SEQ ID NO: 2829288 - RNA, 22 nt, Mycobacterium avium subsp. paratuberculosis
cgccgaugcgcccgcugcggcg

SEQ ID NO: 2829289 - RNA, 14 nt, Mycobacterium avium subsp. paratuberculosis
cgccgaugcgccgc

SEQ ID NO: 2829290 - RNA, 15 nt, Mycobacterium avium subsp. paratuberculosis
cgccgaugcgccgca

SEQ ID NO: 2829291 - RNA, 14 nt, Mycobacterium avium subsp. paratuberculosis
cgccgauggacacg

SEQ ID NO: 2829292 - RNA, 21 nt, Mycobacterium avium subsp. paratuberculosis
cgccgauggccugguggccca

SEQ ID NO: 2829293 - RNA, 12 nt, Mycobacterium avium subsp. paratuberculosis
cgccgauggcga

SEQ ID NO: 2829294 - RNA, 14 nt, Mycobacterium avium subsp. paratuberculosis
cgccgauggcgacg

SEQ ID NO: 2829295 - RNA, 15 nt, Mycobacterium avium subsp. paratuberculosis
cgccgauggcgacgg

SEQ ID NO: 2829296 - RNA, 16 nt, Mycobacterium avium subsp. paratuberculosis
cgccgauggcguucau

SEQ ID NO: 2829297 - RNA, 13 nt, Mycobacterium avium subsp. paratuberculosis
cgccgauggugac

SEQ ID NO: 2829298 - RNA, 19 nt, Mycobacterium avium subsp. paratuberculosis
cgccgauggugaccucggu

SEQ ID NO: 2829299 - RNA, 21 nt, Mycobacterium avium subsp. paratuberculosis
cgccgauggugaccucggucg

SEQ ID NO: 2829300 - RNA, 22 nt, Mycobacterium avium subsp. paratuberculosis
cgccgauggugaccucggucga

SEQ ID NO: 2829301 - RNA, 18 nt, Mycobacterium avium subsp. paratuberculosis
cgccgauggugacggugc

SEQ ID NO: 2829302 - RNA, 20 nt, Mycobacterium avium subsp. paratuberculosis
cgccgauggugacggugccg

SEQ ID NO: 2829303 - RNA, 22 nt, Mycobacterium avium subsp. paratuberculosis
cgccgauggugacggugccgcc

SEQ ID NO: 2829304 - RNA, 13 nt, Mycobacterium avium subsp. paratuberculosis
cgccgauggugcc

SEQ ID NO: 2829305 - RNA, 18 nt, Mycobacterium avium subsp. paratuberculosis
cgccgauguacugggccg

SEQ ID NO: 2829306 - RNA, 19 nt, Mycobacterium avium subsp. paratuberculosis
cgccgauguacugggccgu

SEQ ID NO: 2829307 - RNA, 21 nt, Mycobacterium avium subsp. paratuberculosis
cgccgauguacugggccgucg

SEQ ID NO: 2829308 - RNA, 22 nt, Mycobacterium avium subsp. paratuberculosis
cgccgauguacugggccgucgc

SEQ ID NO: 2829309 - RNA, 16 nt, Mycobacterium avium subsp. paratuberculosis
cgccgaugucggccgg

SEQ ID NO: 2829310 - RNA, 18 nt, Mycobacterium avium subsp. paratuberculosis
cgccgaugugaucggcgg

SEQ ID NO: 2829311 - RNA, 20 nt, Mycobacterium avium subsp. paratuberculosis
cgccgaugugaucggcggcc

SEQ ID NO: 2829312 - RNA, 21 nt, Mycobacterium avium subsp. paratuberculosis
cgccgaugugaucggcggcca

SEQ ID NO: 2829313 - RNA, 12 nt, Mycobacterium avium subsp. paratuberculosis
cgccgaugugcu

SEQ ID NO: 2829314 - RNA, 16 nt, Mycobacterium avium subsp. paratuberculosis
cgccgauguggccggc

SEQ ID NO: 2829315 - RNA, 17 nt, Mycobacterium avium subsp. paratuberculosis
cgccgauguggccggcg

SEQ ID NO: 2829316 - RNA, 18 nt, Mycobacterium avium subsp. paratuberculosis
cgccgauguggccggcga

SEQ ID NO: 2829317 - RNA, 20 nt, Mycobacterium avium subsp. paratuberculosis
cgccgauguggccggcgaug

SEQ ID NO: 2829318 - RNA, 23 nt, Mycobacterium avium subsp. paratuberculosis
cgccgauguggccggcgauggcg

SEQ ID NO: 2829319 - RNA, 20 nt, Mycobacterium avium subsp. paratuberculosis
cgccgauguuuugggugcuu

SEQ ID NO: 2829320 - RNA, 15 nt, Mycobacterium avium subsp. paratuberculosis
cgccgauucaacccc

SEQ ID NO: 2829321 - RNA, 18 nt, Mycobacterium avium subsp. paratuberculosis
cgccgauucaaccccgcg

SEQ ID NO: 2829322 - RNA, 22 nt, Mycobacterium avium subsp. paratuberculosis
cgccgauucaaccccgcgcgcg

SEQ ID NO: 2829323 - RNA, 15 nt, Mycobacterium avium subsp. paratuberculosis
cgccgauuccggccg

SEQ ID NO: 2829324 - RNA, 21 nt, Mycobacterium avium subsp. paratuberculosis
cgccgauuccggccggccgcc

SEQ ID NO: 2829325 - RNA, 23 nt, Mycobacterium avium subsp. paratuberculosis
cgccgauuccggccggccgccgg

SEQ ID NO: 2829326 - RNA, 16 nt, Mycobacterium avium subsp. paratuberculosis
cgccgauuccgucggu

SEQ ID NO: 2829327 - RNA, 17 nt, Mycobacterium avium subsp. paratuberculosis
cgccgauuccgucggug

SEQ ID NO: 2829328 - RNA, 18 nt, Mycobacterium avium subsp. paratuberculosis
cgccgauuccgucggugg

SEQ ID NO: 2829329 - RNA, 19 nt, Mycobacterium avium subsp. paratuberculosis
cgccgauuccgucgguggc

SEQ ID NO: 2829330 - RNA, 20 nt, Mycobacterium avium subsp. paratuberculosis
cgccgauuccgucgguggcg

SEQ ID NO: 2829331 - RNA, 22 nt, Mycobacterium avium subsp. paratuberculosis
cgccgauuccgucgguggcggu

SEQ ID NO: 2829332 - RNA, 15 nt, Mycobacterium avium subsp. paratuberculosis
cgccgcaacagccgg

SEQ ID NO: 2829333 - RNA, 16 nt, Mycobacterium avium subsp. paratuberculosis
cgccgcaacagccggc

SEQ ID NO: 2829334 - RNA, 18 nt, Mycobacterium avium subsp. paratuberculosis
cgccgcaacagccggccc

SEQ ID NO: 2829335 - RNA, 20 nt, Mycobacterium avium subsp. paratuberculosis
cgccgcaacagccggcccga

SEQ ID NO: 2829336 - RNA, 17 nt, Mycobacterium avium subsp. paratuberculosis
cgccgcaacagguuucg

SEQ ID NO: 2829337 - RNA, 22 nt, Mycobacterium avium subsp. paratuberculosis
cgccgcaaccuucuuggccgga

SEQ ID NO: 2829338 - RNA, 23 nt, Mycobacterium avium subsp. paratuberculosis
cgccgcaaccuucuuggccggag

SEQ ID NO: 2829339 - RNA, 14 nt, Mycobacterium avium subsp. paratuberculosis
cgccgcaacggcgc

SEQ ID NO: 2829340 - RNA, 20 nt, Mycobacterium avium subsp. paratuberculosis
cgccgcaacggcucccaggc

SEQ ID NO: 2829341 - RNA, 16 nt, Mycobacterium avium subsp. paratuberculosis
cgccgcaauacaccgc

SEQ ID NO: 2829342 - RNA, 18 nt, Mycobacterium avium subsp. paratuberculosis
cgccgcaauacaccgcga

SEQ ID NO: 2829343 - RNA, 23 nt, Mycobacterium avium subsp. paratuberculosis
cgccgcaauacaccgcgaacucg

SEQ ID NO: 2829344 - RNA, 13 nt, Mycobacterium avium subsp. paratuberculosis
cgccgcacagccg

SEQ ID NO: 2829345 - RNA, 15 nt, Mycobacterium avium subsp. paratuberculosis
cgccgcacagccggc

SEQ ID NO: 2829346 - RNA, 16 nt, Mycobacterium avium subsp. paratuberculosis
cgccgcacagccggcg

SEQ ID NO: 2829347 - RNA, 17 nt, Mycobacterium avium subsp. paratuberculosis
cgccgccagccagccgg

SEQ ID NO: 2829348 - RNA, 16 nt, Mycobacterium avium subsp. paratuberculosis
cgccgccagccgcagc

SEQ ID NO: 2829349 - RNA, 16 nt, Mycobacterium avium subsp. paratuberculosis
cgccgccagcgccacc

SEQ ID NO: 2829350 - RNA, 16 nt, Mycobacterium avium subsp. paratuberculosis
cgccgccagcgcgggg

SEQ ID NO: 2829351 - RNA, 17 nt, Mycobacterium avium subsp. paratuberculosis
cgccgccagcgcggggu

SEQ ID NO: 2829352 - RNA, 23 nt, Mycobacterium avium subsp. paratuberculosis
cgccgccagcgcggggucggcca

SEQ ID NO: 2829353 - RNA, 14 nt, Mycobacterium avium subsp. paratuberculosis
cgccgccagggcgc

SEQ ID NO: 2829354 - RNA, 17 nt, Mycobacterium avium subsp. paratuberculosis
cgccgccagggcgcggc

SEQ ID NO: 2829355 - RNA, 18 nt, Mycobacterium avium subsp. paratuberculosis
cgccgccagggcgcggcg

SEQ ID NO: 2829356 - RNA, 19 nt, Mycobacterium avium subsp. paratuberculosis
cgccgccauccgcgccgaa

SEQ ID NO: 2829357 - RNA, 20 nt, Mycobacterium avium subsp. paratuberculosis
cgccgccauccgcgccgaac

SEQ ID NO: 2829358 - RNA, 23 nt, Mycobacterium avium subsp. paratuberculosis
cgccgccauccgcgccgaacgca

SEQ ID NO: 2829359 - RNA, 13 nt, Mycobacterium avium subsp. paratuberculosis
cgccgccaucgcc

SEQ ID NO: 2829360 - RNA, 14 nt, Mycobacterium avium subsp. paratuberculosis
cgccgccaucgccg

SEQ ID NO: 2829361 - RNA, 17 nt, Mycobacterium avium subsp. paratuberculosis
cgccgccaucgccucgu

SEQ ID NO: 2829362 - RNA, 20 nt, Mycobacterium avium subsp. paratuberculosis
cgccgccaucgccucguccc

SEQ ID NO: 2829363 - RNA, 22 nt, Mycobacterium avium subsp. paratuberculosis
cgccgccaucgccucgucccuc

SEQ ID NO: 2829364 - RNA, 15 nt, Mycobacterium avium subsp. paratuberculosis
cgccgccaucuccuc

SEQ ID NO: 2829365 - RNA, 18 nt, Mycobacterium avium subsp. paratuberculosis
cgccgccaucuccuccgg

SEQ ID NO: 2829366 - RNA, 20 nt, Mycobacterium avium subsp. paratuberculosis
cgccgccaucuccuccgggc

SEQ ID NO: 2829367 - RNA, 14 nt, Mycobacterium avium subsp. paratuberculosis
cgccgcccacaccg

SEQ ID NO: 2829368 - RNA, 17 nt, Mycobacterium avium subsp. paratuberculosis
cgccgcccacaccgaca

SEQ ID NO: 2829369 - RNA, 20 nt, Mycobacterium avium subsp. paratuberculosis
cgccgcccacaccgacaccg

SEQ ID NO: 2829370 - RNA, 24 nt, Mycobacterium avium subsp. paratuberculosis
cgccgcccacaccgacaccggccg

SEQ ID NO: 2829371 - RNA, 17 nt, Mycobacterium avium subsp. paratuberculosis
cgccgcccaccagcaca

SEQ ID NO: 2829372 - RNA, 20 nt, Mycobacterium avium subsp. paratuberculosis
cgccgcccaccagcacaccg

SEQ ID NO: 2829373 - RNA, 23 nt, Mycobacterium avium subsp. paratuberculosis
cgccgcccaccagcacaccggau

SEQ ID NO: 2829374 - RNA, 21 nt, Mycobacterium avium subsp. paratuberculosis
cgccgcccaccuucccaaccc

SEQ ID NO: 2829375 - RNA, 17 nt, Mycobacterium avium subsp. paratuberculosis
cgccgcccacgccgccc

SEQ ID NO: 2829376 - RNA, 20 nt, Mycobacterium avium subsp. paratuberculosis
cgccgcccacgccgcccagg

SEQ ID NO: 2829377 - RNA, 14 nt, Mycobacterium avium subsp. paratuberculosis
cgccgcccagcggc

SEQ ID NO: 2829378 - RNA, 15 nt, Mycobacterium avium subsp. paratuberculosis
cgccgcccagcggcc

SEQ ID NO: 2829379 - RNA, 18 nt, Mycobacterium avium subsp. paratuberculosis
cgccgcccagcggccccg

SEQ ID NO: 2829380 - RNA, 20 nt, Mycobacterium avium subsp. paratuberculosis
cgccgcccagcggccccggc

SEQ ID NO: 2829381 - RNA, 23 nt, Mycobacterium avium subsp. paratuberculosis
cgccgcccagcggccccggcucg

SEQ ID NO: 2829382 - RNA, 18 nt, Mycobacterium avium subsp. paratuberculosis
cgccgcccaggccccggc

SEQ ID NO: 2829383 - RNA, 17 nt, Mycobacterium avium subsp. paratuberculosis
cgccgcccaggccgagc

SEQ ID NO: 2829384 - RNA, 19 nt, Mycobacterium avium subsp. paratuberculosis
cgccgcccaucggcagccc

SEQ ID NO: 2829385 - RNA, 20 nt, Mycobacterium avium subsp. paratuberculosis
cgccgcccaucggcagcccg

SEQ ID NO: 2829386 - RNA, 20 nt, Mycobacterium avium subsp. paratuberculosis
cgccgcccccgauagccccg

SEQ ID NO: 2829387 - RNA, 22 nt, Mycobacterium avium subsp. paratuberculosis
cgccgcccccgcccacagcggu

SEQ ID NO: 2829388 - RNA, 15 nt, Mycobacterium avium subsp. paratuberculosis
cgccgcccccgccgc

SEQ ID NO: 2829389 - RNA, 19 nt, Mycobacterium avium subsp. paratuberculosis
cgccgcccccgccgcgagc

SEQ ID NO: 2829390 - RNA, 20 nt, Mycobacterium avium subsp. paratuberculosis
cgccgcccccgccgcgagca

SEQ ID NO: 2829391 - RNA, 16 nt, Mycobacterium avium subsp. paratuberculosis
cgccgcccccgcggcg

SEQ ID NO: 2829392 - RNA, 18 nt, Mycobacterium avium subsp. paratuberculosis
cgccgcccccgcggcguc

SEQ ID NO: 2829393 - RNA, 19 nt, Mycobacterium avium subsp. paratuberculosis
cgccgcccccgcggcgucc

SEQ ID NO: 2829394 - RNA, 22 nt, Mycobacterium avium subsp. paratuberculosis
cgccgccccgaguuccagcucc

SEQ ID NO: 2829395 - RNA, 23 nt, Mycobacterium avium subsp. paratuberculosis
cgccgccccgaguuccagcuccg

SEQ ID NO: 2829396 - RNA, 13 nt, Mycobacterium avium subsp. paratuberculosis
cgccgccccgucg

SEQ ID NO: 2829397 - RNA, 15 nt, Mycobacterium avium subsp. paratuberculosis
cgccgccccgucggu

SEQ ID NO: 2829398 - RNA, 13 nt, Mycobacterium avium subsp. paratuberculosis
cgccgcccgcacc

SEQ ID NO: 2829399 - RNA, 16 nt, Mycobacterium avium subsp. paratuberculosis
cgccgcccgcaccugc

SEQ ID NO: 2829400 - RNA, 16 nt, Mycobacterium avium subsp. paratuberculosis
cgccgcccgcaguucg

SEQ ID NO: 2829401 - RNA, 20 nt, Mycobacterium avium subsp. paratuberculosis
cgccgcccgcaguucggccg

SEQ ID NO: 2829402 - RNA, 15 nt, Mycobacterium avium subsp. paratuberculosis
cgccgcccgcccgag

SEQ ID NO: 2829403 - RNA, 15 nt, Mycobacterium avium subsp. paratuberculosis
cgccgcccgcgcggc

SEQ ID NO: 2829404 - RNA, 21 nt, Mycobacterium avium subsp. paratuberculosis
cgccgcccgcgcggcggccaa

SEQ ID NO: 2829405 - RNA, 17 nt, Mycobacterium avium subsp. paratuberculosis
cgccgcccggagguucg

SEQ ID NO: 2829406 - RNA, 18 nt, Mycobacterium avium subsp. paratuberculosis
cgccgcccggagguucgc

SEQ ID NO: 2829407 - RNA, 21 nt, Mycobacterium avium subsp. paratuberculosis
cgccgcccggagguucgccgg

SEQ ID NO: 2829408 - RNA, 13 nt, Mycobacterium avium subsp. paratuberculosis
cgccgcccggcga

SEQ ID NO: 2829409 - RNA, 14 nt, Mycobacterium avium subsp. paratuberculosis
cgccgcccggcgau

SEQ ID NO: 2829410 - RNA, 15 nt, Mycobacterium avium subsp. paratuberculosis
cgccgcccggcgaua

SEQ ID NO: 2829411 - RNA, 15 nt, Mycobacterium avium subsp. paratuberculosis
cgccgcccggcgauc

SEQ ID NO: 2829412 - RNA, 20 nt, Mycobacterium avium subsp. paratuberculosis
cgccgcccgggcccggggug

SEQ ID NO: 2829413 - RNA, 17 nt, Mycobacterium avium subsp. paratuberculosis
cgccgcccgggccgcgc

SEQ ID NO: 2829414 - RNA, 13 nt, Mycobacterium avium subsp. paratuberculosis
cgccgcccgggcg

SEQ ID NO: 2829415 - RNA, 19 nt, Mycobacterium avium subsp. paratuberculosis
cgccgcccgggcggcccgg

SEQ ID NO: 2829416 - RNA, 14 nt, Mycobacterium avium subsp. paratuberculosis
cgccgcccgucagc

SEQ ID NO: 2829417 - RNA, 14 nt, Mycobacterium avium subsp. paratuberculosis
cgccgcccguccag

SEQ ID NO: 2829418 - RNA, 15 nt, Mycobacterium avium subsp. paratuberculosis
cgccgcccguccagc

SEQ ID NO: 2829419 - RNA, 16 nt, Mycobacterium avium subsp. paratuberculosis
cgccgcccguccagcg

SEQ ID NO: 2829420 - RNA, 18 nt, Mycobacterium avium subsp. paratuberculosis
cgccgcccguccagcgca

SEQ ID NO: 2829421 - RNA, 17 nt, Mycobacterium avium subsp. paratuberculosis
cgccgcccucgccgaac

SEQ ID NO: 2829422 - RNA, 14 nt, Mycobacterium avium subsp. paratuberculosis
cgccgcccugcggg

SEQ ID NO: 2829423 - RNA, 21 nt, Mycobacterium avium subsp. paratuberculosis
cgccgcccuggccccagaacc

SEQ ID NO: 2829424 - RNA, 21 nt, Mycobacterium avium subsp. paratuberculosis
cgccgccgaacagccggguga

SEQ ID NO: 2829425 - RNA, 20 nt, Mycobacterium avium subsp. paratuberculosis
cgccgccgaaccccagcucc

SEQ ID NO: 2829426 - RNA, 23 nt, Mycobacterium avium subsp. paratuberculosis
cgccgccgaaccccagcuccggg

SEQ ID NO: 2829427 - RNA, 12 nt, Mycobacterium avium subsp. paratuberculosis
cgccgccgacag

SEQ ID NO: 2829428 - RNA, 17 nt, Mycobacterium avium subsp. paratuberculosis
cgccgccgacagcaccu

SEQ ID NO: 2829429 - RNA, 23 nt, Mycobacterium avium subsp. paratuberculosis
cgccgccgaccacaugccguugc

SEQ ID NO: 2829430 - RNA, 14 nt, Mycobacterium avium subsp. paratuberculosis
cgccgccgaccgcc

SEQ ID NO: 2829431 - RNA, 13 nt, Mycobacterium avium subsp. paratuberculosis
cgccgcgaucucg

SEQ ID NO: 2829432 - RNA, 23 nt, Mycobacterium avium subsp. paratuberculosis
cgccgcgaucuugccgccgcgga

SEQ ID NO: 2829433 - RNA, 23 nt, Mycobacterium avium subsp. paratuberculosis
cgccgcgaugaucacacccacga

SEQ ID NO: 2829434 - RNA, 18 nt, Mycobacterium avium subsp. paratuberculosis
cgccgcgaugcaacaccg

SEQ ID NO: 2829435 - RNA, 22 nt, Mycobacterium avium subsp. paratuberculosis
cgccgcgaugcaacaccgaacg

SEQ ID NO: 2829436 - RNA, 12 nt, Mycobacterium avium subsp. paratuberculosis
cgccgcgcaccc

SEQ ID NO: 2829437 - RNA, 14 nt, Mycobacterium avium subsp. paratuberculosis
cgccgcgcaccccg

SEQ ID NO: 2829438 - RNA, 15 nt, Mycobacterium avium subsp. paratuberculosis
cgccgcgcaccccga

SEQ ID NO: 2829439 - RNA, 13 nt, Mycobacterium avium subsp. paratuberculosis
cgccgcgcacccg

SEQ ID NO: 2829440 - RNA, 19 nt, Mycobacterium avium subsp. paratuberculosis
cgccgcgcacccggccacg

SEQ ID NO: 2829441 - RNA, 23 nt, Mycobacterium avium subsp. paratuberculosis
cgccgcgcacccggccacgccgg

SEQ ID NO: 2829442 - RNA, 13 nt, Mycobacterium avium subsp. paratuberculosis
cgccgcgcaccgc

SEQ ID NO: 2829443 - RNA, 13 nt, Mycobacterium avium subsp. paratuberculosis
cgccgcgcacgac

SEQ ID NO: 2829444 - RNA, 15 nt, Mycobacterium avium subsp. paratuberculosis
cgccgcgcagcaccg

SEQ ID NO: 2829445 - RNA, 20 nt, Mycobacterium avium subsp. paratuberculosis
cgccgcgcagcaccgcgucg

SEQ ID NO: 2829446 - RNA, 14 nt, Mycobacterium avium subsp. paratuberculosis
cgccgcgcagccag

SEQ ID NO: 2829447 - RNA, 23 nt, Mycobacterium avium subsp. paratuberculosis
cgccgcgcagccagaccucgccg

SEQ ID NO: 2829448 - RNA, 17 nt, Mycobacterium avium subsp. paratuberculosis
cgccgcgcagcggggcg

SEQ ID NO: 2829449 - RNA, 22 nt, Mycobacterium avium subsp. paratuberculosis
cgccgcgcagcggggcgcgcag

SEQ ID NO: 2829450 - RNA, 18 nt, Mycobacterium avium subsp. paratuberculosis
cgccgcgcauccgcaccg

SEQ ID NO: 2829451 - RNA, 19 nt, Mycobacterium avium subsp. paratuberculosis
cgccgcgcauucaccagcu

SEQ ID NO: 2829452 - RNA, 20 nt, Mycobacterium avium subsp. paratuberculosis
cgccgcgcauucaccagcug

SEQ ID NO: 2829453 - RNA, 12 nt, Mycobacterium avium subsp. paratuberculosis
cgccgcgccacc

SEQ ID NO: 2829454 - RNA, 13 nt, Mycobacterium avium subsp. paratuberculosis
cgccgcgccaccg

SEQ ID NO: 2829455 - RNA, 15 nt, Mycobacterium avium subsp. paratuberculosis
cgccgcgccaccgag

SEQ ID NO: 2829456 - RNA, 14 nt, Mycobacterium avium subsp. paratuberculosis
cgccgcgccagcac

SEQ ID NO: 2829457 - RNA, 15 nt, Mycobacterium avium subsp. paratuberculosis
cgccgcgccagcacc

SEQ ID NO: 2829458 - RNA, 16 nt, Mycobacterium avium subsp. paratuberculosis
cgccgcgccagcaccu

SEQ ID NO: 2829459 - RNA, 23 nt, Mycobacterium avium subsp. paratuberculosis
cgccgcgccagcaccucggcgac

SEQ ID NO: 2829460 - RNA, 13 nt, Mycobacterium avium subsp. paratuberculosis
cgccgcgcccagc

SEQ ID NO: 2829461 - RNA, 14 nt, Mycobacterium avium subsp. paratuberculosis
cgccgcgcccagca

SEQ ID NO: 2829462 - RNA, 16 nt, Mycobacterium avium subsp. paratuberculosis
cgccgcgcccagcacg

SEQ ID NO: 2829463 - RNA, 22 nt, Mycobacterium avium subsp. paratuberculosis
cgccgcgcccagcacgucaccg

SEQ ID NO: 2829464 - RNA, 14 nt, Mycobacterium avium subsp. paratuberculosis
cgccgcgcccgccg

SEQ ID NO: 2829465 - RNA, 15 nt, Mycobacterium avium subsp. paratuberculosis
cgccgcgcccgccgg

SEQ ID NO: 2829466 - RNA, 17 nt, Mycobacterium avium subsp. paratuberculosis
cgccgcgcccgccggcc

SEQ ID NO: 2829467 - RNA, 18 nt, Mycobacterium avium subsp. paratuberculosis
cgccgcgcccgccggccc

SEQ ID NO: 2829468 - RNA, 19 nt, Mycobacterium avium subsp. paratuberculosis
cgccgcgcccgccggccca

SEQ ID NO: 2829469 - RNA, 14 nt, Mycobacterium avium subsp. paratuberculosis
cgccgcgcccgucg

SEQ ID NO: 2829470 - RNA, 16 nt, Mycobacterium avium subsp. paratuberculosis
cgccgcgcccgucgag

SEQ ID NO: 2829471 - RNA, 22 nt, Mycobacterium avium subsp. paratuberculosis
cgccgcgcccgucgagcgucau

SEQ ID NO: 2829472 - RNA, 13 nt, Mycobacterium avium subsp. paratuberculosis
cgccgcgccgagg

SEQ ID NO: 2829473 - RNA, 13 nt, Mycobacterium avium subsp. paratuberculosis
cgccgcgccgccc

SEQ ID NO: 2829474 - RNA, 16 nt, Mycobacterium avium subsp. paratuberculosis
cgccgcgccgcccggc

SEQ ID NO: 2829475 - RNA, 15 nt, Mycobacterium avium subsp. paratuberculosis
cgccgcgccgccggu

SEQ ID NO: 2829476 - RNA, 13 nt, Mycobacterium avium subsp. paratuberculosis
cgccgcgccggca

SEQ ID NO: 2829477 - RNA, 14 nt, Mycobacterium avium subsp. paratuberculosis
cgccgcgccggcac

SEQ ID NO: 2829478 - RNA, 13 nt, Mycobacterium avium subsp. paratuberculosis
cgccgcgccgggc

SEQ ID NO: 2829479 - RNA, 14 nt, Mycobacterium avium subsp. paratuberculosis
cgccgcgccgggcg

SEQ ID NO: 2829480 - RNA, 17 nt, Mycobacterium avium subsp. paratuberculosis
cgccgcgccgggcgccc

SEQ ID NO: 2829481 - RNA, 14 nt, Mycobacterium avium subsp. paratuberculosis
cgccgcgcgccagc

SEQ ID NO: 2829482 - RNA, 17 nt, Mycobacterium avium subsp. paratuberculosis
cgccgcgcgccagcgcg

SEQ ID NO: 2829483 - RNA, 19 nt, Mycobacterium avium subsp. paratuberculosis
cgccgcgcgcgcggccucc

SEQ ID NO: 2829484 - RNA, 22 nt, Mycobacterium avium subsp. paratuberculosis
cgccgcgcgcgcggccuccagc

SEQ ID NO: 2829485 - RNA, 15 nt, Mycobacterium avium subsp. paratuberculosis
cgccgcgcgcggcca

SEQ ID NO: 2829486 - RNA, 16 nt, Mycobacterium avium subsp. paratuberculosis
cgccgcgcgcggccac

SEQ ID NO: 2829487 - RNA, 13 nt, Mycobacterium avium subsp. paratuberculosis
cgccgcgcggccc

SEQ ID NO: 2829488 - RNA, 14 nt, Mycobacterium avium subsp. paratuberculosis
cgccgcgcggcccg

SEQ ID NO: 2829489 - RNA, 15 nt, Mycobacterium avium subsp. paratuberculosis
cgccgcgcggcccgc

SEQ ID NO: 2829490 - RNA, 15 nt, Mycobacterium avium subsp. paratuberculosis
cgccgcgcggccggg

SEQ ID NO: 2829491 - RNA, 17 nt, Mycobacterium avium subsp. paratuberculosis
cgccgcgcggccgggcu

SEQ ID NO: 2829492 - RNA, 13 nt, Mycobacterium avium subsp. paratuberculosis
cgccgcgcgggua

SEQ ID NO: 2829493 - RNA, 22 nt, Mycobacterium avium subsp. paratuberculosis
cgccgcgcggguacggcggccg

SEQ ID NO: 2829494 - RNA, 19 nt, Mycobacterium avium subsp. paratuberculosis
cgccgcgcguuccagcacg

SEQ ID NO: 2829495 - RNA, 21 nt, Mycobacterium avium subsp. paratuberculosis
cgccgcgcucaacccgggccg

SEQ ID NO: 2829496 - RNA, 12 nt, Mycobacterium avium subsp. paratuberculosis
cgccgcgcucgc

SEQ ID NO: 2829497 - RNA, 19 nt, Mycobacterium avium subsp. paratuberculosis
cgccgcgcucgcaccagcg

SEQ ID NO: 2829498 - RNA, 13 nt, Mycobacterium avium subsp. paratuberculosis
cgccgcgcucggc

SEQ ID NO: 2829499 - RNA, 20 nt, Mycobacterium avium subsp. paratuberculosis
cgccgcgcucggccauccgg

SEQ ID NO: 2829500 - RNA, 15 nt, Mycobacterium avium subsp. paratuberculosis
cgccgcgcucgugcu

SEQ ID NO: 2829501 - RNA, 20 nt, Mycobacterium avium subsp. paratuberculosis
cgccgcgcucgugcugcugc

SEQ ID NO: 2829502 - RNA, 14 nt, Mycobacterium avium subsp. paratuberculosis
cgccgcgcuggccg

SEQ ID NO: 2829503 - RNA, 20 nt, Mycobacterium avium subsp. paratuberculosis
cgccgcgcuggccgaucccg

SEQ ID NO: 2829504 - RNA, 14 nt, Mycobacterium avium subsp. paratuberculosis
cgccgcgcuugacg

SEQ ID NO: 2829505 - RNA, 17 nt, Mycobacterium avium subsp. paratuberculosis
cgccgcgcuugacggcc

SEQ ID NO: 2829506 - RNA, 15 nt, Mycobacterium avium subsp. paratuberculosis
cgccgcgcuugcgac

SEQ ID NO: 2829507 - RNA, 19 nt, Mycobacterium avium subsp. paratuberculosis
cgccgcgcuugcgaccgcc

SEQ ID NO: 2829508 - RNA, 20 nt, Mycobacterium avium subsp. paratuberculosis
cgccgcgcuugcgaccgccg

SEQ ID NO: 2829509 - RNA, 21 nt, Mycobacterium avium subsp. paratuberculosis
cgccgcgcuugcgaccgccgc

SEQ ID NO: 2829510 - RNA, 22 nt, Mycobacterium avium subsp. paratuberculosis
cgccgcgcuugcgaccgccgcu

SEQ ID NO: 2829511 - RNA, 20 nt, Mycobacterium avium subsp. paratuberculosis
cgccgcgcuugcgaucgccg

SEQ ID NO: 2829512 - RNA, 21 nt, Mycobacterium avium subsp. paratuberculosis
cgccgcgcuugcgaucgccgc

SEQ ID NO: 2829513 - RNA, 24 nt, Mycobacterium avium subsp. paratuberculosis
cgccgcgcuugcgaucgccgcgca

SEQ ID NO: 2829514 - RNA, 15 nt, Mycobacterium avium subsp. paratuberculosis
cgccgcggaagcccc

SEQ ID NO: 2829515 - RNA, 16 nt, Mycobacterium avium subsp. paratuberculosis
cgccgcggaagcccca

SEQ ID NO: 2829516 - RNA, 13 nt, Mycobacterium avium subsp. paratuberculosis
cgccgcgggugcg

SEQ ID NO: 2829517 - RNA, 20 nt, Mycobacterium avium subsp. paratuberculosis
cgccgcgggugcggcacggc

SEQ ID NO: 2829518 - RNA, 23 nt, Mycobacterium avium subsp. paratuberculosis
cgccgcgggugcggcacggcaug

SEQ ID NO: 2829519 - RNA, 20 nt, Mycobacterium avium subsp. paratuberculosis
cgccgcggguggccagccag

SEQ ID NO: 2829520 - RNA, 20 nt, Mycobacterium avium subsp. paratuberculosis
cgccgcgggugucgcccucg

SEQ ID NO: 2829521 - RNA, 20 nt, Mycobacterium avium subsp. paratuberculosis
cgccgcgguagacaccgccg

SEQ ID NO: 2829522 - RNA, 20 nt, Mycobacterium avium subsp. paratuberculosis
cgccgcgguagcggaccugc

SEQ ID NO: 2829523 - RNA, 14 nt, Mycobacterium avium subsp. paratuberculosis
cgccgcggucaucg

SEQ ID NO: 2829524 - RNA, 15 nt, Mycobacterium avium subsp. paratuberculosis
cgccgcggucaucga

SEQ ID NO: 2829525 - RNA, 17 nt, Mycobacterium avium subsp. paratuberculosis
cgccgcggucaucgagc

SEQ ID NO: 2829526 - RNA, 20 nt, Mycobacterium avium subsp. paratuberculosis
cgccgcggucaucgagccgg

SEQ ID NO: 2829527 - RNA, 17 nt, Mycobacterium avium subsp. paratuberculosis
cgccgcggucgcugacc

SEQ ID NO: 2829528 - RNA, 23 nt, Mycobacterium avium subsp. paratuberculosis
cgccgcggucgcugacccgccgc

SEQ ID NO: 2829529 - RNA, 13 nt, Mycobacterium avium subsp. paratuberculosis
cgccgcggugcag

SEQ ID NO: 2829530 - RNA, 14 nt, Mycobacterium avium subsp. paratuberculosis
cgccgcggugcagc

SEQ ID NO: 2829531 - RNA, 14 nt, Mycobacterium avium subsp. paratuberculosis
cgccgcggugcgcc

SEQ ID NO: 2829532 - RNA, 18 nt, Mycobacterium avium subsp. paratuberculosis
cgccgcggugcgccacgc

SEQ ID NO: 2829533 - RNA, 21 nt, Mycobacterium avium subsp. paratuberculosis
cgccgcggugcgccacgcccg

SEQ ID NO: 2829534 - RNA, 22 nt, Mycobacterium avium subsp. paratuberculosis
cgccgcggugcgccacgcccgc

SEQ ID NO: 2829535 - RNA, 17 nt, Mycobacterium avium subsp. paratuberculosis
cgccgcgguggccggga

SEQ ID NO: 2829536 - RNA, 19 nt, Mycobacterium avium subsp. paratuberculosis
cgccgcgguggccgggaug

SEQ ID NO: 2829537 - RNA, 13 nt, Mycobacterium avium subsp. paratuberculosis
cgccgcgguggcg

SEQ ID NO: 2829538 - RNA, 19 nt, Mycobacterium avium subsp. paratuberculosis
cgccgcgguggcgccgcgg

SEQ ID NO: 2829539 - RNA, 19 nt, Mycobacterium avium subsp. paratuberculosis
cgccgcgguggugggcgcg

SEQ ID NO: 2829540 - RNA, 22 nt, Mycobacterium avium subsp. paratuberculosis
cgccgcgguggugggcgcggug

SEQ ID NO: 2829541 - RNA, 23 nt, Mycobacterium avium subsp. paratuberculosis
cgccgcgguggugggcgcggugg

SEQ ID NO: 2829542 - RNA, 17 nt, Mycobacterium avium subsp. paratuberculosis
cgccgcguacaccggcu

SEQ ID NO: 2829543 - RNA, 16 nt, Mycobacterium avium subsp. paratuberculosis
cgccgcguacagcagc

SEQ ID NO: 2829544 - RNA, 21 nt, Mycobacterium avium subsp. paratuberculosis
cgccgcguacagcagcugccc

SEQ ID NO: 2829545 - RNA, 15 nt, Mycobacterium avium subsp. paratuberculosis
cgccgcguacagcca

SEQ ID NO: 2829546 - RNA, 16 nt, Mycobacterium avium subsp. paratuberculosis
cgccgcguacagccag

SEQ ID NO: 2829547 - RNA, 20 nt, Mycobacterium avium subsp. paratuberculosis
cgccgcguacagccagcccg

SEQ ID NO: 2829548 - RNA, 15 nt, Mycobacterium avium subsp. paratuberculosis
cgccgcguaccagcg

SEQ ID NO: 2829549 - RNA, 16 nt, Mycobacterium avium subsp. paratuberculosis
cgccgcguacgccgcc

SEQ ID NO: 2829550 - RNA, 22 nt, Mycobacterium avium subsp. paratuberculosis
cgccgcguacgccgccuugacg

SEQ ID NO: 2829551 - RNA, 12 nt, Mycobacterium avium subsp. paratuberculosis
cgccgcguccgg

SEQ ID NO: 2829552 - RNA, 13 nt, Mycobacterium avium subsp. paratuberculosis
cgccgcguccggg

SEQ ID NO: 2829553 - RNA, 16 nt, Mycobacterium avium subsp. paratuberculosis
cgccgcguccggggug

SEQ ID NO: 2829554 - RNA, 17 nt, Mycobacterium avium subsp. paratuberculosis
cgccgcguccucgucga

SEQ ID NO: 2829555 - RNA, 20 nt, Mycobacterium avium subsp. paratuberculosis
cgccgcguccucgucgaugc

SEQ ID NO: 2829556 - RNA, 14 nt, Mycobacterium avium subsp. paratuberculosis
cgccgcgucgacgc

SEQ ID NO: 2829557 - RNA, 18 nt, Mycobacterium avium subsp. paratuberculosis
cgccgcgucgacgccgcu

SEQ ID NO: 2829558 - RNA, 14 nt, Mycobacterium avium subsp. paratuberculosis
cgccgcgucgccgc

SEQ ID NO: 2829559 - RNA, 15 nt, Mycobacterium avium subsp. paratuberculosis
cgccgcgucgccgcc

SEQ ID NO: 2829560 - RNA, 17 nt, Mycobacterium avium subsp. paratuberculosis
cgccgcgucgccgccgg

SEQ ID NO: 2829561 - RNA, 20 nt, Mycobacterium avium subsp. paratuberculosis
cgccgcgucgccgccgggcg

SEQ ID NO: 2829562 - RNA, 21 nt, Mycobacterium avium subsp. paratuberculosis
cgccgcgucgccgccgggcgc

SEQ ID NO: 2829563 - RNA, 23 nt, Mycobacterium avium subsp. paratuberculosis
cgccgcgucgccgccgggcgcca

SEQ ID NO: 2829564 - RNA, 14 nt, Mycobacterium avium subsp. paratuberculosis
cgccgcgucgcgcc

SEQ ID NO: 2829565 - RNA, 19 nt, Mycobacterium avium subsp. paratuberculosis
cgccgcgucggucagcgcc

SEQ ID NO: 2829566 - RNA, 20 nt, Mycobacterium avium subsp. paratuberculosis
cgccgcgucggucagcgcca

SEQ ID NO: 2829567 - RNA, 17 nt, Mycobacterium avium subsp. paratuberculosis
cgccgcgucgucaucgu

SEQ ID NO: 2829568 - RNA, 13 nt, Mycobacterium avium subsp. paratuberculosis
cgccgcgucgucg

SEQ ID NO: 2829569 - RNA, 19 nt, Mycobacterium avium subsp. paratuberculosis
cgccgcgucgucgucgacc

SEQ ID NO: 2829570 - RNA, 16 nt, Mycobacterium avium subsp. paratuberculosis
cgccgcgucgugccga

SEQ ID NO: 2829571 - RNA, 19 nt, Mycobacterium avium subsp. paratuberculosis
cgccgcgucgugccgagcg

SEQ ID NO: 2829572 - RNA, 22 nt, Mycobacterium avium subsp. paratuberculosis
cgccgcgucgugccgagcguga

SEQ ID NO: 2829573 - RNA, 15 nt, Mycobacterium avium subsp. paratuberculosis
cgccgcguggccucc

SEQ ID NO: 2829574 - RNA, 23 nt, Mycobacterium avium subsp. paratuberculosis
cgccgcgugggagagcgggaccg

SEQ ID NO: 2829575 - RNA, 18 nt, Mycobacterium avium subsp. paratuberculosis
cgccgcguucacccgcgc

SEQ ID NO: 2829576 - RNA, 20 nt, Mycobacterium avium subsp. paratuberculosis
cgccgcguucacccgcgccc

SEQ ID NO: 2829577 - RNA, 23 nt, Mycobacterium avium subsp. paratuberculosis
cgccgcguucacccgcgcccgca

SEQ ID NO: 2829578 - RNA, 14 nt, Mycobacterium avium subsp. paratuberculosis
cgccgcguucggcg

SEQ ID NO: 2829579 - RNA, 17 nt, Mycobacterium avium subsp. paratuberculosis
cgccgcguucggcggcg

SEQ ID NO: 2829580 - RNA, 18 nt, Mycobacterium avium subsp. paratuberculosis
cgccgcguucggcggcgc

SEQ ID NO: 2829581 - RNA, 17 nt, Mycobacterium avium subsp. paratuberculosis
cgccgcguugucggcgu

SEQ ID NO: 2829582 - RNA, 18 nt, Mycobacterium avium subsp. paratuberculosis
cgccgcguugucggcguc

SEQ ID NO: 2829583 - RNA, 20 nt, Mycobacterium avium subsp. paratuberculosis
cgccgcguugucggcguccu

SEQ ID NO: 2829584 - RNA, 19 nt, Mycobacterium avium subsp. paratuberculosis
cgccgcuagaccgauggcg

SEQ ID NO: 2829585 - RNA, 23 nt, Mycobacterium avium subsp. paratuberculosis
cgccgcuagaccgauggcggcgg

SEQ ID NO: 2829586 - RNA, 22 nt, Mycobacterium avium subsp. paratuberculosis
cgccgcuagguuuggccagcac

SEQ ID NO: 2829587 - RNA, 18 nt, Mycobacterium avium subsp. paratuberculosis
cgccgcuagucgcccagc

SEQ ID NO: 2829588 - RNA, 19 nt, Mycobacterium avium subsp. paratuberculosis
cgccgcuagucgcccagca

SEQ ID NO: 2829589 - RNA, 21 nt, Mycobacterium avium subsp. paratuberculosis
cgccgcuagucgcccagcagc

SEQ ID NO: 2829590 - RNA, 12 nt, Mycobacterium avium subsp. paratuberculosis
cgccgcucaccg

SEQ ID NO: 2829591 - RNA, 13 nt, Mycobacterium avium subsp. paratuberculosis
cgccgcucaccgc

SEQ ID NO: 2829592 - RNA, 15 nt, Mycobacterium avium subsp. paratuberculosis
cgccgcucaccgccg

SEQ ID NO: 2829593 - RNA, 17 nt, Mycobacterium avium subsp. paratuberculosis
cgccgcucaccgccgag

SEQ ID NO: 2829594 - RNA, 19 nt, Mycobacterium avium subsp. paratuberculosis
cgccgcucaccgccgagcc

SEQ ID NO: 2829595 - RNA, 20 nt, Mycobacterium avium subsp. paratuberculosis
cgccgcucaccgccgagccg

SEQ ID NO: 2829596 - RNA, 18 nt, Mycobacterium avium subsp. paratuberculosis
cgccgcucagcgauugcg

SEQ ID NO: 2829597 - RNA, 19 nt, Mycobacterium avium subsp. paratuberculosis
cgccgcucgaccccucggc

SEQ ID NO: 2829598 - RNA, 23 nt, Mycobacterium avium subsp. paratuberculosis
cgccgcucggaguucgcccgcag

SEQ ID NO: 2829599 - RNA, 14 nt, Mycobacterium avium subsp. paratuberculosis
cgccgcucggccag

SEQ ID NO: 2829600 - RNA, 14 nt, Mycobacterium avium subsp. paratuberculosis
cgccggaucgccga

SEQ ID NO: 2829601 - RNA, 13 nt, Mycobacterium avium subsp. paratuberculosis
cgccggaucggca

SEQ ID NO: 2829602 - RNA, 20 nt, Mycobacterium avium subsp. paratuberculosis
cgccggaucggcagcgcguu

SEQ ID NO: 2829603 - RNA, 15 nt, Mycobacterium avium subsp. paratuberculosis
cgccggaucggcccc

SEQ ID NO: 2829604 - RNA, 16 nt, Mycobacterium avium subsp. paratuberculosis
cgccggaugccagcag

SEQ ID NO: 2829605 - RNA, 17 nt, Mycobacterium avium subsp. paratuberculosis
cgccggaugccagcagg

SEQ ID NO: 2829606 - RNA, 15 nt, Mycobacterium avium subsp. paratuberculosis
cgccggaugcggcuc

SEQ ID NO: 2829607 - RNA, 14 nt, Mycobacterium avium subsp. paratuberculosis
cgccggaugcugcg

SEQ ID NO: 2829608 - RNA, 13 nt, Mycobacterium avium subsp. paratuberculosis
cgccggaugggcg

SEQ ID NO: 2829609 - RNA, 15 nt, Mycobacterium avium subsp. paratuberculosis
cgccggaugguccgc

SEQ ID NO: 2829610 - RNA, 23 nt, Mycobacterium avium subsp. paratuberculosis
cgccggauuacucgccggcggcg

SEQ ID NO: 2829611 - RNA, 16 nt, Mycobacterium avium subsp. paratuberculosis
cgccggauucggcgcg

SEQ ID NO: 2829612 - RNA, 18 nt, Mycobacterium avium subsp. paratuberculosis
cgccggauucggcgcggc

SEQ ID NO: 2829613 - RNA, 19 nt, Mycobacterium avium subsp. paratuberculosis
cgccggauucggcgcggcu

SEQ ID NO: 2829614 - RNA, 16 nt, Mycobacterium avium subsp. paratuberculosis
cgccggauuggcgucg

SEQ ID NO: 2829615 - RNA, 20 nt, Mycobacterium avium subsp. paratuberculosis
cgccggauuggcgucggugg

SEQ ID NO: 2829616 - RNA, 19 nt, Mycobacterium avium subsp. paratuberculosis
cgccggcaacuggccgccc

SEQ ID NO: 2829617 - RNA, 21 nt, Mycobacterium avium subsp. paratuberculosis
cgccggcaacuggccgcccgg

SEQ ID NO: 2829618 - RNA, 18 nt, Mycobacterium avium subsp. paratuberculosis
cgccggcacaccgagcga

SEQ ID NO: 2829619 - RNA, 20 nt, Mycobacterium avium subsp. paratuberculosis
cgccggcacaccgagcgagc

SEQ ID NO: 2829620 - RNA, 13 nt, Mycobacterium avium subsp. paratuberculosis
cgccggcaccagc

SEQ ID NO: 2829621 - RNA, 14 nt, Mycobacterium avium subsp. paratuberculosis
cgccggcaccagca

SEQ ID NO: 2829622 - RNA, 16 nt, Mycobacterium avium subsp. paratuberculosis
cgccggcaccagcagc

SEQ ID NO: 2829623 - RNA, 17 nt, Mycobacterium avium subsp. paratuberculosis
cgccggcaccagcagcc

SEQ ID NO: 2829624 - RNA, 19 nt, Mycobacterium avium subsp. paratuberculosis
cgccggcaccagcagccgc

SEQ ID NO: 2829625 - RNA, 21 nt, Mycobacterium avium subsp. paratuberculosis
cgccggcaccagcagccgcag

SEQ ID NO: 2829626 - RNA, 22 nt, Mycobacterium avium subsp. paratuberculosis
cgccggcaccagcagccgcagc

SEQ ID NO: 2829627 - RNA, 18 nt, Mycobacterium avium subsp. paratuberculosis
cgccggcacucgucgugg

SEQ ID NO: 2829628 - RNA, 22 nt, Mycobacterium avium subsp. paratuberculosis
cgccggcacucgucguggcggu

SEQ ID NO: 2829629 - RNA, 23 nt, Mycobacterium avium subsp. paratuberculosis
cgccggcacucgucguggcggug

SEQ ID NO: 2829630 - RNA, 16 nt, Mycobacterium avium subsp. paratuberculosis
cgccggcacugcugcc

SEQ ID NO: 2829631 - RNA, 19 nt, Mycobacterium avium subsp. paratuberculosis
cgccggcacugcugcccgc

SEQ ID NO: 2829632 - RNA, 22 nt, Mycobacterium avium subsp. paratuberculosis
cgccggcagauugguucggccg

SEQ ID NO: 2829633 - RNA, 14 nt, Mycobacterium avium subsp. paratuberculosis
cgccggcagccgcu

SEQ ID NO: 2829634 - RNA, 17 nt, Mycobacterium avium subsp. paratuberculosis
cgccggcagccgcucgg

SEQ ID NO: 2829635 - RNA, 16 nt, Mycobacterium avium subsp. paratuberculosis
cgccggcagcggccgc

SEQ ID NO: 2829636 - RNA, 17 nt, Mycobacterium avium subsp. paratuberculosis
cgccggcagcggcugcu

SEQ ID NO: 2829637 - RNA, 20 nt, Mycobacterium avium subsp. paratuberculosis
cgccggcaguccggacacgg

SEQ ID NO: 2829638 - RNA, 16 nt, Mycobacterium avium subsp. paratuberculosis
cgccggcaucagcgag

SEQ ID NO: 2829639 - RNA, 17 nt, Mycobacterium avium subsp. paratuberculosis
cgccggcaucagcgaga

SEQ ID NO: 2829640 - RNA, 19 nt, Mycobacterium avium subsp. paratuberculosis
cgccggcaucagcgagacg

SEQ ID NO: 2829641 - RNA, 16 nt, Mycobacterium avium subsp. paratuberculosis
cgccggcauccagcac

SEQ ID NO: 2829642 - RNA, 21 nt, Mycobacterium avium subsp. paratuberculosis
cgccggcauccagcacggccg

SEQ ID NO: 2829643 - RNA, 18 nt, Mycobacterium avium subsp. paratuberculosis
cgccggcaucgaccgccc

SEQ ID NO: 2829644 - RNA, 20 nt, Mycobacterium avium subsp. paratuberculosis
cgccggcaucgaccgcccgc

SEQ ID NO: 2829645 - RNA, 23 nt, Mycobacterium avium subsp. paratuberculosis
cgccggccaccaacaggucggcg

SEQ ID NO: 2829646 - RNA, 13 nt, Mycobacterium avium subsp. paratuberculosis
cgccggccaccag

SEQ ID NO: 2829647 - RNA, 15 nt, Mycobacterium avium subsp. paratuberculosis
cgccggccaccaggg

SEQ ID NO: 2829648 - RNA, 23 nt, Mycobacterium avium subsp. paratuberculosis
cgccggccaccagggucucgcgc

SEQ ID NO: 2829649 - RNA, 21 nt, Mycobacterium avium subsp. paratuberculosis
cgccggccacguaguccgacg

SEQ ID NO: 2829650 - RNA, 16 nt, Mycobacterium avium subsp. paratuberculosis
cgccggccagcaccac

SEQ ID NO: 2829651 - RNA, 14 nt, Mycobacterium avium subsp. paratuberculosis
cgccggccagcacg

SEQ ID NO: 2829652 - RNA, 15 nt, Mycobacterium avium subsp. paratuberculosis
cgccggccagcacgc

SEQ ID NO: 2829653 - RNA, 21 nt, Mycobacterium avium subsp. paratuberculosis
cgccggccagcacgccguccu

SEQ ID NO: 2829654 - RNA, 16 nt, Mycobacterium avium subsp. paratuberculosis
cgccggccagcacggc

SEQ ID NO: 2829655 - RNA, 22 nt, Mycobacterium avium subsp. paratuberculosis
cgccggccagcacggccagcca

SEQ ID NO: 2829656 - RNA, 24 nt, Mycobacterium avium subsp. paratuberculosis
cgccggccagcacggccagccagc

SEQ ID NO: 2829657 - RNA, 17 nt, Mycobacterium avium subsp. paratuberculosis
cgccggccagcacggcg

SEQ ID NO: 2829658 - RNA, 21 nt, Mycobacterium avium subsp. paratuberculosis
cgccggccagcacggcggcgu

SEQ ID NO: 2829659 - RNA, 22 nt, Mycobacterium avium subsp. paratuberculosis
cgccggccagcacggcggcgug

SEQ ID NO: 2829660 - RNA, 13 nt, Mycobacterium avium subsp. paratuberculosis
cgccggccagcag

SEQ ID NO: 2829661 - RNA, 14 nt, Mycobacterium avium subsp. paratuberculosis
cgccggccagcagc

SEQ ID NO: 2829662 - RNA, 15 nt, Mycobacterium avium subsp. paratuberculosis
cgccggccagcagca

SEQ ID NO: 2829663 - RNA, 16 nt, Mycobacterium avium subsp. paratuberculosis
cgccggccagcagcag

SEQ ID NO: 2829664 - RNA, 13 nt, Mycobacterium avium subsp. paratuberculosis
cgccggccagccg

SEQ ID NO: 2829665 - RNA, 16 nt, Mycobacterium avium subsp. paratuberculosis
cgccggccagccggcu

SEQ ID NO: 2829666 - RNA, 12 nt, Mycobacterium avium subsp. paratuberculosis
cgccggccagcg

SEQ ID NO: 2829667 - RNA, 16 nt, Mycobacterium avium subsp. paratuberculosis
cgccggccagcggcuu

SEQ ID NO: 2829668 - RNA, 22 nt, Mycobacterium avium subsp. paratuberculosis
cgccggccagcggcuuggccgu

SEQ ID NO: 2829669 - RNA, 16 nt, Mycobacterium avium subsp. paratuberculosis
cgccggccagcuccgc

SEQ ID NO: 2829670 - RNA, 18 nt, Mycobacterium avium subsp. paratuberculosis
cgccggccagcuccgcca

SEQ ID NO: 2829671 - RNA, 19 nt, Mycobacterium avium subsp. paratuberculosis
cgccggccagcuccgccac

SEQ ID NO: 2829672 - RNA, 20 nt, Mycobacterium avium subsp. paratuberculosis
cgccggccagcuccgccacc

SEQ ID NO: 2829673 - RNA, 14 nt, Mycobacterium avium subsp. paratuberculosis
cgccggccaggaug

SEQ ID NO: 2829674 - RNA, 12 nt, Mycobacterium avium subsp. paratuberculosis
cgccggccaggc

SEQ ID NO: 2829675 - RNA, 13 nt, Mycobacterium avium subsp. paratuberculosis
cgccggccaggcc

SEQ ID NO: 2829676 - RNA, 14 nt, Mycobacterium avium subsp. paratuberculosis
cgccggccaggccg

SEQ ID NO: 2829677 - RNA, 15 nt, Mycobacterium avium subsp. paratuberculosis
cgccggccaggcgac

SEQ ID NO: 2829678 - RNA, 16 nt, Mycobacterium avium subsp. paratuberculosis
cgccggccaggcgacu

SEQ ID NO: 2829679 - RNA, 20 nt, Mycobacterium avium subsp. paratuberculosis
cgccggccaggcgacugucc

SEQ ID NO: 2829680 - RNA, 15 nt, Mycobacterium avium subsp. paratuberculosis
cgccggcccagacgg

SEQ ID NO: 2829681 - RNA, 16 nt, Mycobacterium avium subsp. paratuberculosis
cgccggcccagcucca

SEQ ID NO: 2829682 - RNA, 20 nt, Mycobacterium avium subsp. paratuberculosis
cgccggcccagcuccacgcg

SEQ ID NO: 2829683 - RNA, 12 nt, Mycobacterium avium subsp. paratuberculosis
cgccggcccagg

SEQ ID NO: 2829684 - RNA, 13 nt, Mycobacterium avium subsp. paratuberculosis
cgccggcccaggc

SEQ ID NO: 2829685 - RNA, 20 nt, Mycobacterium avium subsp. paratuberculosis
cgccggcgcgcgagcgucac

SEQ ID NO: 2829686 - RNA, 16 nt, Mycobacterium avium subsp. paratuberculosis
cgccggcgcgcugaag

SEQ ID NO: 2829687 - RNA, 11 nt, Mycobacterium avium subsp. paratuberculosis
cgccggcgcgg

SEQ ID NO: 2829688 - RNA, 13 nt, Mycobacterium avium subsp. paratuberculosis
cgccggcgcggaa

SEQ ID NO: 2829689 - RNA, 19 nt, Mycobacterium avium subsp. paratuberculosis
cgccggcgcggacggaucg

SEQ ID NO: 2829690 - RNA, 20 nt, Mycobacterium avium subsp. paratuberculosis
cgccggcgcggacggaucga

SEQ ID NO: 2829691 - RNA, 14 nt, Mycobacterium avium subsp. paratuberculosis
cgccggcgcggcca

SEQ ID NO: 2829692 - RNA, 16 nt, Mycobacterium avium subsp. paratuberculosis
cgccggcgcggccagc

SEQ ID NO: 2829693 - RNA, 17 nt, Mycobacterium avium subsp. paratuberculosis
cgccggcgcggccagcu

SEQ ID NO: 2829694 - RNA, 19 nt, Mycobacterium avium subsp. paratuberculosis
cgccggcgcgggccgcagc

SEQ ID NO: 2829695 - RNA, 19 nt, Mycobacterium avium subsp. paratuberculosis
cgccggcgcgggggcggcc

SEQ ID NO: 2829696 - RNA, 12 nt, Mycobacterium avium subsp. paratuberculosis
cgccggcgcggu

SEQ ID NO: 2829697 - RNA, 14 nt, Mycobacterium avium subsp. paratuberculosis
cgccggcgcguccg

SEQ ID NO: 2829698 - RNA, 20 nt, Mycobacterium avium subsp. paratuberculosis
cgccggcgcguccggaggug

SEQ ID NO: 2829699 - RNA, 16 nt, Mycobacterium avium subsp. paratuberculosis
cgccggcgcuggcgcg

SEQ ID NO: 2829700 - RNA, 19 nt, Mycobacterium avium subsp. paratuberculosis
cgccggcgcuggcgcgccg

SEQ ID NO: 2829701 - RNA, 13 nt, Mycobacterium avium subsp. paratuberculosis
cgccggcggccaa

SEQ ID NO: 2829702 - RNA, 16 nt, Mycobacterium avium subsp. paratuberculosis
cgccggcggccacgau

SEQ ID NO: 2829703 - RNA, 20 nt, Mycobacterium avium subsp. paratuberculosis
cgccggcggccacgaucgcg

SEQ ID NO: 2829704 - RNA, 12 nt, Mycobacterium avium subsp. paratuberculosis
cgccggcggccg

SEQ ID NO: 2829705 - RNA, 13 nt, Mycobacterium avium subsp. paratuberculosis
cgccggcggccgc

SEQ ID NO: 2829706 - RNA, 23 nt, Mycobacterium avium subsp. paratuberculosis
cgccggcggccgccacgcuggug

SEQ ID NO: 2829707 - RNA, 16 nt, Mycobacterium avium subsp. paratuberculosis
cgccggcggccgccgc

SEQ ID NO: 2829708 - RNA, 17 nt, Mycobacterium avium subsp. paratuberculosis
cgccggcggccgccgcc

SEQ ID NO: 2829709 - RNA, 18 nt, Mycobacterium avium subsp. paratuberculosis
cgccggcggccgccgccc

SEQ ID NO: 2829710 - RNA, 14 nt, Mycobacterium avium subsp. paratuberculosis
cgccggcggccgcg

SEQ ID NO: 2829711 - RNA, 16 nt, Mycobacterium avium subsp. paratuberculosis
cgccggcggccgcgac

SEQ ID NO: 2829712 - RNA, 13 nt, Mycobacterium avium subsp. paratuberculosis
cgccggcggccuc

SEQ ID NO: 2829713 - RNA, 19 nt, Mycobacterium avium subsp. paratuberculosis
cgccggcggccuccgccac

SEQ ID NO: 2829714 - RNA, 22 nt, Mycobacterium avium subsp. paratuberculosis
cgccggcggccuccgccaccuc

SEQ ID NO: 2829715 - RNA, 12 nt, Mycobacterium avium subsp. paratuberculosis
cgccggcggcga

SEQ ID NO: 2829716 - RNA, 15 nt, Mycobacterium avium subsp. paratuberculosis
cgccggcggcgaucg

SEQ ID NO: 2829717 - RNA, 14 nt, Mycobacterium avium subsp. paratuberculosis
cgccggcggcgaug

SEQ ID NO: 2829718 - RNA, 19 nt, Mycobacterium avium subsp. paratuberculosis
cgccggcggcgaugaucgg

SEQ ID NO: 2829719 - RNA, 12 nt, Mycobacterium avium subsp. paratuberculosis
cgccggcggcgc

SEQ ID NO: 2829720 - RNA, 16 nt, Mycobacterium avium subsp. paratuberculosis
cgccggcggcgcccgc

SEQ ID NO: 2829721 - RNA, 16 nt, Mycobacterium avium subsp. paratuberculosis
cgccggcggcgccgga

SEQ ID NO: 2829722 - RNA, 14 nt, Mycobacterium avium subsp. paratuberculosis
cgccggcggcggcg

SEQ ID NO: 2829723 - RNA, 16 nt, Mycobacterium avium subsp. paratuberculosis
cgccggcggcggcggu

SEQ ID NO: 2829724 - RNA, 17 nt, Mycobacterium avium subsp. paratuberculosis
cgccggcggggcgucgc

SEQ ID NO: 2829725 - RNA, 12 nt, Mycobacterium avium subsp. paratuberculosis
cgccggcggggg

SEQ ID NO: 2829726 - RNA, 22 nt, Mycobacterium avium subsp. paratuberculosis
cgccggcggggguucgacguca

SEQ ID NO: 2829727 - RNA, 21 nt, Mycobacterium avium subsp. paratuberculosis
cgccggcgggugagccggucg

SEQ ID NO: 2829728 - RNA, 19 nt, Mycobacterium avium subsp. paratuberculosis
cgccggcggguuggccguc

SEQ ID NO: 2829729 - RNA, 20 nt, Mycobacterium avium subsp. paratuberculosis
cgccggcggguuggccgucg

SEQ ID NO: 2829730 - RNA, 21 nt, Mycobacterium avium subsp. paratuberculosis
cgccggcggguuggccgucga

SEQ ID NO: 2829731 - RNA, 13 nt, Mycobacterium avium subsp. paratuberculosis
cgccggcgguaug

SEQ ID NO: 2829732 - RNA, 14 nt, Mycobacterium avium subsp. paratuberculosis
cgccggcgguaugc

SEQ ID NO: 2829733 - RNA, 22 nt, Mycobacterium avium subsp. paratuberculosis
cgccggcgguaugcccgggccg

SEQ ID NO: 2829734 - RNA, 12 nt, Mycobacterium avium subsp. paratuberculosis
cgccggcggucg

SEQ ID NO: 2829735 - RNA, 13 nt, Mycobacterium avium subsp. paratuberculosis
cgccggcggucga

SEQ ID NO: 2829736 - RNA, 14 nt, Mycobacterium avium subsp. paratuberculosis
cgccggcggucgac

SEQ ID NO: 2829737 - RNA, 15 nt, Mycobacterium avium subsp. paratuberculosis
cgccggcggucgaca

SEQ ID NO: 2829738 - RNA, 17 nt, Mycobacterium avium subsp. paratuberculosis
cgccggcggucgacacg

SEQ ID NO: 2829739 - RNA, 18 nt, Mycobacterium avium subsp. paratuberculosis
cgccggcggucgacacga

SEQ ID NO: 2829740 - RNA, 23 nt, Mycobacterium avium subsp. paratuberculosis
cgccggcggucgacacgaucggc

SEQ ID NO: 2829741 - RNA, 11 nt, Mycobacterium avium subsp. paratuberculosis
cgccggcggug

SEQ ID NO: 2829742 - RNA, 14 nt, Mycobacterium avium subsp. paratuberculosis
cgccggcggugcgg

SEQ ID NO: 2829743 - RNA, 17 nt, Mycobacterium avium subsp. paratuberculosis
cgccggcggugcgggug

SEQ ID NO: 2829744 - RNA, 19 nt, Mycobacterium avium subsp. paratuberculosis
cgccggcggugcggguggu

SEQ ID NO: 2829745 - RNA, 13 nt, Mycobacterium avium subsp. paratuberculosis
cgccggcgguguc

SEQ ID NO: 2829746 - RNA, 14 nt, Mycobacterium avium subsp. paratuberculosis
cgccggcggugucg

SEQ ID NO: 2829747 - RNA, 15 nt, Mycobacterium avium subsp. paratuberculosis
cgccggcggugucga

SEQ ID NO: 2829748 - RNA, 24 nt, Mycobacterium avium subsp. paratuberculosis
cgccggcguagaccagcgacgcca

SEQ ID NO: 2829749 - RNA, 12 nt, Mycobacterium avium subsp. paratuberculosis
cgccggcgucau

SEQ ID NO: 2829750 - RNA, 14 nt, Mycobacterium avium subsp. paratuberculosis
cgccggcguccagc

SEQ ID NO: 2829751 - RNA, 17 nt, Mycobacterium avium subsp. paratuberculosis
cgccggcguccagcgcc

SEQ ID NO: 2829752 - RNA, 19 nt, Mycobacterium avium subsp. paratuberculosis
cgccggcguccagcgccgc

SEQ ID NO: 2829753 - RNA, 14 nt, Mycobacterium avium subsp. paratuberculosis
cgccggcgucgacg

SEQ ID NO: 2829754 - RNA, 15 nt, Mycobacterium avium subsp. paratuberculosis
cgccggcgucgacgu

SEQ ID NO: 2829755 - RNA, 17 nt, Mycobacterium avium subsp. paratuberculosis
cgccggcgucgacgucg

SEQ ID NO: 2829756 - RNA, 18 nt, Mycobacterium avium subsp. paratuberculosis
cgccggcgucgacgucgg

SEQ ID NO: 2829757 - RNA, 13 nt, Mycobacterium avium subsp. paratuberculosis
cgccggcgucggu

SEQ ID NO: 2829758 - RNA, 20 nt, Mycobacterium avium subsp. paratuberculosis
cgccggcgucggugucccgc

SEQ ID NO: 2829759 - RNA, 23 nt, Mycobacterium avium subsp. paratuberculosis
cgccggcgucugcauccggaacc

SEQ ID NO: 2829760 - RNA, 20 nt, Mycobacterium avium subsp. paratuberculosis
cgccggcgugcacaggccgc

SEQ ID NO: 2829761 - RNA, 14 nt, Mycobacterium avium subsp. paratuberculosis
cgccggcgugucgg

SEQ ID NO: 2829762 - RNA, 16 nt, Mycobacterium avium subsp. paratuberculosis
cgccggcgugucggcg

SEQ ID NO: 2829763 - RNA, 21 nt, Mycobacterium avium subsp. paratuberculosis
cgccggcgugucggcgccacc

SEQ ID NO: 2829764 - RNA, 18 nt, Mycobacterium avium subsp. paratuberculosis
cgccggcuaccggcgcug

SEQ ID NO: 2829765 - RNA, 20 nt, Mycobacterium avium subsp. paratuberculosis
cgccggcuaccggcgcugga

SEQ ID NO: 2829766 - RNA, 19 nt, Mycobacterium avium subsp. paratuberculosis
cgccggcuagacgcgcagc

SEQ ID NO: 2829767 - RNA, 16 nt, Mycobacterium avium subsp. paratuberculosis
cgccggcuccaccgcg

SEQ ID NO: 2829768 - RNA, 17 nt, Mycobacterium avium subsp. paratuberculosis
cgccggcuccaccgcgc

SEQ ID NO: 2829769 - RNA, 19 nt, Mycobacterium avium subsp. paratuberculosis
cgccggcuccaccgcgccg

SEQ ID NO: 2829770 - RNA, 17 nt, Mycobacterium avium subsp. paratuberculosis
cgccgggcgcccgagcc

SEQ ID NO: 2829771 - RNA, 18 nt, Mycobacterium avium subsp. paratuberculosis
cgccgggcgcccgagccg

SEQ ID NO: 2829772 - RNA, 14 nt, Mycobacterium avium subsp. paratuberculosis
cgccgggcgcccgc

SEQ ID NO: 2829773 - RNA, 14 nt, Mycobacterium avium subsp. paratuberculosis
cgccgggcggaugu

SEQ ID NO: 2829774 - RNA, 20 nt, Mycobacterium avium subsp. paratuberculosis
cgccgggcggaugucggugu

SEQ ID NO: 2829775 - RNA, 16 nt, Mycobacterium avium subsp. paratuberculosis
cgccgggcggcagcac

SEQ ID NO: 2829776 - RNA, 21 nt, Mycobacterium avium subsp. paratuberculosis
cgccgggcggcagcacgucgu

SEQ ID NO: 2829777 - RNA, 13 nt, Mycobacterium avium subsp. paratuberculosis
cgccgggcggccc

SEQ ID NO: 2829778 - RNA, 21 nt, Mycobacterium avium subsp. paratuberculosis
cgccgggcggcccgccucggc

SEQ ID NO: 2829779 - RNA, 14 nt, Mycobacterium avium subsp. paratuberculosis
cgccgggcggccuc

SEQ ID NO: 2829780 - RNA, 13 nt, Mycobacterium avium subsp. paratuberculosis
cgccgggcggcgu

SEQ ID NO: 2829781 - RNA, 15 nt, Mycobacterium avium subsp. paratuberculosis
cgccgggcggcgucc

SEQ ID NO: 2829782 - RNA, 18 nt, Mycobacterium avium subsp. paratuberculosis
cgccgggcggcguccucg

SEQ ID NO: 2829783 - RNA, 14 nt, Mycobacterium avium subsp. paratuberculosis
cgccgggcgggccg

SEQ ID NO: 2829784 - RNA, 16 nt, Mycobacterium avium subsp. paratuberculosis
cgccgggcgggccgca

SEQ ID NO: 2829785 - RNA, 18 nt, Mycobacterium avium subsp. paratuberculosis
cgccgggcgggccgcagc

SEQ ID NO: 2829786 - RNA, 14 nt, Mycobacterium avium subsp. paratuberculosis
cgccgggcgggcgc

SEQ ID NO: 2829787 - RNA, 19 nt, Mycobacterium avium subsp. paratuberculosis
cgccgggcgggcgcaggug

SEQ ID NO: 2829788 - RNA, 17 nt, Mycobacterium avium subsp. paratuberculosis
cgccgggcggguacugg

SEQ ID NO: 2829789 - RNA, 12 nt, Mycobacterium avium subsp. paratuberculosis
cgccgggcguca

SEQ ID NO: 2829790 - RNA, 17 nt, Mycobacterium avium subsp. paratuberculosis
cgccgggcgucacgcca

SEQ ID NO: 2829791 - RNA, 18 nt, Mycobacterium avium subsp. paratuberculosis
cgccgggcgucacgccag

SEQ ID NO: 2829792 - RNA, 20 nt, Mycobacterium avium subsp. paratuberculosis
cgccgggcgucacgccagcg

SEQ ID NO: 2829793 - RNA, 17 nt, Mycobacterium avium subsp. paratuberculosis
cgccgggcgucacucug

SEQ ID NO: 2829794 - RNA, 13 nt, Mycobacterium avium subsp. paratuberculosis
cgccgggcgucgc

SEQ ID NO: 2829795 - RNA, 18 nt, Mycobacterium avium subsp. paratuberculosis
cgccgggcguugcccgcc

SEQ ID NO: 2829796 - RNA, 19 nt, Mycobacterium avium subsp. paratuberculosis
cgccgggcguugcccgccg

SEQ ID NO: 2829797 - RNA, 20 nt, Mycobacterium avium subsp. paratuberculosis
cgccgggcguugcccgccgc

SEQ ID NO: 2829798 - RNA, 20 nt, Mycobacterium avium subsp. paratuberculosis
cgccgggcugcacgcugcgc

SEQ ID NO: 2829799 - RNA, 19 nt, Mycobacterium avium subsp. paratuberculosis
cgccgggcuggccgucggc

SEQ ID NO: 2829800 - RNA, 21 nt, Mycobacterium avium subsp. paratuberculosis
cgccgggcuggccgucggcga

SEQ ID NO: 2829801 - RNA, 23 nt, Mycobacterium avium subsp. paratuberculosis
cgccgggcuggccgucggcgaug

SEQ ID NO: 2829802 - RNA, 13 nt, Mycobacterium avium subsp. paratuberculosis
cgccgggcugggu

SEQ ID NO: 2829803 - RNA, 15 nt, Mycobacterium avium subsp. paratuberculosis
cgccggggaacaccg

SEQ ID NO: 2829804 - RNA, 21 nt, Mycobacterium avium subsp. paratuberculosis
cgccggggaagaucucggcca

SEQ ID NO: 2829805 - RNA, 23 nt, Mycobacterium avium subsp. paratuberculosis
cgccggggaagaucucggccagg

SEQ ID NO: 2829806 - RNA, 14 nt, Mycobacterium avium subsp. paratuberculosis
cgccggggacccgc

SEQ ID NO: 2829807 - RNA, 18 nt, Mycobacterium avium subsp. paratuberculosis
cgccggggacccgcaccg

SEQ ID NO: 2829808 - RNA, 14 nt, Mycobacterium avium subsp. paratuberculosis
cgccggggacgacg

SEQ ID NO: 2829809 - RNA, 19 nt, Mycobacterium avium subsp. paratuberculosis
cgccggggacgacggcggg

SEQ ID NO: 2829810 - RNA, 23 nt, Mycobacterium avium subsp. paratuberculosis
cgccggggacgacggcggggaug

SEQ ID NO: 2829811 - RNA, 21 nt, Mycobacterium avium subsp. paratuberculosis
cgccggggcccucgcucaacc

SEQ ID NO: 2829812 - RNA, 14 nt, Mycobacterium avium subsp. paratuberculosis
cgccggggccgcgg

SEQ ID NO: 2829813 - RNA, 19 nt, Mycobacterium avium subsp. paratuberculosis
cgccggggccgcggcucgc

SEQ ID NO: 2829814 - RNA, 13 nt, Mycobacterium avium subsp. paratuberculosis
cgccggggccggc

SEQ ID NO: 2829815 - RNA, 14 nt, Mycobacterium avium subsp. paratuberculosis
cgccggggccuucu

SEQ ID NO: 2829816 - RNA, 23 nt, Mycobacterium avium subsp. paratuberculosis
cgccggggccuucuuggcggcgg

SEQ ID NO: 2829817 - RNA, 12 nt, Mycobacterium avium subsp. paratuberculosis
cgccggggcgcc

SEQ ID NO: 2829818 - RNA, 14 nt, Mycobacterium avium subsp. paratuberculosis
cgccggggcgccgc

SEQ ID NO: 2829819 - RNA, 16 nt, Mycobacterium avium subsp. paratuberculosis
cgccggggcgccgccg

SEQ ID NO: 2829820 - RNA, 17 nt, Mycobacterium avium subsp. paratuberculosis
cgccggggcgccgccga

SEQ ID NO: 2829821 - RNA, 20 nt, Mycobacterium avium subsp. paratuberculosis
cgccggggcgccgccgaaca

SEQ ID NO: 2829822 - RNA, 22 nt, Mycobacterium avium subsp. paratuberculosis
cgccggggcggauccccgcgcu

SEQ ID NO: 2829823 - RNA, 17 nt, Mycobacterium avium subsp. paratuberculosis
cgccggggcgggcagca

SEQ ID NO: 2829824 - RNA, 16 nt, Mycobacterium avium subsp. paratuberculosis
cgccggggcgggcggc

SEQ ID NO: 2829825 - RNA, 17 nt, Mycobacterium avium subsp. paratuberculosis
cgccggggcgggcggcg

SEQ ID NO: 2829826 - RNA, 19 nt, Mycobacterium avium subsp. paratuberculosis
cgccggggcgggcggcggc

SEQ ID NO: 2829827 - RNA, 14 nt, Mycobacterium avium subsp. paratuberculosis
cgccggggcgucgg

SEQ ID NO: 2829828 - RNA, 15 nt, Mycobacterium avium subsp. paratuberculosis
cgccggggcgucgga

SEQ ID NO: 2829829 - RNA, 20 nt, Mycobacterium avium subsp. paratuberculosis
cgccggggcucauacggcgg

SEQ ID NO: 2829830 - RNA, 21 nt, Mycobacterium avium subsp. paratuberculosis
cgccggggcucauacggcggc

SEQ ID NO: 2829831 - RNA, 22 nt, Mycobacterium avium subsp. paratuberculosis
cgccggggcucauacggcggcu

SEQ ID NO: 2829832 - RNA, 20 nt, Mycobacterium avium subsp. paratuberculosis
cgccgggggagucggggugc

SEQ ID NO: 2829833 - RNA, 17 nt, Mycobacterium avium subsp. paratuberculosis
cgccgggguccgcaacg

SEQ ID NO: 2829834 - RNA, 21 nt, Mycobacterium avium subsp. paratuberculosis
cgccgggguccgcaacgccgg

SEQ ID NO: 2829835 - RNA, 22 nt, Mycobacterium avium subsp. paratuberculosis
cgccgggguccgcaacgccggc

SEQ ID NO: 2829836 - RNA, 23 nt, Mycobacterium avium subsp. paratuberculosis
cgccgggguccgcaacgccggcg

SEQ ID NO: 2829837 - RNA, 13 nt, Mycobacterium avium subsp. paratuberculosis
cgccgggguccuc

SEQ ID NO: 2829838 - RNA, 18 nt, Mycobacterium avium subsp. paratuberculosis
cgccgggguccucucggc

SEQ ID NO: 2829839 - RNA, 20 nt, Mycobacterium avium subsp. paratuberculosis
cgccgggguccucucggcgc

SEQ ID NO: 2829840 - RNA, 22 nt, Mycobacterium avium subsp. paratuberculosis
cgccgggguccucucggcgccg

SEQ ID NO: 2829841 - RNA, 18 nt, Mycobacterium avium subsp. paratuberculosis
cgccggggucgacagccu

SEQ ID NO: 2829842 - RNA, 14 nt, Mycobacterium avium subsp. paratuberculosis
cgccggggucgcgc

SEQ ID NO: 2829843 - RNA, 15 nt, Mycobacterium avium subsp. paratuberculosis
cgccggggucgcgcg

SEQ ID NO: 2829844 - RNA, 18 nt, Mycobacterium avium subsp. paratuberculosis
cgccggggugcaccgugg

SEQ ID NO: 2829845 - RNA, 21 nt, Mycobacterium avium subsp. paratuberculosis
cgccggggugcaccgugguga

SEQ ID NO: 2829846 - RNA, 23 nt, Mycobacterium avium subsp. paratuberculosis
cgccggggugcaccguggugacc

SEQ ID NO: 2829847 - RNA, 19 nt, Mycobacterium avium subsp. paratuberculosis
cgccggggugggccaucgg

SEQ ID NO: 2829848 - RNA, 20 nt, Mycobacterium avium subsp. paratuberculosis
cgccggggugggccaucggc

SEQ ID NO: 2829849 - RNA, 21 nt, Mycobacterium avium subsp. paratuberculosis
cgccggggugggccaucggca

SEQ ID NO: 2829850 - RNA, 18 nt, Mycobacterium avium subsp. paratuberculosis
cgccgggguguccagcgg

SEQ ID NO: 2829851 - RNA, 16 nt, Mycobacterium avium subsp. paratuberculosis
cgccggggugugcagc

SEQ ID NO: 2829852 - RNA, 14 nt, Mycobacterium avium subsp. paratuberculosis
cgccgggucaccgg

SEQ ID NO: 2829853 - RNA, 17 nt, Mycobacterium avium subsp. paratuberculosis
cgccgggucaccggaug

SEQ ID NO: 2829854 - RNA, 13 nt, Mycobacterium avium subsp. paratuberculosis
cgccggugaccug

SEQ ID NO: 2829855 - RNA, 19 nt, Mycobacterium avium subsp. paratuberculosis
cgccggugagcacgaccgc

SEQ ID NO: 2829856 - RNA, 23 nt, Mycobacterium avium subsp. paratuberculosis
cgccggugagcacgaccgccagc

SEQ ID NO: 2829857 - RNA, 19 nt, Mycobacterium avium subsp. paratuberculosis
cgccggugaucucccgugc

SEQ ID NO: 2829858 - RNA, 22 nt, Mycobacterium avium subsp. paratuberculosis
cgccggugcaguacgcaucggc

SEQ ID NO: 2829859 - RNA, 23 nt, Mycobacterium avium subsp. paratuberculosis
cgccggugcaguacgcaucggcg

SEQ ID NO: 2829860 - RNA, 17 nt, Mycobacterium avium subsp. paratuberculosis
cgccggugcccacgccg

SEQ ID NO: 2829861 - RNA, 18 nt, Mycobacterium avium subsp. paratuberculosis
cgccggugccgcagccgu

SEQ ID NO: 2829862 - RNA, 20 nt, Mycobacterium avium subsp. paratuberculosis
cgccggugccgcagccgucc

SEQ ID NO: 2829863 - RNA, 21 nt, Mycobacterium avium subsp. paratuberculosis
cgccggugccgcagccguccc

SEQ ID NO: 2829864 - RNA, 14 nt, Mycobacterium avium subsp. paratuberculosis
cgccggugccguug

SEQ ID NO: 2829865 - RNA, 21 nt, Mycobacterium avium subsp. paratuberculosis
cgccggugccguugaucaggg

SEQ ID NO: 2829866 - RNA, 23 nt, Mycobacterium avium subsp. paratuberculosis
cgccggugccguugaucagggcg

SEQ ID NO: 2829867 - RNA, 14 nt, Mycobacterium avium subsp. paratuberculosis
cgccggugcggccg

SEQ ID NO: 2829868 - RNA, 15 nt, Mycobacterium avium subsp. paratuberculosis
cgccggugcggccgc

SEQ ID NO: 2829869 - RNA, 17 nt, Mycobacterium avium subsp. paratuberculosis
cgccggugcggccgcga

SEQ ID NO: 2829870 - RNA, 13 nt, Mycobacterium avium subsp. paratuberculosis
cgccggugcgggc

SEQ ID NO: 2829871 - RNA, 18 nt, Mycobacterium avium subsp. paratuberculosis
cgccggugcgggcuggag

SEQ ID NO: 2829872 - RNA, 19 nt, Mycobacterium avium subsp. paratuberculosis
cgccggugcgggcuggagu

SEQ ID NO: 2829873 - RNA, 20 nt, Mycobacterium avium subsp. paratuberculosis
cgccggugcgggcuggagug

SEQ ID NO: 2829874 - RNA, 20 nt, Mycobacterium avium subsp. paratuberculosis
cgccggugcuggucaugccg

SEQ ID NO: 2829875 - RNA, 23 nt, Mycobacterium avium subsp. paratuberculosis
cgccggugcuggucaugccgucg

SEQ ID NO: 2829876 - RNA, 15 nt, Mycobacterium avium subsp. paratuberculosis
cgccgguggccgccg

SEQ ID NO: 2829877 - RNA, 14 nt, Mycobacterium avium subsp. paratuberculosis
cgccgguggccgcg

SEQ ID NO: 2829878 - RNA, 15 nt, Mycobacterium avium subsp. paratuberculosis
cgccgguggccgcgc

SEQ ID NO: 2829879 - RNA, 16 nt, Mycobacterium avium subsp. paratuberculosis
cgccgguggccgcgcu

SEQ ID NO: 2829880 - RNA, 17 nt, Mycobacterium avium subsp. paratuberculosis
cgccgguggcggcgaca

SEQ ID NO: 2829881 - RNA, 16 nt, Mycobacterium avium subsp. paratuberculosis
cgccgguggcggcgag

SEQ ID NO: 2829882 - RNA, 13 nt, Mycobacterium avium subsp. paratuberculosis
cgccgguggcguc

SEQ ID NO: 2829883 - RNA, 14 nt, Mycobacterium avium subsp. paratuberculosis
cgccgguggcgucg

SEQ ID NO: 2829884 - RNA, 16 nt, Mycobacterium avium subsp. paratuberculosis
cgccgguggcgucggu

SEQ ID NO: 2829885 - RNA, 19 nt, Mycobacterium avium subsp. paratuberculosis
cgccgguggcgucggugau

SEQ ID NO: 2829886 - RNA, 18 nt, Mycobacterium avium subsp. paratuberculosis
cgccgguggugcaccggu

SEQ ID NO: 2829887 - RNA, 18 nt, Mycobacterium avium subsp. paratuberculosis
cgccgguggugucgacgg

SEQ ID NO: 2829888 - RNA, 16 nt, Mycobacterium avium subsp. paratuberculosis
cgccgguguagaucgg

SEQ ID NO: 2829889 - RNA, 18 nt, Mycobacterium avium subsp. paratuberculosis
cgccgguguagaucggcu

SEQ ID NO: 2829890 - RNA, 20 nt, Mycobacterium avium subsp. paratuberculosis
cgccgguguagaucggcuca

SEQ ID NO: 2829891 - RNA, 14 nt, Mycobacterium avium subsp. paratuberculosis
cgccggugucggcg

SEQ ID NO: 2829892 - RNA, 15 nt, Mycobacterium avium subsp. paratuberculosis
cgccggugucggcga

SEQ ID NO: 2829893 - RNA, 16 nt, Mycobacterium avium subsp. paratuberculosis
cgccggugucggcgac

SEQ ID NO: 2829894 - RNA, 17 nt, Mycobacterium avium subsp. paratuberculosis
cgccggugucggcgacc

SEQ ID NO: 2829895 - RNA, 19 nt, Mycobacterium avium subsp. paratuberculosis
cgccggugucggcgaccaa

SEQ ID NO: 2829896 - RNA, 15 nt, Mycobacterium avium subsp. paratuberculosis
cgccggugugcagcc

SEQ ID NO: 2829897 - RNA, 19 nt, Mycobacterium avium subsp. paratuberculosis
cgccggugugcagccaccc

SEQ ID NO: 2829898 - RNA, 13 nt, Mycobacterium avium subsp. paratuberculosis
cgccgguguucgg

SEQ ID NO: 2829899 - RNA, 16 nt, Mycobacterium avium subsp. paratuberculosis
cgccgguguucggcgc

SEQ ID NO: 2829900 - RNA, 21 nt, Mycobacterium avium subsp. paratuberculosis
cgccgguguucggcgccagcc

SEQ ID NO: 2829901 - RNA, 19 nt, Mycobacterium avium subsp. paratuberculosis
cgccgguucgcuggcggcc

SEQ ID NO: 2829902 - RNA, 21 nt, Mycobacterium avium subsp. paratuberculosis
cgccgguucgcuggcggccag

SEQ ID NO: 2829903 - RNA, 22 nt, Mycobacterium avium subsp. paratuberculosis
cgccgguucgcuggcggccagc

SEQ ID NO: 2829904 - RNA, 22 nt, Mycobacterium avium subsp. paratuberculosis
cgccgguugaucacccgggucg

SEQ ID NO: 2829905 - RNA, 23 nt, Mycobacterium avium subsp. paratuberculosis
cgccgguugaucacccgggucga

SEQ ID NO: 2829906 - RNA, 22 nt, Mycobacterium avium subsp. paratuberculosis
cgccgguuuccaggacgaugcg

SEQ ID NO: 2829907 - RNA, 16 nt, Mycobacterium avium subsp. paratuberculosis
cgccgguuucgucggu

SEQ ID NO: 2829908 - RNA, 18 nt, Mycobacterium avium subsp. paratuberculosis
cgccgguuucgucggucu

SEQ ID NO: 2829909 - RNA, 17 nt, Mycobacterium avium subsp. paratuberculosis
cgccgguuuucggcgug

SEQ ID NO: 2829910 - RNA, 18 nt, Mycobacterium avium subsp. paratuberculosis
cgccgguuuucggcgugu

SEQ ID NO: 2829911 - RNA, 18 nt, Mycobacterium avium subsp. paratuberculosis
cgccguacagcugguccg

SEQ ID NO: 2829912 - RNA, 21 nt, Mycobacterium avium subsp. paratuberculosis
cgccguacagcugguccggcc

SEQ ID NO: 2829913 - RNA, 22 nt, Mycobacterium avium subsp. paratuberculosis
cgccguacagcugguccggccg

SEQ ID NO: 2829914 - RNA, 23 nt, Mycobacterium avium subsp. paratuberculosis
cgccguacagcugguccggccgg

SEQ ID NO: 2829915 - RNA, 23 nt, Mycobacterium avium subsp. paratuberculosis
cgccguacaucauggcgaacgcc

SEQ ID NO: 2829916 - RNA, 15 nt, Mycobacterium avium subsp. paratuberculosis
cgccguacccgaagc

SEQ ID NO: 2829917 - RNA, 14 nt, Mycobacterium avium subsp. paratuberculosis
cgccguacgcgccg

SEQ ID NO: 2829918 - RNA, 16 nt, Mycobacterium avium subsp. paratuberculosis
cgccguacgcgccggc

SEQ ID NO: 2829919 - RNA, 19 nt, Mycobacterium avium subsp. paratuberculosis
cgccguacuugacgugcga

SEQ ID NO: 2829920 - RNA, 22 nt, Mycobacterium avium subsp. paratuberculosis
cgccguacuugacgugcgacac

SEQ ID NO: 2829921 - RNA, 20 nt, Mycobacterium avium subsp. paratuberculosis
cgccguagaauccgccguug

SEQ ID NO: 2829922 - RNA, 17 nt, Mycobacterium avium subsp. paratuberculosis
cgccguagaucacgccg

SEQ ID NO: 2829923 - RNA, 18 nt, Mycobacterium avium subsp. paratuberculosis
cgccguagaucacgccgg

SEQ ID NO: 2829924 - RNA, 19 nt, Mycobacterium avium subsp. paratuberculosis
cgccguagaucacgccggu

SEQ ID NO: 2829925 - RNA, 22 nt, Mycobacterium avium subsp. paratuberculosis
cgccguagaucacgccggugag

SEQ ID NO: 2829926 - RNA, 14 nt, Mycobacterium avium subsp. paratuberculosis
cgccguagccggcg

SEQ ID NO: 2829927 - RNA, 17 nt, Mycobacterium avium subsp. paratuberculosis
cgccguagccggcggug

SEQ ID NO: 2829928 - RNA, 18 nt, Mycobacterium avium subsp. paratuberculosis
cgccguagccggcggugg

SEQ ID NO: 2829929 - RNA, 17 nt, Mycobacterium avium subsp. paratuberculosis
cgccguagcgccggcaa

SEQ ID NO: 2829930 - RNA, 14 nt, Mycobacterium avium subsp. paratuberculosis
cgccguaggccgcg

SEQ ID NO: 2829931 - RNA, 15 nt, Mycobacterium avium subsp. paratuberculosis
cgccguaggccgcgc

SEQ ID NO: 2829932 - RNA, 14 nt, Mycobacterium avium subsp. paratuberculosis
cgccguagguggcc

SEQ ID NO: 2829933 - RNA, 19 nt, Mycobacterium avium subsp. paratuberculosis
cgccguagguggccaugaa

SEQ ID NO: 2829934 - RNA, 17 nt, Mycobacterium avium subsp. paratuberculosis
cgccguaucccugccag

SEQ ID NO: 2829935 - RNA, 21 nt, Mycobacterium avium subsp. paratuberculosis
cgccguauucgccgacggucu

SEQ ID NO: 2829936 - RNA, 23 nt, Mycobacterium avium subsp. paratuberculosis
cgccguauucgccgacggucugc

SEQ ID NO: 2829937 - RNA, 18 nt, Mycobacterium avium subsp. paratuberculosis
cgccguauuggcaggcga

SEQ ID NO: 2829938 - RNA, 23 nt, Mycobacterium avium subsp. paratuberculosis
cgccgucgccaccaccgcgccgu

SEQ ID NO: 2829939 - RNA, 15 nt, Mycobacterium avium subsp. paratuberculosis
cgccgucgccaccga

SEQ ID NO: 2829940 - RNA, 13 nt, Mycobacterium avium subsp. paratuberculosis
cgccgucgccgac

SEQ ID NO: 2829941 - RNA, 14 nt, Mycobacterium avium subsp. paratuberculosis
cgccgucgccgacg

SEQ ID NO: 2829942 - RNA, 18 nt, Mycobacterium avium subsp. paratuberculosis
cgccgucgccgacguugu

SEQ ID NO: 2829943 - RNA, 14 nt, Mycobacterium avium subsp. paratuberculosis
cgccgucgccgauc

SEQ ID NO: 2829944 - RNA, 17 nt, Mycobacterium avium subsp. paratuberculosis
cgccgucgccgcacgcc

SEQ ID NO: 2829945 - RNA, 13 nt, Mycobacterium avium subsp. paratuberculosis
cgccgucgccgcc

SEQ ID NO: 2829946 - RNA, 14 nt, Mycobacterium avium subsp. paratuberculosis
cgccgucgccgccg

SEQ ID NO: 2829947 - RNA, 16 nt, Mycobacterium avium subsp. paratuberculosis
cgccgucgccgccgug

SEQ ID NO: 2829948 - RNA, 18 nt, Mycobacterium avium subsp. paratuberculosis
cgccgucgccgccgugau

SEQ ID NO: 2829949 - RNA, 14 nt, Mycobacterium avium subsp. paratuberculosis
cgccgucgcgaucg

SEQ ID NO: 2829950 - RNA, 19 nt, Mycobacterium avium subsp. paratuberculosis
cgccgucgcgaucgcgguc

SEQ ID NO: 2829951 - RNA, 22 nt, Mycobacterium avium subsp. paratuberculosis
cgccgucgcgaucgcgguccag

SEQ ID NO: 2829952 - RNA, 13 nt, Mycobacterium avium subsp. paratuberculosis
cgccgucgcgcca

SEQ ID NO: 2829953 - RNA, 14 nt, Mycobacterium avium subsp. paratuberculosis
cgccgucgcgccag

SEQ ID NO: 2829954 - RNA, 13 nt, Mycobacterium avium subsp. paratuberculosis
cgccgucgcgggu

SEQ ID NO: 2829955 - RNA, 23 nt, Mycobacterium avium subsp. paratuberculosis
cgccgucgcggguggggaucagg

SEQ ID NO: 2829956 - RNA, 12 nt, Mycobacterium avium subsp. paratuberculosis
cgccgucggcau

SEQ ID NO: 2829957 - RNA, 13 nt, Mycobacterium avium subsp. paratuberculosis
cgccgucggccag

SEQ ID NO: 2829958 - RNA, 14 nt, Mycobacterium avium subsp. paratuberculosis
cgccgucggccagc

SEQ ID NO: 2829959 - RNA, 16 nt, Mycobacterium avium subsp. paratuberculosis
cgccgucggccagcag

SEQ ID NO: 2829960 - RNA, 19 nt, Mycobacterium avium subsp. paratuberculosis
cgccgucggccagcagcgc

SEQ ID NO: 2829961 - RNA, 20 nt, Mycobacterium avium subsp. paratuberculosis
cgccgucggcccacggugag

SEQ ID NO: 2829962 - RNA, 14 nt, Mycobacterium avium subsp. paratuberculosis
cgccgucggcgaug

SEQ ID NO: 2829963 - RNA, 15 nt, Mycobacterium avium subsp. paratuberculosis
cgccgucggcgaugc

SEQ ID NO: 2829964 - RNA, 13 nt, Mycobacterium avium subsp. paratuberculosis
cgccgucggcggg

SEQ ID NO: 2829965 - RNA, 14 nt, Mycobacterium avium subsp. paratuberculosis
cgccgucggcgggg

SEQ ID NO: 2829966 - RNA, 21 nt, Mycobacterium avium subsp. paratuberculosis
cgccgucggcguucagcggca

SEQ ID NO: 2829967 - RNA, 15 nt, Mycobacterium avium subsp. paratuberculosis
cgccgucggggcguc

SEQ ID NO: 2829968 - RNA, 16 nt, Mycobacterium avium subsp. paratuberculosis
cgccgucggggcgucg

SEQ ID NO: 2829969 - RNA, 17 nt, Mycobacterium avium subsp. paratuberculosis
cgccgucggggcgucgg

SEQ ID NO: 2829970 - RNA, 19 nt, Mycobacterium avium subsp. paratuberculosis
cgccgucggggcgucggcg

SEQ ID NO: 2829971 - RNA, 22 nt, Mycobacterium avium subsp. paratuberculosis
cgccgucggggcgucggcggcc

SEQ ID NO: 2829972 - RNA, 21 nt, Mycobacterium avium subsp. paratuberculosis
cgccgucggggcugaguucgg

SEQ ID NO: 2829973 - RNA, 14 nt, Mycobacterium avium subsp. paratuberculosis
cgccgucggggucg

SEQ ID NO: 2829974 - RNA, 19 nt, Mycobacterium avium subsp. paratuberculosis
cgccgucggggucgcgccg

SEQ ID NO: 2829975 - RNA, 20 nt, Mycobacterium avium subsp. paratuberculosis
cgccgucggggucgcgccgg

SEQ ID NO: 2829976 - RNA, 13 nt, Mycobacterium avium subsp. paratuberculosis
cgccgucggggug

SEQ ID NO: 2829977 - RNA, 19 nt, Mycobacterium avium subsp. paratuberculosis
cgccgucggggugcggucg

SEQ ID NO: 2829978 - RNA, 14 nt, Mycobacterium avium subsp. paratuberculosis
cgccgucgguguag

SEQ ID NO: 2829979 - RNA, 14 nt, Mycobacterium avium subsp. paratuberculosis
cgccgucguagccg

SEQ ID NO: 2829980 - RNA, 18 nt, Mycobacterium avium subsp. paratuberculosis
cgccgucguagccgcggg

SEQ ID NO: 2829981 - RNA, 20 nt, Mycobacterium avium subsp. paratuberculosis
cgccgucguagccgcgggug

SEQ ID NO: 2829982 - RNA, 19 nt, Mycobacterium avium subsp. paratuberculosis
cgccgucguauucgacggc

SEQ ID NO: 2829983 - RNA, 20 nt, Mycobacterium avium subsp. paratuberculosis
cgccgucguauucgacggcg

SEQ ID NO: 2829984 - RNA, 21 nt, Mycobacterium avium subsp. paratuberculosis
cgccgucguauucgacggcga

SEQ ID NO: 2829985 - RNA, 22 nt, Mycobacterium avium subsp. paratuberculosis
cgccgucguauucgacggcgac

SEQ ID NO: 2829986 - RNA, 23 nt, Mycobacterium avium subsp. paratuberculosis
cgccgucguauucgacggcgacc

SEQ ID NO: 2829987 - RNA, 21 nt, Mycobacterium avium subsp. paratuberculosis
cgccgucgucagccgggccag

SEQ ID NO: 2829988 - RNA, 15 nt, Mycobacterium avium subsp. paratuberculosis
cgccgucgucgagca

SEQ ID NO: 2829989 - RNA, 21 nt, Mycobacterium avium subsp. paratuberculosis
cgccgucgucgagcaccaccc

SEQ ID NO: 2829990 - RNA, 14 nt, Mycobacterium avium subsp. paratuberculosis
cgccgucgucgucg

SEQ ID NO: 2829991 - RNA, 17 nt, Mycobacterium avium subsp. paratuberculosis
cgccgucgucgucgcuc

SEQ ID NO: 2829992 - RNA, 22 nt, Mycobacterium avium subsp. paratuberculosis
cgccgucgucgucggccgggcc

SEQ ID NO: 2829993 - RNA, 17 nt, Mycobacterium avium subsp. paratuberculosis
cgccgucgugcucggcg

SEQ ID NO: 2829994 - RNA, 23 nt, Mycobacterium avium subsp. paratuberculosis
cgccgucgugcucggcgagcacc

SEQ ID NO: 2829995 - RNA, 22 nt, Mycobacterium avium subsp. paratuberculosis
cgccgucguggguauccgccgc

SEQ ID NO: 2829996 - RNA, 17 nt, Mycobacterium avium subsp. paratuberculosis
cgccgucguugaucagg

SEQ ID NO: 2829997 - RNA, 23 nt, Mycobacterium avium subsp. paratuberculosis
cgccgucguugaucaggugcagc

SEQ ID NO: 2829998 - RNA, 14 nt, Mycobacterium avium subsp. paratuberculosis
cgccgucuccggcg

SEQ ID NO: 2829999 - RNA, 20 nt, Mycobacterium avium subsp. paratuberculosis
cgccgucuccucgaccagcg

SEQ ID NO: 2830000 - RNA, 20 nt, Mycobacterium avium subsp. paratuberculosis
cgccgucucgaccacccggc

SEQ ID NO: 2830001 - RNA, 16 nt, Mycobacterium avium subsp. paratuberculosis
cgccgucucgacccgg

SEQ ID NO: 2830002 - RNA, 18 nt, Mycobacterium avium subsp. paratuberculosis
cgccgucucgacccgggc

SEQ ID NO: 2830003 - RNA, 18 nt, Mycobacterium avium subsp. paratuberculosis
cgccgucugguccaccgg

SEQ ID NO: 2830004 - RNA, 22 nt, Mycobacterium avium subsp. paratuberculosis
cgccgucugguccaccgggcag

SEQ ID NO: 2830005 - RNA, 21 nt, Mycobacterium avium subsp. paratuberculosis
cgccgucuucccagugccgca

SEQ ID NO: 2830006 - RNA, 16 nt, Mycobacterium avium subsp. paratuberculosis
cgccgugaacugugcg

SEQ ID NO: 2830007 - RNA, 21 nt, Mycobacterium avium subsp. paratuberculosis
cgccgugaacugugcggugcg

SEQ ID NO: 2830008 - RNA, 22 nt, Mycobacterium avium subsp. paratuberculosis
cgccgugaacugugcggugcgg

SEQ ID NO: 2830009 - RNA, 18 nt, Mycobacterium avium subsp. paratuberculosis
cgccgugaagggcccgcc

SEQ ID NO: 2830010 - RNA, 14 nt, Mycobacterium avium subsp. paratuberculosis
cgccgugaccggcg

SEQ ID NO: 2830011 - RNA, 16 nt, Mycobacterium avium subsp. paratuberculosis
cgccgugacgccgauc

SEQ ID NO: 2830012 - RNA, 19 nt, Mycobacterium avium subsp. paratuberculosis
cgccgugagauccagcagc

SEQ ID NO: 2830013 - RNA, 18 nt, Mycobacterium avium subsp. paratuberculosis
cgccgugaucuggugggc

SEQ ID NO: 2830014 - RNA, 19 nt, Mycobacterium avium subsp. paratuberculosis
cgccgugcagaacagcacg

SEQ ID NO: 2830015 - RNA, 12 nt, Mycobacterium avium subsp. paratuberculosis
cgccgugcagca

SEQ ID NO: 2830016 - RNA, 14 nt, Mycobacterium avium subsp. paratuberculosis
cgccgugcagcacg

SEQ ID NO: 2830017 - RNA, 15 nt, Mycobacterium avium subsp. paratuberculosis
cgccgugcagcacgc

SEQ ID NO: 2830018 - RNA, 18 nt, Mycobacterium avium subsp. paratuberculosis
cgccgugcagcacgccgc

SEQ ID NO: 2830019 - RNA, 19 nt, Mycobacterium avium subsp. paratuberculosis
cgccgugcagcacgccgcg

SEQ ID NO: 2830020 - RNA, 21 nt, Mycobacterium avium subsp. paratuberculosis
cgccgugcagcacgccgcgga

SEQ ID NO: 2830021 - RNA, 23 nt, Mycobacterium avium subsp. paratuberculosis
cgccgugcaggaugaccgcgucg

SEQ ID NO: 2830022 - RNA, 20 nt, Mycobacterium avium subsp. paratuberculosis
cgccgugcauccagccgucc

SEQ ID NO: 2830023 - RNA, 23 nt, Mycobacterium avium subsp. paratuberculosis
cgccguuggucugcgcgagcaga

SEQ ID NO: 2830024 - RNA, 14 nt, Mycobacterium avium subsp. paratuberculosis
cgccguuggugguc

SEQ ID NO: 2830025 - RNA, 17 nt, Mycobacterium avium subsp. paratuberculosis
cgccguugguggucugc

SEQ ID NO: 2830026 - RNA, 18 nt, Mycobacterium avium subsp. paratuberculosis
cgccguuguaggccgcgc

SEQ ID NO: 2830027 - RNA, 17 nt, Mycobacterium avium subsp. paratuberculosis
cgccguuguaguagacc

SEQ ID NO: 2830028 - RNA, 23 nt, Mycobacterium avium subsp. paratuberculosis
cgccguuguaguagaccuugacc

SEQ ID NO: 2830029 - RNA, 22 nt, Mycobacterium avium subsp. paratuberculosis
cgccguuguugaggaugacgac

SEQ ID NO: 2830030 - RNA, 18 nt, Mycobacterium avium subsp. paratuberculosis
cgccguuucagcagcgcg

SEQ ID NO: 2830031 - RNA, 18 nt, Mycobacterium avium subsp. paratuberculosis
cgccguuucggacgagcc

SEQ ID NO: 2830032 - RNA, 19 nt, Mycobacterium avium subsp. paratuberculosis
cgccguuucggacgagccg

SEQ ID NO: 2830033 - RNA, 22 nt, Mycobacterium avium subsp. paratuberculosis
cgccguuucggacgagccgucg

SEQ ID NO: 2830034 - RNA, 16 nt, Mycobacterium avium subsp. paratuberculosis
cgccguuuugccgccg

SEQ ID NO: 2830035 - RNA, 17 nt, Mycobacterium avium subsp. paratuberculosis
cgccguuuugccgccga

SEQ ID NO: 2830036 - RNA, 20 nt, Mycobacterium avium subsp. paratuberculosis
cgccguuuugccgccgagcg

SEQ ID NO: 2830037 - RNA, 23 nt, Mycobacterium avium subsp. paratuberculosis
cgccuaauucguuguuggcggug

SEQ ID NO: 2830038 - RNA, 13 nt, Mycobacterium avium subsp. paratuberculosis
cgccuaccgggug

SEQ ID NO: 2830039 - RNA, 23 nt, Mycobacterium avium subsp. paratuberculosis
cgccuaccggguggccagcacca

SEQ ID NO: 2830040 - RNA, 14 nt, Mycobacterium avium subsp. paratuberculosis
cgccucaccccagc

SEQ ID NO: 2830041 - RNA, 18 nt, Mycobacterium avium subsp. paratuberculosis
cgccucaccccagcgcga

SEQ ID NO: 2830042 - RNA, 20 nt, Mycobacterium avium subsp. paratuberculosis
cgccucaccccagcgcgacc

SEQ ID NO: 2830043 - RNA, 21 nt, Mycobacterium avium subsp. paratuberculosis
cgccucaccccagcgcgacca

SEQ ID NO: 2830044 - RNA, 15 nt, Mycobacterium avium subsp. paratuberculosis
cgccucacgcagggc

SEQ ID NO: 2830045 - RNA, 23 nt, Mycobacterium avium subsp. paratuberculosis
cgccucagcagcugcuggcguga

SEQ ID NO: 2830046 - RNA, 21 nt, Mycobacterium avium subsp. paratuberculosis
cgccucaggcgagcacccgga

SEQ ID NO: 2830047 - RNA, 21 nt, Mycobacterium avium subsp. paratuberculosis
cgccucaggcugacgccacgc

SEQ ID NO: 2830048 - RNA, 13 nt, Mycobacterium avium subsp. paratuberculosis
cgccucaugccag

SEQ ID NO: 2830049 - RNA, 20 nt, Mycobacterium avium subsp. paratuberculosis
cgccuccacauacgcggcgg

SEQ ID NO: 2830050 - RNA, 13 nt, Mycobacterium avium subsp. paratuberculosis
cgccuccagcacg

SEQ ID NO: 2830051 - RNA, 16 nt, Mycobacterium avium subsp. paratuberculosis
cgccuccagcacgucg

SEQ ID NO: 2830052 - RNA, 13 nt, Mycobacterium avium subsp. paratuberculosis
cgccuccagcagg

SEQ ID NO: 2830053 - RNA, 18 nt, Mycobacterium avium subsp. paratuberculosis
cgccuccagccgcuccuc

SEQ ID NO: 2830054 - RNA, 18 nt, Mycobacterium avium subsp. paratuberculosis
cgccuccauucgggccag

SEQ ID NO: 2830055 - RNA, 19 nt, Mycobacterium avium subsp. paratuberculosis
cgccuccauucgggccagc

SEQ ID NO: 2830056 - RNA, 22 nt, Mycobacterium avium subsp. paratuberculosis
cgccuccauucgggccagcgcc

SEQ ID NO: 2830057 - RNA, 23 nt, Mycobacterium avium subsp. paratuberculosis
cgccuccauucgggccagcgccg

SEQ ID NO: 2830058 - RNA, 15 nt, Mycobacterium avium subsp. paratuberculosis
cgccucccgcagcgc

SEQ ID NO: 2830059 - RNA, 20 nt, Mycobacterium avium subsp. paratuberculosis
cgccucccgcagcgccagcg

SEQ ID NO: 2830060 - RNA, 19 nt, Mycobacterium avium subsp. paratuberculosis
cgccuccgacagccgcacc

SEQ ID NO: 2830061 - RNA, 14 nt, Mycobacterium avium subsp. paratuberculosis
cgccuccgaccagc

SEQ ID NO: 2830062 - RNA, 15 nt, Mycobacterium avium subsp. paratuberculosis
cgccuccgaccagcc

SEQ ID NO: 2830063 - RNA, 18 nt, Mycobacterium avium subsp. paratuberculosis
cgccuccgaccagccggu

SEQ ID NO: 2830064 - RNA, 22 nt, Mycobacterium avium subsp. paratuberculosis
cgccuccgagauggacagcacc

SEQ ID NO: 2830065 - RNA, 23 nt, Mycobacterium avium subsp. paratuberculosis
cgccuccgagauggacagcaccu

SEQ ID NO: 2830066 - RNA, 17 nt, Mycobacterium avium subsp. paratuberculosis
cgccuccgcccgggugc

SEQ ID NO: 2830067 - RNA, 12 nt, Mycobacterium avium subsp. paratuberculosis
cgccuccgccgc

SEQ ID NO: 2830068 - RNA, 14 nt, Mycobacterium avium subsp. paratuberculosis
cgccuccgccgccc

SEQ ID NO: 2830069 - RNA, 18 nt, Mycobacterium avium subsp. paratuberculosis
cgccuccgccgccccguc

SEQ ID NO: 2830070 - RNA, 12 nt, Mycobacterium avium subsp. paratuberculosis
cgccuccggcag

SEQ ID NO: 2830071 - RNA, 20 nt, Mycobacterium avium subsp. paratuberculosis
cgccuccggcaguacgcgcc

SEQ ID NO: 2830072 - RNA, 13 nt, Mycobacterium avium subsp. paratuberculosis
cgccuccgggaag

SEQ ID NO: 2830073 - RNA, 22 nt, Mycobacterium avium subsp. paratuberculosis
cgccuccgguuugcgccggcuc

SEQ ID NO: 2830074 - RNA, 20 nt, Mycobacterium avium subsp. paratuberculosis
cgccuccgucagcgccgccc

SEQ ID NO: 2830075 - RNA, 22 nt, Mycobacterium avium subsp. paratuberculosis
cgccuccgucagcgccgcccgc

SEQ ID NO: 2830076 - RNA, 18 nt, Mycobacterium avium subsp. paratuberculosis
cgccuccugcuggcgcug

SEQ ID NO: 2830077 - RNA, 17 nt, Mycobacterium avium subsp. paratuberculosis
cgccucgaacaucggca

SEQ ID NO: 2830078 - RNA, 17 nt, Mycobacterium avium subsp. paratuberculosis
cgccucgaaggcgccga

SEQ ID NO: 2830079 - RNA, 18 nt, Mycobacterium avium subsp. paratuberculosis
cgccucgaagucgccggc

SEQ ID NO: 2830080 - RNA, 14 nt, Mycobacterium avium subsp. paratuberculosis
cgccucgaccagca

SEQ ID NO: 2830081 - RNA, 16 nt, Mycobacterium avium subsp. paratuberculosis
cgccucgaccagcacc

SEQ ID NO: 2830082 - RNA, 17 nt, Mycobacterium avium subsp. paratuberculosis
cgccucgaccagcaccg

SEQ ID NO: 2830083 - RNA, 19 nt, Mycobacterium avium subsp. paratuberculosis
cgccucgaccagcaccgca

SEQ ID NO: 2830084 - RNA, 17 nt, Mycobacterium avium subsp. paratuberculosis
cgccucgagcaacggcc

SEQ ID NO: 2830085 - RNA, 20 nt, Mycobacterium avium subsp. paratuberculosis
cgccucgagcaacggccgca

SEQ ID NO: 2830086 - RNA, 22 nt, Mycobacterium avium subsp. paratuberculosis
cgccucgagcaacggccgcagc

SEQ ID NO: 2830087 - RNA, 19 nt, Mycobacterium avium subsp. paratuberculosis
cgccucgagcaccacggcc

SEQ ID NO: 2830088 - RNA, 21 nt, Mycobacterium avium subsp. paratuberculosis
cgccucgagcaccacggcccg

SEQ ID NO: 2830089 - RNA, 22 nt, Mycobacterium avium subsp. paratuberculosis
cgccucgagcaccacggcccgc

SEQ ID NO: 2830090 - RNA, 14 nt, Mycobacterium avium subsp. paratuberculosis
cgccucgagcgccc

SEQ ID NO: 2830091 - RNA, 17 nt, Mycobacterium avium subsp. paratuberculosis
cgccucgagcgcccggg

SEQ ID NO: 2830092 - RNA, 18 nt, Mycobacterium avium subsp. paratuberculosis
cgccucgagcgcccgggc

SEQ ID NO: 2830093 - RNA, 19 nt, Mycobacterium avium subsp. paratuberculosis
cgccucgagcgcccgggcg

SEQ ID NO: 2830094 - RNA, 17 nt, Mycobacterium avium subsp. paratuberculosis
cgccucgaucagagcgg

SEQ ID NO: 2830095 - RNA, 21 nt, Mycobacterium avium subsp. paratuberculosis
cgccucgaucagagcgggccg

SEQ ID NO: 2830096 - RNA, 22 nt, Mycobacterium avium subsp. paratuberculosis
cgccucgaucagagcgggccga

SEQ ID NO: 2830097 - RNA, 23 nt, Mycobacterium avium subsp. paratuberculosis
cgccucgaucagagcgggccgac

SEQ ID NO: 2830098 - RNA, 23 nt, Mycobacterium avium subsp. paratuberculosis
cgccucgaucugguucaccgcca

SEQ ID NO: 2830099 - RNA, 16 nt, Mycobacterium avium subsp. paratuberculosis
cgccucgauggcccgc

SEQ ID NO: 2830100 - RNA, 12 nt, Mycobacterium avium subsp. paratuberculosis
cgccucgccgac

SEQ ID NO: 2830101 - RNA, 14 nt, Mycobacterium avium subsp. paratuberculosis
cgccucgccgaccu

SEQ ID NO: 2830102 - RNA, 15 nt, Mycobacterium avium subsp. paratuberculosis
cgccucgccgaccuu

SEQ ID NO: 2830103 - RNA, 14 nt, Mycobacterium avium subsp. paratuberculosis
cgccucgccgggcc

SEQ ID NO: 2830104 - RNA, 15 nt, Mycobacterium avium subsp. paratuberculosis
cgccucgccgggccc

SEQ ID NO: 2830105 - RNA, 18 nt, Mycobacterium avium subsp. paratuberculosis
cgccucgccgggcccgcu

SEQ ID NO: 2830106 - RNA, 17 nt, Mycobacterium avium subsp. paratuberculosis
cgccucgccggucaccu

SEQ ID NO: 2830107 - RNA, 19 nt, Mycobacterium avium subsp. paratuberculosis
cgccugcgcgccgucggcg

SEQ ID NO: 2830108 - RNA, 20 nt, Mycobacterium avium subsp. paratuberculosis
cgccugcgcgccgucggcga

SEQ ID NO: 2830109 - RNA, 13 nt, Mycobacterium avium subsp. paratuberculosis
cgccugcgcggcg

SEQ ID NO: 2830110 - RNA, 15 nt, Mycobacterium avium subsp. paratuberculosis
cgccugcgcggcggc

SEQ ID NO: 2830111 - RNA, 17 nt, Mycobacterium avium subsp. paratuberculosis
cgccugcgcggcggcgu

SEQ ID NO: 2830112 - RNA, 13 nt, Mycobacterium avium subsp. paratuberculosis
cgccugcgcgggc

SEQ ID NO: 2830113 - RNA, 15 nt, Mycobacterium avium subsp. paratuberculosis
cgccugcgcgggcgc

SEQ ID NO: 2830114 - RNA, 16 nt, Mycobacterium avium subsp. paratuberculosis
cgccugcgcgggcgcg

SEQ ID NO: 2830115 - RNA, 17 nt, Mycobacterium avium subsp. paratuberculosis
cgccugcgcgggcgcgg

SEQ ID NO: 2830116 - RNA, 18 nt, Mycobacterium avium subsp. paratuberculosis
cgccugcgcgggcgcgga

SEQ ID NO: 2830117 - RNA, 21 nt, Mycobacterium avium subsp. paratuberculosis
cgccugcgggaaguugcccaa

SEQ ID NO: 2830118 - RNA, 20 nt, Mycobacterium avium subsp. paratuberculosis
cgccugcggguucuggccgu

SEQ ID NO: 2830119 - RNA, 13 nt, Mycobacterium avium subsp. paratuberculosis
cgccugcggugag

SEQ ID NO: 2830120 - RNA, 18 nt, Mycobacterium avium subsp. paratuberculosis
cgccugcuggacguuggg

SEQ ID NO: 2830121 - RNA, 13 nt, Mycobacterium avium subsp. paratuberculosis
cgccugcuucugg

SEQ ID NO: 2830122 - RNA, 14 nt, Mycobacterium avium subsp. paratuberculosis
cgccugcuucugga

SEQ ID NO: 2830123 - RNA, 24 nt, Mycobacterium avium subsp. paratuberculosis
cgccugcuucuggaugcggucguc

SEQ ID NO: 2830124 - RNA, 22 nt, Mycobacterium avium subsp. paratuberculosis
cgccugcuugaugaugccggcc

SEQ ID NO: 2830125 - RNA, 14 nt, Mycobacterium avium subsp. paratuberculosis
cgccuggacgacgu

SEQ ID NO: 2830126 - RNA, 14 nt, Mycobacterium avium subsp. paratuberculosis
cgccuggcagcugc

SEQ ID NO: 2830127 - RNA, 13 nt, Mycobacterium avium subsp. paratuberculosis
cgccuggccaccu

SEQ ID NO: 2830128 - RNA, 21 nt, Mycobacterium avium subsp. paratuberculosis
cgccuggccaccucgacggcg

SEQ ID NO: 2830129 - RNA, 15 nt, Mycobacterium avium subsp. paratuberculosis
cgccuggcgcagggc

SEQ ID NO: 2830130 - RNA, 20 nt, Mycobacterium avium subsp. paratuberculosis
cgccuggcgcagggcguucg

SEQ ID NO: 2830131 - RNA, 17 nt, Mycobacterium avium subsp. paratuberculosis
cgccuggcggaaggccg

SEQ ID NO: 2830132 - RNA, 19 nt, Mycobacterium avium subsp. paratuberculosis
cgccuggcggaaggccgcg

SEQ ID NO: 2830133 - RNA, 24 nt, Mycobacterium avium subsp. paratuberculosis
cgccuggcggaaggccgcgcgggc

SEQ ID NO: 2830134 - RNA, 20 nt, Mycobacterium avium subsp. paratuberculosis
cgccugggcguacagcggcg

SEQ ID NO: 2830135 - RNA, 18 nt, Mycobacterium avium subsp. paratuberculosis
cgccugggucucgggauc

SEQ ID NO: 2830136 - RNA, 22 nt, Mycobacterium avium subsp. paratuberculosis
cgccugguagggguccuccagc

SEQ ID NO: 2830137 - RNA, 19 nt, Mycobacterium avium subsp. paratuberculosis
cgccuggucaaggugcuga

SEQ ID NO: 2830138 - RNA, 19 nt, Mycobacterium avium subsp. paratuberculosis
cgccugguccucccgggug

SEQ ID NO: 2830139 - RNA, 21 nt, Mycobacterium avium subsp. paratuberculosis
cgccugucaguuugcgcgacg

SEQ ID NO: 2830140 - RNA, 17 nt, Mycobacterium avium subsp. paratuberculosis
cgccuguccgaccagcg

SEQ ID NO: 2830141 - RNA, 15 nt, Mycobacterium avium subsp. paratuberculosis
cgccugugcgacggc

SEQ ID NO: 2830142 - RNA, 16 nt, Mycobacterium avium subsp. paratuberculosis
cgccugugcgacggcg

SEQ ID NO: 2830143 - RNA, 17 nt, Mycobacterium avium subsp. paratuberculosis
cgccugugcgacggcgu

SEQ ID NO: 2830144 - RNA, 21 nt, Mycobacterium avium subsp. paratuberculosis
cgccugugcgacggcgucggc

SEQ ID NO: 2830145 - RNA, 20 nt, Mycobacterium avium subsp. paratuberculosis
cgccuucacgaccggcagca

SEQ ID NO: 2830146 - RNA, 23 nt, Mycobacterium avium subsp. paratuberculosis
cgccuucacgaccggcagcaccg

SEQ ID NO: 2830147 - RNA, 13 nt, Mycobacterium avium subsp. paratuberculosis
cgccuuccacgac

SEQ ID NO: 2830148 - RNA, 15 nt, Mycobacterium avium subsp. paratuberculosis
cgccuucgacggccg

SEQ ID NO: 2830149 - RNA, 17 nt, Mycobacterium avium subsp. paratuberculosis
cgccuucgacggccggc

SEQ ID NO: 2830150 - RNA, 18 nt, Mycobacterium avium subsp. paratuberculosis
cgccuucgaugcccucca

SEQ ID NO: 2830151 - RNA, 22 nt, Mycobacterium avium subsp. paratuberculosis
cgccuucgaugcccuccagcac

SEQ ID NO: 2830152 - RNA, 23 nt, Mycobacterium avium subsp. paratuberculosis
cgccuucgaugcccuccagcacc

SEQ ID NO: 2830153 - RNA, 16 nt, Mycobacterium avium subsp. paratuberculosis
cgccuucggcgccagc

SEQ ID NO: 2830154 - RNA, 21 nt, Mycobacterium avium subsp. paratuberculosis
cgccuucggcgccagcccgcc

SEQ ID NO: 2830155 - RNA, 20 nt, Mycobacterium avium subsp. paratuberculosis
cgccuucuccgggucgcggg

SEQ ID NO: 2830156 - RNA, 16 nt, Mycobacterium avium subsp. paratuberculosis
cgccuucuugcgcggc

SEQ ID NO: 2830157 - RNA, 15 nt, Mycobacterium avium subsp. paratuberculosis
cgccuucuugcugcc

SEQ ID NO: 2830158 - RNA, 18 nt, Mycobacterium avium subsp. paratuberculosis
cgccuucuugcugcccgc

SEQ ID NO: 2830159 - RNA, 20 nt, Mycobacterium avium subsp. paratuberculosis
cgccuucuugcugcccgcgg

SEQ ID NO: 2830160 - RNA, 22 nt, Mycobacterium avium subsp. paratuberculosis
cgccuucuugcugcccgcggcc

SEQ ID NO: 2830161 - RNA, 23 nt, Mycobacterium avium subsp. paratuberculosis
cgccuucuugcugcccgcggccg

SEQ ID NO: 2830162 - RNA, 15 nt, Mycobacterium avium subsp. paratuberculosis
cgccuucuuggccgc

SEQ ID NO: 2830163 - RNA, 17 nt, Mycobacterium avium subsp. paratuberculosis
cgccuucuuggccgcgc

SEQ ID NO: 2830164 - RNA, 20 nt, Mycobacterium avium subsp. paratuberculosis
cgccuucuuggccgcgcccu

SEQ ID NO: 2830165 - RNA, 16 nt, Mycobacterium avium subsp. paratuberculosis
cgccuugaaccggcug

SEQ ID NO: 2830166 - RNA, 17 nt, Mycobacterium avium subsp. paratuberculosis
cgccuugaccgccuugg

SEQ ID NO: 2830167 - RNA, 22 nt, Mycobacterium avium subsp. paratuberculosis
cgccuugaccgcguuggcgccg

SEQ ID NO: 2830168 - RNA, 13 nt, Mycobacterium avium subsp. paratuberculosis
cgccuugacgccg

SEQ ID NO: 2830169 - RNA, 16 nt, Mycobacterium avium subsp. paratuberculosis
cgccuugacgccgggc

SEQ ID NO: 2830170 - RNA, 17 nt, Mycobacterium avium subsp. paratuberculosis
cgccuugacgccgggca

SEQ ID NO: 2830171 - RNA, 22 nt, Mycobacterium avium subsp. paratuberculosis
cgccuugaucuuggccugggcc

SEQ ID NO: 2830172 - RNA, 17 nt, Mycobacterium avium subsp. paratuberculosis
cgccuugcacacggccu

SEQ ID NO: 2830173 - RNA, 18 nt, Mycobacterium avium subsp. paratuberculosis
cgccuugcacacggccuu

SEQ ID NO: 2830174 - RNA, 22 nt, Mycobacterium avium subsp. paratuberculosis
cgccuugcacacggccuugccg

SEQ ID NO: 2830175 - RNA, 14 nt, Mycobacterium avium subsp. paratuberculosis
cgccuugcccggcu

SEQ ID NO: 2830176 - RNA, 16 nt, Mycobacterium avium subsp. paratuberculosis
cgccuugcccggcucg

SEQ ID NO: 2830177 - RNA, 13 nt, Mycobacterium avium subsp. paratuberculosis
cgccuugccgacg

SEQ ID NO: 2830178 - RNA, 15 nt, Mycobacterium avium subsp. paratuberculosis
cgccuugccgacgac

SEQ ID NO: 2830179 - RNA, 16 nt, Mycobacterium avium subsp. paratuberculosis
cgccuugccgacgacg

SEQ ID NO: 2830180 - RNA, 14 nt, Mycobacterium avium subsp. paratuberculosis
cgccuugccgucga

SEQ ID NO: 2830181 - RNA, 16 nt, Mycobacterium avium subsp. paratuberculosis
cgccuugccgucgagc

SEQ ID NO: 2830182 - RNA, 15 nt, Mycobacterium avium subsp. paratuberculosis
cgccuuggccacguc

SEQ ID NO: 2830183 - RNA, 14 nt, Mycobacterium avium subsp. paratuberculosis
cgccuuggccucgg

SEQ ID NO: 2830184 - RNA, 18 nt, Mycobacterium avium subsp. paratuberculosis
cgccuuggcgcgcucggu

SEQ ID NO: 2830185 - RNA, 13 nt, Mycobacterium avium subsp. paratuberculosis
cgccuugggccgg

SEQ ID NO: 2830186 - RNA, 22 nt, Mycobacterium avium subsp. paratuberculosis
cgccuugggucccaucgcugcc

SEQ ID NO: 2830187 - RNA, 23 nt, Mycobacterium avium subsp. paratuberculosis
cgccuugguagaugcguuccagg

SEQ ID NO: 2830188 - RNA, 19 nt, Mycobacterium avium subsp. paratuberculosis
cgccuuggugauccggggc

SEQ ID NO: 2830189 - RNA, 13 nt, Mycobacterium avium subsp. paratuberculosis
cgccuugucggcg

SEQ ID NO: 2830190 - RNA, 20 nt, Mycobacterium avium subsp. paratuberculosis
cgccuuguuggcccacagcu

SEQ ID NO: 2830191 - RNA, 16 nt, Mycobacterium avium subsp. paratuberculosis
cgcgacaaggucgacc

SEQ ID NO: 2830192 - RNA, 18 nt, Mycobacterium avium subsp. paratuberculosis
cgcgacaaggucgaccgc

SEQ ID NO: 2830193 - RNA, 18 nt, Mycobacterium avium subsp. paratuberculosis
cgcgacacccgcgacgac

SEQ ID NO: 2830194 - RNA, 14 nt, Mycobacterium avium subsp. paratuberculosis
cgcgacaccgcggc

SEQ ID NO: 2830195 - RNA, 17 nt, Mycobacterium avium subsp. paratuberculosis
cgcgacaccgcggcgac

SEQ ID NO: 2830196 - RNA, 18 nt, Mycobacterium avium subsp. paratuberculosis
cgcgacaccgcggcgacg

SEQ ID NO: 2830197 - RNA, 20 nt, Mycobacterium avium subsp. paratuberculosis
cgcgacaccgcggcgacguc

SEQ ID NO: 2830198 - RNA, 22 nt, Mycobacterium avium subsp. paratuberculosis
cgcgacaccgcggcgacgucgu

SEQ ID NO: 2830199 - RNA, 18 nt, Mycobacterium avium subsp. paratuberculosis
cgcgacaccugcucaccg

SEQ ID NO: 2830200 - RNA, 20 nt, Mycobacterium avium subsp. paratuberculosis
cgcgacaccugcucaccgag

SEQ ID NO: 2830201 - RNA, 21 nt, Mycobacterium avium subsp. paratuberculosis
cgcgacaccugcucaccgagc

SEQ ID NO: 2830202 - RNA, 14 nt, Mycobacterium avium subsp. paratuberculosis
cgcgacacgccgcg

SEQ ID NO: 2830203 - RNA, 15 nt, Mycobacterium avium subsp. paratuberculosis
cgcgacacgccgcgc

SEQ ID NO: 2830204 - RNA, 18 nt, Mycobacterium avium subsp. paratuberculosis
cgcgacacgugcaucugc

SEQ ID NO: 2830205 - RNA, 20 nt, Mycobacterium avium subsp. paratuberculosis
cgcgacacgugcaucugcga

SEQ ID NO: 2830206 - RNA, 11 nt, Mycobacterium avium subsp. paratuberculosis
cgcgacacugc

SEQ ID NO: 2830207 - RNA, 20 nt, Mycobacterium avium subsp. paratuberculosis
cgcgacacugcaacuacgca

SEQ ID NO: 2830208 - RNA, 15 nt, Mycobacterium avium subsp. paratuberculosis
cgcgacagccgcccg

SEQ ID NO: 2830209 - RNA, 19 nt, Mycobacterium avium subsp. paratuberculosis
cgcgacagccgcccggcgc

SEQ ID NO: 2830210 - RNA, 21 nt, Mycobacterium avium subsp. paratuberculosis
cgcgacagccgcccggcgccc

SEQ ID NO: 2830211 - RNA, 15 nt, Mycobacterium avium subsp. paratuberculosis
cgcgacagccgggaa

SEQ ID NO: 2830212 - RNA, 17 nt, Mycobacterium avium subsp. paratuberculosis
cgcgacaucaccgcggg

SEQ ID NO: 2830213 - RNA, 22 nt, Mycobacterium avium subsp. paratuberculosis
cgcgacaucaccgcgggcgcgc

SEQ ID NO: 2830214 - RNA, 14 nt, Mycobacterium avium subsp. paratuberculosis
cgcgacaucgccgg

SEQ ID NO: 2830215 - RNA, 14 nt, Mycobacterium avium subsp. paratuberculosis
cgcgacaucggcgc

SEQ ID NO: 2830216 - RNA, 15 nt, Mycobacterium avium subsp. paratuberculosis
cgcgacaucggcgcc

SEQ ID NO: 2830217 - RNA, 16 nt, Mycobacterium avium subsp. paratuberculosis
cgcgacaucggcgccg

SEQ ID NO: 2830218 - RNA, 18 nt, Mycobacterium avium subsp. paratuberculosis
cgcgacaucggcgccgac

SEQ ID NO: 2830219 - RNA, 19 nt, Mycobacterium avium subsp. paratuberculosis
cgcgacaucggcgccgacg

SEQ ID NO: 2830220 - RNA, 23 nt, Mycobacterium avium subsp. paratuberculosis
cgcgacaucggcgccgacggggu

SEQ ID NO: 2830221 - RNA, 17 nt, Mycobacterium avium subsp. paratuberculosis
cgcgacaucggugaccg

SEQ ID NO: 2830222 - RNA, 19 nt, Mycobacterium avium subsp. paratuberculosis
cgcgaccaaacgcagcguc

SEQ ID NO: 2830223 - RNA, 20 nt, Mycobacterium avium subsp. paratuberculosis
cgcgaccaaacgcagcgucu

SEQ ID NO: 2830224 - RNA, 13 nt, Mycobacterium avium subsp. paratuberculosis
cgcgaccacagcg

SEQ ID NO: 2830225 - RNA, 19 nt, Mycobacterium avium subsp. paratuberculosis
cgcgaccacagcgccucgu

SEQ ID NO: 2830226 - RNA, 20 nt, Mycobacterium avium subsp. paratuberculosis
cgcgaccacagcgccucguc

SEQ ID NO: 2830227 - RNA, 14 nt, Mycobacterium avium subsp. paratuberculosis
cgcgaccaccggcc

SEQ ID NO: 2830228 - RNA, 15 nt, Mycobacterium avium subsp. paratuberculosis
cgcgaccaccggccg

SEQ ID NO: 2830229 - RNA, 17 nt, Mycobacterium avium subsp. paratuberculosis
cgcgaccaccggccgac

SEQ ID NO: 2830230 - RNA, 18 nt, Mycobacterium avium subsp. paratuberculosis
cgcgaccaccggccgacc

SEQ ID NO: 2830231 - RNA, 14 nt, Mycobacterium avium subsp. paratuberculosis
cgcgaccacgccgc

SEQ ID NO: 2830232 - RNA, 15 nt, Mycobacterium avium subsp. paratuberculosis
cgcgaccacgccgcg

SEQ ID NO: 2830233 - RNA, 19 nt, Mycobacterium avium subsp. paratuberculosis
cgcgaccagcccggccgcc

SEQ ID NO: 2830234 - RNA, 20 nt, Mycobacterium avium subsp. paratuberculosis
cgcgaccagcccggccgccg

SEQ ID NO: 2830235 - RNA, 14 nt, Mycobacterium avium subsp. paratuberculosis
cgcgaccagcggca

SEQ ID NO: 2830236 - RNA, 16 nt, Mycobacterium avium subsp. paratuberculosis
cgcgaccagcggcagc

SEQ ID NO: 2830237 - RNA, 17 nt, Mycobacterium avium subsp. paratuberculosis
cgcgaccagcggcagca

SEQ ID NO: 2830238 - RNA, 18 nt, Mycobacterium avium subsp. paratuberculosis
cgcgaccagcggcagcag

SEQ ID NO: 2830239 - RNA, 23 nt, Mycobacterium avium subsp. paratuberculosis
cgcgaccagcggcagcagcacca

SEQ ID NO: 2830240 - RNA, 15 nt, Mycobacterium avium subsp. paratuberculosis
cgcgaccagcucggg

SEQ ID NO: 2830241 - RNA, 16 nt, Mycobacterium avium subsp. paratuberculosis
cgcgaccaggcccagc

SEQ ID NO: 2830242 - RNA, 17 nt, Mycobacterium avium subsp. paratuberculosis
cgcgaccaggcccagcg

SEQ ID NO: 2830243 - RNA, 18 nt, Mycobacterium avium subsp. paratuberculosis
cgcgaccaggcccagcgg

SEQ ID NO: 2830244 - RNA, 22 nt, Mycobacterium avium subsp. paratuberculosis
cgcgaccaggcccagcggaucg

SEQ ID NO: 2830245 - RNA, 17 nt, Mycobacterium avium subsp. paratuberculosis
cgcgaccaguaccgggc

SEQ ID NO: 2830246 - RNA, 13 nt, Mycobacterium avium subsp. paratuberculosis
cgcgaccaucagc

SEQ ID NO: 2830247 - RNA, 15 nt, Mycobacterium avium subsp. paratuberculosis
cgcgaccaucagccc

SEQ ID NO: 2830248 - RNA, 16 nt, Mycobacterium avium subsp. paratuberculosis
cgcgaccaucagcccg

SEQ ID NO: 2830249 - RNA, 19 nt, Mycobacterium avium subsp. paratuberculosis
cgcgaccaucagcccggug

SEQ ID NO: 2830250 - RNA, 15 nt, Mycobacterium avium subsp. paratuberculosis
cgcgaccaugcccgg

SEQ ID NO: 2830251 - RNA, 22 nt, Mycobacterium avium subsp. paratuberculosis
cgcgacccagacuugggcagca

SEQ ID NO: 2830252 - RNA, 14 nt, Mycobacterium avium subsp. paratuberculosis
cgcgacccaggccg

SEQ ID NO: 2830253 - RNA, 15 nt, Mycobacterium avium subsp. paratuberculosis
cgcgacccaggccgc

SEQ ID NO: 2830254 - RNA, 16 nt, Mycobacterium avium subsp. paratuberculosis
cgcgacccaggccgcc

SEQ ID NO: 2830255 - RNA, 17 nt, Mycobacterium avium subsp. paratuberculosis
cgcgacccaggccgccg

SEQ ID NO: 2830256 - RNA, 18 nt, Mycobacterium avium subsp. paratuberculosis
cgcgacccaggccgccgc

SEQ ID NO: 2830257 - RNA, 19 nt, Mycobacterium avium subsp. paratuberculosis
cgcgacccaggccgccgcc

SEQ ID NO: 2830258 - RNA, 20 nt, Mycobacterium avium subsp. paratuberculosis
cgcgacccaggccgccgcca

SEQ ID NO: 2830259 - RNA, 19 nt, Mycobacterium avium subsp. paratuberculosis
cgcgaccccggaccgcgga

SEQ ID NO: 2830260 - RNA, 20 nt, Mycobacterium avium subsp. paratuberculosis
cgcgaccccggaccgcggaa

SEQ ID NO: 2830261 - RNA, 21 nt, Mycobacterium avium subsp. paratuberculosis
cgcgaccccggaccgcggaac

SEQ ID NO: 2830262 - RNA, 16 nt, Mycobacterium avium subsp. paratuberculosis
cgcgaccccuacgggc

SEQ ID NO: 2830263 - RNA, 22 nt, Mycobacterium avium subsp. paratuberculosis
cgcgacccgaacuucagcgcgu

SEQ ID NO: 2830264 - RNA, 12 nt, Mycobacterium avium subsp. paratuberculosis
cgcgacccgcuc

SEQ ID NO: 2830265 - RNA, 17 nt, Mycobacterium avium subsp. paratuberculosis
cgcgacccgcucgacgc

SEQ ID NO: 2830266 - RNA, 18 nt, Mycobacterium avium subsp. paratuberculosis
cgcgacccgcucgacgcg

SEQ ID NO: 2830267 - RNA, 13 nt, Mycobacterium avium subsp. paratuberculosis
cgcgacccggccg

SEQ ID NO: 2830268 - RNA, 14 nt, Mycobacterium avium subsp. paratuberculosis
cgcgacccggccga

SEQ ID NO: 2830269 - RNA, 22 nt, Mycobacterium avium subsp. paratuberculosis
cgcgacccggccgagcgcgccg

SEQ ID NO: 2830270 - RNA, 15 nt, Mycobacterium avium subsp. paratuberculosis
cgcgacccgggccgc

SEQ ID NO: 2830271 - RNA, 17 nt, Mycobacterium avium subsp. paratuberculosis
cgcgacccgggccgcca

SEQ ID NO: 2830272 - RNA, 19 nt, Mycobacterium avium subsp. paratuberculosis
cgcgaccgaggucgacgcc

SEQ ID NO: 2830273 - RNA, 15 nt, Mycobacterium avium subsp. paratuberculosis
cgcgaccgcagcagg

SEQ ID NO: 2830274 - RNA, 15 nt, Mycobacterium avium subsp. paratuberculosis
cgcgaccgccucguc

SEQ ID NO: 2830275 - RNA, 21 nt, Mycobacterium avium subsp. paratuberculosis
cgcgaccgcgaucagggccgc

SEQ ID NO: 2830276 - RNA, 16 nt, Mycobacterium avium subsp. paratuberculosis
cgcgacggcgagccgg

SEQ ID NO: 2830277 - RNA, 17 nt, Mycobacterium avium subsp. paratuberculosis
cgcgacggcgcccgccc

SEQ ID NO: 2830278 - RNA, 18 nt, Mycobacterium avium subsp. paratuberculosis
cgcgacggcgcccgcccc

SEQ ID NO: 2830279 - RNA, 21 nt, Mycobacterium avium subsp. paratuberculosis
cgcgacggcgcccgccccgac

SEQ ID NO: 2830280 - RNA, 14 nt, Mycobacterium avium subsp. paratuberculosis
cgcgacggcggcga

SEQ ID NO: 2830281 - RNA, 17 nt, Mycobacterium avium subsp. paratuberculosis
cgcgacggcggcgaaga

SEQ ID NO: 2830282 - RNA, 16 nt, Mycobacterium avium subsp. paratuberculosis
cgcgacggcgggucga

SEQ ID NO: 2830283 - RNA, 14 nt, Mycobacterium avium subsp. paratuberculosis
cgcgacgggcaccc

SEQ ID NO: 2830284 - RNA, 19 nt, Mycobacterium avium subsp. paratuberculosis
cgcgacgggcacccgcgcg

SEQ ID NO: 2830285 - RNA, 20 nt, Mycobacterium avium subsp. paratuberculosis
cgcgacgggcacccgcgcgu

SEQ ID NO: 2830286 - RNA, 22 nt, Mycobacterium avium subsp. paratuberculosis
cgcgacgggcacccgcgcgucg

SEQ ID NO: 2830287 - RNA, 17 nt, Mycobacterium avium subsp. paratuberculosis
cgcgacgggcaugccgu

SEQ ID NO: 2830288 - RNA, 18 nt, Mycobacterium avium subsp. paratuberculosis
cgcgacgggcaugccguc

SEQ ID NO: 2830289 - RNA, 23 nt, Mycobacterium avium subsp. paratuberculosis
cgcgacgggcaugccgucggcgc

SEQ ID NO: 2830290 - RNA, 19 nt, Mycobacterium avium subsp. paratuberculosis
cgcgacgggcguccgagaa

SEQ ID NO: 2830291 - RNA, 13 nt, Mycobacterium avium subsp. paratuberculosis
cgcgacgggcucg

SEQ ID NO: 2830292 - RNA, 16 nt, Mycobacterium avium subsp. paratuberculosis
cgcgacgggcucggcg

SEQ ID NO: 2830293 - RNA, 13 nt, Mycobacterium avium subsp. paratuberculosis
cgcgacgggcugc

SEQ ID NO: 2830294 - RNA, 14 nt, Mycobacterium avium subsp. paratuberculosis
cgcgacgggcugcu

SEQ ID NO: 2830295 - RNA, 22 nt, Mycobacterium avium subsp. paratuberculosis
cgcgacgggcugcugcacgucg

SEQ ID NO: 2830296 - RNA, 21 nt, Mycobacterium avium subsp. paratuberculosis
cgcgacgggcugucccggccg

SEQ ID NO: 2830297 - RNA, 23 nt, Mycobacterium avium subsp. paratuberculosis
cgcgacgggcugucccggccgcg

SEQ ID NO: 2830298 - RNA, 12 nt, Mycobacterium avium subsp. paratuberculosis
cgcgacggucac

SEQ ID NO: 2830299 - RNA, 15 nt, Mycobacterium avium subsp. paratuberculosis
cgcgacggucacgcu

SEQ ID NO: 2830300 - RNA, 22 nt, Mycobacterium avium subsp. paratuberculosis
cgcgacggucacgcuggcguga

SEQ ID NO: 2830301 - RNA, 22 nt, Mycobacterium avium subsp. paratuberculosis
cgcgacggugagcaacaccggc

SEQ ID NO: 2830302 - RNA, 23 nt, Mycobacterium avium subsp. paratuberculosis
cgcgacggugagcaacaccggca

SEQ ID NO: 2830303 - RNA, 15 nt, Mycobacterium avium subsp. paratuberculosis
cgcgacgguggaccc

SEQ ID NO: 2830304 - RNA, 16 nt, Mycobacterium avium subsp. paratuberculosis
cgcgacgguggcggcg

SEQ ID NO: 2830305 - RNA, 17 nt, Mycobacterium avium subsp. paratuberculosis
cgcgacgguggcggcga

SEQ ID NO: 2830306 - RNA, 21 nt, Mycobacterium avium subsp. paratuberculosis
cgcgacgguggcggcgauguc

SEQ ID NO: 2830307 - RNA, 22 nt, Mycobacterium avium subsp. paratuberculosis
cgcgacgguguaggacgccgug

SEQ ID NO: 2830308 - RNA, 21 nt, Mycobacterium avium subsp. paratuberculosis
cgcgacgguuguucagcccgg

SEQ ID NO: 2830309 - RNA, 22 nt, Mycobacterium avium subsp. paratuberculosis
cgcgacgguuguucagcccggu

SEQ ID NO: 2830310 - RNA, 15 nt, Mycobacterium avium subsp. paratuberculosis
cgcgacguagccggu

SEQ ID NO: 2830311 - RNA, 16 nt, Mycobacterium avium subsp. paratuberculosis
cgcgacguccaucggg

SEQ ID NO: 2830312 - RNA, 19 nt, Mycobacterium avium subsp. paratuberculosis
cgcgacguccaucgggacc

SEQ ID NO: 2830313 - RNA, 15 nt, Mycobacterium avium subsp. paratuberculosis
cgcgacgucgaccgc

SEQ ID NO: 2830314 - RNA, 22 nt, Mycobacterium avium subsp. paratuberculosis
cgcgacgucgaccgcgacgacc

SEQ ID NO: 2830315 - RNA, 22 nt, Mycobacterium avium subsp. paratuberculosis
cgcgacgucgguguagucggcg

SEQ ID NO: 2830316 - RNA, 23 nt, Mycobacterium avium subsp. paratuberculosis
cgcgacgucgguguagucggcga

SEQ ID NO: 2830317 - RNA, 13 nt, Mycobacterium avium subsp. paratuberculosis
cgcgacgugccgg

SEQ ID NO: 2830318 - RNA, 13 nt, Mycobacterium avium subsp. paratuberculosis
cgcgacguggcgc

SEQ ID NO: 2830319 - RNA, 13 nt, Mycobacterium avium subsp. paratuberculosis
cgcgacucggugu

SEQ ID NO: 2830320 - RNA, 14 nt, Mycobacterium avium subsp. paratuberculosis
cgcgacugcacccg

SEQ ID NO: 2830321 - RNA, 13 nt, Mycobacterium avium subsp. paratuberculosis
cgcgacugggcgc

SEQ ID NO: 2830322 - RNA, 14 nt, Mycobacterium avium subsp. paratuberculosis
cgcgacugggcgcc

SEQ ID NO: 2830323 - RNA, 15 nt, Mycobacterium avium subsp. paratuberculosis
cgcgacugggcgccc

SEQ ID NO: 2830324 - RNA, 17 nt, Mycobacterium avium subsp. paratuberculosis
cgcgacugggcgcccac

SEQ ID NO: 2830325 - RNA, 15 nt, Mycobacterium avium subsp. paratuberculosis
cgcgacugucggcgc

SEQ ID NO: 2830326 - RNA, 16 nt, Mycobacterium avium subsp. paratuberculosis
cgcgacugucggcgcc

SEQ ID NO: 2830327 - RNA, 17 nt, Mycobacterium avium subsp. paratuberculosis
cgcgacugucggcgccc

SEQ ID NO: 2830328 - RNA, 17 nt, Mycobacterium avium subsp. paratuberculosis
cgcgacugucggcucgc

SEQ ID NO: 2830329 - RNA, 18 nt, Mycobacterium avium subsp. paratuberculosis
cgcgacugucggcucgcc

SEQ ID NO: 2830330 - RNA, 19 nt, Mycobacterium avium subsp. paratuberculosis
cgcgacugucggcucgccc

SEQ ID NO: 2830331 - RNA, 19 nt, Mycobacterium avium subsp. paratuberculosis
cgcgacuuucaaguccucc

SEQ ID NO: 2830332 - RNA, 15 nt, Mycobacterium avium subsp. paratuberculosis
cgcgagaagcgcgca

SEQ ID NO: 2830333 - RNA, 13 nt, Mycobacterium avium subsp. paratuberculosis
cgcgagacccggu

SEQ ID NO: 2830334 - RNA, 14 nt, Mycobacterium avium subsp. paratuberculosis
cgcgagacccgguc

SEQ ID NO: 2830335 - RNA, 15 nt, Mycobacterium avium subsp. paratuberculosis
cgcgagacgagccgc

SEQ ID NO: 2830336 - RNA, 15 nt, Mycobacterium avium subsp. paratuberculosis
cgcgagaucagcgcc

SEQ ID NO: 2830337 - RNA, 12 nt, Mycobacterium avium subsp. paratuberculosis
cgcgagcaccgc

SEQ ID NO: 2830338 - RNA, 20 nt, Mycobacterium avium subsp. paratuberculosis
cgcgagcaccgcgaucgccg

SEQ ID NO: 2830339 - RNA, 23 nt, Mycobacterium avium subsp. paratuberculosis
cgcgagcacgaaguacagcguca

SEQ ID NO: 2830340 - RNA, 12 nt, Mycobacterium avium subsp. paratuberculosis
cgcgagcacgac

SEQ ID NO: 2830341 - RNA, 13 nt, Mycobacterium avium subsp. paratuberculosis
cgcgagcacgacg

SEQ ID NO: 2830342 - RNA, 15 nt, Mycobacterium avium subsp. paratuberculosis
cgcgagcacgacguc

SEQ ID NO: 2830343 - RNA, 19 nt, Mycobacterium avium subsp. paratuberculosis
cgcgagcacgacgucgacg

SEQ ID NO: 2830344 - RNA, 20 nt, Mycobacterium avium subsp. paratuberculosis
cgcgagcacgacgucgacgu

SEQ ID NO: 2830345 - RNA, 19 nt, Mycobacterium avium subsp. paratuberculosis
cgcgagcagacgcaaaagc

SEQ ID NO: 2830346 - RNA, 21 nt, Mycobacterium avium subsp. paratuberculosis
cgcgagcagggcgggcaggcc

SEQ ID NO: 2830347 - RNA, 22 nt, Mycobacterium avium subsp. paratuberculosis
cgcgagcagggcgggcaggccc

SEQ ID NO: 2830348 - RNA, 14 nt, Mycobacterium avium subsp. paratuberculosis
cgcgagcaucaccg

SEQ ID NO: 2830349 - RNA, 23 nt, Mycobacterium avium subsp. paratuberculosis
cgcgagcccgcaaaucagccgag

SEQ ID NO: 2830350 - RNA, 12 nt, Mycobacterium avium subsp. paratuberculosis
cgcgagcccggc

SEQ ID NO: 2830351 - RNA, 16 nt, Mycobacterium avium subsp. paratuberculosis
cgcgagcccggcgacg

SEQ ID NO: 2830352 - RNA, 14 nt, Mycobacterium avium subsp. paratuberculosis
cgcgagccgaaacg

SEQ ID NO: 2830353 - RNA, 22 nt, Mycobacterium avium subsp. paratuberculosis
cgcgagccgaaacggugcccgc

SEQ ID NO: 2830354 - RNA, 15 nt, Mycobacterium avium subsp. paratuberculosis
cgcgagccgagccgg

SEQ ID NO: 2830355 - RNA, 20 nt, Mycobacterium avium subsp. paratuberculosis
cgcgagccgagccgguccga

SEQ ID NO: 2830356 - RNA, 14 nt, Mycobacterium avium subsp. paratuberculosis
cgcgagcgcagcag

SEQ ID NO: 2830357 - RNA, 17 nt, Mycobacterium avium subsp. paratuberculosis
cgcgagcgcagcaggua

SEQ ID NO: 2830358 - RNA, 13 nt, Mycobacterium avium subsp. paratuberculosis
cgcgagcgcagcg

SEQ ID NO: 2830359 - RNA, 14 nt, Mycobacterium avium subsp. paratuberculosis
cgcgagcgcagcgc

SEQ ID NO: 2830360 - RNA, 21 nt, Mycobacterium avium subsp. paratuberculosis
cgcgagcgcagcgccaggcag

SEQ ID NO: 2830361 - RNA, 17 nt, Mycobacterium avium subsp. paratuberculosis
cgcgaucgccaacgcgc

SEQ ID NO: 2830362 - RNA, 15 nt, Mycobacterium avium subsp. paratuberculosis
cgcgaucgccagcgc

SEQ ID NO: 2830363 - RNA, 19 nt, Mycobacterium avium subsp. paratuberculosis
cgcgaucgccagcgcggug

SEQ ID NO: 2830364 - RNA, 13 nt, Mycobacterium avium subsp. paratuberculosis
cgcgaucgccgac

SEQ ID NO: 2830365 - RNA, 13 nt, Mycobacterium avium subsp. paratuberculosis
cgcgaucgccgau

SEQ ID NO: 2830366 - RNA, 19 nt, Mycobacterium avium subsp. paratuberculosis
cgcgaucgccgauccggcg

SEQ ID NO: 2830367 - RNA, 16 nt, Mycobacterium avium subsp. paratuberculosis
cgcgaucgccggaucg

SEQ ID NO: 2830368 - RNA, 14 nt, Mycobacterium avium subsp. paratuberculosis
cgcgaucgccggga

SEQ ID NO: 2830369 - RNA, 16 nt, Mycobacterium avium subsp. paratuberculosis
cgcgaucgccggugcg

SEQ ID NO: 2830370 - RNA, 15 nt, Mycobacterium avium subsp. paratuberculosis
cgcgaucgcggucca

SEQ ID NO: 2830371 - RNA, 20 nt, Mycobacterium avium subsp. paratuberculosis
cgcgaucgcgguccaggauc

SEQ ID NO: 2830372 - RNA, 17 nt, Mycobacterium avium subsp. paratuberculosis
cgcgaucggauggugcc

SEQ ID NO: 2830373 - RNA, 18 nt, Mycobacterium avium subsp. paratuberculosis
cgcgaucggcaggucguc

SEQ ID NO: 2830374 - RNA, 23 nt, Mycobacterium avium subsp. paratuberculosis
cgcgaucggcaggucgucgacgu

SEQ ID NO: 2830375 - RNA, 14 nt, Mycobacterium avium subsp. paratuberculosis
cgcgaucggccgcu

SEQ ID NO: 2830376 - RNA, 16 nt, Mycobacterium avium subsp. paratuberculosis
cgcgaucggccgcugc

SEQ ID NO: 2830377 - RNA, 13 nt, Mycobacterium avium subsp. paratuberculosis
cgcgaucggcgag

SEQ ID NO: 2830378 - RNA, 15 nt, Mycobacterium avium subsp. paratuberculosis
cgcgaucggcgagcc

SEQ ID NO: 2830379 - RNA, 17 nt, Mycobacterium avium subsp. paratuberculosis
cgcgaucggcgagccgg

SEQ ID NO: 2830380 - RNA, 14 nt, Mycobacterium avium subsp. paratuberculosis
cgcgaucggcgcca

SEQ ID NO: 2830381 - RNA, 12 nt, Mycobacterium avium subsp. paratuberculosis
cgcgaucggcgu

SEQ ID NO: 2830382 - RNA, 13 nt, Mycobacterium avium subsp. paratuberculosis
cgcgaucggcgug

SEQ ID NO: 2830383 - RNA, 14 nt, Mycobacterium avium subsp. paratuberculosis
cgcgaucgucgacc

SEQ ID NO: 2830384 - RNA, 18 nt, Mycobacterium avium subsp. paratuberculosis
cgcgaucgucgaccacca

SEQ ID NO: 2830385 - RNA, 19 nt, Mycobacterium avium subsp. paratuberculosis
cgcgaucgucgaccaccac

SEQ ID NO: 2830386 - RNA, 22 nt, Mycobacterium avium subsp. paratuberculosis
cgcgaucgucgaccaccacgac

SEQ ID NO: 2830387 - RNA, 23 nt, Mycobacterium avium subsp. paratuberculosis
cgcgaucuccuuguugacgauga

SEQ ID NO: 2830388 - RNA, 20 nt, Mycobacterium avium subsp. paratuberculosis
cgcgaucucggcggacucgg

SEQ ID NO: 2830389 - RNA, 18 nt, Mycobacterium avium subsp. paratuberculosis
cgcgaugaucagcucgcg

SEQ ID NO: 2830390 - RNA, 23 nt, Mycobacterium avium subsp. paratuberculosis
cgcgaugaucagcucgcgcauca

SEQ ID NO: 2830391 - RNA, 13 nt, Mycobacterium avium subsp. paratuberculosis
cgcgaugaucgcc

SEQ ID NO: 2830392 - RNA, 15 nt, Mycobacterium avium subsp. paratuberculosis
cgcgaugaucgccgg

SEQ ID NO: 2830393 - RNA, 21 nt, Mycobacterium avium subsp. paratuberculosis
cgcgaugaucgccggcgccgg

SEQ ID NO: 2830394 - RNA, 15 nt, Mycobacterium avium subsp. paratuberculosis
cgcgaugauggcguc

SEQ ID NO: 2830395 - RNA, 17 nt, Mycobacterium avium subsp. paratuberculosis
cgcgaugauggcgucga

SEQ ID NO: 2830396 - RNA, 18 nt, Mycobacterium avium subsp. paratuberculosis
cgcgaugauggcgucgac

SEQ ID NO: 2830397 - RNA, 20 nt, Mycobacterium avium subsp. paratuberculosis
cgcgaugauggcgucgacgu

SEQ ID NO: 2830398 - RNA, 22 nt, Mycobacterium avium subsp. paratuberculosis
cgcgaugauggcgucgacgugc

SEQ ID NO: 2830399 - RNA, 21 nt, Mycobacterium avium subsp. paratuberculosis
cgcgaugcaacaccgaacgcc

SEQ ID NO: 2830400 - RNA, 14 nt, Mycobacterium avium subsp. paratuberculosis
cgcgaugcccaagc

SEQ ID NO: 2830401 - RNA, 18 nt, Mycobacterium avium subsp. paratuberculosis
cgcgaugcccaagccggc

SEQ ID NO: 2830402 - RNA, 20 nt, Mycobacterium avium subsp. paratuberculosis
cgcgaugcccaagccggcca

SEQ ID NO: 2830403 - RNA, 13 nt, Mycobacterium avium subsp. paratuberculosis
cgcgaugcccgcc

SEQ ID NO: 2830404 - RNA, 15 nt, Mycobacterium avium subsp. paratuberculosis
cgcgaugccggccag

SEQ ID NO: 2830405 - RNA, 21 nt, Mycobacterium avium subsp. paratuberculosis
cgcgaugcgacaccgcguccu

SEQ ID NO: 2830406 - RNA, 13 nt, Mycobacterium avium subsp. paratuberculosis
cgcgaugcggcuc

SEQ ID NO: 2830407 - RNA, 16 nt, Mycobacterium avium subsp. paratuberculosis
cgcgaugcgggcgccg

SEQ ID NO: 2830408 - RNA, 19 nt, Mycobacterium avium subsp. paratuberculosis
cgcgaugcgggcgccgaac

SEQ ID NO: 2830409 - RNA, 15 nt, Mycobacterium avium subsp. paratuberculosis
cgcgauggaagcgcc

SEQ ID NO: 2830410 - RNA, 17 nt, Mycobacterium avium subsp. paratuberculosis
cgcgauggacagcagcc

SEQ ID NO: 2830411 - RNA, 18 nt, Mycobacterium avium subsp. paratuberculosis
cgcgauggcacacagcgu

SEQ ID NO: 2830412 - RNA, 14 nt, Mycobacterium avium subsp. paratuberculosis
cgcgauggcccgcg

SEQ ID NO: 2830413 - RNA, 14 nt, Mycobacterium avium subsp. paratuberculosis
cgcgauggccuccg

SEQ ID NO: 2830414 - RNA, 13 nt, Mycobacterium avium subsp. paratuberculosis
cgcgauggcgcug

SEQ ID NO: 2830415 - RNA, 17 nt, Mycobacterium avium subsp. paratuberculosis
cgcgauggcgcuggccg

SEQ ID NO: 2830416 - RNA, 20 nt, Mycobacterium avium subsp. paratuberculosis
cgcgauggcgcuggccgcga

SEQ ID NO: 2830417 - RNA, 13 nt, Mycobacterium avium subsp. paratuberculosis
cgcgauggcggcg

SEQ ID NO: 2830418 - RNA, 15 nt, Mycobacterium avium subsp. paratuberculosis
cgcgauggcggcgcg

SEQ ID NO: 2830419 - RNA, 16 nt, Mycobacterium avium subsp. paratuberculosis
cgcgauggcggcgcgc

SEQ ID NO: 2830420 - RNA, 17 nt, Mycobacterium avium subsp. paratuberculosis
cgcgauggcggcgcgcu

SEQ ID NO: 2830421 - RNA, 18 nt, Mycobacterium avium subsp. paratuberculosis
cgcgauggcggcgcgcuc

SEQ ID NO: 2830422 - RNA, 13 nt, Mycobacterium avium subsp. paratuberculosis
cgcgauggcgggu

SEQ ID NO: 2830423 - RNA, 14 nt, Mycobacterium avium subsp. paratuberculosis
cgcgauggcgugcc

SEQ ID NO: 2830424 - RNA, 15 nt, Mycobacterium avium subsp. paratuberculosis
cgcgauggcgugccg

SEQ ID NO: 2830425 - RNA, 16 nt, Mycobacterium avium subsp. paratuberculosis
cgcgauggcgugccgg

SEQ ID NO: 2830426 - RNA, 18 nt, Mycobacterium avium subsp. paratuberculosis
cgcgauggcgugccggcg

SEQ ID NO: 2830427 - RNA, 21 nt, Mycobacterium avium subsp. paratuberculosis
cgcgauggcgugccggcgcug

SEQ ID NO: 2830428 - RNA, 15 nt, Mycobacterium avium subsp. paratuberculosis
cgcgaugguggcguc

SEQ ID NO: 2830429 - RNA, 20 nt, Mycobacterium avium subsp. paratuberculosis
cgcgaugguggcgucacgcu

SEQ ID NO: 2830430 - RNA, 13 nt, Mycobacterium avium subsp. paratuberculosis
cgcgauguagcgg

SEQ ID NO: 2830431 - RNA, 23 nt, Mycobacterium avium subsp. paratuberculosis
cgcgauguagcggacgggccgca

SEQ ID NO: 2830432 - RNA, 18 nt, Mycobacterium avium subsp. paratuberculosis
cgcgauguaggugcgcga

SEQ ID NO: 2830433 - RNA, 16 nt, Mycobacterium avium subsp. paratuberculosis
cgcgauguccgacagc

SEQ ID NO: 2830434 - RNA, 22 nt, Mycobacterium avium subsp. paratuberculosis
cgcgauguccgacagcccgccc

SEQ ID NO: 2830435 - RNA, 13 nt, Mycobacterium avium subsp. paratuberculosis
cgcgaugucgacg

SEQ ID NO: 2830436 - RNA, 20 nt, Mycobacterium avium subsp. paratuberculosis
cgcgaugucggugggccgca

SEQ ID NO: 2830437 - RNA, 22 nt, Mycobacterium avium subsp. paratuberculosis
cgcgaugucggugggccgcacc

SEQ ID NO: 2830438 - RNA, 24 nt, Mycobacterium avium subsp. paratuberculosis
cgcgaugugccacuucgacggcag

SEQ ID NO: 2830439 - RNA, 15 nt, Mycobacterium avium subsp. paratuberculosis
cgcgaugugcucgau

SEQ ID NO: 2830440 - RNA, 21 nt, Mycobacterium avium subsp. paratuberculosis
cgcgauucgguaccagggcag

SEQ ID NO: 2830441 - RNA, 18 nt, Mycobacterium avium subsp. paratuberculosis
cgcgauucucgcugcggc

SEQ ID NO: 2830442 - RNA, 19 nt, Mycobacterium avium subsp. paratuberculosis
cgcgauucucgcugcggcg

SEQ ID NO: 2830443 - RNA, 21 nt, Mycobacterium avium subsp. paratuberculosis
cgcgauuuccgguugcggcag

SEQ ID NO: 2830444 - RNA, 16 nt, Mycobacterium avium subsp. paratuberculosis
cgcgcaaacugacagg

SEQ ID NO: 2830445 - RNA, 22 nt, Mycobacterium avium subsp. paratuberculosis
cgcgcaaacugacaggcggucg

SEQ ID NO: 2830446 - RNA, 23 nt, Mycobacterium avium subsp. paratuberculosis
cgcgcacguuggcggccagcgcg

SEQ ID NO: 2830447 - RNA, 18 nt, Mycobacterium avium subsp. paratuberculosis
cgcgcacuggagugcugc

SEQ ID NO: 2830448 - RNA, 16 nt, Mycobacterium avium subsp. paratuberculosis
cgcgcacuucgcgggc

SEQ ID NO: 2830449 - RNA, 18 nt, Mycobacterium avium subsp. paratuberculosis
cgcgcacuucgcgggcgg

SEQ ID NO: 2830450 - RNA, 19 nt, Mycobacterium avium subsp. paratuberculosis
cgcgcacuucgcgggcggc

SEQ ID NO: 2830451 - RNA, 20 nt, Mycobacterium avium subsp. paratuberculosis
cgcgcagaaaccccacgauc

SEQ ID NO: 2830452 - RNA, 19 nt, Mycobacterium avium subsp. paratuberculosis
cgcgcagaacaccaccgcc

SEQ ID NO: 2830453 - RNA, 21 nt, Mycobacterium avium subsp. paratuberculosis
cgcgcagaacaccaccgccag

SEQ ID NO: 2830454 - RNA, 21 nt, Mycobacterium avium subsp. paratuberculosis
cgcgcagaaccgcaccccguc

SEQ ID NO: 2830455 - RNA, 19 nt, Mycobacterium avium subsp. paratuberculosis
cgcgcagaucgagaucagg

SEQ ID NO: 2830456 - RNA, 15 nt, Mycobacterium avium subsp. paratuberculosis
cgcgcagaucgaugg

SEQ ID NO: 2830457 - RNA, 22 nt, Mycobacterium avium subsp. paratuberculosis
cgcgcagaucgccagcaccggc

SEQ ID NO: 2830458 - RNA, 15 nt, Mycobacterium avium subsp. paratuberculosis
cgcgcagaucgucga

SEQ ID NO: 2830459 - RNA, 18 nt, Mycobacterium avium subsp. paratuberculosis
cgcgcagaucgucgaacu

SEQ ID NO: 2830460 - RNA, 20 nt, Mycobacterium avium subsp. paratuberculosis
cgcgcagcaauugacgccga

SEQ ID NO: 2830461 - RNA, 14 nt, Mycobacterium avium subsp. paratuberculosis
cgcgcagcaccagc

SEQ ID NO: 2830462 - RNA, 16 nt, Mycobacterium avium subsp. paratuberculosis
cgcgcagcaccagcuc

SEQ ID NO: 2830463 - RNA, 12 nt, Mycobacterium avium subsp. paratuberculosis
cgcgcagcaccg

SEQ ID NO: 2830464 - RNA, 13 nt, Mycobacterium avium subsp. paratuberculosis
cgcgcagcaccgc

SEQ ID NO: 2830465 - RNA, 15 nt, Mycobacterium avium subsp. paratuberculosis
cgcgcagcaccgcgu

SEQ ID NO: 2830466 - RNA, 23 nt, Mycobacterium avium subsp. paratuberculosis
cgcgcagcaccgcgucggcgcug

SEQ ID NO: 2830467 - RNA, 17 nt, Mycobacterium avium subsp. paratuberculosis
cgcgcagcaccuccugg

SEQ ID NO: 2830468 - RNA, 21 nt, Mycobacterium avium subsp. paratuberculosis
cgcgcagcacgaugaucccga

SEQ ID NO: 2830469 - RNA, 15 nt, Mycobacterium avium subsp. paratuberculosis
cgcgcagcacggaac

SEQ ID NO: 2830470 - RNA, 20 nt, Mycobacterium avium subsp. paratuberculosis
cgcgcagcagcugcacccgc

SEQ ID NO: 2830471 - RNA, 15 nt, Mycobacterium avium subsp. paratuberculosis
cgcgcagcauccgca

SEQ ID NO: 2830472 - RNA, 19 nt, Mycobacterium avium subsp. paratuberculosis
cgcgcagcauccgcaccag

SEQ ID NO: 2830473 - RNA, 22 nt, Mycobacterium avium subsp. paratuberculosis
cgcgcagcaucucuugaugcag

SEQ ID NO: 2830474 - RNA, 14 nt, Mycobacterium avium subsp. paratuberculosis
cgcgcagcauggcc

SEQ ID NO: 2830475 - RNA, 17 nt, Mycobacterium avium subsp. paratuberculosis
cgcgcagcauggcccac

SEQ ID NO: 2830476 - RNA, 18 nt, Mycobacterium avium subsp. paratuberculosis
cgcgcagcauggcccaca

SEQ ID NO: 2830477 - RNA, 17 nt, Mycobacterium avium subsp. paratuberculosis
cgcgcagccaccgcccg

SEQ ID NO: 2830478 - RNA, 22 nt, Mycobacterium avium subsp. paratuberculosis
cgcgcagccaccgcccgaaccg

SEQ ID NO: 2830479 - RNA, 15 nt, Mycobacterium avium subsp. paratuberculosis
cgcgcagccacgagc

SEQ ID NO: 2830480 - RNA, 13 nt, Mycobacterium avium subsp. paratuberculosis
cgcgcagccagac

SEQ ID NO: 2830481 - RNA, 14 nt, Mycobacterium avium subsp. paratuberculosis
cgcgcagccagacc

SEQ ID NO: 2830482 - RNA, 20 nt, Mycobacterium avium subsp. paratuberculosis
cgcgcagccagaccucgccg

SEQ ID NO: 2830483 - RNA, 18 nt, Mycobacterium avium subsp. paratuberculosis
cgcgcagccagucgccgg

SEQ ID NO: 2830484 - RNA, 20 nt, Mycobacterium avium subsp. paratuberculosis
cgcgcagccagucgccggcc

SEQ ID NO: 2830485 - RNA, 21 nt, Mycobacterium avium subsp. paratuberculosis
cgcgcagccagucgccggcca

SEQ ID NO: 2830486 - RNA, 13 nt, Mycobacterium avium subsp. paratuberculosis
cgcgcagcccagc

SEQ ID NO: 2830487 - RNA, 17 nt, Mycobacterium avium subsp. paratuberculosis
cgcgcagcccagccagc

SEQ ID NO: 2830488 - RNA, 16 nt, Mycobacterium avium subsp. paratuberculosis
cgcgcagcccccggac

SEQ ID NO: 2830489 - RNA, 16 nt, Mycobacterium avium subsp. paratuberculosis
cgcgcagccgccgggc

SEQ ID NO: 2830490 - RNA, 15 nt, Mycobacterium avium subsp. paratuberculosis
cgcgcagccgcggug

SEQ ID NO: 2830491 - RNA, 17 nt, Mycobacterium avium subsp. paratuberculosis
cgcgcagccggccgacc

SEQ ID NO: 2830492 - RNA, 18 nt, Mycobacterium avium subsp. paratuberculosis
cgcgcagccggccgaccg

SEQ ID NO: 2830493 - RNA, 18 nt, Mycobacterium avium subsp. paratuberculosis
cgcgcagccggccgucca

SEQ ID NO: 2830494 - RNA, 22 nt, Mycobacterium avium subsp. paratuberculosis
cgcgcagccggccguccacggc

SEQ ID NO: 2830495 - RNA, 23 nt, Mycobacterium avium subsp. paratuberculosis
cgcgcagccggccguccacggcg

SEQ ID NO: 2830496 - RNA, 12 nt, Mycobacterium avium subsp. paratuberculosis
cgcgcagccggg

SEQ ID NO: 2830497 - RNA, 13 nt, Mycobacterium avium subsp. paratuberculosis
cgcgcagccgggc

SEQ ID NO: 2830498 - RNA, 14 nt, Mycobacterium avium subsp. paratuberculosis
cgcgcagccgggcg

SEQ ID NO: 2830499 - RNA, 16 nt, Mycobacterium avium subsp. paratuberculosis
cgcgcagccgggcggc

SEQ ID NO: 2830500 - RNA, 18 nt, Mycobacterium avium subsp. paratuberculosis
cgcgcagccgggcggcgc

SEQ ID NO: 2830501 - RNA, 19 nt, Mycobacterium avium subsp. paratuberculosis
cgcgcagccgggcggcgcu

SEQ ID NO: 2830502 - RNA, 15 nt, Mycobacterium avium subsp. paratuberculosis
cgcgcagcgcgucgg

SEQ ID NO: 2830503 - RNA, 15 nt, Mycobacterium avium subsp. paratuberculosis
cgcgcagcgcuucca

SEQ ID NO: 2830504 - RNA, 13 nt, Mycobacterium avium subsp. paratuberculosis
cgcgcagcggggc

SEQ ID NO: 2830505 - RNA, 13 nt, Mycobacterium avium subsp. paratuberculosis
cgcgcagcgucau

SEQ ID NO: 2830506 - RNA, 14 nt, Mycobacterium avium subsp. paratuberculosis
cgcgcagcgucauc

SEQ ID NO: 2830507 - RNA, 20 nt, Mycobacterium avium subsp. paratuberculosis
cgcgcagcgucuugcccagc

SEQ ID NO: 2830508 - RNA, 21 nt, Mycobacterium avium subsp. paratuberculosis
cgcgcagcgucuugcccagcg

SEQ ID NO: 2830509 - RNA, 13 nt, Mycobacterium avium subsp. paratuberculosis
cgcgcagcguguc

SEQ ID NO: 2830510 - RNA, 21 nt, Mycobacterium avium subsp. paratuberculosis
cgcgcagcgugucggggucgg

SEQ ID NO: 2830511 - RNA, 14 nt, Mycobacterium avium subsp. paratuberculosis
cgcgcagcucgacg

SEQ ID NO: 2830512 - RNA, 15 nt, Mycobacterium avium subsp. paratuberculosis
cgcgcagcucgacga

SEQ ID NO: 2830513 - RNA, 16 nt, Mycobacterium avium subsp. paratuberculosis
cgcgcagcucgacgac

SEQ ID NO: 2830514 - RNA, 17 nt, Mycobacterium avium subsp. paratuberculosis
cgcgcagcucgacgacc

SEQ ID NO: 2830515 - RNA, 13 nt, Mycobacterium avium subsp. paratuberculosis
cgcgcagcucgcg

SEQ ID NO: 2830516 - RNA, 17 nt, Mycobacterium avium subsp. paratuberculosis
cgcgcagcucgcgcagc

SEQ ID NO: 2830517 - RNA, 22 nt, Mycobacterium avium subsp. paratuberculosis
cgcgcagcucgcgcagccggcc

SEQ ID NO: 2830518 - RNA, 14 nt, Mycobacterium avium subsp. paratuberculosis
cgcgcagcucgggg

SEQ ID NO: 2830519 - RNA, 15 nt, Mycobacterium avium subsp. paratuberculosis
cgcgcagcucggggu

SEQ ID NO: 2830520 - RNA, 17 nt, Mycobacterium avium subsp. paratuberculosis
cgcgcagcucugcucgu

SEQ ID NO: 2830521 - RNA, 13 nt, Mycobacterium avium subsp. paratuberculosis
cgcgcagcugcgc

SEQ ID NO: 2830522 - RNA, 14 nt, Mycobacterium avium subsp. paratuberculosis
cgcgcagcugcgcc

SEQ ID NO: 2830523 - RNA, 21 nt, Mycobacterium avium subsp. paratuberculosis
cgcgcagcugcgccgcgucga

SEQ ID NO: 2830524 - RNA, 14 nt, Mycobacterium avium subsp. paratuberculosis
cgcgcagcuggccg

SEQ ID NO: 2830525 - RNA, 18 nt, Mycobacterium avium subsp. paratuberculosis
cgcgcaggaacagcgacc

SEQ ID NO: 2830526 - RNA, 19 nt, Mycobacterium avium subsp. paratuberculosis
cgcgcaggaacagcgaccc

SEQ ID NO: 2830527 - RNA, 20 nt, Mycobacterium avium subsp. paratuberculosis
cgcgcaggaacuccagcagc

SEQ ID NO: 2830528 - RNA, 13 nt, Mycobacterium avium subsp. paratuberculosis
cgcgcaggccccg

SEQ ID NO: 2830529 - RNA, 14 nt, Mycobacterium avium subsp. paratuberculosis
cgcgcaggccccgg

SEQ ID NO: 2830530 - RNA, 15 nt, Mycobacterium avium subsp. paratuberculosis
cgcgcaggccccggc

SEQ ID NO: 2830531 - RNA, 17 nt, Mycobacterium avium subsp. paratuberculosis
cgcgccagccgccgccg

SEQ ID NO: 2830532 - RNA, 20 nt, Mycobacterium avium subsp. paratuberculosis
cgcgccagccgccgccgacc

SEQ ID NO: 2830533 - RNA, 12 nt, Mycobacterium avium subsp. paratuberculosis
cgcgccagcgcg

SEQ ID NO: 2830534 - RNA, 17 nt, Mycobacterium avium subsp. paratuberculosis
cgcgccagcgcgugcgg

SEQ ID NO: 2830535 - RNA, 15 nt, Mycobacterium avium subsp. paratuberculosis
cgcgccaggaccagc

SEQ ID NO: 2830536 - RNA, 19 nt, Mycobacterium avium subsp. paratuberculosis
cgcgccaggucgaagaggu

SEQ ID NO: 2830537 - RNA, 19 nt, Mycobacterium avium subsp. paratuberculosis
cgcgccauuuccguugugc

SEQ ID NO: 2830538 - RNA, 14 nt, Mycobacterium avium subsp. paratuberculosis
cgcgcccacccgcg

SEQ ID NO: 2830539 - RNA, 18 nt, Mycobacterium avium subsp. paratuberculosis
cgcgcccacccgcgccgg

SEQ ID NO: 2830540 - RNA, 16 nt, Mycobacterium avium subsp. paratuberculosis
cgcgcccagccccagc

SEQ ID NO: 2830541 - RNA, 21 nt, Mycobacterium avium subsp. paratuberculosis
cgcgcccaggaacgcgccggc

SEQ ID NO: 2830542 - RNA, 23 nt, Mycobacterium avium subsp. paratuberculosis
cgcgcccaggaacgcgccggcgc

SEQ ID NO: 2830543 - RNA, 12 nt, Mycobacterium avium subsp. paratuberculosis
cgcgcccaggcc

SEQ ID NO: 2830544 - RNA, 14 nt, Mycobacterium avium subsp. paratuberculosis
cgcgcccaggcccg

SEQ ID NO: 2830545 - RNA, 13 nt, Mycobacterium avium subsp. paratuberculosis
cgcgcccaggcug

SEQ ID NO: 2830546 - RNA, 19 nt, Mycobacterium avium subsp. paratuberculosis
cgcgcccaggcugaacacc

SEQ ID NO: 2830547 - RNA, 11 nt, Mycobacterium avium subsp. paratuberculosis
cgcgcccaggg

SEQ ID NO: 2830548 - RNA, 16 nt, Mycobacterium avium subsp. paratuberculosis
cgcgcccaggggagcg

SEQ ID NO: 2830549 - RNA, 17 nt, Mycobacterium avium subsp. paratuberculosis
cgcgcccaggggagcgg

SEQ ID NO: 2830550 - RNA, 18 nt, Mycobacterium avium subsp. paratuberculosis
cgcgcccaggggagcggc

SEQ ID NO: 2830551 - RNA, 18 nt, Mycobacterium avium subsp. paratuberculosis
cgcgcccaucgcggccgc

SEQ ID NO: 2830552 - RNA, 20 nt, Mycobacterium avium subsp. paratuberculosis
cgcgcccaucgcggccgccc

SEQ ID NO: 2830553 - RNA, 19 nt, Mycobacterium avium subsp. paratuberculosis
cgcgcccaugaacgcgucg

SEQ ID NO: 2830554 - RNA, 20 nt, Mycobacterium avium subsp. paratuberculosis
cgcgcccaugaacgcgucgc

SEQ ID NO: 2830555 - RNA, 22 nt, Mycobacterium avium subsp. paratuberculosis
cgcgcccaugaacgcgucgccg

SEQ ID NO: 2830556 - RNA, 14 nt, Mycobacterium avium subsp. paratuberculosis
cgcgccccagcccc

SEQ ID NO: 2830557 - RNA, 23 nt, Mycobacterium avium subsp. paratuberculosis
cgcgccccagccccucgccgggc

SEQ ID NO: 2830558 - RNA, 18 nt, Mycobacterium avium subsp. paratuberculosis
cgcgccccagugcaggca

SEQ ID NO: 2830559 - RNA, 15 nt, Mycobacterium avium subsp. paratuberculosis
cgcgcccccugggac

SEQ ID NO: 2830560 - RNA, 13 nt, Mycobacterium avium subsp. paratuberculosis
cgcgccccgagca

SEQ ID NO: 2830561 - RNA, 15 nt, Mycobacterium avium subsp. paratuberculosis
cgcgccccgagcagc

SEQ ID NO: 2830562 - RNA, 19 nt, Mycobacterium avium subsp. paratuberculosis
cgcgccccgagcagcgggu

SEQ ID NO: 2830563 - RNA, 23 nt, Mycobacterium avium subsp. paratuberculosis
cgcgccccgagcagcgggucguc

SEQ ID NO: 2830564 - RNA, 13 nt, Mycobacterium avium subsp. paratuberculosis
cgcgccccgccgg

SEQ ID NO: 2830565 - RNA, 15 nt, Mycobacterium avium subsp. paratuberculosis
cgcgccccgccggga

SEQ ID NO: 2830566 - RNA, 16 nt, Mycobacterium avium subsp. paratuberculosis
cgcgccccgccgggau

SEQ ID NO: 2830567 - RNA, 18 nt, Mycobacterium avium subsp. paratuberculosis
cgcgccccggcccggcga

SEQ ID NO: 2830568 - RNA, 23 nt, Mycobacterium avium subsp. paratuberculosis
cgcgccccggcccguccagaucg

SEQ ID NO: 2830569 - RNA, 15 nt, Mycobacterium avium subsp. paratuberculosis
cgcgccccggcgcag

SEQ ID NO: 2830570 - RNA, 16 nt, Mycobacterium avium subsp. paratuberculosis
cgcgccccggcgcagc

SEQ ID NO: 2830571 - RNA, 19 nt, Mycobacterium avium subsp. paratuberculosis
cgcgccccggcgcagcgcc

SEQ ID NO: 2830572 - RNA, 15 nt, Mycobacterium avium subsp. paratuberculosis
cgcgccccggcgcgc

SEQ ID NO: 2830573 - RNA, 17 nt, Mycobacterium avium subsp. paratuberculosis
cgcgccccggcgcgccu

SEQ ID NO: 2830574 - RNA, 18 nt, Mycobacterium avium subsp. paratuberculosis
cgcgccccggcgcgccug

SEQ ID NO: 2830575 - RNA, 13 nt, Mycobacterium avium subsp. paratuberculosis
cgcgccccggcgg

SEQ ID NO: 2830576 - RNA, 14 nt, Mycobacterium avium subsp. paratuberculosis
cgcgccccggcggc

SEQ ID NO: 2830577 - RNA, 15 nt, Mycobacterium avium subsp. paratuberculosis
cgcgccccggcggcc

SEQ ID NO: 2830578 - RNA, 17 nt, Mycobacterium avium subsp. paratuberculosis
cgcgccccggcggccac

SEQ ID NO: 2830579 - RNA, 19 nt, Mycobacterium avium subsp. paratuberculosis
cgcgccccggucccgccgg

SEQ ID NO: 2830580 - RNA, 13 nt, Mycobacterium avium subsp. paratuberculosis
cgcgcccgacgau

SEQ ID NO: 2830581 - RNA, 18 nt, Mycobacterium avium subsp. paratuberculosis
cgcgcccgacggucgcca

SEQ ID NO: 2830582 - RNA, 22 nt, Mycobacterium avium subsp. paratuberculosis
cgcgcccgagcauuucgcgcac

SEQ ID NO: 2830583 - RNA, 23 nt, Mycobacterium avium subsp. paratuberculosis
cgcgcccgagcauuucgcgcacg

SEQ ID NO: 2830584 - RNA, 23 nt, Mycobacterium avium subsp. paratuberculosis
cgcgcccgagucacccggcuggc

SEQ ID NO: 2830585 - RNA, 14 nt, Mycobacterium avium subsp. paratuberculosis
cgcgcccgauggag

SEQ ID NO: 2830586 - RNA, 13 nt, Mycobacterium avium subsp. paratuberculosis
cgcgcccgccgcg

SEQ ID NO: 2830587 - RNA, 14 nt, Mycobacterium avium subsp. paratuberculosis
cgcgcccgccggcc

SEQ ID NO: 2830588 - RNA, 17 nt, Mycobacterium avium subsp. paratuberculosis
cgcgcccgccggcccag

SEQ ID NO: 2830589 - RNA, 18 nt, Mycobacterium avium subsp. paratuberculosis
cgcgcccgccggcccagc

SEQ ID NO: 2830590 - RNA, 13 nt, Mycobacterium avium subsp. paratuberculosis
cgcgcccgcgaac

SEQ ID NO: 2830591 - RNA, 19 nt, Mycobacterium avium subsp. paratuberculosis
cgcgcccgcgaacacgcga

SEQ ID NO: 2830592 - RNA, 14 nt, Mycobacterium avium subsp. paratuberculosis
cgcgcccgcggcca

SEQ ID NO: 2830593 - RNA, 15 nt, Mycobacterium avium subsp. paratuberculosis
cgcgcccgcggccau

SEQ ID NO: 2830594 - RNA, 18 nt, Mycobacterium avium subsp. paratuberculosis
cgcgcccgcggccaucgc

SEQ ID NO: 2830595 - RNA, 22 nt, Mycobacterium avium subsp. paratuberculosis
cgcgcccggaaagcgcgggcag

SEQ ID NO: 2830596 - RNA, 14 nt, Mycobacterium avium subsp. paratuberculosis
cgcgcccggcaccg

SEQ ID NO: 2830597 - RNA, 15 nt, Mycobacterium avium subsp. paratuberculosis
cgcgcccggcaccgc

SEQ ID NO: 2830598 - RNA, 16 nt, Mycobacterium avium subsp. paratuberculosis
cgcgcccggcaccgcg

SEQ ID NO: 2830599 - RNA, 12 nt, Mycobacterium avium subsp. paratuberculosis
cgcgcccggcca

SEQ ID NO: 2830600 - RNA, 11 nt, Mycobacterium avium subsp. paratuberculosis
cgcgcccggcg

SEQ ID NO: 2830601 - RNA, 13 nt, Mycobacterium avium subsp. paratuberculosis
cgcgcccggcgac

SEQ ID NO: 2830602 - RNA, 15 nt, Mycobacterium avium subsp. paratuberculosis
cgcgcccggcgacgc

SEQ ID NO: 2830603 - RNA, 16 nt, Mycobacterium avium subsp. paratuberculosis
cgcgcccggcgacgcg

SEQ ID NO: 2830604 - RNA, 19 nt, Mycobacterium avium subsp. paratuberculosis
cgcgcccggcgacgcggcg

SEQ ID NO: 2830605 - RNA, 16 nt, Mycobacterium avium subsp. paratuberculosis
cgcgcccggcgccggc

SEQ ID NO: 2830606 - RNA, 20 nt, Mycobacterium avium subsp. paratuberculosis
cgcgcccggcgccggcccgc

SEQ ID NO: 2830607 - RNA, 13 nt, Mycobacterium avium subsp. paratuberculosis
cgcgcccggcggg

SEQ ID NO: 2830608 - RNA, 14 nt, Mycobacterium avium subsp. paratuberculosis
cgcgcccggcgucg

SEQ ID NO: 2830609 - RNA, 15 nt, Mycobacterium avium subsp. paratuberculosis
cgcgcccggcgucgg

SEQ ID NO: 2830610 - RNA, 14 nt, Mycobacterium avium subsp. paratuberculosis
cgcgcccggcuucg

SEQ ID NO: 2830611 - RNA, 17 nt, Mycobacterium avium subsp. paratuberculosis
cgcgcccggcuucgccg

SEQ ID NO: 2830612 - RNA, 13 nt, Mycobacterium avium subsp. paratuberculosis
cgcgcccgucgag

SEQ ID NO: 2830613 - RNA, 22 nt, Mycobacterium avium subsp. paratuberculosis
cgcgcccgucgagcgucauucc

SEQ ID NO: 2830614 - RNA, 21 nt, Mycobacterium avium subsp. paratuberculosis
cgcgcccuaacgugcccggcc

SEQ ID NO: 2830615 - RNA, 19 nt, Mycobacterium avium subsp. paratuberculosis
cgcgcccuagucgacgccg

SEQ ID NO: 2830616 - RNA, 14 nt, Mycobacterium avium subsp. paratuberculosis
cgcgccgcccggcg

SEQ ID NO: 2830617 - RNA, 18 nt, Mycobacterium avium subsp. paratuberculosis
cgcgccgcccggcgaucu

SEQ ID NO: 2830618 - RNA, 13 nt, Mycobacterium avium subsp. paratuberculosis
cgcgccgccgacc

SEQ ID NO: 2830619 - RNA, 13 nt, Mycobacterium avium subsp. paratuberculosis
cgcgccgccgaug

SEQ ID NO: 2830620 - RNA, 13 nt, Mycobacterium avium subsp. paratuberculosis
cgcgccgccgcca

SEQ ID NO: 2830621 - RNA, 19 nt, Mycobacterium avium subsp. paratuberculosis
cgcgccgccgccagccagc

SEQ ID NO: 2830622 - RNA, 21 nt, Mycobacterium avium subsp. paratuberculosis
cgcgccgccgccagccagccg

SEQ ID NO: 2830623 - RNA, 13 nt, Mycobacterium avium subsp. paratuberculosis
cgcgccgccgccc

SEQ ID NO: 2830624 - RNA, 14 nt, Mycobacterium avium subsp. paratuberculosis
cgcgccgccgccgc

SEQ ID NO: 2830625 - RNA, 16 nt, Mycobacterium avium subsp. paratuberculosis
cgcgccgccgccgccc

SEQ ID NO: 2830626 - RNA, 19 nt, Mycobacterium avium subsp. paratuberculosis
cgcgccgccgcguaggcca

SEQ ID NO: 2830627 - RNA, 21 nt, Mycobacterium avium subsp. paratuberculosis
cgcgccgccgcgucgugccga

SEQ ID NO: 2830628 - RNA, 13 nt, Mycobacterium avium subsp. paratuberculosis
cgcgccgccggug

SEQ ID NO: 2830629 - RNA, 20 nt, Mycobacterium avium subsp. paratuberculosis
cgcgccgccuucuugcgcgg

SEQ ID NO: 2830630 - RNA, 16 nt, Mycobacterium avium subsp. paratuberculosis
cgcgccgcgacgucgg

SEQ ID NO: 2830631 - RNA, 13 nt, Mycobacterium avium subsp. paratuberculosis
cgcgccgcgaucu

SEQ ID NO: 2830632 - RNA, 16 nt, Mycobacterium avium subsp. paratuberculosis
cgcgccgcgaucucgg

SEQ ID NO: 2830633 - RNA, 20 nt, Mycobacterium avium subsp. paratuberculosis
cgcgccgcgaucucggcgga

SEQ ID NO: 2830634 - RNA, 13 nt, Mycobacterium avium subsp. paratuberculosis
cgcgccgcgcauu

SEQ ID NO: 2830635 - RNA, 13 nt, Mycobacterium avium subsp. paratuberculosis
cgcgccgcgccgc

SEQ ID NO: 2830636 - RNA, 15 nt, Mycobacterium avium subsp. paratuberculosis
cgcgccgcgccgccu

SEQ ID NO: 2830637 - RNA, 13 nt, Mycobacterium avium subsp. paratuberculosis
cgcgccgcgcgcc

SEQ ID NO: 2830638 - RNA, 14 nt, Mycobacterium avium subsp. paratuberculosis
cgcgccgcgcgccc

SEQ ID NO: 2830639 - RNA, 13 nt, Mycobacterium avium subsp. paratuberculosis
cgcgccgcggcca

SEQ ID NO: 2830640 - RNA, 14 nt, Mycobacterium avium subsp. paratuberculosis
cgcgccgcggccag

SEQ ID NO: 2830641 - RNA, 15 nt, Mycobacterium avium subsp. paratuberculosis
cgcgccgcggccagc

SEQ ID NO: 2830642 - RNA, 16 nt, Mycobacterium avium subsp. paratuberculosis
cgcgccgcggccagcg

SEQ ID NO: 2830643 - RNA, 14 nt, Mycobacterium avium subsp. paratuberculosis
cgcgccgcggcgcu

SEQ ID NO: 2830644 - RNA, 17 nt, Mycobacterium avium subsp. paratuberculosis
cgcgccgcggcgcuuga

SEQ ID NO: 2830645 - RNA, 13 nt, Mycobacterium avium subsp. paratuberculosis
cgcgccgcgggug

SEQ ID NO: 2830646 - RNA, 17 nt, Mycobacterium avium subsp. paratuberculosis
cgcgccgcgggugacga

SEQ ID NO: 2830647 - RNA, 21 nt, Mycobacterium avium subsp. paratuberculosis
cgcgccgcgucgcgccgccgc

SEQ ID NO: 2830648 - RNA, 14 nt, Mycobacterium avium subsp. paratuberculosis
cgcgccgcgucguc

SEQ ID NO: 2830649 - RNA, 15 nt, Mycobacterium avium subsp. paratuberculosis
cgcgccgcgucgucg

SEQ ID NO: 2830650 - RNA, 21 nt, Mycobacterium avium subsp. paratuberculosis
cgcgccgcgucgucgucgacc

SEQ ID NO: 2830651 - RNA, 14 nt, Mycobacterium avium subsp. paratuberculosis
cgcgccgcucggcc

SEQ ID NO: 2830652 - RNA, 15 nt, Mycobacterium avium subsp. paratuberculosis
cgcgccgcucggcca

SEQ ID NO: 2830653 - RNA, 16 nt, Mycobacterium avium subsp. paratuberculosis
cgcgccgcucggccag

SEQ ID NO: 2830654 - RNA, 17 nt, Mycobacterium avium subsp. paratuberculosis
cgcgccgcucggccagc

SEQ ID NO: 2830655 - RNA, 19 nt, Mycobacterium avium subsp. paratuberculosis
cgcgccgcucggccagcag

SEQ ID NO: 2830656 - RNA, 20 nt, Mycobacterium avium subsp. paratuberculosis
cgcgccgcucggccagcagc

SEQ ID NO: 2830657 - RNA, 23 nt, Mycobacterium avium subsp. paratuberculosis
cgcgccgcucggccagcagcacc

SEQ ID NO: 2830658 - RNA, 12 nt, Mycobacterium avium subsp. paratuberculosis
cgcgccggccag

SEQ ID NO: 2830659 - RNA, 13 nt, Mycobacterium avium subsp. paratuberculosis
cgcgccggccagc

SEQ ID NO: 2830660 - RNA, 16 nt, Mycobacterium avium subsp. paratuberculosis
cgcgccggccagcacg

SEQ ID NO: 2830661 - RNA, 15 nt, Mycobacterium avium subsp. paratuberculosis
cgcgccggccagcag

SEQ ID NO: 2830662 - RNA, 16 nt, Mycobacterium avium subsp. paratuberculosis
cgcgccggccagcagc

SEQ ID NO: 2830663 - RNA, 17 nt, Mycobacterium avium subsp. paratuberculosis
cgcgccggccagcagca

SEQ ID NO: 2830664 - RNA, 15 nt, Mycobacterium avium subsp. paratuberculosis
cgcgccggccagccg

SEQ ID NO: 2830665 - RNA, 14 nt, Mycobacterium avium subsp. paratuberculosis
cgcgccggccgccg

SEQ ID NO: 2830666 - RNA, 15 nt, Mycobacterium avium subsp. paratuberculosis
cgcgccggccgccgc

SEQ ID NO: 2830667 - RNA, 13 nt, Mycobacterium avium subsp. paratuberculosis
cgcgccggccgga

SEQ ID NO: 2830668 - RNA, 18 nt, Mycobacterium avium subsp. paratuberculosis
cgcgccggccggacagau

SEQ ID NO: 2830669 - RNA, 15 nt, Mycobacterium avium subsp. paratuberculosis
cgcgccggccggagc

SEQ ID NO: 2830670 - RNA, 17 nt, Mycobacterium avium subsp. paratuberculosis
cgcgccggccggagcgg

SEQ ID NO: 2830671 - RNA, 14 nt, Mycobacterium avium subsp. paratuberculosis
cgcgccggccggca

SEQ ID NO: 2830672 - RNA, 16 nt, Mycobacterium avium subsp. paratuberculosis
cgcgccggccggcacg

SEQ ID NO: 2830673 - RNA, 19 nt, Mycobacterium avium subsp. paratuberculosis
cgcgccggccuuggcccgc

SEQ ID NO: 2830674 - RNA, 13 nt, Mycobacterium avium subsp. paratuberculosis
cgcgccggcgaua

SEQ ID NO: 2830675 - RNA, 20 nt, Mycobacterium avium subsp. paratuberculosis
cgcgccggcgauaggcggcc

SEQ ID NO: 2830676 - RNA, 22 nt, Mycobacterium avium subsp. paratuberculosis
cgcgccggcgauaggcggccag

SEQ ID NO: 2830677 - RNA, 14 nt, Mycobacterium avium subsp. paratuberculosis
cgcgccggcgcaca

SEQ ID NO: 2830678 - RNA, 13 nt, Mycobacterium avium subsp. paratuberculosis
cgcgccggcgcag

SEQ ID NO: 2830679 - RNA, 15 nt, Mycobacterium avium subsp. paratuberculosis
cgcgccggcgcagcg

SEQ ID NO: 2830680 - RNA, 18 nt, Mycobacterium avium subsp. paratuberculosis
cgcgccggcgcagcggcc

SEQ ID NO: 2830681 - RNA, 19 nt, Mycobacterium avium subsp. paratuberculosis
cgcgccggcgcagcggccc

SEQ ID NO: 2830682 - RNA, 12 nt, Mycobacterium avium subsp. paratuberculosis
cgcgccggcgcg

SEQ ID NO: 2830683 - RNA, 13 nt, Mycobacterium avium subsp. paratuberculosis
cgcgccggcgcgc

SEQ ID NO: 2830684 - RNA, 16 nt, Mycobacterium avium subsp. paratuberculosis
cgcgccggcgcgcagc

SEQ ID NO: 2830685 - RNA, 24 nt, Mycobacterium avium subsp. paratuberculosis
cgcgccggcgcgcagccagucgcc

SEQ ID NO: 2830686 - RNA, 15 nt, Mycobacterium avium subsp. paratuberculosis
cgcgccggcgcgggc

SEQ ID NO: 2830687 - RNA, 16 nt, Mycobacterium avium subsp. paratuberculosis
cgcgccggcgcgggca

SEQ ID NO: 2830688 - RNA, 19 nt, Mycobacterium avium subsp. paratuberculosis
cgcgccggcgcgggcauga

SEQ ID NO: 2830689 - RNA, 13 nt, Mycobacterium avium subsp. paratuberculosis
cgcgccggcggcc

SEQ ID NO: 2830690 - RNA, 15 nt, Mycobacterium avium subsp. paratuberculosis
cgcgccggcggccgc

SEQ ID NO: 2830691 - RNA, 17 nt, Mycobacterium avium subsp. paratuberculosis
cgcgccggcggccgccg

SEQ ID NO: 2830692 - RNA, 18 nt, Mycobacterium avium subsp. paratuberculosis
cgcgccggcggccgccgc

SEQ ID NO: 2830693 - RNA, 20 nt, Mycobacterium avium subsp. paratuberculosis
cgcgccggcggccgccgccc

SEQ ID NO: 2830694 - RNA, 21 nt, Mycobacterium avium subsp. paratuberculosis
cgcgccggcggcggcgguccg

SEQ ID NO: 2830695 - RNA, 13 nt, Mycobacterium avium subsp. paratuberculosis
cgcgccggcgguc

SEQ ID NO: 2830696 - RNA, 16 nt, Mycobacterium avium subsp. paratuberculosis
cgcgccggcgucggug

SEQ ID NO: 2830697 - RNA, 12 nt, Mycobacterium avium subsp. paratuberculosis
cgcgccggcgug

SEQ ID NO: 2830698 - RNA, 14 nt, Mycobacterium avium subsp. paratuberculosis
cgcgccggcguguc

SEQ ID NO: 2830699 - RNA, 12 nt, Mycobacterium avium subsp. paratuberculosis
cgcgccgggcaa

SEQ ID NO: 2830700 - RNA, 16 nt, Mycobacterium avium subsp. paratuberculosis
cgcgccgggcaacagc

SEQ ID NO: 2830701 - RNA, 20 nt, Mycobacterium avium subsp. paratuberculosis
cgcgccgggcaacagcgcgc

SEQ ID NO: 2830702 - RNA, 18 nt, Mycobacterium avium subsp. paratuberculosis
cgcgccuucuugcugccc

SEQ ID NO: 2830703 - RNA, 15 nt, Mycobacterium avium subsp. paratuberculosis
cgcgccuugggccau

SEQ ID NO: 2830704 - RNA, 21 nt, Mycobacterium avium subsp. paratuberculosis
cgcgcgaacagccgaccgauc

SEQ ID NO: 2830705 - RNA, 15 nt, Mycobacterium avium subsp. paratuberculosis
cgcgcgaaggcucgc

SEQ ID NO: 2830706 - RNA, 19 nt, Mycobacterium avium subsp. paratuberculosis
cgcgcgaaggcucgccacg

SEQ ID NO: 2830707 - RNA, 20 nt, Mycobacterium avium subsp. paratuberculosis
cgcgcgaaggcucgccacgc

SEQ ID NO: 2830708 - RNA, 20 nt, Mycobacterium avium subsp. paratuberculosis
cgcgcgacaucaccgcgggc

SEQ ID NO: 2830709 - RNA, 23 nt, Mycobacterium avium subsp. paratuberculosis
cgcgcgacaucaccgcgggcgcg

SEQ ID NO: 2830710 - RNA, 18 nt, Mycobacterium avium subsp. paratuberculosis
cgcgcgaccaucagcccg

SEQ ID NO: 2830711 - RNA, 22 nt, Mycobacterium avium subsp. paratuberculosis
cgcgcgaccaucagcccgguga

SEQ ID NO: 2830712 - RNA, 13 nt, Mycobacterium avium subsp. paratuberculosis
cgcgcgaccgcga

SEQ ID NO: 2830713 - RNA, 15 nt, Mycobacterium avium subsp. paratuberculosis
cgcgcgaccgcgaug

SEQ ID NO: 2830714 - RNA, 16 nt, Mycobacterium avium subsp. paratuberculosis
cgcgcgaccgcgaugc

SEQ ID NO: 2830715 - RNA, 22 nt, Mycobacterium avium subsp. paratuberculosis
cgcgcgaccgcgaugcgacacc

SEQ ID NO: 2830716 - RNA, 13 nt, Mycobacterium avium subsp. paratuberculosis
cgcgcgacgccgu

SEQ ID NO: 2830717 - RNA, 15 nt, Mycobacterium avium subsp. paratuberculosis
cgcgcgacggcgcgu

SEQ ID NO: 2830718 - RNA, 21 nt, Mycobacterium avium subsp. paratuberculosis
cgcgcgacugggcgcccaccc

SEQ ID NO: 2830719 - RNA, 19 nt, Mycobacterium avium subsp. paratuberculosis
cgcgcgagacaccucgucg

SEQ ID NO: 2830720 - RNA, 20 nt, Mycobacterium avium subsp. paratuberculosis
cgcgcgagacaccucgucga

SEQ ID NO: 2830721 - RNA, 22 nt, Mycobacterium avium subsp. paratuberculosis
cgcgcgagacaccucgucgauc

SEQ ID NO: 2830722 - RNA, 23 nt, Mycobacterium avium subsp. paratuberculosis
cgcgcgagacaccucgucgaucu

SEQ ID NO: 2830723 - RNA, 20 nt, Mycobacterium avium subsp. paratuberculosis
cgcgcgagaguaucgccacg

SEQ ID NO: 2830724 - RNA, 21 nt, Mycobacterium avium subsp. paratuberculosis
cgcgcgagaguaucgccacgc

SEQ ID NO: 2830725 - RNA, 22 nt, Mycobacterium avium subsp. paratuberculosis
cgcgcgagaguaucgccacgcc

SEQ ID NO: 2830726 - RNA, 11 nt, Mycobacterium avium subsp. paratuberculosis
cgcgcgagcag

SEQ ID NO: 2830727 - RNA, 15 nt, Mycobacterium avium subsp. paratuberculosis
cgcgcgagccgaaac

SEQ ID NO: 2830728 - RNA, 21 nt, Mycobacterium avium subsp. paratuberculosis
cgcgcgagcgcagcgccaggc

SEQ ID NO: 2830729 - RNA, 13 nt, Mycobacterium avium subsp. paratuberculosis
cgcgcgagcgcgc

SEQ ID NO: 2830730 - RNA, 14 nt, Mycobacterium avium subsp. paratuberculosis
cgcgcgagcgcgcu

SEQ ID NO: 2830731 - RNA, 20 nt, Mycobacterium avium subsp. paratuberculosis
cgcgcgagcgucacgcuggc

SEQ ID NO: 2830732 - RNA, 18 nt, Mycobacterium avium subsp. paratuberculosis
cgcgcgaucagcgccguc

SEQ ID NO: 2830733 - RNA, 19 nt, Mycobacterium avium subsp. paratuberculosis
cgcgcgaucagcgccgucu

SEQ ID NO: 2830734 - RNA, 15 nt, Mycobacterium avium subsp. paratuberculosis
cgcgcgaucaggccg

SEQ ID NO: 2830735 - RNA, 16 nt, Mycobacterium avium subsp. paratuberculosis
cgcgcgaucaggccgg

SEQ ID NO: 2830736 - RNA, 17 nt, Mycobacterium avium subsp. paratuberculosis
cgcgcgaucaggccggc

SEQ ID NO: 2830737 - RNA, 21 nt, Mycobacterium avium subsp. paratuberculosis
cgcgcgaucaggccggccacc

SEQ ID NO: 2830738 - RNA, 22 nt, Mycobacterium avium subsp. paratuberculosis
cgcgcgaucaggccggccacca

SEQ ID NO: 2830739 - RNA, 12 nt, Mycobacterium avium subsp. paratuberculosis
cgcgcgaucgcc

SEQ ID NO: 2830740 - RNA, 19 nt, Mycobacterium avium subsp. paratuberculosis
cgcgcgaucgccggugcgg

SEQ ID NO: 2830741 - RNA, 13 nt, Mycobacterium avium subsp. paratuberculosis
cgcgcgaucggcg

SEQ ID NO: 2830742 - RNA, 20 nt, Mycobacterium avium subsp. paratuberculosis
cgcgcgaucggcgagccggg

SEQ ID NO: 2830743 - RNA, 20 nt, Mycobacterium avium subsp. paratuberculosis
cgcgcgaucgguagcaggac

SEQ ID NO: 2830744 - RNA, 15 nt, Mycobacterium avium subsp. paratuberculosis
cgcgcgaucgguguc

SEQ ID NO: 2830745 - RNA, 22 nt, Mycobacterium avium subsp. paratuberculosis
cgcgcgaucgguguccagccgc

SEQ ID NO: 2830746 - RNA, 18 nt, Mycobacterium avium subsp. paratuberculosis
cgcgcgaucuccgucacc

SEQ ID NO: 2830747 - RNA, 19 nt, Mycobacterium avium subsp. paratuberculosis
cgcgcgaucuccgucaccg

SEQ ID NO: 2830748 - RNA, 23 nt, Mycobacterium avium subsp. paratuberculosis
cgcgcgaugaugagcaagucggc

SEQ ID NO: 2830749 - RNA, 16 nt, Mycobacterium avium subsp. paratuberculosis
cgcgcgaugcgggcgc

SEQ ID NO: 2830750 - RNA, 21 nt, Mycobacterium avium subsp. paratuberculosis
cgcgcgaugcgggcgccgaac

SEQ ID NO: 2830751 - RNA, 16 nt, Mycobacterium avium subsp. paratuberculosis
cgcgcgauggacagca

SEQ ID NO: 2830752 - RNA, 15 nt, Mycobacterium avium subsp. paratuberculosis
cgcgcgcaacgaggc

SEQ ID NO: 2830753 - RNA, 18 nt, Mycobacterium avium subsp. paratuberculosis
cgcgcgcaccacgugcgc

SEQ ID NO: 2830754 - RNA, 23 nt, Mycobacterium avium subsp. paratuberculosis
cgcgcgcaccacgugcgcgaagc

SEQ ID NO: 2830755 - RNA, 12 nt, Mycobacterium avium subsp. paratuberculosis
cgcgcgcacuuc

SEQ ID NO: 2830756 - RNA, 23 nt, Mycobacterium avium subsp. paratuberculosis
cgcgcgcacuuccuccucuucgc

SEQ ID NO: 2830757 - RNA, 13 nt, Mycobacterium avium subsp. paratuberculosis
cgcgcgcagcgcu

SEQ ID NO: 2830758 - RNA, 21 nt, Mycobacterium avium subsp. paratuberculosis
cgcgcgcaggcacucgcgcag

SEQ ID NO: 2830759 - RNA, 13 nt, Mycobacterium avium subsp. paratuberculosis
cgcgcgcaggccc

SEQ ID NO: 2830760 - RNA, 14 nt, Mycobacterium avium subsp. paratuberculosis
cgcgcgcaucaccg

SEQ ID NO: 2830761 - RNA, 20 nt, Mycobacterium avium subsp. paratuberculosis
cgcgcgcaucaccgagguca

SEQ ID NO: 2830762 - RNA, 14 nt, Mycobacterium avium subsp. paratuberculosis
cgcgcgcaucucga

SEQ ID NO: 2830763 - RNA, 22 nt, Mycobacterium avium subsp. paratuberculosis
cgcgcgccccagccccucgccg

SEQ ID NO: 2830764 - RNA, 23 nt, Mycobacterium avium subsp. paratuberculosis
cgcgcgccccagccccucgccgg

SEQ ID NO: 2830765 - RNA, 21 nt, Mycobacterium avium subsp. paratuberculosis
cgcgcgccccggucccgccgg

SEQ ID NO: 2830766 - RNA, 16 nt, Mycobacterium avium subsp. paratuberculosis
cgcgcgcccggcaccg

SEQ ID NO: 2830767 - RNA, 18 nt, Mycobacterium avium subsp. paratuberculosis
cgcgcgcccgucgucggu

SEQ ID NO: 2830768 - RNA, 16 nt, Mycobacterium avium subsp. paratuberculosis
cgcgcgcccuagucga

SEQ ID NO: 2830769 - RNA, 20 nt, Mycobacterium avium subsp. paratuberculosis
cgcgcgcccuagucgacgcc

SEQ ID NO: 2830770 - RNA, 15 nt, Mycobacterium avium subsp. paratuberculosis
cgcgcgccgacagac

SEQ ID NO: 2830771 - RNA, 13 nt, Mycobacterium avium subsp. paratuberculosis
cgcgcgccgagag

SEQ ID NO: 2830772 - RNA, 13 nt, Mycobacterium avium subsp. paratuberculosis
cgcgcgccgcagc

SEQ ID NO: 2830773 - RNA, 20 nt, Mycobacterium avium subsp. paratuberculosis
cgcgcgccgcagcgcgcgcu

SEQ ID NO: 2830774 - RNA, 22 nt, Mycobacterium avium subsp. paratuberculosis
cgcgcgccgcccccgcggcguc

SEQ ID NO: 2830775 - RNA, 14 nt, Mycobacterium avium subsp. paratuberculosis
cgcgcgccggccag

SEQ ID NO: 2830776 - RNA, 19 nt, Mycobacterium avium subsp. paratuberculosis
cgcgcgccggccagcacgg

SEQ ID NO: 2830777 - RNA, 13 nt, Mycobacterium avium subsp. paratuberculosis
cgcgcgccggcgc

SEQ ID NO: 2830778 - RNA, 21 nt, Mycobacterium avium subsp. paratuberculosis
cgcgcgccggcgcagcggccc

SEQ ID NO: 2830779 - RNA, 13 nt, Mycobacterium avium subsp. paratuberculosis
cgcgcgccgggau

SEQ ID NO: 2830780 - RNA, 12 nt, Mycobacterium avium subsp. paratuberculosis
cgcgcgcgacgg

SEQ ID NO: 2830781 - RNA, 13 nt, Mycobacterium avium subsp. paratuberculosis
cgcgcgcgacggc

SEQ ID NO: 2830782 - RNA, 14 nt, Mycobacterium avium subsp. paratuberculosis
cgcgcgcgacggcg

SEQ ID NO: 2830783 - RNA, 14 nt, Mycobacterium avium subsp. paratuberculosis
cgcgcgcgccacga

SEQ ID NO: 2830784 - RNA, 15 nt, Mycobacterium avium subsp. paratuberculosis
cgcgcgcgcucggcg

SEQ ID NO: 2830785 - RNA, 13 nt, Mycobacterium avium subsp. paratuberculosis
cgcgcgcggcacg

SEQ ID NO: 2830786 - RNA, 13 nt, Mycobacterium avium subsp. paratuberculosis
cgcgcgcggcccg

SEQ ID NO: 2830787 - RNA, 21 nt, Mycobacterium avium subsp. paratuberculosis
cgcgcgggccuaggaccccgg

SEQ ID NO: 2830788 - RNA, 22 nt, Mycobacterium avium subsp. paratuberculosis
cgcgcgggccuaggaccccggc

SEQ ID NO: 2830789 - RNA, 13 nt, Mycobacterium avium subsp. paratuberculosis
cgcgcgggcgacc

SEQ ID NO: 2830790 - RNA, 16 nt, Mycobacterium avium subsp. paratuberculosis
cgcgcgggcgaccugc

SEQ ID NO: 2830791 - RNA, 16 nt, Mycobacterium avium subsp. paratuberculosis
cgcgcgggcgcgcgcc

SEQ ID NO: 2830792 - RNA, 18 nt, Mycobacterium avium subsp. paratuberculosis
cgcgcgggcgcgcgccgc

SEQ ID NO: 2830793 - RNA, 19 nt, Mycobacterium avium subsp. paratuberculosis
cgcgcgggcgcgcgccgcc

SEQ ID NO: 2830794 - RNA, 17 nt, Mycobacterium avium subsp. paratuberculosis
cgcgcgggcguccucgu

SEQ ID NO: 2830795 - RNA, 20 nt, Mycobacterium avium subsp. paratuberculosis
cgcgcgggcguccucgucgg

SEQ ID NO: 2830796 - RNA, 23 nt, Mycobacterium avium subsp. paratuberculosis
cgcgcgggcguccucgucggcga

SEQ ID NO: 2830797 - RNA, 12 nt, Mycobacterium avium subsp. paratuberculosis
cgcgcggggccg

SEQ ID NO: 2830798 - RNA, 15 nt, Mycobacterium avium subsp. paratuberculosis
cgcgcggggccggcg

SEQ ID NO: 2830799 - RNA, 19 nt, Mycobacterium avium subsp. paratuberculosis
cgcgcggggccggcgcggu

SEQ ID NO: 2830800 - RNA, 20 nt, Mycobacterium avium subsp. paratuberculosis
cgcgcggggccggcgcggug

SEQ ID NO: 2830801 - RNA, 21 nt, Mycobacterium avium subsp. paratuberculosis
cgcgcggggccggcgcggugc

SEQ ID NO: 2830802 - RNA, 19 nt, Mycobacterium avium subsp. paratuberculosis
cgcgcggggcggccgccgg

SEQ ID NO: 2830803 - RNA, 22 nt, Mycobacterium avium subsp. paratuberculosis
cgcgcggggcggccgccgggcc

SEQ ID NO: 2830804 - RNA, 17 nt, Mycobacterium avium subsp. paratuberculosis
cgcgcggggugacgccc

SEQ ID NO: 2830805 - RNA, 14 nt, Mycobacterium avium subsp. paratuberculosis
cgcgcggggugucg

SEQ ID NO: 2830806 - RNA, 17 nt, Mycobacterium avium subsp. paratuberculosis
cgcgcggggugucgcgg

SEQ ID NO: 2830807 - RNA, 19 nt, Mycobacterium avium subsp. paratuberculosis
cgcgcggggugucgcggcu

SEQ ID NO: 2830808 - RNA, 16 nt, Mycobacterium avium subsp. paratuberculosis
cgcgcggguacggcgg

SEQ ID NO: 2830809 - RNA, 18 nt, Mycobacterium avium subsp. paratuberculosis
cgcgcggguacggcggcc

SEQ ID NO: 2830810 - RNA, 17 nt, Mycobacterium avium subsp. paratuberculosis
cgcgcgggucgagcagc

SEQ ID NO: 2830811 - RNA, 18 nt, Mycobacterium avium subsp. paratuberculosis
cgcgcgggucgagcagca

SEQ ID NO: 2830812 - RNA, 20 nt, Mycobacterium avium subsp. paratuberculosis
cgcgcgggucgagcagcagc

SEQ ID NO: 2830813 - RNA, 21 nt, Mycobacterium avium subsp. paratuberculosis
cgcgcgggucgagcagcagcc

SEQ ID NO: 2830814 - RNA, 21 nt, Mycobacterium avium subsp. paratuberculosis
cgcgcgggucgucggccuguc

SEQ ID NO: 2830815 - RNA, 21 nt, Mycobacterium avium subsp. paratuberculosis
cgcgcgggugaguagccgaua

SEQ ID NO: 2830816 - RNA, 16 nt, Mycobacterium avium subsp. paratuberculosis
cgcgcgggugcgggcg

SEQ ID NO: 2830817 - RNA, 17 nt, Mycobacterium avium subsp. paratuberculosis
cgcgcgggugcgggcgu

SEQ ID NO: 2830818 - RNA, 18 nt, Mycobacterium avium subsp. paratuberculosis
cgcgcgggugcgggcguc

SEQ ID NO: 2830819 - RNA, 14 nt, Mycobacterium avium subsp. paratuberculosis
cgcgcggucgucgc

SEQ ID NO: 2830820 - RNA, 18 nt, Mycobacterium avium subsp. paratuberculosis
cgcgcggugaugaccucc

SEQ ID NO: 2830821 - RNA, 20 nt, Mycobacterium avium subsp. paratuberculosis
cgcgcggugcaccaggacgc

SEQ ID NO: 2830822 - RNA, 15 nt, Mycobacterium avium subsp. paratuberculosis
cgcgcggugcacggu

SEQ ID NO: 2830823 - RNA, 17 nt, Mycobacterium avium subsp. paratuberculosis
cgcgcggugcacgguca

SEQ ID NO: 2830824 - RNA, 19 nt, Mycobacterium avium subsp. paratuberculosis
cgcgcggugcacggucagc

SEQ ID NO: 2830825 - RNA, 20 nt, Mycobacterium avium subsp. paratuberculosis
cgcgcggugcgccagcgccg

SEQ ID NO: 2830826 - RNA, 20 nt, Mycobacterium avium subsp. paratuberculosis
cgcgcgguguuuggccgcgc

SEQ ID NO: 2830827 - RNA, 14 nt, Mycobacterium avium subsp. paratuberculosis
cgcgcgguuccggc

SEQ ID NO: 2830828 - RNA, 18 nt, Mycobacterium avium subsp. paratuberculosis
cgcgcgguuccggcgugc

SEQ ID NO: 2830829 - RNA, 15 nt, Mycobacterium avium subsp. paratuberculosis
cgcgcguagcgcagc

SEQ ID NO: 2830830 - RNA, 16 nt, Mycobacterium avium subsp. paratuberculosis
cgcgcguagcgcagcu

SEQ ID NO: 2830831 - RNA, 18 nt, Mycobacterium avium subsp. paratuberculosis
cgcgcguauuccagcgcc

SEQ ID NO: 2830832 - RNA, 21 nt, Mycobacterium avium subsp. paratuberculosis
cgcgcguauuccagcgccagc

SEQ ID NO: 2830833 - RNA, 15 nt, Mycobacterium avium subsp. paratuberculosis
cgcgcgucacgcugg

SEQ ID NO: 2830834 - RNA, 20 nt, Mycobacterium avium subsp. paratuberculosis
cgcgcgucacgcuggcguga

SEQ ID NO: 2830835 - RNA, 13 nt, Mycobacterium avium subsp. paratuberculosis
cgcgcgucgacgu

SEQ ID NO: 2830836 - RNA, 22 nt, Mycobacterium avium subsp. paratuberculosis
cgcgcgucgacguucgccgcca

SEQ ID NO: 2830837 - RNA, 15 nt, Mycobacterium avium subsp. paratuberculosis
cgcgcgucgcgcagc

SEQ ID NO: 2830838 - RNA, 15 nt, Mycobacterium avium subsp. paratuberculosis
cgcgcgucgggggug

SEQ ID NO: 2830839 - RNA, 20 nt, Mycobacterium avium subsp. paratuberculosis
cgcgcgucgggggugccgcu

SEQ ID NO: 2830840 - RNA, 22 nt, Mycobacterium avium subsp. paratuberculosis
cgcgcgucgggggugccgcucc

SEQ ID NO: 2830841 - RNA, 18 nt, Mycobacterium avium subsp. paratuberculosis
cgcgcgucucccccgauc

SEQ ID NO: 2830842 - RNA, 22 nt, Mycobacterium avium subsp. paratuberculosis
cgcgcgucucccccgaucagcg

SEQ ID NO: 2830843 - RNA, 16 nt, Mycobacterium avium subsp. paratuberculosis
cgcgcgugacggcggg

SEQ ID NO: 2830844 - RNA, 18 nt, Mycobacterium avium subsp. paratuberculosis
cgcgcgugacggcggggc

SEQ ID NO: 2830845 - RNA, 13 nt, Mycobacterium avium subsp. paratuberculosis
cgcgcgugcagcc

SEQ ID NO: 2830846 - RNA, 18 nt, Mycobacterium avium subsp. paratuberculosis
cgcgcgugcagccgggcg

SEQ ID NO: 2830847 - RNA, 20 nt, Mycobacterium avium subsp. paratuberculosis
cgcgcgugcagccgggcggc

SEQ ID NO: 2830848 - RNA, 21 nt, Mycobacterium avium subsp. paratuberculosis
cgcgcgugcagccgggcggcg

SEQ ID NO: 2830849 - RNA, 22 nt, Mycobacterium avium subsp. paratuberculosis
cgcgcgugcagccgggcggcgc

SEQ ID NO: 2830850 - RNA, 13 nt, Mycobacterium avium subsp. paratuberculosis
cgcgcgugggcca

SEQ ID NO: 2830851 - RNA, 19 nt, Mycobacterium avium subsp. paratuberculosis
cgcgcgugggccaacgcga

SEQ ID NO: 2830852 - RNA, 21 nt, Mycobacterium avium subsp. paratuberculosis
cgcgcguggucccacaccacc

SEQ ID NO: 2830853 - RNA, 18 nt, Mycobacterium avium subsp. paratuberculosis
cgcgcguuccagcacgcc

SEQ ID NO: 2830854 - RNA, 19 nt, Mycobacterium avium subsp. paratuberculosis
cgcgcguuccagcacgccc

SEQ ID NO: 2830855 - RNA, 22 nt, Mycobacterium avium subsp. paratuberculosis
cgcgcguuccagcacgcccaga

SEQ ID NO: 2830856 - RNA, 23 nt, Mycobacterium avium subsp. paratuberculosis
cgcgcguucgaguucgucgacca

SEQ ID NO: 2830857 - RNA, 16 nt, Mycobacterium avium subsp. paratuberculosis
cgcgcguuguccagca

SEQ ID NO: 2830858 - RNA, 17 nt, Mycobacterium avium subsp. paratuberculosis
cgcgcguuguccagcag

SEQ ID NO: 2830859 - RNA, 19 nt, Mycobacterium avium subsp. paratuberculosis
cgcgcguuguccagcagcg

SEQ ID NO: 2830860 - RNA, 21 nt, Mycobacterium avium subsp. paratuberculosis
cgcgcguuguccagcagcgcc

SEQ ID NO: 2830861 - RNA, 22 nt, Mycobacterium avium subsp. paratuberculosis
cgcgcguuguccagcagcgccg

SEQ ID NO: 2830862 - RNA, 23 nt, Mycobacterium avium subsp. paratuberculosis
cgcgcguuguccagcagcgccgg

SEQ ID NO: 2830863 - RNA, 17 nt, Mycobacterium avium subsp. paratuberculosis
cgcgcuaacggcgcggc

SEQ ID NO: 2830864 - RNA, 16 nt, Mycobacterium avium subsp. paratuberculosis
cgcgcuaggacgcggg

SEQ ID NO: 2830865 - RNA, 17 nt, Mycobacterium avium subsp. paratuberculosis
cgcgcuaggacgcgggc

SEQ ID NO: 2830866 - RNA, 16 nt, Mycobacterium avium subsp. paratuberculosis
cgcgcucaacccgggc

SEQ ID NO: 2830867 - RNA, 20 nt, Mycobacterium avium subsp. paratuberculosis
cgcgcucaacccgggccgga

SEQ ID NO: 2830868 - RNA, 18 nt, Mycobacterium avium subsp. paratuberculosis
cgcgcucaaccgcccagc

SEQ ID NO: 2830869 - RNA, 21 nt, Mycobacterium avium subsp. paratuberculosis
cgcgcucaaccgcccagcggc

SEQ ID NO: 2830870 - RNA, 22 nt, Mycobacterium avium subsp. paratuberculosis
cgcgcucaccgcggggugcccg

SEQ ID NO: 2830871 - RNA, 20 nt, Mycobacterium avium subsp. paratuberculosis
cgcgcuggugcugccgaaca

SEQ ID NO: 2830872 - RNA, 17 nt, Mycobacterium avium subsp. paratuberculosis
cgcgcuguccucgucgg

SEQ ID NO: 2830873 - RNA, 22 nt, Mycobacterium avium subsp. paratuberculosis
cgcgcugucgcccucgaucgcg

SEQ ID NO: 2830874 - RNA, 14 nt, Mycobacterium avium subsp. paratuberculosis
cgcgcugugcgcca

SEQ ID NO: 2830875 - RNA, 14 nt, Mycobacterium avium subsp. paratuberculosis
cgcgcuguucggga

SEQ ID NO: 2830876 - RNA, 19 nt, Mycobacterium avium subsp. paratuberculosis
cgcgcuuaauacagcgcgu

SEQ ID NO: 2830877 - RNA, 14 nt, Mycobacterium avium subsp. paratuberculosis
cgcgcuugacggcc

SEQ ID NO: 2830878 - RNA, 15 nt, Mycobacterium avium subsp. paratuberculosis
cgcgcuugacggccg

SEQ ID NO: 2830879 - RNA, 18 nt, Mycobacterium avium subsp. paratuberculosis
cgcgcuugacggccgggc

SEQ ID NO: 2830880 - RNA, 14 nt, Mycobacterium avium subsp. paratuberculosis
cgcgcuugccgcga

SEQ ID NO: 2830881 - RNA, 15 nt, Mycobacterium avium subsp. paratuberculosis
cgcgcuugccgcgac

SEQ ID NO: 2830882 - RNA, 19 nt, Mycobacterium avium subsp. paratuberculosis
cgcgcuugccgcgacccgg

SEQ ID NO: 2830883 - RNA, 15 nt, Mycobacterium avium subsp. paratuberculosis
cgcgcuugcgaucgc

SEQ ID NO: 2830884 - RNA, 18 nt, Mycobacterium avium subsp. paratuberculosis
cgcgcuugcgaucgccgc

SEQ ID NO: 2830885 - RNA, 13 nt, Mycobacterium avium subsp. paratuberculosis
cgcgcuugcgcuc

SEQ ID NO: 2830886 - RNA, 21 nt, Mycobacterium avium subsp. paratuberculosis
cgcgcuugcgcucggucgcgg

SEQ ID NO: 2830887 - RNA, 17 nt, Mycobacterium avium subsp. paratuberculosis
cgcgcuugguggcgacg

SEQ ID NO: 2830888 - RNA, 18 nt, Mycobacterium avium subsp. paratuberculosis
cgcgcuuguacaggucga

SEQ ID NO: 2830889 - RNA, 21 nt, Mycobacterium avium subsp. paratuberculosis
cgcgcuuguacaggucgacca

SEQ ID NO: 2830890 - RNA, 23 nt, Mycobacterium avium subsp. paratuberculosis
cgcgcuuguacaggucgaccauc

SEQ ID NO: 2830891 - RNA, 22 nt, Mycobacterium avium subsp. paratuberculosis
cgcgcuuuggaccagggcggug

SEQ ID NO: 2830892 - RNA, 20 nt, Mycobacterium avium subsp. paratuberculosis
cgcggaaacuccuggccccg

SEQ ID NO: 2830893 - RNA, 21 nt, Mycobacterium avium subsp. paratuberculosis
cgcggaaacuccuggccccga

SEQ ID NO: 2830894 - RNA, 22 nt, Mycobacterium avium subsp. paratuberculosis
cgcggaaacuccuggccccgau

SEQ ID NO: 2830895 - RNA, 17 nt, Mycobacterium avium subsp. paratuberculosis
cgcggaacagccggcuc

SEQ ID NO: 2830896 - RNA, 19 nt, Mycobacterium avium subsp. paratuberculosis
cgcggaacagcgucgccga

SEQ ID NO: 2830897 - RNA, 14 nt, Mycobacterium avium subsp. paratuberculosis
cgcggaaccggccg

SEQ ID NO: 2830898 - RNA, 15 nt, Mycobacterium avium subsp. paratuberculosis
cgcggaaccggccgg

SEQ ID NO: 2830899 - RNA, 16 nt, Mycobacterium avium subsp. paratuberculosis
cgcggaaccggccggg

SEQ ID NO: 2830900 - RNA, 17 nt, Mycobacterium avium subsp. paratuberculosis
cgcggaaccggccgggg

SEQ ID NO: 2830901 - RNA, 22 nt, Mycobacterium avium subsp. paratuberculosis
cgcggaaccggccggggcgcca

SEQ ID NO: 2830902 - RNA, 22 nt, Mycobacterium avium subsp. paratuberculosis
cgcggaaccguagaccaccucg

SEQ ID NO: 2830903 - RNA, 17 nt, Mycobacterium avium subsp. paratuberculosis
cgcggaaccguugcagc

SEQ ID NO: 2830904 - RNA, 22 nt, Mycobacterium avium subsp. paratuberculosis
cgcggaaccguugcagcacagc

SEQ ID NO: 2830905 - RNA, 14 nt, Mycobacterium avium subsp. paratuberculosis
cgcggaacgcgccg

SEQ ID NO: 2830906 - RNA, 16 nt, Mycobacterium avium subsp. paratuberculosis
cgcggaacgcgccggg

SEQ ID NO: 2830907 - RNA, 19 nt, Mycobacterium avium subsp. paratuberculosis
cgcggaacgcgccgggcaa

SEQ ID NO: 2830908 - RNA, 14 nt, Mycobacterium avium subsp. paratuberculosis
cgcggaacgggucg

SEQ ID NO: 2830909 - RNA, 23 nt, Mycobacterium avium subsp. paratuberculosis
cgcggaacgggucgaucucggcg

SEQ ID NO: 2830910 - RNA, 18 nt, Mycobacterium avium subsp. paratuberculosis
cgcggaacugcucccagg

SEQ ID NO: 2830911 - RNA, 19 nt, Mycobacterium avium subsp. paratuberculosis
cgcggaagccccaggcccg

SEQ ID NO: 2830912 - RNA, 21 nt, Mycobacterium avium subsp. paratuberculosis
cgcggaagccccaggcccggu

SEQ ID NO: 2830913 - RNA, 18 nt, Mycobacterium avium subsp. paratuberculosis
cgcggaaguggaccgcgu

SEQ ID NO: 2830914 - RNA, 11 nt, Mycobacterium avium subsp. paratuberculosis
cgcggaaugcu

SEQ ID NO: 2830915 - RNA, 12 nt, Mycobacterium avium subsp. paratuberculosis
cgcggaaugcuc

SEQ ID NO: 2830916 - RNA, 17 nt, Mycobacterium avium subsp. paratuberculosis
cgcggaauucgcgggug

SEQ ID NO: 2830917 - RNA, 23 nt, Mycobacterium avium subsp. paratuberculosis
cgcggaauugcuuuuugaccacc

SEQ ID NO: 2830918 - RNA, 15 nt, Mycobacterium avium subsp. paratuberculosis
cgcggacacgaacga

SEQ ID NO: 2830919 - RNA, 16 nt, Mycobacterium avium subsp. paratuberculosis
cgcggacacgaacgac

SEQ ID NO: 2830920 - RNA, 21 nt, Mycobacterium avium subsp. paratuberculosis
cgcggacacgaacgacgcggc

SEQ ID NO: 2830921 - RNA, 22 nt, Mycobacterium avium subsp. paratuberculosis
cgcggacacgaacgacgcggca

SEQ ID NO: 2830922 - RNA, 23 nt, Mycobacterium avium subsp. paratuberculosis
cgcggacacgaacgacgcggcac

SEQ ID NO: 2830923 - RNA, 15 nt, Mycobacterium avium subsp. paratuberculosis
cgcggacagcgcggu

SEQ ID NO: 2830924 - RNA, 17 nt, Mycobacterium avium subsp. paratuberculosis
cgcggacagcucgccgg

SEQ ID NO: 2830925 - RNA, 20 nt, Mycobacterium avium subsp. paratuberculosis
cgcggacagcucgccggccg

SEQ ID NO: 2830926 - RNA, 13 nt, Mycobacterium avium subsp. paratuberculosis
cgcggacagggcg

SEQ ID NO: 2830927 - RNA, 16 nt, Mycobacterium avium subsp. paratuberculosis
cgcggacagggcggcg

SEQ ID NO: 2830928 - RNA, 20 nt, Mycobacterium avium subsp. paratuberculosis
cgcggacauucggacggccc

SEQ ID NO: 2830929 - RNA, 18 nt, Mycobacterium avium subsp. paratuberculosis
cgcggacauucugcacga

SEQ ID NO: 2830930 - RNA, 22 nt, Mycobacterium avium subsp. paratuberculosis
cgcggacauucugcacgacgaa

SEQ ID NO: 2830931 - RNA, 13 nt, Mycobacterium avium subsp. paratuberculosis
cgcggaccaccgc

SEQ ID NO: 2830932 - RNA, 17 nt, Mycobacterium avium subsp. paratuberculosis
cgcggaccaccgcgugc

SEQ ID NO: 2830933 - RNA, 23 nt, Mycobacterium avium subsp. paratuberculosis
cgcggaccaccgcgugcgagccg

SEQ ID NO: 2830934 - RNA, 17 nt, Mycobacterium avium subsp. paratuberculosis
cgcggaccccagcguga

SEQ ID NO: 2830935 - RNA, 20 nt, Mycobacterium avium subsp. paratuberculosis
cgcggaccccagcgugacgu

SEQ ID NO: 2830936 - RNA, 19 nt, Mycobacterium avium subsp. paratuberculosis
cgcggaccccagugcaggc

SEQ ID NO: 2830937 - RNA, 21 nt, Mycobacterium avium subsp. paratuberculosis
cgcggaccccagugcaggcug

SEQ ID NO: 2830938 - RNA, 23 nt, Mycobacterium avium subsp. paratuberculosis
cgcggacccuggccagcaccgcg

SEQ ID NO: 2830939 - RNA, 22 nt, Mycobacterium avium subsp. paratuberculosis
cgcggaccgcacccccagcucg

SEQ ID NO: 2830940 - RNA, 20 nt, Mycobacterium avium subsp. paratuberculosis
cgcggaccuuggugucggcg

SEQ ID NO: 2830941 - RNA, 16 nt, Mycobacterium avium subsp. paratuberculosis
cgcggacgcggcggac

SEQ ID NO: 2830942 - RNA, 18 nt, Mycobacterium avium subsp. paratuberculosis
cgcggacgcggcggacga

SEQ ID NO: 2830943 - RNA, 20 nt, Mycobacterium avium subsp. paratuberculosis
cgcggacggccagcccgucg

SEQ ID NO: 2830944 - RNA, 12 nt, Mycobacterium avium subsp. paratuberculosis
cgcggacggcga

SEQ ID NO: 2830945 - RNA, 13 nt, Mycobacterium avium subsp. paratuberculosis
cgcggacggcgaa

SEQ ID NO: 2830946 - RNA, 19 nt, Mycobacterium avium subsp. paratuberculosis
cgcggacggguugggcgcc

SEQ ID NO: 2830947 - RNA, 22 nt, Mycobacterium avium subsp. paratuberculosis
cgcggacuggccaccgcgaucu

SEQ ID NO: 2830948 - RNA, 15 nt, Mycobacterium avium subsp. paratuberculosis
cgcggacuggugggc

SEQ ID NO: 2830949 - RNA, 18 nt, Mycobacterium avium subsp. paratuberculosis
cgcggacuggugggcguc

SEQ ID NO: 2830950 - RNA, 19 nt, Mycobacterium avium subsp. paratuberculosis
cgcggacuggugggcgucg

SEQ ID NO: 2830951 - RNA, 20 nt, Mycobacterium avium subsp. paratuberculosis
cgcggacuggugggcgucgu

SEQ ID NO: 2830952 - RNA, 21 nt, Mycobacterium avium subsp. paratuberculosis
cgcggacuggugggcgucgug

SEQ ID NO: 2830953 - RNA, 22 nt, Mycobacterium avium subsp. paratuberculosis
cgcggagaaggugucgcacugc

SEQ ID NO: 2830954 - RNA, 23 nt, Mycobacterium avium subsp. paratuberculosis
cgcggagaucaccccuggcgggu

SEQ ID NO: 2830955 - RNA, 15 nt, Mycobacterium avium subsp. paratuberculosis
cgcggcagggccagg

SEQ ID NO: 2830956 - RNA, 16 nt, Mycobacterium avium subsp. paratuberculosis
cgcggcagggccaggc

SEQ ID NO: 2830957 - RNA, 18 nt, Mycobacterium avium subsp. paratuberculosis
cgcggcagggccaggccg

SEQ ID NO: 2830958 - RNA, 15 nt, Mycobacterium avium subsp. paratuberculosis
cgcggcagguugcgc

SEQ ID NO: 2830959 - RNA, 15 nt, Mycobacterium avium subsp. paratuberculosis
cgcggcaguccgccg

SEQ ID NO: 2830960 - RNA, 18 nt, Mycobacterium avium subsp. paratuberculosis
cgcggcaguccgccggag

SEQ ID NO: 2830961 - RNA, 20 nt, Mycobacterium avium subsp. paratuberculosis
cgcggcaucggcgacggcga

SEQ ID NO: 2830962 - RNA, 21 nt, Mycobacterium avium subsp. paratuberculosis
cgcggcaucggcgacggcgac

SEQ ID NO: 2830963 - RNA, 13 nt, Mycobacterium avium subsp. paratuberculosis
cgcggcaucguca

SEQ ID NO: 2830964 - RNA, 19 nt, Mycobacterium avium subsp. paratuberculosis
cgcggcaucgucaccucga

SEQ ID NO: 2830965 - RNA, 16 nt, Mycobacterium avium subsp. paratuberculosis
cgcggcaucgucgggg

SEQ ID NO: 2830966 - RNA, 20 nt, Mycobacterium avium subsp. paratuberculosis
cgcggcaucgugaugcgggu

SEQ ID NO: 2830967 - RNA, 15 nt, Mycobacterium avium subsp. paratuberculosis
cgcggcaugaccggc

SEQ ID NO: 2830968 - RNA, 16 nt, Mycobacterium avium subsp. paratuberculosis
cgcggcaugaccggcc

SEQ ID NO: 2830969 - RNA, 17 nt, Mycobacterium avium subsp. paratuberculosis
cgcggcaugaccggcca

SEQ ID NO: 2830970 - RNA, 14 nt, Mycobacterium avium subsp. paratuberculosis
cgcggcaugccgcc

SEQ ID NO: 2830971 - RNA, 16 nt, Mycobacterium avium subsp. paratuberculosis
cgcggcaugccgcccg

SEQ ID NO: 2830972 - RNA, 18 nt, Mycobacterium avium subsp. paratuberculosis
cgcggcaugccgcccggg

SEQ ID NO: 2830973 - RNA, 21 nt, Mycobacterium avium subsp. paratuberculosis
cgcggcaugccgcccgggccg

SEQ ID NO: 2830974 - RNA, 22 nt, Mycobacterium avium subsp. paratuberculosis
cgcggcaugccgcccgggccgu

SEQ ID NO: 2830975 - RNA, 16 nt, Mycobacterium avium subsp. paratuberculosis
cgcggcauggcuggcg

SEQ ID NO: 2830976 - RNA, 20 nt, Mycobacterium avium subsp. paratuberculosis
cgcggcauggcuggcggcaa

SEQ ID NO: 2830977 - RNA, 21 nt, Mycobacterium avium subsp. paratuberculosis
cgcggcauggcuggcggcaac

SEQ ID NO: 2830978 - RNA, 22 nt, Mycobacterium avium subsp. paratuberculosis
cgcggcauggcuggcggcaacg

SEQ ID NO: 2830979 - RNA, 17 nt, Mycobacterium avium subsp. paratuberculosis
cgcggccaacgcccacc

SEQ ID NO: 2830980 - RNA, 18 nt, Mycobacterium avium subsp. paratuberculosis
cgcggccaagugcggucg

SEQ ID NO: 2830981 - RNA, 13 nt, Mycobacterium avium subsp. paratuberculosis
cgcggccacaccg

SEQ ID NO: 2830982 - RNA, 20 nt, Mycobacterium avium subsp. paratuberculosis
cgcggccacaccgaucagca

SEQ ID NO: 2830983 - RNA, 23 nt, Mycobacterium avium subsp. paratuberculosis
cgcggccacaccgaucagcaugc

SEQ ID NO: 2830984 - RNA, 12 nt, Mycobacterium avium subsp. paratuberculosis
cgcggccacacu

SEQ ID NO: 2830985 - RNA, 17 nt, Mycobacterium avium subsp. paratuberculosis
cgcggccacacuggcgu

SEQ ID NO: 2830986 - RNA, 12 nt, Mycobacterium avium subsp. paratuberculosis
cgcggccaccac

SEQ ID NO: 2830987 - RNA, 17 nt, Mycobacterium avium subsp. paratuberculosis
cgcggccaccaccacgg

SEQ ID NO: 2830988 - RNA, 18 nt, Mycobacterium avium subsp. paratuberculosis
cgcggccaccaccacggc

SEQ ID NO: 2830989 - RNA, 14 nt, Mycobacterium avium subsp. paratuberculosis
cgcggccaccaccg

SEQ ID NO: 2830990 - RNA, 14 nt, Mycobacterium avium subsp. paratuberculosis
cgcggccaccacga

SEQ ID NO: 2830991 - RNA, 15 nt, Mycobacterium avium subsp. paratuberculosis
cgcggccaccacgac

SEQ ID NO: 2830992 - RNA, 22 nt, Mycobacterium avium subsp. paratuberculosis
cgcggccaccacgacggggaac

SEQ ID NO: 2830993 - RNA, 13 nt, Mycobacterium avium subsp. paratuberculosis
cgcggccaccagc

SEQ ID NO: 2830994 - RNA, 12 nt, Mycobacterium avium subsp. paratuberculosis
cgcggccacccc

SEQ ID NO: 2830995 - RNA, 19 nt, Mycobacterium avium subsp. paratuberculosis
cgcggccaccgcgcgcugc

SEQ ID NO: 2830996 - RNA, 20 nt, Mycobacterium avium subsp. paratuberculosis
cgcggccaccgcgcgcugcc

SEQ ID NO: 2830997 - RNA, 12 nt, Mycobacterium avium subsp. paratuberculosis
cgcggccaccgg

SEQ ID NO: 2830998 - RNA, 13 nt, Mycobacterium avium subsp. paratuberculosis
cgcggccaccggg

SEQ ID NO: 2830999 - RNA, 14 nt, Mycobacterium avium subsp. paratuberculosis
cgcggccaccggga

SEQ ID NO: 2831000 - RNA, 16 nt, Mycobacterium avium subsp. paratuberculosis
cgcggccaccgggacc

SEQ ID NO: 2831001 - RNA, 20 nt, Mycobacterium avium subsp. paratuberculosis
cgcggccaccgggaccgucg

SEQ ID NO: 2831002 - RNA, 14 nt, Mycobacterium avium subsp. paratuberculosis
cgcggccaccgggu

SEQ ID NO: 2831003 - RNA, 16 nt, Mycobacterium avium subsp. paratuberculosis
cgcggccaccuccagc

SEQ ID NO: 2831004 - RNA, 17 nt, Mycobacterium avium subsp. paratuberculosis
cgcggccaccuccagcc

SEQ ID NO: 2831005 - RNA, 20 nt, Mycobacterium avium subsp. paratuberculosis
cgcggccaccuccagcccgg

SEQ ID NO: 2831006 - RNA, 21 nt, Mycobacterium avium subsp. paratuberculosis
cgcggccacgcccuggccgcc

SEQ ID NO: 2831007 - RNA, 22 nt, Mycobacterium avium subsp. paratuberculosis
cgcggccacgcccuggccgccg

SEQ ID NO: 2831008 - RNA, 14 nt, Mycobacterium avium subsp. paratuberculosis
cgcggccacgcucg

SEQ ID NO: 2831009 - RNA, 20 nt, Mycobacterium avium subsp. paratuberculosis
cgcggccacgcucgggccgg

SEQ ID NO: 2831010 - RNA, 22 nt, Mycobacterium avium subsp. paratuberculosis
cgcggccacgcucgggccggcg

SEQ ID NO: 2831011 - RNA, 23 nt, Mycobacterium avium subsp. paratuberculosis
cgcggccacgcucgggccggcgc

SEQ ID NO: 2831012 - RNA, 11 nt, Mycobacterium avium subsp. paratuberculosis
cgcggccagca

SEQ ID NO: 2831013 - RNA, 12 nt, Mycobacterium avium subsp. paratuberculosis
cgcggccagcac

SEQ ID NO: 2831014 - RNA, 22 nt, Mycobacterium avium subsp. paratuberculosis
cgcggccagcacggucagcggc

SEQ ID NO: 2831015 - RNA, 14 nt, Mycobacterium avium subsp. paratuberculosis
cgcggccagccccg

SEQ ID NO: 2831016 - RNA, 16 nt, Mycobacterium avium subsp. paratuberculosis
cgcggccagccccggg

SEQ ID NO: 2831017 - RNA, 18 nt, Mycobacterium avium subsp. paratuberculosis
cgcggccagccccgggaa

SEQ ID NO: 2831018 - RNA, 12 nt, Mycobacterium avium subsp. paratuberculosis
cgcggccagccg

SEQ ID NO: 2831019 - RNA, 16 nt, Mycobacterium avium subsp. paratuberculosis
cgcggccagccggucg

SEQ ID NO: 2831020 - RNA, 22 nt, Mycobacterium avium subsp. paratuberculosis
cgcggccagccggucgucgggg

SEQ ID NO: 2831021 - RNA, 13 nt, Mycobacterium avium subsp. paratuberculosis
cgcggccagcgcc

SEQ ID NO: 2831022 - RNA, 14 nt, Mycobacterium avium subsp. paratuberculosis
cgcggccagcgccc

SEQ ID NO: 2831023 - RNA, 20 nt, Mycobacterium avium subsp. paratuberculosis
cgcggccagcgccccgccgg

SEQ ID NO: 2831024 - RNA, 17 nt, Mycobacterium avium subsp. paratuberculosis
cgcggccagcgcgcggg

SEQ ID NO: 2831025 - RNA, 23 nt, Mycobacterium avium subsp. paratuberculosis
cgcggccagcgcgcgggcguccu

SEQ ID NO: 2831026 - RNA, 12 nt, Mycobacterium avium subsp. paratuberculosis
cgcggccagcgg

SEQ ID NO: 2831027 - RNA, 14 nt, Mycobacterium avium subsp. paratuberculosis
cgcggccagcggcg

SEQ ID NO: 2831028 - RNA, 15 nt, Mycobacterium avium subsp. paratuberculosis
cgcggccagcggcgc

SEQ ID NO: 2831029 - RNA, 17 nt, Mycobacterium avium subsp. paratuberculosis
cgcggccagcggcgccg

SEQ ID NO: 2831030 - RNA, 16 nt, Mycobacterium avium subsp. paratuberculosis
cgcggccagcgggccg

SEQ ID NO: 2831031 - RNA, 16 nt, Mycobacterium avium subsp. paratuberculosis
cgcggccagcgugaac

SEQ ID NO: 2831032 - RNA, 21 nt, Mycobacterium avium subsp. paratuberculosis
cgcggccagcgugaacaccgc

SEQ ID NO: 2831033 - RNA, 13 nt, Mycobacterium avium subsp. paratuberculosis
cgcggccagcucc

SEQ ID NO: 2831034 - RNA, 19 nt, Mycobacterium avium subsp. paratuberculosis
cgcggccagcuccgggucg

SEQ ID NO: 2831035 - RNA, 15 nt, Mycobacterium avium subsp. paratuberculosis
cgcggccagcucggu

SEQ ID NO: 2831036 - RNA, 21 nt, Mycobacterium avium subsp. paratuberculosis
cgcggccagcucggucgcggu

SEQ ID NO: 2831037 - RNA, 13 nt, Mycobacterium avium subsp. paratuberculosis
cgcggccagcuga

SEQ ID NO: 2831038 - RNA, 23 nt, Mycobacterium avium subsp. paratuberculosis
cgcggccagcugaacacgaaccc

SEQ ID NO: 2831039 - RNA, 13 nt, Mycobacterium avium subsp. paratuberculosis
cgcggccagcugc

SEQ ID NO: 2831040 - RNA, 17 nt, Mycobacterium avium subsp. paratuberculosis
cgcggccggccgacacc

SEQ ID NO: 2831041 - RNA, 21 nt, Mycobacterium avium subsp. paratuberculosis
cgcggccggccggccuggugc

SEQ ID NO: 2831042 - RNA, 13 nt, Mycobacterium avium subsp. paratuberculosis
cgcggccggcgag

SEQ ID NO: 2831043 - RNA, 20 nt, Mycobacterium avium subsp. paratuberculosis
cgcggccggcgagucgcgga

SEQ ID NO: 2831044 - RNA, 14 nt, Mycobacterium avium subsp. paratuberculosis
cgcggccggcggca

SEQ ID NO: 2831045 - RNA, 22 nt, Mycobacterium avium subsp. paratuberculosis
cgcggccggcggcaguccggcg

SEQ ID NO: 2831046 - RNA, 13 nt, Mycobacterium avium subsp. paratuberculosis
cgcggccgggcgc

SEQ ID NO: 2831047 - RNA, 21 nt, Mycobacterium avium subsp. paratuberculosis
cgcggccgggcgccccgacau

SEQ ID NO: 2831048 - RNA, 14 nt, Mycobacterium avium subsp. paratuberculosis
cgcggccgggcucc

SEQ ID NO: 2831049 - RNA, 21 nt, Mycobacterium avium subsp. paratuberculosis
cgcggccggugccacggucag

SEQ ID NO: 2831050 - RNA, 14 nt, Mycobacterium avium subsp. paratuberculosis
cgcggccguagccg

SEQ ID NO: 2831051 - RNA, 17 nt, Mycobacterium avium subsp. paratuberculosis
cgcggccguguacagca

SEQ ID NO: 2831052 - RNA, 19 nt, Mycobacterium avium subsp. paratuberculosis
cgcggccguugcucucggc

SEQ ID NO: 2831053 - RNA, 14 nt, Mycobacterium avium subsp. paratuberculosis
cgcggccucaccgc

SEQ ID NO: 2831054 - RNA, 21 nt, Mycobacterium avium subsp. paratuberculosis
cgcggccucaccgcgggccag

SEQ ID NO: 2831055 - RNA, 12 nt, Mycobacterium avium subsp. paratuberculosis
cgcggccuccag

SEQ ID NO: 2831056 - RNA, 15 nt, Mycobacterium avium subsp. paratuberculosis
cgcggccuccagccg

SEQ ID NO: 2831057 - RNA, 16 nt, Mycobacterium avium subsp. paratuberculosis
cgcggccuccagccgc

SEQ ID NO: 2831058 - RNA, 23 nt, Mycobacterium avium subsp. paratuberculosis
cgcggccuccagccgcgcggccg

SEQ ID NO: 2831059 - RNA, 18 nt, Mycobacterium avium subsp. paratuberculosis
cgcggccuccagccgcuc

SEQ ID NO: 2831060 - RNA, 21 nt, Mycobacterium avium subsp. paratuberculosis
cgcggccuccagccgcuccgc

SEQ ID NO: 2831061 - RNA, 23 nt, Mycobacterium avium subsp. paratuberculosis
cgcggccuccagccgcuccgcgg

SEQ ID NO: 2831062 - RNA, 21 nt, Mycobacterium avium subsp. paratuberculosis
cgcggccuccgagcggcgcag

SEQ ID NO: 2831063 - RNA, 14 nt, Mycobacterium avium subsp. paratuberculosis
cgcggccuccgguu

SEQ ID NO: 2831064 - RNA, 17 nt, Mycobacterium avium subsp. paratuberculosis
cgcggccucgaagcugg

SEQ ID NO: 2831065 - RNA, 14 nt, Mycobacterium avium subsp. paratuberculosis
cgcggccucggcgu

SEQ ID NO: 2831066 - RNA, 15 nt, Mycobacterium avium subsp. paratuberculosis
cgcggccucgucgag

SEQ ID NO: 2831067 - RNA, 17 nt, Mycobacterium avium subsp. paratuberculosis
cgcggccucgucgaggu

SEQ ID NO: 2831068 - RNA, 18 nt, Mycobacterium avium subsp. paratuberculosis
cgcggccucucagcgcug

SEQ ID NO: 2831069 - RNA, 18 nt, Mycobacterium avium subsp. paratuberculosis
cgcggccugcagcaccga

SEQ ID NO: 2831070 - RNA, 17 nt, Mycobacterium avium subsp. paratuberculosis
cgcggccugcgggcgcc

SEQ ID NO: 2831071 - RNA, 18 nt, Mycobacterium avium subsp. paratuberculosis
cgcggccugcgggcgccg

SEQ ID NO: 2831072 - RNA, 20 nt, Mycobacterium avium subsp. paratuberculosis
cgcggccugcgggcgccggc

SEQ ID NO: 2831073 - RNA, 21 nt, Mycobacterium avium subsp. paratuberculosis
cgcggccugcgggcgccggcu

SEQ ID NO: 2831074 - RNA, 17 nt, Mycobacterium avium subsp. paratuberculosis
cgcggccuucuuggccg

SEQ ID NO: 2831075 - RNA, 21 nt, Mycobacterium avium subsp. paratuberculosis
cgcggccuucuuggccggagc

SEQ ID NO: 2831076 - RNA, 17 nt, Mycobacterium avium subsp. paratuberculosis
cgcggccuugcgagccg

SEQ ID NO: 2831077 - RNA, 20 nt, Mycobacterium avium subsp. paratuberculosis
cgcggccuugcgagccggag

SEQ ID NO: 2831078 - RNA, 23 nt, Mycobacterium avium subsp. paratuberculosis
cgcggccuugcgagccggagccu

SEQ ID NO: 2831079 - RNA, 18 nt, Mycobacterium avium subsp. paratuberculosis
cgcggccuugcgcaccgg

SEQ ID NO: 2831080 - RNA, 20 nt, Mycobacterium avium subsp. paratuberculosis
cgcggccuugcgcaccggag

SEQ ID NO: 2831081 - RNA, 23 nt, Mycobacterium avium subsp. paratuberculosis
cgcggccuugcgcaccggagccu

SEQ ID NO: 2831082 - RNA, 15 nt, Mycobacterium avium subsp. paratuberculosis
cgcggccuugcgggc

SEQ ID NO: 2831083 - RNA, 17 nt, Mycobacterium avium subsp. paratuberculosis
cgcggccuugcgggccg

SEQ ID NO: 2831084 - RNA, 18 nt, Mycobacterium avium subsp. paratuberculosis
cgcggccuugcgggccgg

SEQ ID NO: 2831085 - RNA, 23 nt, Mycobacterium avium subsp. paratuberculosis
cgcggccuugcgggccggagccu

SEQ ID NO: 2831086 - RNA, 16 nt, Mycobacterium avium subsp. paratuberculosis
cgcggcgaaaacgccu

SEQ ID NO: 2831087 - RNA, 15 nt, Mycobacterium avium subsp. paratuberculosis
cgcggcgaacaacgc

SEQ ID NO: 2831088 - RNA, 16 nt, Mycobacterium avium subsp. paratuberculosis
cgcggcgaacaccucg

SEQ ID NO: 2831089 - RNA, 19 nt, Mycobacterium avium subsp. paratuberculosis
cgcggcgaacaccucggcg

SEQ ID NO: 2831090 - RNA, 22 nt, Mycobacterium avium subsp. paratuberculosis
cgcggcgaacaccucggcgaug

SEQ ID NO: 2831091 - RNA, 14 nt, Mycobacterium avium subsp. paratuberculosis
cgcggcgaaccagc

SEQ ID NO: 2831092 - RNA, 16 nt, Mycobacterium avium subsp. paratuberculosis
cgcggcgaaccagcau

SEQ ID NO: 2831093 - RNA, 18 nt, Mycobacterium avium subsp. paratuberculosis
cgcggcgaaccagcaugc

SEQ ID NO: 2831094 - RNA, 19 nt, Mycobacterium avium subsp. paratuberculosis
cgcggcgaaccagcaugcg

SEQ ID NO: 2831095 - RNA, 20 nt, Mycobacterium avium subsp. paratuberculosis
cgcggcgaaccagcaugcgc

SEQ ID NO: 2831096 - RNA, 18 nt, Mycobacterium avium subsp. paratuberculosis
cgcggcgaacccgagcac

SEQ ID NO: 2831097 - RNA, 19 nt, Mycobacterium avium subsp. paratuberculosis
cgcggcgaacccgagcacc

SEQ ID NO: 2831098 - RNA, 20 nt, Mycobacterium avium subsp. paratuberculosis
cgcggcgaacccgagcaccc

SEQ ID NO: 2831099 - RNA, 22 nt, Mycobacterium avium subsp. paratuberculosis
cgcggcgaacccgagcaccccg

SEQ ID NO: 2831100 - RNA, 16 nt, Mycobacterium avium subsp. paratuberculosis
cgcggcgaaggcaucc

SEQ ID NO: 2831101 - RNA, 16 nt, Mycobacterium avium subsp. paratuberculosis
cgcggcgaaggccagc

SEQ ID NO: 2831102 - RNA, 20 nt, Mycobacterium avium subsp. paratuberculosis
cgcggcgaaggccagcgaua

SEQ ID NO: 2831103 - RNA, 18 nt, Mycobacterium avium subsp. paratuberculosis
cgcggcgaaucgguccgg

SEQ ID NO: 2831104 - RNA, 20 nt, Mycobacterium avium subsp. paratuberculosis
cgcggcgaaucgguccggcg

SEQ ID NO: 2831105 - RNA, 13 nt, Mycobacterium avium subsp. paratuberculosis
cgcggcgacaccc

SEQ ID NO: 2831106 - RNA, 15 nt, Mycobacterium avium subsp. paratuberculosis
cgcggcgacacccag

SEQ ID NO: 2831107 - RNA, 18 nt, Mycobacterium avium subsp. paratuberculosis
cgcggcgacacccagcgg

SEQ ID NO: 2831108 - RNA, 19 nt, Mycobacterium avium subsp. paratuberculosis
cgcggcgacacccagcggc

SEQ ID NO: 2831109 - RNA, 15 nt, Mycobacterium avium subsp. paratuberculosis
cgcggcgaccaccac

SEQ ID NO: 2831110 - RNA, 19 nt, Mycobacterium avium subsp. paratuberculosis
cgcggcgaccaccaccgcc

SEQ ID NO: 2831111 - RNA, 20 nt, Mycobacterium avium subsp. paratuberculosis
cgcggcgacccgcuucgccc

SEQ ID NO: 2831112 - RNA, 22 nt, Mycobacterium avium subsp. paratuberculosis
cgcggcgacccgcuucgcccgg

SEQ ID NO: 2831113 - RNA, 23 nt, Mycobacterium avium subsp. paratuberculosis
cgcggcgacccgcuucgcccggc

SEQ ID NO: 2831114 - RNA, 17 nt, Mycobacterium avium subsp. paratuberculosis
cgcggcgaccggggcgg

SEQ ID NO: 2831115 - RNA, 18 nt, Mycobacterium avium subsp. paratuberculosis
cgcggcgaccggggcggu

SEQ ID NO: 2831116 - RNA, 19 nt, Mycobacterium avium subsp. paratuberculosis
cgcggcgaccggggcggug

SEQ ID NO: 2831117 - RNA, 19 nt, Mycobacterium avium subsp. paratuberculosis
cgcggcgacgguggcgggc

SEQ ID NO: 2831118 - RNA, 16 nt, Mycobacterium avium subsp. paratuberculosis
cgcggcgacgucgugc

SEQ ID NO: 2831119 - RNA, 17 nt, Mycobacterium avium subsp. paratuberculosis
cgcggcgacgucgugca

SEQ ID NO: 2831120 - RNA, 20 nt, Mycobacterium avium subsp. paratuberculosis
cgcggcgacgucgugcacgc

SEQ ID NO: 2831121 - RNA, 12 nt, Mycobacterium avium subsp. paratuberculosis
cgcggcgagcag

SEQ ID NO: 2831122 - RNA, 16 nt, Mycobacterium avium subsp. paratuberculosis
cgcggcgagcagcgcg

SEQ ID NO: 2831123 - RNA, 17 nt, Mycobacterium avium subsp. paratuberculosis
cgcggcgagcagcgcga

SEQ ID NO: 2831124 - RNA, 13 nt, Mycobacterium avium subsp. paratuberculosis
cgcggcgccgguu

SEQ ID NO: 2831125 - RNA, 23 nt, Mycobacterium avium subsp. paratuberculosis
cgcggcgccguagguggccauga

SEQ ID NO: 2831126 - RNA, 13 nt, Mycobacterium avium subsp. paratuberculosis
cgcggcgccguug

SEQ ID NO: 2831127 - RNA, 19 nt, Mycobacterium avium subsp. paratuberculosis
cgcggcgccguugaccggc

SEQ ID NO: 2831128 - RNA, 18 nt, Mycobacterium avium subsp. paratuberculosis
cgcggcgcgaagcccucg

SEQ ID NO: 2831129 - RNA, 14 nt, Mycobacterium avium subsp. paratuberculosis
cgcggcgcgacacc

SEQ ID NO: 2831130 - RNA, 16 nt, Mycobacterium avium subsp. paratuberculosis
cgcggcgcgacaccgc

SEQ ID NO: 2831131 - RNA, 22 nt, Mycobacterium avium subsp. paratuberculosis
cgcggcgcgaggcgcggggcgc

SEQ ID NO: 2831132 - RNA, 12 nt, Mycobacterium avium subsp. paratuberculosis
cgcggcgcgcag

SEQ ID NO: 2831133 - RNA, 13 nt, Mycobacterium avium subsp. paratuberculosis
cgcggcgcgcagg

SEQ ID NO: 2831134 - RNA, 14 nt, Mycobacterium avium subsp. paratuberculosis
cgcggcgcgcaggu

SEQ ID NO: 2831135 - RNA, 14 nt, Mycobacterium avium subsp. paratuberculosis
cgcggcgcgcaucg

SEQ ID NO: 2831136 - RNA, 15 nt, Mycobacterium avium subsp. paratuberculosis
cgcggcgcgcaucgc

SEQ ID NO: 2831137 - RNA, 15 nt, Mycobacterium avium subsp. paratuberculosis
cgcggcgcgcaucgu

SEQ ID NO: 2831138 - RNA, 18 nt, Mycobacterium avium subsp. paratuberculosis
cgcggcgcgcaucgucgc

SEQ ID NO: 2831139 - RNA, 16 nt, Mycobacterium avium subsp. paratuberculosis
cgcggcgcgcgaugga

SEQ ID NO: 2831140 - RNA, 13 nt, Mycobacterium avium subsp. paratuberculosis
cgcggcgcgcggc

SEQ ID NO: 2831141 - RNA, 15 nt, Mycobacterium avium subsp. paratuberculosis
cgcggcgcgcggccg

SEQ ID NO: 2831142 - RNA, 15 nt, Mycobacterium avium subsp. paratuberculosis
cgcggcgcggagccg

SEQ ID NO: 2831143 - RNA, 15 nt, Mycobacterium avium subsp. paratuberculosis
cgcggcgcggcccgg

SEQ ID NO: 2831144 - RNA, 19 nt, Mycobacterium avium subsp. paratuberculosis
cgcggcgcuaaagccacca

SEQ ID NO: 2831145 - RNA, 21 nt, Mycobacterium avium subsp. paratuberculosis
cgcggcgcuaaagccaccagc

SEQ ID NO: 2831146 - RNA, 22 nt, Mycobacterium avium subsp. paratuberculosis
cgcggcgcuaaagccaccagcg

SEQ ID NO: 2831147 - RNA, 23 nt, Mycobacterium avium subsp. paratuberculosis
cgcggcgcuaaagccaccagcgu

SEQ ID NO: 2831148 - RNA, 14 nt, Mycobacterium avium subsp. paratuberculosis
cgcggcgcugccgc

SEQ ID NO: 2831149 - RNA, 19 nt, Mycobacterium avium subsp. paratuberculosis
cgcggcgcugccgccggcc

SEQ ID NO: 2831150 - RNA, 22 nt, Mycobacterium avium subsp. paratuberculosis
cgcggcgcugccgccggccucg

SEQ ID NO: 2831151 - RNA, 16 nt, Mycobacterium avium subsp. paratuberculosis
cgcggcgcugccggug

SEQ ID NO: 2831152 - RNA, 19 nt, Mycobacterium avium subsp. paratuberculosis
cgcggcgcugccggugcug

SEQ ID NO: 2831153 - RNA, 13 nt, Mycobacterium avium subsp. paratuberculosis
cgcggcgcugcgc

SEQ ID NO: 2831154 - RNA, 21 nt, Mycobacterium avium subsp. paratuberculosis
cgcggcgcuugaccucgccga

SEQ ID NO: 2831155 - RNA, 14 nt, Mycobacterium avium subsp. paratuberculosis
cgcggcggacagca

SEQ ID NO: 2831156 - RNA, 17 nt, Mycobacterium avium subsp. paratuberculosis
cgcggcggacagcacgu

SEQ ID NO: 2831157 - RNA, 15 nt, Mycobacterium avium subsp. paratuberculosis
cgcggcggaggccug

SEQ ID NO: 2831158 - RNA, 16 nt, Mycobacterium avium subsp. paratuberculosis
cgcggcggaggccugc

SEQ ID NO: 2831159 - RNA, 18 nt, Mycobacterium avium subsp. paratuberculosis
cgcggcggaggccugcgc

SEQ ID NO: 2831160 - RNA, 18 nt, Mycobacterium avium subsp. paratuberculosis
cgcggcggaggucagcgg

SEQ ID NO: 2831161 - RNA, 21 nt, Mycobacterium avium subsp. paratuberculosis
cgcggcggaggucagcggccc

SEQ ID NO: 2831162 - RNA, 23 nt, Mycobacterium avium subsp. paratuberculosis
cgcggcggaggucagcggcccga

SEQ ID NO: 2831163 - RNA, 17 nt, Mycobacterium avium subsp. paratuberculosis
cgcggcggauccagcac

SEQ ID NO: 2831164 - RNA, 18 nt, Mycobacterium avium subsp. paratuberculosis
cgcggcggauccagcacc

SEQ ID NO: 2831165 - RNA, 19 nt, Mycobacterium avium subsp. paratuberculosis
cgcggcggauguccuggug

SEQ ID NO: 2831166 - RNA, 16 nt, Mycobacterium avium subsp. paratuberculosis
cgcggcggcaaccagc

SEQ ID NO: 2831167 - RNA, 13 nt, Mycobacterium avium subsp. paratuberculosis
cgcggcggcaagu

SEQ ID NO: 2831168 - RNA, 23 nt, Mycobacterium avium subsp. paratuberculosis
cgcggcggcacccaggucaccga

SEQ ID NO: 2831169 - RNA, 15 nt, Mycobacterium avium subsp. paratuberculosis
cgcggcggcagcacc

SEQ ID NO: 2831170 - RNA, 17 nt, Mycobacterium avium subsp. paratuberculosis
cgcggcggcagcacccg

SEQ ID NO: 2831171 - RNA, 16 nt, Mycobacterium avium subsp. paratuberculosis
cgcggcggcagcagcc

SEQ ID NO: 2831172 - RNA, 18 nt, Mycobacterium avium subsp. paratuberculosis
cgcggcggccaacgcgac

SEQ ID NO: 2831173 - RNA, 20 nt, Mycobacterium avium subsp. paratuberculosis
cgcggcggccaacgcgacga

SEQ ID NO: 2831174 - RNA, 16 nt, Mycobacterium avium subsp. paratuberculosis
cgcggcggccaaucgc

SEQ ID NO: 2831175 - RNA, 20 nt, Mycobacterium avium subsp. paratuberculosis
cgcggcggccaaucgcugug

SEQ ID NO: 2831176 - RNA, 13 nt, Mycobacterium avium subsp. paratuberculosis
cgcggcggccacc

SEQ ID NO: 2831177 - RNA, 14 nt, Mycobacterium avium subsp. paratuberculosis
cgcggcggccaccu

SEQ ID NO: 2831178 - RNA, 16 nt, Mycobacterium avium subsp. paratuberculosis
cgcggcggccaccucg

SEQ ID NO: 2831179 - RNA, 17 nt, Mycobacterium avium subsp. paratuberculosis
cgcggcggccaccucgg

SEQ ID NO: 2831180 - RNA, 18 nt, Mycobacterium avium subsp. paratuberculosis
cgcggcggccaccucggc

SEQ ID NO: 2831181 - RNA, 12 nt, Mycobacterium avium subsp. paratuberculosis
cgcggcggccag

SEQ ID NO: 2831182 - RNA, 15 nt, Mycobacterium avium subsp. paratuberculosis
cgcggcggcccggcg

SEQ ID NO: 2831183 - RNA, 16 nt, Mycobacterium avium subsp. paratuberculosis
cgcggcggcccggcgu

SEQ ID NO: 2831184 - RNA, 21 nt, Mycobacterium avium subsp. paratuberculosis
cgcggcggcccgucgccacca

SEQ ID NO: 2831185 - RNA, 22 nt, Mycobacterium avium subsp. paratuberculosis
cgcggcggcccgucgccaccac

SEQ ID NO: 2831186 - RNA, 11 nt, Mycobacterium avium subsp. paratuberculosis
cgcggcggccg

SEQ ID NO: 2831187 - RNA, 13 nt, Mycobacterium avium subsp. paratuberculosis
cgcggcggccgac

SEQ ID NO: 2831188 - RNA, 21 nt, Mycobacterium avium subsp. paratuberculosis
cgcggcggccgacagcgcguc

SEQ ID NO: 2831189 - RNA, 15 nt, Mycobacterium avium subsp. paratuberculosis
cgcggcggccgacgc

SEQ ID NO: 2831190 - RNA, 17 nt, Mycobacterium avium subsp. paratuberculosis
cgcggcggccgacgcgc

SEQ ID NO: 2831191 - RNA, 21 nt, Mycobacterium avium subsp. paratuberculosis
cgcggcggccgacgcgccguc

SEQ ID NO: 2831192 - RNA, 13 nt, Mycobacterium avium subsp. paratuberculosis
cgcggcggccggc

SEQ ID NO: 2831193 - RNA, 14 nt, Mycobacterium avium subsp. paratuberculosis
cgcggcggccggcc

SEQ ID NO: 2831194 - RNA, 15 nt, Mycobacterium avium subsp. paratuberculosis
cgcggcggccggcca

SEQ ID NO: 2831195 - RNA, 17 nt, Mycobacterium avium subsp. paratuberculosis
cgcggcggccggccagc

SEQ ID NO: 2831196 - RNA, 17 nt, Mycobacterium avium subsp. paratuberculosis
cgcggcggccggcgaug

SEQ ID NO: 2831197 - RNA, 19 nt, Mycobacterium avium subsp. paratuberculosis
cgcggcggccggcgccgac

SEQ ID NO: 2831198 - RNA, 14 nt, Mycobacterium avium subsp. paratuberculosis
cgcggcggccucgg

SEQ ID NO: 2831199 - RNA, 12 nt, Mycobacterium avium subsp. paratuberculosis
cgcggcggccug

SEQ ID NO: 2831200 - RNA, 16 nt, Mycobacterium avium subsp. paratuberculosis
cgcggcggccugcuug

SEQ ID NO: 2831201 - RNA, 20 nt, Mycobacterium avium subsp. paratuberculosis
cgcggcggccuggccgucgc

SEQ ID NO: 2831202 - RNA, 24 nt, Mycobacterium avium subsp. paratuberculosis
cgcggcggccuggccgucgcggcg

SEQ ID NO: 2831203 - RNA, 12 nt, Mycobacterium avium subsp. paratuberculosis
cgcggcggcgcc

SEQ ID NO: 2831204 - RNA, 13 nt, Mycobacterium avium subsp. paratuberculosis
cgcggcggcgcca

SEQ ID NO: 2831205 - RNA, 13 nt, Mycobacterium avium subsp. paratuberculosis
cgcggcggcgccg

SEQ ID NO: 2831206 - RNA, 14 nt, Mycobacterium avium subsp. paratuberculosis
cgcggcggcgccga

SEQ ID NO: 2831207 - RNA, 14 nt, Mycobacterium avium subsp. paratuberculosis
cgcggcggcgccgc

SEQ ID NO: 2831208 - RNA, 21 nt, Mycobacterium avium subsp. paratuberculosis
cgcggcggcgccgcagcacgc

SEQ ID NO: 2831209 - RNA, 17 nt, Mycobacterium avium subsp. paratuberculosis
cgcggcgugguagccgc

SEQ ID NO: 2831210 - RNA, 18 nt, Mycobacterium avium subsp. paratuberculosis
cgcggcgugguagccgcc

SEQ ID NO: 2831211 - RNA, 16 nt, Mycobacterium avium subsp. paratuberculosis
cgcggcguucagcagc

SEQ ID NO: 2831212 - RNA, 18 nt, Mycobacterium avium subsp. paratuberculosis
cgcggcguucagcagcgc

SEQ ID NO: 2831213 - RNA, 19 nt, Mycobacterium avium subsp. paratuberculosis
cgcggcguucuccagcacc

SEQ ID NO: 2831214 - RNA, 20 nt, Mycobacterium avium subsp. paratuberculosis
cgcggcguucuccagcaccc

SEQ ID NO: 2831215 - RNA, 21 nt, Mycobacterium avium subsp. paratuberculosis
cgcggcguucuccagcacccg

SEQ ID NO: 2831216 - RNA, 22 nt, Mycobacterium avium subsp. paratuberculosis
cgcggcguucuccagcacccgc

SEQ ID NO: 2831217 - RNA, 23 nt, Mycobacterium avium subsp. paratuberculosis
cgcggcguucuccagcacccgca

SEQ ID NO: 2831218 - RNA, 24 nt, Mycobacterium avium subsp. paratuberculosis
cgcggcguucuccagcacccgcaa

SEQ ID NO: 2831219 - RNA, 13 nt, Mycobacterium avium subsp. paratuberculosis
cgcggcguugccc

SEQ ID NO: 2831220 - RNA, 16 nt, Mycobacterium avium subsp. paratuberculosis
cgcggcguugccgccg

SEQ ID NO: 2831221 - RNA, 17 nt, Mycobacterium avium subsp. paratuberculosis
cgcggcguugccgccgg

SEQ ID NO: 2831222 - RNA, 19 nt, Mycobacterium avium subsp. paratuberculosis
cgcggcguugccgccggcg

SEQ ID NO: 2831223 - RNA, 21 nt, Mycobacterium avium subsp. paratuberculosis
cgcggcuaauucagcugcgga

SEQ ID NO: 2831224 - RNA, 18 nt, Mycobacterium avium subsp. paratuberculosis
cgcggcuaguuggccggc

SEQ ID NO: 2831225 - RNA, 13 nt, Mycobacterium avium subsp. paratuberculosis
cgcggcucacagc

SEQ ID NO: 2831226 - RNA, 17 nt, Mycobacterium avium subsp. paratuberculosis
cgcggcucacagcgcgg

SEQ ID NO: 2831227 - RNA, 19 nt, Mycobacterium avium subsp. paratuberculosis
cgcggcucacagcgcggcg

SEQ ID NO: 2831228 - RNA, 20 nt, Mycobacterium avium subsp. paratuberculosis
cgcggcucacagcgcggcgg

SEQ ID NO: 2831229 - RNA, 22 nt, Mycobacterium avium subsp. paratuberculosis
cgcggcucacgacuccuggccg

SEQ ID NO: 2831230 - RNA, 15 nt, Mycobacterium avium subsp. paratuberculosis
cgcggcuccagcagc

SEQ ID NO: 2831231 - RNA, 16 nt, Mycobacterium avium subsp. paratuberculosis
cgcggcuccagcagcg

SEQ ID NO: 2831232 - RNA, 22 nt, Mycobacterium avium subsp. paratuberculosis
cgcggcuccagcagcggcucgg

SEQ ID NO: 2831233 - RNA, 15 nt, Mycobacterium avium subsp. paratuberculosis
cgcggcuccggccgc

SEQ ID NO: 2831234 - RNA, 19 nt, Mycobacterium avium subsp. paratuberculosis
cgcggcuccggccgcgccg

SEQ ID NO: 2831235 - RNA, 20 nt, Mycobacterium avium subsp. paratuberculosis
cgcggcuccggccgcgccgg

SEQ ID NO: 2831236 - RNA, 21 nt, Mycobacterium avium subsp. paratuberculosis
cgcggcuccggccgcgccggc

SEQ ID NO: 2831237 - RNA, 22 nt, Mycobacterium avium subsp. paratuberculosis
cgcggcuccggccgcgccggcc

SEQ ID NO: 2831238 - RNA, 20 nt, Mycobacterium avium subsp. paratuberculosis
cgcggcucgauggacgccag

SEQ ID NO: 2831239 - RNA, 17 nt, Mycobacterium avium subsp. paratuberculosis
cgcggcucgcgacgcgg

SEQ ID NO: 2831240 - RNA, 18 nt, Mycobacterium avium subsp. paratuberculosis
cgcggcucgcgacgcggc

SEQ ID NO: 2831241 - RNA, 14 nt, Mycobacterium avium subsp. paratuberculosis
cgcggcucgcgggc

SEQ ID NO: 2831242 - RNA, 15 nt, Mycobacterium avium subsp. paratuberculosis
cgcggcucgcgggcg

SEQ ID NO: 2831243 - RNA, 18 nt, Mycobacterium avium subsp. paratuberculosis
cgcggcucgcgggcgaug

SEQ ID NO: 2831244 - RNA, 13 nt, Mycobacterium avium subsp. paratuberculosis
cgcggcucggucg

SEQ ID NO: 2831245 - RNA, 19 nt, Mycobacterium avium subsp. paratuberculosis
cgcggcugaucagccggcg

SEQ ID NO: 2831246 - RNA, 20 nt, Mycobacterium avium subsp. paratuberculosis
cgcggcugaucagccggcga

SEQ ID NO: 2831247 - RNA, 21 nt, Mycobacterium avium subsp. paratuberculosis
cgcggcugaucagccggcgag

SEQ ID NO: 2831248 - RNA, 23 nt, Mycobacterium avium subsp. paratuberculosis
cgcggcugaucagccggcgagcg

SEQ ID NO: 2831249 - RNA, 15 nt, Mycobacterium avium subsp. paratuberculosis
cgcggcugcgcacgu

SEQ ID NO: 2831250 - RNA, 17 nt, Mycobacterium avium subsp. paratuberculosis
cgcggcugcgcacguag

SEQ ID NO: 2831251 - RNA, 15 nt, Mycobacterium avium subsp. paratuberculosis
cgcggcugcucgaac

SEQ ID NO: 2831252 - RNA, 15 nt, Mycobacterium avium subsp. paratuberculosis
cgcggcuggcccggc

SEQ ID NO: 2831253 - RNA, 16 nt, Mycobacterium avium subsp. paratuberculosis
cgcggcuggcccggcg

SEQ ID NO: 2831254 - RNA, 17 nt, Mycobacterium avium subsp. paratuberculosis
cgcggcuggcccggcgc

SEQ ID NO: 2831255 - RNA, 18 nt, Mycobacterium avium subsp. paratuberculosis
cgcggcuggcccggcgcg

SEQ ID NO: 2831256 - RNA, 12 nt, Mycobacterium avium subsp. paratuberculosis
cgcggcuggccg

SEQ ID NO: 2831257 - RNA, 13 nt, Mycobacterium avium subsp. paratuberculosis
cgcggcuggccgc

SEQ ID NO: 2831258 - RNA, 16 nt, Mycobacterium avium subsp. paratuberculosis
cgcggcuggccgcggc

SEQ ID NO: 2831259 - RNA, 18 nt, Mycobacterium avium subsp. paratuberculosis
cgcggcuggccgcggcga

SEQ ID NO: 2831260 - RNA, 20 nt, Mycobacterium avium subsp. paratuberculosis
cgcggcuggccgcggcgauc

SEQ ID NO: 2831261 - RNA, 22 nt, Mycobacterium avium subsp. paratuberculosis
cgcggcuggccgcggcgaucgg

SEQ ID NO: 2831262 - RNA, 15 nt, Mycobacterium avium subsp. paratuberculosis
cgcggcuggccgucg

SEQ ID NO: 2831263 - RNA, 16 nt, Mycobacterium avium subsp. paratuberculosis
cgcggcuggccgucgu

SEQ ID NO: 2831264 - RNA, 14 nt, Mycobacterium avium subsp. paratuberculosis
cgcggcuggcgggu

SEQ ID NO: 2831265 - RNA, 15 nt, Mycobacterium avium subsp. paratuberculosis
cgcggcuggugccgc

SEQ ID NO: 2831266 - RNA, 22 nt, Mycobacterium avium subsp. paratuberculosis
cgcggcuggugccgccggcgau

SEQ ID NO: 2831267 - RNA, 23 nt, Mycobacterium avium subsp. paratuberculosis
cgcggcuggugccgccggcgauc

SEQ ID NO: 2831268 - RNA, 18 nt, Mycobacterium avium subsp. paratuberculosis
cgcggcuucagucccgcg

SEQ ID NO: 2831269 - RNA, 23 nt, Mycobacterium avium subsp. paratuberculosis
cgcggcuucauaugacgccggcc

SEQ ID NO: 2831270 - RNA, 16 nt, Mycobacterium avium subsp. paratuberculosis
cgcggcuugcugcggu

SEQ ID NO: 2831271 - RNA, 22 nt, Mycobacterium avium subsp. paratuberculosis
cgcggcuuggccaccaccacgg

SEQ ID NO: 2831272 - RNA, 19 nt, Mycobacterium avium subsp. paratuberculosis
cgcggcuuuuggcgucguu

SEQ ID NO: 2831273 - RNA, 17 nt, Mycobacterium avium subsp. paratuberculosis
cgcgggaacgaucggcu

SEQ ID NO: 2831274 - RNA, 18 nt, Mycobacterium avium subsp. paratuberculosis
cgcgggaaucccacccgc

SEQ ID NO: 2831275 - RNA, 19 nt, Mycobacterium avium subsp. paratuberculosis
cgcgggaaucccacccgca

SEQ ID NO: 2831276 - RNA, 20 nt, Mycobacterium avium subsp. paratuberculosis
cgcgggaaucccacccgcaa

SEQ ID NO: 2831277 - RNA, 17 nt, Mycobacterium avium subsp. paratuberculosis
cgcgggaauggccgcgc

SEQ ID NO: 2831278 - RNA, 22 nt, Mycobacterium avium subsp. paratuberculosis
cgcgggaauggccgcgccguag

SEQ ID NO: 2831279 - RNA, 12 nt, Mycobacterium avium subsp. paratuberculosis
cgcgggacacgg

SEQ ID NO: 2831280 - RNA, 13 nt, Mycobacterium avium subsp. paratuberculosis
cgcgggacacggc

SEQ ID NO: 2831281 - RNA, 17 nt, Mycobacterium avium subsp. paratuberculosis
cgcgggacacggcggcg

SEQ ID NO: 2831282 - RNA, 15 nt, Mycobacterium avium subsp. paratuberculosis
cgcgggaccgggccc

SEQ ID NO: 2831283 - RNA, 16 nt, Mycobacterium avium subsp. paratuberculosis
cgcgggacggcggcga

SEQ ID NO: 2831284 - RNA, 22 nt, Mycobacterium avium subsp. paratuberculosis
cgcgggagagcgcgggcaccgu

SEQ ID NO: 2831285 - RNA, 14 nt, Mycobacterium avium subsp. paratuberculosis
cgcgggagcgcugg

SEQ ID NO: 2831286 - RNA, 17 nt, Mycobacterium avium subsp. paratuberculosis
cgcgggagcgcuggucg

SEQ ID NO: 2831287 - RNA, 20 nt, Mycobacterium avium subsp. paratuberculosis
cgcgggagcgcuggucggcg

SEQ ID NO: 2831288 - RNA, 21 nt, Mycobacterium avium subsp. paratuberculosis
cgcgggagcgcuggucggcga

SEQ ID NO: 2831289 - RNA, 14 nt, Mycobacterium avium subsp. paratuberculosis
cgcgggaggacagc

SEQ ID NO: 2831290 - RNA, 17 nt, Mycobacterium avium subsp. paratuberculosis
cgcgggaggacagcgcg

SEQ ID NO: 2831291 - RNA, 19 nt, Mycobacterium avium subsp. paratuberculosis
cgcgggaggacagcgcggu

SEQ ID NO: 2831292 - RNA, 15 nt, Mycobacterium avium subsp. paratuberculosis
cgcgggaguccacgc

SEQ ID NO: 2831293 - RNA, 15 nt, Mycobacterium avium subsp. paratuberculosis
cgcgggcgcgcgccg

SEQ ID NO: 2831294 - RNA, 16 nt, Mycobacterium avium subsp. paratuberculosis
cgcgggcgcgcgccgc

SEQ ID NO: 2831295 - RNA, 19 nt, Mycobacterium avium subsp. paratuberculosis
cgcgggcgcgcgccgcccc

SEQ ID NO: 2831296 - RNA, 16 nt, Mycobacterium avium subsp. paratuberculosis
cgcgggcgcggacagc

SEQ ID NO: 2831297 - RNA, 18 nt, Mycobacterium avium subsp. paratuberculosis
cgcgggcgcggccagcgc

SEQ ID NO: 2831298 - RNA, 14 nt, Mycobacterium avium subsp. paratuberculosis
cgcgggcggcaggu

SEQ ID NO: 2831299 - RNA, 19 nt, Mycobacterium avium subsp. paratuberculosis
cgcgggcggcaggucggcg

SEQ ID NO: 2831300 - RNA, 13 nt, Mycobacterium avium subsp. paratuberculosis
cgcgggcggcgca

SEQ ID NO: 2831301 - RNA, 17 nt, Mycobacterium avium subsp. paratuberculosis
cgcgggcggcgcagucg

SEQ ID NO: 2831302 - RNA, 22 nt, Mycobacterium avium subsp. paratuberculosis
cgcgggcggcgcagucggccgg

SEQ ID NO: 2831303 - RNA, 14 nt, Mycobacterium avium subsp. paratuberculosis
cgcgggcggcgucg

SEQ ID NO: 2831304 - RNA, 15 nt, Mycobacterium avium subsp. paratuberculosis
cgcgggcggcgucgg

SEQ ID NO: 2831305 - RNA, 16 nt, Mycobacterium avium subsp. paratuberculosis
cgcgggcggcgucggc

SEQ ID NO: 2831306 - RNA, 17 nt, Mycobacterium avium subsp. paratuberculosis
cgcgggcggcgucggcg

SEQ ID NO: 2831307 - RNA, 20 nt, Mycobacterium avium subsp. paratuberculosis
cgcgggcggcgucggcgacg

SEQ ID NO: 2831308 - RNA, 18 nt, Mycobacterium avium subsp. paratuberculosis
cgcgggcggggccugcgg

SEQ ID NO: 2831309 - RNA, 23 nt, Mycobacterium avium subsp. paratuberculosis
cgcgggcggggccugcgggacgc

SEQ ID NO: 2831310 - RNA, 17 nt, Mycobacterium avium subsp. paratuberculosis
cgcgggcggggcgccga

SEQ ID NO: 2831311 - RNA, 17 nt, Mycobacterium avium subsp. paratuberculosis
cgcgggcggucgcgcag

SEQ ID NO: 2831312 - RNA, 20 nt, Mycobacterium avium subsp. paratuberculosis
cgcgggcggucgcgcagccg

SEQ ID NO: 2831313 - RNA, 13 nt, Mycobacterium avium subsp. paratuberculosis
cgcgggcguccac

SEQ ID NO: 2831314 - RNA, 14 nt, Mycobacterium avium subsp. paratuberculosis
cgcgggcguccacg

SEQ ID NO: 2831315 - RNA, 15 nt, Mycobacterium avium subsp. paratuberculosis
cgcgggcguccacga

SEQ ID NO: 2831316 - RNA, 20 nt, Mycobacterium avium subsp. paratuberculosis
cgcgggcguccucgucggcg

SEQ ID NO: 2831317 - RNA, 12 nt, Mycobacterium avium subsp. paratuberculosis
cgcgggcgucgg

SEQ ID NO: 2831318 - RNA, 20 nt, Mycobacterium avium subsp. paratuberculosis
cgcgggcgucgggcagcagc

SEQ ID NO: 2831319 - RNA, 15 nt, Mycobacterium avium subsp. paratuberculosis
cgcgggcguggcggu

SEQ ID NO: 2831320 - RNA, 20 nt, Mycobacterium avium subsp. paratuberculosis
cgcgggcguggcggucggug

SEQ ID NO: 2831321 - RNA, 13 nt, Mycobacterium avium subsp. paratuberculosis
cgcgggcguucau

SEQ ID NO: 2831322 - RNA, 23 nt, Mycobacterium avium subsp. paratuberculosis
cgcgggcguucaucaccuggucg

SEQ ID NO: 2831323 - RNA, 15 nt, Mycobacterium avium subsp. paratuberculosis
cgcgggcuaaugcau

SEQ ID NO: 2831324 - RNA, 15 nt, Mycobacterium avium subsp. paratuberculosis
cgcgggcucgaacaa

SEQ ID NO: 2831325 - RNA, 16 nt, Mycobacterium avium subsp. paratuberculosis
cgcgggcugcagggcc

SEQ ID NO: 2831326 - RNA, 22 nt, Mycobacterium avium subsp. paratuberculosis
cgcgggcugcagggccgggucg

SEQ ID NO: 2831327 - RNA, 14 nt, Mycobacterium avium subsp. paratuberculosis
cgcgggcugcggcg

SEQ ID NO: 2831328 - RNA, 15 nt, Mycobacterium avium subsp. paratuberculosis
cgcggggccaccagg

SEQ ID NO: 2831329 - RNA, 20 nt, Mycobacterium avium subsp. paratuberculosis
cgcggggccaccaggcgccg

SEQ ID NO: 2831330 - RNA, 21 nt, Mycobacterium avium subsp. paratuberculosis
cgcggggccaccaggcgccgu

SEQ ID NO: 2831331 - RNA, 13 nt, Mycobacterium avium subsp. paratuberculosis
cgcggggccggcg

SEQ ID NO: 2831332 - RNA, 15 nt, Mycobacterium avium subsp. paratuberculosis
cgcggggccggcgcg

SEQ ID NO: 2831333 - RNA, 18 nt, Mycobacterium avium subsp. paratuberculosis
cgcggggccggcgcggug

SEQ ID NO: 2831334 - RNA, 23 nt, Mycobacterium avium subsp. paratuberculosis
cgcggggccggcgcuggcgugcu

SEQ ID NO: 2831335 - RNA, 21 nt, Mycobacterium avium subsp. paratuberculosis
cgcggggcgcgaggcgcgaaa

SEQ ID NO: 2831336 - RNA, 16 nt, Mycobacterium avium subsp. paratuberculosis
cgcggggcggccgccg

SEQ ID NO: 2831337 - RNA, 21 nt, Mycobacterium avium subsp. paratuberculosis
cgcggggcggccgccgggccg

SEQ ID NO: 2831338 - RNA, 15 nt, Mycobacterium avium subsp. paratuberculosis
cgcggggcggcggcg

SEQ ID NO: 2831339 - RNA, 21 nt, Mycobacterium avium subsp. paratuberculosis
cgcggggcguacgcgcugccg

SEQ ID NO: 2831340 - RNA, 22 nt, Mycobacterium avium subsp. paratuberculosis
cgcggggcguacgcgcugccga

SEQ ID NO: 2831341 - RNA, 21 nt, Mycobacterium avium subsp. paratuberculosis
cgcggggcugggcgccauggc

SEQ ID NO: 2831342 - RNA, 13 nt, Mycobacterium avium subsp. paratuberculosis
cgcgggggccgcc

SEQ ID NO: 2831343 - RNA, 14 nt, Mycobacterium avium subsp. paratuberculosis
cgcgggggccgcga

SEQ ID NO: 2831344 - RNA, 16 nt, Mycobacterium avium subsp. paratuberculosis
cgcgggggcggccuga

SEQ ID NO: 2831345 - RNA, 23 nt, Mycobacterium avium subsp. paratuberculosis
cgcgggggcggccugagccgccg

SEQ ID NO: 2831346 - RNA, 21 nt, Mycobacterium avium subsp. paratuberculosis
cgcggggggagggucgguggc

SEQ ID NO: 2831347 - RNA, 14 nt, Mycobacterium avium subsp. paratuberculosis
cgcggggucggcca

SEQ ID NO: 2831348 - RNA, 22 nt, Mycobacterium avium subsp. paratuberculosis
cgcggggucgggccggacagcg

SEQ ID NO: 2831349 - RNA, 15 nt, Mycobacterium avium subsp. paratuberculosis
cgcgggguggcgccg

SEQ ID NO: 2831350 - RNA, 17 nt, Mycobacterium avium subsp. paratuberculosis
cgcgggguggcgccggc

SEQ ID NO: 2831351 - RNA, 19 nt, Mycobacterium avium subsp. paratuberculosis
cgcgggguggcgccggcca

SEQ ID NO: 2831352 - RNA, 16 nt, Mycobacterium avium subsp. paratuberculosis
cgcggggugucgcggc

SEQ ID NO: 2831353 - RNA, 16 nt, Mycobacterium avium subsp. paratuberculosis
cgcggguacggcggcc

SEQ ID NO: 2831354 - RNA, 17 nt, Mycobacterium avium subsp. paratuberculosis
cgcggguacggcggccg

SEQ ID NO: 2831355 - RNA, 18 nt, Mycobacterium avium subsp. paratuberculosis
cgcggguacggcggccgc

SEQ ID NO: 2831356 - RNA, 20 nt, Mycobacterium avium subsp. paratuberculosis
cgcggguacggcggccgcgg

SEQ ID NO: 2831357 - RNA, 16 nt, Mycobacterium avium subsp. paratuberculosis
cgcggguacggucggc

SEQ ID NO: 2831358 - RNA, 18 nt, Mycobacterium avium subsp. paratuberculosis
cgcggguacggucggccg

SEQ ID NO: 2831359 - RNA, 22 nt, Mycobacterium avium subsp. paratuberculosis
cgcggguacggucggccguaca

SEQ ID NO: 2831360 - RNA, 22 nt, Mycobacterium avium subsp. paratuberculosis
cgcggguagacguucuccccgc

SEQ ID NO: 2831361 - RNA, 16 nt, Mycobacterium avium subsp. paratuberculosis
cgcggguagcccgucg

SEQ ID NO: 2831362 - RNA, 20 nt, Mycobacterium avium subsp. paratuberculosis
cgcggguauccgugaccccg

SEQ ID NO: 2831363 - RNA, 22 nt, Mycobacterium avium subsp. paratuberculosis
cgcggguauccgugaccccgga

SEQ ID NO: 2831364 - RNA, 18 nt, Mycobacterium avium subsp. paratuberculosis
cgcgggucagcgucgcca

SEQ ID NO: 2831365 - RNA, 12 nt, Mycobacterium avium subsp. paratuberculosis
cgcggguccugc

SEQ ID NO: 2831366 - RNA, 18 nt, Mycobacterium avium subsp. paratuberculosis
cgcggguccugcaaccgc

SEQ ID NO: 2831367 - RNA, 15 nt, Mycobacterium avium subsp. paratuberculosis
cgcgggucgagcagc

SEQ ID NO: 2831368 - RNA, 17 nt, Mycobacterium avium subsp. paratuberculosis
cgcgggucgagcagcag

SEQ ID NO: 2831369 - RNA, 23 nt, Mycobacterium avium subsp. paratuberculosis
cgcgggucgagcagcagccgccg

SEQ ID NO: 2831370 - RNA, 14 nt, Mycobacterium avium subsp. paratuberculosis
cgcgggucgccggg

SEQ ID NO: 2831371 - RNA, 18 nt, Mycobacterium avium subsp. paratuberculosis
cgcgggucgccgggcagg

SEQ ID NO: 2831372 - RNA, 13 nt, Mycobacterium avium subsp. paratuberculosis
cgcgggucgcggc

SEQ ID NO: 2831373 - RNA, 14 nt, Mycobacterium avium subsp. paratuberculosis
cgcgggucgcggcc

SEQ ID NO: 2831374 - RNA, 14 nt, Mycobacterium avium subsp. paratuberculosis
cgcgggucgcgguu

SEQ ID NO: 2831375 - RNA, 17 nt, Mycobacterium avium subsp. paratuberculosis
cgcgggucgcuggccgc

SEQ ID NO: 2831376 - RNA, 14 nt, Mycobacterium avium subsp. paratuberculosis
cgcgggucggcgac

SEQ ID NO: 2831377 - RNA, 17 nt, Mycobacterium avium subsp. paratuberculosis
cgcgggucggcgacggc

SEQ ID NO: 2831378 - RNA, 18 nt, Mycobacterium avium subsp. paratuberculosis
cgcggucgcaggccgccc

SEQ ID NO: 2831379 - RNA, 21 nt, Mycobacterium avium subsp. paratuberculosis
cgcggucgcaggccgcccggc

SEQ ID NO: 2831380 - RNA, 15 nt, Mycobacterium avium subsp. paratuberculosis
cgcggucgcaggcga

SEQ ID NO: 2831381 - RNA, 19 nt, Mycobacterium avium subsp. paratuberculosis
cgcggucgcaggcgagccg

SEQ ID NO: 2831382 - RNA, 15 nt, Mycobacterium avium subsp. paratuberculosis
cgcggucgccaccac

SEQ ID NO: 2831383 - RNA, 19 nt, Mycobacterium avium subsp. paratuberculosis
cgcggucgccaccaccagc

SEQ ID NO: 2831384 - RNA, 21 nt, Mycobacterium avium subsp. paratuberculosis
cgcggucgccaccaccagcgg

SEQ ID NO: 2831385 - RNA, 22 nt, Mycobacterium avium subsp. paratuberculosis
cgcggucgccaccaccagcggg

SEQ ID NO: 2831386 - RNA, 18 nt, Mycobacterium avium subsp. paratuberculosis
cgcggucgccccggccgc

SEQ ID NO: 2831387 - RNA, 20 nt, Mycobacterium avium subsp. paratuberculosis
cgcggucgccccggccgcgg

SEQ ID NO: 2831388 - RNA, 14 nt, Mycobacterium avium subsp. paratuberculosis
cgcggucgccgccc

SEQ ID NO: 2831389 - RNA, 18 nt, Mycobacterium avium subsp. paratuberculosis
cgcggucgccgcccacgc

SEQ ID NO: 2831390 - RNA, 16 nt, Mycobacterium avium subsp. paratuberculosis
cgcggucgcggcgccg

SEQ ID NO: 2831391 - RNA, 17 nt, Mycobacterium avium subsp. paratuberculosis
cgcggucgcggcgccgg

SEQ ID NO: 2831392 - RNA, 13 nt, Mycobacterium avium subsp. paratuberculosis
cgcggucgcugac

SEQ ID NO: 2831393 - RNA, 14 nt, Mycobacterium avium subsp. paratuberculosis
cgcggucggcgccc

SEQ ID NO: 2831394 - RNA, 17 nt, Mycobacterium avium subsp. paratuberculosis
cgcggucggcgcccggc

SEQ ID NO: 2831395 - RNA, 23 nt, Mycobacterium avium subsp. paratuberculosis
cgcggucggcgcccggcccagcc

SEQ ID NO: 2831396 - RNA, 12 nt, Mycobacterium avium subsp. paratuberculosis
cgcggucggcgg

SEQ ID NO: 2831397 - RNA, 14 nt, Mycobacterium avium subsp. paratuberculosis
cgcggucggcggcg

SEQ ID NO: 2831398 - RNA, 15 nt, Mycobacterium avium subsp. paratuberculosis
cgcggucggcgucgc

SEQ ID NO: 2831399 - RNA, 13 nt, Mycobacterium avium subsp. paratuberculosis
cgcggucggggaa

SEQ ID NO: 2831400 - RNA, 12 nt, Mycobacterium avium subsp. paratuberculosis
cgcggucggguc

SEQ ID NO: 2831401 - RNA, 17 nt, Mycobacterium avium subsp. paratuberculosis
cgcggucgggucccggc

SEQ ID NO: 2831402 - RNA, 19 nt, Mycobacterium avium subsp. paratuberculosis
cgcggucgggucccggcaa

SEQ ID NO: 2831403 - RNA, 12 nt, Mycobacterium avium subsp. paratuberculosis
cgcggucggugg

SEQ ID NO: 2831404 - RNA, 23 nt, Mycobacterium avium subsp. paratuberculosis
cgcggucgguggcggugccgcgg

SEQ ID NO: 2831405 - RNA, 16 nt, Mycobacterium avium subsp. paratuberculosis
cgcggucgucgcccgu

SEQ ID NO: 2831406 - RNA, 17 nt, Mycobacterium avium subsp. paratuberculosis
cgcggucgucgcccguc

SEQ ID NO: 2831407 - RNA, 23 nt, Mycobacterium avium subsp. paratuberculosis
cgcggucgucgcccgucucggcg

SEQ ID NO: 2831408 - RNA, 16 nt, Mycobacterium avium subsp. paratuberculosis
cgcggucgucgucguc

SEQ ID NO: 2831409 - RNA, 18 nt, Mycobacterium avium subsp. paratuberculosis
cgcggucgucgucgucgg

SEQ ID NO: 2831410 - RNA, 23 nt, Mycobacterium avium subsp. paratuberculosis
cgcggucgucgucgucggugaug

SEQ ID NO: 2831411 - RNA, 18 nt, Mycobacterium avium subsp. paratuberculosis
cgcggucgucuucuuggc

SEQ ID NO: 2831412 - RNA, 13 nt, Mycobacterium avium subsp. paratuberculosis
cgcggucucgacc

SEQ ID NO: 2831413 - RNA, 20 nt, Mycobacterium avium subsp. paratuberculosis
cgcggucucgaucugcacca

SEQ ID NO: 2831414 - RNA, 21 nt, Mycobacterium avium subsp. paratuberculosis
cgcggucucgaucugcaccag

SEQ ID NO: 2831415 - RNA, 14 nt, Mycobacterium avium subsp. paratuberculosis
cgcggucugcgcca

SEQ ID NO: 2831416 - RNA, 16 nt, Mycobacterium avium subsp. paratuberculosis
cgcggucugcgccagc

SEQ ID NO: 2831417 - RNA, 16 nt, Mycobacterium avium subsp. paratuberculosis
cgcggucugcggugcg

SEQ ID NO: 2831418 - RNA, 16 nt, Mycobacterium avium subsp. paratuberculosis
cgcggucuucgaacau

SEQ ID NO: 2831419 - RNA, 19 nt, Mycobacterium avium subsp. paratuberculosis
cgcggugaaguugccgccg

SEQ ID NO: 2831420 - RNA, 20 nt, Mycobacterium avium subsp. paratuberculosis
cgcggugaaguugccgccgc

SEQ ID NO: 2831421 - RNA, 23 nt, Mycobacterium avium subsp. paratuberculosis
cgcggugacaugcccgggcucgc

SEQ ID NO: 2831422 - RNA, 12 nt, Mycobacterium avium subsp. paratuberculosis
cgcggugaccgc

SEQ ID NO: 2831423 - RNA, 19 nt, Mycobacterium avium subsp. paratuberculosis
cgcggugaccgcccgcucg

SEQ ID NO: 2831424 - RNA, 21 nt, Mycobacterium avium subsp. paratuberculosis
cgcggugaccgcccgcucgac

SEQ ID NO: 2831425 - RNA, 16 nt, Mycobacterium avium subsp. paratuberculosis
cgcggugaccgccgcc

SEQ ID NO: 2831426 - RNA, 18 nt, Mycobacterium avium subsp. paratuberculosis
cgcggugaccgccgccau

SEQ ID NO: 2831427 - RNA, 21 nt, Mycobacterium avium subsp. paratuberculosis
cgcggugaccgccgccauccg

SEQ ID NO: 2831428 - RNA, 22 nt, Mycobacterium avium subsp. paratuberculosis
cgcggugaccgccgccauccgc

SEQ ID NO: 2831429 - RNA, 13 nt, Mycobacterium avium subsp. paratuberculosis
cgcggugaccgcg

SEQ ID NO: 2831430 - RNA, 20 nt, Mycobacterium avium subsp. paratuberculosis
cgcggugaccgcgccgcggg

SEQ ID NO: 2831431 - RNA, 21 nt, Mycobacterium avium subsp. paratuberculosis
cgcggugaccgcgccgcgggu

SEQ ID NO: 2831432 - RNA, 15 nt, Mycobacterium avium subsp. paratuberculosis
cgcggugacgcgccg

SEQ ID NO: 2831433 - RNA, 16 nt, Mycobacterium avium subsp. paratuberculosis
cgcggugacgcgccgg

SEQ ID NO: 2831434 - RNA, 17 nt, Mycobacterium avium subsp. paratuberculosis
cgcggugacgcgccggc

SEQ ID NO: 2831435 - RNA, 14 nt, Mycobacterium avium subsp. paratuberculosis
cgcggugacgguga

SEQ ID NO: 2831436 - RNA, 19 nt, Mycobacterium avium subsp. paratuberculosis
cgcggugagcaccggaucg

SEQ ID NO: 2831437 - RNA, 22 nt, Mycobacterium avium subsp. paratuberculosis
cgcggugagcagcaugccgagc

SEQ ID NO: 2831438 - RNA, 23 nt, Mycobacterium avium subsp. paratuberculosis
cgcggugagcagcaugccgagca

SEQ ID NO: 2831439 - RNA, 13 nt, Mycobacterium avium subsp. paratuberculosis
cgcggugagcgcg

SEQ ID NO: 2831440 - RNA, 22 nt, Mycobacterium avium subsp. paratuberculosis
cgcggugagcgcgccggcccga

SEQ ID NO: 2831441 - RNA, 17 nt, Mycobacterium avium subsp. paratuberculosis
cgcggugagcggccgca

SEQ ID NO: 2831442 - RNA, 16 nt, Mycobacterium avium subsp. paratuberculosis
cgcggugagcgugccg

SEQ ID NO: 2831443 - RNA, 21 nt, Mycobacterium avium subsp. paratuberculosis
cgcggugaguucaucgacguc

SEQ ID NO: 2831444 - RNA, 14 nt, Mycobacterium avium subsp. paratuberculosis
cgcggugauccaga

SEQ ID NO: 2831445 - RNA, 14 nt, Mycobacterium avium subsp. paratuberculosis
cgcggugaugaccu

SEQ ID NO: 2831446 - RNA, 15 nt, Mycobacterium avium subsp. paratuberculosis
cgcggugaugaccuc

SEQ ID NO: 2831447 - RNA, 17 nt, Mycobacterium avium subsp. paratuberculosis
cgcggugaugccgaguu

SEQ ID NO: 2831448 - RNA, 21 nt, Mycobacterium avium subsp. paratuberculosis
cgcggugauguugucgaacag

SEQ ID NO: 2831449 - RNA, 20 nt, Mycobacterium avium subsp. paratuberculosis
cgcggugcaacgccgccgac

SEQ ID NO: 2831450 - RNA, 13 nt, Mycobacterium avium subsp. paratuberculosis
cgcggugcaccag

SEQ ID NO: 2831451 - RNA, 14 nt, Mycobacterium avium subsp. paratuberculosis
cgcggugcaccagg

SEQ ID NO: 2831452 - RNA, 22 nt, Mycobacterium avium subsp. paratuberculosis
cgcggugcacggucagcucgcg

SEQ ID NO: 2831453 - RNA, 21 nt, Mycobacterium avium subsp. paratuberculosis
cgcggugcagucggucgguca

SEQ ID NO: 2831454 - RNA, 13 nt, Mycobacterium avium subsp. paratuberculosis
cgcggugcccagc

SEQ ID NO: 2831455 - RNA, 14 nt, Mycobacterium avium subsp. paratuberculosis
cgcggugcccagcc

SEQ ID NO: 2831456 - RNA, 18 nt, Mycobacterium avium subsp. paratuberculosis
cgcggugcccagccaggc

SEQ ID NO: 2831457 - RNA, 15 nt, Mycobacterium avium subsp. paratuberculosis
cgcggugcccagccg

SEQ ID NO: 2831458 - RNA, 16 nt, Mycobacterium avium subsp. paratuberculosis
cgcggugcccagccgc

SEQ ID NO: 2831459 - RNA, 18 nt, Mycobacterium avium subsp. paratuberculosis
cgcggugcccagccgcag

SEQ ID NO: 2831460 - RNA, 21 nt, Mycobacterium avium subsp. paratuberculosis
cgcggugcccagccgcaggug

SEQ ID NO: 2831461 - RNA, 13 nt, Mycobacterium avium subsp. paratuberculosis
cgcggugcccgga

SEQ ID NO: 2831462 - RNA, 17 nt, Mycobacterium avium subsp. paratuberculosis
cgcggugcccggaacgg

SEQ ID NO: 2831463 - RNA, 21 nt, Mycobacterium avium subsp. paratuberculosis
cgcggugugggcggacugccc

SEQ ID NO: 2831464 - RNA, 18 nt, Mycobacterium avium subsp. paratuberculosis
cgcgguguuggcggcguc

SEQ ID NO: 2831465 - RNA, 16 nt, Mycobacterium avium subsp. paratuberculosis
cgcgguguuuggccgc

SEQ ID NO: 2831466 - RNA, 20 nt, Mycobacterium avium subsp. paratuberculosis
cgcgguguuuggccgcgcag

SEQ ID NO: 2831467 - RNA, 15 nt, Mycobacterium avium subsp. paratuberculosis
cgcgguuccggcgug

SEQ ID NO: 2831468 - RNA, 20 nt, Mycobacterium avium subsp. paratuberculosis
cgcgguuccggcgugcagca

SEQ ID NO: 2831469 - RNA, 14 nt, Mycobacterium avium subsp. paratuberculosis
cgcgguucgaggug

SEQ ID NO: 2831470 - RNA, 20 nt, Mycobacterium avium subsp. paratuberculosis
cgcgguucgaggugcucgcg

SEQ ID NO: 2831471 - RNA, 21 nt, Mycobacterium avium subsp. paratuberculosis
cgcgguucgaggugcucgcgc

SEQ ID NO: 2831472 - RNA, 15 nt, Mycobacterium avium subsp. paratuberculosis
cgcgguucgaucucc

SEQ ID NO: 2831473 - RNA, 21 nt, Mycobacterium avium subsp. paratuberculosis
cgcgguucgaucuccucggcg

SEQ ID NO: 2831474 - RNA, 22 nt, Mycobacterium avium subsp. paratuberculosis
cgcgguucgaucuccucggcgu

SEQ ID NO: 2831475 - RNA, 14 nt, Mycobacterium avium subsp. paratuberculosis
cgcgguucggcguc

SEQ ID NO: 2831476 - RNA, 15 nt, Mycobacterium avium subsp. paratuberculosis
cgcgguucggcgucg

SEQ ID NO: 2831477 - RNA, 16 nt, Mycobacterium avium subsp. paratuberculosis
cgcgguucggcgucgg

SEQ ID NO: 2831478 - RNA, 20 nt, Mycobacterium avium subsp. paratuberculosis
cgcgguucggcgucggucca

SEQ ID NO: 2831479 - RNA, 21 nt, Mycobacterium avium subsp. paratuberculosis
cgcgguucuugcgccaucccc

SEQ ID NO: 2831480 - RNA, 18 nt, Mycobacterium avium subsp. paratuberculosis
cgcgguucuuguccucga

SEQ ID NO: 2831481 - RNA, 14 nt, Mycobacterium avium subsp. paratuberculosis
cgcgguugaccgcc

SEQ ID NO: 2831482 - RNA, 17 nt, Mycobacterium avium subsp. paratuberculosis
cgcgguugaccgccgac

SEQ ID NO: 2831483 - RNA, 23 nt, Mycobacterium avium subsp. paratuberculosis
cgcgguugaccgccgacaccacc

SEQ ID NO: 2831484 - RNA, 12 nt, Mycobacterium avium subsp. paratuberculosis
cgcgguugacgu

SEQ ID NO: 2831485 - RNA, 16 nt, Mycobacterium avium subsp. paratuberculosis
cgcgguugaucacacc

SEQ ID NO: 2831486 - RNA, 14 nt, Mycobacterium avium subsp. paratuberculosis
cgcgguugaugauc

SEQ ID NO: 2831487 - RNA, 15 nt, Mycobacterium avium subsp. paratuberculosis
cgcgguugcccgcac

SEQ ID NO: 2831488 - RNA, 15 nt, Mycobacterium avium subsp. paratuberculosis
cgcgguugcccucgg

SEQ ID NO: 2831489 - RNA, 19 nt, Mycobacterium avium subsp. paratuberculosis
cgcgguugcccucggucaa

SEQ ID NO: 2831490 - RNA, 19 nt, Mycobacterium avium subsp. paratuberculosis
cgcgguugcggguggcggc

SEQ ID NO: 2831491 - RNA, 21 nt, Mycobacterium avium subsp. paratuberculosis
cgcgguugcggguggcggccg

SEQ ID NO: 2831492 - RNA, 23 nt, Mycobacterium avium subsp. paratuberculosis
cgcgguugcggguggcggccggg

SEQ ID NO: 2831493 - RNA, 16 nt, Mycobacterium avium subsp. paratuberculosis
cgcgguugggccgccg

SEQ ID NO: 2831494 - RNA, 21 nt, Mycobacterium avium subsp. paratuberculosis
cgcgguugggccgccggccgc

SEQ ID NO: 2831495 - RNA, 17 nt, Mycobacterium avium subsp. paratuberculosis
cgcgguugggccggcgc

SEQ ID NO: 2831496 - RNA, 15 nt, Mycobacterium avium subsp. paratuberculosis
cgcgguuggucacca

SEQ ID NO: 2831497 - RNA, 18 nt, Mycobacterium avium subsp. paratuberculosis
cgcgguuggucaccaggu

SEQ ID NO: 2831498 - RNA, 20 nt, Mycobacterium avium subsp. paratuberculosis
cgcgguuggucaccaggucg

SEQ ID NO: 2831499 - RNA, 21 nt, Mycobacterium avium subsp. paratuberculosis
cgcgguuucaccgugcgcgcg

SEQ ID NO: 2831500 - RNA, 22 nt, Mycobacterium avium subsp. paratuberculosis
cgcgguuucaccgugcgcgcgc

SEQ ID NO: 2831501 - RNA, 20 nt, Mycobacterium avium subsp. paratuberculosis
cgcgguuuccggcgauucga

SEQ ID NO: 2831502 - RNA, 19 nt, Mycobacterium avium subsp. paratuberculosis
cgcgguuuggucagcgccc

SEQ ID NO: 2831503 - RNA, 19 nt, Mycobacterium avium subsp. paratuberculosis
cgcgguuuugaugccgccg

SEQ ID NO: 2831504 - RNA, 20 nt, Mycobacterium avium subsp. paratuberculosis
cgcguaaaggaugucgccgc

SEQ ID NO: 2831505 - RNA, 19 nt, Mycobacterium avium subsp. paratuberculosis
cgcguaaccggcggcggug

SEQ ID NO: 2831506 - RNA, 15 nt, Mycobacterium avium subsp. paratuberculosis
cgcguacaccggcug

SEQ ID NO: 2831507 - RNA, 18 nt, Mycobacterium avium subsp. paratuberculosis
cgcguacaccggcugacc

SEQ ID NO: 2831508 - RNA, 20 nt, Mycobacterium avium subsp. paratuberculosis
cgcguacaccggcugaccgg

SEQ ID NO: 2831509 - RNA, 21 nt, Mycobacterium avium subsp. paratuberculosis
cgcguacaccggcugaccggc

SEQ ID NO: 2831510 - RNA, 15 nt, Mycobacterium avium subsp. paratuberculosis
cgcguacacgaugcc

SEQ ID NO: 2831511 - RNA, 17 nt, Mycobacterium avium subsp. paratuberculosis
cgcguacacggcccgcg

SEQ ID NO: 2831512 - RNA, 13 nt, Mycobacterium avium subsp. paratuberculosis
cgcguacagcagc

SEQ ID NO: 2831513 - RNA, 17 nt, Mycobacterium avium subsp. paratuberculosis
cgcguacagcagcugcc

SEQ ID NO: 2831514 - RNA, 16 nt, Mycobacterium avium subsp. paratuberculosis
cgcguacagccagccc

SEQ ID NO: 2831515 - RNA, 18 nt, Mycobacterium avium subsp. paratuberculosis
cgcguacagccagcccgu

SEQ ID NO: 2831516 - RNA, 19 nt, Mycobacterium avium subsp. paratuberculosis
cgcguacagccagcccgug

SEQ ID NO: 2831517 - RNA, 17 nt, Mycobacterium avium subsp. paratuberculosis
cgcguacagcgcccgga

SEQ ID NO: 2831518 - RNA, 21 nt, Mycobacterium avium subsp. paratuberculosis
cgcguacagcgcccggauguc

SEQ ID NO: 2831519 - RNA, 13 nt, Mycobacterium avium subsp. paratuberculosis
cgcguacagcggg

SEQ ID NO: 2831520 - RNA, 16 nt, Mycobacterium avium subsp. paratuberculosis
cgcguacagcgggucg

SEQ ID NO: 2831521 - RNA, 17 nt, Mycobacterium avium subsp. paratuberculosis
cgcguacagggcgucgg

SEQ ID NO: 2831522 - RNA, 20 nt, Mycobacterium avium subsp. paratuberculosis
cgcguacagggcgucggaca

SEQ ID NO: 2831523 - RNA, 14 nt, Mycobacterium avium subsp. paratuberculosis
cgcguaccagcgcc

SEQ ID NO: 2831524 - RNA, 12 nt, Mycobacterium avium subsp. paratuberculosis
cgcguacccgcg

SEQ ID NO: 2831525 - RNA, 16 nt, Mycobacterium avium subsp. paratuberculosis
cgcguacccgcgcggc

SEQ ID NO: 2831526 - RNA, 21 nt, Mycobacterium avium subsp. paratuberculosis
cgcguacccgcgcggcgucgg

SEQ ID NO: 2831527 - RNA, 21 nt, Mycobacterium avium subsp. paratuberculosis
cgcguacgaccguagccgguc

SEQ ID NO: 2831528 - RNA, 14 nt, Mycobacterium avium subsp. paratuberculosis
cgcguacgccgccu

SEQ ID NO: 2831529 - RNA, 20 nt, Mycobacterium avium subsp. paratuberculosis
cgcguacgggaugaucagca

SEQ ID NO: 2831530 - RNA, 16 nt, Mycobacterium avium subsp. paratuberculosis
cgcguacuccgacaga

SEQ ID NO: 2831531 - RNA, 16 nt, Mycobacterium avium subsp. paratuberculosis
cgcguagaaccagugc

SEQ ID NO: 2831532 - RNA, 21 nt, Mycobacterium avium subsp. paratuberculosis
cgcguagaucaucuggcuggu

SEQ ID NO: 2831533 - RNA, 15 nt, Mycobacterium avium subsp. paratuberculosis
cgcguagccgaccaa

SEQ ID NO: 2831534 - RNA, 15 nt, Mycobacterium avium subsp. paratuberculosis
cgcguagcgcagcuc

SEQ ID NO: 2831535 - RNA, 15 nt, Mycobacterium avium subsp. paratuberculosis
cgcguagcgccgccc

SEQ ID NO: 2831536 - RNA, 13 nt, Mycobacterium avium subsp. paratuberculosis
cgcguagcgccgg

SEQ ID NO: 2831537 - RNA, 23 nt, Mycobacterium avium subsp. paratuberculosis
cgcguagcgccgguaggccgcgc

SEQ ID NO: 2831538 - RNA, 18 nt, Mycobacterium avium subsp. paratuberculosis
cgcguagcucgccgcggc

SEQ ID NO: 2831539 - RNA, 22 nt, Mycobacterium avium subsp. paratuberculosis
cgcguaggccuugcugagccgg

SEQ ID NO: 2831540 - RNA, 23 nt, Mycobacterium avium subsp. paratuberculosis
cgcguagggcagggucgcggagc

SEQ ID NO: 2831541 - RNA, 16 nt, Mycobacterium avium subsp. paratuberculosis
cgcguaggugcggucg

SEQ ID NO: 2831542 - RNA, 18 nt, Mycobacterium avium subsp. paratuberculosis
cgcguaguccagcacggc

SEQ ID NO: 2831543 - RNA, 13 nt, Mycobacterium avium subsp. paratuberculosis
cgcguagucggcg

SEQ ID NO: 2831544 - RNA, 15 nt, Mycobacterium avium subsp. paratuberculosis
cgcguagucggcguc

SEQ ID NO: 2831545 - RNA, 16 nt, Mycobacterium avium subsp. paratuberculosis
cgcguagucggcgucg

SEQ ID NO: 2831546 - RNA, 17 nt, Mycobacterium avium subsp. paratuberculosis
cgcguagucggcgucgg

SEQ ID NO: 2831547 - RNA, 23 nt, Mycobacterium avium subsp. paratuberculosis
cgcgucgagcagcaccacccgca

SEQ ID NO: 2831548 - RNA, 16 nt, Mycobacterium avium subsp. paratuberculosis
cgcgucgagcgugggc

SEQ ID NO: 2831549 - RNA, 17 nt, Mycobacterium avium subsp. paratuberculosis
cgcgucgagcgugggcc

SEQ ID NO: 2831550 - RNA, 13 nt, Mycobacterium avium subsp. paratuberculosis
cgcgucgaggucg

SEQ ID NO: 2831551 - RNA, 17 nt, Mycobacterium avium subsp. paratuberculosis
cgcgucgaggucgcgca

SEQ ID NO: 2831552 - RNA, 22 nt, Mycobacterium avium subsp. paratuberculosis
cgcgucgaggucgcgcagcacc

SEQ ID NO: 2831553 - RNA, 17 nt, Mycobacterium avium subsp. paratuberculosis
cgcgucgaugccggcga

SEQ ID NO: 2831554 - RNA, 16 nt, Mycobacterium avium subsp. paratuberculosis
cgcgucgaugcgggcc

SEQ ID NO: 2831555 - RNA, 19 nt, Mycobacterium avium subsp. paratuberculosis
cgcgucgaugcgggcccgc

SEQ ID NO: 2831556 - RNA, 20 nt, Mycobacterium avium subsp. paratuberculosis
cgcgucgaugcgggcccgca

SEQ ID NO: 2831557 - RNA, 16 nt, Mycobacterium avium subsp. paratuberculosis
cgcgucgcacagcgcc

SEQ ID NO: 2831558 - RNA, 21 nt, Mycobacterium avium subsp. paratuberculosis
cgcgucgcacagcgccgcguu

SEQ ID NO: 2831559 - RNA, 14 nt, Mycobacterium avium subsp. paratuberculosis
cgcgucgcccacgc

SEQ ID NO: 2831560 - RNA, 14 nt, Mycobacterium avium subsp. paratuberculosis
cgcgucgccgacca

SEQ ID NO: 2831561 - RNA, 16 nt, Mycobacterium avium subsp. paratuberculosis
cgcgucgccgaccagc

SEQ ID NO: 2831562 - RNA, 20 nt, Mycobacterium avium subsp. paratuberculosis
cgcgucgccgccgggcgcca

SEQ ID NO: 2831563 - RNA, 12 nt, Mycobacterium avium subsp. paratuberculosis
cgcgucgccgug

SEQ ID NO: 2831564 - RNA, 23 nt, Mycobacterium avium subsp. paratuberculosis
cgcgucgccgugccggaccgcgc

SEQ ID NO: 2831565 - RNA, 19 nt, Mycobacterium avium subsp. paratuberculosis
cgcgucgcgcagcgaagcg

SEQ ID NO: 2831566 - RNA, 11 nt, Mycobacterium avium subsp. paratuberculosis
cgcgucgcgcc

SEQ ID NO: 2831567 - RNA, 17 nt, Mycobacterium avium subsp. paratuberculosis
cgcgucgcgccagcggu

SEQ ID NO: 2831568 - RNA, 20 nt, Mycobacterium avium subsp. paratuberculosis
cgcgucgcgccagcggucca

SEQ ID NO: 2831569 - RNA, 20 nt, Mycobacterium avium subsp. paratuberculosis
cgcgucgcgcccggcgucgg

SEQ ID NO: 2831570 - RNA, 13 nt, Mycobacterium avium subsp. paratuberculosis
cgcgucgcgccgc

SEQ ID NO: 2831571 - RNA, 19 nt, Mycobacterium avium subsp. paratuberculosis
cgcgucgcgccgccgcguc

SEQ ID NO: 2831572 - RNA, 15 nt, Mycobacterium avium subsp. paratuberculosis
cgcgucgcggcgcgg

SEQ ID NO: 2831573 - RNA, 17 nt, Mycobacterium avium subsp. paratuberculosis
cgcgucgcggcgcggac

SEQ ID NO: 2831574 - RNA, 14 nt, Mycobacterium avium subsp. paratuberculosis
cgcgucgcgggccc

SEQ ID NO: 2831575 - RNA, 16 nt, Mycobacterium avium subsp. paratuberculosis
cgcgucgcgggcccgg

SEQ ID NO: 2831576 - RNA, 17 nt, Mycobacterium avium subsp. paratuberculosis
cgcgucgcgggcccggg

SEQ ID NO: 2831577 - RNA, 22 nt, Mycobacterium avium subsp. paratuberculosis
cgcgucgcgguggagcacagca

SEQ ID NO: 2831578 - RNA, 12 nt, Mycobacterium avium subsp. paratuberculosis
cgcgucgcgugg

SEQ ID NO: 2831579 - RNA, 13 nt, Mycobacterium avium subsp. paratuberculosis
cgcgucgcguggc

SEQ ID NO: 2831580 - RNA, 18 nt, Mycobacterium avium subsp. paratuberculosis
cgcgucggagaucaccgg

SEQ ID NO: 2831581 - RNA, 19 nt, Mycobacterium avium subsp. paratuberculosis
cgcgucggagaucaccggc

SEQ ID NO: 2831582 - RNA, 20 nt, Mycobacterium avium subsp. paratuberculosis
cgcgucggagaucaccggca

SEQ ID NO: 2831583 - RNA, 21 nt, Mycobacterium avium subsp. paratuberculosis
cgcgucggagaucaccggcac

SEQ ID NO: 2831584 - RNA, 14 nt, Mycobacterium avium subsp. paratuberculosis
cgcgucggaggcca

SEQ ID NO: 2831585 - RNA, 13 nt, Mycobacterium avium subsp. paratuberculosis
cgcgucggccagc

SEQ ID NO: 2831586 - RNA, 20 nt, Mycobacterium avium subsp. paratuberculosis
cgcgucggccagcaccacca

SEQ ID NO: 2831587 - RNA, 22 nt, Mycobacterium avium subsp. paratuberculosis
cgcgucggccagcaccaccaac

SEQ ID NO: 2831588 - RNA, 14 nt, Mycobacterium avium subsp. paratuberculosis
cgcgucggccagcg

SEQ ID NO: 2831589 - RNA, 21 nt, Mycobacterium avium subsp. paratuberculosis
cgcgucggccagcgcgcgggc

SEQ ID NO: 2831590 - RNA, 15 nt, Mycobacterium avium subsp. paratuberculosis
cgcgucggcccagac

SEQ ID NO: 2831591 - RNA, 20 nt, Mycobacterium avium subsp. paratuberculosis
cgcgucggcccagacgaugu

SEQ ID NO: 2831592 - RNA, 16 nt, Mycobacterium avium subsp. paratuberculosis
cgcgucggcccccagc

SEQ ID NO: 2831593 - RNA, 15 nt, Mycobacterium avium subsp. paratuberculosis
cgcgucggcgaccgc

SEQ ID NO: 2831594 - RNA, 14 nt, Mycobacterium avium subsp. paratuberculosis
cgcgucggcgaugu

SEQ ID NO: 2831595 - RNA, 14 nt, Mycobacterium avium subsp. paratuberculosis
cgcgucggcgccgg

SEQ ID NO: 2831596 - RNA, 13 nt, Mycobacterium avium subsp. paratuberculosis
cgcgucggcgcug

SEQ ID NO: 2831597 - RNA, 14 nt, Mycobacterium avium subsp. paratuberculosis
cgcgucggcgcugg

SEQ ID NO: 2831598 - RNA, 15 nt, Mycobacterium avium subsp. paratuberculosis
cgcgucggcgcuggc

SEQ ID NO: 2831599 - RNA, 17 nt, Mycobacterium avium subsp. paratuberculosis
cgcgucggcgcuggcca

SEQ ID NO: 2831600 - RNA, 13 nt, Mycobacterium avium subsp. paratuberculosis
cgcgucggcggcg

SEQ ID NO: 2831601 - RNA, 13 nt, Mycobacterium avium subsp. paratuberculosis
cgcgucggcgguc

SEQ ID NO: 2831602 - RNA, 17 nt, Mycobacterium avium subsp. paratuberculosis
cgcgucggcggucgcca

SEQ ID NO: 2831603 - RNA, 13 nt, Mycobacterium avium subsp. paratuberculosis
cgcgucggcgucu

SEQ ID NO: 2831604 - RNA, 12 nt, Mycobacterium avium subsp. paratuberculosis
cgcgucgggcag

SEQ ID NO: 2831605 - RNA, 14 nt, Mycobacterium avium subsp. paratuberculosis
cgcgucgggcaggu

SEQ ID NO: 2831606 - RNA, 14 nt, Mycobacterium avium subsp. paratuberculosis
cgcgucgggcucgc

SEQ ID NO: 2831607 - RNA, 20 nt, Mycobacterium avium subsp. paratuberculosis
cgcgucgggcucgcggucgg

SEQ ID NO: 2831608 - RNA, 16 nt, Mycobacterium avium subsp. paratuberculosis
cgcgucgggcucggcc

SEQ ID NO: 2831609 - RNA, 17 nt, Mycobacterium avium subsp. paratuberculosis
cgcgucgggcucggccg

SEQ ID NO: 2831610 - RNA, 19 nt, Mycobacterium avium subsp. paratuberculosis
cgcgucgggcucggccgcc

SEQ ID NO: 2831611 - RNA, 21 nt, Mycobacterium avium subsp. paratuberculosis
cgcgucgggcucggccgccga

SEQ ID NO: 2831612 - RNA, 20 nt, Mycobacterium avium subsp. paratuberculosis
cgcgucgguaaucggcggug

SEQ ID NO: 2831613 - RNA, 21 nt, Mycobacterium avium subsp. paratuberculosis
cgcgucgguaaucggcggugg

SEQ ID NO: 2831614 - RNA, 23 nt, Mycobacterium avium subsp. paratuberculosis
cgcgucgguaggugucgaugaac

SEQ ID NO: 2831615 - RNA, 16 nt, Mycobacterium avium subsp. paratuberculosis
cgcgucggucagcgcc

SEQ ID NO: 2831616 - RNA, 15 nt, Mycobacterium avium subsp. paratuberculosis
cgcgucggucagcgg

SEQ ID NO: 2831617 - RNA, 17 nt, Mycobacterium avium subsp. paratuberculosis
cgcgucggucagcggcg

SEQ ID NO: 2831618 - RNA, 11 nt, Mycobacterium avium subsp. paratuberculosis
cgcgucggugu

SEQ ID NO: 2831619 - RNA, 12 nt, Mycobacterium avium subsp. paratuberculosis
cgcgucgguguc

SEQ ID NO: 2831620 - RNA, 17 nt, Mycobacterium avium subsp. paratuberculosis
cgcgucguacaccucgg

SEQ ID NO: 2831621 - RNA, 14 nt, Mycobacterium avium subsp. paratuberculosis
cgcgucguagccgg

SEQ ID NO: 2831622 - RNA, 17 nt, Mycobacterium avium subsp. paratuberculosis
cgcgucguagccggcac

SEQ ID NO: 2831623 - RNA, 13 nt, Mycobacterium avium subsp. paratuberculosis
cgcgucgucaucg

SEQ ID NO: 2831624 - RNA, 22 nt, Mycobacterium avium subsp. paratuberculosis
cgcgucguccgacaccaccugc

SEQ ID NO: 2831625 - RNA, 19 nt, Mycobacterium avium subsp. paratuberculosis
cgcgucguccucuucgcgg

SEQ ID NO: 2831626 - RNA, 22 nt, Mycobacterium avium subsp. paratuberculosis
cgcgucgucgauggccaccagg

SEQ ID NO: 2831627 - RNA, 12 nt, Mycobacterium avium subsp. paratuberculosis
cgcgucgucgcc

SEQ ID NO: 2831628 - RNA, 14 nt, Mycobacterium avium subsp. paratuberculosis
cgcgucgucgccga

SEQ ID NO: 2831629 - RNA, 22 nt, Mycobacterium avium subsp. paratuberculosis
cgcgucgucggcgggcugcagc

SEQ ID NO: 2831630 - RNA, 19 nt, Mycobacterium avium subsp. paratuberculosis
cgcgucgucggucaggccg

SEQ ID NO: 2831631 - RNA, 22 nt, Mycobacterium avium subsp. paratuberculosis
cgcgucgucggucaggccggcg

SEQ ID NO: 2831632 - RNA, 15 nt, Mycobacterium avium subsp. paratuberculosis
cgcguuccgccacgg

SEQ ID NO: 2831633 - RNA, 16 nt, Mycobacterium avium subsp. paratuberculosis
cgcguuccgccacggc

SEQ ID NO: 2831634 - RNA, 18 nt, Mycobacterium avium subsp. paratuberculosis
cgcguuccgccacggcgg

SEQ ID NO: 2831635 - RNA, 19 nt, Mycobacterium avium subsp. paratuberculosis
cgcguuccgccacggcggg

SEQ ID NO: 2831636 - RNA, 21 nt, Mycobacterium avium subsp. paratuberculosis
cgcguucgaccuccacgagcc

SEQ ID NO: 2831637 - RNA, 22 nt, Mycobacterium avium subsp. paratuberculosis
cgcguucgaccuccacgagccg

SEQ ID NO: 2831638 - RNA, 22 nt, Mycobacterium avium subsp. paratuberculosis
cgcguucggacaccucggccag

SEQ ID NO: 2831639 - RNA, 14 nt, Mycobacterium avium subsp. paratuberculosis
cgcguucggcgcca

SEQ ID NO: 2831640 - RNA, 17 nt, Mycobacterium avium subsp. paratuberculosis
cgcguucggcgccaccc

SEQ ID NO: 2831641 - RNA, 21 nt, Mycobacterium avium subsp. paratuberculosis
cgcguucggcgccaccccggg

SEQ ID NO: 2831642 - RNA, 16 nt, Mycobacterium avium subsp. paratuberculosis
cgcguucgggcagcgc

SEQ ID NO: 2831643 - RNA, 17 nt, Mycobacterium avium subsp. paratuberculosis
cgcguucgggcagcgcc

SEQ ID NO: 2831644 - RNA, 16 nt, Mycobacterium avium subsp. paratuberculosis
cgcguucgggcccggc

SEQ ID NO: 2831645 - RNA, 23 nt, Mycobacterium avium subsp. paratuberculosis
cgcguucgggcccggccgccagc

SEQ ID NO: 2831646 - RNA, 17 nt, Mycobacterium avium subsp. paratuberculosis
cgcguucuccaccgcgc

SEQ ID NO: 2831647 - RNA, 21 nt, Mycobacterium avium subsp. paratuberculosis
cgcguucuccaccgcgcgcgg

SEQ ID NO: 2831648 - RNA, 16 nt, Mycobacterium avium subsp. paratuberculosis
cgcguucuccucgaac

SEQ ID NO: 2831649 - RNA, 14 nt, Mycobacterium avium subsp. paratuberculosis
cgcguucucggcgg

SEQ ID NO: 2831650 - RNA, 13 nt, Mycobacterium avium subsp. paratuberculosis
cgcguucugcacc

SEQ ID NO: 2831651 - RNA, 14 nt, Mycobacterium avium subsp. paratuberculosis
cgcguucugcacca

SEQ ID NO: 2831652 - RNA, 15 nt, Mycobacterium avium subsp. paratuberculosis
cgcguucugcaccag

SEQ ID NO: 2831653 - RNA, 16 nt, Mycobacterium avium subsp. paratuberculosis
cgcguucugcaccagc

SEQ ID NO: 2831654 - RNA, 19 nt, Mycobacterium avium subsp. paratuberculosis
cgcguucugcaccagcucg

SEQ ID NO: 2831655 - RNA, 17 nt, Mycobacterium avium subsp. paratuberculosis
cgcguugaaagccgcga

SEQ ID NO: 2831656 - RNA, 18 nt, Mycobacterium avium subsp. paratuberculosis
cgcguugaaagccgcgaa

SEQ ID NO: 2831657 - RNA, 19 nt, Mycobacterium avium subsp. paratuberculosis
cgcguugaaaguccuugcu

SEQ ID NO: 2831658 - RNA, 20 nt, Mycobacterium avium subsp. paratuberculosis
cgcguugaacgacaucacca

SEQ ID NO: 2831659 - RNA, 22 nt, Mycobacterium avium subsp. paratuberculosis
cgcguugaacgacaucaccacc

SEQ ID NO: 2831660 - RNA, 19 nt, Mycobacterium avium subsp. paratuberculosis
cgcguugaccagaccgaag

SEQ ID NO: 2831661 - RNA, 15 nt, Mycobacterium avium subsp. paratuberculosis
cgcguugagcgucgc

SEQ ID NO: 2831662 - RNA, 20 nt, Mycobacterium avium subsp. paratuberculosis
cgcguugagcgucgccacca

SEQ ID NO: 2831663 - RNA, 20 nt, Mycobacterium avium subsp. paratuberculosis
cgcguugaguggugaaucgc

SEQ ID NO: 2831664 - RNA, 16 nt, Mycobacterium avium subsp. paratuberculosis
cgcguugaucagcgcc

SEQ ID NO: 2831665 - RNA, 17 nt, Mycobacterium avium subsp. paratuberculosis
cgcguugaugccgugcg

SEQ ID NO: 2831666 - RNA, 17 nt, Mycobacterium avium subsp. paratuberculosis
cgcguugcagcgccgcg

SEQ ID NO: 2831667 - RNA, 19 nt, Mycobacterium avium subsp. paratuberculosis
cgcguugcagcgccgcggc

SEQ ID NO: 2831668 - RNA, 13 nt, Mycobacterium avium subsp. paratuberculosis
cgcguugcgcgga

SEQ ID NO: 2831669 - RNA, 15 nt, Mycobacterium avium subsp. paratuberculosis
cgcguugcgcggacc

SEQ ID NO: 2831670 - RNA, 16 nt, Mycobacterium avium subsp. paratuberculosis
cgcguugcgcggaccg

SEQ ID NO: 2831671 - RNA, 19 nt, Mycobacterium avium subsp. paratuberculosis
cgcguugcgcggaccggcg

SEQ ID NO: 2831672 - RNA, 17 nt, Mycobacterium avium subsp. paratuberculosis
cgcguugcggaucucga

SEQ ID NO: 2831673 - RNA, 23 nt, Mycobacterium avium subsp. paratuberculosis
cgcguugcggaucucgaccucgu

SEQ ID NO: 2831674 - RNA, 15 nt, Mycobacterium avium subsp. paratuberculosis
cgcguugcggccguc

SEQ ID NO: 2831675 - RNA, 21 nt, Mycobacterium avium subsp. paratuberculosis
cgcguugcggccguccagcgu

SEQ ID NO: 2831676 - RNA, 15 nt, Mycobacterium avium subsp. paratuberculosis
cgcguuggccagcgc

SEQ ID NO: 2831677 - RNA, 16 nt, Mycobacterium avium subsp. paratuberculosis
cgcguuggccagguug

SEQ ID NO: 2831678 - RNA, 19 nt, Mycobacterium avium subsp. paratuberculosis
cgcguuggccgaggggucc

SEQ ID NO: 2831679 - RNA, 16 nt, Mycobacterium avium subsp. paratuberculosis
cgcguuguccagcagc

SEQ ID NO: 2831680 - RNA, 21 nt, Mycobacterium avium subsp. paratuberculosis
cgcguuguccagcagcgccgg

SEQ ID NO: 2831681 - RNA, 18 nt, Mycobacterium avium subsp. paratuberculosis
cgcguugucgaccaccag

SEQ ID NO: 2831682 - RNA, 21 nt, Mycobacterium avium subsp. paratuberculosis
cgcguugucgaccaccaggug

SEQ ID NO: 2831683 - RNA, 15 nt, Mycobacterium avium subsp. paratuberculosis
cgcguugucggcgac

SEQ ID NO: 2831684 - RNA, 16 nt, Mycobacterium avium subsp. paratuberculosis
cgcguugucggcgacg

SEQ ID NO: 2831685 - RNA, 17 nt, Mycobacterium avium subsp. paratuberculosis
cgcguugucggcgacgg

SEQ ID NO: 2831686 - RNA, 15 nt, Mycobacterium avium subsp. paratuberculosis
cgcguugucggcguc

SEQ ID NO: 2831687 - RNA, 15 nt, Mycobacterium avium subsp. paratuberculosis
cgcguuguugcucgg

SEQ ID NO: 2831688 - RNA, 21 nt, Mycobacterium avium subsp. paratuberculosis
cgcguuuugaaauccgggcgc

SEQ ID NO: 2831689 - RNA, 14 nt, Mycobacterium avium subsp. paratuberculosis
cgcuaaagccacca

SEQ ID NO: 2831690 - RNA, 19 nt, Mycobacterium avium subsp. paratuberculosis
cgcuaaagccgaccgcccc

SEQ ID NO: 2831691 - RNA, 20 nt, Mycobacterium avium subsp. paratuberculosis
cgcuaaagccgaccgccccg

SEQ ID NO: 2831692 - RNA, 15 nt, Mycobacterium avium subsp. paratuberculosis
cgcuaacaaaagccc

SEQ ID NO: 2831693 - RNA, 18 nt, Mycobacterium avium subsp. paratuberculosis
cgcuaacggcgcggcagu

SEQ ID NO: 2831694 - RNA, 22 nt, Mycobacterium avium subsp. paratuberculosis
cgcuaacucacggcgcgaucca

SEQ ID NO: 2831695 - RNA, 21 nt, Mycobacterium avium subsp. paratuberculosis
cgcuaaggccgcugcccggcg

SEQ ID NO: 2831696 - RNA, 22 nt, Mycobacterium avium subsp. paratuberculosis
cgcuaaggccgcugcccggcgc

SEQ ID NO: 2831697 - RNA, 17 nt, Mycobacterium avium subsp. paratuberculosis
cgcuaaucgccgcgcgu

SEQ ID NO: 2831698 - RNA, 20 nt, Mycobacterium avium subsp. paratuberculosis
cgcuacccggcgaaccggga

SEQ ID NO: 2831699 - RNA, 20 nt, Mycobacterium avium subsp. paratuberculosis
cgcuaccgcgcucaccgucg

SEQ ID NO: 2831700 - RNA, 16 nt, Mycobacterium avium subsp. paratuberculosis
cgcuaccucaccacgu

SEQ ID NO: 2831701 - RNA, 22 nt, Mycobacterium avium subsp. paratuberculosis
cgcuacgccgaggcgcaggagg

SEQ ID NO: 2831702 - RNA, 21 nt, Mycobacterium avium subsp. paratuberculosis
cgcuacgcgagcugcuucguc

SEQ ID NO: 2831703 - RNA, 14 nt, Mycobacterium avium subsp. paratuberculosis
cgcuacugccgcug

SEQ ID NO: 2831704 - RNA, 19 nt, Mycobacterium avium subsp. paratuberculosis
cgcuagaccgauggcggcg

SEQ ID NO: 2831705 - RNA, 13 nt, Mycobacterium avium subsp. paratuberculosis
cgcuagcgugacg

SEQ ID NO: 2831706 - RNA, 18 nt, Mycobacterium avium subsp. paratuberculosis
cgcuaggacgcgggccug

SEQ ID NO: 2831707 - RNA, 21 nt, Mycobacterium avium subsp. paratuberculosis
cgcuagguuuggccagcaccg

SEQ ID NO: 2831708 - RNA, 23 nt, Mycobacterium avium subsp. paratuberculosis
cgcuagguuuggccagcaccgcg

SEQ ID NO: 2831709 - RNA, 17 nt, Mycobacterium avium subsp. paratuberculosis
cgcuaguuggugcuggg

SEQ ID NO: 2831710 - RNA, 22 nt, Mycobacterium avium subsp. paratuberculosis
cgcuaguuggugcugggcaccc

SEQ ID NO: 2831711 - RNA, 17 nt, Mycobacterium avium subsp. paratuberculosis
cgcuauaucgcaccggc

SEQ ID NO: 2831712 - RNA, 18 nt, Mycobacterium avium subsp. paratuberculosis
cgcuauaucgcaccggcg

SEQ ID NO: 2831713 - RNA, 17 nt, Mycobacterium avium subsp. paratuberculosis
cgcucaacccgggccgg

SEQ ID NO: 2831714 - RNA, 15 nt, Mycobacterium avium subsp. paratuberculosis
cgcucaacccgucgc

SEQ ID NO: 2831715 - RNA, 19 nt, Mycobacterium avium subsp. paratuberculosis
cgcucaacccgucgcgggu

SEQ ID NO: 2831716 - RNA, 14 nt, Mycobacterium avium subsp. paratuberculosis
cgcuccuccucgcg

SEQ ID NO: 2831717 - RNA, 19 nt, Mycobacterium avium subsp. paratuberculosis
cgcuccuccucgcgccgcc

SEQ ID NO: 2831718 - RNA, 12 nt, Mycobacterium avium subsp. paratuberculosis
cgcuccucguug

SEQ ID NO: 2831719 - RNA, 19 nt, Mycobacterium avium subsp. paratuberculosis
cgcuccugcagcgcggcga

SEQ ID NO: 2831720 - RNA, 22 nt, Mycobacterium avium subsp. paratuberculosis
cgcuccugcagcgcggcgauca

SEQ ID NO: 2831721 - RNA, 15 nt, Mycobacterium avium subsp. paratuberculosis
cgcuccugcaggccg

SEQ ID NO: 2831722 - RNA, 16 nt, Mycobacterium avium subsp. paratuberculosis
cgcuccugcaggccga

SEQ ID NO: 2831723 - RNA, 21 nt, Mycobacterium avium subsp. paratuberculosis
cgcuccugcaggccgagccgc

SEQ ID NO: 2831724 - RNA, 12 nt, Mycobacterium avium subsp. paratuberculosis
cgcucgaccccu

SEQ ID NO: 2831725 - RNA, 13 nt, Mycobacterium avium subsp. paratuberculosis
cgcucgaccccuc

SEQ ID NO: 2831726 - RNA, 16 nt, Mycobacterium avium subsp. paratuberculosis
cgcucgaccccucggc

SEQ ID NO: 2831727 - RNA, 15 nt, Mycobacterium avium subsp. paratuberculosis
cgcucgaccucggcg

SEQ ID NO: 2831728 - RNA, 16 nt, Mycobacterium avium subsp. paratuberculosis
cgcucgaccucggcgg

SEQ ID NO: 2831729 - RNA, 17 nt, Mycobacterium avium subsp. paratuberculosis
cgcucgaccucggcggc

SEQ ID NO: 2831730 - RNA, 15 nt, Mycobacterium avium subsp. paratuberculosis
cgcucgacgaggcgg

SEQ ID NO: 2831731 - RNA, 19 nt, Mycobacterium avium subsp. paratuberculosis
cgcucgacgaggcgggcga

SEQ ID NO: 2831732 - RNA, 19 nt, Mycobacterium avium subsp. paratuberculosis
cgcucgacgcgcacccggg

SEQ ID NO: 2831733 - RNA, 13 nt, Mycobacterium avium subsp. paratuberculosis
cgcucgacggccg

SEQ ID NO: 2831734 - RNA, 15 nt, Mycobacterium avium subsp. paratuberculosis
cgcucgacggccggc

SEQ ID NO: 2831735 - RNA, 16 nt, Mycobacterium avium subsp. paratuberculosis
cgcucgacggccggcg

SEQ ID NO: 2831736 - RNA, 18 nt, Mycobacterium avium subsp. paratuberculosis
cgcucgacggccggcguc

SEQ ID NO: 2831737 - RNA, 21 nt, Mycobacterium avium subsp. paratuberculosis
cgcucgaggggcuuggcgacg

SEQ ID NO: 2831738 - RNA, 18 nt, Mycobacterium avium subsp. paratuberculosis
cgcucgauggcgccgauc

SEQ ID NO: 2831739 - RNA, 19 nt, Mycobacterium avium subsp. paratuberculosis
cgcucgauggcgccgaucg

SEQ ID NO: 2831740 - RNA, 22 nt, Mycobacterium avium subsp. paratuberculosis
cgcucgauggcgccgaucgcgc

SEQ ID NO: 2831741 - RNA, 17 nt, Mycobacterium avium subsp. paratuberculosis
cgcucgauggguguggc

SEQ ID NO: 2831742 - RNA, 20 nt, Mycobacterium avium subsp. paratuberculosis
cgcucgcacaacccgcccgg

SEQ ID NO: 2831743 - RNA, 13 nt, Mycobacterium avium subsp. paratuberculosis
cgcucgcaccagc

SEQ ID NO: 2831744 - RNA, 22 nt, Mycobacterium avium subsp. paratuberculosis
cgcucgccaccccgcgccacgc

SEQ ID NO: 2831745 - RNA, 14 nt, Mycobacterium avium subsp. paratuberculosis
cgcucgccagaccg

SEQ ID NO: 2831746 - RNA, 22 nt, Mycobacterium avium subsp. paratuberculosis
cgcucgccaugcgaccacgacc

SEQ ID NO: 2831747 - RNA, 23 nt, Mycobacterium avium subsp. paratuberculosis
cgcucgccaugcgaccacgaccg

SEQ ID NO: 2831748 - RNA, 17 nt, Mycobacterium avium subsp. paratuberculosis
cgcucgcccagcgcggc

SEQ ID NO: 2831749 - RNA, 21 nt, Mycobacterium avium subsp. paratuberculosis
cgcucgcccagcgcggcggcc

SEQ ID NO: 2831750 - RNA, 22 nt, Mycobacterium avium subsp. paratuberculosis
cgcucgcccagcgcggcggcca

SEQ ID NO: 2831751 - RNA, 21 nt, Mycobacterium avium subsp. paratuberculosis
cgcucgccgaaaugccgugcc

SEQ ID NO: 2831752 - RNA, 23 nt, Mycobacterium avium subsp. paratuberculosis
cgcucgccgaucuggcgcagcgu

SEQ ID NO: 2831753 - RNA, 12 nt, Mycobacterium avium subsp. paratuberculosis
cgcucgccgaug

SEQ ID NO: 2831754 - RNA, 14 nt, Mycobacterium avium subsp. paratuberculosis
cgcucgccgcgcgg

SEQ ID NO: 2831755 - RNA, 18 nt, Mycobacterium avium subsp. paratuberculosis
cgcucgccgcgcggcccg

SEQ ID NO: 2831756 - RNA, 19 nt, Mycobacterium avium subsp. paratuberculosis
cgcucgccgcgcggcccgc

SEQ ID NO: 2831757 - RNA, 14 nt, Mycobacterium avium subsp. paratuberculosis
cgcucgccgcgggu

SEQ ID NO: 2831758 - RNA, 13 nt, Mycobacterium avium subsp. paratuberculosis
cgcucgccggcgg

SEQ ID NO: 2831759 - RNA, 14 nt, Mycobacterium avium subsp. paratuberculosis
cgcucgccggcggc

SEQ ID NO: 2831760 - RNA, 18 nt, Mycobacterium avium subsp. paratuberculosis
cgcucgccggcggccgcc

SEQ ID NO: 2831761 - RNA, 21 nt, Mycobacterium avium subsp. paratuberculosis
cgcucgccggggacgacggcg

SEQ ID NO: 2831762 - RNA, 22 nt, Mycobacterium avium subsp. paratuberculosis
cgcucgccggggacgacggcgg

SEQ ID NO: 2831763 - RNA, 16 nt, Mycobacterium avium subsp. paratuberculosis
cgcucgccgucggcca

SEQ ID NO: 2831764 - RNA, 22 nt, Mycobacterium avium subsp. paratuberculosis
cgcucgccgucggccagcagcg

SEQ ID NO: 2831765 - RNA, 19 nt, Mycobacterium avium subsp. paratuberculosis
cgcucgccgucggugauga

SEQ ID NO: 2831766 - RNA, 16 nt, Mycobacterium avium subsp. paratuberculosis
cgcucgcgcaccggga

SEQ ID NO: 2831767 - RNA, 22 nt, Mycobacterium avium subsp. paratuberculosis
cgcucgcggauguccgaccggu

SEQ ID NO: 2831768 - RNA, 23 nt, Mycobacterium avium subsp. paratuberculosis
cgcucgcgggccacagcggcgac

SEQ ID NO: 2831769 - RNA, 13 nt, Mycobacterium avium subsp. paratuberculosis
cgcucgcgggccc

SEQ ID NO: 2831770 - RNA, 14 nt, Mycobacterium avium subsp. paratuberculosis
cgcucgcgggcccg

SEQ ID NO: 2831771 - RNA, 18 nt, Mycobacterium avium subsp. paratuberculosis
cgcucgcgggcccgcgcc

SEQ ID NO: 2831772 - RNA, 20 nt, Mycobacterium avium subsp. paratuberculosis
cgcucgcgggugcgcugcag

SEQ ID NO: 2831773 - RNA, 13 nt, Mycobacterium avium subsp. paratuberculosis
cgcucgcggugcg

SEQ ID NO: 2831774 - RNA, 21 nt, Mycobacterium avium subsp. paratuberculosis
cgcucgcggugcgcgcgcgcu

SEQ ID NO: 2831775 - RNA, 17 nt, Mycobacterium avium subsp. paratuberculosis
cgcucgcgguugggccg

SEQ ID NO: 2831776 - RNA, 21 nt, Mycobacterium avium subsp. paratuberculosis
cgcucgcgguugggccgccgg

SEQ ID NO: 2831777 - RNA, 20 nt, Mycobacterium avium subsp. paratuberculosis
cgcucgcgguugggccggcg

SEQ ID NO: 2831778 - RNA, 21 nt, Mycobacterium avium subsp. paratuberculosis
cgcucgcgguugggccggcgc

SEQ ID NO: 2831779 - RNA, 22 nt, Mycobacterium avium subsp. paratuberculosis
cgcucgcgguugggccggcgcc

SEQ ID NO: 2831780 - RNA, 17 nt, Mycobacterium avium subsp. paratuberculosis
cgcucgcguggccuggg

SEQ ID NO: 2831781 - RNA, 21 nt, Mycobacterium avium subsp. paratuberculosis
cgcucgcguggccugggcgac

SEQ ID NO: 2831782 - RNA, 16 nt, Mycobacterium avium subsp. paratuberculosis
cgcucgcuagcacacg

SEQ ID NO: 2831783 - RNA, 20 nt, Mycobacterium avium subsp. paratuberculosis
cgcucgcuauaucgcaccgg

SEQ ID NO: 2831784 - RNA, 22 nt, Mycobacterium avium subsp. paratuberculosis
cgcucggaaugaacugccgcgg

SEQ ID NO: 2831785 - RNA, 20 nt, Mycobacterium avium subsp. paratuberculosis
cgcucggauucccgcucggg

SEQ ID NO: 2831786 - RNA, 16 nt, Mycobacterium avium subsp. paratuberculosis
cgcucggccagcagca

SEQ ID NO: 2831787 - RNA, 16 nt, Mycobacterium avium subsp. paratuberculosis
cgcucggccagcagug

SEQ ID NO: 2831788 - RNA, 19 nt, Mycobacterium avium subsp. paratuberculosis
cgcucggccagcagugcca

SEQ ID NO: 2831789 - RNA, 14 nt, Mycobacterium avium subsp. paratuberculosis
cgcucggccagcgc

SEQ ID NO: 2831790 - RNA, 15 nt, Mycobacterium avium subsp. paratuberculosis
cgcucggccagcgca

SEQ ID NO: 2831791 - RNA, 20 nt, Mycobacterium avium subsp. paratuberculosis
cgcucggccagcgcagcgac

SEQ ID NO: 2831792 - RNA, 17 nt, Mycobacterium avium subsp. paratuberculosis
cgcucggccagcgcgcc

SEQ ID NO: 2831793 - RNA, 18 nt, Mycobacterium avium subsp. paratuberculosis
cgcucggccagcgcgccg

SEQ ID NO: 2831794 - RNA, 20 nt, Mycobacterium avium subsp. paratuberculosis
cgcucggccagcgcgccgca

SEQ ID NO: 2831795 - RNA, 21 nt, Mycobacterium avium subsp. paratuberculosis
cgcucggccagcgcgccgcac

SEQ ID NO: 2831796 - RNA, 16 nt, Mycobacterium avium subsp. paratuberculosis
cgcucggccaggguga

SEQ ID NO: 2831797 - RNA, 19 nt, Mycobacterium avium subsp. paratuberculosis
cgcucggccauccgggcgg

SEQ ID NO: 2831798 - RNA, 21 nt, Mycobacterium avium subsp. paratuberculosis
cgcucggccauccgggcggca

SEQ ID NO: 2831799 - RNA, 13 nt, Mycobacterium avium subsp. paratuberculosis
cgcucggcccgcu

SEQ ID NO: 2831800 - RNA, 13 nt, Mycobacterium avium subsp. paratuberculosis
cgcucgucgucgg

SEQ ID NO: 2831801 - RNA, 19 nt, Mycobacterium avium subsp. paratuberculosis
cgcucuaacuccgcucggg

SEQ ID NO: 2831802 - RNA, 16 nt, Mycobacterium avium subsp. paratuberculosis
cgcucuguuggccguc

SEQ ID NO: 2831803 - RNA, 18 nt, Mycobacterium avium subsp. paratuberculosis
cgcucuguuggccgucgc

SEQ ID NO: 2831804 - RNA, 15 nt, Mycobacterium avium subsp. paratuberculosis
cgcucuucagcgcga

SEQ ID NO: 2831805 - RNA, 13 nt, Mycobacterium avium subsp. paratuberculosis
cgcucuucgacga

SEQ ID NO: 2831806 - RNA, 21 nt, Mycobacterium avium subsp. paratuberculosis
cgcucuucggucaucgugauc

SEQ ID NO: 2831807 - RNA, 16 nt, Mycobacterium avium subsp. paratuberculosis
cgcucuugggcggccg

SEQ ID NO: 2831808 - RNA, 15 nt, Mycobacterium avium subsp. paratuberculosis
cgcugaaagcucgcg

SEQ ID NO: 2831809 - RNA, 19 nt, Mycobacterium avium subsp. paratuberculosis
cgcugaaagcucgcgucga

SEQ ID NO: 2831810 - RNA, 20 nt, Mycobacterium avium subsp. paratuberculosis
cgcugaaagcucgcgucgac

SEQ ID NO: 2831811 - RNA, 13 nt, Mycobacterium avium subsp. paratuberculosis
cgcugaaauccgg

SEQ ID NO: 2831812 - RNA, 16 nt, Mycobacterium avium subsp. paratuberculosis
cgcugaacagcagcag

SEQ ID NO: 2831813 - RNA, 14 nt, Mycobacterium avium subsp. paratuberculosis
cgcugaacagcccg

SEQ ID NO: 2831814 - RNA, 17 nt, Mycobacterium avium subsp. paratuberculosis
cgcugaacagcccgagc

SEQ ID NO: 2831815 - RNA, 23 nt, Mycobacterium avium subsp. paratuberculosis
cgcugaacgcggugggcaccagc

SEQ ID NO: 2831816 - RNA, 15 nt, Mycobacterium avium subsp. paratuberculosis
cgcugaacgcgucgu

SEQ ID NO: 2831817 - RNA, 14 nt, Mycobacterium avium subsp. paratuberculosis
cgcugaacggugcc

SEQ ID NO: 2831818 - RNA, 18 nt, Mycobacterium avium subsp. paratuberculosis
cgcugaacggugccguca

SEQ ID NO: 2831819 - RNA, 19 nt, Mycobacterium avium subsp. paratuberculosis
cgcugaacggugccgucac

SEQ ID NO: 2831820 - RNA, 20 nt, Mycobacterium avium subsp. paratuberculosis
cgcugaacugcucgaccagc

SEQ ID NO: 2831821 - RNA, 23 nt, Mycobacterium avium subsp. paratuberculosis
cgcugaacugcucgaccagcgcc

SEQ ID NO: 2831822 - RNA, 15 nt, Mycobacterium avium subsp. paratuberculosis
cgcugaagaucgaaa

SEQ ID NO: 2831823 - RNA, 13 nt, Mycobacterium avium subsp. paratuberculosis
cgcugaagcccac

SEQ ID NO: 2831824 - RNA, 16 nt, Mycobacterium avium subsp. paratuberculosis
cgcugaagcccaccgc

SEQ ID NO: 2831825 - RNA, 17 nt, Mycobacterium avium subsp. paratuberculosis
cgcugaagcccaccgcc

SEQ ID NO: 2831826 - RNA, 18 nt, Mycobacterium avium subsp. paratuberculosis
cgcugaagcccaccgccg

SEQ ID NO: 2831827 - RNA, 14 nt, Mycobacterium avium subsp. paratuberculosis
cgcugaagccgcug

SEQ ID NO: 2831828 - RNA, 17 nt, Mycobacterium avium subsp. paratuberculosis
cgcugaagccgcuggaa

SEQ ID NO: 2831829 - RNA, 16 nt, Mycobacterium avium subsp. paratuberculosis
cgcugaagcgcgaccc

SEQ ID NO: 2831830 - RNA, 12 nt, Mycobacterium avium subsp. paratuberculosis
cgcugaccaccg

SEQ ID NO: 2831831 - RNA, 21 nt, Mycobacterium avium subsp. paratuberculosis
cgcugaccagcgugaccucga

SEQ ID NO: 2831832 - RNA, 13 nt, Mycobacterium avium subsp. paratuberculosis
cgcugaccaggcc

SEQ ID NO: 2831833 - RNA, 15 nt, Mycobacterium avium subsp. paratuberculosis
cgcugaccaggccga

SEQ ID NO: 2831834 - RNA, 21 nt, Mycobacterium avium subsp. paratuberculosis
cgcugaccaggccguccacca

SEQ ID NO: 2831835 - RNA, 23 nt, Mycobacterium avium subsp. paratuberculosis
cgcugaccaggccguccaccaga

SEQ ID NO: 2831836 - RNA, 16 nt, Mycobacterium avium subsp. paratuberculosis
cgcugaccccgcucgg

SEQ ID NO: 2831837 - RNA, 18 nt, Mycobacterium avium subsp. paratuberculosis
cgcugaccccgcucggcg

SEQ ID NO: 2831838 - RNA, 13 nt, Mycobacterium avium subsp. paratuberculosis
cgcugacccgccg

SEQ ID NO: 2831839 - RNA, 23 nt, Mycobacterium avium subsp. paratuberculosis
cgcugacccgggcggccugcugc

SEQ ID NO: 2831840 - RNA, 17 nt, Mycobacterium avium subsp. paratuberculosis
cgcugaccgcaggaaag

SEQ ID NO: 2831841 - RNA, 13 nt, Mycobacterium avium subsp. paratuberculosis
cgcugaccgccau

SEQ ID NO: 2831842 - RNA, 16 nt, Mycobacterium avium subsp. paratuberculosis
cgcugaccgccgcgcu

SEQ ID NO: 2831843 - RNA, 20 nt, Mycobacterium avium subsp. paratuberculosis
cgcugaccgccgcgcucggc

SEQ ID NO: 2831844 - RNA, 21 nt, Mycobacterium avium subsp. paratuberculosis
cgcugaccgccgcgcucggcc

SEQ ID NO: 2831845 - RNA, 22 nt, Mycobacterium avium subsp. paratuberculosis
cgcugaccucgacacgggccgc

SEQ ID NO: 2831846 - RNA, 18 nt, Mycobacterium avium subsp. paratuberculosis
cgcugacgaugauccugg

SEQ ID NO: 2831847 - RNA, 20 nt, Mycobacterium avium subsp. paratuberculosis
cgcugacgaugcggccggcg

SEQ ID NO: 2831848 - RNA, 23 nt, Mycobacterium avium subsp. paratuberculosis
cgcugacgaugcggccggcgggc

SEQ ID NO: 2831849 - RNA, 15 nt, Mycobacterium avium subsp. paratuberculosis
cgcugacgccgagca

SEQ ID NO: 2831850 - RNA, 16 nt, Mycobacterium avium subsp. paratuberculosis
cgcugacggucgccga

SEQ ID NO: 2831851 - RNA, 18 nt, Mycobacterium avium subsp. paratuberculosis
cgcugacggucgccgacu

SEQ ID NO: 2831852 - RNA, 14 nt, Mycobacterium avium subsp. paratuberculosis
cgcugacgucgaug

SEQ ID NO: 2831853 - RNA, 19 nt, Mycobacterium avium subsp. paratuberculosis
cgcugacgucgaugccggc

SEQ ID NO: 2831854 - RNA, 21 nt, Mycobacterium avium subsp. paratuberculosis
cgcugacgucgaugccggcca

SEQ ID NO: 2831855 - RNA, 20 nt, Mycobacterium avium subsp. paratuberculosis
cgcugacuccaucccgugcg

SEQ ID NO: 2831856 - RNA, 20 nt, Mycobacterium avium subsp. paratuberculosis
cgcugacugcgaucgccgac

SEQ ID NO: 2831857 - RNA, 17 nt, Mycobacterium avium subsp. paratuberculosis
cgcugagcaaccgccga

SEQ ID NO: 2831858 - RNA, 18 nt, Mycobacterium avium subsp. paratuberculosis
cgcugagcaaccgccgaa

SEQ ID NO: 2831859 - RNA, 19 nt, Mycobacterium avium subsp. paratuberculosis
cgcugagcaauucggugac

SEQ ID NO: 2831860 - RNA, 20 nt, Mycobacterium avium subsp. paratuberculosis
cgcugagcaauucggugacg

SEQ ID NO: 2831861 - RNA, 14 nt, Mycobacterium avium subsp. paratuberculosis
cgcugagcacccgc

SEQ ID NO: 2831862 - RNA, 17 nt, Mycobacterium avium subsp. paratuberculosis
cgcugagcacccgcccg

SEQ ID NO: 2831863 - RNA, 18 nt, Mycobacterium avium subsp. paratuberculosis
cgcugagcacccgcccgg

SEQ ID NO: 2831864 - RNA, 22 nt, Mycobacterium avium subsp. paratuberculosis
cgcugagcacggugggcgccgg

SEQ ID NO: 2831865 - RNA, 18 nt, Mycobacterium avium subsp. paratuberculosis
cgcugagcagguccucga

SEQ ID NO: 2831866 - RNA, 22 nt, Mycobacterium avium subsp. paratuberculosis
cgcugagccgcucgucgagucc

SEQ ID NO: 2831867 - RNA, 16 nt, Mycobacterium avium subsp. paratuberculosis
cgcugagcgacauggu

SEQ ID NO: 2831868 - RNA, 14 nt, Mycobacterium avium subsp. paratuberculosis
cgcugagcgccagg

SEQ ID NO: 2831869 - RNA, 22 nt, Mycobacterium avium subsp. paratuberculosis
cgcugagcgggaagcugcuggc

SEQ ID NO: 2831870 - RNA, 15 nt, Mycobacterium avium subsp. paratuberculosis
cgcugagcgggacgc

SEQ ID NO: 2831871 - RNA, 23 nt, Mycobacterium avium subsp. paratuberculosis
cgcugagcggguaaccgcagccg

SEQ ID NO: 2831872 - RNA, 21 nt, Mycobacterium avium subsp. paratuberculosis
cgcugagcuucugcccggcca

SEQ ID NO: 2831873 - RNA, 17 nt, Mycobacterium avium subsp. paratuberculosis
cgcugaggaugguggug

SEQ ID NO: 2831874 - RNA, 18 nt, Mycobacterium avium subsp. paratuberculosis
cgcugaggaugguggugc

SEQ ID NO: 2831875 - RNA, 22 nt, Mycobacterium avium subsp. paratuberculosis
cgcugaggaugguggugcaggc

SEQ ID NO: 2831876 - RNA, 19 nt, Mycobacterium avium subsp. paratuberculosis
cgcugagguagucccgcgc

SEQ ID NO: 2831877 - RNA, 22 nt, Mycobacterium avium subsp. paratuberculosis
cgcugagguagucccgcgccug

SEQ ID NO: 2831878 - RNA, 22 nt, Mycobacterium avium subsp. paratuberculosis
cgcugagucuacuuggccagcu

SEQ ID NO: 2831879 - RNA, 23 nt, Mycobacterium avium subsp. paratuberculosis
cgcugaucagcucuucgauggcc

SEQ ID NO: 2831880 - RNA, 15 nt, Mycobacterium avium subsp. paratuberculosis
cgcugauccagcagc

SEQ ID NO: 2831881 - RNA, 18 nt, Mycobacterium avium subsp. paratuberculosis
cgcugauccagcagcgcc

SEQ ID NO: 2831882 - RNA, 22 nt, Mycobacterium avium subsp. paratuberculosis
cgcugauccagcagcgccucgg

SEQ ID NO: 2831883 - RNA, 23 nt, Mycobacterium avium subsp. paratuberculosis
cgcugauccagcagcgccucggc

SEQ ID NO: 2831884 - RNA, 20 nt, Mycobacterium avium subsp. paratuberculosis
cgcugccgagguacgcgcug

SEQ ID NO: 2831885 - RNA, 20 nt, Mycobacterium avium subsp. paratuberculosis
cgcugccgcccccgcuggcg

SEQ ID NO: 2831886 - RNA, 21 nt, Mycobacterium avium subsp. paratuberculosis
cgcugccgcccccgcuggcga

SEQ ID NO: 2831887 - RNA, 23 nt, Mycobacterium avium subsp. paratuberculosis
cgcugccgcccccgcuggcgaau

SEQ ID NO: 2831888 - RNA, 12 nt, Mycobacterium avium subsp. paratuberculosis
cgcugccgccgc

SEQ ID NO: 2831889 - RNA, 13 nt, Mycobacterium avium subsp. paratuberculosis
cgcugccgccgcc

SEQ ID NO: 2831890 - RNA, 14 nt, Mycobacterium avium subsp. paratuberculosis
cgcugccgccgccg

SEQ ID NO: 2831891 - RNA, 16 nt, Mycobacterium avium subsp. paratuberculosis
cgcugccgccgccggc

SEQ ID NO: 2831892 - RNA, 13 nt, Mycobacterium avium subsp. paratuberculosis
cgcugccgccggc

SEQ ID NO: 2831893 - RNA, 14 nt, Mycobacterium avium subsp. paratuberculosis
cgcugccgccggcc

SEQ ID NO: 2831894 - RNA, 17 nt, Mycobacterium avium subsp. paratuberculosis
cgcugccgccggccucg

SEQ ID NO: 2831895 - RNA, 14 nt, Mycobacterium avium subsp. paratuberculosis
cgcugccgcgcccc

SEQ ID NO: 2831896 - RNA, 21 nt, Mycobacterium avium subsp. paratuberculosis
cgcugccgcgccccgagcagc

SEQ ID NO: 2831897 - RNA, 14 nt, Mycobacterium avium subsp. paratuberculosis
cgcugccgcgccgc

SEQ ID NO: 2831898 - RNA, 20 nt, Mycobacterium avium subsp. paratuberculosis
cgcugccgcgccgccacacc

SEQ ID NO: 2831899 - RNA, 16 nt, Mycobacterium avium subsp. paratuberculosis
cgcugccgcgcgccga

SEQ ID NO: 2831900 - RNA, 14 nt, Mycobacterium avium subsp. paratuberculosis
cgcugccgcuggcg

SEQ ID NO: 2831901 - RNA, 16 nt, Mycobacterium avium subsp. paratuberculosis
cgcugccggaccucga

SEQ ID NO: 2831902 - RNA, 14 nt, Mycobacterium avium subsp. paratuberculosis
cgcugccggcccga

SEQ ID NO: 2831903 - RNA, 15 nt, Mycobacterium avium subsp. paratuberculosis
cgcugccggcccgau

SEQ ID NO: 2831904 - RNA, 13 nt, Mycobacterium avium subsp. paratuberculosis
cgcugccggccgg

SEQ ID NO: 2831905 - RNA, 14 nt, Mycobacterium avium subsp. paratuberculosis
cgcugccggccggg

SEQ ID NO: 2831906 - RNA, 15 nt, Mycobacterium avium subsp. paratuberculosis
cgcugccggccgggg

SEQ ID NO: 2831907 - RNA, 16 nt, Mycobacterium avium subsp. paratuberculosis
cgcugccggccggggc

SEQ ID NO: 2831908 - RNA, 17 nt, Mycobacterium avium subsp. paratuberculosis
cgcugccggccggggcg

SEQ ID NO: 2831909 - RNA, 23 nt, Mycobacterium avium subsp. paratuberculosis
cgcugccggccggggcggcggua

SEQ ID NO: 2831910 - RNA, 13 nt, Mycobacterium avium subsp. paratuberculosis
cgcugccggcgca

SEQ ID NO: 2831911 - RNA, 14 nt, Mycobacterium avium subsp. paratuberculosis
cgcugccggcgcac

SEQ ID NO: 2831912 - RNA, 17 nt, Mycobacterium avium subsp. paratuberculosis
cgcugccggcgcacccg

SEQ ID NO: 2831913 - RNA, 14 nt, Mycobacterium avium subsp. paratuberculosis
cgcugccggggcgc

SEQ ID NO: 2831914 - RNA, 15 nt, Mycobacterium avium subsp. paratuberculosis
cgcugccggggcgca

SEQ ID NO: 2831915 - RNA, 17 nt, Mycobacterium avium subsp. paratuberculosis
cgcugccggggcgcagc

SEQ ID NO: 2831916 - RNA, 13 nt, Mycobacterium avium subsp. paratuberculosis
cgcugccggggug

SEQ ID NO: 2831917 - RNA, 18 nt, Mycobacterium avium subsp. paratuberculosis
cgcugccggggugcagca

SEQ ID NO: 2831918 - RNA, 21 nt, Mycobacterium avium subsp. paratuberculosis
cgcugccggggugcagcacca

SEQ ID NO: 2831919 - RNA, 17 nt, Mycobacterium avium subsp. paratuberculosis
cgcugccgguggucccg

SEQ ID NO: 2831920 - RNA, 23 nt, Mycobacterium avium subsp. paratuberculosis
cgcugccgguggucccggucagc

SEQ ID NO: 2831921 - RNA, 14 nt, Mycobacterium avium subsp. paratuberculosis
cgcugccguagcgc

SEQ ID NO: 2831922 - RNA, 16 nt, Mycobacterium avium subsp. paratuberculosis
cgcugccguagcgcug

SEQ ID NO: 2831923 - RNA, 19 nt, Mycobacterium avium subsp. paratuberculosis
cgcugccguagcgcugggu

SEQ ID NO: 2831924 - RNA, 13 nt, Mycobacterium avium subsp. paratuberculosis
cgcugccguccac

SEQ ID NO: 2831925 - RNA, 20 nt, Mycobacterium avium subsp. paratuberculosis
cgcugccguccacccggccc

SEQ ID NO: 2831926 - RNA, 21 nt, Mycobacterium avium subsp. paratuberculosis
cgcugccguccacccggccca

SEQ ID NO: 2831927 - RNA, 14 nt, Mycobacterium avium subsp. paratuberculosis
cgcugccguccggc

SEQ ID NO: 2831928 - RNA, 17 nt, Mycobacterium avium subsp. paratuberculosis
cgcugccguccggcggc

SEQ ID NO: 2831929 - RNA, 18 nt, Mycobacterium avium subsp. paratuberculosis
cgcugccguucgccggua

SEQ ID NO: 2831930 - RNA, 15 nt, Mycobacterium avium subsp. paratuberculosis
cgcugcgacaggucg

SEQ ID NO: 2831931 - RNA, 19 nt, Mycobacterium avium subsp. paratuberculosis
cgcugcgacaggucggcgg

SEQ ID NO: 2831932 - RNA, 22 nt, Mycobacterium avium subsp. paratuberculosis
cgcugcgacaggucggcggucg

SEQ ID NO: 2831933 - RNA, 23 nt, Mycobacterium avium subsp. paratuberculosis
cgcugcgacaggucggcggucgc

SEQ ID NO: 2831934 - RNA, 13 nt, Mycobacterium avium subsp. paratuberculosis
cgcugcgaugaug

SEQ ID NO: 2831935 - RNA, 13 nt, Mycobacterium avium subsp. paratuberculosis
cgcugcgcacccg

SEQ ID NO: 2831936 - RNA, 15 nt, Mycobacterium avium subsp. paratuberculosis
cgcugcgcacccggu

SEQ ID NO: 2831937 - RNA, 16 nt, Mycobacterium avium subsp. paratuberculosis
cgcugcgcacccgguc

SEQ ID NO: 2831938 - RNA, 21 nt, Mycobacterium avium subsp. paratuberculosis
cgcugcgcacccgguccggcu

SEQ ID NO: 2831939 - RNA, 23 nt, Mycobacterium avium subsp. paratuberculosis
cgcugcgcacccgguccggcugg

SEQ ID NO: 2831940 - RNA, 14 nt, Mycobacterium avium subsp. paratuberculosis
cgcugcgccagccg

SEQ ID NO: 2831941 - RNA, 15 nt, Mycobacterium avium subsp. paratuberculosis
cgcugcgccagccgu

SEQ ID NO: 2831942 - RNA, 19 nt, Mycobacterium avium subsp. paratuberculosis
cgcugcgcccagcgcgcga

SEQ ID NO: 2831943 - RNA, 13 nt, Mycobacterium avium subsp. paratuberculosis
cgcugcgcccgcc

SEQ ID NO: 2831944 - RNA, 14 nt, Mycobacterium avium subsp. paratuberculosis
cgcugcgcccgccg

SEQ ID NO: 2831945 - RNA, 15 nt, Mycobacterium avium subsp. paratuberculosis
cgcugcgcccgccgc

SEQ ID NO: 2831946 - RNA, 17 nt, Mycobacterium avium subsp. paratuberculosis
cgcugcgcccgccgcca

SEQ ID NO: 2831947 - RNA, 18 nt, Mycobacterium avium subsp. paratuberculosis
cgcugcgcccgccgccac

SEQ ID NO: 2831948 - RNA, 22 nt, Mycobacterium avium subsp. paratuberculosis
cgcugcgccgaacgugcacuca

SEQ ID NO: 2831949 - RNA, 21 nt, Mycobacterium avium subsp. paratuberculosis
cgcugcgccgacuugaucgcg

SEQ ID NO: 2831950 - RNA, 18 nt, Mycobacterium avium subsp. paratuberculosis
cgcugcgccggcgcggcc

SEQ ID NO: 2831951 - RNA, 19 nt, Mycobacterium avium subsp. paratuberculosis
cgcugcgccggcgcggcca

SEQ ID NO: 2831952 - RNA, 16 nt, Mycobacterium avium subsp. paratuberculosis
cgcugcgccggcggua

SEQ ID NO: 2831953 - RNA, 12 nt, Mycobacterium avium subsp. paratuberculosis
cgcugcgccggg

SEQ ID NO: 2831954 - RNA, 13 nt, Mycobacterium avium subsp. paratuberculosis
cgcugcgccgggu

SEQ ID NO: 2831955 - RNA, 14 nt, Mycobacterium avium subsp. paratuberculosis
cgcugcgccgggug

SEQ ID NO: 2831956 - RNA, 14 nt, Mycobacterium avium subsp. paratuberculosis
cgcugcgcgacacc

SEQ ID NO: 2831957 - RNA, 21 nt, Mycobacterium avium subsp. paratuberculosis
cgcugcgcgacaccugcucac

SEQ ID NO: 2831958 - RNA, 13 nt, Mycobacterium avium subsp. paratuberculosis
cgcugcgcgccga

SEQ ID NO: 2831959 - RNA, 22 nt, Mycobacterium avium subsp. paratuberculosis
cgcugcgcgccgauccggcucc

SEQ ID NO: 2831960 - RNA, 13 nt, Mycobacterium avium subsp. paratuberculosis
cgcugcgcgccgc

SEQ ID NO: 2831961 - RNA, 14 nt, Mycobacterium avium subsp. paratuberculosis
cgcugcgcgccgcc

SEQ ID NO: 2831962 - RNA, 16 nt, Mycobacterium avium subsp. paratuberculosis
cgcugcgcgcgcgauc

SEQ ID NO: 2831963 - RNA, 17 nt, Mycobacterium avium subsp. paratuberculosis
cgcugcgcgcgcgaucg

SEQ ID NO: 2831964 - RNA, 21 nt, Mycobacterium avium subsp. paratuberculosis
cgcugcgcgcgcgaucggugu

SEQ ID NO: 2831965 - RNA, 16 nt, Mycobacterium avium subsp. paratuberculosis
cgcugcgcgcguuguc

SEQ ID NO: 2831966 - RNA, 23 nt, Mycobacterium avium subsp. paratuberculosis
cgcugcgcgcguuguccagcagc

SEQ ID NO: 2831967 - RNA, 12 nt, Mycobacterium avium subsp. paratuberculosis
cgcugcgcgggu

SEQ ID NO: 2831968 - RNA, 17 nt, Mycobacterium avium subsp. paratuberculosis
cgcugcgcgggucggcg

SEQ ID NO: 2831969 - RNA, 13 nt, Mycobacterium avium subsp. paratuberculosis
cgcuggcgguguc

SEQ ID NO: 2831970 - RNA, 14 nt, Mycobacterium avium subsp. paratuberculosis
cgcuggcguagauc

SEQ ID NO: 2831971 - RNA, 17 nt, Mycobacterium avium subsp. paratuberculosis
cgcuggcguccaggucg

SEQ ID NO: 2831972 - RNA, 17 nt, Mycobacterium avium subsp. paratuberculosis
cgcuggcgucgaucgcg

SEQ ID NO: 2831973 - RNA, 13 nt, Mycobacterium avium subsp. paratuberculosis
cgcuggcgugacg

SEQ ID NO: 2831974 - RNA, 16 nt, Mycobacterium avium subsp. paratuberculosis
cgcuggcgugacgcuc

SEQ ID NO: 2831975 - RNA, 17 nt, Mycobacterium avium subsp. paratuberculosis
cgcuggcgugacgcucg

SEQ ID NO: 2831976 - RNA, 19 nt, Mycobacterium avium subsp. paratuberculosis
cgcuggcgugacgcucgag

SEQ ID NO: 2831977 - RNA, 23 nt, Mycobacterium avium subsp. paratuberculosis
cgcuggcgugacgcucgaggccc

SEQ ID NO: 2831978 - RNA, 20 nt, Mycobacterium avium subsp. paratuberculosis
cgcuggcgugacgcucgccg

SEQ ID NO: 2831979 - RNA, 20 nt, Mycobacterium avium subsp. paratuberculosis
cgcuggcgugacgcucggcc

SEQ ID NO: 2831980 - RNA, 23 nt, Mycobacterium avium subsp. paratuberculosis
cgcuggcgugacgcucggcgccg

SEQ ID NO: 2831981 - RNA, 24 nt, Mycobacterium avium subsp. paratuberculosis
cgcuggcgugacgcucggcgccgc

SEQ ID NO: 2831982 - RNA, 19 nt, Mycobacterium avium subsp. paratuberculosis
cgcuggcgugacgcucggg

SEQ ID NO: 2831983 - RNA, 20 nt, Mycobacterium avium subsp. paratuberculosis
cgcuggcgugacgcucgggg

SEQ ID NO: 2831984 - RNA, 14 nt, Mycobacterium avium subsp. paratuberculosis
cgcuggcgugacgg

SEQ ID NO: 2831985 - RNA, 21 nt, Mycobacterium avium subsp. paratuberculosis
cgcuggcgugacggucgaccu

SEQ ID NO: 2831986 - RNA, 14 nt, Mycobacterium avium subsp. paratuberculosis
cgcuggcgugacgu

SEQ ID NO: 2831987 - RNA, 14 nt, Mycobacterium avium subsp. paratuberculosis
cgcuggcguggcac

SEQ ID NO: 2831988 - RNA, 18 nt, Mycobacterium avium subsp. paratuberculosis
cgcuggcguggcacccgg

SEQ ID NO: 2831989 - RNA, 22 nt, Mycobacterium avium subsp. paratuberculosis
cgcuggcguggcacccgggcgc

SEQ ID NO: 2831990 - RNA, 14 nt, Mycobacterium avium subsp. paratuberculosis
cgcuggcguggcgc

SEQ ID NO: 2831991 - RNA, 17 nt, Mycobacterium avium subsp. paratuberculosis
cgcuggcguggcgccgg

SEQ ID NO: 2831992 - RNA, 20 nt, Mycobacterium avium subsp. paratuberculosis
cgcuggcguggcgccggcgc

SEQ ID NO: 2831993 - RNA, 21 nt, Mycobacterium avium subsp. paratuberculosis
cgcuggcguggcgccggcgcg

SEQ ID NO: 2831994 - RNA, 15 nt, Mycobacterium avium subsp. paratuberculosis
cgcuggcguggcucg

SEQ ID NO: 2831995 - RNA, 21 nt, Mycobacterium avium subsp. paratuberculosis
cgcuggcguggcucggcccgc

SEQ ID NO: 2831996 - RNA, 18 nt, Mycobacterium avium subsp. paratuberculosis
cgcuggcguugagcacgc

SEQ ID NO: 2831997 - RNA, 19 nt, Mycobacterium avium subsp. paratuberculosis
cgcugggagcacgugauga

SEQ ID NO: 2831998 - RNA, 16 nt, Mycobacterium avium subsp. paratuberculosis
cgcugggagcgggcca

SEQ ID NO: 2831999 - RNA, 19 nt, Mycobacterium avium subsp. paratuberculosis
cgcugggagcgggccacgc

SEQ ID NO: 2832000 - RNA, 21 nt, Mycobacterium avium subsp. paratuberculosis
cgcugggagcgggccacgcag

SEQ ID NO: 2832001 - RNA, 17 nt, Mycobacterium avium subsp. paratuberculosis
cgcugggcagccguccc

SEQ ID NO: 2832002 - RNA, 13 nt, Mycobacterium avium subsp. paratuberculosis
cgcugggcgccgg

SEQ ID NO: 2832003 - RNA, 15 nt, Mycobacterium avium subsp. paratuberculosis
cgcugggcggcgaca

SEQ ID NO: 2832004 - RNA, 18 nt, Mycobacterium avium subsp. paratuberculosis
cgcugggcggcgacaucg

SEQ ID NO: 2832005 - RNA, 15 nt, Mycobacterium avium subsp. paratuberculosis
cgcugggcggcgcgg

SEQ ID NO: 2832006 - RNA, 18 nt, Mycobacterium avium subsp. paratuberculosis
cgcugggcggcgcggcgg

SEQ ID NO: 2832007 - RNA, 20 nt, Mycobacterium avium subsp. paratuberculosis
cgcugggcggcgcggcgguc

SEQ ID NO: 2832008 - RNA, 22 nt, Mycobacterium avium subsp. paratuberculosis
cgcugggcggcgcggcggucgg

SEQ ID NO: 2832009 - RNA, 15 nt, Mycobacterium avium subsp. paratuberculosis
cgcugggcuaacgcu

SEQ ID NO: 2832010 - RNA, 20 nt, Mycobacterium avium subsp. paratuberculosis
cgcugggcuaacgcuggucg

SEQ ID NO: 2832011 - RNA, 21 nt, Mycobacterium avium subsp. paratuberculosis
cgcugggcuaacgcuggucga

SEQ ID NO: 2832012 - RNA, 19 nt, Mycobacterium avium subsp. paratuberculosis
cgcugggcuggccguccgg

SEQ ID NO: 2832013 - RNA, 12 nt, Mycobacterium avium subsp. paratuberculosis
cgcuggggugcc

SEQ ID NO: 2832014 - RNA, 19 nt, Mycobacterium avium subsp. paratuberculosis
cgcuggggugcccaccagc

SEQ ID NO: 2832015 - RNA, 16 nt, Mycobacterium avium subsp. paratuberculosis
cgcuggggugcucgau

SEQ ID NO: 2832016 - RNA, 20 nt, Mycobacterium avium subsp. paratuberculosis
cgcuggggugcucgaucagc

SEQ ID NO: 2832017 - RNA, 18 nt, Mycobacterium avium subsp. paratuberculosis
cgcugggugaacaccccg

SEQ ID NO: 2832018 - RNA, 19 nt, Mycobacterium avium subsp. paratuberculosis
cgcugggugaacaccccgc

SEQ ID NO: 2832019 - RNA, 22 nt, Mycobacterium avium subsp. paratuberculosis
cgcugggugaacaccccgcggg

SEQ ID NO: 2832020 - RNA, 23 nt, Mycobacterium avium subsp. paratuberculosis
cgcugggugaacaccccgcggga

SEQ ID NO: 2832021 - RNA, 17 nt, Mycobacterium avium subsp. paratuberculosis
cgcugggugcgggcugc

SEQ ID NO: 2832022 - RNA, 21 nt, Mycobacterium avium subsp. paratuberculosis
cgcugggugcgggcugcacca

SEQ ID NO: 2832023 - RNA, 23 nt, Mycobacterium avium subsp. paratuberculosis
cgcugggugcgggcugcaccagg

SEQ ID NO: 2832024 - RNA, 21 nt, Mycobacterium avium subsp. paratuberculosis
cgcuggguguaaccggcuucc

SEQ ID NO: 2832025 - RNA, 20 nt, Mycobacterium avium subsp. paratuberculosis
cgcuggguguuccccgggcg

SEQ ID NO: 2832026 - RNA, 18 nt, Mycobacterium avium subsp. paratuberculosis
cgcugguaggcggcgcag

SEQ ID NO: 2832027 - RNA, 22 nt, Mycobacterium avium subsp. paratuberculosis
cgcugguaguacaccgggcugg

SEQ ID NO: 2832028 - RNA, 21 nt, Mycobacterium avium subsp. paratuberculosis
cgcuggucaacucgacccgca

SEQ ID NO: 2832029 - RNA, 22 nt, Mycobacterium avium subsp. paratuberculosis
cgcuggucaacucgacccgcac

SEQ ID NO: 2832030 - RNA, 23 nt, Mycobacterium avium subsp. paratuberculosis
cgcuggucaacucgacccgcacc

SEQ ID NO: 2832031 - RNA, 18 nt, Mycobacterium avium subsp. paratuberculosis
cgcugguccucggggaug

SEQ ID NO: 2832032 - RNA, 18 nt, Mycobacterium avium subsp. paratuberculosis
cgcuggucgaaccgcgag

SEQ ID NO: 2832033 - RNA, 14 nt, Mycobacterium avium subsp. paratuberculosis
cgcuggucgaacgc

SEQ ID NO: 2832034 - RNA, 15 nt, Mycobacterium avium subsp. paratuberculosis
cgcuggucgaacgcc

SEQ ID NO: 2832035 - RNA, 14 nt, Mycobacterium avium subsp. paratuberculosis
cgcuggucgcgaag

SEQ ID NO: 2832036 - RNA, 16 nt, Mycobacterium avium subsp. paratuberculosis
cgcuggucgcgaagcg

SEQ ID NO: 2832037 - RNA, 14 nt, Mycobacterium avium subsp. paratuberculosis
cgcuggucggcgaa

SEQ ID NO: 2832038 - RNA, 18 nt, Mycobacterium avium subsp. paratuberculosis
cgcuggucggcgggcagc

SEQ ID NO: 2832039 - RNA, 17 nt, Mycobacterium avium subsp. paratuberculosis
cgcuggugaacucgccg

SEQ ID NO: 2832040 - RNA, 20 nt, Mycobacterium avium subsp. paratuberculosis
cgcuggugaacucgccgauc

SEQ ID NO: 2832041 - RNA, 14 nt, Mycobacterium avium subsp. paratuberculosis
cgcuggugacgugc

SEQ ID NO: 2832042 - RNA, 20 nt, Mycobacterium avium subsp. paratuberculosis
cgcuggugacgugcaccugc

SEQ ID NO: 2832043 - RNA, 22 nt, Mycobacterium avium subsp. paratuberculosis
cgcuggugacgugcaccugcag

SEQ ID NO: 2832044 - RNA, 17 nt, Mycobacterium avium subsp. paratuberculosis
cgcuggugaggucgcgc

SEQ ID NO: 2832045 - RNA, 19 nt, Mycobacterium avium subsp. paratuberculosis
cgcuggugaggucgcgcag

SEQ ID NO: 2832046 - RNA, 13 nt, Mycobacterium avium subsp. paratuberculosis
cgcuggugcaccc

SEQ ID NO: 2832047 - RNA, 15 nt, Mycobacterium avium subsp. paratuberculosis
cgcuggugcacccga

SEQ ID NO: 2832048 - RNA, 14 nt, Mycobacterium avium subsp. paratuberculosis
cgcuggugcagcag

SEQ ID NO: 2832049 - RNA, 15 nt, Mycobacterium avium subsp. paratuberculosis
cgcuggugcgcgccg

SEQ ID NO: 2832050 - RNA, 16 nt, Mycobacterium avium subsp. paratuberculosis
cgcuggugcgcgccgg

SEQ ID NO: 2832051 - RNA, 17 nt, Mycobacterium avium subsp. paratuberculosis
cgcuggugcgcgccggc

SEQ ID NO: 2832052 - RNA, 20 nt, Mycobacterium avium subsp. paratuberculosis
cgcuggugcgcgccggcguc

SEQ ID NO: 2832053 - RNA, 17 nt, Mycobacterium avium subsp. paratuberculosis
cgcuugccagccgggcc

SEQ ID NO: 2832054 - RNA, 21 nt, Mycobacterium avium subsp. paratuberculosis
cgcuugccgaaguccuugacc

SEQ ID NO: 2832055 - RNA, 20 nt, Mycobacterium avium subsp. paratuberculosis
cgcuugccgcgacccgggcc

SEQ ID NO: 2832056 - RNA, 21 nt, Mycobacterium avium subsp. paratuberculosis
cgcuugccgcgacccgggccg

SEQ ID NO: 2832057 - RNA, 22 nt, Mycobacterium avium subsp. paratuberculosis
cgcuugccggauugcgagccgg

SEQ ID NO: 2832058 - RNA, 13 nt, Mycobacterium avium subsp. paratuberculosis
cgcuugcgaccgc

SEQ ID NO: 2832059 - RNA, 15 nt, Mycobacterium avium subsp. paratuberculosis
cgcuugcgaccgccg

SEQ ID NO: 2832060 - RNA, 17 nt, Mycobacterium avium subsp. paratuberculosis
cgcuugcgaccgccgcu

SEQ ID NO: 2832061 - RNA, 14 nt, Mycobacterium avium subsp. paratuberculosis
cgcuugcgccgcag

SEQ ID NO: 2832062 - RNA, 19 nt, Mycobacterium avium subsp. paratuberculosis
cgcuugcgccgcagcggug

SEQ ID NO: 2832063 - RNA, 14 nt, Mycobacterium avium subsp. paratuberculosis
cgcuugcgcucggu

SEQ ID NO: 2832064 - RNA, 16 nt, Mycobacterium avium subsp. paratuberculosis
cgcuugcgcucggucg

SEQ ID NO: 2832065 - RNA, 17 nt, Mycobacterium avium subsp. paratuberculosis
cgcuugcguucccagcc

SEQ ID NO: 2832066 - RNA, 18 nt, Mycobacterium avium subsp. paratuberculosis
cgcuugcguucccagccc

SEQ ID NO: 2832067 - RNA, 15 nt, Mycobacterium avium subsp. paratuberculosis
cgcuuggccgggcgg

SEQ ID NO: 2832068 - RNA, 18 nt, Mycobacterium avium subsp. paratuberculosis
cgcuuggcgcgccgcacc

SEQ ID NO: 2832069 - RNA, 18 nt, Mycobacterium avium subsp. paratuberculosis
cgcuuggcggagagcggu

SEQ ID NO: 2832070 - RNA, 21 nt, Mycobacterium avium subsp. paratuberculosis
cgcuugggguuuggcgacguc

SEQ ID NO: 2832071 - RNA, 17 nt, Mycobacterium avium subsp. paratuberculosis
cgcuugggucgccgggu

SEQ ID NO: 2832072 - RNA, 17 nt, Mycobacterium avium subsp. paratuberculosis
cgcuugguggcgccggu

SEQ ID NO: 2832073 - RNA, 18 nt, Mycobacterium avium subsp. paratuberculosis
cgcuugguggcgccgguu

SEQ ID NO: 2832074 - RNA, 15 nt, Mycobacterium avium subsp. paratuberculosis
cgcuugucgcagacc

SEQ ID NO: 2832075 - RNA, 17 nt, Mycobacterium avium subsp. paratuberculosis
cgcuugucggcguggcc

SEQ ID NO: 2832076 - RNA, 22 nt, Mycobacterium avium subsp. paratuberculosis
cgcuugucggcguggccguccg

SEQ ID NO: 2832077 - RNA, 23 nt, Mycobacterium avium subsp. paratuberculosis
cgcuugugccggaagcggcggua

SEQ ID NO: 2832078 - RNA, 22 nt, Mycobacterium avium subsp. paratuberculosis
cgcuuuccaaccaggcgcucgu

SEQ ID NO: 2832079 - RNA, 21 nt, Mycobacterium avium subsp. paratuberculosis
cgcuuuccaccucgagcaacc

SEQ ID NO: 2832080 - RNA, 14 nt, Mycobacterium avium subsp. paratuberculosis
cgcuuucgccgggc

SEQ ID NO: 2832081 - RNA, 18 nt, Mycobacterium avium subsp. paratuberculosis
cgcuuucgccgggcguca

SEQ ID NO: 2832082 - RNA, 23 nt, Mycobacterium avium subsp. paratuberculosis
cgcuuucgccgggcgucacgcca

SEQ ID NO: 2832083 - RNA, 17 nt, Mycobacterium avium subsp. paratuberculosis
cgcuuucgcgcacgcca

SEQ ID NO: 2832084 - RNA, 14 nt, Mycobacterium avium subsp. paratuberculosis
cgcuuucgcugguc

SEQ ID NO: 2832085 - RNA, 16 nt, Mycobacterium avium subsp. paratuberculosis
cgcuuucgcuggucgc

SEQ ID NO: 2832086 - RNA, 14 nt, Mycobacterium avium subsp. paratuberculosis
cgcuuucggugacc

SEQ ID NO: 2832087 - RNA, 21 nt, Mycobacterium avium subsp. paratuberculosis
cgcuuugaauugagcgccggg

SEQ ID NO: 2832088 - RNA, 22 nt, Mycobacterium avium subsp. paratuberculosis
cgcuuugaauugagcgccgggg

SEQ ID NO: 2832089 - RNA, 19 nt, Mycobacterium avium subsp. paratuberculosis
cgcuuugaucagcucgccg

SEQ ID NO: 2832090 - RNA, 17 nt, Mycobacterium avium subsp. paratuberculosis
cgcuuuggaccagggcg

SEQ ID NO: 2832091 - RNA, 22 nt, Mycobacterium avium subsp. paratuberculosis
cggaaaaagcguugcgccagca

SEQ ID NO: 2832092 - RNA, 17 nt, Mycobacterium avium subsp. paratuberculosis
cggaaaaccccaccccg

SEQ ID NO: 2832093 - RNA, 20 nt, Mycobacterium avium subsp. paratuberculosis
cggaaacgacgucgccacca

SEQ ID NO: 2832094 - RNA, 15 nt, Mycobacterium avium subsp. paratuberculosis
cggaaagcgcgggca

SEQ ID NO: 2832095 - RNA, 23 nt, Mycobacterium avium subsp. paratuberculosis
cggaaaucgccuguccgaccagc

SEQ ID NO: 2832096 - RNA, 16 nt, Mycobacterium avium subsp. paratuberculosis
cggaaaugcccgcgcc

SEQ ID NO: 2832097 - RNA, 23 nt, Mycobacterium avium subsp. paratuberculosis
cggaacacccagguugucaaggg

SEQ ID NO: 2832098 - RNA, 14 nt, Mycobacterium avium subsp. paratuberculosis
cggaacagccggcu

SEQ ID NO: 2832099 - RNA, 16 nt, Mycobacterium avium subsp. paratuberculosis
cggaacagccggcuca

SEQ ID NO: 2832100 - RNA, 16 nt, Mycobacterium avium subsp. paratuberculosis
cggaacagcgucgccg

SEQ ID NO: 2832101 - RNA, 19 nt, Mycobacterium avium subsp. paratuberculosis
cggaacagcgucgccgacg

SEQ ID NO: 2832102 - RNA, 15 nt, Mycobacterium avium subsp. paratuberculosis
cggaacagcuggucc

SEQ ID NO: 2832103 - RNA, 21 nt, Mycobacterium avium subsp. paratuberculosis
cggaacagcuuggcgcagccg

SEQ ID NO: 2832104 - RNA, 22 nt, Mycobacterium avium subsp. paratuberculosis
cggaacagcuuggcgcagccgg

SEQ ID NO: 2832105 - RNA, 18 nt, Mycobacterium avium subsp. paratuberculosis
cggaacccacgugcggcg

SEQ ID NO: 2832106 - RNA, 20 nt, Mycobacterium avium subsp. paratuberculosis
cggaacccacgugcggcgcc

SEQ ID NO: 2832107 - RNA, 20 nt, Mycobacterium avium subsp. paratuberculosis
cggaacccggguggcccgca

SEQ ID NO: 2832108 - RNA, 17 nt, Mycobacterium avium subsp. paratuberculosis
cggaacccguugcgccc

SEQ ID NO: 2832109 - RNA, 15 nt, Mycobacterium avium subsp. paratuberculosis
cggaacccugcccca

SEQ ID NO: 2832110 - RNA, 23 nt, Mycobacterium avium subsp. paratuberculosis
cggaaccgcgccuucgacccggu

SEQ ID NO: 2832111 - RNA, 14 nt, Mycobacterium avium subsp. paratuberculosis
cggaaccggccggg

SEQ ID NO: 2832112 - RNA, 15 nt, Mycobacterium avium subsp. paratuberculosis
cggaaccgggcaccc

SEQ ID NO: 2832113 - RNA, 14 nt, Mycobacterium avium subsp. paratuberculosis
cggaaccgggccgc

SEQ ID NO: 2832114 - RNA, 19 nt, Mycobacterium avium subsp. paratuberculosis
cggaaccgggggccgucac

SEQ ID NO: 2832115 - RNA, 14 nt, Mycobacterium avium subsp. paratuberculosis
cggaaccguagacc

SEQ ID NO: 2832116 - RNA, 18 nt, Mycobacterium avium subsp. paratuberculosis
cggaaccguagaccaccu

SEQ ID NO: 2832117 - RNA, 23 nt, Mycobacterium avium subsp. paratuberculosis
cggaaccguuugucccuugggcg

SEQ ID NO: 2832118 - RNA, 15 nt, Mycobacterium avium subsp. paratuberculosis
cggaacgcccgaucu

SEQ ID NO: 2832119 - RNA, 21 nt, Mycobacterium avium subsp. paratuberculosis
cggaacgcccgaucugggauc

SEQ ID NO: 2832120 - RNA, 14 nt, Mycobacterium avium subsp. paratuberculosis
cggaacgcgccggg

SEQ ID NO: 2832121 - RNA, 22 nt, Mycobacterium avium subsp. paratuberculosis
cggaacgcgccgggcaacagcg

SEQ ID NO: 2832122 - RNA, 15 nt, Mycobacterium avium subsp. paratuberculosis
cggaacgcgucgccc

SEQ ID NO: 2832123 - RNA, 21 nt, Mycobacterium avium subsp. paratuberculosis
cggaacggcuugcgcucggcc

SEQ ID NO: 2832124 - RNA, 15 nt, Mycobacterium avium subsp. paratuberculosis
cggaacggucggggc

SEQ ID NO: 2832125 - RNA, 18 nt, Mycobacterium avium subsp. paratuberculosis
cggaacggucggggcggc

SEQ ID NO: 2832126 - RNA, 22 nt, Mycobacterium avium subsp. paratuberculosis
cggaacggucggggcggcgggc

SEQ ID NO: 2832127 - RNA, 13 nt, Mycobacterium avium subsp. paratuberculosis
cggaacucggccg

SEQ ID NO: 2832128 - RNA, 17 nt, Mycobacterium avium subsp. paratuberculosis
cggaacucggccggcac

SEQ ID NO: 2832129 - RNA, 15 nt, Mycobacterium avium subsp. paratuberculosis
cggaacugcucccag

SEQ ID NO: 2832130 - RNA, 21 nt, Mycobacterium avium subsp. paratuberculosis
cggaagaacaguuccucggcg

SEQ ID NO: 2832131 - RNA, 13 nt, Mycobacterium avium subsp. paratuberculosis
cggaagaucagca

SEQ ID NO: 2832132 - RNA, 18 nt, Mycobacterium avium subsp. paratuberculosis
cggaagaucagcaggcug

SEQ ID NO: 2832133 - RNA, 20 nt, Mycobacterium avium subsp. paratuberculosis
cggaagaucagcaggcuggc

SEQ ID NO: 2832134 - RNA, 17 nt, Mycobacterium avium subsp. paratuberculosis
cggaagccccaggcccg

SEQ ID NO: 2832135 - RNA, 19 nt, Mycobacterium avium subsp. paratuberculosis
cggaagccccaggcccggu

SEQ ID NO: 2832136 - RNA, 17 nt, Mycobacterium avium subsp. paratuberculosis
cggaagcccuugcagca

SEQ ID NO: 2832137 - RNA, 21 nt, Mycobacterium avium subsp. paratuberculosis
cggacauaggcgucgcggucg

SEQ ID NO: 2832138 - RNA, 22 nt, Mycobacterium avium subsp. paratuberculosis
cggacauaggcgucgcggucgg

SEQ ID NO: 2832139 - RNA, 24 nt, Mycobacterium avium subsp. paratuberculosis
cggacauaggcgucgcggucggcg

SEQ ID NO: 2832140 - RNA, 15 nt, Mycobacterium avium subsp. paratuberculosis
cggacaucgccucgg

SEQ ID NO: 2832141 - RNA, 24 nt, Mycobacterium avium subsp. paratuberculosis
cggacaucucccgcacccguucgg

SEQ ID NO: 2832142 - RNA, 15 nt, Mycobacterium avium subsp. paratuberculosis
cggacaugccggcgc

SEQ ID NO: 2832143 - RNA, 17 nt, Mycobacterium avium subsp. paratuberculosis
cggacaugccggcgccg

SEQ ID NO: 2832144 - RNA, 18 nt, Mycobacterium avium subsp. paratuberculosis
cggacaugccggcgccga

SEQ ID NO: 2832145 - RNA, 17 nt, Mycobacterium avium subsp. paratuberculosis
cggacauucugcacgac

SEQ ID NO: 2832146 - RNA, 16 nt, Mycobacterium avium subsp. paratuberculosis
cggaccacccaggugg

SEQ ID NO: 2832147 - RNA, 18 nt, Mycobacterium avium subsp. paratuberculosis
cggaccacguccccgggc

SEQ ID NO: 2832148 - RNA, 18 nt, Mycobacterium avium subsp. paratuberculosis
cggaccaggguggcccca

SEQ ID NO: 2832149 - RNA, 23 nt, Mycobacterium avium subsp. paratuberculosis
cggaccagguauucaucgcggcc

SEQ ID NO: 2832150 - RNA, 15 nt, Mycobacterium avium subsp. paratuberculosis
cggaccaucuacgac

SEQ ID NO: 2832151 - RNA, 20 nt, Mycobacterium avium subsp. paratuberculosis
cggaccaucuacgaccucga

SEQ ID NO: 2832152 - RNA, 16 nt, Mycobacterium avium subsp. paratuberculosis
cggacccagcccggcg

SEQ ID NO: 2832153 - RNA, 18 nt, Mycobacterium avium subsp. paratuberculosis
cggacccagcccggcgac

SEQ ID NO: 2832154 - RNA, 20 nt, Mycobacterium avium subsp. paratuberculosis
cggacccagcccggcgacga

SEQ ID NO: 2832155 - RNA, 21 nt, Mycobacterium avium subsp. paratuberculosis
cggacccagcccggcgacgaa

SEQ ID NO: 2832156 - RNA, 13 nt, Mycobacterium avium subsp. paratuberculosis
cggacccagcucc

SEQ ID NO: 2832157 - RNA, 15 nt, Mycobacterium avium subsp. paratuberculosis
cggacccagcuccuc

SEQ ID NO: 2832158 - RNA, 20 nt, Mycobacterium avium subsp. paratuberculosis
cggacccagcuccucggcca

SEQ ID NO: 2832159 - RNA, 22 nt, Mycobacterium avium subsp. paratuberculosis
cggacccagcuccucggccagc

SEQ ID NO: 2832160 - RNA, 15 nt, Mycobacterium avium subsp. paratuberculosis
cggacccaggcagcg

SEQ ID NO: 2832161 - RNA, 20 nt, Mycobacterium avium subsp. paratuberculosis
cggacccaggcagcgcgacu

SEQ ID NO: 2832162 - RNA, 18 nt, Mycobacterium avium subsp. paratuberculosis
cggacccauucgucggcg

SEQ ID NO: 2832163 - RNA, 20 nt, Mycobacterium avium subsp. paratuberculosis
cggacccauucgucggcggu

SEQ ID NO: 2832164 - RNA, 14 nt, Mycobacterium avium subsp. paratuberculosis
cggaccccacagcg

SEQ ID NO: 2832165 - RNA, 17 nt, Mycobacterium avium subsp. paratuberculosis
cggaccccacagcgcgc

SEQ ID NO: 2832166 - RNA, 19 nt, Mycobacterium avium subsp. paratuberculosis
cggaccccacagcgcgccc

SEQ ID NO: 2832167 - RNA, 21 nt, Mycobacterium avium subsp. paratuberculosis
cggaccccacagcgcgcccca

SEQ ID NO: 2832168 - RNA, 15 nt, Mycobacterium avium subsp. paratuberculosis
cggaccccagcguga

SEQ ID NO: 2832169 - RNA, 20 nt, Mycobacterium avium subsp. paratuberculosis
cggaccccagcgugacgucg

SEQ ID NO: 2832170 - RNA, 23 nt, Mycobacterium avium subsp. paratuberculosis
cggacccccucggggcucaccac

SEQ ID NO: 2832171 - RNA, 14 nt, Mycobacterium avium subsp. paratuberculosis
cggaccccgaugcg

SEQ ID NO: 2832172 - RNA, 14 nt, Mycobacterium avium subsp. paratuberculosis
cggacccgcucccg

SEQ ID NO: 2832173 - RNA, 15 nt, Mycobacterium avium subsp. paratuberculosis
cggacccgcucccgg

SEQ ID NO: 2832174 - RNA, 14 nt, Mycobacterium avium subsp. paratuberculosis
cggacccgcucgcc

SEQ ID NO: 2832175 - RNA, 16 nt, Mycobacterium avium subsp. paratuberculosis
cggacccgcucgccga

SEQ ID NO: 2832176 - RNA, 14 nt, Mycobacterium avium subsp. paratuberculosis
cggacccggaggcg

SEQ ID NO: 2832177 - RNA, 18 nt, Mycobacterium avium subsp. paratuberculosis
cggacccggaggcggcgg

SEQ ID NO: 2832178 - RNA, 20 nt, Mycobacterium avium subsp. paratuberculosis
cggacccggaggcggcgggg

SEQ ID NO: 2832179 - RNA, 17 nt, Mycobacterium avium subsp. paratuberculosis
cggacccggucggccgc

SEQ ID NO: 2832180 - RNA, 16 nt, Mycobacterium avium subsp. paratuberculosis
cggacccguugggcca

SEQ ID NO: 2832181 - RNA, 14 nt, Mycobacterium avium subsp. paratuberculosis
cggacccuggccag

SEQ ID NO: 2832182 - RNA, 15 nt, Mycobacterium avium subsp. paratuberculosis
cggacccuggccagc

SEQ ID NO: 2832183 - RNA, 18 nt, Mycobacterium avium subsp. paratuberculosis
cggacccuucagccagau

SEQ ID NO: 2832184 - RNA, 16 nt, Mycobacterium avium subsp. paratuberculosis
cggaccgauccggcgc

SEQ ID NO: 2832185 - RNA, 18 nt, Mycobacterium avium subsp. paratuberculosis
cggaccgauccggcgccc

SEQ ID NO: 2832186 - RNA, 17 nt, Mycobacterium avium subsp. paratuberculosis
cggaccgcacccccagc

SEQ ID NO: 2832187 - RNA, 12 nt, Mycobacterium avium subsp. paratuberculosis
cggaccgccgag

SEQ ID NO: 2832188 - RNA, 12 nt, Mycobacterium avium subsp. paratuberculosis
cggaccgccgcg

SEQ ID NO: 2832189 - RNA, 15 nt, Mycobacterium avium subsp. paratuberculosis
cggaccgccgcggcg

SEQ ID NO: 2832190 - RNA, 22 nt, Mycobacterium avium subsp. paratuberculosis
cggaccgccgcggcgcccggcg

SEQ ID NO: 2832191 - RNA, 18 nt, Mycobacterium avium subsp. paratuberculosis
cggaccgccgcggcggcc

SEQ ID NO: 2832192 - RNA, 19 nt, Mycobacterium avium subsp. paratuberculosis
cggaccgccgcggcggccu

SEQ ID NO: 2832193 - RNA, 14 nt, Mycobacterium avium subsp. paratuberculosis
cggaccgcgcgggc

SEQ ID NO: 2832194 - RNA, 16 nt, Mycobacterium avium subsp. paratuberculosis
cggaccgcgcgggcca

SEQ ID NO: 2832195 - RNA, 18 nt, Mycobacterium avium subsp. paratuberculosis
cggaccgcgcgggccagc

SEQ ID NO: 2832196 - RNA, 18 nt, Mycobacterium avium subsp. paratuberculosis
cggaccgcuugacgccgc

SEQ ID NO: 2832197 - RNA, 19 nt, Mycobacterium avium subsp. paratuberculosis
cggaccgcuugacgccgcc

SEQ ID NO: 2832198 - RNA, 21 nt, Mycobacterium avium subsp. paratuberculosis
cggaccgcuugacgccgccga

SEQ ID NO: 2832199 - RNA, 13 nt, Mycobacterium avium subsp. paratuberculosis
cggaccggccagc

SEQ ID NO: 2832200 - RNA, 17 nt, Mycobacterium avium subsp. paratuberculosis
cggaccggccagcagcc

SEQ ID NO: 2832201 - RNA, 13 nt, Mycobacterium avium subsp. paratuberculosis
cggaccggccgug

SEQ ID NO: 2832202 - RNA, 14 nt, Mycobacterium avium subsp. paratuberculosis
cggaccggccgugc

SEQ ID NO: 2832203 - RNA, 12 nt, Mycobacterium avium subsp. paratuberculosis
cggaccggcgau

SEQ ID NO: 2832204 - RNA, 21 nt, Mycobacterium avium subsp. paratuberculosis
cggaccggcgauuucggccgu

SEQ ID NO: 2832205 - RNA, 14 nt, Mycobacterium avium subsp. paratuberculosis
cggaccggcggccg

SEQ ID NO: 2832206 - RNA, 17 nt, Mycobacterium avium subsp. paratuberculosis
cggaccggcggccgcca

SEQ ID NO: 2832207 - RNA, 19 nt, Mycobacterium avium subsp. paratuberculosis
cggaccggcggccgccauc

SEQ ID NO: 2832208 - RNA, 20 nt, Mycobacterium avium subsp. paratuberculosis
cggaccggcggccgccauca

SEQ ID NO: 2832209 - RNA, 13 nt, Mycobacterium avium subsp. paratuberculosis
cggaccggcucgu

SEQ ID NO: 2832210 - RNA, 16 nt, Mycobacterium avium subsp. paratuberculosis
cggaccgggcgggcug

SEQ ID NO: 2832211 - RNA, 17 nt, Mycobacterium avium subsp. paratuberculosis
cggaccgggugaccggc

SEQ ID NO: 2832212 - RNA, 18 nt, Mycobacterium avium subsp. paratuberculosis
cggaccgggugaccggcg

SEQ ID NO: 2832213 - RNA, 19 nt, Mycobacterium avium subsp. paratuberculosis
cggaccgggugaccggcgc

SEQ ID NO: 2832214 - RNA, 22 nt, Mycobacterium avium subsp. paratuberculosis
cggaccgggugaccggcgcgca

SEQ ID NO: 2832215 - RNA, 22 nt, Mycobacterium avium subsp. paratuberculosis
cggaccgguaggcgcaccgccg

SEQ ID NO: 2832216 - RNA, 23 nt, Mycobacterium avium subsp. paratuberculosis
cggaccgguaggcgcaccgccgg

SEQ ID NO: 2832217 - RNA, 16 nt, Mycobacterium avium subsp. paratuberculosis
cggaccguucgguccg

SEQ ID NO: 2832218 - RNA, 14 nt, Mycobacterium avium subsp. paratuberculosis
cggaccugccggcg

SEQ ID NO: 2832219 - RNA, 15 nt, Mycobacterium avium subsp. paratuberculosis
cggaccugccggcga

SEQ ID NO: 2832220 - RNA, 16 nt, Mycobacterium avium subsp. paratuberculosis
cggaccugccggcgau

SEQ ID NO: 2832221 - RNA, 18 nt, Mycobacterium avium subsp. paratuberculosis
cggaccugccggcgauca

SEQ ID NO: 2832222 - RNA, 18 nt, Mycobacterium avium subsp. paratuberculosis
cggacuucuucagcuuga

SEQ ID NO: 2832223 - RNA, 21 nt, Mycobacterium avium subsp. paratuberculosis
cggacuucuucagcuugaccg

SEQ ID NO: 2832224 - RNA, 21 nt, Mycobacterium avium subsp. paratuberculosis
cggacuugaugcugcccggcg

SEQ ID NO: 2832225 - RNA, 16 nt, Mycobacterium avium subsp. paratuberculosis
cggagaacaucagccc

SEQ ID NO: 2832226 - RNA, 18 nt, Mycobacterium avium subsp. paratuberculosis
cggagaaccgcucgaugg

SEQ ID NO: 2832227 - RNA, 19 nt, Mycobacterium avium subsp. paratuberculosis
cggagaacuccuugagcuc

SEQ ID NO: 2832228 - RNA, 15 nt, Mycobacterium avium subsp. paratuberculosis
cggagaaggugucgc

SEQ ID NO: 2832229 - RNA, 15 nt, Mycobacterium avium subsp. paratuberculosis
cggagaccaggucgg

SEQ ID NO: 2832230 - RNA, 17 nt, Mycobacterium avium subsp. paratuberculosis
cggagaccaggucggcc

SEQ ID NO: 2832231 - RNA, 18 nt, Mycobacterium avium subsp. paratuberculosis
cggagacccgcccggaga

SEQ ID NO: 2832232 - RNA, 18 nt, Mycobacterium avium subsp. paratuberculosis
cggagaccgccguggcgu

SEQ ID NO: 2832233 - RNA, 15 nt, Mycobacterium avium subsp. paratuberculosis
cggagacgaccaggu

SEQ ID NO: 2832234 - RNA, 20 nt, Mycobacterium avium subsp. paratuberculosis
cggagacgaccagguccacc

SEQ ID NO: 2832235 - RNA, 13 nt, Mycobacterium avium subsp. paratuberculosis
cggagacgacgac

SEQ ID NO: 2832236 - RNA, 20 nt, Mycobacterium avium subsp. paratuberculosis
cggagacguugccgcacacc

SEQ ID NO: 2832237 - RNA, 22 nt, Mycobacterium avium subsp. paratuberculosis
cggagacguugccgcacaccgc

SEQ ID NO: 2832238 - RNA, 18 nt, Mycobacterium avium subsp. paratuberculosis
cggagagcaacaccucgg

SEQ ID NO: 2832239 - RNA, 14 nt, Mycobacterium avium subsp. paratuberculosis
cggagaucaccggc

SEQ ID NO: 2832240 - RNA, 15 nt, Mycobacterium avium subsp. paratuberculosis
cggagaucagggugc

SEQ ID NO: 2832241 - RNA, 19 nt, Mycobacterium avium subsp. paratuberculosis
cggagauccggccgcuggu

SEQ ID NO: 2832242 - RNA, 15 nt, Mycobacterium avium subsp. paratuberculosis
cggagaucgccccgg

SEQ ID NO: 2832243 - RNA, 15 nt, Mycobacterium avium subsp. paratuberculosis
cggagaucggcgagu

SEQ ID NO: 2832244 - RNA, 20 nt, Mycobacterium avium subsp. paratuberculosis
cggagaugaauucggcgauc

SEQ ID NO: 2832245 - RNA, 22 nt, Mycobacterium avium subsp. paratuberculosis
cggagaugaauucggcgaucuc

SEQ ID NO: 2832246 - RNA, 17 nt, Mycobacterium avium subsp. paratuberculosis
cggagaugauggccgcg

SEQ ID NO: 2832247 - RNA, 22 nt, Mycobacterium avium subsp. paratuberculosis
cggagaugauggccgcgccgcc

SEQ ID NO: 2832248 - RNA, 23 nt, Mycobacterium avium subsp. paratuberculosis
cggagaugauggccgcgccgccg

SEQ ID NO: 2832249 - RNA, 15 nt, Mycobacterium avium subsp. paratuberculosis
cggagaugcgggcca

SEQ ID NO: 2832250 - RNA, 18 nt, Mycobacterium avium subsp. paratuberculosis
cggagaugcgggccaccg

SEQ ID NO: 2832251 - RNA, 20 nt, Mycobacterium avium subsp. paratuberculosis
cggagaugcuggugacgccg

SEQ ID NO: 2832252 - RNA, 18 nt, Mycobacterium avium subsp. paratuberculosis
cggagaugguggucacca

SEQ ID NO: 2832253 - RNA, 22 nt, Mycobacterium avium subsp. paratuberculosis
cggagaugguggucaccaccac

SEQ ID NO: 2832254 - RNA, 22 nt, Mycobacterium avium subsp. paratuberculosis
cggagcaaagguaguccagcac

SEQ ID NO: 2832255 - RNA, 18 nt, Mycobacterium avium subsp. paratuberculosis
cggagcccagcuuggcgc

SEQ ID NO: 2832256 - RNA, 17 nt, Mycobacterium avium subsp. paratuberculosis
cggagccgaccucggcg

SEQ ID NO: 2832257 - RNA, 19 nt, Mycobacterium avium subsp. paratuberculosis
cggagccgaccucggcgac

SEQ ID NO: 2832258 - RNA, 20 nt, Mycobacterium avium subsp. paratuberculosis
cggagccgaucgccuccguc

SEQ ID NO: 2832259 - RNA, 23 nt, Mycobacterium avium subsp. paratuberculosis
cggagccgaucgccuccgucagc

SEQ ID NO: 2832260 - RNA, 12 nt, Mycobacterium avium subsp. paratuberculosis
cggagccggccg

SEQ ID NO: 2832261 - RNA, 14 nt, Mycobacterium avium subsp. paratuberculosis
cggagccggccgcc

SEQ ID NO: 2832262 - RNA, 15 nt, Mycobacterium avium subsp. paratuberculosis
cggagccggccgccg

SEQ ID NO: 2832263 - RNA, 16 nt, Mycobacterium avium subsp. paratuberculosis
cggagccggccgccga

SEQ ID NO: 2832264 - RNA, 19 nt, Mycobacterium avium subsp. paratuberculosis
cggagccggccgccgaagc

SEQ ID NO: 2832265 - RNA, 18 nt, Mycobacterium avium subsp. paratuberculosis
cggagccggccucgccgg

SEQ ID NO: 2832266 - RNA, 20 nt, Mycobacterium avium subsp. paratuberculosis
cggagccggccucgccggcg

SEQ ID NO: 2832267 - RNA, 21 nt, Mycobacterium avium subsp. paratuberculosis
cggagccggccucgccggcgc

SEQ ID NO: 2832268 - RNA, 14 nt, Mycobacterium avium subsp. paratuberculosis
cggagccgucggcu

SEQ ID NO: 2832269 - RNA, 19 nt, Mycobacterium avium subsp. paratuberculosis
cggagccgucggcuuccuc

SEQ ID NO: 2832270 - RNA, 14 nt, Mycobacterium avium subsp. paratuberculosis
cggagccgucggug

SEQ ID NO: 2832271 - RNA, 16 nt, Mycobacterium avium subsp. paratuberculosis
cggagccgucgguguc

SEQ ID NO: 2832272 - RNA, 21 nt, Mycobacterium avium subsp. paratuberculosis
cggagccgucgguguccaggu

SEQ ID NO: 2832273 - RNA, 13 nt, Mycobacterium avium subsp. paratuberculosis
cggagccgugccc

SEQ ID NO: 2832274 - RNA, 15 nt, Mycobacterium avium subsp. paratuberculosis
cggagccuucuucgc

SEQ ID NO: 2832275 - RNA, 18 nt, Mycobacterium avium subsp. paratuberculosis
cggagccuucuucgccgc

SEQ ID NO: 2832276 - RNA, 19 nt, Mycobacterium avium subsp. paratuberculosis
cggagccuucuucgccgca

SEQ ID NO: 2832277 - RNA, 21 nt, Mycobacterium avium subsp. paratuberculosis
cggagccuucuucgccgcaac

SEQ ID NO: 2832278 - RNA, 21 nt, Mycobacterium avium subsp. paratuberculosis
cggagccuucuucgccgcagc

SEQ ID NO: 2832279 - RNA, 23 nt, Mycobacterium avium subsp. paratuberculosis
cggagccuucuucgccgcagccu

SEQ ID NO: 2832280 - RNA, 14 nt, Mycobacterium avium subsp. paratuberculosis
cggagccuucuuga

SEQ ID NO: 2832281 - RNA, 21 nt, Mycobacterium avium subsp. paratuberculosis
cggagccuucuugaccgcagc

SEQ ID NO: 2832282 - RNA, 23 nt, Mycobacterium avium subsp. paratuberculosis
cggagccuucuugaccgcagccu

SEQ ID NO: 2832283 - RNA, 17 nt, Mycobacterium avium subsp. paratuberculosis
cggagccuugcuggcgg

SEQ ID NO: 2832284 - RNA, 18 nt, Mycobacterium avium subsp. paratuberculosis
cggagccuuggucgcggc

SEQ ID NO: 2832285 - RNA, 19 nt, Mycobacterium avium subsp. paratuberculosis
cggagccuuggucgcggcc

SEQ ID NO: 2832286 - RNA, 20 nt, Mycobacterium avium subsp. paratuberculosis
cggagccuuggucgcggccu

SEQ ID NO: 2832287 - RNA, 22 nt, Mycobacterium avium subsp. paratuberculosis
cggagcgaaggugccgcgaugc

SEQ ID NO: 2832288 - RNA, 14 nt, Mycobacterium avium subsp. paratuberculosis
cggagcgcccggcc

SEQ ID NO: 2832289 - RNA, 20 nt, Mycobacterium avium subsp. paratuberculosis
cggagcgcccggccagccgg

SEQ ID NO: 2832290 - RNA, 14 nt, Mycobacterium avium subsp. paratuberculosis
cggagcgcggucca

SEQ ID NO: 2832291 - RNA, 20 nt, Mycobacterium avium subsp. paratuberculosis
cggagcgcgguccacggugg

SEQ ID NO: 2832292 - RNA, 16 nt, Mycobacterium avium subsp. paratuberculosis
cggagcgcuccaccac

SEQ ID NO: 2832293 - RNA, 20 nt, Mycobacterium avium subsp. paratuberculosis
cggagcggauggcgccgucg

SEQ ID NO: 2832294 - RNA, 13 nt, Mycobacterium avium subsp. paratuberculosis
cggagcggcggua

SEQ ID NO: 2832295 - RNA, 16 nt, Mycobacterium avium subsp. paratuberculosis
cggagcggcggucacg

SEQ ID NO: 2832296 - RNA, 14 nt, Mycobacterium avium subsp. paratuberculosis
cggagcggugcggc

SEQ ID NO: 2832297 - RNA, 18 nt, Mycobacterium avium subsp. paratuberculosis
cggagcggugcggcucgg

SEQ ID NO: 2832298 - RNA, 19 nt, Mycobacterium avium subsp. paratuberculosis
cggagcggugcggcucggg

SEQ ID NO: 2832299 - RNA, 23 nt, Mycobacterium avium subsp. paratuberculosis
cggagcggugcggcucgggcggu

SEQ ID NO: 2832300 - RNA, 21 nt, Mycobacterium avium subsp. paratuberculosis
cggagcguucuccacccgccc

SEQ ID NO: 2832301 - RNA, 23 nt, Mycobacterium avium subsp. paratuberculosis
cggagcugcgcgccccggcccgg

SEQ ID NO: 2832302 - RNA, 18 nt, Mycobacterium avium subsp. paratuberculosis
cggaggacaacgcgucga

SEQ ID NO: 2832303 - RNA, 23 nt, Mycobacterium avium subsp. paratuberculosis
cggaggaguuuuucgggguggug

SEQ ID NO: 2832304 - RNA, 16 nt, Mycobacterium avium subsp. paratuberculosis
cggaggaugccggcca

SEQ ID NO: 2832305 - RNA, 17 nt, Mycobacterium avium subsp. paratuberculosis
cggaggaugccggccag

SEQ ID NO: 2832306 - RNA, 17 nt, Mycobacterium avium subsp. paratuberculosis
cggauccagcaccgcca

SEQ ID NO: 2832307 - RNA, 20 nt, Mycobacterium avium subsp. paratuberculosis
cggauccagguggggcacgg

SEQ ID NO: 2832308 - RNA, 18 nt, Mycobacterium avium subsp. paratuberculosis
cggauccccgcgcugggc

SEQ ID NO: 2832309 - RNA, 20 nt, Mycobacterium avium subsp. paratuberculosis
cggauccccgcgcugggcug

SEQ ID NO: 2832310 - RNA, 19 nt, Mycobacterium avium subsp. paratuberculosis
cggaucccggggcgcgcug

SEQ ID NO: 2832311 - RNA, 12 nt, Mycobacterium avium subsp. paratuberculosis
cggauccgcagc

SEQ ID NO: 2832312 - RNA, 16 nt, Mycobacterium avium subsp. paratuberculosis
cggauccgggccgccu

SEQ ID NO: 2832313 - RNA, 14 nt, Mycobacterium avium subsp. paratuberculosis
cggauccgggccgg

SEQ ID NO: 2832314 - RNA, 20 nt, Mycobacterium avium subsp. paratuberculosis
cggauccgggccggcgucgc

SEQ ID NO: 2832315 - RNA, 23 nt, Mycobacterium avium subsp. paratuberculosis
cggauccgggccggcgucgcggu

SEQ ID NO: 2832316 - RNA, 16 nt, Mycobacterium avium subsp. paratuberculosis
cggauccgggcgccgg

SEQ ID NO: 2832317 - RNA, 17 nt, Mycobacterium avium subsp. paratuberculosis
cggauccgggcgccggu

SEQ ID NO: 2832318 - RNA, 14 nt, Mycobacterium avium subsp. paratuberculosis
cggauccgucgccc

SEQ ID NO: 2832319 - RNA, 22 nt, Mycobacterium avium subsp. paratuberculosis
cggauccgucgccccgcaccga

SEQ ID NO: 2832320 - RNA, 20 nt, Mycobacterium avium subsp. paratuberculosis
cggauccucaguccgccccg

SEQ ID NO: 2832321 - RNA, 16 nt, Mycobacterium avium subsp. paratuberculosis
cggaucgaacagggcg

SEQ ID NO: 2832322 - RNA, 18 nt, Mycobacterium avium subsp. paratuberculosis
cggaucgaacagggcggc

SEQ ID NO: 2832323 - RNA, 20 nt, Mycobacterium avium subsp. paratuberculosis
cggaucgaacagggcggcgg

SEQ ID NO: 2832324 - RNA, 22 nt, Mycobacterium avium subsp. paratuberculosis
cggaucgaacuugaucaccgcg

SEQ ID NO: 2832325 - RNA, 22 nt, Mycobacterium avium subsp. paratuberculosis
cggaucgaauccggcggcgcuc

SEQ ID NO: 2832326 - RNA, 19 nt, Mycobacterium avium subsp. paratuberculosis
cggaucgagcacccggcgg

SEQ ID NO: 2832327 - RNA, 20 nt, Mycobacterium avium subsp. paratuberculosis
cggaucgagcacccggcggg

SEQ ID NO: 2832328 - RNA, 12 nt, Mycobacterium avium subsp. paratuberculosis
cggaucgagcgc

SEQ ID NO: 2832329 - RNA, 16 nt, Mycobacterium avium subsp. paratuberculosis
cggaucgagcgcaccg

SEQ ID NO: 2832330 - RNA, 18 nt, Mycobacterium avium subsp. paratuberculosis
cggaucgagcgcaccgcc

SEQ ID NO: 2832331 - RNA, 19 nt, Mycobacterium avium subsp. paratuberculosis
cggaucgagcgcaccgccc

SEQ ID NO: 2832332 - RNA, 18 nt, Mycobacterium avium subsp. paratuberculosis
cggaucgagcucgcaguc

SEQ ID NO: 2832333 - RNA, 23 nt, Mycobacterium avium subsp. paratuberculosis
cggaucgagcucgcagucgauca

SEQ ID NO: 2832334 - RNA, 18 nt, Mycobacterium avium subsp. paratuberculosis
cggaucgagucccgcgcg

SEQ ID NO: 2832335 - RNA, 19 nt, Mycobacterium avium subsp. paratuberculosis
cggaucgagucccgcgcgg

SEQ ID NO: 2832336 - RNA, 20 nt, Mycobacterium avium subsp. paratuberculosis
cggaucgagucccgcgcggc

SEQ ID NO: 2832337 - RNA, 22 nt, Mycobacterium avium subsp. paratuberculosis
cggaucgagucccgcgcggcgc

SEQ ID NO: 2832338 - RNA, 20 nt, Mycobacterium avium subsp. paratuberculosis
cggaucgcaucgggcgacau

SEQ ID NO: 2832339 - RNA, 14 nt, Mycobacterium avium subsp. paratuberculosis
cggaucgcccaccc

SEQ ID NO: 2832340 - RNA, 16 nt, Mycobacterium avium subsp. paratuberculosis
cggaucgcccacccgc

SEQ ID NO: 2832341 - RNA, 19 nt, Mycobacterium avium subsp. paratuberculosis
cggaucgcccacccgcacg

SEQ ID NO: 2832342 - RNA, 19 nt, Mycobacterium avium subsp. paratuberculosis
cggaucgccgaacgccucg

SEQ ID NO: 2832343 - RNA, 17 nt, Mycobacterium avium subsp. paratuberculosis
cggaucgccgagguagc

SEQ ID NO: 2832344 - RNA, 21 nt, Mycobacterium avium subsp. paratuberculosis
cggaucgccgagguagccgcg

SEQ ID NO: 2832345 - RNA, 15 nt, Mycobacterium avium subsp. paratuberculosis
cggaucgccggacag

SEQ ID NO: 2832346 - RNA, 16 nt, Mycobacterium avium subsp. paratuberculosis
cggaucgccggacagc

SEQ ID NO: 2832347 - RNA, 15 nt, Mycobacterium avium subsp. paratuberculosis
cggaucgcgggcgac

SEQ ID NO: 2832348 - RNA, 18 nt, Mycobacterium avium subsp. paratuberculosis
cggaucgcgggcgacccg

SEQ ID NO: 2832349 - RNA, 23 nt, Mycobacterium avium subsp. paratuberculosis
cggaucgcgggcgacccgcugga

SEQ ID NO: 2832350 - RNA, 22 nt, Mycobacterium avium subsp. paratuberculosis
cggaucgcguaguccagcacgg

SEQ ID NO: 2832351 - RNA, 18 nt, Mycobacterium avium subsp. paratuberculosis
cggaucgcgugcgucacg

SEQ ID NO: 2832352 - RNA, 15 nt, Mycobacterium avium subsp. paratuberculosis
cggaucggccauggu

SEQ ID NO: 2832353 - RNA, 22 nt, Mycobacterium avium subsp. paratuberculosis
cggaucggccauggugccgccg

SEQ ID NO: 2832354 - RNA, 14 nt, Mycobacterium avium subsp. paratuberculosis
cggaucggcccccg

SEQ ID NO: 2832355 - RNA, 13 nt, Mycobacterium avium subsp. paratuberculosis
cggaucggccgcg

SEQ ID NO: 2832356 - RNA, 16 nt, Mycobacterium avium subsp. paratuberculosis
cggaucggccgcgucg

SEQ ID NO: 2832357 - RNA, 16 nt, Mycobacterium avium subsp. paratuberculosis
cggaucggcggcgacg

SEQ ID NO: 2832358 - RNA, 17 nt, Mycobacterium avium subsp. paratuberculosis
cggaucggcggucccgu

SEQ ID NO: 2832359 - RNA, 18 nt, Mycobacterium avium subsp. paratuberculosis
cggaucggcuagcagcuc

SEQ ID NO: 2832360 - RNA, 22 nt, Mycobacterium avium subsp. paratuberculosis
cggaucggcuagcagcuccggu

SEQ ID NO: 2832361 - RNA, 20 nt, Mycobacterium avium subsp. paratuberculosis
cggaucggcugcgggccagc

SEQ ID NO: 2832362 - RNA, 18 nt, Mycobacterium avium subsp. paratuberculosis
cggaucgggaccgggaag

SEQ ID NO: 2832363 - RNA, 22 nt, Mycobacterium avium subsp. paratuberculosis
cggaucgggaccgggaagccga

SEQ ID NO: 2832364 - RNA, 22 nt, Mycobacterium avium subsp. paratuberculosis
cggaucgggcgguccaccgacg

SEQ ID NO: 2832365 - RNA, 12 nt, Mycobacterium avium subsp. paratuberculosis
cggaucggggcg

SEQ ID NO: 2832366 - RNA, 14 nt, Mycobacterium avium subsp. paratuberculosis
cggaucggggcgac

SEQ ID NO: 2832367 - RNA, 22 nt, Mycobacterium avium subsp. paratuberculosis
cggaucggggcgaccuggacgc

SEQ ID NO: 2832368 - RNA, 15 nt, Mycobacterium avium subsp. paratuberculosis
cggaucggugcaggc

SEQ ID NO: 2832369 - RNA, 15 nt, Mycobacterium avium subsp. paratuberculosis
cggaucgucaccgac

SEQ ID NO: 2832370 - RNA, 20 nt, Mycobacterium avium subsp. paratuberculosis
cggaucgugucccggcgccc

SEQ ID NO: 2832371 - RNA, 21 nt, Mycobacterium avium subsp. paratuberculosis
cggaucgugucccggcgcccu

SEQ ID NO: 2832372 - RNA, 16 nt, Mycobacterium avium subsp. paratuberculosis
cggaucucgaccucgu

SEQ ID NO: 2832373 - RNA, 15 nt, Mycobacterium avium subsp. paratuberculosis
cggaucucgcgcagg

SEQ ID NO: 2832374 - RNA, 18 nt, Mycobacterium avium subsp. paratuberculosis
cggaucucgcgcaggucc

SEQ ID NO: 2832375 - RNA, 18 nt, Mycobacterium avium subsp. paratuberculosis
cggaucucggugccggug

SEQ ID NO: 2832376 - RNA, 17 nt, Mycobacterium avium subsp. paratuberculosis
cggaucucgucgggcac

SEQ ID NO: 2832377 - RNA, 18 nt, Mycobacterium avium subsp. paratuberculosis
cggaucucgucgggccac

SEQ ID NO: 2832378 - RNA, 22 nt, Mycobacterium avium subsp. paratuberculosis
cggaucugcgucugugguggcg

SEQ ID NO: 2832379 - RNA, 14 nt, Mycobacterium avium subsp. paratuberculosis
cggaucuggcccug

SEQ ID NO: 2832380 - RNA, 16 nt, Mycobacterium avium subsp. paratuberculosis
cggaucuggcccuggc

SEQ ID NO: 2832381 - RNA, 18 nt, Mycobacterium avium subsp. paratuberculosis
cggaucuucucgcugcuc

SEQ ID NO: 2832382 - RNA, 16 nt, Mycobacterium avium subsp. paratuberculosis
cggaucuugccgucgg

SEQ ID NO: 2832383 - RNA, 22 nt, Mycobacterium avium subsp. paratuberculosis
cggaucuugccgucggccgccg

SEQ ID NO: 2832384 - RNA, 17 nt, Mycobacterium avium subsp. paratuberculosis
cggaucuugguguccag

SEQ ID NO: 2832385 - RNA, 21 nt, Mycobacterium avium subsp. paratuberculosis
cggaucuugguguccagcggc

SEQ ID NO: 2832386 - RNA, 19 nt, Mycobacterium avium subsp. paratuberculosis
cggaugaccaggucgccgg

SEQ ID NO: 2832387 - RNA, 16 nt, Mycobacterium avium subsp. paratuberculosis
cggaugacgugcacca

SEQ ID NO: 2832388 - RNA, 22 nt, Mycobacterium avium subsp. paratuberculosis
cggaugaugcccuuggcggcca

SEQ ID NO: 2832389 - RNA, 18 nt, Mycobacterium avium subsp. paratuberculosis
cggaugaugguggccagu

SEQ ID NO: 2832390 - RNA, 20 nt, Mycobacterium avium subsp. paratuberculosis
cggauugccgggcagcggcc

SEQ ID NO: 2832391 - RNA, 23 nt, Mycobacterium avium subsp. paratuberculosis
cggauugguacuagccuggcacg

SEQ ID NO: 2832392 - RNA, 16 nt, Mycobacterium avium subsp. paratuberculosis
cggauuggucagagcc

SEQ ID NO: 2832393 - RNA, 20 nt, Mycobacterium avium subsp. paratuberculosis
cggauuggucagagcccgaa

SEQ ID NO: 2832394 - RNA, 17 nt, Mycobacterium avium subsp. paratuberculosis
cggauuggugccgauca

SEQ ID NO: 2832395 - RNA, 18 nt, Mycobacterium avium subsp. paratuberculosis
cggauuggugccgaucac

SEQ ID NO: 2832396 - RNA, 15 nt, Mycobacterium avium subsp. paratuberculosis
cggauugucgcuguu

SEQ ID NO: 2832397 - RNA, 17 nt, Mycobacterium avium subsp. paratuberculosis
cggauuucucagcggcg

SEQ ID NO: 2832398 - RNA, 16 nt, Mycobacterium avium subsp. paratuberculosis
cggauuugguugcggc

SEQ ID NO: 2832399 - RNA, 20 nt, Mycobacterium avium subsp. paratuberculosis
cggauuugguugcggcaccg

SEQ ID NO: 2832400 - RNA, 15 nt, Mycobacterium avium subsp. paratuberculosis
cggcaaaacgcuggg

SEQ ID NO: 2832401 - RNA, 18 nt, Mycobacterium avium subsp. paratuberculosis
cggcaaaacgcugggcgc

SEQ ID NO: 2832402 - RNA, 19 nt, Mycobacterium avium subsp. paratuberculosis
cggcaaaacgcugggcgcc

SEQ ID NO: 2832403 - RNA, 20 nt, Mycobacterium avium subsp. paratuberculosis
cggcaaaacgcugggcgccg

SEQ ID NO: 2832404 - RNA, 15 nt, Mycobacterium avium subsp. paratuberculosis
cggcaaagcguugcc

SEQ ID NO: 2832405 - RNA, 22 nt, Mycobacterium avium subsp. paratuberculosis
cggcaaagcguugccgcgcgcc

SEQ ID NO: 2832406 - RNA, 16 nt, Mycobacterium avium subsp. paratuberculosis
cggcaacaacgccagc

SEQ ID NO: 2832407 - RNA, 18 nt, Mycobacterium avium subsp. paratuberculosis
cggcaacaacgccagcgu

SEQ ID NO: 2832408 - RNA, 20 nt, Mycobacterium avium subsp. paratuberculosis
cggcaacaacgccagcguga

SEQ ID NO: 2832409 - RNA, 15 nt, Mycobacterium avium subsp. paratuberculosis
cggcaacaccggcgg

SEQ ID NO: 2832410 - RNA, 17 nt, Mycobacterium avium subsp. paratuberculosis
cggcaacaccggcggcg

SEQ ID NO: 2832411 - RNA, 20 nt, Mycobacterium avium subsp. paratuberculosis
cggcaacaccggcggcgacg

SEQ ID NO: 2832412 - RNA, 21 nt, Mycobacterium avium subsp. paratuberculosis
cggcaacaccggcggcgacgg

SEQ ID NO: 2832413 - RNA, 14 nt, Mycobacterium avium subsp. paratuberculosis
cggcaacacgccgg

SEQ ID NO: 2832414 - RNA, 16 nt, Mycobacterium avium subsp. paratuberculosis
cggcaacacgccggcg

SEQ ID NO: 2832415 - RNA, 17 nt, Mycobacterium avium subsp. paratuberculosis
cggcaacacgccggcgg

SEQ ID NO: 2832416 - RNA, 23 nt, Mycobacterium avium subsp. paratuberculosis
cggcaacacguagucgccgaugg

SEQ ID NO: 2832417 - RNA, 22 nt, Mycobacterium avium subsp. paratuberculosis
cggcaacagcaccagcaccacc

SEQ ID NO: 2832418 - RNA, 15 nt, Mycobacterium avium subsp. paratuberculosis
cggcaaccagcuccg

SEQ ID NO: 2832419 - RNA, 16 nt, Mycobacterium avium subsp. paratuberculosis
cggcaaccagcuccgg

SEQ ID NO: 2832420 - RNA, 17 nt, Mycobacterium avium subsp. paratuberculosis
cggcaaccagcuccggc

SEQ ID NO: 2832421 - RNA, 20 nt, Mycobacterium avium subsp. paratuberculosis
cggcaaccagcuccggcaac

SEQ ID NO: 2832422 - RNA, 23 nt, Mycobacterium avium subsp. paratuberculosis
cggcaacccgaccucgucgacgg

SEQ ID NO: 2832423 - RNA, 18 nt, Mycobacterium avium subsp. paratuberculosis
cggcaacccgaucgccga

SEQ ID NO: 2832424 - RNA, 23 nt, Mycobacterium avium subsp. paratuberculosis
cggcaacccgaucgccgagucga

SEQ ID NO: 2832425 - RNA, 13 nt, Mycobacterium avium subsp. paratuberculosis
cggcaaccgccac

SEQ ID NO: 2832426 - RNA, 15 nt, Mycobacterium avium subsp. paratuberculosis
cggcaaccgccacga

SEQ ID NO: 2832427 - RNA, 20 nt, Mycobacterium avium subsp. paratuberculosis
cggcaaccgccacgacgcgg

SEQ ID NO: 2832428 - RNA, 16 nt, Mycobacterium avium subsp. paratuberculosis
cggcaaccgcugcggu

SEQ ID NO: 2832429 - RNA, 14 nt, Mycobacterium avium subsp. paratuberculosis
cggcaaccugggcg

SEQ ID NO: 2832430 - RNA, 18 nt, Mycobacterium avium subsp. paratuberculosis
cggcaaccugggcggcgg

SEQ ID NO: 2832431 - RNA, 20 nt, Mycobacterium avium subsp. paratuberculosis
cggcaaccugggcggcggcg

SEQ ID NO: 2832432 - RNA, 23 nt, Mycobacterium avium subsp. paratuberculosis
cggcaacgaggccagggcccgca

SEQ ID NO: 2832433 - RNA, 16 nt, Mycobacterium avium subsp. paratuberculosis
cggcaacgccagccag

SEQ ID NO: 2832434 - RNA, 14 nt, Mycobacterium avium subsp. paratuberculosis
cggcaacggcggcg

SEQ ID NO: 2832435 - RNA, 16 nt, Mycobacterium avium subsp. paratuberculosis
cggcaacucccgaucg

SEQ ID NO: 2832436 - RNA, 17 nt, Mycobacterium avium subsp. paratuberculosis
cggcaacucccgaucgc

SEQ ID NO: 2832437 - RNA, 16 nt, Mycobacterium avium subsp. paratuberculosis
cggcaacuggccgccc

SEQ ID NO: 2832438 - RNA, 18 nt, Mycobacterium avium subsp. paratuberculosis
cggcaacugggcggccug

SEQ ID NO: 2832439 - RNA, 22 nt, Mycobacterium avium subsp. paratuberculosis
cggcaacugggcggccugcacc

SEQ ID NO: 2832440 - RNA, 21 nt, Mycobacterium avium subsp. paratuberculosis
cggcaagcaguaugcccgccg

SEQ ID NO: 2832441 - RNA, 22 nt, Mycobacterium avium subsp. paratuberculosis
cggcaagcaguaugcccgccgc

SEQ ID NO: 2832442 - RNA, 21 nt, Mycobacterium avium subsp. paratuberculosis
cggcaagcccuuuggcggcca

SEQ ID NO: 2832443 - RNA, 17 nt, Mycobacterium avium subsp. paratuberculosis
cggcaaggugccguccg

SEQ ID NO: 2832444 - RNA, 15 nt, Mycobacterium avium subsp. paratuberculosis
cggcaaguccggguc

SEQ ID NO: 2832445 - RNA, 16 nt, Mycobacterium avium subsp. paratuberculosis
cggcaauccggccccg

SEQ ID NO: 2832446 - RNA, 13 nt, Mycobacterium avium subsp. paratuberculosis
cggcaaucgggac

SEQ ID NO: 2832447 - RNA, 17 nt, Mycobacterium avium subsp. paratuberculosis
cggcaaugaccggcacc

SEQ ID NO: 2832448 - RNA, 15 nt, Mycobacterium avium subsp. paratuberculosis
cggcaaugccguugg

SEQ ID NO: 2832449 - RNA, 22 nt, Mycobacterium avium subsp. paratuberculosis
cggcaaugguugcggcgggccg

SEQ ID NO: 2832450 - RNA, 19 nt, Mycobacterium avium subsp. paratuberculosis
cggcaauugaauucgacca

SEQ ID NO: 2832451 - RNA, 22 nt, Mycobacterium avium subsp. paratuberculosis
cggcacaccagcguucgucgcc

SEQ ID NO: 2832452 - RNA, 19 nt, Mycobacterium avium subsp. paratuberculosis
cggcacaccagguaggcgg

SEQ ID NO: 2832453 - RNA, 13 nt, Mycobacterium avium subsp. paratuberculosis
cggcacaccgagc

SEQ ID NO: 2832454 - RNA, 14 nt, Mycobacterium avium subsp. paratuberculosis
cggcacaccgagcg

SEQ ID NO: 2832455 - RNA, 22 nt, Mycobacterium avium subsp. paratuberculosis
cggcacaggcgaaucggcgcac

SEQ ID NO: 2832456 - RNA, 15 nt, Mycobacterium avium subsp. paratuberculosis
cggcaccaacccgau

SEQ ID NO: 2832457 - RNA, 12 nt, Mycobacterium avium subsp. paratuberculosis
cggcaccaccac

SEQ ID NO: 2832458 - RNA, 20 nt, Mycobacterium avium subsp. paratuberculosis
cggcaccaccacgguggcgc

SEQ ID NO: 2832459 - RNA, 14 nt, Mycobacterium avium subsp. paratuberculosis
cggcaccaccagcg

SEQ ID NO: 2832460 - RNA, 18 nt, Mycobacterium avium subsp. paratuberculosis
cggcaccacccgcggccg

SEQ ID NO: 2832461 - RNA, 19 nt, Mycobacterium avium subsp. paratuberculosis
cggcaccacccgcggccgg

SEQ ID NO: 2832462 - RNA, 14 nt, Mycobacterium avium subsp. paratuberculosis
cggcaccacccggu

SEQ ID NO: 2832463 - RNA, 16 nt, Mycobacterium avium subsp. paratuberculosis
cggcaccacccggucc

SEQ ID NO: 2832464 - RNA, 21 nt, Mycobacterium avium subsp. paratuberculosis
cggcaccacgaucaccagacc

SEQ ID NO: 2832465 - RNA, 19 nt, Mycobacterium avium subsp. paratuberculosis
cggcaccacgcugugcucg

SEQ ID NO: 2832466 - RNA, 23 nt, Mycobacterium avium subsp. paratuberculosis
cggcaccacgcugugcucgacga

SEQ ID NO: 2832467 - RNA, 15 nt, Mycobacterium avium subsp. paratuberculosis
cggcaccagagcgcc

SEQ ID NO: 2832468 - RNA, 16 nt, Mycobacterium avium subsp. paratuberculosis
cggcaccagagcgccg

SEQ ID NO: 2832469 - RNA, 17 nt, Mycobacterium avium subsp. paratuberculosis
cggcaccagagcgccgg

SEQ ID NO: 2832470 - RNA, 18 nt, Mycobacterium avium subsp. paratuberculosis
cggcaccagagcgccgga

SEQ ID NO: 2832471 - RNA, 19 nt, Mycobacterium avium subsp. paratuberculosis
cggcaccagagcgccggac

SEQ ID NO: 2832472 - RNA, 15 nt, Mycobacterium avium subsp. paratuberculosis
cggcaccagcagccg

SEQ ID NO: 2832473 - RNA, 23 nt, Mycobacterium avium subsp. paratuberculosis
cggcaccagcagccgcagcgcgc

SEQ ID NO: 2832474 - RNA, 18 nt, Mycobacterium avium subsp. paratuberculosis
cggcacgaucggcagcgc

SEQ ID NO: 2832475 - RNA, 19 nt, Mycobacterium avium subsp. paratuberculosis
cggcacgaucggcagcgcc

SEQ ID NO: 2832476 - RNA, 20 nt, Mycobacterium avium subsp. paratuberculosis
cggcacgaucggcagcgcca

SEQ ID NO: 2832477 - RNA, 17 nt, Mycobacterium avium subsp. paratuberculosis
cggcacgaucgucgccg

SEQ ID NO: 2832478 - RNA, 18 nt, Mycobacterium avium subsp. paratuberculosis
cggcacgaucgucgccgc

SEQ ID NO: 2832479 - RNA, 20 nt, Mycobacterium avium subsp. paratuberculosis
cggcacgaucgucgccgcca

SEQ ID NO: 2832480 - RNA, 22 nt, Mycobacterium avium subsp. paratuberculosis
cggcacgaucgucgccgccaac

SEQ ID NO: 2832481 - RNA, 14 nt, Mycobacterium avium subsp. paratuberculosis
cggcacgaucucga

SEQ ID NO: 2832482 - RNA, 20 nt, Mycobacterium avium subsp. paratuberculosis
cggcacgaucucgaccaggc

SEQ ID NO: 2832483 - RNA, 18 nt, Mycobacterium avium subsp. paratuberculosis
cggcacgauggcgcggcg

SEQ ID NO: 2832484 - RNA, 19 nt, Mycobacterium avium subsp. paratuberculosis
cggcacgauggcgcggcgc

SEQ ID NO: 2832485 - RNA, 18 nt, Mycobacterium avium subsp. paratuberculosis
cggcacgcccguucgagc

SEQ ID NO: 2832486 - RNA, 23 nt, Mycobacterium avium subsp. paratuberculosis
cggcacgcccguucgagcgccgg

SEQ ID NO: 2832487 - RNA, 11 nt, Mycobacterium avium subsp. paratuberculosis
cggcacgccga

SEQ ID NO: 2832488 - RNA, 17 nt, Mycobacterium avium subsp. paratuberculosis
cggcacgccgaccaccc

SEQ ID NO: 2832489 - RNA, 18 nt, Mycobacterium avium subsp. paratuberculosis
cggcacgccgcucgucgg

SEQ ID NO: 2832490 - RNA, 19 nt, Mycobacterium avium subsp. paratuberculosis
cggcacgccgcucgucggg

SEQ ID NO: 2832491 - RNA, 16 nt, Mycobacterium avium subsp. paratuberculosis
cggcacgccggggccc

SEQ ID NO: 2832492 - RNA, 13 nt, Mycobacterium avium subsp. paratuberculosis
cggcacgcgcgcc

SEQ ID NO: 2832493 - RNA, 14 nt, Mycobacterium avium subsp. paratuberculosis
cggcacgcgucacc

SEQ ID NO: 2832494 - RNA, 15 nt, Mycobacterium avium subsp. paratuberculosis
cggcacgcgucaccg

SEQ ID NO: 2832495 - RNA, 15 nt, Mycobacterium avium subsp. paratuberculosis
cggcacgcugcgcca

SEQ ID NO: 2832496 - RNA, 19 nt, Mycobacterium avium subsp. paratuberculosis
cggcacgcugcgccagccg

SEQ ID NO: 2832497 - RNA, 22 nt, Mycobacterium avium subsp. paratuberculosis
cggcacgcugcgccagccgucg

SEQ ID NO: 2832498 - RNA, 23 nt, Mycobacterium avium subsp. paratuberculosis
cggcacgcugcgccagccgucgc

SEQ ID NO: 2832499 - RNA, 15 nt, Mycobacterium avium subsp. paratuberculosis
cggcacggcaccgcg

SEQ ID NO: 2832500 - RNA, 18 nt, Mycobacterium avium subsp. paratuberculosis
cggcacggcaccgcgagc

SEQ ID NO: 2832501 - RNA, 20 nt, Mycobacterium avium subsp. paratuberculosis
cggcacggcgaggucgggau

SEQ ID NO: 2832502 - RNA, 17 nt, Mycobacterium avium subsp. paratuberculosis
cggcacgggcaccgacg

SEQ ID NO: 2832503 - RNA, 18 nt, Mycobacterium avium subsp. paratuberculosis
cggcacgggcaccgacga

SEQ ID NO: 2832504 - RNA, 17 nt, Mycobacterium avium subsp. paratuberculosis
cggcacggugcacacgc

SEQ ID NO: 2832505 - RNA, 19 nt, Mycobacterium avium subsp. paratuberculosis
cggcacggugcacacgccg

SEQ ID NO: 2832506 - RNA, 23 nt, Mycobacterium avium subsp. paratuberculosis
cggcacggugcacacgccgaggc

SEQ ID NO: 2832507 - RNA, 15 nt, Mycobacterium avium subsp. paratuberculosis
cggcacggugcgggu

SEQ ID NO: 2832508 - RNA, 16 nt, Mycobacterium avium subsp. paratuberculosis
cggcacggugcgggug

SEQ ID NO: 2832509 - RNA, 20 nt, Mycobacterium avium subsp. paratuberculosis
cggcacggugcgggugccga

SEQ ID NO: 2832510 - RNA, 14 nt, Mycobacterium avium subsp. paratuberculosis
cggcacgguggcca

SEQ ID NO: 2832511 - RNA, 18 nt, Mycobacterium avium subsp. paratuberculosis
cggcacgguuggccggcc

SEQ ID NO: 2832512 - RNA, 19 nt, Mycobacterium avium subsp. paratuberculosis
cggcacgguuggccggccc

SEQ ID NO: 2832513 - RNA, 21 nt, Mycobacterium avium subsp. paratuberculosis
cggcacgguuggccggcccgc

SEQ ID NO: 2832514 - RNA, 22 nt, Mycobacterium avium subsp. paratuberculosis
cggcacgguuggccggcccgcc

SEQ ID NO: 2832515 - RNA, 23 nt, Mycobacterium avium subsp. paratuberculosis
cggcacgguuggccggcccgccc

SEQ ID NO: 2832516 - RNA, 15 nt, Mycobacterium avium subsp. paratuberculosis
cggcacgucgagcag

SEQ ID NO: 2832517 - RNA, 16 nt, Mycobacterium avium subsp. paratuberculosis
cggcacgucgagcagu

SEQ ID NO: 2832518 - RNA, 22 nt, Mycobacterium avium subsp. paratuberculosis
cggcacgucgagcuccucggcc

SEQ ID NO: 2832519 - RNA, 20 nt, Mycobacterium avium subsp. paratuberculosis
cggcacgucgagggugaugu

SEQ ID NO: 2832520 - RNA, 12 nt, Mycobacterium avium subsp. paratuberculosis
cggcacgucgcc

SEQ ID NO: 2832521 - RNA, 13 nt, Mycobacterium avium subsp. paratuberculosis
cggcacgucgccg

SEQ ID NO: 2832522 - RNA, 15 nt, Mycobacterium avium subsp. paratuberculosis
cggcacgucgccguu

SEQ ID NO: 2832523 - RNA, 14 nt, Mycobacterium avium subsp. paratuberculosis
cggcacgucggcca

SEQ ID NO: 2832524 - RNA, 15 nt, Mycobacterium avium subsp. paratuberculosis
cggcacgucggccac

SEQ ID NO: 2832525 - RNA, 20 nt, Mycobacterium avium subsp. paratuberculosis
cggcacgucggccacgccgg

SEQ ID NO: 2832526 - RNA, 22 nt, Mycobacterium avium subsp. paratuberculosis
cggcacgugcggguuggcgccg

SEQ ID NO: 2832527 - RNA, 23 nt, Mycobacterium avium subsp. paratuberculosis
cggcacgugcggguuggcgccgg

SEQ ID NO: 2832528 - RNA, 18 nt, Mycobacterium avium subsp. paratuberculosis
cggcacguguccgacgcc

SEQ ID NO: 2832529 - RNA, 16 nt, Mycobacterium avium subsp. paratuberculosis
cggcacguugcccagg

SEQ ID NO: 2832530 - RNA, 17 nt, Mycobacterium avium subsp. paratuberculosis
cggcacguugcccagga

SEQ ID NO: 2832531 - RNA, 14 nt, Mycobacterium avium subsp. paratuberculosis
cggcacuaccgccu

SEQ ID NO: 2832532 - RNA, 15 nt, Mycobacterium avium subsp. paratuberculosis
cggcacuaccgccuc

SEQ ID NO: 2832533 - RNA, 21 nt, Mycobacterium avium subsp. paratuberculosis
cggcacuaccgccucgccagc

SEQ ID NO: 2832534 - RNA, 20 nt, Mycobacterium avium subsp. paratuberculosis
cggcacucgucguggcggug

SEQ ID NO: 2832535 - RNA, 21 nt, Mycobacterium avium subsp. paratuberculosis
cggcacucgucguggcggugc

SEQ ID NO: 2832536 - RNA, 17 nt, Mycobacterium avium subsp. paratuberculosis
cggcacugaaggcgcgg

SEQ ID NO: 2832537 - RNA, 18 nt, Mycobacterium avium subsp. paratuberculosis
cggcacugaaggcgcggg

SEQ ID NO: 2832538 - RNA, 15 nt, Mycobacterium avium subsp. paratuberculosis
cggcacugcccgcau

SEQ ID NO: 2832539 - RNA, 19 nt, Mycobacterium avium subsp. paratuberculosis
cggcacugcugcccgcgac

SEQ ID NO: 2832540 - RNA, 20 nt, Mycobacterium avium subsp. paratuberculosis
cggcacugcugcccgcgacg

SEQ ID NO: 2832541 - RNA, 21 nt, Mycobacterium avium subsp. paratuberculosis
cggcacugcugcccgcgacgg

SEQ ID NO: 2832542 - RNA, 22 nt, Mycobacterium avium subsp. paratuberculosis
cggcacuucgaucaucuccacc

SEQ ID NO: 2832543 - RNA, 14 nt, Mycobacterium avium subsp. paratuberculosis
cggcagaacgacgc

SEQ ID NO: 2832544 - RNA, 16 nt, Mycobacterium avium subsp. paratuberculosis
cggcagaacgacgcca

SEQ ID NO: 2832545 - RNA, 13 nt, Mycobacterium avium subsp. paratuberculosis
cggcagacccagc

SEQ ID NO: 2832546 - RNA, 14 nt, Mycobacterium avium subsp. paratuberculosis
cggcagacccagca

SEQ ID NO: 2832547 - RNA, 20 nt, Mycobacterium avium subsp. paratuberculosis
cggcagacccagcagcggcc

SEQ ID NO: 2832548 - RNA, 22 nt, Mycobacterium avium subsp. paratuberculosis
cggcagacccagcagcggccgg

SEQ ID NO: 2832549 - RNA, 23 nt, Mycobacterium avium subsp. paratuberculosis
cggcagacccagcagcggccggc

SEQ ID NO: 2832550 - RNA, 12 nt, Mycobacterium avium subsp. paratuberculosis
cggcagaccggu

SEQ ID NO: 2832551 - RNA, 16 nt, Mycobacterium avium subsp. paratuberculosis
cggcagaccgguggcg

SEQ ID NO: 2832552 - RNA, 14 nt, Mycobacterium avium subsp. paratuberculosis
cggcagaccguccg

SEQ ID NO: 2832553 - RNA, 17 nt, Mycobacterium avium subsp. paratuberculosis
cggcagauagaucagca

SEQ ID NO: 2832554 - RNA, 16 nt, Mycobacterium avium subsp. paratuberculosis
cggcagaucgcggccc

SEQ ID NO: 2832555 - RNA, 21 nt, Mycobacterium avium subsp. paratuberculosis
cggcagaucgcggcccgccgc

SEQ ID NO: 2832556 - RNA, 21 nt, Mycobacterium avium subsp. paratuberculosis
cggcagaucguugggcauguc

SEQ ID NO: 2832557 - RNA, 22 nt, Mycobacterium avium subsp. paratuberculosis
cggcagaucguugggcaugucg

SEQ ID NO: 2832558 - RNA, 13 nt, Mycobacterium avium subsp. paratuberculosis
cggcagcggugcc

SEQ ID NO: 2832559 - RNA, 15 nt, Mycobacterium avium subsp. paratuberculosis
cggcagcggugccgc

SEQ ID NO: 2832560 - RNA, 17 nt, Mycobacterium avium subsp. paratuberculosis
cggcagcggugccgccc

SEQ ID NO: 2832561 - RNA, 13 nt, Mycobacterium avium subsp. paratuberculosis
cggcagcgucgcc

SEQ ID NO: 2832562 - RNA, 16 nt, Mycobacterium avium subsp. paratuberculosis
cggcagcgucgccagc

SEQ ID NO: 2832563 - RNA, 18 nt, Mycobacterium avium subsp. paratuberculosis
cggcagcgucgccagccg

SEQ ID NO: 2832564 - RNA, 21 nt, Mycobacterium avium subsp. paratuberculosis
cggcagcgucgccagccgccg

SEQ ID NO: 2832565 - RNA, 22 nt, Mycobacterium avium subsp. paratuberculosis
cggcagcgucgccagccgccgg

SEQ ID NO: 2832566 - RNA, 14 nt, Mycobacterium avium subsp. paratuberculosis
cggcagcgucgggc

SEQ ID NO: 2832567 - RNA, 11 nt, Mycobacterium avium subsp. paratuberculosis
cggcagcucgg

SEQ ID NO: 2832568 - RNA, 13 nt, Mycobacterium avium subsp. paratuberculosis
cggcagcucggcg

SEQ ID NO: 2832569 - RNA, 15 nt, Mycobacterium avium subsp. paratuberculosis
cggcagcucggcggc

SEQ ID NO: 2832570 - RNA, 15 nt, Mycobacterium avium subsp. paratuberculosis
cggcagcucgucgac

SEQ ID NO: 2832571 - RNA, 22 nt, Mycobacterium avium subsp. paratuberculosis
cggcagcugaagugcacucggc

SEQ ID NO: 2832572 - RNA, 16 nt, Mycobacterium avium subsp. paratuberculosis
cggcagcugcccgucg

SEQ ID NO: 2832573 - RNA, 19 nt, Mycobacterium avium subsp. paratuberculosis
cggcagcugcccgucggag

SEQ ID NO: 2832574 - RNA, 23 nt, Mycobacterium avium subsp. paratuberculosis
cggcaggaaccgggucagcacca

SEQ ID NO: 2832575 - RNA, 23 nt, Mycobacterium avium subsp. paratuberculosis
cggcaggaauuccagcgacaaca

SEQ ID NO: 2832576 - RNA, 17 nt, Mycobacterium avium subsp. paratuberculosis
cggcaggacgggggccg

SEQ ID NO: 2832577 - RNA, 17 nt, Mycobacterium avium subsp. paratuberculosis
cggcaggauccggacga

SEQ ID NO: 2832578 - RNA, 19 nt, Mycobacterium avium subsp. paratuberculosis
cggcaggauccggacgacc

SEQ ID NO: 2832579 - RNA, 22 nt, Mycobacterium avium subsp. paratuberculosis
cggcaggauccggucgaucacc

SEQ ID NO: 2832580 - RNA, 13 nt, Mycobacterium avium subsp. paratuberculosis
cggcaggccgccc

SEQ ID NO: 2832581 - RNA, 15 nt, Mycobacterium avium subsp. paratuberculosis
cggcaggccgcccga

SEQ ID NO: 2832582 - RNA, 13 nt, Mycobacterium avium subsp. paratuberculosis
cggcaggccgcgg

SEQ ID NO: 2832583 - RNA, 16 nt, Mycobacterium avium subsp. paratuberculosis
cggcaggccgcggccg

SEQ ID NO: 2832584 - RNA, 17 nt, Mycobacterium avium subsp. paratuberculosis
cggcaggccgcggccgu

SEQ ID NO: 2832585 - RNA, 14 nt, Mycobacterium avium subsp. paratuberculosis
cggcaggcgcccca

SEQ ID NO: 2832586 - RNA, 13 nt, Mycobacterium avium subsp. paratuberculosis
cggcaggcggccc

SEQ ID NO: 2832587 - RNA, 15 nt, Mycobacterium avium subsp. paratuberculosis
cggcaggcggcccgc

SEQ ID NO: 2832588 - RNA, 15 nt, Mycobacterium avium subsp. paratuberculosis
cggcaggcucagcag

SEQ ID NO: 2832589 - RNA, 16 nt, Mycobacterium avium subsp. paratuberculosis
cggcaggcucagcagc

SEQ ID NO: 2832590 - RNA, 17 nt, Mycobacterium avium subsp. paratuberculosis
cggcaggcucagcagca

SEQ ID NO: 2832591 - RNA, 20 nt, Mycobacterium avium subsp. paratuberculosis
cggcaggcucagcagcaccg

SEQ ID NO: 2832592 - RNA, 22 nt, Mycobacterium avium subsp. paratuberculosis
cggcaggcucagcagcaccgca

SEQ ID NO: 2832593 - RNA, 14 nt, Mycobacterium avium subsp. paratuberculosis
cggcagggccaccg

SEQ ID NO: 2832594 - RNA, 18 nt, Mycobacterium avium subsp. paratuberculosis
cggcagggccaccgucag

SEQ ID NO: 2832595 - RNA, 22 nt, Mycobacterium avium subsp. paratuberculosis
cggcagggccaccgucagggug

SEQ ID NO: 2832596 - RNA, 13 nt, Mycobacterium avium subsp. paratuberculosis
cggcagggccagc

SEQ ID NO: 2832597 - RNA, 14 nt, Mycobacterium avium subsp. paratuberculosis
cggcagggccagca

SEQ ID NO: 2832598 - RNA, 17 nt, Mycobacterium avium subsp. paratuberculosis
cggcagggccagcacca

SEQ ID NO: 2832599 - RNA, 18 nt, Mycobacterium avium subsp. paratuberculosis
cggcagggccagcaccau

SEQ ID NO: 2832600 - RNA, 16 nt, Mycobacterium avium subsp. paratuberculosis
cggcagggccaggccg

SEQ ID NO: 2832601 - RNA, 14 nt, Mycobacterium avium subsp. paratuberculosis
cggcagguaggcgc

SEQ ID NO: 2832602 - RNA, 16 nt, Mycobacterium avium subsp. paratuberculosis
cggcagguaggcgccg

SEQ ID NO: 2832603 - RNA, 17 nt, Mycobacterium avium subsp. paratuberculosis
cggcagguaggcgccgc

SEQ ID NO: 2832604 - RNA, 22 nt, Mycobacterium avium subsp. paratuberculosis
cggcagguaggcgccgcucgac

SEQ ID NO: 2832605 - RNA, 16 nt, Mycobacterium avium subsp. paratuberculosis
cggcaggucccaggcc

SEQ ID NO: 2832606 - RNA, 13 nt, Mycobacterium avium subsp. paratuberculosis
cggcaggucggcc

SEQ ID NO: 2832607 - RNA, 16 nt, Mycobacterium avium subsp. paratuberculosis
cggcaggucggccagc

SEQ ID NO: 2832608 - RNA, 19 nt, Mycobacterium avium subsp. paratuberculosis
cggcaggucggccagcgcc

SEQ ID NO: 2832609 - RNA, 20 nt, Mycobacterium avium subsp. paratuberculosis
cggcaggucggccagcgccg

SEQ ID NO: 2832610 - RNA, 15 nt, Mycobacterium avium subsp. paratuberculosis
cggcaggucggcggg

SEQ ID NO: 2832611 - RNA, 16 nt, Mycobacterium avium subsp. paratuberculosis
cggcaggucggcggga

SEQ ID NO: 2832612 - RNA, 21 nt, Mycobacterium avium subsp. paratuberculosis
cggcaggucggcgggagccgg

SEQ ID NO: 2832613 - RNA, 14 nt, Mycobacterium avium subsp. paratuberculosis
cggcaggucggugc

SEQ ID NO: 2832614 - RNA, 22 nt, Mycobacterium avium subsp. paratuberculosis
cggcaggucggugcgcggggug

SEQ ID NO: 2832615 - RNA, 14 nt, Mycobacterium avium subsp. paratuberculosis
cggcaggucgucga

SEQ ID NO: 2832616 - RNA, 20 nt, Mycobacterium avium subsp. paratuberculosis
cggcaggucgucgacgucgc

SEQ ID NO: 2832617 - RNA, 16 nt, Mycobacterium avium subsp. paratuberculosis
cggcaggucgucgucg

SEQ ID NO: 2832618 - RNA, 17 nt, Mycobacterium avium subsp. paratuberculosis
cggcaggucgucgucgc

SEQ ID NO: 2832619 - RNA, 18 nt, Mycobacterium avium subsp. paratuberculosis
cggcaggucgucgucgcc

SEQ ID NO: 2832620 - RNA, 20 nt, Mycobacterium avium subsp. paratuberculosis
cggcaggucgucgucgccgc

SEQ ID NO: 2832621 - RNA, 20 nt, Mycobacterium avium subsp. paratuberculosis
cggcagguggauugucggcc

SEQ ID NO: 2832622 - RNA, 21 nt, Mycobacterium avium subsp. paratuberculosis
cggcagguggauugucggccg

SEQ ID NO: 2832623 - RNA, 22 nt, Mycobacterium avium subsp. paratuberculosis
cggcagguggauugucggccgc

SEQ ID NO: 2832624 - RNA, 23 nt, Mycobacterium avium subsp. paratuberculosis
cggcagguggauugucggccgcc

SEQ ID NO: 2832625 - RNA, 20 nt, Mycobacterium avium subsp. paratuberculosis
cggcagguggggcagcaccu

SEQ ID NO: 2832626 - RNA, 19 nt, Mycobacterium avium subsp. paratuberculosis
cggcagguugcgcuggaug

SEQ ID NO: 2832627 - RNA, 20 nt, Mycobacterium avium subsp. paratuberculosis
cggcagguugcgcuggauga

SEQ ID NO: 2832628 - RNA, 14 nt, Mycobacterium avium subsp. paratuberculosis
cggcagguugggga

SEQ ID NO: 2832629 - RNA, 19 nt, Mycobacterium avium subsp. paratuberculosis
cggcagguuggggacggcg

SEQ ID NO: 2832630 - RNA, 22 nt, Mycobacterium avium subsp. paratuberculosis
cggcagguuguugacgacguug

SEQ ID NO: 2832631 - RNA, 15 nt, Mycobacterium avium subsp. paratuberculosis
cggcaguacgcgccg

SEQ ID NO: 2832632 - RNA, 16 nt, Mycobacterium avium subsp. paratuberculosis
cggcaguacgcgccgg

SEQ ID NO: 2832633 - RNA, 17 nt, Mycobacterium avium subsp. paratuberculosis
cggcaguacgcgccggc

SEQ ID NO: 2832634 - RNA, 19 nt, Mycobacterium avium subsp. paratuberculosis
cggcaguacgcgccggccu

SEQ ID NO: 2832635 - RNA, 20 nt, Mycobacterium avium subsp. paratuberculosis
cggcaguagcacuuucgcgg

SEQ ID NO: 2832636 - RNA, 22 nt, Mycobacterium avium subsp. paratuberculosis
cggcaguaucuuguucgccgac

SEQ ID NO: 2832637 - RNA, 14 nt, Mycobacterium avium subsp. paratuberculosis
cggcaguccgcgcc

SEQ ID NO: 2832638 - RNA, 15 nt, Mycobacterium avium subsp. paratuberculosis
cggcaguccgcgccg

SEQ ID NO: 2832639 - RNA, 17 nt, Mycobacterium avium subsp. paratuberculosis
cggcaguccgcgccggu

SEQ ID NO: 2832640 - RNA, 19 nt, Mycobacterium avium subsp. paratuberculosis
cggcaguccgcgccggucc

SEQ ID NO: 2832641 - RNA, 22 nt, Mycobacterium avium subsp. paratuberculosis
cggcaguccggacacggccagc

SEQ ID NO: 2832642 - RNA, 14 nt, Mycobacterium avium subsp. paratuberculosis
cggcagucgcagca

SEQ ID NO: 2832643 - RNA, 21 nt, Mycobacterium avium subsp. paratuberculosis
cggccaacagugcgcaggcgg

SEQ ID NO: 2832644 - RNA, 19 nt, Mycobacterium avium subsp. paratuberculosis
cggccaaccgcccggcgcc

SEQ ID NO: 2832645 - RNA, 15 nt, Mycobacterium avium subsp. paratuberculosis
cggccaaccgggcag

SEQ ID NO: 2832646 - RNA, 14 nt, Mycobacterium avium subsp. paratuberculosis
cggccaacgccucg

SEQ ID NO: 2832647 - RNA, 21 nt, Mycobacterium avium subsp. paratuberculosis
cggccaacgccucgucgaccg

SEQ ID NO: 2832648 - RNA, 13 nt, Mycobacterium avium subsp. paratuberculosis
cggccaacgcgac

SEQ ID NO: 2832649 - RNA, 14 nt, Mycobacterium avium subsp. paratuberculosis
cggccaacgcgacg

SEQ ID NO: 2832650 - RNA, 18 nt, Mycobacterium avium subsp. paratuberculosis
cggccaacgcgacgaagc

SEQ ID NO: 2832651 - RNA, 23 nt, Mycobacterium avium subsp. paratuberculosis
cggccaacgcgacgaagccggug

SEQ ID NO: 2832652 - RNA, 19 nt, Mycobacterium avium subsp. paratuberculosis
cggccaacggauagcgucc

SEQ ID NO: 2832653 - RNA, 20 nt, Mycobacterium avium subsp. paratuberculosis
cggccaacggauagcguccg

SEQ ID NO: 2832654 - RNA, 17 nt, Mycobacterium avium subsp. paratuberculosis
cggccaacgggaagagc

SEQ ID NO: 2832655 - RNA, 22 nt, Mycobacterium avium subsp. paratuberculosis
cggccaacgggaagagcggcgu

SEQ ID NO: 2832656 - RNA, 17 nt, Mycobacterium avium subsp. paratuberculosis
cggccaacugcaucgcc

SEQ ID NO: 2832657 - RNA, 20 nt, Mycobacterium avium subsp. paratuberculosis
cggccaacugcaucgccagc

SEQ ID NO: 2832658 - RNA, 16 nt, Mycobacterium avium subsp. paratuberculosis
cggccaaggcaagucg

SEQ ID NO: 2832659 - RNA, 14 nt, Mycobacterium avium subsp. paratuberculosis
cggccaaucccacc

SEQ ID NO: 2832660 - RNA, 18 nt, Mycobacterium avium subsp. paratuberculosis
cggccaaucccaccauga

SEQ ID NO: 2832661 - RNA, 19 nt, Mycobacterium avium subsp. paratuberculosis
cggccaaucccaccaugag

SEQ ID NO: 2832662 - RNA, 22 nt, Mycobacterium avium subsp. paratuberculosis
cggccaaugaaccauccauuuc

SEQ ID NO: 2832663 - RNA, 17 nt, Mycobacterium avium subsp. paratuberculosis
cggccaauuccucagcc

SEQ ID NO: 2832664 - RNA, 19 nt, Mycobacterium avium subsp. paratuberculosis
cggccaauuccucagcccg

SEQ ID NO: 2832665 - RNA, 23 nt, Mycobacterium avium subsp. paratuberculosis
cggccaauuccucagcccggcag

SEQ ID NO: 2832666 - RNA, 16 nt, Mycobacterium avium subsp. paratuberculosis
cggccacaccgaucag

SEQ ID NO: 2832667 - RNA, 18 nt, Mycobacterium avium subsp. paratuberculosis
cggccacaccgaucagca

SEQ ID NO: 2832668 - RNA, 19 nt, Mycobacterium avium subsp. paratuberculosis
cggccacaccgaucagcau

SEQ ID NO: 2832669 - RNA, 21 nt, Mycobacterium avium subsp. paratuberculosis
cggccacaccgaucagcaugc

SEQ ID NO: 2832670 - RNA, 14 nt, Mycobacterium avium subsp. paratuberculosis
cggccacaccgggg

SEQ ID NO: 2832671 - RNA, 15 nt, Mycobacterium avium subsp. paratuberculosis
cggccacaccggggc

SEQ ID NO: 2832672 - RNA, 20 nt, Mycobacterium avium subsp. paratuberculosis
cggccacaccggggccaggu

SEQ ID NO: 2832673 - RNA, 15 nt, Mycobacterium avium subsp. paratuberculosis
cggccacacuggcgu

SEQ ID NO: 2832674 - RNA, 17 nt, Mycobacterium avium subsp. paratuberculosis
cggccaccaacaggucg

SEQ ID NO: 2832675 - RNA, 17 nt, Mycobacterium avium subsp. paratuberculosis
cggccaccaacggcagc

SEQ ID NO: 2832676 - RNA, 13 nt, Mycobacterium avium subsp. paratuberculosis
cggccaccaccac

SEQ ID NO: 2832677 - RNA, 21 nt, Mycobacterium avium subsp. paratuberculosis
cggccaccaccacggccaugc

SEQ ID NO: 2832678 - RNA, 23 nt, Mycobacterium avium subsp. paratuberculosis
cggccaccaccacggccaugcag

SEQ ID NO: 2832679 - RNA, 12 nt, Mycobacterium avium subsp. paratuberculosis
cggccaccaccg

SEQ ID NO: 2832680 - RNA, 16 nt, Mycobacterium avium subsp. paratuberculosis
cggccaccaccgcauc

SEQ ID NO: 2832681 - RNA, 15 nt, Mycobacterium avium subsp. paratuberculosis
cggccaccaccgcca

SEQ ID NO: 2832682 - RNA, 21 nt, Mycobacterium avium subsp. paratuberculosis
cggccaccaccgccacggcgg

SEQ ID NO: 2832683 - RNA, 12 nt, Mycobacterium avium subsp. paratuberculosis
cggccaccaccu

SEQ ID NO: 2832684 - RNA, 13 nt, Mycobacterium avium subsp. paratuberculosis
cggccaccaccuc

SEQ ID NO: 2832685 - RNA, 16 nt, Mycobacterium avium subsp. paratuberculosis
cggccaccacgacgcc

SEQ ID NO: 2832686 - RNA, 16 nt, Mycobacterium avium subsp. paratuberculosis
cggccaccacgacggg

SEQ ID NO: 2832687 - RNA, 17 nt, Mycobacterium avium subsp. paratuberculosis
cggccaccacggcaccg

SEQ ID NO: 2832688 - RNA, 18 nt, Mycobacterium avium subsp. paratuberculosis
cggccaccacggcaccgc

SEQ ID NO: 2832689 - RNA, 19 nt, Mycobacterium avium subsp. paratuberculosis
cggccaccacggcaccgcc

SEQ ID NO: 2832690 - RNA, 22 nt, Mycobacterium avium subsp. paratuberculosis
cggccaccacggcaccgccgcg

SEQ ID NO: 2832691 - RNA, 12 nt, Mycobacterium avium subsp. paratuberculosis
cggccaccacgu

SEQ ID NO: 2832692 - RNA, 18 nt, Mycobacterium avium subsp. paratuberculosis
cggccaccagaugccggg

SEQ ID NO: 2832693 - RNA, 19 nt, Mycobacterium avium subsp. paratuberculosis
cggccaccagaugccgggc

SEQ ID NO: 2832694 - RNA, 13 nt, Mycobacterium avium subsp. paratuberculosis
cggccaccagcag

SEQ ID NO: 2832695 - RNA, 15 nt, Mycobacterium avium subsp. paratuberculosis
cggccaccagcagcg

SEQ ID NO: 2832696 - RNA, 18 nt, Mycobacterium avium subsp. paratuberculosis
cggccaccagcagcgaga

SEQ ID NO: 2832697 - RNA, 21 nt, Mycobacterium avium subsp. paratuberculosis
cggccaccagcagcgagaccg

SEQ ID NO: 2832698 - RNA, 23 nt, Mycobacterium avium subsp. paratuberculosis
cggccaccagcagcgagaccggc

SEQ ID NO: 2832699 - RNA, 13 nt, Mycobacterium avium subsp. paratuberculosis
cggccaccagccg

SEQ ID NO: 2832700 - RNA, 14 nt, Mycobacterium avium subsp. paratuberculosis
cggccaccagccgg

SEQ ID NO: 2832701 - RNA, 17 nt, Mycobacterium avium subsp. paratuberculosis
cggccaccagccggccg

SEQ ID NO: 2832702 - RNA, 18 nt, Mycobacterium avium subsp. paratuberculosis
cggccaccagccggccgg

SEQ ID NO: 2832703 - RNA, 12 nt, Mycobacterium avium subsp. paratuberculosis
cggccaccagcg

SEQ ID NO: 2832704 - RNA, 13 nt, Mycobacterium avium subsp. paratuberculosis
cggccaccagcgc

SEQ ID NO: 2832705 - RNA, 16 nt, Mycobacterium avium subsp. paratuberculosis
cggccaccagcgcccg

SEQ ID NO: 2832706 - RNA, 19 nt, Mycobacterium avium subsp. paratuberculosis
cggccaccagcgcccgccc

SEQ ID NO: 2832707 - RNA, 20 nt, Mycobacterium avium subsp. paratuberculosis
cggccaccagcgcccgcccg

SEQ ID NO: 2832708 - RNA, 21 nt, Mycobacterium avium subsp. paratuberculosis
cggccaccagcgcccgcccgg

SEQ ID NO: 2832709 - RNA, 14 nt, Mycobacterium avium subsp. paratuberculosis
cggccaccagcgcg

SEQ ID NO: 2832710 - RNA, 15 nt, Mycobacterium avium subsp. paratuberculosis
cggccaccagcgcgg

SEQ ID NO: 2832711 - RNA, 16 nt, Mycobacterium avium subsp. paratuberculosis
cggccaccagcgcggc

SEQ ID NO: 2832712 - RNA, 18 nt, Mycobacterium avium subsp. paratuberculosis
cggccaccagcgcggcca

SEQ ID NO: 2832713 - RNA, 21 nt, Mycobacterium avium subsp. paratuberculosis
cggccaccagcgcggccacca

SEQ ID NO: 2832714 - RNA, 14 nt, Mycobacterium avium subsp. paratuberculosis
cggccaccagcggc

SEQ ID NO: 2832715 - RNA, 15 nt, Mycobacterium avium subsp. paratuberculosis
cggccaccagcggcc

SEQ ID NO: 2832716 - RNA, 16 nt, Mycobacterium avium subsp. paratuberculosis
cggccaccagcggccg

SEQ ID NO: 2832717 - RNA, 18 nt, Mycobacterium avium subsp. paratuberculosis
cggccaccagcggccgga

SEQ ID NO: 2832718 - RNA, 15 nt, Mycobacterium avium subsp. paratuberculosis
cggccaccagggaca

SEQ ID NO: 2832719 - RNA, 18 nt, Mycobacterium avium subsp. paratuberculosis
cggccaccagggcgaccg

SEQ ID NO: 2832720 - RNA, 23 nt, Mycobacterium avium subsp. paratuberculosis
cggccaccagggucucgcgcagc

SEQ ID NO: 2832721 - RNA, 16 nt, Mycobacterium avium subsp. paratuberculosis
cggccaccaucuccgc

SEQ ID NO: 2832722 - RNA, 21 nt, Mycobacterium avium subsp. paratuberculosis
cggccaccaucuccgcggcgc

SEQ ID NO: 2832723 - RNA, 16 nt, Mycobacterium avium subsp. paratuberculosis
cggccaccaugccggc

SEQ ID NO: 2832724 - RNA, 17 nt, Mycobacterium avium subsp. paratuberculosis
cggccaccaugccggcg

SEQ ID NO: 2832725 - RNA, 18 nt, Mycobacterium avium subsp. paratuberculosis
cggccaccaugccggcgu

SEQ ID NO: 2832726 - RNA, 14 nt, Mycobacterium avium subsp. paratuberculosis
cggccaccaugggc

SEQ ID NO: 2832727 - RNA, 15 nt, Mycobacterium avium subsp. paratuberculosis
cggccaccaugggcg

SEQ ID NO: 2832728 - RNA, 23 nt, Mycobacterium avium subsp. paratuberculosis
cggccacgauggggacgucgacg

SEQ ID NO: 2832729 - RNA, 21 nt, Mycobacterium avium subsp. paratuberculosis
cggccacgcccuggccgccgg

SEQ ID NO: 2832730 - RNA, 22 nt, Mycobacterium avium subsp. paratuberculosis
cggccacgcccuggccgccggc

SEQ ID NO: 2832731 - RNA, 14 nt, Mycobacterium avium subsp. paratuberculosis
cggccacgccgggc

SEQ ID NO: 2832732 - RNA, 18 nt, Mycobacterium avium subsp. paratuberculosis
cggccacgccggguuugu

SEQ ID NO: 2832733 - RNA, 19 nt, Mycobacterium avium subsp. paratuberculosis
cggccacgcuagcgugacg

SEQ ID NO: 2832734 - RNA, 13 nt, Mycobacterium avium subsp. paratuberculosis
cggccacgcucgc

SEQ ID NO: 2832735 - RNA, 19 nt, Mycobacterium avium subsp. paratuberculosis
cggccacgcucgccagacc

SEQ ID NO: 2832736 - RNA, 20 nt, Mycobacterium avium subsp. paratuberculosis
cggccacgcucgccagaccg

SEQ ID NO: 2832737 - RNA, 18 nt, Mycobacterium avium subsp. paratuberculosis
cggccacgcucggcggcg

SEQ ID NO: 2832738 - RNA, 23 nt, Mycobacterium avium subsp. paratuberculosis
cggccacgcucggcggcgcgcag

SEQ ID NO: 2832739 - RNA, 19 nt, Mycobacterium avium subsp. paratuberculosis
cggccacgcucgggccggc

SEQ ID NO: 2832740 - RNA, 20 nt, Mycobacterium avium subsp. paratuberculosis
cggccacgcucgggccggcg

SEQ ID NO: 2832741 - RNA, 22 nt, Mycobacterium avium subsp. paratuberculosis
cggccacgcucgggccggcgcc

SEQ ID NO: 2832742 - RNA, 13 nt, Mycobacterium avium subsp. paratuberculosis
cggccacgucgau

SEQ ID NO: 2832743 - RNA, 15 nt, Mycobacterium avium subsp. paratuberculosis
cggccacgucgaugc

SEQ ID NO: 2832744 - RNA, 16 nt, Mycobacterium avium subsp. paratuberculosis
cggccacgucgaugcc

SEQ ID NO: 2832745 - RNA, 17 nt, Mycobacterium avium subsp. paratuberculosis
cggccacgucgaugccg

SEQ ID NO: 2832746 - RNA, 18 nt, Mycobacterium avium subsp. paratuberculosis
cggccacgucgaugccga

SEQ ID NO: 2832747 - RNA, 20 nt, Mycobacterium avium subsp. paratuberculosis
cggccacgucgaugccgaac

SEQ ID NO: 2832748 - RNA, 14 nt, Mycobacterium avium subsp. paratuberculosis
cggccacucgccgc

SEQ ID NO: 2832749 - RNA, 16 nt, Mycobacterium avium subsp. paratuberculosis
cggccacucgccgcga

SEQ ID NO: 2832750 - RNA, 17 nt, Mycobacterium avium subsp. paratuberculosis
cggccacucgccgcgaa

SEQ ID NO: 2832751 - RNA, 21 nt, Mycobacterium avium subsp. paratuberculosis
cggccacucgcguccccgcgc

SEQ ID NO: 2832752 - RNA, 23 nt, Mycobacterium avium subsp. paratuberculosis
cggccacucgcguccccgcgccg

SEQ ID NO: 2832753 - RNA, 13 nt, Mycobacterium avium subsp. paratuberculosis
cggccacugcccc

SEQ ID NO: 2832754 - RNA, 16 nt, Mycobacterium avium subsp. paratuberculosis
cggccacugccccggc

SEQ ID NO: 2832755 - RNA, 19 nt, Mycobacterium avium subsp. paratuberculosis
cggccacugccccggcgaa

SEQ ID NO: 2832756 - RNA, 11 nt, Mycobacterium avium subsp. paratuberculosis
cggccagaccg

SEQ ID NO: 2832757 - RNA, 13 nt, Mycobacterium avium subsp. paratuberculosis
cggccagaccgca

SEQ ID NO: 2832758 - RNA, 20 nt, Mycobacterium avium subsp. paratuberculosis
cggccagaccgcacaauccg

SEQ ID NO: 2832759 - RNA, 17 nt, Mycobacterium avium subsp. paratuberculosis
cggccagauagaugagc

SEQ ID NO: 2832760 - RNA, 19 nt, Mycobacterium avium subsp. paratuberculosis
cggccagaucgacgccgcg

SEQ ID NO: 2832761 - RNA, 21 nt, Mycobacterium avium subsp. paratuberculosis
cggccagaucgacgccgcggu

SEQ ID NO: 2832762 - RNA, 22 nt, Mycobacterium avium subsp. paratuberculosis
cggccagaucgacgccgcggug

SEQ ID NO: 2832763 - RNA, 23 nt, Mycobacterium avium subsp. paratuberculosis
cggccagaucgacgccgcggugg

SEQ ID NO: 2832764 - RNA, 15 nt, Mycobacterium avium subsp. paratuberculosis
cggccagaucggcca

SEQ ID NO: 2832765 - RNA, 13 nt, Mycobacterium avium subsp. paratuberculosis
cggccagcaccac

SEQ ID NO: 2832766 - RNA, 15 nt, Mycobacterium avium subsp. paratuberculosis
cggccagcaccacca

SEQ ID NO: 2832767 - RNA, 14 nt, Mycobacterium avium subsp. paratuberculosis
cggccagcaccacg

SEQ ID NO: 2832768 - RNA, 16 nt, Mycobacterium avium subsp. paratuberculosis
cggccagcaccagcag

SEQ ID NO: 2832769 - RNA, 18 nt, Mycobacterium avium subsp. paratuberculosis
cggccagcaccagcagcc

SEQ ID NO: 2832770 - RNA, 19 nt, Mycobacterium avium subsp. paratuberculosis
cggccagcaccagcagccg

SEQ ID NO: 2832771 - RNA, 21 nt, Mycobacterium avium subsp. paratuberculosis
cggccagcaccagcagccggu

SEQ ID NO: 2832772 - RNA, 14 nt, Mycobacterium avium subsp. paratuberculosis
cggccagcaccagu

SEQ ID NO: 2832773 - RNA, 14 nt, Mycobacterium avium subsp. paratuberculosis
cggccagcacccgc

SEQ ID NO: 2832774 - RNA, 15 nt, Mycobacterium avium subsp. paratuberculosis
cggccagcacccgcu

SEQ ID NO: 2832775 - RNA, 22 nt, Mycobacterium avium subsp. paratuberculosis
cggccagcaccgccagcgccgg

SEQ ID NO: 2832776 - RNA, 13 nt, Mycobacterium avium subsp. paratuberculosis
cggccagcacgaa

SEQ ID NO: 2832777 - RNA, 17 nt, Mycobacterium avium subsp. paratuberculosis
cggccagcacgaacacc

SEQ ID NO: 2832778 - RNA, 16 nt, Mycobacterium avium subsp. paratuberculosis
cggccagcacgccguc

SEQ ID NO: 2832779 - RNA, 17 nt, Mycobacterium avium subsp. paratuberculosis
cggccagcacgccgucc

SEQ ID NO: 2832780 - RNA, 18 nt, Mycobacterium avium subsp. paratuberculosis
cggccagcacgccguccu

SEQ ID NO: 2832781 - RNA, 23 nt, Mycobacterium avium subsp. paratuberculosis
cggccagcacggccagccagccg

SEQ ID NO: 2832782 - RNA, 16 nt, Mycobacterium avium subsp. paratuberculosis
cggccagcacggcggc

SEQ ID NO: 2832783 - RNA, 22 nt, Mycobacterium avium subsp. paratuberculosis
cggccagcacggucagcggcca

SEQ ID NO: 2832784 - RNA, 24 nt, Mycobacterium avium subsp. paratuberculosis
cggccagcacggucagcggccagc

SEQ ID NO: 2832785 - RNA, 12 nt, Mycobacterium avium subsp. paratuberculosis
cggccagcagca

SEQ ID NO: 2832786 - RNA, 13 nt, Mycobacterium avium subsp. paratuberculosis
cggccagcagcac

SEQ ID NO: 2832787 - RNA, 15 nt, Mycobacterium avium subsp. paratuberculosis
cggccagcagcacca

SEQ ID NO: 2832788 - RNA, 20 nt, Mycobacterium avium subsp. paratuberculosis
cggccagcagcaccagggcg

SEQ ID NO: 2832789 - RNA, 15 nt, Mycobacterium avium subsp. paratuberculosis
cggccagcagcaccg

SEQ ID NO: 2832790 - RNA, 14 nt, Mycobacterium avium subsp. paratuberculosis
cggccagcagcagc

SEQ ID NO: 2832791 - RNA, 17 nt, Mycobacterium avium subsp. paratuberculosis
cggccagcagcagcccg

SEQ ID NO: 2832792 - RNA, 15 nt, Mycobacterium avium subsp. paratuberculosis
cggccagcagcaggu

SEQ ID NO: 2832793 - RNA, 21 nt, Mycobacterium avium subsp. paratuberculosis
cggccagcagcagguagcggc

SEQ ID NO: 2832794 - RNA, 12 nt, Mycobacterium avium subsp. paratuberculosis
cggccagcagcc

SEQ ID NO: 2832795 - RNA, 15 nt, Mycobacterium avium subsp. paratuberculosis
cggccagcagcgcgu

SEQ ID NO: 2832796 - RNA, 16 nt, Mycobacterium avium subsp. paratuberculosis
cggccagcagcgcguc

SEQ ID NO: 2832797 - RNA, 15 nt, Mycobacterium avium subsp. paratuberculosis
cggccagcagcggcu

SEQ ID NO: 2832798 - RNA, 20 nt, Mycobacterium avium subsp. paratuberculosis
cggccagcaggaugaugacc

SEQ ID NO: 2832799 - RNA, 18 nt, Mycobacterium avium subsp. paratuberculosis
cggccagcagggcgccga

SEQ ID NO: 2832800 - RNA, 19 nt, Mycobacterium avium subsp. paratuberculosis
cggccagcagggcgccgac

SEQ ID NO: 2832801 - RNA, 20 nt, Mycobacterium avium subsp. paratuberculosis
cggccagcagggcgccgacg

SEQ ID NO: 2832802 - RNA, 21 nt, Mycobacterium avium subsp. paratuberculosis
cggccagcagggcgccgacga

SEQ ID NO: 2832803 - RNA, 15 nt, Mycobacterium avium subsp. paratuberculosis
cggccagcaggucga

SEQ ID NO: 2832804 - RNA, 18 nt, Mycobacterium avium subsp. paratuberculosis
cggccagcaggucgaagg

SEQ ID NO: 2832805 - RNA, 20 nt, Mycobacterium avium subsp. paratuberculosis
cggccagcaggucgucgacg

SEQ ID NO: 2832806 - RNA, 20 nt, Mycobacterium avium subsp. paratuberculosis
cggccagcagugccaacacg

SEQ ID NO: 2832807 - RNA, 13 nt, Mycobacterium avium subsp. paratuberculosis
cggccagcaucgg

SEQ ID NO: 2832808 - RNA, 14 nt, Mycobacterium avium subsp. paratuberculosis
cggccagccacgcc

SEQ ID NO: 2832809 - RNA, 15 nt, Mycobacterium avium subsp. paratuberculosis
cggccagccacgccg

SEQ ID NO: 2832810 - RNA, 21 nt, Mycobacterium avium subsp. paratuberculosis
cggccagccacgccgacaccg

SEQ ID NO: 2832811 - RNA, 14 nt, Mycobacterium avium subsp. paratuberculosis
cggccagccagccg

SEQ ID NO: 2832812 - RNA, 15 nt, Mycobacterium avium subsp. paratuberculosis
cggccagccagccgc

SEQ ID NO: 2832813 - RNA, 18 nt, Mycobacterium avium subsp. paratuberculosis
cggccagcgcggugugcg

SEQ ID NO: 2832814 - RNA, 23 nt, Mycobacterium avium subsp. paratuberculosis
cggccagcgcggugugcggcggc

SEQ ID NO: 2832815 - RNA, 13 nt, Mycobacterium avium subsp. paratuberculosis
cggccagcgcguc

SEQ ID NO: 2832816 - RNA, 15 nt, Mycobacterium avium subsp. paratuberculosis
cggccagcgcgucgg

SEQ ID NO: 2832817 - RNA, 18 nt, Mycobacterium avium subsp. paratuberculosis
cggccagcgcgucggcca

SEQ ID NO: 2832818 - RNA, 21 nt, Mycobacterium avium subsp. paratuberculosis
cggccagcgcgucggccagca

SEQ ID NO: 2832819 - RNA, 14 nt, Mycobacterium avium subsp. paratuberculosis
cggccagcggcagc

SEQ ID NO: 2832820 - RNA, 16 nt, Mycobacterium avium subsp. paratuberculosis
cggccagcggcagcgg

SEQ ID NO: 2832821 - RNA, 20 nt, Mycobacterium avium subsp. paratuberculosis
cggccagcggcagcggcguc

SEQ ID NO: 2832822 - RNA, 23 nt, Mycobacterium avium subsp. paratuberculosis
cggccagcggcagcggcgucguc

SEQ ID NO: 2832823 - RNA, 18 nt, Mycobacterium avium subsp. paratuberculosis
cggccagcggcagcgucg

SEQ ID NO: 2832824 - RNA, 20 nt, Mycobacterium avium subsp. paratuberculosis
cggccagcggcagcgucggg

SEQ ID NO: 2832825 - RNA, 13 nt, Mycobacterium avium subsp. paratuberculosis
cggccagcggcca

SEQ ID NO: 2832826 - RNA, 14 nt, Mycobacterium avium subsp. paratuberculosis
cggccagcggccag

SEQ ID NO: 2832827 - RNA, 20 nt, Mycobacterium avium subsp. paratuberculosis
cggccagcggccagcccgcg

SEQ ID NO: 2832828 - RNA, 22 nt, Mycobacterium avium subsp. paratuberculosis
cggccagcggccagcccgcggc

SEQ ID NO: 2832829 - RNA, 16 nt, Mycobacterium avium subsp. paratuberculosis
cggccagcggcgccga

SEQ ID NO: 2832830 - RNA, 18 nt, Mycobacterium avium subsp. paratuberculosis
cggccagcggcuuggccg

SEQ ID NO: 2832831 - RNA, 21 nt, Mycobacterium avium subsp. paratuberculosis
cggccagcggcuuggccgugc

SEQ ID NO: 2832832 - RNA, 16 nt, Mycobacterium avium subsp. paratuberculosis
cggccagcgggcggcc

SEQ ID NO: 2832833 - RNA, 17 nt, Mycobacterium avium subsp. paratuberculosis
cggccagcgggcggccc

SEQ ID NO: 2832834 - RNA, 22 nt, Mycobacterium avium subsp. paratuberculosis
cggccagcgggcggccccgggc

SEQ ID NO: 2832835 - RNA, 13 nt, Mycobacterium avium subsp. paratuberculosis
cggccagcgggug

SEQ ID NO: 2832836 - RNA, 22 nt, Mycobacterium avium subsp. paratuberculosis
cggccagcgggugauggccgcc

SEQ ID NO: 2832837 - RNA, 22 nt, Mycobacterium avium subsp. paratuberculosis
cggccagcgguugcacggucug

SEQ ID NO: 2832838 - RNA, 14 nt, Mycobacterium avium subsp. paratuberculosis
cggccagcgucgcg

SEQ ID NO: 2832839 - RNA, 16 nt, Mycobacterium avium subsp. paratuberculosis
cggccagcgucgcgcc

SEQ ID NO: 2832840 - RNA, 17 nt, Mycobacterium avium subsp. paratuberculosis
cggccagcgucgcgccg

SEQ ID NO: 2832841 - RNA, 21 nt, Mycobacterium avium subsp. paratuberculosis
cggccagcgucgcgccgccac

SEQ ID NO: 2832842 - RNA, 17 nt, Mycobacterium avium subsp. paratuberculosis
cggccagcgucuccggc

SEQ ID NO: 2832843 - RNA, 18 nt, Mycobacterium avium subsp. paratuberculosis
cggccagcgucuccggcg

SEQ ID NO: 2832844 - RNA, 19 nt, Mycobacterium avium subsp. paratuberculosis
cggccagcgucuccggcgg

SEQ ID NO: 2832845 - RNA, 21 nt, Mycobacterium avium subsp. paratuberculosis
cggccagcgucuccggcgggc

SEQ ID NO: 2832846 - RNA, 14 nt, Mycobacterium avium subsp. paratuberculosis
cggccagcguggcg

SEQ ID NO: 2832847 - RNA, 20 nt, Mycobacterium avium subsp. paratuberculosis
cggccagcguggcgcgcccc

SEQ ID NO: 2832848 - RNA, 21 nt, Mycobacterium avium subsp. paratuberculosis
cggccagcguggcgcgccccg

SEQ ID NO: 2832849 - RNA, 23 nt, Mycobacterium avium subsp. paratuberculosis
cggccagcguggcgcgccccggc

SEQ ID NO: 2832850 - RNA, 16 nt, Mycobacterium avium subsp. paratuberculosis
cggccagcucaccggc

SEQ ID NO: 2832851 - RNA, 19 nt, Mycobacterium avium subsp. paratuberculosis
cggccagcucaccggccag

SEQ ID NO: 2832852 - RNA, 23 nt, Mycobacterium avium subsp. paratuberculosis
cggccagcucaccggccagggcc

SEQ ID NO: 2832853 - RNA, 14 nt, Mycobacterium avium subsp. paratuberculosis
cggccagcucccgg

SEQ ID NO: 2832854 - RNA, 16 nt, Mycobacterium avium subsp. paratuberculosis
cggccagcucccgggc

SEQ ID NO: 2832855 - RNA, 19 nt, Mycobacterium avium subsp. paratuberculosis
cggccagcucccgggcggc

SEQ ID NO: 2832856 - RNA, 21 nt, Mycobacterium avium subsp. paratuberculosis
cggccagcucccgggcggcgc

SEQ ID NO: 2832857 - RNA, 19 nt, Mycobacterium avium subsp. paratuberculosis
cggccagcuccgccacccu

SEQ ID NO: 2832858 - RNA, 22 nt, Mycobacterium avium subsp. paratuberculosis
cggccagcuccgggucgaccgc

SEQ ID NO: 2832859 - RNA, 14 nt, Mycobacterium avium subsp. paratuberculosis
cggccagcucgagc

SEQ ID NO: 2832860 - RNA, 21 nt, Mycobacterium avium subsp. paratuberculosis
cggccagcucgagcaucacga

SEQ ID NO: 2832861 - RNA, 15 nt, Mycobacterium avium subsp. paratuberculosis
cggccagcucggccc

SEQ ID NO: 2832862 - RNA, 14 nt, Mycobacterium avium subsp. paratuberculosis
cggccagcugaaca

SEQ ID NO: 2832863 - RNA, 19 nt, Mycobacterium avium subsp. paratuberculosis
cggccagcugauagccgcc

SEQ ID NO: 2832864 - RNA, 20 nt, Mycobacterium avium subsp. paratuberculosis
cggccagcugauagccgccc

SEQ ID NO: 2832865 - RNA, 22 nt, Mycobacterium avium subsp. paratuberculosis
cggccagcugauagccgcccug

SEQ ID NO: 2832866 - RNA, 15 nt, Mycobacterium avium subsp. paratuberculosis
cggccagcugcccgc

SEQ ID NO: 2832867 - RNA, 18 nt, Mycobacterium avium subsp. paratuberculosis
cggccagcugcccgccga

SEQ ID NO: 2832868 - RNA, 20 nt, Mycobacterium avium subsp. paratuberculosis
cggccagcugcccgccgacg

SEQ ID NO: 2832869 - RNA, 22 nt, Mycobacterium avium subsp. paratuberculosis
cggccagcugcccgccgacgcc

SEQ ID NO: 2832870 - RNA, 15 nt, Mycobacterium avium subsp. paratuberculosis
cggccagcugcgggu

SEQ ID NO: 2832871 - RNA, 15 nt, Mycobacterium avium subsp. paratuberculosis
cggccagcuggucgu

SEQ ID NO: 2832872 - RNA, 18 nt, Mycobacterium avium subsp. paratuberculosis
cggccagcuuuccggccg

SEQ ID NO: 2832873 - RNA, 19 nt, Mycobacterium avium subsp. paratuberculosis
cggccagcuuuccggccgc

SEQ ID NO: 2832874 - RNA, 22 nt, Mycobacterium avium subsp. paratuberculosis
cggccagcuuuccggccgccuc

SEQ ID NO: 2832875 - RNA, 19 nt, Mycobacterium avium subsp. paratuberculosis
cggccaggaaccaccggaa

SEQ ID NO: 2832876 - RNA, 13 nt, Mycobacterium avium subsp. paratuberculosis
cggccaggaagcc

SEQ ID NO: 2832877 - RNA, 18 nt, Mycobacterium avium subsp. paratuberculosis
cggccaggaagccggcga

SEQ ID NO: 2832878 - RNA, 20 nt, Mycobacterium avium subsp. paratuberculosis
cggccaggaagccggcgacg

SEQ ID NO: 2832879 - RNA, 19 nt, Mycobacterium avium subsp. paratuberculosis
cggccaggaucucgcgggc

SEQ ID NO: 2832880 - RNA, 21 nt, Mycobacterium avium subsp. paratuberculosis
cggccaggaucucgcgggccc

SEQ ID NO: 2832881 - RNA, 21 nt, Mycobacterium avium subsp. paratuberculosis
cggccaggaucuugucggcgg

SEQ ID NO: 2832882 - RNA, 23 nt, Mycobacterium avium subsp. paratuberculosis
cggccaggaucuugucggcggcc

SEQ ID NO: 2832883 - RNA, 16 nt, Mycobacterium avium subsp. paratuberculosis
cggccaggcacagcag

SEQ ID NO: 2832884 - RNA, 22 nt, Mycobacterium avium subsp. paratuberculosis
cggccaggcacagcagggcacc

SEQ ID NO: 2832885 - RNA, 23 nt, Mycobacterium avium subsp. paratuberculosis
cggccaggcacagcagggcaccg

SEQ ID NO: 2832886 - RNA, 13 nt, Mycobacterium avium subsp. paratuberculosis
cggccaggcccag

SEQ ID NO: 2832887 - RNA, 16 nt, Mycobacterium avium subsp. paratuberculosis
cggccaggcccagccc

SEQ ID NO: 2832888 - RNA, 19 nt, Mycobacterium avium subsp. paratuberculosis
cggccaggccggccugccg

SEQ ID NO: 2832889 - RNA, 22 nt, Mycobacterium avium subsp. paratuberculosis
cggccaggccggccugccggau

SEQ ID NO: 2832890 - RNA, 17 nt, Mycobacterium avium subsp. paratuberculosis
cggccaggccggcgacg

SEQ ID NO: 2832891 - RNA, 13 nt, Mycobacterium avium subsp. paratuberculosis
cggccaggcgccc

SEQ ID NO: 2832892 - RNA, 14 nt, Mycobacterium avium subsp. paratuberculosis
cggccaggcgccca

SEQ ID NO: 2832893 - RNA, 16 nt, Mycobacterium avium subsp. paratuberculosis
cggccaggcgcccagc

SEQ ID NO: 2832894 - RNA, 23 nt, Mycobacterium avium subsp. paratuberculosis
cggccaggcgcccagcacccggu

SEQ ID NO: 2832895 - RNA, 16 nt, Mycobacterium avium subsp. paratuberculosis
cggccagggccgccgc

SEQ ID NO: 2832896 - RNA, 18 nt, Mycobacterium avium subsp. paratuberculosis
cggccagggccgccgcau

SEQ ID NO: 2832897 - RNA, 14 nt, Mycobacterium avium subsp. paratuberculosis
cggccaucucggcg

SEQ ID NO: 2832898 - RNA, 15 nt, Mycobacterium avium subsp. paratuberculosis
cggccaucucggcgg

SEQ ID NO: 2832899 - RNA, 16 nt, Mycobacterium avium subsp. paratuberculosis
cggccaucucggcggc

SEQ ID NO: 2832900 - RNA, 22 nt, Mycobacterium avium subsp. paratuberculosis
cggccaucucgugcccgggccc

SEQ ID NO: 2832901 - RNA, 18 nt, Mycobacterium avium subsp. paratuberculosis
cggccaucugcgcgacga

SEQ ID NO: 2832902 - RNA, 17 nt, Mycobacterium avium subsp. paratuberculosis
cggccaugaccaugucg

SEQ ID NO: 2832903 - RNA, 18 nt, Mycobacterium avium subsp. paratuberculosis
cggccaugaccaugucga

SEQ ID NO: 2832904 - RNA, 20 nt, Mycobacterium avium subsp. paratuberculosis
cggccaugaccaugucgacg

SEQ ID NO: 2832905 - RNA, 23 nt, Mycobacterium avium subsp. paratuberculosis
cggccaugaccaugucgacgcug

SEQ ID NO: 2832906 - RNA, 15 nt, Mycobacterium avium subsp. paratuberculosis
cggccaugcagacca

SEQ ID NO: 2832907 - RNA, 18 nt, Mycobacterium avium subsp. paratuberculosis
cggccaugcagaccagcc

SEQ ID NO: 2832908 - RNA, 23 nt, Mycobacterium avium subsp. paratuberculosis
cggccaugcagaccagcccgucg

SEQ ID NO: 2832909 - RNA, 18 nt, Mycobacterium avium subsp. paratuberculosis
cggccaugcccucgaucg

SEQ ID NO: 2832910 - RNA, 14 nt, Mycobacterium avium subsp. paratuberculosis
cggccaugccgcgc

SEQ ID NO: 2832911 - RNA, 17 nt, Mycobacterium avium subsp. paratuberculosis
cggccaugccgcgcuug

SEQ ID NO: 2832912 - RNA, 21 nt, Mycobacterium avium subsp. paratuberculosis
cggccauggucgcggccgugu

SEQ ID NO: 2832913 - RNA, 20 nt, Mycobacterium avium subsp. paratuberculosis
cggccauggugccgccguug

SEQ ID NO: 2832914 - RNA, 15 nt, Mycobacterium avium subsp. paratuberculosis
cggccaugucggagc

SEQ ID NO: 2832915 - RNA, 22 nt, Mycobacterium avium subsp. paratuberculosis
cggccauucaucgcgcaccagg

SEQ ID NO: 2832916 - RNA, 15 nt, Mycobacterium avium subsp. paratuberculosis
cggcccaacacgccc

SEQ ID NO: 2832917 - RNA, 17 nt, Mycobacterium avium subsp. paratuberculosis
cggcccaacacgcccug

SEQ ID NO: 2832918 - RNA, 18 nt, Mycobacterium avium subsp. paratuberculosis
cggcccaacacgcccugc

SEQ ID NO: 2832919 - RNA, 22 nt, Mycobacterium avium subsp. paratuberculosis
cggcccaacacgcccugcaggu

SEQ ID NO: 2832920 - RNA, 12 nt, Mycobacterium avium subsp. paratuberculosis
cggcccaaccgg

SEQ ID NO: 2832921 - RNA, 15 nt, Mycobacterium avium subsp. paratuberculosis
cggcccaagacccgc

SEQ ID NO: 2832922 - RNA, 18 nt, Mycobacterium avium subsp. paratuberculosis
cggcccaagacccgcguc

SEQ ID NO: 2832923 - RNA, 19 nt, Mycobacterium avium subsp. paratuberculosis
cggcccaagacccgcguca

SEQ ID NO: 2832924 - RNA, 17 nt, Mycobacterium avium subsp. paratuberculosis
cggcccaccaccgccuc

SEQ ID NO: 2832925 - RNA, 21 nt, Mycobacterium avium subsp. paratuberculosis
cggcccaccaccgccucgacg

SEQ ID NO: 2832926 - RNA, 22 nt, Mycobacterium avium subsp. paratuberculosis
cggcccaccaccgccucgacgg

SEQ ID NO: 2832927 - RNA, 18 nt, Mycobacterium avium subsp. paratuberculosis
cggcccacccgcagggcg

SEQ ID NO: 2832928 - RNA, 12 nt, Mycobacterium avium subsp. paratuberculosis
cggcccacccgg

SEQ ID NO: 2832929 - RNA, 13 nt, Mycobacterium avium subsp. paratuberculosis
cggcccacccgga

SEQ ID NO: 2832930 - RNA, 13 nt, Mycobacterium avium subsp. paratuberculosis
cggcccaccgcga

SEQ ID NO: 2832931 - RNA, 21 nt, Mycobacterium avium subsp. paratuberculosis
cggcccaccgcgacccggccg

SEQ ID NO: 2832932 - RNA, 22 nt, Mycobacterium avium subsp. paratuberculosis
cggcccaccgcgacccggccga

SEQ ID NO: 2832933 - RNA, 15 nt, Mycobacterium avium subsp. paratuberculosis
cggcccaccgcgucg

SEQ ID NO: 2832934 - RNA, 13 nt, Mycobacterium avium subsp. paratuberculosis
cggcccaccggcc

SEQ ID NO: 2832935 - RNA, 15 nt, Mycobacterium avium subsp. paratuberculosis
cggcccaccggcccg

SEQ ID NO: 2832936 - RNA, 13 nt, Mycobacterium avium subsp. paratuberculosis
cggcccacgccgu

SEQ ID NO: 2832937 - RNA, 18 nt, Mycobacterium avium subsp. paratuberculosis
cggcccacgccgucgucg

SEQ ID NO: 2832938 - RNA, 15 nt, Mycobacterium avium subsp. paratuberculosis
cggcccacggugauu

SEQ ID NO: 2832939 - RNA, 23 nt, Mycobacterium avium subsp. paratuberculosis
cggcccacggugauuccggcacc

SEQ ID NO: 2832940 - RNA, 16 nt, Mycobacterium avium subsp. paratuberculosis
cggcccacgucgcgcc

SEQ ID NO: 2832941 - RNA, 17 nt, Mycobacterium avium subsp. paratuberculosis
cggcccacgucgcgccg

SEQ ID NO: 2832942 - RNA, 18 nt, Mycobacterium avium subsp. paratuberculosis
cggcccacgucgcgccga

SEQ ID NO: 2832943 - RNA, 21 nt, Mycobacterium avium subsp. paratuberculosis
cggcccagacgguuccaccgg

SEQ ID NO: 2832944 - RNA, 23 nt, Mycobacterium avium subsp. paratuberculosis
cggcccagacgguuccaccgguc

SEQ ID NO: 2832945 - RNA, 21 nt, Mycobacterium avium subsp. paratuberculosis
cggcccagaucgcgguccacc

SEQ ID NO: 2832946 - RNA, 14 nt, Mycobacterium avium subsp. paratuberculosis
cggcccagcaccac

SEQ ID NO: 2832947 - RNA, 18 nt, Mycobacterium avium subsp. paratuberculosis
cggcccagcagcgucacg

SEQ ID NO: 2832948 - RNA, 14 nt, Mycobacterium avium subsp. paratuberculosis
cggcccagcccggc

SEQ ID NO: 2832949 - RNA, 17 nt, Mycobacterium avium subsp. paratuberculosis
cggcccagcccggccag

SEQ ID NO: 2832950 - RNA, 20 nt, Mycobacterium avium subsp. paratuberculosis
cggcccagcccggccagcac

SEQ ID NO: 2832951 - RNA, 14 nt, Mycobacterium avium subsp. paratuberculosis
cggcccagccgcug

SEQ ID NO: 2832952 - RNA, 12 nt, Mycobacterium avium subsp. paratuberculosis
cggcccagccgg

SEQ ID NO: 2832953 - RNA, 13 nt, Mycobacterium avium subsp. paratuberculosis
cggcccagccggc

SEQ ID NO: 2832954 - RNA, 15 nt, Mycobacterium avium subsp. paratuberculosis
cggcccagccggcgg

SEQ ID NO: 2832955 - RNA, 16 nt, Mycobacterium avium subsp. paratuberculosis
cggcccagccggcggu

SEQ ID NO: 2832956 - RNA, 18 nt, Mycobacterium avium subsp. paratuberculosis
cggcccagccggcggugc

SEQ ID NO: 2832957 - RNA, 17 nt, Mycobacterium avium subsp. paratuberculosis
cggcccagccuucgccg

SEQ ID NO: 2832958 - RNA, 13 nt, Mycobacterium avium subsp. paratuberculosis
cggcccagcgcgc

SEQ ID NO: 2832959 - RNA, 16 nt, Mycobacterium avium subsp. paratuberculosis
cggcccagcgcgcggc

SEQ ID NO: 2832960 - RNA, 16 nt, Mycobacterium avium subsp. paratuberculosis
cggcccagcgcggugu

SEQ ID NO: 2832961 - RNA, 21 nt, Mycobacterium avium subsp. paratuberculosis
cggcccagcgucaacucgucg

SEQ ID NO: 2832962 - RNA, 21 nt, Mycobacterium avium subsp. paratuberculosis
cggcccagcuccacgcguagc

SEQ ID NO: 2832963 - RNA, 23 nt, Mycobacterium avium subsp. paratuberculosis
cggcccagcuccacgcguagccg

SEQ ID NO: 2832964 - RNA, 15 nt, Mycobacterium avium subsp. paratuberculosis
cggcccagcucggug

SEQ ID NO: 2832965 - RNA, 13 nt, Mycobacterium avium subsp. paratuberculosis
cggcccaggcaca

SEQ ID NO: 2832966 - RNA, 15 nt, Mycobacterium avium subsp. paratuberculosis
cggcccaggcacagc

SEQ ID NO: 2832967 - RNA, 18 nt, Mycobacterium avium subsp. paratuberculosis
cggcccaggcacagcgaa

SEQ ID NO: 2832968 - RNA, 21 nt, Mycobacterium avium subsp. paratuberculosis
cggcccaggcaguagccgauc

SEQ ID NO: 2832969 - RNA, 16 nt, Mycobacterium avium subsp. paratuberculosis
cggcccaggccaacag

SEQ ID NO: 2832970 - RNA, 20 nt, Mycobacterium avium subsp. paratuberculosis
cggcccagguauucguugcc

SEQ ID NO: 2832971 - RNA, 20 nt, Mycobacterium avium subsp. paratuberculosis
cggcccagguucuccggccc

SEQ ID NO: 2832972 - RNA, 21 nt, Mycobacterium avium subsp. paratuberculosis
cggcccagguucuccggcccg

SEQ ID NO: 2832973 - RNA, 22 nt, Mycobacterium avium subsp. paratuberculosis
cggcccagguucuccggcccgc

SEQ ID NO: 2832974 - RNA, 23 nt, Mycobacterium avium subsp. paratuberculosis
cggcccagguucuccggcccgcu

SEQ ID NO: 2832975 - RNA, 20 nt, Mycobacterium avium subsp. paratuberculosis
cggcccaguccagucgcgcc

SEQ ID NO: 2832976 - RNA, 21 nt, Mycobacterium avium subsp. paratuberculosis
cggcccaguccagucgcgccg

SEQ ID NO: 2832977 - RNA, 23 nt, Mycobacterium avium subsp. paratuberculosis
cggcccaguccagucgcgccgag

SEQ ID NO: 2832978 - RNA, 20 nt, Mycobacterium avium subsp. paratuberculosis
cggcccaguggaucggcccg

SEQ ID NO: 2832979 - RNA, 21 nt, Mycobacterium avium subsp. paratuberculosis
cggcccaguggaucggcccga

SEQ ID NO: 2832980 - RNA, 23 nt, Mycobacterium avium subsp. paratuberculosis
cggcccaguggaucggcccgacg

SEQ ID NO: 2832981 - RNA, 21 nt, Mycobacterium avium subsp. paratuberculosis
cggcccgagugugcauccugg

SEQ ID NO: 2832982 - RNA, 16 nt, Mycobacterium avium subsp. paratuberculosis
cggcccgauaggccga

SEQ ID NO: 2832983 - RNA, 18 nt, Mycobacterium avium subsp. paratuberculosis
cggcccgauaggccgacu

SEQ ID NO: 2832984 - RNA, 12 nt, Mycobacterium avium subsp. paratuberculosis
cggcccgaucac

SEQ ID NO: 2832985 - RNA, 14 nt, Mycobacterium avium subsp. paratuberculosis
cggcccgaucacca

SEQ ID NO: 2832986 - RNA, 15 nt, Mycobacterium avium subsp. paratuberculosis
cggcccgaucaccag

SEQ ID NO: 2832987 - RNA, 17 nt, Mycobacterium avium subsp. paratuberculosis
cggcccgaucaccaggc

SEQ ID NO: 2832988 - RNA, 19 nt, Mycobacterium avium subsp. paratuberculosis
cggcccgaucaccaggccc

SEQ ID NO: 2832989 - RNA, 15 nt, Mycobacterium avium subsp. paratuberculosis
cggcccgaucaccgc

SEQ ID NO: 2832990 - RNA, 17 nt, Mycobacterium avium subsp. paratuberculosis
cggcccgaucaccgccg

SEQ ID NO: 2832991 - RNA, 13 nt, Mycobacterium avium subsp. paratuberculosis
cggcccgaucgcg

SEQ ID NO: 2832992 - RNA, 17 nt, Mycobacterium avium subsp. paratuberculosis
cggcccgaucgcggcga

SEQ ID NO: 2832993 - RNA, 23 nt, Mycobacterium avium subsp. paratuberculosis
cggcccgaucgcgucgacgaugg

SEQ ID NO: 2832994 - RNA, 20 nt, Mycobacterium avium subsp. paratuberculosis
cggcccgaucucgcgcgggu

SEQ ID NO: 2832995 - RNA, 21 nt, Mycobacterium avium subsp. paratuberculosis
cggcccgaucucgcgcggguc

SEQ ID NO: 2832996 - RNA, 16 nt, Mycobacterium avium subsp. paratuberculosis
cggcccgaugcggacc

SEQ ID NO: 2832997 - RNA, 17 nt, Mycobacterium avium subsp. paratuberculosis
cggcccgaugcggaccg

SEQ ID NO: 2832998 - RNA, 15 nt, Mycobacterium avium subsp. paratuberculosis
cggcccgcacggccg

SEQ ID NO: 2832999 - RNA, 12 nt, Mycobacterium avium subsp. paratuberculosis
cggcccgcagcc

SEQ ID NO: 2833000 - RNA, 18 nt, Mycobacterium avium subsp. paratuberculosis
cggcccgcagccagcgca

SEQ ID NO: 2833001 - RNA, 14 nt, Mycobacterium avium subsp. paratuberculosis
cggcccgcagcgcc

SEQ ID NO: 2833002 - RNA, 15 nt, Mycobacterium avium subsp. paratuberculosis
cggcccgcagcgccu

SEQ ID NO: 2833003 - RNA, 16 nt, Mycobacterium avium subsp. paratuberculosis
cggcccgcagcgccuc

SEQ ID NO: 2833004 - RNA, 19 nt, Mycobacterium avium subsp. paratuberculosis
cggcccgcagcgccucggc

SEQ ID NO: 2833005 - RNA, 23 nt, Mycobacterium avium subsp. paratuberculosis
cggcccgcagcgccucggcgugg

SEQ ID NO: 2833006 - RNA, 20 nt, Mycobacterium avium subsp. paratuberculosis
cggcccgcaggaucgagccg

SEQ ID NO: 2833007 - RNA, 21 nt, Mycobacterium avium subsp. paratuberculosis
cggcccgcaggaucgagccgg

SEQ ID NO: 2833008 - RNA, 22 nt, Mycobacterium avium subsp. paratuberculosis
cggcccgcaggaucgagccggc

SEQ ID NO: 2833009 - RNA, 22 nt, Mycobacterium avium subsp. paratuberculosis
cggcccgcaucgaauccacgaa

SEQ ID NO: 2833010 - RNA, 15 nt, Mycobacterium avium subsp. paratuberculosis
cggcccgcaucgacg

SEQ ID NO: 2833011 - RNA, 14 nt, Mycobacterium avium subsp. paratuberculosis
cggcccgcaucgcg

SEQ ID NO: 2833012 - RNA, 14 nt, Mycobacterium avium subsp. paratuberculosis
cggcccgccacccg

SEQ ID NO: 2833013 - RNA, 19 nt, Mycobacterium avium subsp. paratuberculosis
cggcccgccacccgaggcc

SEQ ID NO: 2833014 - RNA, 14 nt, Mycobacterium avium subsp. paratuberculosis
cggcccgcccggcg

SEQ ID NO: 2833015 - RNA, 15 nt, Mycobacterium avium subsp. paratuberculosis
cggcccgcccggcgg

SEQ ID NO: 2833016 - RNA, 16 nt, Mycobacterium avium subsp. paratuberculosis
cggcccgcccggcggc

SEQ ID NO: 2833017 - RNA, 17 nt, Mycobacterium avium subsp. paratuberculosis
cggcccgcccggcggcg

SEQ ID NO: 2833018 - RNA, 20 nt, Mycobacterium avium subsp. paratuberculosis
cggcccgcccggcggcgcug

SEQ ID NO: 2833019 - RNA, 15 nt, Mycobacterium avium subsp. paratuberculosis
cggcccgcccguaga

SEQ ID NO: 2833020 - RNA, 13 nt, Mycobacterium avium subsp. paratuberculosis
cggcccgccgaac

SEQ ID NO: 2833021 - RNA, 16 nt, Mycobacterium avium subsp. paratuberculosis
cggcccgccgaacgcc

SEQ ID NO: 2833022 - RNA, 13 nt, Mycobacterium avium subsp. paratuberculosis
cggcccgccgccg

SEQ ID NO: 2833023 - RNA, 16 nt, Mycobacterium avium subsp. paratuberculosis
cggcccgccgccggcg

SEQ ID NO: 2833024 - RNA, 22 nt, Mycobacterium avium subsp. paratuberculosis
cggcccgccgccggcggcgucc

SEQ ID NO: 2833025 - RNA, 12 nt, Mycobacterium avium subsp. paratuberculosis
cggcccgccgcg

SEQ ID NO: 2833026 - RNA, 14 nt, Mycobacterium avium subsp. paratuberculosis
cggcccgccgcgcc

SEQ ID NO: 2833027 - RNA, 15 nt, Mycobacterium avium subsp. paratuberculosis
cggcccgccgcgccc

SEQ ID NO: 2833028 - RNA, 16 nt, Mycobacterium avium subsp. paratuberculosis
cggcccgccgcgcccg

SEQ ID NO: 2833029 - RNA, 18 nt, Mycobacterium avium subsp. paratuberculosis
cggcccgccgcgcccggc

SEQ ID NO: 2833030 - RNA, 20 nt, Mycobacterium avium subsp. paratuberculosis
cggcccgccgcucaccgccg

SEQ ID NO: 2833031 - RNA, 17 nt, Mycobacterium avium subsp. paratuberculosis
cggcccgccgcugcagc

SEQ ID NO: 2833032 - RNA, 11 nt, Mycobacterium avium subsp. paratuberculosis
cggcccgccgg

SEQ ID NO: 2833033 - RNA, 14 nt, Mycobacterium avium subsp. paratuberculosis
cggcccgccggaac

SEQ ID NO: 2833034 - RNA, 20 nt, Mycobacterium avium subsp. paratuberculosis
cggcccgccggagccgaucg

SEQ ID NO: 2833035 - RNA, 13 nt, Mycobacterium avium subsp. paratuberculosis
cggcccgccgggc

SEQ ID NO: 2833036 - RNA, 14 nt, Mycobacterium avium subsp. paratuberculosis
cggcccgccgggcg

SEQ ID NO: 2833037 - RNA, 12 nt, Mycobacterium avium subsp. paratuberculosis
cggcccgccucg

SEQ ID NO: 2833038 - RNA, 14 nt, Mycobacterium avium subsp. paratuberculosis
cggcccgccucggc

SEQ ID NO: 2833039 - RNA, 17 nt, Mycobacterium avium subsp. paratuberculosis
cggcccgccucggcggc

SEQ ID NO: 2833040 - RNA, 18 nt, Mycobacterium avium subsp. paratuberculosis
cggcccgccucggcggcc

SEQ ID NO: 2833041 - RNA, 22 nt, Mycobacterium avium subsp. paratuberculosis
cggcccgccucggcggccgccu

SEQ ID NO: 2833042 - RNA, 11 nt, Mycobacterium avium subsp. paratuberculosis
cggcccgcgcc

SEQ ID NO: 2833043 - RNA, 14 nt, Mycobacterium avium subsp. paratuberculosis
cggcccgcgccccg

SEQ ID NO: 2833044 - RNA, 15 nt, Mycobacterium avium subsp. paratuberculosis
cggcccgcgccccgg

SEQ ID NO: 2833045 - RNA, 16 nt, Mycobacterium avium subsp. paratuberculosis
cggcccgcgccccggc

SEQ ID NO: 2833046 - RNA, 17 nt, Mycobacterium avium subsp. paratuberculosis
cggcccgcgccccggcg

SEQ ID NO: 2833047 - RNA, 19 nt, Mycobacterium avium subsp. paratuberculosis
cggcccgcgccccggcggc

SEQ ID NO: 2833048 - RNA, 17 nt, Mycobacterium avium subsp. paratuberculosis
cggcccgcgccggcgug

SEQ ID NO: 2833049 - RNA, 13 nt, Mycobacterium avium subsp. paratuberculosis
cggcccgcggcac

SEQ ID NO: 2833050 - RNA, 14 nt, Mycobacterium avium subsp. paratuberculosis
cggcccgcggcacg

SEQ ID NO: 2833051 - RNA, 19 nt, Mycobacterium avium subsp. paratuberculosis
cggcccgcggcacgcugcg

SEQ ID NO: 2833052 - RNA, 14 nt, Mycobacterium avium subsp. paratuberculosis
cggcccgcggcauc

SEQ ID NO: 2833053 - RNA, 18 nt, Mycobacterium avium subsp. paratuberculosis
cggcccgcggcaucgucg

SEQ ID NO: 2833054 - RNA, 12 nt, Mycobacterium avium subsp. paratuberculosis
cggcccgcggcg

SEQ ID NO: 2833055 - RNA, 13 nt, Mycobacterium avium subsp. paratuberculosis
cggcccgcggcgg

SEQ ID NO: 2833056 - RNA, 14 nt, Mycobacterium avium subsp. paratuberculosis
cggcccgcggcguc

SEQ ID NO: 2833057 - RNA, 13 nt, Mycobacterium avium subsp. paratuberculosis
cggcccgcggggc

SEQ ID NO: 2833058 - RNA, 15 nt, Mycobacterium avium subsp. paratuberculosis
cggcccgcucggcgg

SEQ ID NO: 2833059 - RNA, 16 nt, Mycobacterium avium subsp. paratuberculosis
cggcccgcucggcggg

SEQ ID NO: 2833060 - RNA, 17 nt, Mycobacterium avium subsp. paratuberculosis
cggcccgcucggcgggu

SEQ ID NO: 2833061 - RNA, 16 nt, Mycobacterium avium subsp. paratuberculosis
cggcccgcucgggcca

SEQ ID NO: 2833062 - RNA, 17 nt, Mycobacterium avium subsp. paratuberculosis
cggcccgcucgggccau

SEQ ID NO: 2833063 - RNA, 15 nt, Mycobacterium avium subsp. paratuberculosis
cggcccgcugcgcgg

SEQ ID NO: 2833064 - RNA, 17 nt, Mycobacterium avium subsp. paratuberculosis
cggcccgcugcgcggcc

SEQ ID NO: 2833065 - RNA, 17 nt, Mycobacterium avium subsp. paratuberculosis
cggcccgcugcggcugg

SEQ ID NO: 2833066 - RNA, 13 nt, Mycobacterium avium subsp. paratuberculosis
cggcccgcuggcc

SEQ ID NO: 2833067 - RNA, 19 nt, Mycobacterium avium subsp. paratuberculosis
cggcccuguucgccgucgc

SEQ ID NO: 2833068 - RNA, 20 nt, Mycobacterium avium subsp. paratuberculosis
cggcccuguucgccgucgcg

SEQ ID NO: 2833069 - RNA, 21 nt, Mycobacterium avium subsp. paratuberculosis
cggcccuguucgccgucgcgg

SEQ ID NO: 2833070 - RNA, 22 nt, Mycobacterium avium subsp. paratuberculosis
cggcccuguuugcaggcgaucu

SEQ ID NO: 2833071 - RNA, 17 nt, Mycobacterium avium subsp. paratuberculosis
cggcccuucucggacgc

SEQ ID NO: 2833072 - RNA, 17 nt, Mycobacterium avium subsp. paratuberculosis
cggcccuugcggccgau

SEQ ID NO: 2833073 - RNA, 18 nt, Mycobacterium avium subsp. paratuberculosis
cggcccuugcggccgauc

SEQ ID NO: 2833074 - RNA, 20 nt, Mycobacterium avium subsp. paratuberculosis
cggccgaaaacccucagacc

SEQ ID NO: 2833075 - RNA, 15 nt, Mycobacterium avium subsp. paratuberculosis
cggccgaaacgcccg

SEQ ID NO: 2833076 - RNA, 17 nt, Mycobacterium avium subsp. paratuberculosis
cggccgaaacgcccggc

SEQ ID NO: 2833077 - RNA, 18 nt, Mycobacterium avium subsp. paratuberculosis
cggccgaaacgcccggcu

SEQ ID NO: 2833078 - RNA, 18 nt, Mycobacterium avium subsp. paratuberculosis
cggccgaaaucaacgcgc

SEQ ID NO: 2833079 - RNA, 23 nt, Mycobacterium avium subsp. paratuberculosis
cggccgaaaucaacgcgccgaac

SEQ ID NO: 2833080 - RNA, 16 nt, Mycobacterium avium subsp. paratuberculosis
cggccgaacacggccg

SEQ ID NO: 2833081 - RNA, 18 nt, Mycobacterium avium subsp. paratuberculosis
cggccgaacacggccgcc

SEQ ID NO: 2833082 - RNA, 19 nt, Mycobacterium avium subsp. paratuberculosis
cggccgaagcguuccgccg

SEQ ID NO: 2833083 - RNA, 16 nt, Mycobacterium avium subsp. paratuberculosis
cggccgaauccggccg

SEQ ID NO: 2833084 - RNA, 22 nt, Mycobacterium avium subsp. paratuberculosis
cggccgaauccggccggagacc

SEQ ID NO: 2833085 - RNA, 23 nt, Mycobacterium avium subsp. paratuberculosis
cggccgaauccggccggagaccg

SEQ ID NO: 2833086 - RNA, 20 nt, Mycobacterium avium subsp. paratuberculosis
cggccgacaacgacagcacc

SEQ ID NO: 2833087 - RNA, 21 nt, Mycobacterium avium subsp. paratuberculosis
cggccgacaacgacagcaccc

SEQ ID NO: 2833088 - RNA, 23 nt, Mycobacterium avium subsp. paratuberculosis
cggccgacaacgacagcacccag

SEQ ID NO: 2833089 - RNA, 15 nt, Mycobacterium avium subsp. paratuberculosis
cggccgacagcgcgu

SEQ ID NO: 2833090 - RNA, 17 nt, Mycobacterium avium subsp. paratuberculosis
cggccgacagcgcgucg

SEQ ID NO: 2833091 - RNA, 14 nt, Mycobacterium avium subsp. paratuberculosis
cggccgacagggug

SEQ ID NO: 2833092 - RNA, 18 nt, Mycobacterium avium subsp. paratuberculosis
cggccgacauggacgcgg

SEQ ID NO: 2833093 - RNA, 21 nt, Mycobacterium avium subsp. paratuberculosis
cggccgacauggacgcggccu

SEQ ID NO: 2833094 - RNA, 15 nt, Mycobacterium avium subsp. paratuberculosis
cggccgaccgccucg

SEQ ID NO: 2833095 - RNA, 20 nt, Mycobacterium avium subsp. paratuberculosis
cggccgaccggucucgaccg

SEQ ID NO: 2833096 - RNA, 12 nt, Mycobacterium avium subsp. paratuberculosis
cggccgacgaac

SEQ ID NO: 2833097 - RNA, 13 nt, Mycobacterium avium subsp. paratuberculosis
cggccgacgaaca

SEQ ID NO: 2833098 - RNA, 12 nt, Mycobacterium avium subsp. paratuberculosis
cggccgacgccc

SEQ ID NO: 2833099 - RNA, 15 nt, Mycobacterium avium subsp. paratuberculosis
cggccgacgcccagc

SEQ ID NO: 2833100 - RNA, 17 nt, Mycobacterium avium subsp. paratuberculosis
cggccgacgcccagcac

SEQ ID NO: 2833101 - RNA, 19 nt, Mycobacterium avium subsp. paratuberculosis
cggccgacgcccagcaccg

SEQ ID NO: 2833102 - RNA, 15 nt, Mycobacterium avium subsp. paratuberculosis
cggccgacucgaugc

SEQ ID NO: 2833103 - RNA, 16 nt, Mycobacterium avium subsp. paratuberculosis
cggccgacucgaugcg

SEQ ID NO: 2833104 - RNA, 18 nt, Mycobacterium avium subsp. paratuberculosis
cggccgacugauccacca

SEQ ID NO: 2833105 - RNA, 19 nt, Mycobacterium avium subsp. paratuberculosis
cggccgacugauccaccau

SEQ ID NO: 2833106 - RNA, 20 nt, Mycobacterium avium subsp. paratuberculosis
cggccgacuuggucagcccg

SEQ ID NO: 2833107 - RNA, 23 nt, Mycobacterium avium subsp. paratuberculosis
cggccgacuuggucagcccgcgc

SEQ ID NO: 2833108 - RNA, 15 nt, Mycobacterium avium subsp. paratuberculosis
cggccgagccgagcc

SEQ ID NO: 2833109 - RNA, 18 nt, Mycobacterium avium subsp. paratuberculosis
cggccgagccgaggccga

SEQ ID NO: 2833110 - RNA, 21 nt, Mycobacterium avium subsp. paratuberculosis
cggccgagccgaggccgaugg

SEQ ID NO: 2833111 - RNA, 17 nt, Mycobacterium avium subsp. paratuberculosis
cggccgagccgaugccc

SEQ ID NO: 2833112 - RNA, 23 nt, Mycobacterium avium subsp. paratuberculosis
cggccgagccgaugcccagcagc

SEQ ID NO: 2833113 - RNA, 22 nt, Mycobacterium avium subsp. paratuberculosis
cggccgagcgcaccgcggagcg

SEQ ID NO: 2833114 - RNA, 14 nt, Mycobacterium avium subsp. paratuberculosis
cggccgagcgcagc

SEQ ID NO: 2833115 - RNA, 15 nt, Mycobacterium avium subsp. paratuberculosis
cggccgagcgcagcg

SEQ ID NO: 2833116 - RNA, 18 nt, Mycobacterium avium subsp. paratuberculosis
cggccgagcgcagcgggg

SEQ ID NO: 2833117 - RNA, 20 nt, Mycobacterium avium subsp. paratuberculosis
cggccgagcgcagcggggag

SEQ ID NO: 2833118 - RNA, 15 nt, Mycobacterium avium subsp. paratuberculosis
cggccgagcgcgccg

SEQ ID NO: 2833119 - RNA, 16 nt, Mycobacterium avium subsp. paratuberculosis
cggccgagcgcgccga

SEQ ID NO: 2833120 - RNA, 17 nt, Mycobacterium avium subsp. paratuberculosis
cggccgagcgcgccgag

SEQ ID NO: 2833121 - RNA, 18 nt, Mycobacterium avium subsp. paratuberculosis
cggccgagcgcgccgagc

SEQ ID NO: 2833122 - RNA, 17 nt, Mycobacterium avium subsp. paratuberculosis
cggccgaggucaccacc

SEQ ID NO: 2833123 - RNA, 16 nt, Mycobacterium avium subsp. paratuberculosis
cggccgagguccgcgg

SEQ ID NO: 2833124 - RNA, 14 nt, Mycobacterium avium subsp. paratuberculosis
cggccgagucgacg

SEQ ID NO: 2833125 - RNA, 17 nt, Mycobacterium avium subsp. paratuberculosis
cggccgagucgacgugc

SEQ ID NO: 2833126 - RNA, 16 nt, Mycobacterium avium subsp. paratuberculosis
cggccgaucauggucg

SEQ ID NO: 2833127 - RNA, 20 nt, Mycobacterium avium subsp. paratuberculosis
cggccgaucauggucggcga

SEQ ID NO: 2833128 - RNA, 19 nt, Mycobacterium avium subsp. paratuberculosis
cggccgauggcccaggccg

SEQ ID NO: 2833129 - RNA, 13 nt, Mycobacterium avium subsp. paratuberculosis
cggccgauggugu

SEQ ID NO: 2833130 - RNA, 15 nt, Mycobacterium avium subsp. paratuberculosis
cggccgauggugugg

SEQ ID NO: 2833131 - RNA, 16 nt, Mycobacterium avium subsp. paratuberculosis
cggccgauggugugga

SEQ ID NO: 2833132 - RNA, 19 nt, Mycobacterium avium subsp. paratuberculosis
cggccgaugguguggaucg

SEQ ID NO: 2833133 - RNA, 16 nt, Mycobacterium avium subsp. paratuberculosis
cggccgauucggcgcc

SEQ ID NO: 2833134 - RNA, 17 nt, Mycobacterium avium subsp. paratuberculosis
cggccgauucggcgccg

SEQ ID NO: 2833135 - RNA, 18 nt, Mycobacterium avium subsp. paratuberculosis
cggccgauucggcgccgc

SEQ ID NO: 2833136 - RNA, 20 nt, Mycobacterium avium subsp. paratuberculosis
cggccgauucggcgccgcga

SEQ ID NO: 2833137 - RNA, 21 nt, Mycobacterium avium subsp. paratuberculosis
cggccgauucggcgccgcgac

SEQ ID NO: 2833138 - RNA, 22 nt, Mycobacterium avium subsp. paratuberculosis
cggccgauucggcgccgcgacc

SEQ ID NO: 2833139 - RNA, 14 nt, Mycobacterium avium subsp. paratuberculosis
cggccgcaacggcg

SEQ ID NO: 2833140 - RNA, 15 nt, Mycobacterium avium subsp. paratuberculosis
cggccgcaacggcgg

SEQ ID NO: 2833141 - RNA, 19 nt, Mycobacterium avium subsp. paratuberculosis
cggccgcaagcgaagccgu

SEQ ID NO: 2833142 - RNA, 22 nt, Mycobacterium avium subsp. paratuberculosis
cggccgcaagcgaagccgugac

SEQ ID NO: 2833143 - RNA, 15 nt, Mycobacterium avium subsp. paratuberculosis
cggccgcaaucggcg

SEQ ID NO: 2833144 - RNA, 17 nt, Mycobacterium avium subsp. paratuberculosis
cggccgcaaucggcgcc

SEQ ID NO: 2833145 - RNA, 18 nt, Mycobacterium avium subsp. paratuberculosis
cggccgcaaucggcgccg

SEQ ID NO: 2833146 - RNA, 22 nt, Mycobacterium avium subsp. paratuberculosis
cggccgcaaucggcgccggcuc

SEQ ID NO: 2833147 - RNA, 13 nt, Mycobacterium avium subsp. paratuberculosis
cggccgcacacca

SEQ ID NO: 2833148 - RNA, 16 nt, Mycobacterium avium subsp. paratuberculosis
cggccgcacaccacca

SEQ ID NO: 2833149 - RNA, 19 nt, Mycobacterium avium subsp. paratuberculosis
cggccgcacaccaccacgu

SEQ ID NO: 2833150 - RNA, 13 nt, Mycobacterium avium subsp. paratuberculosis
cggccgcacccca

SEQ ID NO: 2833151 - RNA, 12 nt, Mycobacterium avium subsp. paratuberculosis
cggccgccgcga

SEQ ID NO: 2833152 - RNA, 13 nt, Mycobacterium avium subsp. paratuberculosis
cggccgccgcgac

SEQ ID NO: 2833153 - RNA, 15 nt, Mycobacterium avium subsp. paratuberculosis
cggccgccgcgacgg

SEQ ID NO: 2833154 - RNA, 21 nt, Mycobacterium avium subsp. paratuberculosis
cggccgccgcgacggccgccg

SEQ ID NO: 2833155 - RNA, 14 nt, Mycobacterium avium subsp. paratuberculosis
cggccgccgcgcau

SEQ ID NO: 2833156 - RNA, 22 nt, Mycobacterium avium subsp. paratuberculosis
cggccgccgcgcauccgcaccg

SEQ ID NO: 2833157 - RNA, 13 nt, Mycobacterium avium subsp. paratuberculosis
cggccgccggauc

SEQ ID NO: 2833158 - RNA, 21 nt, Mycobacterium avium subsp. paratuberculosis
cggccgccggauuacucgccg

SEQ ID NO: 2833159 - RNA, 15 nt, Mycobacterium avium subsp. paratuberculosis
cggccgccggcaccg

SEQ ID NO: 2833160 - RNA, 14 nt, Mycobacterium avium subsp. paratuberculosis
cggccgccggccag

SEQ ID NO: 2833161 - RNA, 18 nt, Mycobacterium avium subsp. paratuberculosis
cggccgccggccagcucc

SEQ ID NO: 2833162 - RNA, 19 nt, Mycobacterium avium subsp. paratuberculosis
cggccgccggccagcuccg

SEQ ID NO: 2833163 - RNA, 16 nt, Mycobacterium avium subsp. paratuberculosis
cggccgccggcggcca

SEQ ID NO: 2833164 - RNA, 15 nt, Mycobacterium avium subsp. paratuberculosis
cggccgccgggacgg

SEQ ID NO: 2833165 - RNA, 15 nt, Mycobacterium avium subsp. paratuberculosis
cggccgccggggccc

SEQ ID NO: 2833166 - RNA, 13 nt, Mycobacterium avium subsp. paratuberculosis
cggccgccguauc

SEQ ID NO: 2833167 - RNA, 14 nt, Mycobacterium avium subsp. paratuberculosis
cggccgccuccagc

SEQ ID NO: 2833168 - RNA, 15 nt, Mycobacterium avium subsp. paratuberculosis
cggccgccuccagca

SEQ ID NO: 2833169 - RNA, 20 nt, Mycobacterium avium subsp. paratuberculosis
cggccgccuccagcacgucg

SEQ ID NO: 2833170 - RNA, 21 nt, Mycobacterium avium subsp. paratuberculosis
cggccgccuccagcacgucgg

SEQ ID NO: 2833171 - RNA, 22 nt, Mycobacterium avium subsp. paratuberculosis
cggccgccuccagcacgucggg

SEQ ID NO: 2833172 - RNA, 13 nt, Mycobacterium avium subsp. paratuberculosis
cggccgccucccg

SEQ ID NO: 2833173 - RNA, 17 nt, Mycobacterium avium subsp. paratuberculosis
cggccgccucccgcagc

SEQ ID NO: 2833174 - RNA, 20 nt, Mycobacterium avium subsp. paratuberculosis
cggccgccucccgcagcgcc

SEQ ID NO: 2833175 - RNA, 21 nt, Mycobacterium avium subsp. paratuberculosis
cggccgccucccgcagcgcca

SEQ ID NO: 2833176 - RNA, 23 nt, Mycobacterium avium subsp. paratuberculosis
cggccgccuccgguuugcgccgg

SEQ ID NO: 2833177 - RNA, 12 nt, Mycobacterium avium subsp. paratuberculosis
cggccgccucgu

SEQ ID NO: 2833178 - RNA, 14 nt, Mycobacterium avium subsp. paratuberculosis
cggccgccucgucg

SEQ ID NO: 2833179 - RNA, 15 nt, Mycobacterium avium subsp. paratuberculosis
cggccgccucgucga

SEQ ID NO: 2833180 - RNA, 16 nt, Mycobacterium avium subsp. paratuberculosis
cggccgccucgucgag

SEQ ID NO: 2833181 - RNA, 12 nt, Mycobacterium avium subsp. paratuberculosis
cggccgccugga

SEQ ID NO: 2833182 - RNA, 14 nt, Mycobacterium avium subsp. paratuberculosis
cggccgccuggacg

SEQ ID NO: 2833183 - RNA, 17 nt, Mycobacterium avium subsp. paratuberculosis
cggccgccuggacgacg

SEQ ID NO: 2833184 - RNA, 20 nt, Mycobacterium avium subsp. paratuberculosis
cggccgccuggacgacgucg

SEQ ID NO: 2833185 - RNA, 23 nt, Mycobacterium avium subsp. paratuberculosis
cggccgccuggacgacgucgaug

SEQ ID NO: 2833186 - RNA, 22 nt, Mycobacterium avium subsp. paratuberculosis
cggccgccuucacgaccggcag

SEQ ID NO: 2833187 - RNA, 23 nt, Mycobacterium avium subsp. paratuberculosis
cggccgccuucacgaccggcagc

SEQ ID NO: 2833188 - RNA, 19 nt, Mycobacterium avium subsp. paratuberculosis
cggccgccuuggugauccg

SEQ ID NO: 2833189 - RNA, 21 nt, Mycobacterium avium subsp. paratuberculosis
cggccgccuuggugauccggg

SEQ ID NO: 2833190 - RNA, 15 nt, Mycobacterium avium subsp. paratuberculosis
cggccgcgaaggcgg

SEQ ID NO: 2833191 - RNA, 17 nt, Mycobacterium avium subsp. paratuberculosis
cggccgcgaaggcggcg

SEQ ID NO: 2833192 - RNA, 20 nt, Mycobacterium avium subsp. paratuberculosis
cggccgcgaaggcggcgucg

SEQ ID NO: 2833193 - RNA, 18 nt, Mycobacterium avium subsp. paratuberculosis
cggccgcgaauucggcga

SEQ ID NO: 2833194 - RNA, 21 nt, Mycobacterium avium subsp. paratuberculosis
cggccgcgaauucggcgauga

SEQ ID NO: 2833195 - RNA, 15 nt, Mycobacterium avium subsp. paratuberculosis
cggccgcgacgaccg

SEQ ID NO: 2833196 - RNA, 16 nt, Mycobacterium avium subsp. paratuberculosis
cggccgcgacgaccgc

SEQ ID NO: 2833197 - RNA, 18 nt, Mycobacterium avium subsp. paratuberculosis
cggccgcgacgaccgccu

SEQ ID NO: 2833198 - RNA, 13 nt, Mycobacterium avium subsp. paratuberculosis
cggccgcgacgcg

SEQ ID NO: 2833199 - RNA, 16 nt, Mycobacterium avium subsp. paratuberculosis
cggccgcgacgcgcgg

SEQ ID NO: 2833200 - RNA, 17 nt, Mycobacterium avium subsp. paratuberculosis
cggccgcgacgcgcggu

SEQ ID NO: 2833201 - RNA, 19 nt, Mycobacterium avium subsp. paratuberculosis
cggccgcgacgcgcggucg

SEQ ID NO: 2833202 - RNA, 22 nt, Mycobacterium avium subsp. paratuberculosis
cggccgcgacgguuuccggcuu

SEQ ID NO: 2833203 - RNA, 13 nt, Mycobacterium avium subsp. paratuberculosis
cggccgcgacugc

SEQ ID NO: 2833204 - RNA, 14 nt, Mycobacterium avium subsp. paratuberculosis
cggccgcgacugca

SEQ ID NO: 2833205 - RNA, 17 nt, Mycobacterium avium subsp. paratuberculosis
cggccgcgacugcaccc

SEQ ID NO: 2833206 - RNA, 18 nt, Mycobacterium avium subsp. paratuberculosis
cggccgcgacugcacccg

SEQ ID NO: 2833207 - RNA, 19 nt, Mycobacterium avium subsp. paratuberculosis
cggccgcgacugcacccga

SEQ ID NO: 2833208 - RNA, 18 nt, Mycobacterium avium subsp. paratuberculosis
cggccgcgagcccggcga

SEQ ID NO: 2833209 - RNA, 16 nt, Mycobacterium avium subsp. paratuberculosis
cggccgcgauccagcg

SEQ ID NO: 2833210 - RNA, 22 nt, Mycobacterium avium subsp. paratuberculosis
cggccgcgauccagcgcuggcc

SEQ ID NO: 2833211 - RNA, 15 nt, Mycobacterium avium subsp. paratuberculosis
cggccgcgaucgcca

SEQ ID NO: 2833212 - RNA, 18 nt, Mycobacterium avium subsp. paratuberculosis
cggccgcgaucgccaacg

SEQ ID NO: 2833213 - RNA, 22 nt, Mycobacterium avium subsp. paratuberculosis
cggccgcgauguagcggacggg

SEQ ID NO: 2833214 - RNA, 18 nt, Mycobacterium avium subsp. paratuberculosis
cggccgcgaugucggugg

SEQ ID NO: 2833215 - RNA, 20 nt, Mycobacterium avium subsp. paratuberculosis
cggccgcgaugucggugggc

SEQ ID NO: 2833216 - RNA, 14 nt, Mycobacterium avium subsp. paratuberculosis
cggccgcgcaccgc

SEQ ID NO: 2833217 - RNA, 16 nt, Mycobacterium avium subsp. paratuberculosis
cggccgcgcaccgccc

SEQ ID NO: 2833218 - RNA, 17 nt, Mycobacterium avium subsp. paratuberculosis
cggccgcgcaccgcccc

SEQ ID NO: 2833219 - RNA, 14 nt, Mycobacterium avium subsp. paratuberculosis
cggccgcgcagauc

SEQ ID NO: 2833220 - RNA, 20 nt, Mycobacterium avium subsp. paratuberculosis
cggccgcgcagaucgccagc

SEQ ID NO: 2833221 - RNA, 22 nt, Mycobacterium avium subsp. paratuberculosis
cggccgcgcagaucgccagcac

SEQ ID NO: 2833222 - RNA, 12 nt, Mycobacterium avium subsp. paratuberculosis
cggccgcgccca

SEQ ID NO: 2833223 - RNA, 12 nt, Mycobacterium avium subsp. paratuberculosis
cggccgcgccga

SEQ ID NO: 2833224 - RNA, 17 nt, Mycobacterium avium subsp. paratuberculosis
cggccgcgccgaacacc

SEQ ID NO: 2833225 - RNA, 13 nt, Mycobacterium avium subsp. paratuberculosis
cggccgcgccggc

SEQ ID NO: 2833226 - RNA, 14 nt, Mycobacterium avium subsp. paratuberculosis
cggccgcgccggcc

SEQ ID NO: 2833227 - RNA, 15 nt, Mycobacterium avium subsp. paratuberculosis
cggccgcgccggccg

SEQ ID NO: 2833228 - RNA, 20 nt, Mycobacterium avium subsp. paratuberculosis
cggccgcgccggccggacag

SEQ ID NO: 2833229 - RNA, 14 nt, Mycobacterium avium subsp. paratuberculosis
cggccgcgcgcccg

SEQ ID NO: 2833230 - RNA, 16 nt, Mycobacterium avium subsp. paratuberculosis
cggccgcgcgcggcgc

SEQ ID NO: 2833231 - RNA, 18 nt, Mycobacterium avium subsp. paratuberculosis
cggccgcgcguagaucau

SEQ ID NO: 2833232 - RNA, 19 nt, Mycobacterium avium subsp. paratuberculosis
cggccgcgcgugcccgcgg

SEQ ID NO: 2833233 - RNA, 20 nt, Mycobacterium avium subsp. paratuberculosis
cggccgcgcgugcccgcggu

SEQ ID NO: 2833234 - RNA, 20 nt, Mycobacterium avium subsp. paratuberculosis
cggccgcggaauucgcgggu

SEQ ID NO: 2833235 - RNA, 22 nt, Mycobacterium avium subsp. paratuberculosis
cggccgcggaauucgcgggugc

SEQ ID NO: 2833236 - RNA, 21 nt, Mycobacterium avium subsp. paratuberculosis
cggccggauucucgcccggcu

SEQ ID NO: 2833237 - RNA, 20 nt, Mycobacterium avium subsp. paratuberculosis
cggccggcaacgacccgucg

SEQ ID NO: 2833238 - RNA, 20 nt, Mycobacterium avium subsp. paratuberculosis
cggccggcacgaaaccgugg

SEQ ID NO: 2833239 - RNA, 17 nt, Mycobacterium avium subsp. paratuberculosis
cggccggcacuaccgcc

SEQ ID NO: 2833240 - RNA, 15 nt, Mycobacterium avium subsp. paratuberculosis
cggccggcagcaucg

SEQ ID NO: 2833241 - RNA, 20 nt, Mycobacterium avium subsp. paratuberculosis
cggccggcagcaucgggacg

SEQ ID NO: 2833242 - RNA, 12 nt, Mycobacterium avium subsp. paratuberculosis
cggccggcagcg

SEQ ID NO: 2833243 - RNA, 16 nt, Mycobacterium avium subsp. paratuberculosis
cggccggcagcggugc

SEQ ID NO: 2833244 - RNA, 21 nt, Mycobacterium avium subsp. paratuberculosis
cggccggcagcggugccgccc

SEQ ID NO: 2833245 - RNA, 20 nt, Mycobacterium avium subsp. paratuberculosis
cggccggcagcugcccgucg

SEQ ID NO: 2833246 - RNA, 14 nt, Mycobacterium avium subsp. paratuberculosis
cggccggcaggccg

SEQ ID NO: 2833247 - RNA, 15 nt, Mycobacterium avium subsp. paratuberculosis
cggccggcaggccgc

SEQ ID NO: 2833248 - RNA, 18 nt, Mycobacterium avium subsp. paratuberculosis
cggccggcaggccgcccg

SEQ ID NO: 2833249 - RNA, 20 nt, Mycobacterium avium subsp. paratuberculosis
cggccggcaguuccucgccg

SEQ ID NO: 2833250 - RNA, 21 nt, Mycobacterium avium subsp. paratuberculosis
cggccggcaguugcggccgcu

SEQ ID NO: 2833251 - RNA, 23 nt, Mycobacterium avium subsp. paratuberculosis
cggccggcaguugcggccgcuuc

SEQ ID NO: 2833252 - RNA, 13 nt, Mycobacterium avium subsp. paratuberculosis
cggccggccagca

SEQ ID NO: 2833253 - RNA, 14 nt, Mycobacterium avium subsp. paratuberculosis
cggccggccagcag

SEQ ID NO: 2833254 - RNA, 17 nt, Mycobacterium avium subsp. paratuberculosis
cggccggccagcagccg

SEQ ID NO: 2833255 - RNA, 18 nt, Mycobacterium avium subsp. paratuberculosis
cggccggccagcagccgg

SEQ ID NO: 2833256 - RNA, 15 nt, Mycobacterium avium subsp. paratuberculosis
cggccggccagcgcg

SEQ ID NO: 2833257 - RNA, 15 nt, Mycobacterium avium subsp. paratuberculosis
cggccggcccagcgc

SEQ ID NO: 2833258 - RNA, 16 nt, Mycobacterium avium subsp. paratuberculosis
cggccggccccgcccg

SEQ ID NO: 2833259 - RNA, 21 nt, Mycobacterium avium subsp. paratuberculosis
cggccggccccgcccggcgcg

SEQ ID NO: 2833260 - RNA, 13 nt, Mycobacterium avium subsp. paratuberculosis
cggccggccccgg

SEQ ID NO: 2833261 - RNA, 14 nt, Mycobacterium avium subsp. paratuberculosis
cggccggccccggc

SEQ ID NO: 2833262 - RNA, 15 nt, Mycobacterium avium subsp. paratuberculosis
cggccggccccggcc

SEQ ID NO: 2833263 - RNA, 20 nt, Mycobacterium avium subsp. paratuberculosis
cggccggccccggccgggcg

SEQ ID NO: 2833264 - RNA, 17 nt, Mycobacterium avium subsp. paratuberculosis
cggccggcccgcccggc

SEQ ID NO: 2833265 - RNA, 19 nt, Mycobacterium avium subsp. paratuberculosis
cggccggcccgcccggcgg

SEQ ID NO: 2833266 - RNA, 20 nt, Mycobacterium avium subsp. paratuberculosis
cggccggcccgcccggcggc

SEQ ID NO: 2833267 - RNA, 22 nt, Mycobacterium avium subsp. paratuberculosis
cggccggcccgcccggcggcgc

SEQ ID NO: 2833268 - RNA, 13 nt, Mycobacterium avium subsp. paratuberculosis
cggccggcccggc

SEQ ID NO: 2833269 - RNA, 16 nt, Mycobacterium avium subsp. paratuberculosis
cggccggcccggcccg

SEQ ID NO: 2833270 - RNA, 17 nt, Mycobacterium avium subsp. paratuberculosis
cggccggcccggcccga

SEQ ID NO: 2833271 - RNA, 21 nt, Mycobacterium avium subsp. paratuberculosis
cggccggccgaacacggccgc

SEQ ID NO: 2833272 - RNA, 13 nt, Mycobacterium avium subsp. paratuberculosis
cggccggccgaca

SEQ ID NO: 2833273 - RNA, 14 nt, Mycobacterium avium subsp. paratuberculosis
cggccggccgacaa

SEQ ID NO: 2833274 - RNA, 21 nt, Mycobacterium avium subsp. paratuberculosis
cggccggccgacaacgacagc

SEQ ID NO: 2833275 - RNA, 14 nt, Mycobacterium avium subsp. paratuberculosis
cggccggccgacac

SEQ ID NO: 2833276 - RNA, 15 nt, Mycobacterium avium subsp. paratuberculosis
cggccggccgacacc

SEQ ID NO: 2833277 - RNA, 16 nt, Mycobacterium avium subsp. paratuberculosis
cggccggccgacaccc

SEQ ID NO: 2833278 - RNA, 13 nt, Mycobacterium avium subsp. paratuberculosis
cggccggccgagc

SEQ ID NO: 2833279 - RNA, 15 nt, Mycobacterium avium subsp. paratuberculosis
cggccggccgagccg

SEQ ID NO: 2833280 - RNA, 16 nt, Mycobacterium avium subsp. paratuberculosis
cggccggccgagccga

SEQ ID NO: 2833281 - RNA, 19 nt, Mycobacterium avium subsp. paratuberculosis
cggccggccgagccgagcc

SEQ ID NO: 2833282 - RNA, 14 nt, Mycobacterium avium subsp. paratuberculosis
cggccggccgccgg

SEQ ID NO: 2833283 - RNA, 15 nt, Mycobacterium avium subsp. paratuberculosis
cggccggccgccggc

SEQ ID NO: 2833284 - RNA, 17 nt, Mycobacterium avium subsp. paratuberculosis
cggccggccgccggcgg

SEQ ID NO: 2833285 - RNA, 19 nt, Mycobacterium avium subsp. paratuberculosis
cggccggccgccggcggcc

SEQ ID NO: 2833286 - RNA, 13 nt, Mycobacterium avium subsp. paratuberculosis
cggccggccgccu

SEQ ID NO: 2833287 - RNA, 13 nt, Mycobacterium avium subsp. paratuberculosis
cggccggccgcgc

SEQ ID NO: 2833288 - RNA, 16 nt, Mycobacterium avium subsp. paratuberculosis
cggccggccgcgcgcg

SEQ ID NO: 2833289 - RNA, 14 nt, Mycobacterium avium subsp. paratuberculosis
cggccggccggccg

SEQ ID NO: 2833290 - RNA, 15 nt, Mycobacterium avium subsp. paratuberculosis
cggccggccggccga

SEQ ID NO: 2833291 - RNA, 14 nt, Mycobacterium avium subsp. paratuberculosis
cggccggccuggug

SEQ ID NO: 2833292 - RNA, 16 nt, Mycobacterium avium subsp. paratuberculosis
cggccggccuggugcg

SEQ ID NO: 2833293 - RNA, 22 nt, Mycobacterium avium subsp. paratuberculosis
cggccggcgaaacacagcagca

SEQ ID NO: 2833294 - RNA, 12 nt, Mycobacterium avium subsp. paratuberculosis
cggccggcgaag

SEQ ID NO: 2833295 - RNA, 15 nt, Mycobacterium avium subsp. paratuberculosis
cggccggcgaagccg

SEQ ID NO: 2833296 - RNA, 16 nt, Mycobacterium avium subsp. paratuberculosis
cggccggcgaagccgc

SEQ ID NO: 2833297 - RNA, 18 nt, Mycobacterium avium subsp. paratuberculosis
cggccggcgaagccgcuc

SEQ ID NO: 2833298 - RNA, 17 nt, Mycobacterium avium subsp. paratuberculosis
cggccggcgacgccgcg

SEQ ID NO: 2833299 - RNA, 20 nt, Mycobacterium avium subsp. paratuberculosis
cggccggcgacgccgcgcug

SEQ ID NO: 2833300 - RNA, 16 nt, Mycobacterium avium subsp. paratuberculosis
cggccggcgagguggg

SEQ ID NO: 2833301 - RNA, 14 nt, Mycobacterium avium subsp. paratuberculosis
cggccggcgagucg

SEQ ID NO: 2833302 - RNA, 16 nt, Mycobacterium avium subsp. paratuberculosis
cggccggcgcagccgg

SEQ ID NO: 2833303 - RNA, 15 nt, Mycobacterium avium subsp. paratuberculosis
cggccggcgccgacc

SEQ ID NO: 2833304 - RNA, 14 nt, Mycobacterium avium subsp. paratuberculosis
cggccggcgccggc

SEQ ID NO: 2833305 - RNA, 15 nt, Mycobacterium avium subsp. paratuberculosis
cggccggcgccggcg

SEQ ID NO: 2833306 - RNA, 19 nt, Mycobacterium avium subsp. paratuberculosis
cggccggcgccggcgguca

SEQ ID NO: 2833307 - RNA, 14 nt, Mycobacterium avium subsp. paratuberculosis
cggccggcgcgacc

SEQ ID NO: 2833308 - RNA, 16 nt, Mycobacterium avium subsp. paratuberculosis
cggccggcgcgaccag

SEQ ID NO: 2833309 - RNA, 17 nt, Mycobacterium avium subsp. paratuberculosis
cggccggcgcgaccagc

SEQ ID NO: 2833310 - RNA, 12 nt, Mycobacterium avium subsp. paratuberculosis
cggccggcgcgc

SEQ ID NO: 2833311 - RNA, 15 nt, Mycobacterium avium subsp. paratuberculosis
cggccggcgcgcacg

SEQ ID NO: 2833312 - RNA, 16 nt, Mycobacterium avium subsp. paratuberculosis
cggccggcgcgcacgg

SEQ ID NO: 2833313 - RNA, 13 nt, Mycobacterium avium subsp. paratuberculosis
cggccggcgcggc

SEQ ID NO: 2833314 - RNA, 14 nt, Mycobacterium avium subsp. paratuberculosis
cggccggcgcggcg

SEQ ID NO: 2833315 - RNA, 15 nt, Mycobacterium avium subsp. paratuberculosis
cggccggcgcggcgg

SEQ ID NO: 2833316 - RNA, 16 nt, Mycobacterium avium subsp. paratuberculosis
cggccggcgcggcggc

SEQ ID NO: 2833317 - RNA, 18 nt, Mycobacterium avium subsp. paratuberculosis
cggccggcgcggcggcga

SEQ ID NO: 2833318 - RNA, 23 nt, Mycobacterium avium subsp. paratuberculosis
cggccggcgcggcggcgacgucg

SEQ ID NO: 2833319 - RNA, 15 nt, Mycobacterium avium subsp. paratuberculosis
cggccggcgcgugcg

SEQ ID NO: 2833320 - RNA, 22 nt, Mycobacterium avium subsp. paratuberculosis
cggccggcgcgugcgcgacgaa

SEQ ID NO: 2833321 - RNA, 18 nt, Mycobacterium avium subsp. paratuberculosis
cggccggugcgcgucagc

SEQ ID NO: 2833322 - RNA, 14 nt, Mycobacterium avium subsp. paratuberculosis
cggccgguggccgg

SEQ ID NO: 2833323 - RNA, 16 nt, Mycobacterium avium subsp. paratuberculosis
cggccgguggccggug

SEQ ID NO: 2833324 - RNA, 18 nt, Mycobacterium avium subsp. paratuberculosis
cggccgguggccgguggg

SEQ ID NO: 2833325 - RNA, 23 nt, Mycobacterium avium subsp. paratuberculosis
cggccgguggccggugggcggcg

SEQ ID NO: 2833326 - RNA, 20 nt, Mycobacterium avium subsp. paratuberculosis
cggccgguuguugcggucca

SEQ ID NO: 2833327 - RNA, 23 nt, Mycobacterium avium subsp. paratuberculosis
cggccgguuguugcgguccagga

SEQ ID NO: 2833328 - RNA, 24 nt, Mycobacterium avium subsp. paratuberculosis
cggccguacgcgguucgugcgcaa

SEQ ID NO: 2833329 - RNA, 16 nt, Mycobacterium avium subsp. paratuberculosis
cggccguagccggacc

SEQ ID NO: 2833330 - RNA, 17 nt, Mycobacterium avium subsp. paratuberculosis
cggccguagccggaccg

SEQ ID NO: 2833331 - RNA, 21 nt, Mycobacterium avium subsp. paratuberculosis
cggccguagcggacgacggcc

SEQ ID NO: 2833332 - RNA, 22 nt, Mycobacterium avium subsp. paratuberculosis
cggccguagcggacgacggcca

SEQ ID NO: 2833333 - RNA, 15 nt, Mycobacterium avium subsp. paratuberculosis
cggccgucacgcugg

SEQ ID NO: 2833334 - RNA, 20 nt, Mycobacterium avium subsp. paratuberculosis
cggccgucacgcuggcguga

SEQ ID NO: 2833335 - RNA, 18 nt, Mycobacterium avium subsp. paratuberculosis
cggccgucaggaacgccg

SEQ ID NO: 2833336 - RNA, 15 nt, Mycobacterium avium subsp. paratuberculosis
cggccguccaccacc

SEQ ID NO: 2833337 - RNA, 16 nt, Mycobacterium avium subsp. paratuberculosis
cggccguccacggcgg

SEQ ID NO: 2833338 - RNA, 19 nt, Mycobacterium avium subsp. paratuberculosis
cggccguccacggcggugg

SEQ ID NO: 2833339 - RNA, 16 nt, Mycobacterium avium subsp. paratuberculosis
cggccguccagcgucu

SEQ ID NO: 2833340 - RNA, 19 nt, Mycobacterium avium subsp. paratuberculosis
cggccguccagcgucuggc

SEQ ID NO: 2833341 - RNA, 21 nt, Mycobacterium avium subsp. paratuberculosis
cggccguccagcgucuggcag

SEQ ID NO: 2833342 - RNA, 13 nt, Mycobacterium avium subsp. paratuberculosis
cggccgucgccgg

SEQ ID NO: 2833343 - RNA, 16 nt, Mycobacterium avium subsp. paratuberculosis
cggccgucgccgggcg

SEQ ID NO: 2833344 - RNA, 17 nt, Mycobacterium avium subsp. paratuberculosis
cggccgucgccgggcgg

SEQ ID NO: 2833345 - RNA, 18 nt, Mycobacterium avium subsp. paratuberculosis
cggccgucgccgggcggg

SEQ ID NO: 2833346 - RNA, 15 nt, Mycobacterium avium subsp. paratuberculosis
cggccgucgcgcacc

SEQ ID NO: 2833347 - RNA, 16 nt, Mycobacterium avium subsp. paratuberculosis
cggccgucgcgcacca

SEQ ID NO: 2833348 - RNA, 19 nt, Mycobacterium avium subsp. paratuberculosis
cggccgucgcgcaccaccu

SEQ ID NO: 2833349 - RNA, 17 nt, Mycobacterium avium subsp. paratuberculosis
cggccgucgcggcgauc

SEQ ID NO: 2833350 - RNA, 19 nt, Mycobacterium avium subsp. paratuberculosis
cggccgucgcggcgaucgc

SEQ ID NO: 2833351 - RNA, 21 nt, Mycobacterium avium subsp. paratuberculosis
cggccgucgcggcgaucgcga

SEQ ID NO: 2833352 - RNA, 16 nt, Mycobacterium avium subsp. paratuberculosis
cggccgucggcgccgc

SEQ ID NO: 2833353 - RNA, 19 nt, Mycobacterium avium subsp. paratuberculosis
cggccgucggcgccgccga

SEQ ID NO: 2833354 - RNA, 21 nt, Mycobacterium avium subsp. paratuberculosis
cggccgucggcgccgccgagc

SEQ ID NO: 2833355 - RNA, 13 nt, Mycobacterium avium subsp. paratuberculosis
cggccgucgucgu

SEQ ID NO: 2833356 - RNA, 15 nt, Mycobacterium avium subsp. paratuberculosis
cggccgucgucgugc

SEQ ID NO: 2833357 - RNA, 14 nt, Mycobacterium avium subsp. paratuberculosis
cggccgucuugccc

SEQ ID NO: 2833358 - RNA, 18 nt, Mycobacterium avium subsp. paratuberculosis
cggccgucuugcccggcg

SEQ ID NO: 2833359 - RNA, 21 nt, Mycobacterium avium subsp. paratuberculosis
cggccgucuugcccggcgagc

SEQ ID NO: 2833360 - RNA, 22 nt, Mycobacterium avium subsp. paratuberculosis
cggccgucuugcccggcgagcg

SEQ ID NO: 2833361 - RNA, 14 nt, Mycobacterium avium subsp. paratuberculosis
cggccgugaaccgg

SEQ ID NO: 2833362 - RNA, 20 nt, Mycobacterium avium subsp. paratuberculosis
cggccgugaaccggcguugc

SEQ ID NO: 2833363 - RNA, 22 nt, Mycobacterium avium subsp. paratuberculosis
cggccgugaguguugaagccgc

SEQ ID NO: 2833364 - RNA, 21 nt, Mycobacterium avium subsp. paratuberculosis
cggccgugaucucgugccgca

SEQ ID NO: 2833365 - RNA, 23 nt, Mycobacterium avium subsp. paratuberculosis
cggccgugaucucgugccgcacc

SEQ ID NO: 2833366 - RNA, 24 nt, Mycobacterium avium subsp. paratuberculosis
cggccgugaugccgggcaaccaca

SEQ ID NO: 2833367 - RNA, 17 nt, Mycobacterium avium subsp. paratuberculosis
cggccgugaugcgccgg

SEQ ID NO: 2833368 - RNA, 18 nt, Mycobacterium avium subsp. paratuberculosis
cggccgugaugcgccggc

SEQ ID NO: 2833369 - RNA, 19 nt, Mycobacterium avium subsp. paratuberculosis
cggccgugaugcgccggcg

SEQ ID NO: 2833370 - RNA, 20 nt, Mycobacterium avium subsp. paratuberculosis
cggccgugaugcgccggcgg

SEQ ID NO: 2833371 - RNA, 21 nt, Mycobacterium avium subsp. paratuberculosis
cggccgugaugcgccggcggu

SEQ ID NO: 2833372 - RNA, 19 nt, Mycobacterium avium subsp. paratuberculosis
cggccgugccggcucggcg

SEQ ID NO: 2833373 - RNA, 20 nt, Mycobacterium avium subsp. paratuberculosis
cggccgugccggcucggcgg

SEQ ID NO: 2833374 - RNA, 21 nt, Mycobacterium avium subsp. paratuberculosis
cggccgugccggcucggcggc

SEQ ID NO: 2833375 - RNA, 15 nt, Mycobacterium avium subsp. paratuberculosis
cggccgugccguggu

SEQ ID NO: 2833376 - RNA, 16 nt, Mycobacterium avium subsp. paratuberculosis
cggccgugccgugguc

SEQ ID NO: 2833377 - RNA, 18 nt, Mycobacterium avium subsp. paratuberculosis
cggccgugccguggucgg

SEQ ID NO: 2833378 - RNA, 23 nt, Mycobacterium avium subsp. paratuberculosis
cggccgugccguggucggugccc

SEQ ID NO: 2833379 - RNA, 20 nt, Mycobacterium avium subsp. paratuberculosis
cggccgugcgcgucgacacc

SEQ ID NO: 2833380 - RNA, 21 nt, Mycobacterium avium subsp. paratuberculosis
cggccgugcgcgucgacaccc

SEQ ID NO: 2833381 - RNA, 15 nt, Mycobacterium avium subsp. paratuberculosis
cggccguggacccgc

SEQ ID NO: 2833382 - RNA, 15 nt, Mycobacterium avium subsp. paratuberculosis
cggccguggccguca

SEQ ID NO: 2833383 - RNA, 17 nt, Mycobacterium avium subsp. paratuberculosis
cggccguggccgucacg

SEQ ID NO: 2833384 - RNA, 19 nt, Mycobacterium avium subsp. paratuberculosis
cggccguggccgucacgcu

SEQ ID NO: 2833385 - RNA, 19 nt, Mycobacterium avium subsp. paratuberculosis
cggccguggucgaugaacu

SEQ ID NO: 2833386 - RNA, 19 nt, Mycobacterium avium subsp. paratuberculosis
cggccguguacagcagggu

SEQ ID NO: 2833387 - RNA, 13 nt, Mycobacterium avium subsp. paratuberculosis
cggccguucgccg

SEQ ID NO: 2833388 - RNA, 15 nt, Mycobacterium avium subsp. paratuberculosis
cggccguucgccggc

SEQ ID NO: 2833389 - RNA, 20 nt, Mycobacterium avium subsp. paratuberculosis
cggccguucgccggccagca

SEQ ID NO: 2833390 - RNA, 18 nt, Mycobacterium avium subsp. paratuberculosis
cggccguucuugcgggug

SEQ ID NO: 2833391 - RNA, 19 nt, Mycobacterium avium subsp. paratuberculosis
cggccguucuugcggguga

SEQ ID NO: 2833392 - RNA, 19 nt, Mycobacterium avium subsp. paratuberculosis
cggccguugggccagcggc

SEQ ID NO: 2833393 - RNA, 22 nt, Mycobacterium avium subsp. paratuberculosis
cggccguugggccagcggcgcc

SEQ ID NO: 2833394 - RNA, 23 nt, Mycobacterium avium subsp. paratuberculosis
cggccguugggccagcggcgccg

SEQ ID NO: 2833395 - RNA, 15 nt, Mycobacterium avium subsp. paratuberculosis
cggccuaggacgccg

SEQ ID NO: 2833396 - RNA, 18 nt, Mycobacterium avium subsp. paratuberculosis
cggccuaggacgccgccc

SEQ ID NO: 2833397 - RNA, 20 nt, Mycobacterium avium subsp. paratuberculosis
cggccuaugcgcccgggaag

SEQ ID NO: 2833398 - RNA, 15 nt, Mycobacterium avium subsp. paratuberculosis
cggccucaccgcggg

SEQ ID NO: 2833399 - RNA, 16 nt, Mycobacterium avium subsp. paratuberculosis
cggccucaccgcgggc

SEQ ID NO: 2833400 - RNA, 21 nt, Mycobacterium avium subsp. paratuberculosis
cggccucaccgcgggccaggc

SEQ ID NO: 2833401 - RNA, 19 nt, Mycobacterium avium subsp. paratuberculosis
cggccucaggcgucgguca

SEQ ID NO: 2833402 - RNA, 23 nt, Mycobacterium avium subsp. paratuberculosis
cggccucaggcgucggucagcag

SEQ ID NO: 2833403 - RNA, 14 nt, Mycobacterium avium subsp. paratuberculosis
cggccuccagccgc

SEQ ID NO: 2833404 - RNA, 16 nt, Mycobacterium avium subsp. paratuberculosis
cggccuccagccgcgc

SEQ ID NO: 2833405 - RNA, 16 nt, Mycobacterium avium subsp. paratuberculosis
cggccugcggcggcaa

SEQ ID NO: 2833406 - RNA, 16 nt, Mycobacterium avium subsp. paratuberculosis
cggccugcgggcgccg

SEQ ID NO: 2833407 - RNA, 17 nt, Mycobacterium avium subsp. paratuberculosis
cggccugcgggcgccgg

SEQ ID NO: 2833408 - RNA, 20 nt, Mycobacterium avium subsp. paratuberculosis
cggccugcgggcgccggcug

SEQ ID NO: 2833409 - RNA, 21 nt, Mycobacterium avium subsp. paratuberculosis
cggccugcgggcgccggcugc

SEQ ID NO: 2833410 - RNA, 23 nt, Mycobacterium avium subsp. paratuberculosis
cggccugcgggcgccggcugccc

SEQ ID NO: 2833411 - RNA, 18 nt, Mycobacterium avium subsp. paratuberculosis
cggccugcuccagcgagu

SEQ ID NO: 2833412 - RNA, 20 nt, Mycobacterium avium subsp. paratuberculosis
cggccugcuccagcgagucg

SEQ ID NO: 2833413 - RNA, 17 nt, Mycobacterium avium subsp. paratuberculosis
cggccugcuucucgccg

SEQ ID NO: 2833414 - RNA, 20 nt, Mycobacterium avium subsp. paratuberculosis
cggccugcuucucgccgucg

SEQ ID NO: 2833415 - RNA, 21 nt, Mycobacterium avium subsp. paratuberculosis
cggccugcuucucgccgucgu

SEQ ID NO: 2833416 - RNA, 20 nt, Mycobacterium avium subsp. paratuberculosis
cggccugcuugaccgccaga

SEQ ID NO: 2833417 - RNA, 20 nt, Mycobacterium avium subsp. paratuberculosis
cggccugcuuggucgccugc

SEQ ID NO: 2833418 - RNA, 18 nt, Mycobacterium avium subsp. paratuberculosis
cggccugcuuuucggccg

SEQ ID NO: 2833419 - RNA, 19 nt, Mycobacterium avium subsp. paratuberculosis
cggccugcuuuucggccga

SEQ ID NO: 2833420 - RNA, 14 nt, Mycobacterium avium subsp. paratuberculosis
cggccuggcccagc

SEQ ID NO: 2833421 - RNA, 15 nt, Mycobacterium avium subsp. paratuberculosis
cggccuggcccagcc

SEQ ID NO: 2833422 - RNA, 18 nt, Mycobacterium avium subsp. paratuberculosis
cggccuggcccagccgcg

SEQ ID NO: 2833423 - RNA, 20 nt, Mycobacterium avium subsp. paratuberculosis
cggccuggcccagccgcguc

SEQ ID NO: 2833424 - RNA, 21 nt, Mycobacterium avium subsp. paratuberculosis
cggccuggcccagccgcguca

SEQ ID NO: 2833425 - RNA, 16 nt, Mycobacterium avium subsp. paratuberculosis
cggccuggccgucgcg

SEQ ID NO: 2833426 - RNA, 20 nt, Mycobacterium avium subsp. paratuberculosis
cggccuggccgucgcggcgc

SEQ ID NO: 2833427 - RNA, 22 nt, Mycobacterium avium subsp. paratuberculosis
cggccuggccgucgcggcgcgg

SEQ ID NO: 2833428 - RNA, 15 nt, Mycobacterium avium subsp. paratuberculosis
cggccugggcgacca

SEQ ID NO: 2833429 - RNA, 17 nt, Mycobacterium avium subsp. paratuberculosis
cggccugggugaccgag

SEQ ID NO: 2833430 - RNA, 17 nt, Mycobacterium avium subsp. paratuberculosis
cggccugguacagcacc

SEQ ID NO: 2833431 - RNA, 20 nt, Mycobacterium avium subsp. paratuberculosis
cggccugguacagcaccgcc

SEQ ID NO: 2833432 - RNA, 21 nt, Mycobacterium avium subsp. paratuberculosis
cggccugguacagcaccgccg

SEQ ID NO: 2833433 - RNA, 20 nt, Mycobacterium avium subsp. paratuberculosis
cggccuuacgcugcgcgacc

SEQ ID NO: 2833434 - RNA, 23 nt, Mycobacterium avium subsp. paratuberculosis
cggccuuacgcugcgcgaccugc

SEQ ID NO: 2833435 - RNA, 23 nt, Mycobacterium avium subsp. paratuberculosis
cggccuucaccagggugccccgc

SEQ ID NO: 2833436 - RNA, 18 nt, Mycobacterium avium subsp. paratuberculosis
cggccuucagcguccacg

SEQ ID NO: 2833437 - RNA, 19 nt, Mycobacterium avium subsp. paratuberculosis
cggccuucagcguccacga

SEQ ID NO: 2833438 - RNA, 21 nt, Mycobacterium avium subsp. paratuberculosis
cggccuucagugaaccccggg

SEQ ID NO: 2833439 - RNA, 22 nt, Mycobacterium avium subsp. paratuberculosis
cggccuucagugaaccccgggc

SEQ ID NO: 2833440 - RNA, 14 nt, Mycobacterium avium subsp. paratuberculosis
cggccuucgccucg

SEQ ID NO: 2833441 - RNA, 15 nt, Mycobacterium avium subsp. paratuberculosis
cggccuucggggugg

SEQ ID NO: 2833442 - RNA, 18 nt, Mycobacterium avium subsp. paratuberculosis
cggccuucucgcgcaccg

SEQ ID NO: 2833443 - RNA, 20 nt, Mycobacterium avium subsp. paratuberculosis
cggccuucucgcgcaccgcg

SEQ ID NO: 2833444 - RNA, 21 nt, Mycobacterium avium subsp. paratuberculosis
cggccuucucgcgcaccgcgg

SEQ ID NO: 2833445 - RNA, 17 nt, Mycobacterium avium subsp. paratuberculosis
cggccuucuuggccgga

SEQ ID NO: 2833446 - RNA, 19 nt, Mycobacterium avium subsp. paratuberculosis
cggccuucuuggccggagc

SEQ ID NO: 2833447 - RNA, 17 nt, Mycobacterium avium subsp. paratuberculosis
cggccuugaacgcgucc

SEQ ID NO: 2833448 - RNA, 15 nt, Mycobacterium avium subsp. paratuberculosis
cggccuugaccacgg

SEQ ID NO: 2833449 - RNA, 22 nt, Mycobacterium avium subsp. paratuberculosis
cggccuugacgaguuccaccuc

SEQ ID NO: 2833450 - RNA, 17 nt, Mycobacterium avium subsp. paratuberculosis
cggccuugagccggucg

SEQ ID NO: 2833451 - RNA, 18 nt, Mycobacterium avium subsp. paratuberculosis
cggccuugagccggucgu

SEQ ID NO: 2833452 - RNA, 16 nt, Mycobacterium avium subsp. paratuberculosis
cggccuugccgcugug

SEQ ID NO: 2833453 - RNA, 19 nt, Mycobacterium avium subsp. paratuberculosis
cggccuugcgagccggagc

SEQ ID NO: 2833454 - RNA, 14 nt, Mycobacterium avium subsp. paratuberculosis
cggccuugcgcacc

SEQ ID NO: 2833455 - RNA, 15 nt, Mycobacterium avium subsp. paratuberculosis
cggccuugcgcaccg

SEQ ID NO: 2833456 - RNA, 19 nt, Mycobacterium avium subsp. paratuberculosis
cggccuugcgcaccggagc

SEQ ID NO: 2833457 - RNA, 19 nt, Mycobacterium avium subsp. paratuberculosis
cggccuugcgggccggagc

SEQ ID NO: 2833458 - RNA, 17 nt, Mycobacterium avium subsp. paratuberculosis
cggccuugcucgccgcg

SEQ ID NO: 2833459 - RNA, 18 nt, Mycobacterium avium subsp. paratuberculosis
cggccuugcucgccgcgu

SEQ ID NO: 2833460 - RNA, 14 nt, Mycobacterium avium subsp. paratuberculosis
cggccuuggccacc

SEQ ID NO: 2833461 - RNA, 18 nt, Mycobacterium avium subsp. paratuberculosis
cggccuuggcccgcgccc

SEQ ID NO: 2833462 - RNA, 14 nt, Mycobacterium avium subsp. paratuberculosis
cggccuuuuccggc

SEQ ID NO: 2833463 - RNA, 18 nt, Mycobacterium avium subsp. paratuberculosis
cggccuuuuccggcgaca

SEQ ID NO: 2833464 - RNA, 23 nt, Mycobacterium avium subsp. paratuberculosis
cggccuuuuccggcgacaccgca

SEQ ID NO: 2833465 - RNA, 20 nt, Mycobacterium avium subsp. paratuberculosis
cggcgaaaacgccugcgccg

SEQ ID NO: 2833466 - RNA, 21 nt, Mycobacterium avium subsp. paratuberculosis
cggcgaaaacgccugcgccgc

SEQ ID NO: 2833467 - RNA, 15 nt, Mycobacterium avium subsp. paratuberculosis
cggcgaaacacagca

SEQ ID NO: 2833468 - RNA, 16 nt, Mycobacterium avium subsp. paratuberculosis
cggcgaaacacagcag

SEQ ID NO: 2833469 - RNA, 18 nt, Mycobacterium avium subsp. paratuberculosis
cggcgaaacacagcagca

SEQ ID NO: 2833470 - RNA, 20 nt, Mycobacterium avium subsp. paratuberculosis
cggcgaaacacagcagcacg

SEQ ID NO: 2833471 - RNA, 20 nt, Mycobacterium avium subsp. paratuberculosis
cggcgaaaucgcuccucgau

SEQ ID NO: 2833472 - RNA, 17 nt, Mycobacterium avium subsp. paratuberculosis
cggcgaaaucggugaag

SEQ ID NO: 2833473 - RNA, 13 nt, Mycobacterium avium subsp. paratuberculosis
cggcgaacaccac

SEQ ID NO: 2833474 - RNA, 15 nt, Mycobacterium avium subsp. paratuberculosis
cggcgaacaccacgg

SEQ ID NO: 2833475 - RNA, 14 nt, Mycobacterium avium subsp. paratuberculosis
cggcgaacaccagc

SEQ ID NO: 2833476 - RNA, 16 nt, Mycobacterium avium subsp. paratuberculosis
cggcgaacaccagcac

SEQ ID NO: 2833477 - RNA, 17 nt, Mycobacterium avium subsp. paratuberculosis
cggcgaacaccagcacc

SEQ ID NO: 2833478 - RNA, 18 nt, Mycobacterium avium subsp. paratuberculosis
cggcgaacaccagcaccc

SEQ ID NO: 2833479 - RNA, 19 nt, Mycobacterium avium subsp. paratuberculosis
cggcgaacaccagcaccca

SEQ ID NO: 2833480 - RNA, 21 nt, Mycobacterium avium subsp. paratuberculosis
cggcgaacaccagcacccagc

SEQ ID NO: 2833481 - RNA, 15 nt, Mycobacterium avium subsp. paratuberculosis
cggcgaacaccucgg

SEQ ID NO: 2833482 - RNA, 17 nt, Mycobacterium avium subsp. paratuberculosis
cggcgaacaccucggcg

SEQ ID NO: 2833483 - RNA, 18 nt, Mycobacterium avium subsp. paratuberculosis
cggcgaacaccucggcga

SEQ ID NO: 2833484 - RNA, 19 nt, Mycobacterium avium subsp. paratuberculosis
cggcgaacaccucggcgau

SEQ ID NO: 2833485 - RNA, 13 nt, Mycobacterium avium subsp. paratuberculosis
cggcgaacagcgg

SEQ ID NO: 2833486 - RNA, 14 nt, Mycobacterium avium subsp. paratuberculosis
cggcgaacagcggg

SEQ ID NO: 2833487 - RNA, 18 nt, Mycobacterium avium subsp. paratuberculosis
cggcgaacagcggggugc

SEQ ID NO: 2833488 - RNA, 19 nt, Mycobacterium avium subsp. paratuberculosis
cggcgaacagcggggugcc

SEQ ID NO: 2833489 - RNA, 13 nt, Mycobacterium avium subsp. paratuberculosis
cggcgacaccgca

SEQ ID NO: 2833490 - RNA, 16 nt, Mycobacterium avium subsp. paratuberculosis
cggcgacaccgcaugg

SEQ ID NO: 2833491 - RNA, 18 nt, Mycobacterium avium subsp. paratuberculosis
cggcgacaccgcauggcc

SEQ ID NO: 2833492 - RNA, 23 nt, Mycobacterium avium subsp. paratuberculosis
cggcgacaccgcauggccggcga

SEQ ID NO: 2833493 - RNA, 14 nt, Mycobacterium avium subsp. paratuberculosis
cggcgacacgccga

SEQ ID NO: 2833494 - RNA, 16 nt, Mycobacterium avium subsp. paratuberculosis
cggcgacacgccgacg

SEQ ID NO: 2833495 - RNA, 17 nt, Mycobacterium avium subsp. paratuberculosis
cggcgacacgccgacga

SEQ ID NO: 2833496 - RNA, 13 nt, Mycobacterium avium subsp. paratuberculosis
cggcgacaucgcc

SEQ ID NO: 2833497 - RNA, 15 nt, Mycobacterium avium subsp. paratuberculosis
cggcgacaucgccga

SEQ ID NO: 2833498 - RNA, 22 nt, Mycobacterium avium subsp. paratuberculosis
cggcgacaucgccgagacgauc

SEQ ID NO: 2833499 - RNA, 16 nt, Mycobacterium avium subsp. paratuberculosis
cggcgacaugcgcagc

SEQ ID NO: 2833500 - RNA, 20 nt, Mycobacterium avium subsp. paratuberculosis
cggcgacaugcgcagcgccc

SEQ ID NO: 2833501 - RNA, 21 nt, Mycobacterium avium subsp. paratuberculosis
cggcgacaugcgcagcgccca

SEQ ID NO: 2833502 - RNA, 17 nt, Mycobacterium avium subsp. paratuberculosis
cggcgacauuggccgcg

SEQ ID NO: 2833503 - RNA, 20 nt, Mycobacterium avium subsp. paratuberculosis
cggcgacauuggccgcgcgc

SEQ ID NO: 2833504 - RNA, 21 nt, Mycobacterium avium subsp. paratuberculosis
cggcgacauuggccgcgcgca

SEQ ID NO: 2833505 - RNA, 20 nt, Mycobacterium avium subsp. paratuberculosis
cggcgaccaauugcgagcag

SEQ ID NO: 2833506 - RNA, 14 nt, Mycobacterium avium subsp. paratuberculosis
cggcgaccacaccg

SEQ ID NO: 2833507 - RNA, 17 nt, Mycobacterium avium subsp. paratuberculosis
cggcgaccacaccgucg

SEQ ID NO: 2833508 - RNA, 18 nt, Mycobacterium avium subsp. paratuberculosis
cggcgaccacaccgucga

SEQ ID NO: 2833509 - RNA, 12 nt, Mycobacterium avium subsp. paratuberculosis
cggcgaccacca

SEQ ID NO: 2833510 - RNA, 18 nt, Mycobacterium avium subsp. paratuberculosis
cggcgaccaccaccgccc

SEQ ID NO: 2833511 - RNA, 17 nt, Mycobacterium avium subsp. paratuberculosis
cggcgaccaccagccgc

SEQ ID NO: 2833512 - RNA, 15 nt, Mycobacterium avium subsp. paratuberculosis
cggcgaccaccucgg

SEQ ID NO: 2833513 - RNA, 17 nt, Mycobacterium avium subsp. paratuberculosis
cggcgaccaccucggcg

SEQ ID NO: 2833514 - RNA, 18 nt, Mycobacterium avium subsp. paratuberculosis
cggcgaccaccucggcga

SEQ ID NO: 2833515 - RNA, 15 nt, Mycobacterium avium subsp. paratuberculosis
cggcgaccacgaaca

SEQ ID NO: 2833516 - RNA, 15 nt, Mycobacterium avium subsp. paratuberculosis
cggcgaccagcaggu

SEQ ID NO: 2833517 - RNA, 17 nt, Mycobacterium avium subsp. paratuberculosis
cggcgaccagcaggucg

SEQ ID NO: 2833518 - RNA, 18 nt, Mycobacterium avium subsp. paratuberculosis
cggcgaccagcaggucga

SEQ ID NO: 2833519 - RNA, 20 nt, Mycobacterium avium subsp. paratuberculosis
cggcgaccagcaggucgagc

SEQ ID NO: 2833520 - RNA, 13 nt, Mycobacterium avium subsp. paratuberculosis
cggcgaccagccc

SEQ ID NO: 2833521 - RNA, 15 nt, Mycobacterium avium subsp. paratuberculosis
cggcgaccagccccu

SEQ ID NO: 2833522 - RNA, 12 nt, Mycobacterium avium subsp. paratuberculosis
cggcgaccagcg

SEQ ID NO: 2833523 - RNA, 16 nt, Mycobacterium avium subsp. paratuberculosis
cggcgaccagcgacgg

SEQ ID NO: 2833524 - RNA, 17 nt, Mycobacterium avium subsp. paratuberculosis
cggcgaccagcgacggc

SEQ ID NO: 2833525 - RNA, 19 nt, Mycobacterium avium subsp. paratuberculosis
cggcgaccagcgacggcag

SEQ ID NO: 2833526 - RNA, 21 nt, Mycobacterium avium subsp. paratuberculosis
cggcgaccagcgacggcaggu

SEQ ID NO: 2833527 - RNA, 17 nt, Mycobacterium avium subsp. paratuberculosis
cggcgaccagcgagccc

SEQ ID NO: 2833528 - RNA, 20 nt, Mycobacterium avium subsp. paratuberculosis
cggcgaccagcgagcccagc

SEQ ID NO: 2833529 - RNA, 15 nt, Mycobacterium avium subsp. paratuberculosis
cggcgaccaugccgu

SEQ ID NO: 2833530 - RNA, 22 nt, Mycobacterium avium subsp. paratuberculosis
cggcgaccaugccguagcgguc

SEQ ID NO: 2833531 - RNA, 18 nt, Mycobacterium avium subsp. paratuberculosis
cggcgaccccguucgccg

SEQ ID NO: 2833532 - RNA, 16 nt, Mycobacterium avium subsp. paratuberculosis
cggcgacccgcuucgc

SEQ ID NO: 2833533 - RNA, 20 nt, Mycobacterium avium subsp. paratuberculosis
cggcgacccgcuucgcccgg

SEQ ID NO: 2833534 - RNA, 23 nt, Mycobacterium avium subsp. paratuberculosis
cggcgacccgcuucgcccggcug

SEQ ID NO: 2833535 - RNA, 14 nt, Mycobacterium avium subsp. paratuberculosis
cggcgacccgcuug

SEQ ID NO: 2833536 - RNA, 17 nt, Mycobacterium avium subsp. paratuberculosis
cggcgaccgccaccucg

SEQ ID NO: 2833537 - RNA, 20 nt, Mycobacterium avium subsp. paratuberculosis
cggcgaccgccaccucgagc

SEQ ID NO: 2833538 - RNA, 21 nt, Mycobacterium avium subsp. paratuberculosis
cggcgaccgcccggggcgcgg

SEQ ID NO: 2833539 - RNA, 12 nt, Mycobacterium avium subsp. paratuberculosis
cggcgaccgccg

SEQ ID NO: 2833540 - RNA, 20 nt, Mycobacterium avium subsp. paratuberculosis
cggcgaccgccuugucggcg

SEQ ID NO: 2833541 - RNA, 22 nt, Mycobacterium avium subsp. paratuberculosis
cggcgaccgccuugucggcgau

SEQ ID NO: 2833542 - RNA, 14 nt, Mycobacterium avium subsp. paratuberculosis
cggcgaccgcgcgc

SEQ ID NO: 2833543 - RNA, 16 nt, Mycobacterium avium subsp. paratuberculosis
cggcgaccgcgcgcgg

SEQ ID NO: 2833544 - RNA, 19 nt, Mycobacterium avium subsp. paratuberculosis
cggcgaccgcgcgcggcgc

SEQ ID NO: 2833545 - RNA, 21 nt, Mycobacterium avium subsp. paratuberculosis
cggcgaccgcgcgcggcgccg

SEQ ID NO: 2833546 - RNA, 13 nt, Mycobacterium avium subsp. paratuberculosis
cggcgaccggggc

SEQ ID NO: 2833547 - RNA, 18 nt, Mycobacterium avium subsp. paratuberculosis
cggcgaccggggcgguga

SEQ ID NO: 2833548 - RNA, 20 nt, Mycobacterium avium subsp. paratuberculosis
cggcgaccggggcggugacc

SEQ ID NO: 2833549 - RNA, 19 nt, Mycobacterium avium subsp. paratuberculosis
cggcgaccgugcccaccag

SEQ ID NO: 2833550 - RNA, 20 nt, Mycobacterium avium subsp. paratuberculosis
cggcgaccgugcccaccagc

SEQ ID NO: 2833551 - RNA, 22 nt, Mycobacterium avium subsp. paratuberculosis
cggcgaccgugcccaccagccg

SEQ ID NO: 2833552 - RNA, 23 nt, Mycobacterium avium subsp. paratuberculosis
cggcgaccgugcccaccagccgg

SEQ ID NO: 2833553 - RNA, 12 nt, Mycobacterium avium subsp. paratuberculosis
cggcgaccucgg

SEQ ID NO: 2833554 - RNA, 21 nt, Mycobacterium avium subsp. paratuberculosis
cggcgaccucggggaugucga

SEQ ID NO: 2833555 - RNA, 16 nt, Mycobacterium avium subsp. paratuberculosis
cggcgaccucuaacgu

SEQ ID NO: 2833556 - RNA, 14 nt, Mycobacterium avium subsp. paratuberculosis
cggcgaccugcggc

SEQ ID NO: 2833557 - RNA, 16 nt, Mycobacterium avium subsp. paratuberculosis
cggcgaccugcggcuc

SEQ ID NO: 2833558 - RNA, 18 nt, Mycobacterium avium subsp. paratuberculosis
cggcgaccugcggcucgu

SEQ ID NO: 2833559 - RNA, 22 nt, Mycobacterium avium subsp. paratuberculosis
cggcgaccuugcggcgcgaugc

SEQ ID NO: 2833560 - RNA, 17 nt, Mycobacterium avium subsp. paratuberculosis
cggcgacgaacgccggc

SEQ ID NO: 2833561 - RNA, 18 nt, Mycobacterium avium subsp. paratuberculosis
cggcgacgaacgccggca

SEQ ID NO: 2833562 - RNA, 23 nt, Mycobacterium avium subsp. paratuberculosis
cggcgacgaacgcuuccagcacc

SEQ ID NO: 2833563 - RNA, 14 nt, Mycobacterium avium subsp. paratuberculosis
cggcgacgaagcag

SEQ ID NO: 2833564 - RNA, 15 nt, Mycobacterium avium subsp. paratuberculosis
cggcgacgaagcagc

SEQ ID NO: 2833565 - RNA, 18 nt, Mycobacterium avium subsp. paratuberculosis
cggcgacgaagcagcucg

SEQ ID NO: 2833566 - RNA, 21 nt, Mycobacterium avium subsp. paratuberculosis
cggcgacgaagcagcucgcgu

SEQ ID NO: 2833567 - RNA, 23 nt, Mycobacterium avium subsp. paratuberculosis
cggcgacgaagcagcucgcguag

SEQ ID NO: 2833568 - RNA, 16 nt, Mycobacterium avium subsp. paratuberculosis
cggcgacgaccaccag

SEQ ID NO: 2833569 - RNA, 22 nt, Mycobacterium avium subsp. paratuberculosis
cggcgacgaccaccaggagcac

SEQ ID NO: 2833570 - RNA, 13 nt, Mycobacterium avium subsp. paratuberculosis
cggcgacgaccgc

SEQ ID NO: 2833571 - RNA, 14 nt, Mycobacterium avium subsp. paratuberculosis
cggcgacgaccgca

SEQ ID NO: 2833572 - RNA, 15 nt, Mycobacterium avium subsp. paratuberculosis
cggcgacgaccgcac

SEQ ID NO: 2833573 - RNA, 17 nt, Mycobacterium avium subsp. paratuberculosis
cggcgacgaccgcaccg

SEQ ID NO: 2833574 - RNA, 18 nt, Mycobacterium avium subsp. paratuberculosis
cggcgacgucgucgaugc

SEQ ID NO: 2833575 - RNA, 19 nt, Mycobacterium avium subsp. paratuberculosis
cggcgacgucgucgaugcc

SEQ ID NO: 2833576 - RNA, 17 nt, Mycobacterium avium subsp. paratuberculosis
cggcgacgucgugcacg

SEQ ID NO: 2833577 - RNA, 20 nt, Mycobacterium avium subsp. paratuberculosis
cggcgacgucgugcacgccg

SEQ ID NO: 2833578 - RNA, 21 nt, Mycobacterium avium subsp. paratuberculosis
cggcgacgucgugcacgccgu

SEQ ID NO: 2833579 - RNA, 14 nt, Mycobacterium avium subsp. paratuberculosis
cggcgacgucgugg

SEQ ID NO: 2833580 - RNA, 20 nt, Mycobacterium avium subsp. paratuberculosis
cggcgacgucguggcccgga

SEQ ID NO: 2833581 - RNA, 22 nt, Mycobacterium avium subsp. paratuberculosis
cggcgacgugaucggcggccug

SEQ ID NO: 2833582 - RNA, 21 nt, Mycobacterium avium subsp. paratuberculosis
cggcgacgugauggucgucgu

SEQ ID NO: 2833583 - RNA, 16 nt, Mycobacterium avium subsp. paratuberculosis
cggcgacgugccggcg

SEQ ID NO: 2833584 - RNA, 18 nt, Mycobacterium avium subsp. paratuberculosis
cggcgacgugccggcggc

SEQ ID NO: 2833585 - RNA, 22 nt, Mycobacterium avium subsp. paratuberculosis
cggcgacgugccggcggcaggu

SEQ ID NO: 2833586 - RNA, 15 nt, Mycobacterium avium subsp. paratuberculosis
cggcgacuccagcag

SEQ ID NO: 2833587 - RNA, 18 nt, Mycobacterium avium subsp. paratuberculosis
cggcgacuccagcagcgc

SEQ ID NO: 2833588 - RNA, 20 nt, Mycobacterium avium subsp. paratuberculosis
cggcgacuccagcagcgcca

SEQ ID NO: 2833589 - RNA, 22 nt, Mycobacterium avium subsp. paratuberculosis
cggcgacuccagcagcgccagc

SEQ ID NO: 2833590 - RNA, 21 nt, Mycobacterium avium subsp. paratuberculosis
cggcgagaucccugcgcucag

SEQ ID NO: 2833591 - RNA, 22 nt, Mycobacterium avium subsp. paratuberculosis
cggcgagaucccugcgcucagc

SEQ ID NO: 2833592 - RNA, 21 nt, Mycobacterium avium subsp. paratuberculosis
cggcgagaucuucuccccgcc

SEQ ID NO: 2833593 - RNA, 21 nt, Mycobacterium avium subsp. paratuberculosis
cggcgagauuggccucggcgc

SEQ ID NO: 2833594 - RNA, 23 nt, Mycobacterium avium subsp. paratuberculosis
cggcgagcaaggcgagcacggca

SEQ ID NO: 2833595 - RNA, 23 nt, Mycobacterium avium subsp. paratuberculosis
cggcgagcacaggaacgcgacgg

SEQ ID NO: 2833596 - RNA, 14 nt, Mycobacterium avium subsp. paratuberculosis
cggcgagcaccgug

SEQ ID NO: 2833597 - RNA, 20 nt, Mycobacterium avium subsp. paratuberculosis
cggcgagcaccgugccgucg

SEQ ID NO: 2833598 - RNA, 21 nt, Mycobacterium avium subsp. paratuberculosis
cggcgagcaccgugccgucgg

SEQ ID NO: 2833599 - RNA, 14 nt, Mycobacterium avium subsp. paratuberculosis
cggcgagcacgccg

SEQ ID NO: 2833600 - RNA, 17 nt, Mycobacterium avium subsp. paratuberculosis
cggcgagcacgccgccg

SEQ ID NO: 2833601 - RNA, 19 nt, Mycobacterium avium subsp. paratuberculosis
cggcgagcagcagcgcggu

SEQ ID NO: 2833602 - RNA, 21 nt, Mycobacterium avium subsp. paratuberculosis
cggcgagcagcagcgcggugc

SEQ ID NO: 2833603 - RNA, 18 nt, Mycobacterium avium subsp. paratuberculosis
cggcgagcagcccggcga

SEQ ID NO: 2833604 - RNA, 13 nt, Mycobacterium avium subsp. paratuberculosis
cggcgagcagccg

SEQ ID NO: 2833605 - RNA, 17 nt, Mycobacterium avium subsp. paratuberculosis
cggcgagcagccgcgcc

SEQ ID NO: 2833606 - RNA, 20 nt, Mycobacterium avium subsp. paratuberculosis
cggcgagcagccgcgccggg

SEQ ID NO: 2833607 - RNA, 13 nt, Mycobacterium avium subsp. paratuberculosis
cggcgagcagcgc

SEQ ID NO: 2833608 - RNA, 18 nt, Mycobacterium avium subsp. paratuberculosis
cggcgagcagcgcgaugc

SEQ ID NO: 2833609 - RNA, 19 nt, Mycobacterium avium subsp. paratuberculosis
cggcgagcagcgcgaugcc

SEQ ID NO: 2833610 - RNA, 21 nt, Mycobacterium avium subsp. paratuberculosis
cggcgagcagcugcagcgucg

SEQ ID NO: 2833611 - RNA, 14 nt, Mycobacterium avium subsp. paratuberculosis
cggcgagccggccg

SEQ ID NO: 2833612 - RNA, 15 nt, Mycobacterium avium subsp. paratuberculosis
cggcgagccggccgu

SEQ ID NO: 2833613 - RNA, 16 nt, Mycobacterium avium subsp. paratuberculosis
cggcgagccgggccgg

SEQ ID NO: 2833614 - RNA, 18 nt, Mycobacterium avium subsp. paratuberculosis
cggcgagccgggccgggu

SEQ ID NO: 2833615 - RNA, 16 nt, Mycobacterium avium subsp. paratuberculosis
cggcgagcgacgccac

SEQ ID NO: 2833616 - RNA, 15 nt, Mycobacterium avium subsp. paratuberculosis
cggcgagcgaggcca

SEQ ID NO: 2833617 - RNA, 12 nt, Mycobacterium avium subsp. paratuberculosis
cggcgagcgcgc

SEQ ID NO: 2833618 - RNA, 20 nt, Mycobacterium avium subsp. paratuberculosis
cggcgagcgcgcugaucgcc

SEQ ID NO: 2833619 - RNA, 12 nt, Mycobacterium avium subsp. paratuberculosis
cggcgagcgcgu

SEQ ID NO: 2833620 - RNA, 14 nt, Mycobacterium avium subsp. paratuberculosis
cggcgagcgcgugc

SEQ ID NO: 2833621 - RNA, 20 nt, Mycobacterium avium subsp. paratuberculosis
cggcgagcgcguucuccacc

SEQ ID NO: 2833622 - RNA, 22 nt, Mycobacterium avium subsp. paratuberculosis
cggcgagcgcguucuccaccgc

SEQ ID NO: 2833623 - RNA, 14 nt, Mycobacterium avium subsp. paratuberculosis
cggcgagcggcacc

SEQ ID NO: 2833624 - RNA, 21 nt, Mycobacterium avium subsp. paratuberculosis
cggcgagcggcccugcgcggc

SEQ ID NO: 2833625 - RNA, 15 nt, Mycobacterium avium subsp. paratuberculosis
cggcgagcgguucga

SEQ ID NO: 2833626 - RNA, 19 nt, Mycobacterium avium subsp. paratuberculosis
cggcgagcugaucggcguu

SEQ ID NO: 2833627 - RNA, 23 nt, Mycobacterium avium subsp. paratuberculosis
cggcgagcugaucggcguuggcg

SEQ ID NO: 2833628 - RNA, 14 nt, Mycobacterium avium subsp. paratuberculosis
cggcgagcugcggg

SEQ ID NO: 2833629 - RNA, 22 nt, Mycobacterium avium subsp. paratuberculosis
cggcgagcuugccuugcgccca

SEQ ID NO: 2833630 - RNA, 15 nt, Mycobacterium avium subsp. paratuberculosis
cggcgagcuuggcgg

SEQ ID NO: 2833631 - RNA, 20 nt, Mycobacterium avium subsp. paratuberculosis
cggcgagcuuggcgggcguc

SEQ ID NO: 2833632 - RNA, 20 nt, Mycobacterium avium subsp. paratuberculosis
cggcgagcuuguccugcacc

SEQ ID NO: 2833633 - RNA, 23 nt, Mycobacterium avium subsp. paratuberculosis
cggcgagcuuguccugcaccgac

SEQ ID NO: 2833634 - RNA, 18 nt, Mycobacterium avium subsp. paratuberculosis
cggcgaggaacucagcgc

SEQ ID NO: 2833635 - RNA, 20 nt, Mycobacterium avium subsp. paratuberculosis
cggcgaggacgucgucgacg

SEQ ID NO: 2833636 - RNA, 19 nt, Mycobacterium avium subsp. paratuberculosis
cggcgaggaucgcgauguc

SEQ ID NO: 2833637 - RNA, 20 nt, Mycobacterium avium subsp. paratuberculosis
cggcgaggauggcgaucauc

SEQ ID NO: 2833638 - RNA, 15 nt, Mycobacterium avium subsp. paratuberculosis
cggcgaggccaggcg

SEQ ID NO: 2833639 - RNA, 12 nt, Mycobacterium avium subsp. paratuberculosis
cggcgaggcggu

SEQ ID NO: 2833640 - RNA, 19 nt, Mycobacterium avium subsp. paratuberculosis
cggcgaggcggucggcgga

SEQ ID NO: 2833641 - RNA, 20 nt, Mycobacterium avium subsp. paratuberculosis
cggcgagguagaccgccgag

SEQ ID NO: 2833642 - RNA, 14 nt, Mycobacterium avium subsp. paratuberculosis
cggcgaggucgucg

SEQ ID NO: 2833643 - RNA, 15 nt, Mycobacterium avium subsp. paratuberculosis
cggcgaggucgucga

SEQ ID NO: 2833644 - RNA, 17 nt, Mycobacterium avium subsp. paratuberculosis
cggcgaggucgucgagg

SEQ ID NO: 2833645 - RNA, 19 nt, Mycobacterium avium subsp. paratuberculosis
cggcgaggugaaccgcgac

SEQ ID NO: 2833646 - RNA, 15 nt, Mycobacterium avium subsp. paratuberculosis
cggcgaggugcgcca

SEQ ID NO: 2833647 - RNA, 21 nt, Mycobacterium avium subsp. paratuberculosis
cggcgaguacccgccgcaccu

SEQ ID NO: 2833648 - RNA, 17 nt, Mycobacterium avium subsp. paratuberculosis
cggcgagucccggcgca

SEQ ID NO: 2833649 - RNA, 19 nt, Mycobacterium avium subsp. paratuberculosis
cggcgagucccggcgcacc

SEQ ID NO: 2833650 - RNA, 20 nt, Mycobacterium avium subsp. paratuberculosis
cggcgagucccggcgcacca

SEQ ID NO: 2833651 - RNA, 16 nt, Mycobacterium avium subsp. paratuberculosis
cggcgaguccgcggag

SEQ ID NO: 2833652 - RNA, 16 nt, Mycobacterium avium subsp. paratuberculosis
cggcgaguccggccag

SEQ ID NO: 2833653 - RNA, 23 nt, Mycobacterium avium subsp. paratuberculosis
cggcgaguccggccaggucgccg

SEQ ID NO: 2833654 - RNA, 20 nt, Mycobacterium avium subsp. paratuberculosis
cggcgagucgcggaucauga

SEQ ID NO: 2833655 - RNA, 16 nt, Mycobacterium avium subsp. paratuberculosis
cggcgagugaggccga

SEQ ID NO: 2833656 - RNA, 14 nt, Mycobacterium avium subsp. paratuberculosis
cggcgagugcaccu

SEQ ID NO: 2833657 - RNA, 23 nt, Mycobacterium avium subsp. paratuberculosis
cggcgagugcgaaacucaccgcg

SEQ ID NO: 2833658 - RNA, 17 nt, Mycobacterium avium subsp. paratuberculosis
cggcgaucuccaccgug

SEQ ID NO: 2833659 - RNA, 16 nt, Mycobacterium avium subsp. paratuberculosis
cggcgaucucgaucgu

SEQ ID NO: 2833660 - RNA, 12 nt, Mycobacterium avium subsp. paratuberculosis
cggcgaucucgg

SEQ ID NO: 2833661 - RNA, 21 nt, Mycobacterium avium subsp. paratuberculosis
cggcgaucucggcggccgcgu

SEQ ID NO: 2833662 - RNA, 18 nt, Mycobacterium avium subsp. paratuberculosis
cggcgaucucggucaccg

SEQ ID NO: 2833663 - RNA, 19 nt, Mycobacterium avium subsp. paratuberculosis
cggcgaucucggucaccga

SEQ ID NO: 2833664 - RNA, 20 nt, Mycobacterium avium subsp. paratuberculosis
cggcgaucucggucaccgag

SEQ ID NO: 2833665 - RNA, 21 nt, Mycobacterium avium subsp. paratuberculosis
cggcgaucucggucaccgagc

SEQ ID NO: 2833666 - RNA, 20 nt, Mycobacterium avium subsp. paratuberculosis
cggcgaucucgucccacggc

SEQ ID NO: 2833667 - RNA, 15 nt, Mycobacterium avium subsp. paratuberculosis
cggcgaucucgucgc

SEQ ID NO: 2833668 - RNA, 20 nt, Mycobacterium avium subsp. paratuberculosis
cggcgaucucgucgcgcagc

SEQ ID NO: 2833669 - RNA, 21 nt, Mycobacterium avium subsp. paratuberculosis
cggcgaucucgucgcgguuga

SEQ ID NO: 2833670 - RNA, 18 nt, Mycobacterium avium subsp. paratuberculosis
cggcgaucugcuccucgg

SEQ ID NO: 2833671 - RNA, 23 nt, Mycobacterium avium subsp. paratuberculosis
cggcgaucugcuccucggucagc

SEQ ID NO: 2833672 - RNA, 18 nt, Mycobacterium avium subsp. paratuberculosis
cggcgaucuggcgguugg

SEQ ID NO: 2833673 - RNA, 21 nt, Mycobacterium avium subsp. paratuberculosis
cggcgaucuugucccgcaugg

SEQ ID NO: 2833674 - RNA, 20 nt, Mycobacterium avium subsp. paratuberculosis
cggcgaucuuugcggccgug

SEQ ID NO: 2833675 - RNA, 21 nt, Mycobacterium avium subsp. paratuberculosis
cggcgaucuuugcggccgugg

SEQ ID NO: 2833676 - RNA, 23 nt, Mycobacterium avium subsp. paratuberculosis
cggcgaucuuugcggccguggcg

SEQ ID NO: 2833677 - RNA, 18 nt, Mycobacterium avium subsp. paratuberculosis
cggcgaugaacacgccga

SEQ ID NO: 2833678 - RNA, 15 nt, Mycobacterium avium subsp. paratuberculosis
cggcgaugaccgccu

SEQ ID NO: 2833679 - RNA, 16 nt, Mycobacterium avium subsp. paratuberculosis
cggcgaugaccgccug

SEQ ID NO: 2833680 - RNA, 17 nt, Mycobacterium avium subsp. paratuberculosis
cggcgaugaccgccugc

SEQ ID NO: 2833681 - RNA, 20 nt, Mycobacterium avium subsp. paratuberculosis
cggcgaugaccgccugcggc

SEQ ID NO: 2833682 - RNA, 14 nt, Mycobacterium avium subsp. paratuberculosis
cggcgaugaccgga

SEQ ID NO: 2833683 - RNA, 14 nt, Mycobacterium avium subsp. paratuberculosis
cggcgaugaccggg

SEQ ID NO: 2833684 - RNA, 21 nt, Mycobacterium avium subsp. paratuberculosis
cggcgaugaccgggacgaagg

SEQ ID NO: 2833685 - RNA, 13 nt, Mycobacterium avium subsp. paratuberculosis
cggcgaugaucac

SEQ ID NO: 2833686 - RNA, 14 nt, Mycobacterium avium subsp. paratuberculosis
cggcgaugaucagg

SEQ ID NO: 2833687 - RNA, 21 nt, Mycobacterium avium subsp. paratuberculosis
cggcgaugauccgcggcgccg

SEQ ID NO: 2833688 - RNA, 15 nt, Mycobacterium avium subsp. paratuberculosis
cggcgaugcagauca

SEQ ID NO: 2833689 - RNA, 18 nt, Mycobacterium avium subsp. paratuberculosis
cggcgaugcagaucacca

SEQ ID NO: 2833690 - RNA, 22 nt, Mycobacterium avium subsp. paratuberculosis
cggcgaugcagaucaccacggu

SEQ ID NO: 2833691 - RNA, 13 nt, Mycobacterium avium subsp. paratuberculosis
cggcgaugccagc

SEQ ID NO: 2833692 - RNA, 18 nt, Mycobacterium avium subsp. paratuberculosis
cggcgaugccagcgcacc

SEQ ID NO: 2833693 - RNA, 19 nt, Mycobacterium avium subsp. paratuberculosis
cggcgaugccagcgcaccg

SEQ ID NO: 2833694 - RNA, 20 nt, Mycobacterium avium subsp. paratuberculosis
cggcgaugccagcgcaccgg

SEQ ID NO: 2833695 - RNA, 14 nt, Mycobacterium avium subsp. paratuberculosis
cggcgaugcccaca

SEQ ID NO: 2833696 - RNA, 17 nt, Mycobacterium avium subsp. paratuberculosis
cggcgaugcccacagcc

SEQ ID NO: 2833697 - RNA, 21 nt, Mycobacterium avium subsp. paratuberculosis
cggcgaugcccacagccaggu

SEQ ID NO: 2833698 - RNA, 20 nt, Mycobacterium avium subsp. paratuberculosis
cggcgaugcccgugaucgcc

SEQ ID NO: 2833699 - RNA, 21 nt, Mycobacterium avium subsp. paratuberculosis
cggcgaugcccgugaucgcca

SEQ ID NO: 2833700 - RNA, 22 nt, Mycobacterium avium subsp. paratuberculosis
cggcgaugcccgugaucgccac

SEQ ID NO: 2833701 - RNA, 14 nt, Mycobacterium avium subsp. paratuberculosis
cggcgaugccgagc

SEQ ID NO: 2833702 - RNA, 15 nt, Mycobacterium avium subsp. paratuberculosis
cggcgaugccgagcc

SEQ ID NO: 2833703 - RNA, 15 nt, Mycobacterium avium subsp. paratuberculosis
cggcgaugccggaaa

SEQ ID NO: 2833704 - RNA, 14 nt, Mycobacterium avium subsp. paratuberculosis
cggcgaugccguug

SEQ ID NO: 2833705 - RNA, 21 nt, Mycobacterium avium subsp. paratuberculosis
cggcgaugccuuccucggcgc

SEQ ID NO: 2833706 - RNA, 22 nt, Mycobacterium avium subsp. paratuberculosis
cggcgaugccuuccucggcgcu

SEQ ID NO: 2833707 - RNA, 16 nt, Mycobacterium avium subsp. paratuberculosis
cggcgaugcgcaccau

SEQ ID NO: 2833708 - RNA, 17 nt, Mycobacterium avium subsp. paratuberculosis
cggcgaugcgcaccauc

SEQ ID NO: 2833709 - RNA, 18 nt, Mycobacterium avium subsp. paratuberculosis
cggcgaugcgcaccauca

SEQ ID NO: 2833710 - RNA, 20 nt, Mycobacterium avium subsp. paratuberculosis
cggcgaugcgcaccaucacc

SEQ ID NO: 2833711 - RNA, 15 nt, Mycobacterium avium subsp. paratuberculosis
cggcgaugcgccguc

SEQ ID NO: 2833712 - RNA, 16 nt, Mycobacterium avium subsp. paratuberculosis
cggcgaugcgccgucu

SEQ ID NO: 2833713 - RNA, 14 nt, Mycobacterium avium subsp. paratuberculosis
cggcgaugcgcgcc

SEQ ID NO: 2833714 - RNA, 18 nt, Mycobacterium avium subsp. paratuberculosis
cggcgaugcgcgccuccg

SEQ ID NO: 2833715 - RNA, 17 nt, Mycobacterium avium subsp. paratuberculosis
cggcgaugcgcggcccg

SEQ ID NO: 2833716 - RNA, 18 nt, Mycobacterium avium subsp. paratuberculosis
cggcgaugcgcggcccgu

SEQ ID NO: 2833717 - RNA, 22 nt, Mycobacterium avium subsp. paratuberculosis
cggcgaugcgcggcccguugag

SEQ ID NO: 2833718 - RNA, 15 nt, Mycobacterium avium subsp. paratuberculosis
cggcgaugcgcucca

SEQ ID NO: 2833719 - RNA, 17 nt, Mycobacterium avium subsp. paratuberculosis
cggcgaugcgcuccagc

SEQ ID NO: 2833720 - RNA, 23 nt, Mycobacterium avium subsp. paratuberculosis
cggcgaugcgcuccagcaggcug

SEQ ID NO: 2833721 - RNA, 20 nt, Mycobacterium avium subsp. paratuberculosis
cggcgaugcguugcgccagc

SEQ ID NO: 2833722 - RNA, 22 nt, Mycobacterium avium subsp. paratuberculosis
cggcgauggaguagcugaccga

SEQ ID NO: 2833723 - RNA, 15 nt, Mycobacterium avium subsp. paratuberculosis
cggcgauggcccgcu

SEQ ID NO: 2833724 - RNA, 17 nt, Mycobacterium avium subsp. paratuberculosis
cggcgauggcccgcugc

SEQ ID NO: 2833725 - RNA, 18 nt, Mycobacterium avium subsp. paratuberculosis
cggcgauggccgacaaca

SEQ ID NO: 2833726 - RNA, 15 nt, Mycobacterium avium subsp. paratuberculosis
cggcgauggcgcggc

SEQ ID NO: 2833727 - RNA, 16 nt, Mycobacterium avium subsp. paratuberculosis
cggcgauggcgcggcc

SEQ ID NO: 2833728 - RNA, 18 nt, Mycobacterium avium subsp. paratuberculosis
cggcgauggcgcggccgg

SEQ ID NO: 2833729 - RNA, 19 nt, Mycobacterium avium subsp. paratuberculosis
cggcgauggcgcggccggc

SEQ ID NO: 2833730 - RNA, 21 nt, Mycobacterium avium subsp. paratuberculosis
cggcgauggcgcggccggccg

SEQ ID NO: 2833731 - RNA, 22 nt, Mycobacterium avium subsp. paratuberculosis
cggcgauggcgcggccggccga

SEQ ID NO: 2833732 - RNA, 16 nt, Mycobacterium avium subsp. paratuberculosis
cggcgauggcggcgug

SEQ ID NO: 2833733 - RNA, 17 nt, Mycobacterium avium subsp. paratuberculosis
cggcgauggcggcgugc

SEQ ID NO: 2833734 - RNA, 20 nt, Mycobacterium avium subsp. paratuberculosis
cggcgauggcggcgugcagu

SEQ ID NO: 2833735 - RNA, 15 nt, Mycobacterium avium subsp. paratuberculosis
cggcgauggugaacu

SEQ ID NO: 2833736 - RNA, 20 nt, Mycobacterium avium subsp. paratuberculosis
cggcgauggugaugcggaug

SEQ ID NO: 2833737 - RNA, 22 nt, Mycobacterium avium subsp. paratuberculosis
cggcgauggugaugugcggcgc

SEQ ID NO: 2833738 - RNA, 16 nt, Mycobacterium avium subsp. paratuberculosis
cggcgaugguggcgcu

SEQ ID NO: 2833739 - RNA, 19 nt, Mycobacterium avium subsp. paratuberculosis
cggcgaugguggcgcugcc

SEQ ID NO: 2833740 - RNA, 14 nt, Mycobacterium avium subsp. paratuberculosis
cggcgauggugggc

SEQ ID NO: 2833741 - RNA, 23 nt, Mycobacterium avium subsp. paratuberculosis
cggcgauggugggcagccggcaa

SEQ ID NO: 2833742 - RNA, 19 nt, Mycobacterium avium subsp. paratuberculosis
cggcgcagcgcgauguccg

SEQ ID NO: 2833743 - RNA, 15 nt, Mycobacterium avium subsp. paratuberculosis
cggcgcagcgcgucg

SEQ ID NO: 2833744 - RNA, 17 nt, Mycobacterium avium subsp. paratuberculosis
cggcgcagcgcgucgcg

SEQ ID NO: 2833745 - RNA, 23 nt, Mycobacterium avium subsp. paratuberculosis
cggcgcagcgcgucgcgcccggc

SEQ ID NO: 2833746 - RNA, 13 nt, Mycobacterium avium subsp. paratuberculosis
cggcgcagcggcc

SEQ ID NO: 2833747 - RNA, 15 nt, Mycobacterium avium subsp. paratuberculosis
cggcgcagcggcccg

SEQ ID NO: 2833748 - RNA, 16 nt, Mycobacterium avium subsp. paratuberculosis
cggcgcagcggcccga

SEQ ID NO: 2833749 - RNA, 16 nt, Mycobacterium avium subsp. paratuberculosis
cggcgcagcgucucga

SEQ ID NO: 2833750 - RNA, 12 nt, Mycobacterium avium subsp. paratuberculosis
cggcgcagcucg

SEQ ID NO: 2833751 - RNA, 18 nt, Mycobacterium avium subsp. paratuberculosis
cggcgcagcucgcgcagc

SEQ ID NO: 2833752 - RNA, 22 nt, Mycobacterium avium subsp. paratuberculosis
cggcgcaggcauuuccaggucc

SEQ ID NO: 2833753 - RNA, 15 nt, Mycobacterium avium subsp. paratuberculosis
cggcgcaggccgguc

SEQ ID NO: 2833754 - RNA, 16 nt, Mycobacterium avium subsp. paratuberculosis
cggcgcaggccgguca

SEQ ID NO: 2833755 - RNA, 16 nt, Mycobacterium avium subsp. paratuberculosis
cggcgcaggcgcgcac

SEQ ID NO: 2833756 - RNA, 17 nt, Mycobacterium avium subsp. paratuberculosis
cggcgcaggcgcgcacc

SEQ ID NO: 2833757 - RNA, 16 nt, Mycobacterium avium subsp. paratuberculosis
cggcgcagggcggccg

SEQ ID NO: 2833758 - RNA, 17 nt, Mycobacterium avium subsp. paratuberculosis
cggcgcagggcggccgg

SEQ ID NO: 2833759 - RNA, 23 nt, Mycobacterium avium subsp. paratuberculosis
cggcgcagggcggccggccaguc

SEQ ID NO: 2833760 - RNA, 12 nt, Mycobacterium avium subsp. paratuberculosis
cggcgcaggucc

SEQ ID NO: 2833761 - RNA, 17 nt, Mycobacterium avium subsp. paratuberculosis
cggcgcagguccggcag

SEQ ID NO: 2833762 - RNA, 18 nt, Mycobacterium avium subsp. paratuberculosis
cggcgcagguccggcagc

SEQ ID NO: 2833763 - RNA, 22 nt, Mycobacterium avium subsp. paratuberculosis
cggcgcaggugaucaaagccgg

SEQ ID NO: 2833764 - RNA, 20 nt, Mycobacterium avium subsp. paratuberculosis
cggcgcagguguccagcccu

SEQ ID NO: 2833765 - RNA, 16 nt, Mycobacterium avium subsp. paratuberculosis
cggcgcagguugucca

SEQ ID NO: 2833766 - RNA, 20 nt, Mycobacterium avium subsp. paratuberculosis
cggcgcagguuguccagccg

SEQ ID NO: 2833767 - RNA, 21 nt, Mycobacterium avium subsp. paratuberculosis
cggcgcagguuguccagccgg

SEQ ID NO: 2833768 - RNA, 22 nt, Mycobacterium avium subsp. paratuberculosis
cggcgcagguuguccagccggu

SEQ ID NO: 2833769 - RNA, 23 nt, Mycobacterium avium subsp. paratuberculosis
cggcgcagguuguccagccggug

SEQ ID NO: 2833770 - RNA, 20 nt, Mycobacterium avium subsp. paratuberculosis
cggcgcagucgaucucgucg

SEQ ID NO: 2833771 - RNA, 14 nt, Mycobacterium avium subsp. paratuberculosis
cggcgcagucggcc

SEQ ID NO: 2833772 - RNA, 19 nt, Mycobacterium avium subsp. paratuberculosis
cggcgcaucaucucggcga

SEQ ID NO: 2833773 - RNA, 21 nt, Mycobacterium avium subsp. paratuberculosis
cggcgcaucaucucggcgaag

SEQ ID NO: 2833774 - RNA, 16 nt, Mycobacterium avium subsp. paratuberculosis
cggcgcaugaccgauc

SEQ ID NO: 2833775 - RNA, 18 nt, Mycobacterium avium subsp. paratuberculosis
cggcgcaugaccgauccg

SEQ ID NO: 2833776 - RNA, 21 nt, Mycobacterium avium subsp. paratuberculosis
cggcgcaugaccgauccgccg

SEQ ID NO: 2833777 - RNA, 22 nt, Mycobacterium avium subsp. paratuberculosis
cggcgcaugaccgauccgccgg

SEQ ID NO: 2833778 - RNA, 21 nt, Mycobacterium avium subsp. paratuberculosis
cggcgccaacaacucagaaca

SEQ ID NO: 2833779 - RNA, 19 nt, Mycobacterium avium subsp. paratuberculosis
cggcgccaacaacucgacg

SEQ ID NO: 2833780 - RNA, 24 nt, Mycobacterium avium subsp. paratuberculosis
cggcgccaacaacucgacgcucgg

SEQ ID NO: 2833781 - RNA, 14 nt, Mycobacterium avium subsp. paratuberculosis
cggcgccaccagcc

SEQ ID NO: 2833782 - RNA, 20 nt, Mycobacterium avium subsp. paratuberculosis
cggcgccaccagccacaccg

SEQ ID NO: 2833783 - RNA, 12 nt, Mycobacterium avium subsp. paratuberculosis
cggcgccacccc

SEQ ID NO: 2833784 - RNA, 12 nt, Mycobacterium avium subsp. paratuberculosis
cggcgccaccgg

SEQ ID NO: 2833785 - RNA, 15 nt, Mycobacterium avium subsp. paratuberculosis
cggcgccaccggcug

SEQ ID NO: 2833786 - RNA, 16 nt, Mycobacterium avium subsp. paratuberculosis
cggcgccaccggcugg

SEQ ID NO: 2833787 - RNA, 19 nt, Mycobacterium avium subsp. paratuberculosis
cggcgccaccggcuggccg

SEQ ID NO: 2833788 - RNA, 16 nt, Mycobacterium avium subsp. paratuberculosis
cggcgccaccgggacc

SEQ ID NO: 2833789 - RNA, 16 nt, Mycobacterium avium subsp. paratuberculosis
cggcgccacgaccagc

SEQ ID NO: 2833790 - RNA, 19 nt, Mycobacterium avium subsp. paratuberculosis
cggcgccacgaccagcggc

SEQ ID NO: 2833791 - RNA, 20 nt, Mycobacterium avium subsp. paratuberculosis
cggcgccacgaccagcggca

SEQ ID NO: 2833792 - RNA, 22 nt, Mycobacterium avium subsp. paratuberculosis
cggcgccacgaccagcggcagc

SEQ ID NO: 2833793 - RNA, 19 nt, Mycobacterium avium subsp. paratuberculosis
cggcgccacgacugcgcgg

SEQ ID NO: 2833794 - RNA, 20 nt, Mycobacterium avium subsp. paratuberculosis
cggcgccacgacugcgcggc

SEQ ID NO: 2833795 - RNA, 21 nt, Mycobacterium avium subsp. paratuberculosis
cggcgccacgacugcgcggcc

SEQ ID NO: 2833796 - RNA, 22 nt, Mycobacterium avium subsp. paratuberculosis
cggcgccacgacugcgcggccg

SEQ ID NO: 2833797 - RNA, 12 nt, Mycobacterium avium subsp. paratuberculosis
cggcgccacgcc

SEQ ID NO: 2833798 - RNA, 16 nt, Mycobacterium avium subsp. paratuberculosis
cggcgccacgccgcga

SEQ ID NO: 2833799 - RNA, 17 nt, Mycobacterium avium subsp. paratuberculosis
cggcgccacgccgcgau

SEQ ID NO: 2833800 - RNA, 18 nt, Mycobacterium avium subsp. paratuberculosis
cggcgccacgccgcgauc

SEQ ID NO: 2833801 - RNA, 19 nt, Mycobacterium avium subsp. paratuberculosis
cggcgccacgccgcgaucc

SEQ ID NO: 2833802 - RNA, 13 nt, Mycobacterium avium subsp. paratuberculosis
cggcgccacgugg

SEQ ID NO: 2833803 - RNA, 17 nt, Mycobacterium avium subsp. paratuberculosis
cggcgccacguggucga

SEQ ID NO: 2833804 - RNA, 19 nt, Mycobacterium avium subsp. paratuberculosis
cggcgccacguggucgagc

SEQ ID NO: 2833805 - RNA, 20 nt, Mycobacterium avium subsp. paratuberculosis
cggcgccacguggucgagca

SEQ ID NO: 2833806 - RNA, 13 nt, Mycobacterium avium subsp. paratuberculosis
cggcgccagcccg

SEQ ID NO: 2833807 - RNA, 16 nt, Mycobacterium avium subsp. paratuberculosis
cggcgccagcccgccg

SEQ ID NO: 2833808 - RNA, 19 nt, Mycobacterium avium subsp. paratuberculosis
cggcgccagcccgccgaac

SEQ ID NO: 2833809 - RNA, 15 nt, Mycobacterium avium subsp. paratuberculosis
cggcgccagcccggu

SEQ ID NO: 2833810 - RNA, 22 nt, Mycobacterium avium subsp. paratuberculosis
cggcgccagcccggugaucgcc

SEQ ID NO: 2833811 - RNA, 13 nt, Mycobacterium avium subsp. paratuberculosis
cggcgccagccgc

SEQ ID NO: 2833812 - RNA, 16 nt, Mycobacterium avium subsp. paratuberculosis
cggcgccagccgcacc

SEQ ID NO: 2833813 - RNA, 20 nt, Mycobacterium avium subsp. paratuberculosis
cggcgccagccgcaccgcga

SEQ ID NO: 2833814 - RNA, 16 nt, Mycobacterium avium subsp. paratuberculosis
cggcgccagcggccga

SEQ ID NO: 2833815 - RNA, 18 nt, Mycobacterium avium subsp. paratuberculosis
cggcgccagcggccgauc

SEQ ID NO: 2833816 - RNA, 19 nt, Mycobacterium avium subsp. paratuberculosis
cggcgccagcggccgauca

SEQ ID NO: 2833817 - RNA, 15 nt, Mycobacterium avium subsp. paratuberculosis
cggcgccaggccggc

SEQ ID NO: 2833818 - RNA, 17 nt, Mycobacterium avium subsp. paratuberculosis
cggcgccaggccggcga

SEQ ID NO: 2833819 - RNA, 12 nt, Mycobacterium avium subsp. paratuberculosis
cggcgccaucgu

SEQ ID NO: 2833820 - RNA, 14 nt, Mycobacterium avium subsp. paratuberculosis
cggcgccaucgugg

SEQ ID NO: 2833821 - RNA, 19 nt, Mycobacterium avium subsp. paratuberculosis
cggcgccaugaacggcggg

SEQ ID NO: 2833822 - RNA, 16 nt, Mycobacterium avium subsp. paratuberculosis
cggcgccaugcgccgc

SEQ ID NO: 2833823 - RNA, 18 nt, Mycobacterium avium subsp. paratuberculosis
cggcgccaugcgccgcgc

SEQ ID NO: 2833824 - RNA, 13 nt, Mycobacterium avium subsp. paratuberculosis
cggcgcccacagc

SEQ ID NO: 2833825 - RNA, 14 nt, Mycobacterium avium subsp. paratuberculosis
cggcgcccacagca

SEQ ID NO: 2833826 - RNA, 15 nt, Mycobacterium avium subsp. paratuberculosis
cggcgcccacagcag

SEQ ID NO: 2833827 - RNA, 21 nt, Mycobacterium avium subsp. paratuberculosis
cggcgccgaccaggcucgcga

SEQ ID NO: 2833828 - RNA, 12 nt, Mycobacterium avium subsp. paratuberculosis
cggcgccgaccc

SEQ ID NO: 2833829 - RNA, 19 nt, Mycobacterium avium subsp. paratuberculosis
cggcgccgacccccgccgc

SEQ ID NO: 2833830 - RNA, 14 nt, Mycobacterium avium subsp. paratuberculosis
cggcgccgaccgag

SEQ ID NO: 2833831 - RNA, 15 nt, Mycobacterium avium subsp. paratuberculosis
cggcgccgaccucgg

SEQ ID NO: 2833832 - RNA, 19 nt, Mycobacterium avium subsp. paratuberculosis
cggcgccgaccucggccag

SEQ ID NO: 2833833 - RNA, 23 nt, Mycobacterium avium subsp. paratuberculosis
cggcgccgaccucggccagcgug

SEQ ID NO: 2833834 - RNA, 14 nt, Mycobacterium avium subsp. paratuberculosis
cggcgccgacgacg

SEQ ID NO: 2833835 - RNA, 16 nt, Mycobacterium avium subsp. paratuberculosis
cggcgccgacggccag

SEQ ID NO: 2833836 - RNA, 21 nt, Mycobacterium avium subsp. paratuberculosis
cggcgccgacggccagcagga

SEQ ID NO: 2833837 - RNA, 13 nt, Mycobacterium avium subsp. paratuberculosis
cggcgccgacggg

SEQ ID NO: 2833838 - RNA, 14 nt, Mycobacterium avium subsp. paratuberculosis
cggcgccgacgucc

SEQ ID NO: 2833839 - RNA, 21 nt, Mycobacterium avium subsp. paratuberculosis
cggcgccgacguccugguuga

SEQ ID NO: 2833840 - RNA, 14 nt, Mycobacterium avium subsp. paratuberculosis
cggcgccgagcacg

SEQ ID NO: 2833841 - RNA, 15 nt, Mycobacterium avium subsp. paratuberculosis
cggcgccgagcacga

SEQ ID NO: 2833842 - RNA, 23 nt, Mycobacterium avium subsp. paratuberculosis
cggcgccgagcacgaacgcggcc

SEQ ID NO: 2833843 - RNA, 15 nt, Mycobacterium avium subsp. paratuberculosis
cggcgccgagcguca

SEQ ID NO: 2833844 - RNA, 19 nt, Mycobacterium avium subsp. paratuberculosis
cggcgccgagcgucacgcu

SEQ ID NO: 2833845 - RNA, 21 nt, Mycobacterium avium subsp. paratuberculosis
cggcgccgagcgucacgcugg

SEQ ID NO: 2833846 - RNA, 18 nt, Mycobacterium avium subsp. paratuberculosis
cggcgccgaucugcucgg

SEQ ID NO: 2833847 - RNA, 16 nt, Mycobacterium avium subsp. paratuberculosis
cggcgccgaugcagca

SEQ ID NO: 2833848 - RNA, 19 nt, Mycobacterium avium subsp. paratuberculosis
cggcgccgaugcagcacau

SEQ ID NO: 2833849 - RNA, 21 nt, Mycobacterium avium subsp. paratuberculosis
cggcgccgauuccgucggugg

SEQ ID NO: 2833850 - RNA, 19 nt, Mycobacterium avium subsp. paratuberculosis
cggcgccgcagcggcgccg

SEQ ID NO: 2833851 - RNA, 10 nt, Mycobacterium avium subsp. paratuberculosis
cggcgccgcc

SEQ ID NO: 2833852 - RNA, 14 nt, Mycobacterium avium subsp. paratuberculosis
cggcgccgccacca

SEQ ID NO: 2833853 - RNA, 16 nt, Mycobacterium avium subsp. paratuberculosis
cggcgccgcccggcga

SEQ ID NO: 2833854 - RNA, 17 nt, Mycobacterium avium subsp. paratuberculosis
cggcgccgcccggcgau

SEQ ID NO: 2833855 - RNA, 14 nt, Mycobacterium avium subsp. paratuberculosis
cggcgccgcccggg

SEQ ID NO: 2833856 - RNA, 11 nt, Mycobacterium avium subsp. paratuberculosis
cggcgccgccg

SEQ ID NO: 2833857 - RNA, 14 nt, Mycobacterium avium subsp. paratuberculosis
cggcgccgccgagc

SEQ ID NO: 2833858 - RNA, 15 nt, Mycobacterium avium subsp. paratuberculosis
cggcgccgccgagcc

SEQ ID NO: 2833859 - RNA, 14 nt, Mycobacterium avium subsp. paratuberculosis
cggcgccgccgggg

SEQ ID NO: 2833860 - RNA, 16 nt, Mycobacterium avium subsp. paratuberculosis
cggcgccgccggggcg

SEQ ID NO: 2833861 - RNA, 15 nt, Mycobacterium avium subsp. paratuberculosis
cggcgccgccggucg

SEQ ID NO: 2833862 - RNA, 18 nt, Mycobacterium avium subsp. paratuberculosis
cggcgccgccggucgccc

SEQ ID NO: 2833863 - RNA, 19 nt, Mycobacterium avium subsp. paratuberculosis
cggcgccgccggucgcccc

SEQ ID NO: 2833864 - RNA, 17 nt, Mycobacterium avium subsp. paratuberculosis
cggcgccgcgaccccgg

SEQ ID NO: 2833865 - RNA, 13 nt, Mycobacterium avium subsp. paratuberculosis
cggcgccgcgccg

SEQ ID NO: 2833866 - RNA, 14 nt, Mycobacterium avium subsp. paratuberculosis
cggcgccgcgccgg

SEQ ID NO: 2833867 - RNA, 15 nt, Mycobacterium avium subsp. paratuberculosis
cggcgccgcgccggc

SEQ ID NO: 2833868 - RNA, 17 nt, Mycobacterium avium subsp. paratuberculosis
cggcgccgcgccggcac

SEQ ID NO: 2833869 - RNA, 18 nt, Mycobacterium avium subsp. paratuberculosis
cggcgccgcgccggcacu

SEQ ID NO: 2833870 - RNA, 13 nt, Mycobacterium avium subsp. paratuberculosis
cggcgccgcgcgc

SEQ ID NO: 2833871 - RNA, 14 nt, Mycobacterium avium subsp. paratuberculosis
cggcgccgcgcgcc

SEQ ID NO: 2833872 - RNA, 17 nt, Mycobacterium avium subsp. paratuberculosis
cggcgccgcgcgccagc

SEQ ID NO: 2833873 - RNA, 19 nt, Mycobacterium avium subsp. paratuberculosis
cggcgccgcgcgccagcgc

SEQ ID NO: 2833874 - RNA, 14 nt, Mycobacterium avium subsp. paratuberculosis
cggcgccgcggccg

SEQ ID NO: 2833875 - RNA, 15 nt, Mycobacterium avium subsp. paratuberculosis
cggcgccgcggcggc

SEQ ID NO: 2833876 - RNA, 21 nt, Mycobacterium avium subsp. paratuberculosis
cggcgccgcggcggcacccag

SEQ ID NO: 2833877 - RNA, 22 nt, Mycobacterium avium subsp. paratuberculosis
cggcgccgcggcggcacccagg

SEQ ID NO: 2833878 - RNA, 12 nt, Mycobacterium avium subsp. paratuberculosis
cggcgccgcggg

SEQ ID NO: 2833879 - RNA, 18 nt, Mycobacterium avium subsp. paratuberculosis
cggcgccgcgggcgccgu

SEQ ID NO: 2833880 - RNA, 13 nt, Mycobacterium avium subsp. paratuberculosis
cggcgccgcgggu

SEQ ID NO: 2833881 - RNA, 15 nt, Mycobacterium avium subsp. paratuberculosis
cggcgccgcgggugc

SEQ ID NO: 2833882 - RNA, 18 nt, Mycobacterium avium subsp. paratuberculosis
cggcgccgcgggugcggc

SEQ ID NO: 2833883 - RNA, 20 nt, Mycobacterium avium subsp. paratuberculosis
cggcgccgcgggugcggcac

SEQ ID NO: 2833884 - RNA, 21 nt, Mycobacterium avium subsp. paratuberculosis
cggcgccgcgggugcggcacg

SEQ ID NO: 2833885 - RNA, 18 nt, Mycobacterium avium subsp. paratuberculosis
cggcgccgcgguagcgga

SEQ ID NO: 2833886 - RNA, 16 nt, Mycobacterium avium subsp. paratuberculosis
cggcgccgcgucggac

SEQ ID NO: 2833887 - RNA, 13 nt, Mycobacterium avium subsp. paratuberculosis
cggcgccggacac

SEQ ID NO: 2833888 - RNA, 18 nt, Mycobacterium avium subsp. paratuberculosis
cggcgccggacggcccgc

SEQ ID NO: 2833889 - RNA, 13 nt, Mycobacterium avium subsp. paratuberculosis
cggcgccggaggg

SEQ ID NO: 2833890 - RNA, 19 nt, Mycobacterium avium subsp. paratuberculosis
cggcgccggaucggccccc

SEQ ID NO: 2833891 - RNA, 20 nt, Mycobacterium avium subsp. paratuberculosis
cggcgccggaucggcccccg

SEQ ID NO: 2833892 - RNA, 14 nt, Mycobacterium avium subsp. paratuberculosis
cggcgccggaugcc

SEQ ID NO: 2833893 - RNA, 22 nt, Mycobacterium avium subsp. paratuberculosis
cggcgccggaugccagcagguc

SEQ ID NO: 2833894 - RNA, 15 nt, Mycobacterium avium subsp. paratuberculosis
cggcgccggcacugc

SEQ ID NO: 2833895 - RNA, 19 nt, Mycobacterium avium subsp. paratuberculosis
cggcgccggcauccagcac

SEQ ID NO: 2833896 - RNA, 21 nt, Mycobacterium avium subsp. paratuberculosis
cggcgccggcauccagcacgg

SEQ ID NO: 2833897 - RNA, 13 nt, Mycobacterium avium subsp. paratuberculosis
cggcgccggccag

SEQ ID NO: 2833898 - RNA, 18 nt, Mycobacterium avium subsp. paratuberculosis
cggcgccggccagcggcu

SEQ ID NO: 2833899 - RNA, 15 nt, Mycobacterium avium subsp. paratuberculosis
cggcgccggcccgcg

SEQ ID NO: 2833900 - RNA, 18 nt, Mycobacterium avium subsp. paratuberculosis
cggcgccggcccgcggcg

SEQ ID NO: 2833901 - RNA, 20 nt, Mycobacterium avium subsp. paratuberculosis
cggcgccggcccgcggcgga

SEQ ID NO: 2833902 - RNA, 12 nt, Mycobacterium avium subsp. paratuberculosis
cggcgccggccg

SEQ ID NO: 2833903 - RNA, 13 nt, Mycobacterium avium subsp. paratuberculosis
cggcgccggccga

SEQ ID NO: 2833904 - RNA, 15 nt, Mycobacterium avium subsp. paratuberculosis
cggcgccggccgaca

SEQ ID NO: 2833905 - RNA, 16 nt, Mycobacterium avium subsp. paratuberculosis
cggcgccggccgacau

SEQ ID NO: 2833906 - RNA, 13 nt, Mycobacterium avium subsp. paratuberculosis
cggcgccggccgc

SEQ ID NO: 2833907 - RNA, 14 nt, Mycobacterium avium subsp. paratuberculosis
cggcgccggccgcc

SEQ ID NO: 2833908 - RNA, 16 nt, Mycobacterium avium subsp. paratuberculosis
cggcgccggccgccgg

SEQ ID NO: 2833909 - RNA, 15 nt, Mycobacterium avium subsp. paratuberculosis
cggcgccggccgggc

SEQ ID NO: 2833910 - RNA, 13 nt, Mycobacterium avium subsp. paratuberculosis
cggcgccggccgu

SEQ ID NO: 2833911 - RNA, 14 nt, Mycobacterium avium subsp. paratuberculosis
cggcgccggccguc

SEQ ID NO: 2833912 - RNA, 15 nt, Mycobacterium avium subsp. paratuberculosis
cggcgccggccguca

SEQ ID NO: 2833913 - RNA, 21 nt, Mycobacterium avium subsp. paratuberculosis
cggcgcgaucgucgaccacca

SEQ ID NO: 2833914 - RNA, 19 nt, Mycobacterium avium subsp. paratuberculosis
cggcgcgaugaucgccggc

SEQ ID NO: 2833915 - RNA, 21 nt, Mycobacterium avium subsp. paratuberculosis
cggcgcgaugaucgccggcgc

SEQ ID NO: 2833916 - RNA, 22 nt, Mycobacterium avium subsp. paratuberculosis
cggcgcgaugaucgccggcgcc

SEQ ID NO: 2833917 - RNA, 22 nt, Mycobacterium avium subsp. paratuberculosis
cggcgcgaugcuauucgggcca

SEQ ID NO: 2833918 - RNA, 17 nt, Mycobacterium avium subsp. paratuberculosis
cggcgcgcaacagcguc

SEQ ID NO: 2833919 - RNA, 22 nt, Mycobacterium avium subsp. paratuberculosis
cggcgcgcaacgauucacccag

SEQ ID NO: 2833920 - RNA, 23 nt, Mycobacterium avium subsp. paratuberculosis
cggcgcgcaacgauucacccagc

SEQ ID NO: 2833921 - RNA, 12 nt, Mycobacterium avium subsp. paratuberculosis
cggcgcgcaccc

SEQ ID NO: 2833922 - RNA, 14 nt, Mycobacterium avium subsp. paratuberculosis
cggcgcgcaccgcg

SEQ ID NO: 2833923 - RNA, 16 nt, Mycobacterium avium subsp. paratuberculosis
cggcgcgcaccgcggg

SEQ ID NO: 2833924 - RNA, 22 nt, Mycobacterium avium subsp. paratuberculosis
cggcgcgcaccgcgggcagcag

SEQ ID NO: 2833925 - RNA, 14 nt, Mycobacterium avium subsp. paratuberculosis
cggcgcgcacggca

SEQ ID NO: 2833926 - RNA, 16 nt, Mycobacterium avium subsp. paratuberculosis
cggcgcgcacggcagc

SEQ ID NO: 2833927 - RNA, 24 nt, Mycobacterium avium subsp. paratuberculosis
cggcgcgcacgucaccgcgcuugc

SEQ ID NO: 2833928 - RNA, 15 nt, Mycobacterium avium subsp. paratuberculosis
cggcgcgcagcaauu

SEQ ID NO: 2833929 - RNA, 21 nt, Mycobacterium avium subsp. paratuberculosis
cggcgcgcagcaauugacgcc

SEQ ID NO: 2833930 - RNA, 13 nt, Mycobacterium avium subsp. paratuberculosis
cggcgcgcagcca

SEQ ID NO: 2833931 - RNA, 21 nt, Mycobacterium avium subsp. paratuberculosis
cggcgcgcagccagucgccgg

SEQ ID NO: 2833932 - RNA, 13 nt, Mycobacterium avium subsp. paratuberculosis
cggcgcgcagccc

SEQ ID NO: 2833933 - RNA, 16 nt, Mycobacterium avium subsp. paratuberculosis
cggcgcgcagcccagc

SEQ ID NO: 2833934 - RNA, 22 nt, Mycobacterium avium subsp. paratuberculosis
cggcgcgcagcccagccagcga

SEQ ID NO: 2833935 - RNA, 13 nt, Mycobacterium avium subsp. paratuberculosis
cggcgcgcagccg

SEQ ID NO: 2833936 - RNA, 14 nt, Mycobacterium avium subsp. paratuberculosis
cggcgcgcagccgg

SEQ ID NO: 2833937 - RNA, 18 nt, Mycobacterium avium subsp. paratuberculosis
cggcgcgcagccggccgu

SEQ ID NO: 2833938 - RNA, 19 nt, Mycobacterium avium subsp. paratuberculosis
cggcgcgcagccggccguc

SEQ ID NO: 2833939 - RNA, 15 nt, Mycobacterium avium subsp. paratuberculosis
cggcgcgcagcgugu

SEQ ID NO: 2833940 - RNA, 17 nt, Mycobacterium avium subsp. paratuberculosis
cggcgcgcagcucgcgc

SEQ ID NO: 2833941 - RNA, 20 nt, Mycobacterium avium subsp. paratuberculosis
cggcgcgcagcucgcgcagc

SEQ ID NO: 2833942 - RNA, 24 nt, Mycobacterium avium subsp. paratuberculosis
cggcgcgcagcucgcgcagccggc

SEQ ID NO: 2833943 - RNA, 14 nt, Mycobacterium avium subsp. paratuberculosis
cggcgcgcaggcgc

SEQ ID NO: 2833944 - RNA, 14 nt, Mycobacterium avium subsp. paratuberculosis
cggcgcgcaggcug

SEQ ID NO: 2833945 - RNA, 17 nt, Mycobacterium avium subsp. paratuberculosis
cggcgcgcaggcuggca

SEQ ID NO: 2833946 - RNA, 22 nt, Mycobacterium avium subsp. paratuberculosis
cggcgcgcaggucguccgacag

SEQ ID NO: 2833947 - RNA, 16 nt, Mycobacterium avium subsp. paratuberculosis
cggcgcgcaucccgau

SEQ ID NO: 2833948 - RNA, 21 nt, Mycobacterium avium subsp. paratuberculosis
cggcgcgcaucgccguccacg

SEQ ID NO: 2833949 - RNA, 16 nt, Mycobacterium avium subsp. paratuberculosis
cggcgcgcaucgucgc

SEQ ID NO: 2833950 - RNA, 22 nt, Mycobacterium avium subsp. paratuberculosis
cggcgcgcaucgucgcggcgcu

SEQ ID NO: 2833951 - RNA, 19 nt, Mycobacterium avium subsp. paratuberculosis
cggcgcgcaucuugaucuc

SEQ ID NO: 2833952 - RNA, 20 nt, Mycobacterium avium subsp. paratuberculosis
cggcgcgccacgacguaccc

SEQ ID NO: 2833953 - RNA, 14 nt, Mycobacterium avium subsp. paratuberculosis
cggcgcgcccgacg

SEQ ID NO: 2833954 - RNA, 22 nt, Mycobacterium avium subsp. paratuberculosis
cggcgcgcccgagucacccggc

SEQ ID NO: 2833955 - RNA, 13 nt, Mycobacterium avium subsp. paratuberculosis
cggcgcgcccgga

SEQ ID NO: 2833956 - RNA, 16 nt, Mycobacterium avium subsp. paratuberculosis
cggcgcgcccggaaag

SEQ ID NO: 2833957 - RNA, 23 nt, Mycobacterium avium subsp. paratuberculosis
cggcgcgcccggaaagcgcgggc

SEQ ID NO: 2833958 - RNA, 14 nt, Mycobacterium avium subsp. paratuberculosis
cggcgcgccgaaga

SEQ ID NO: 2833959 - RNA, 12 nt, Mycobacterium avium subsp. paratuberculosis
cggcgcgccgca

SEQ ID NO: 2833960 - RNA, 13 nt, Mycobacterium avium subsp. paratuberculosis
cggcgcgccgcag

SEQ ID NO: 2833961 - RNA, 18 nt, Mycobacterium avium subsp. paratuberculosis
cggcgcgccgcgauuucc

SEQ ID NO: 2833962 - RNA, 13 nt, Mycobacterium avium subsp. paratuberculosis
cggcgcgccgcgu

SEQ ID NO: 2833963 - RNA, 13 nt, Mycobacterium avium subsp. paratuberculosis
cggcgcgccggcc

SEQ ID NO: 2833964 - RNA, 14 nt, Mycobacterium avium subsp. paratuberculosis
cggcgcgccggccg

SEQ ID NO: 2833965 - RNA, 15 nt, Mycobacterium avium subsp. paratuberculosis
cggcgcgccggccgg

SEQ ID NO: 2833966 - RNA, 14 nt, Mycobacterium avium subsp. paratuberculosis
cggcgcgccgggca

SEQ ID NO: 2833967 - RNA, 15 nt, Mycobacterium avium subsp. paratuberculosis
cggcgcgccgggcag

SEQ ID NO: 2833968 - RNA, 23 nt, Mycobacterium avium subsp. paratuberculosis
cggcgcgccgggcagcccgccgc

SEQ ID NO: 2833969 - RNA, 14 nt, Mycobacterium avium subsp. paratuberculosis
cggcgcgccguccu

SEQ ID NO: 2833970 - RNA, 15 nt, Mycobacterium avium subsp. paratuberculosis
cggcgcgccugcgcg

SEQ ID NO: 2833971 - RNA, 16 nt, Mycobacterium avium subsp. paratuberculosis
cggcgcgccugcgcgg

SEQ ID NO: 2833972 - RNA, 20 nt, Mycobacterium avium subsp. paratuberculosis
cggcgcgccugcgcggcggc

SEQ ID NO: 2833973 - RNA, 22 nt, Mycobacterium avium subsp. paratuberculosis
cggcgcgccugcgcggcggcgu

SEQ ID NO: 2833974 - RNA, 13 nt, Mycobacterium avium subsp. paratuberculosis
cggcgcgcgagcg

SEQ ID NO: 2833975 - RNA, 14 nt, Mycobacterium avium subsp. paratuberculosis
cggcgcgcgagcgu

SEQ ID NO: 2833976 - RNA, 21 nt, Mycobacterium avium subsp. paratuberculosis
cggcgcgcgagcgucacgcug

SEQ ID NO: 2833977 - RNA, 14 nt, Mycobacterium avium subsp. paratuberculosis
cggcgcgcgaugga

SEQ ID NO: 2833978 - RNA, 20 nt, Mycobacterium avium subsp. paratuberculosis
cggcgcgcgauggacagcag

SEQ ID NO: 2833979 - RNA, 17 nt, Mycobacterium avium subsp. paratuberculosis
cggcgcgcgccagcguc

SEQ ID NO: 2833980 - RNA, 12 nt, Mycobacterium avium subsp. paratuberculosis
cggcgcgcgccg

SEQ ID NO: 2833981 - RNA, 14 nt, Mycobacterium avium subsp. paratuberculosis
cggcgcgcgccgau

SEQ ID NO: 2833982 - RNA, 16 nt, Mycobacterium avium subsp. paratuberculosis
cggcgcgcgccgauca

SEQ ID NO: 2833983 - RNA, 18 nt, Mycobacterium avium subsp. paratuberculosis
cggcgcgcgcgccccagc

SEQ ID NO: 2833984 - RNA, 13 nt, Mycobacterium avium subsp. paratuberculosis
cggcgcgcggccg

SEQ ID NO: 2833985 - RNA, 15 nt, Mycobacterium avium subsp. paratuberculosis
cggcgcgcggggugu

SEQ ID NO: 2833986 - RNA, 22 nt, Mycobacterium avium subsp. paratuberculosis
cggcgcgcggggugucgcggcu

SEQ ID NO: 2833987 - RNA, 16 nt, Mycobacterium avium subsp. paratuberculosis
cggcgcgcgguggugu

SEQ ID NO: 2833988 - RNA, 20 nt, Mycobacterium avium subsp. paratuberculosis
cggcgcgcguauuccagcgc

SEQ ID NO: 2833989 - RNA, 21 nt, Mycobacterium avium subsp. paratuberculosis
cggcgcgcguauuccagcgcc

SEQ ID NO: 2833990 - RNA, 22 nt, Mycobacterium avium subsp. paratuberculosis
cggcgcgcguauuccagcgcca

SEQ ID NO: 2833991 - RNA, 15 nt, Mycobacterium avium subsp. paratuberculosis
cggcgcgcucggugc

SEQ ID NO: 2833992 - RNA, 15 nt, Mycobacterium avium subsp. paratuberculosis
cggcgcgcucgucgu

SEQ ID NO: 2833993 - RNA, 21 nt, Mycobacterium avium subsp. paratuberculosis
cggcgcgcucgucgucgguga

SEQ ID NO: 2833994 - RNA, 23 nt, Mycobacterium avium subsp. paratuberculosis
cggcgcgcucuaacuccgcucgg

SEQ ID NO: 2833995 - RNA, 20 nt, Mycobacterium avium subsp. paratuberculosis
cggcgcgcugaagcgcgacc

SEQ ID NO: 2833996 - RNA, 22 nt, Mycobacterium avium subsp. paratuberculosis
cggcgcgcugaagcgcgacccc

SEQ ID NO: 2833997 - RNA, 17 nt, Mycobacterium avium subsp. paratuberculosis
cggcgcgcugcggcguc

SEQ ID NO: 2833998 - RNA, 16 nt, Mycobacterium avium subsp. paratuberculosis
cggcgcgguggcgugc

SEQ ID NO: 2833999 - RNA, 19 nt, Mycobacterium avium subsp. paratuberculosis
cggcgcgguggcgugcagc

SEQ ID NO: 2834000 - RNA, 22 nt, Mycobacterium avium subsp. paratuberculosis
cggcgcgguggcgugcagcgcg

SEQ ID NO: 2834001 - RNA, 23 nt, Mycobacterium avium subsp. paratuberculosis
cggcgcgguggcgugcagcgcgg

SEQ ID NO: 2834002 - RNA, 24 nt, Mycobacterium avium subsp. paratuberculosis
cggcgcgguggcgugcagcgcggc

SEQ ID NO: 2834003 - RNA, 15 nt, Mycobacterium avium subsp. paratuberculosis
cggcgcggugggcgg

SEQ ID NO: 2834004 - RNA, 18 nt, Mycobacterium avium subsp. paratuberculosis
cggcgcggugggcggcgg

SEQ ID NO: 2834005 - RNA, 18 nt, Mycobacterium avium subsp. paratuberculosis
cggcgcgguugaccgccg

SEQ ID NO: 2834006 - RNA, 19 nt, Mycobacterium avium subsp. paratuberculosis
cggcgcgguugaccgccga

SEQ ID NO: 2834007 - RNA, 20 nt, Mycobacterium avium subsp. paratuberculosis
cggcgcgguugaccgccgac

SEQ ID NO: 2834008 - RNA, 21 nt, Mycobacterium avium subsp. paratuberculosis
cggcgcgguugaccgccgaca

SEQ ID NO: 2834009 - RNA, 22 nt, Mycobacterium avium subsp. paratuberculosis
cggcgcgguugaccgccgacac

SEQ ID NO: 2834010 - RNA, 14 nt, Mycobacterium avium subsp. paratuberculosis
cggcgcgguugacg

SEQ ID NO: 2834011 - RNA, 20 nt, Mycobacterium avium subsp. paratuberculosis
cggcgcgguugcccgcaccc

SEQ ID NO: 2834012 - RNA, 17 nt, Mycobacterium avium subsp. paratuberculosis
cggcgcguccauggucg

SEQ ID NO: 2834013 - RNA, 18 nt, Mycobacterium avium subsp. paratuberculosis
cggcgcguccauggucga

SEQ ID NO: 2834014 - RNA, 18 nt, Mycobacterium avium subsp. paratuberculosis
cggcgcguccggaggugc

SEQ ID NO: 2834015 - RNA, 16 nt, Mycobacterium avium subsp. paratuberculosis
cggcgcgucgcugggc

SEQ ID NO: 2834016 - RNA, 17 nt, Mycobacterium avium subsp. paratuberculosis
cggcgcgucgcugggca

SEQ ID NO: 2834017 - RNA, 18 nt, Mycobacterium avium subsp. paratuberculosis
cggcgcgucgcugggcag

SEQ ID NO: 2834018 - RNA, 24 nt, Mycobacterium avium subsp. paratuberculosis
cggcgcgucgcugggcagccgucc

SEQ ID NO: 2834019 - RNA, 14 nt, Mycobacterium avium subsp. paratuberculosis
cggcgcgucggcgu

SEQ ID NO: 2834020 - RNA, 15 nt, Mycobacterium avium subsp. paratuberculosis
cggcgcgucggcguc

SEQ ID NO: 2834021 - RNA, 13 nt, Mycobacterium avium subsp. paratuberculosis
cggcgcgucgucc

SEQ ID NO: 2834022 - RNA, 16 nt, Mycobacterium avium subsp. paratuberculosis
cggcgcgucguccgac

SEQ ID NO: 2834023 - RNA, 19 nt, Mycobacterium avium subsp. paratuberculosis
cggcgcgucguccgacacc

SEQ ID NO: 2834024 - RNA, 23 nt, Mycobacterium avium subsp. paratuberculosis
cggcgcgucguccgacaccaccu

SEQ ID NO: 2834025 - RNA, 19 nt, Mycobacterium avium subsp. paratuberculosis
cggcgcgugauccggaaug

SEQ ID NO: 2834026 - RNA, 23 nt, Mycobacterium avium subsp. paratuberculosis
cggcgcgugauccggaaugcggu

SEQ ID NO: 2834027 - RNA, 14 nt, Mycobacterium avium subsp. paratuberculosis
cggcgcgugcgccg

SEQ ID NO: 2834028 - RNA, 20 nt, Mycobacterium avium subsp. paratuberculosis
cggcgcgugcgccgcggcgg

SEQ ID NO: 2834029 - RNA, 16 nt, Mycobacterium avium subsp. paratuberculosis
cggcgcgugcgcgacg

SEQ ID NO: 2834030 - RNA, 20 nt, Mycobacterium avium subsp. paratuberculosis
cggcgcgugcuguugcaggu

SEQ ID NO: 2834031 - RNA, 21 nt, Mycobacterium avium subsp. paratuberculosis
cggcgcgugcuguugcaggug

SEQ ID NO: 2834032 - RNA, 20 nt, Mycobacterium avium subsp. paratuberculosis
cggcgcguuccaucagcgcc

SEQ ID NO: 2834033 - RNA, 23 nt, Mycobacterium avium subsp. paratuberculosis
cggcgcguuccaucagcgcccgc

SEQ ID NO: 2834034 - RNA, 15 nt, Mycobacterium avium subsp. paratuberculosis
cggcgcguuggcccg

SEQ ID NO: 2834035 - RNA, 14 nt, Mycobacterium avium subsp. paratuberculosis
cggcgcguuggccg

SEQ ID NO: 2834036 - RNA, 23 nt, Mycobacterium avium subsp. paratuberculosis
cggcgcuaaagccaccagcguuc

SEQ ID NO: 2834037 - RNA, 18 nt, Mycobacterium avium subsp. paratuberculosis
cggcgcuaaagccgaccg

SEQ ID NO: 2834038 - RNA, 19 nt, Mycobacterium avium subsp. paratuberculosis
cggcgcuaaagccgaccgc

SEQ ID NO: 2834039 - RNA, 20 nt, Mycobacterium avium subsp. paratuberculosis
cggcgcuaaagccgaccgcc

SEQ ID NO: 2834040 - RNA, 16 nt, Mycobacterium avium subsp. paratuberculosis
cggcgcuacgccggcu

SEQ ID NO: 2834041 - RNA, 15 nt, Mycobacterium avium subsp. paratuberculosis
cggcgcucaccgcga

SEQ ID NO: 2834042 - RNA, 17 nt, Mycobacterium avium subsp. paratuberculosis
cggcgcucaccgcgaug

SEQ ID NO: 2834043 - RNA, 13 nt, Mycobacterium avium subsp. paratuberculosis
cggcgcucaccgg

SEQ ID NO: 2834044 - RNA, 17 nt, Mycobacterium avium subsp. paratuberculosis
cggcgcucaccggcgug

SEQ ID NO: 2834045 - RNA, 18 nt, Mycobacterium avium subsp. paratuberculosis
cggcgcucaccggcgugg

SEQ ID NO: 2834046 - RNA, 21 nt, Mycobacterium avium subsp. paratuberculosis
cggcgcucaccggcguggugg

SEQ ID NO: 2834047 - RNA, 15 nt, Mycobacterium avium subsp. paratuberculosis
cggcgcucagcgcgg

SEQ ID NO: 2834048 - RNA, 15 nt, Mycobacterium avium subsp. paratuberculosis
cggcgcuccagcggg

SEQ ID NO: 2834049 - RNA, 16 nt, Mycobacterium avium subsp. paratuberculosis
cggcgcuccagcgggc

SEQ ID NO: 2834050 - RNA, 17 nt, Mycobacterium avium subsp. paratuberculosis
cggcgcuccagcgggcg

SEQ ID NO: 2834051 - RNA, 22 nt, Mycobacterium avium subsp. paratuberculosis
cggcgcuccagcgggcggcggu

SEQ ID NO: 2834052 - RNA, 23 nt, Mycobacterium avium subsp. paratuberculosis
cggcgcuccagcgggcggcggug

SEQ ID NO: 2834053 - RNA, 19 nt, Mycobacterium avium subsp. paratuberculosis
cggcgcucccgauggcucg

SEQ ID NO: 2834054 - RNA, 12 nt, Mycobacterium avium subsp. paratuberculosis
cggcgcucgccg

SEQ ID NO: 2834055 - RNA, 17 nt, Mycobacterium avium subsp. paratuberculosis
cggcgcucgccgcgcgg

SEQ ID NO: 2834056 - RNA, 19 nt, Mycobacterium avium subsp. paratuberculosis
cggcgcucgccgcgcggcc

SEQ ID NO: 2834057 - RNA, 14 nt, Mycobacterium avium subsp. paratuberculosis
cggcgcucgcgggu

SEQ ID NO: 2834058 - RNA, 14 nt, Mycobacterium avium subsp. paratuberculosis
cggcgcucggugug

SEQ ID NO: 2834059 - RNA, 19 nt, Mycobacterium avium subsp. paratuberculosis
cggcgcucggugugcgguu

SEQ ID NO: 2834060 - RNA, 12 nt, Mycobacterium avium subsp. paratuberculosis
cggcgcucgucg

SEQ ID NO: 2834061 - RNA, 21 nt, Mycobacterium avium subsp. paratuberculosis
cggcgcucgucgucgccgaug

SEQ ID NO: 2834062 - RNA, 23 nt, Mycobacterium avium subsp. paratuberculosis
cggcgcugaacugcucgaccagc

SEQ ID NO: 2834063 - RNA, 13 nt, Mycobacterium avium subsp. paratuberculosis
cggcgcugcagca

SEQ ID NO: 2834064 - RNA, 16 nt, Mycobacterium avium subsp. paratuberculosis
cggcgcugcagcagcc

SEQ ID NO: 2834065 - RNA, 19 nt, Mycobacterium avium subsp. paratuberculosis
cggcgcugcagcagcccga

SEQ ID NO: 2834066 - RNA, 20 nt, Mycobacterium avium subsp. paratuberculosis
cggcgcugcagcagcccgau

SEQ ID NO: 2834067 - RNA, 21 nt, Mycobacterium avium subsp. paratuberculosis
cggcgcugcagcagcccgauc

SEQ ID NO: 2834068 - RNA, 20 nt, Mycobacterium avium subsp. paratuberculosis
cggcgcugccccagccacag

SEQ ID NO: 2834069 - RNA, 15 nt, Mycobacterium avium subsp. paratuberculosis
cggcgcugcccgccg

SEQ ID NO: 2834070 - RNA, 16 nt, Mycobacterium avium subsp. paratuberculosis
cggcgcugcccgccgc

SEQ ID NO: 2834071 - RNA, 19 nt, Mycobacterium avium subsp. paratuberculosis
cggcgcugcccgccgcggu

SEQ ID NO: 2834072 - RNA, 14 nt, Mycobacterium avium subsp. paratuberculosis
cggcgcugcccgcg

SEQ ID NO: 2834073 - RNA, 20 nt, Mycobacterium avium subsp. paratuberculosis
cggcgcugcccgcgaucgcc

SEQ ID NO: 2834074 - RNA, 21 nt, Mycobacterium avium subsp. paratuberculosis
cggcgcugcccgcgaucgcca

SEQ ID NO: 2834075 - RNA, 15 nt, Mycobacterium avium subsp. paratuberculosis
cggcgcugcccgucg

SEQ ID NO: 2834076 - RNA, 16 nt, Mycobacterium avium subsp. paratuberculosis
cggcgcugcccgucga

SEQ ID NO: 2834077 - RNA, 18 nt, Mycobacterium avium subsp. paratuberculosis
cggcgcugcccgucgacc

SEQ ID NO: 2834078 - RNA, 19 nt, Mycobacterium avium subsp. paratuberculosis
cggcgcugcccgucgaccu

SEQ ID NO: 2834079 - RNA, 13 nt, Mycobacterium avium subsp. paratuberculosis
cggcgcugccgcc

SEQ ID NO: 2834080 - RNA, 14 nt, Mycobacterium avium subsp. paratuberculosis
cggcgcugccgccg

SEQ ID NO: 2834081 - RNA, 15 nt, Mycobacterium avium subsp. paratuberculosis
cggcgcugccgccgg

SEQ ID NO: 2834082 - RNA, 15 nt, Mycobacterium avium subsp. paratuberculosis
cggcggaugggugcg

SEQ ID NO: 2834083 - RNA, 20 nt, Mycobacterium avium subsp. paratuberculosis
cggcggaugggugcgguuga

SEQ ID NO: 2834084 - RNA, 18 nt, Mycobacterium avium subsp. paratuberculosis
cggcggauguccugguga

SEQ ID NO: 2834085 - RNA, 19 nt, Mycobacterium avium subsp. paratuberculosis
cggcggauucucgcucugc

SEQ ID NO: 2834086 - RNA, 22 nt, Mycobacterium avium subsp. paratuberculosis
cggcggauucucgcucugccgg

SEQ ID NO: 2834087 - RNA, 18 nt, Mycobacterium avium subsp. paratuberculosis
cggcggcaaaacgcuggg

SEQ ID NO: 2834088 - RNA, 19 nt, Mycobacterium avium subsp. paratuberculosis
cggcggcaaaacgcugggc

SEQ ID NO: 2834089 - RNA, 21 nt, Mycobacterium avium subsp. paratuberculosis
cggcggcaaaacgcugggcgc

SEQ ID NO: 2834090 - RNA, 19 nt, Mycobacterium avium subsp. paratuberculosis
cggcggcaaagcguugccg

SEQ ID NO: 2834091 - RNA, 18 nt, Mycobacterium avium subsp. paratuberculosis
cggcggcaaguccggguc

SEQ ID NO: 2834092 - RNA, 13 nt, Mycobacterium avium subsp. paratuberculosis
cggcggcaccacc

SEQ ID NO: 2834093 - RNA, 14 nt, Mycobacterium avium subsp. paratuberculosis
cggcggcaccaccc

SEQ ID NO: 2834094 - RNA, 15 nt, Mycobacterium avium subsp. paratuberculosis
cggcggcaccacccg

SEQ ID NO: 2834095 - RNA, 16 nt, Mycobacterium avium subsp. paratuberculosis
cggcggcaccacccgc

SEQ ID NO: 2834096 - RNA, 18 nt, Mycobacterium avium subsp. paratuberculosis
cggcggcaccacccgcgg

SEQ ID NO: 2834097 - RNA, 22 nt, Mycobacterium avium subsp. paratuberculosis
cggcggcaccacccgcggccgg

SEQ ID NO: 2834098 - RNA, 23 nt, Mycobacterium avium subsp. paratuberculosis
cggcggcaccacccgcggccggc

SEQ ID NO: 2834099 - RNA, 22 nt, Mycobacterium avium subsp. paratuberculosis
cggcggcacccaggucaccgag

SEQ ID NO: 2834100 - RNA, 12 nt, Mycobacterium avium subsp. paratuberculosis
cggcggcaccgc

SEQ ID NO: 2834101 - RNA, 15 nt, Mycobacterium avium subsp. paratuberculosis
cggcggcaccgcccg

SEQ ID NO: 2834102 - RNA, 14 nt, Mycobacterium avium subsp. paratuberculosis
cggcggcaccgccg

SEQ ID NO: 2834103 - RNA, 18 nt, Mycobacterium avium subsp. paratuberculosis
cggcggcaccgccgcggu

SEQ ID NO: 2834104 - RNA, 21 nt, Mycobacterium avium subsp. paratuberculosis
cggcggcagauagaucagcag

SEQ ID NO: 2834105 - RNA, 13 nt, Mycobacterium avium subsp. paratuberculosis
cggcggcagcacc

SEQ ID NO: 2834106 - RNA, 14 nt, Mycobacterium avium subsp. paratuberculosis
cggcggcagcaccc

SEQ ID NO: 2834107 - RNA, 17 nt, Mycobacterium avium subsp. paratuberculosis
cggcggcagcacccgca

SEQ ID NO: 2834108 - RNA, 17 nt, Mycobacterium avium subsp. paratuberculosis
cggcggcagcagcccgu

SEQ ID NO: 2834109 - RNA, 16 nt, Mycobacterium avium subsp. paratuberculosis
cggcggcagccaggcg

SEQ ID NO: 2834110 - RNA, 21 nt, Mycobacterium avium subsp. paratuberculosis
cggcggcagcgacucgggcag

SEQ ID NO: 2834111 - RNA, 13 nt, Mycobacterium avium subsp. paratuberculosis
cggcggcagcgag

SEQ ID NO: 2834112 - RNA, 14 nt, Mycobacterium avium subsp. paratuberculosis
cggcggcagcgagg

SEQ ID NO: 2834113 - RNA, 15 nt, Mycobacterium avium subsp. paratuberculosis
cggcggcagcgaggc

SEQ ID NO: 2834114 - RNA, 16 nt, Mycobacterium avium subsp. paratuberculosis
cggcggcagcgaggcg

SEQ ID NO: 2834115 - RNA, 20 nt, Mycobacterium avium subsp. paratuberculosis
cggcggcagcgaggcgcgca

SEQ ID NO: 2834116 - RNA, 22 nt, Mycobacterium avium subsp. paratuberculosis
cggcggcagcgaggcgcgcagg

SEQ ID NO: 2834117 - RNA, 14 nt, Mycobacterium avium subsp. paratuberculosis
cggcggcagcgcgg

SEQ ID NO: 2834118 - RNA, 16 nt, Mycobacterium avium subsp. paratuberculosis
cggcggcagcgcggcg

SEQ ID NO: 2834119 - RNA, 17 nt, Mycobacterium avium subsp. paratuberculosis
cggcggcagguggucgg

SEQ ID NO: 2834120 - RNA, 22 nt, Mycobacterium avium subsp. paratuberculosis
cggcggcagguggucggugaag

SEQ ID NO: 2834121 - RNA, 13 nt, Mycobacterium avium subsp. paratuberculosis
cggcggcaguccg

SEQ ID NO: 2834122 - RNA, 17 nt, Mycobacterium avium subsp. paratuberculosis
cggcggcaguccggcga

SEQ ID NO: 2834123 - RNA, 13 nt, Mycobacterium avium subsp. paratuberculosis
cggcggcagucgc

SEQ ID NO: 2834124 - RNA, 18 nt, Mycobacterium avium subsp. paratuberculosis
cggcggcagucgcagcag

SEQ ID NO: 2834125 - RNA, 19 nt, Mycobacterium avium subsp. paratuberculosis
cggcggcagucgcagcagc

SEQ ID NO: 2834126 - RNA, 19 nt, Mycobacterium avium subsp. paratuberculosis
cggcggcagugcgccgucc

SEQ ID NO: 2834127 - RNA, 19 nt, Mycobacterium avium subsp. paratuberculosis
cggcggcauguucgaugcg

SEQ ID NO: 2834128 - RNA, 22 nt, Mycobacterium avium subsp. paratuberculosis
cggcggccaacgcgacgaagcc

SEQ ID NO: 2834129 - RNA, 19 nt, Mycobacterium avium subsp. paratuberculosis
cggcggccaaucccaccau

SEQ ID NO: 2834130 - RNA, 15 nt, Mycobacterium avium subsp. paratuberculosis
cggcggccaccagcc

SEQ ID NO: 2834131 - RNA, 16 nt, Mycobacterium avium subsp. paratuberculosis
cggcggccaccagccg

SEQ ID NO: 2834132 - RNA, 17 nt, Mycobacterium avium subsp. paratuberculosis
cggcggccaccagccgg

SEQ ID NO: 2834133 - RNA, 20 nt, Mycobacterium avium subsp. paratuberculosis
cggcggccaccagccggccg

SEQ ID NO: 2834134 - RNA, 21 nt, Mycobacterium avium subsp. paratuberculosis
cggcggccaccagccggccgg

SEQ ID NO: 2834135 - RNA, 16 nt, Mycobacterium avium subsp. paratuberculosis
cggcggccaccgcgcc

SEQ ID NO: 2834136 - RNA, 17 nt, Mycobacterium avium subsp. paratuberculosis
cggcggccaccucgccg

SEQ ID NO: 2834137 - RNA, 18 nt, Mycobacterium avium subsp. paratuberculosis
cggcggccaccucgccgc

SEQ ID NO: 2834138 - RNA, 20 nt, Mycobacterium avium subsp. paratuberculosis
cggcggccaccucgccgcag

SEQ ID NO: 2834139 - RNA, 15 nt, Mycobacterium avium subsp. paratuberculosis
cggcggccaccucgg

SEQ ID NO: 2834140 - RNA, 16 nt, Mycobacterium avium subsp. paratuberculosis
cggcggccaccucggc

SEQ ID NO: 2834141 - RNA, 18 nt, Mycobacterium avium subsp. paratuberculosis
cggcggccaccucggcgg

SEQ ID NO: 2834142 - RNA, 17 nt, Mycobacterium avium subsp. paratuberculosis
cggcggccacgaucgcg

SEQ ID NO: 2834143 - RNA, 12 nt, Mycobacterium avium subsp. paratuberculosis
cggcggccacgc

SEQ ID NO: 2834144 - RNA, 14 nt, Mycobacterium avium subsp. paratuberculosis
cggcggccacgcag

SEQ ID NO: 2834145 - RNA, 18 nt, Mycobacterium avium subsp. paratuberculosis
cggcggccacgcuagcgu

SEQ ID NO: 2834146 - RNA, 13 nt, Mycobacterium avium subsp. paratuberculosis
cggcggccagcau

SEQ ID NO: 2834147 - RNA, 22 nt, Mycobacterium avium subsp. paratuberculosis
cggcggccagcaucggaugccg

SEQ ID NO: 2834148 - RNA, 14 nt, Mycobacterium avium subsp. paratuberculosis
cggcggccagcgag

SEQ ID NO: 2834149 - RNA, 17 nt, Mycobacterium avium subsp. paratuberculosis
cggcggccagcgagucg

SEQ ID NO: 2834150 - RNA, 20 nt, Mycobacterium avium subsp. paratuberculosis
cggcggccagcgagucgaug

SEQ ID NO: 2834151 - RNA, 17 nt, Mycobacterium avium subsp. paratuberculosis
cggcggccagcgcgacg

SEQ ID NO: 2834152 - RNA, 19 nt, Mycobacterium avium subsp. paratuberculosis
cggcggccagcgcgacgcg

SEQ ID NO: 2834153 - RNA, 21 nt, Mycobacterium avium subsp. paratuberculosis
cggcggccagcgcgacgcgca

SEQ ID NO: 2834154 - RNA, 22 nt, Mycobacterium avium subsp. paratuberculosis
cggcggccagcgcgacgcgcau

SEQ ID NO: 2834155 - RNA, 22 nt, Mycobacterium avium subsp. paratuberculosis
cggcggccagcucggcccgcug

SEQ ID NO: 2834156 - RNA, 15 nt, Mycobacterium avium subsp. paratuberculosis
cggcggccagggugg

SEQ ID NO: 2834157 - RNA, 18 nt, Mycobacterium avium subsp. paratuberculosis
cggcggccaguucgagcg

SEQ ID NO: 2834158 - RNA, 20 nt, Mycobacterium avium subsp. paratuberculosis
cggcggccaguucgagcgcc

SEQ ID NO: 2834159 - RNA, 22 nt, Mycobacterium avium subsp. paratuberculosis
cggcggccaguucgagcgccgc

SEQ ID NO: 2834160 - RNA, 17 nt, Mycobacterium avium subsp. paratuberculosis
cggcggccaguugacgu

SEQ ID NO: 2834161 - RNA, 18 nt, Mycobacterium avium subsp. paratuberculosis
cggcggccaucucgugcc

SEQ ID NO: 2834162 - RNA, 12 nt, Mycobacterium avium subsp. paratuberculosis
cggcggccaugg

SEQ ID NO: 2834163 - RNA, 20 nt, Mycobacterium avium subsp. paratuberculosis
cggcggccauggucgcggcc

SEQ ID NO: 2834164 - RNA, 21 nt, Mycobacterium avium subsp. paratuberculosis
cggcggccauggucgcggccg

SEQ ID NO: 2834165 - RNA, 14 nt, Mycobacterium avium subsp. paratuberculosis
cggcggccaugucg

SEQ ID NO: 2834166 - RNA, 18 nt, Mycobacterium avium subsp. paratuberculosis
cggcggccaugucggagc

SEQ ID NO: 2834167 - RNA, 21 nt, Mycobacterium avium subsp. paratuberculosis
cggcggccucgguggucgcgu

SEQ ID NO: 2834168 - RNA, 17 nt, Mycobacterium avium subsp. paratuberculosis
cggcggccugcgcgucg

SEQ ID NO: 2834169 - RNA, 23 nt, Mycobacterium avium subsp. paratuberculosis
cggcggccugcgcgucgucgccc

SEQ ID NO: 2834170 - RNA, 16 nt, Mycobacterium avium subsp. paratuberculosis
cggcggccugcggcgg

SEQ ID NO: 2834171 - RNA, 17 nt, Mycobacterium avium subsp. paratuberculosis
cggcggccugcuccagc

SEQ ID NO: 2834172 - RNA, 20 nt, Mycobacterium avium subsp. paratuberculosis
cggcggccugcuccagcgag

SEQ ID NO: 2834173 - RNA, 15 nt, Mycobacterium avium subsp. paratuberculosis
cggcggccugcucgc

SEQ ID NO: 2834174 - RNA, 22 nt, Mycobacterium avium subsp. paratuberculosis
cggcggccugcuucucgccguc

SEQ ID NO: 2834175 - RNA, 17 nt, Mycobacterium avium subsp. paratuberculosis
cggcggccugcuugacc

SEQ ID NO: 2834176 - RNA, 22 nt, Mycobacterium avium subsp. paratuberculosis
cggcggccugcuugaccgccag

SEQ ID NO: 2834177 - RNA, 18 nt, Mycobacterium avium subsp. paratuberculosis
cggcggccuggccgucgc

SEQ ID NO: 2834178 - RNA, 17 nt, Mycobacterium avium subsp. paratuberculosis
cggcggccuugaacgcg

SEQ ID NO: 2834179 - RNA, 22 nt, Mycobacterium avium subsp. paratuberculosis
cggcggccuugaacgcguccga

SEQ ID NO: 2834180 - RNA, 19 nt, Mycobacterium avium subsp. paratuberculosis
cggcggccuuuuccggcga

SEQ ID NO: 2834181 - RNA, 20 nt, Mycobacterium avium subsp. paratuberculosis
cggcggccuuuuccggcgac

SEQ ID NO: 2834182 - RNA, 21 nt, Mycobacterium avium subsp. paratuberculosis
cggcggccuuuuccggcgaca

SEQ ID NO: 2834183 - RNA, 21 nt, Mycobacterium avium subsp. paratuberculosis
cggcggccuuuuucugcgccc

SEQ ID NO: 2834184 - RNA, 22 nt, Mycobacterium avium subsp. paratuberculosis
cggcggccuuuuucugcgcccg

SEQ ID NO: 2834185 - RNA, 16 nt, Mycobacterium avium subsp. paratuberculosis
cggcggcgaacgccgc

SEQ ID NO: 2834186 - RNA, 17 nt, Mycobacterium avium subsp. paratuberculosis
cggcggcgaagccggcc

SEQ ID NO: 2834187 - RNA, 21 nt, Mycobacterium avium subsp. paratuberculosis
cggcggcgaagccggccccgc

SEQ ID NO: 2834188 - RNA, 15 nt, Mycobacterium avium subsp. paratuberculosis
cggcggcgacgaugc

SEQ ID NO: 2834189 - RNA, 13 nt, Mycobacterium avium subsp. paratuberculosis
cggcggcgacggc

SEQ ID NO: 2834190 - RNA, 17 nt, Mycobacterium avium subsp. paratuberculosis
cggcggcgacggcaccg

SEQ ID NO: 2834191 - RNA, 14 nt, Mycobacterium avium subsp. paratuberculosis
cggcggcgacggcg

SEQ ID NO: 2834192 - RNA, 15 nt, Mycobacterium avium subsp. paratuberculosis
cggcggcgacggugu

SEQ ID NO: 2834193 - RNA, 16 nt, Mycobacterium avium subsp. paratuberculosis
cggcggcgacgguguc

SEQ ID NO: 2834194 - RNA, 22 nt, Mycobacterium avium subsp. paratuberculosis
cggcggcgacgguguccgcggc

SEQ ID NO: 2834195 - RNA, 13 nt, Mycobacterium avium subsp. paratuberculosis
cggcggcgacguc

SEQ ID NO: 2834196 - RNA, 14 nt, Mycobacterium avium subsp. paratuberculosis
cggcggcgacgucg

SEQ ID NO: 2834197 - RNA, 22 nt, Mycobacterium avium subsp. paratuberculosis
cggcggcgacgucgacggcagc

SEQ ID NO: 2834198 - RNA, 23 nt, Mycobacterium avium subsp. paratuberculosis
cggcggcgacgucgacggcagcg

SEQ ID NO: 2834199 - RNA, 18 nt, Mycobacterium avium subsp. paratuberculosis
cggcggcgacgugaucgg

SEQ ID NO: 2834200 - RNA, 22 nt, Mycobacterium avium subsp. paratuberculosis
cggcggcgacgugaucggcggc

SEQ ID NO: 2834201 - RNA, 14 nt, Mycobacterium avium subsp. paratuberculosis
cggcggcgacgugc

SEQ ID NO: 2834202 - RNA, 17 nt, Mycobacterium avium subsp. paratuberculosis
cggcggcgacgugccgg

SEQ ID NO: 2834203 - RNA, 21 nt, Mycobacterium avium subsp. paratuberculosis
cggcggcgacgugccggcggc

SEQ ID NO: 2834204 - RNA, 22 nt, Mycobacterium avium subsp. paratuberculosis
cggcggcgacgugccggcggca

SEQ ID NO: 2834205 - RNA, 20 nt, Mycobacterium avium subsp. paratuberculosis
cggcggcgaggacgucgucg

SEQ ID NO: 2834206 - RNA, 22 nt, Mycobacterium avium subsp. paratuberculosis
cggcggcgaggacgucgucgac

SEQ ID NO: 2834207 - RNA, 20 nt, Mycobacterium avium subsp. paratuberculosis
cggcggcgaguucggcggcc

SEQ ID NO: 2834208 - RNA, 23 nt, Mycobacterium avium subsp. paratuberculosis
cggcggcgaguucggcggcccgc

SEQ ID NO: 2834209 - RNA, 24 nt, Mycobacterium avium subsp. paratuberculosis
cggcggcgaguucggcggcccgcu

SEQ ID NO: 2834210 - RNA, 16 nt, Mycobacterium avium subsp. paratuberculosis
cggcggcgauccggcc

SEQ ID NO: 2834211 - RNA, 18 nt, Mycobacterium avium subsp. paratuberculosis
cggcggcgauccggccgg

SEQ ID NO: 2834212 - RNA, 19 nt, Mycobacterium avium subsp. paratuberculosis
cggcggcgauccggccggc

SEQ ID NO: 2834213 - RNA, 22 nt, Mycobacterium avium subsp. paratuberculosis
cggcggcgauccggccggcggc

SEQ ID NO: 2834214 - RNA, 16 nt, Mycobacterium avium subsp. paratuberculosis
cggcggcgaugaucgg

SEQ ID NO: 2834215 - RNA, 11 nt, Mycobacterium avium subsp. paratuberculosis
cggcggcgcag

SEQ ID NO: 2834216 - RNA, 13 nt, Mycobacterium avium subsp. paratuberculosis
cggcggcgcccag

SEQ ID NO: 2834217 - RNA, 15 nt, Mycobacterium avium subsp. paratuberculosis
cggcggcgcccagga

SEQ ID NO: 2834218 - RNA, 13 nt, Mycobacterium avium subsp. paratuberculosis
cggcggcgccgac

SEQ ID NO: 2834219 - RNA, 14 nt, Mycobacterium avium subsp. paratuberculosis
cggcggcgccgacg

SEQ ID NO: 2834220 - RNA, 12 nt, Mycobacterium avium subsp. paratuberculosis
cggcggcgccgc

SEQ ID NO: 2834221 - RNA, 13 nt, Mycobacterium avium subsp. paratuberculosis
cggcggcgccgca

SEQ ID NO: 2834222 - RNA, 16 nt, Mycobacterium avium subsp. paratuberculosis
cggcggcgccgcagca

SEQ ID NO: 2834223 - RNA, 14 nt, Mycobacterium avium subsp. paratuberculosis
cggcggcgccgcgg

SEQ ID NO: 2834224 - RNA, 15 nt, Mycobacterium avium subsp. paratuberculosis
cggcggcgccgcggu

SEQ ID NO: 2834225 - RNA, 13 nt, Mycobacterium avium subsp. paratuberculosis
cggcggcgccggg

SEQ ID NO: 2834226 - RNA, 20 nt, Mycobacterium avium subsp. paratuberculosis
cggcggcgccggucagaccc

SEQ ID NO: 2834227 - RNA, 13 nt, Mycobacterium avium subsp. paratuberculosis
cggcggcgccguc

SEQ ID NO: 2834228 - RNA, 14 nt, Mycobacterium avium subsp. paratuberculosis
cggcggcgccgucg

SEQ ID NO: 2834229 - RNA, 15 nt, Mycobacterium avium subsp. paratuberculosis
cggcggcgccgucgc

SEQ ID NO: 2834230 - RNA, 15 nt, Mycobacterium avium subsp. paratuberculosis
cggcggcgccgucgu

SEQ ID NO: 2834231 - RNA, 13 nt, Mycobacterium avium subsp. paratuberculosis
cggcggcgcgcac

SEQ ID NO: 2834232 - RNA, 15 nt, Mycobacterium avium subsp. paratuberculosis
cggcggcgcgcacgu

SEQ ID NO: 2834233 - RNA, 21 nt, Mycobacterium avium subsp. paratuberculosis
cggcggcgcgcacgucaccgc

SEQ ID NO: 2834234 - RNA, 14 nt, Mycobacterium avium subsp. paratuberculosis
cggcggcgcgcagg

SEQ ID NO: 2834235 - RNA, 22 nt, Mycobacterium avium subsp. paratuberculosis
cggcggcgcgcaggcgcgcggc

SEQ ID NO: 2834236 - RNA, 14 nt, Mycobacterium avium subsp. paratuberculosis
cggcggcgcgccgg

SEQ ID NO: 2834237 - RNA, 17 nt, Mycobacterium avium subsp. paratuberculosis
cggcggcgcgccggccg

SEQ ID NO: 2834238 - RNA, 18 nt, Mycobacterium avium subsp. paratuberculosis
cggcggcgcgccggccgg

SEQ ID NO: 2834239 - RNA, 22 nt, Mycobacterium avium subsp. paratuberculosis
cggcggcgcgccggccggagcg

SEQ ID NO: 2834240 - RNA, 15 nt, Mycobacterium avium subsp. paratuberculosis
cggcggcgcggcagg

SEQ ID NO: 2834241 - RNA, 14 nt, Mycobacterium avium subsp. paratuberculosis
cggcggcgcggccc

SEQ ID NO: 2834242 - RNA, 15 nt, Mycobacterium avium subsp. paratuberculosis
cggcggcgcggccca

SEQ ID NO: 2834243 - RNA, 12 nt, Mycobacterium avium subsp. paratuberculosis
cggcggcgcggg

SEQ ID NO: 2834244 - RNA, 13 nt, Mycobacterium avium subsp. paratuberculosis
cggcggcgcgggc

SEQ ID NO: 2834245 - RNA, 14 nt, Mycobacterium avium subsp. paratuberculosis
cggcggcgcgggcg

SEQ ID NO: 2834246 - RNA, 17 nt, Mycobacterium avium subsp. paratuberculosis
cggcggcgcgggcgccc

SEQ ID NO: 2834247 - RNA, 15 nt, Mycobacterium avium subsp. paratuberculosis
cggcggcgcgggcgg

SEQ ID NO: 2834248 - RNA, 17 nt, Mycobacterium avium subsp. paratuberculosis
cggcggcgcgggcggcg

SEQ ID NO: 2834249 - RNA, 17 nt, Mycobacterium avium subsp. paratuberculosis
cggcggcgcgugcgccg

SEQ ID NO: 2834250 - RNA, 18 nt, Mycobacterium avium subsp. paratuberculosis
cggcggcgcgugcgccgc

SEQ ID NO: 2834251 - RNA, 20 nt, Mycobacterium avium subsp. paratuberculosis
cggcggcgcucagcgcggcg

SEQ ID NO: 2834252 - RNA, 14 nt, Mycobacterium avium subsp. paratuberculosis
cggcgggccagcuc

SEQ ID NO: 2834253 - RNA, 15 nt, Mycobacterium avium subsp. paratuberculosis
cggcgggccagcucg

SEQ ID NO: 2834254 - RNA, 13 nt, Mycobacterium avium subsp. paratuberculosis
cggcgggccaggg

SEQ ID NO: 2834255 - RNA, 14 nt, Mycobacterium avium subsp. paratuberculosis
cggcgggccagggc

SEQ ID NO: 2834256 - RNA, 19 nt, Mycobacterium avium subsp. paratuberculosis
cggcgggccagggcgagga

SEQ ID NO: 2834257 - RNA, 20 nt, Mycobacterium avium subsp. paratuberculosis
cggcgggccagggcgaggac

SEQ ID NO: 2834258 - RNA, 13 nt, Mycobacterium avium subsp. paratuberculosis
cggcgggcccagc

SEQ ID NO: 2834259 - RNA, 14 nt, Mycobacterium avium subsp. paratuberculosis
cggcgggcccagca

SEQ ID NO: 2834260 - RNA, 14 nt, Mycobacterium avium subsp. paratuberculosis
cggcgggcccggcg

SEQ ID NO: 2834261 - RNA, 15 nt, Mycobacterium avium subsp. paratuberculosis
cggcgggcccggcga

SEQ ID NO: 2834262 - RNA, 16 nt, Mycobacterium avium subsp. paratuberculosis
cggcgggcccgucgcc

SEQ ID NO: 2834263 - RNA, 14 nt, Mycobacterium avium subsp. paratuberculosis
cggcgggccgcccg

SEQ ID NO: 2834264 - RNA, 18 nt, Mycobacterium avium subsp. paratuberculosis
cggcgggccgcccggcgc

SEQ ID NO: 2834265 - RNA, 19 nt, Mycobacterium avium subsp. paratuberculosis
cggcgggccgcccggcgcg

SEQ ID NO: 2834266 - RNA, 20 nt, Mycobacterium avium subsp. paratuberculosis
cggcgggccgcccggcgcgc

SEQ ID NO: 2834267 - RNA, 23 nt, Mycobacterium avium subsp. paratuberculosis
cggcgggccgcccggcgcgccgc

SEQ ID NO: 2834268 - RNA, 12 nt, Mycobacterium avium subsp. paratuberculosis
cggcgggccggc

SEQ ID NO: 2834269 - RNA, 13 nt, Mycobacterium avium subsp. paratuberculosis
cggcgggccgguc

SEQ ID NO: 2834270 - RNA, 14 nt, Mycobacterium avium subsp. paratuberculosis
cggcgggccggucc

SEQ ID NO: 2834271 - RNA, 15 nt, Mycobacterium avium subsp. paratuberculosis
cggcgggccucgccg

SEQ ID NO: 2834272 - RNA, 22 nt, Mycobacterium avium subsp. paratuberculosis
cggcgggccuucuucucgacgu

SEQ ID NO: 2834273 - RNA, 23 nt, Mycobacterium avium subsp. paratuberculosis
cggcgggccuugagcaccgcguc

SEQ ID NO: 2834274 - RNA, 14 nt, Mycobacterium avium subsp. paratuberculosis
cggcgggcgccgaa

SEQ ID NO: 2834275 - RNA, 19 nt, Mycobacterium avium subsp. paratuberculosis
cggcgggcgccggucggcg

SEQ ID NO: 2834276 - RNA, 12 nt, Mycobacterium avium subsp. paratuberculosis
cggcgggcgcgc

SEQ ID NO: 2834277 - RNA, 14 nt, Mycobacterium avium subsp. paratuberculosis
cggcgggcgcgcgc

SEQ ID NO: 2834278 - RNA, 13 nt, Mycobacterium avium subsp. paratuberculosis
cggcgggcgcguc

SEQ ID NO: 2834279 - RNA, 16 nt, Mycobacterium avium subsp. paratuberculosis
cggcgggcgcgucgag

SEQ ID NO: 2834280 - RNA, 13 nt, Mycobacterium avium subsp. paratuberculosis
cggcgggcgcucg

SEQ ID NO: 2834281 - RNA, 13 nt, Mycobacterium avium subsp. paratuberculosis
cggcgggcggccg

SEQ ID NO: 2834282 - RNA, 14 nt, Mycobacterium avium subsp. paratuberculosis
cggcgggcggccga

SEQ ID NO: 2834283 - RNA, 12 nt, Mycobacterium avium subsp. paratuberculosis
cggcgggcggcg

SEQ ID NO: 2834284 - RNA, 13 nt, Mycobacterium avium subsp. paratuberculosis
cggcgggcggcgg

SEQ ID NO: 2834285 - RNA, 15 nt, Mycobacterium avium subsp. paratuberculosis
cggcgggcggcggcg

SEQ ID NO: 2834286 - RNA, 14 nt, Mycobacterium avium subsp. paratuberculosis
cggcgggcgugccg

SEQ ID NO: 2834287 - RNA, 13 nt, Mycobacterium avium subsp. paratuberculosis
cggcgggcgugcg

SEQ ID NO: 2834288 - RNA, 22 nt, Mycobacterium avium subsp. paratuberculosis
cggcgggcucccucgucgcuac

SEQ ID NO: 2834289 - RNA, 14 nt, Mycobacterium avium subsp. paratuberculosis
cggcgggcucgccg

SEQ ID NO: 2834290 - RNA, 15 nt, Mycobacterium avium subsp. paratuberculosis
cggcgggcucgccgg

SEQ ID NO: 2834291 - RNA, 19 nt, Mycobacterium avium subsp. paratuberculosis
cggcgggcucgcgcuggcg

SEQ ID NO: 2834292 - RNA, 13 nt, Mycobacterium avium subsp. paratuberculosis
cggcgggcucgga

SEQ ID NO: 2834293 - RNA, 14 nt, Mycobacterium avium subsp. paratuberculosis
cggcgggcuggugc

SEQ ID NO: 2834294 - RNA, 15 nt, Mycobacterium avium subsp. paratuberculosis
cggcgggcuggugcg

SEQ ID NO: 2834295 - RNA, 22 nt, Mycobacterium avium subsp. paratuberculosis
cggcgggcuggugcgcagccgu

SEQ ID NO: 2834296 - RNA, 22 nt, Mycobacterium avium subsp. paratuberculosis
cggcggggaaggugcgggcggg

SEQ ID NO: 2834297 - RNA, 17 nt, Mycobacterium avium subsp. paratuberculosis
cggcggggccuccacca

SEQ ID NO: 2834298 - RNA, 18 nt, Mycobacterium avium subsp. paratuberculosis
cggcggggccuccaccag

SEQ ID NO: 2834299 - RNA, 21 nt, Mycobacterium avium subsp. paratuberculosis
cggcggggccuccaccagcgg

SEQ ID NO: 2834300 - RNA, 14 nt, Mycobacterium avium subsp. paratuberculosis
cggcggggccucga

SEQ ID NO: 2834301 - RNA, 20 nt, Mycobacterium avium subsp. paratuberculosis
cggcggggccucgaugcggc

SEQ ID NO: 2834302 - RNA, 17 nt, Mycobacterium avium subsp. paratuberculosis
cggcggggcgcguucgg

SEQ ID NO: 2834303 - RNA, 15 nt, Mycobacterium avium subsp. paratuberculosis
cggcggggcgucgcc

SEQ ID NO: 2834304 - RNA, 18 nt, Mycobacterium avium subsp. paratuberculosis
cggcggggcugcccaggu

SEQ ID NO: 2834305 - RNA, 22 nt, Mycobacterium avium subsp. paratuberculosis
cggcgggggauccgccugcgcg

SEQ ID NO: 2834306 - RNA, 17 nt, Mycobacterium avium subsp. paratuberculosis
cggcgggggcgcguccg

SEQ ID NO: 2834307 - RNA, 15 nt, Mycobacterium avium subsp. paratuberculosis
cggcgggggcggcgg

SEQ ID NO: 2834308 - RNA, 22 nt, Mycobacterium avium subsp. paratuberculosis
cggcgggggcggcggggugacg

SEQ ID NO: 2834309 - RNA, 22 nt, Mycobacterium avium subsp. paratuberculosis
cggcgggggcgggccccacgcc

SEQ ID NO: 2834310 - RNA, 18 nt, Mycobacterium avium subsp. paratuberculosis
cggcggggggagaggcgc

SEQ ID NO: 2834311 - RNA, 20 nt, Mycobacterium avium subsp. paratuberculosis
cggcggggggagaggcgcgg

SEQ ID NO: 2834312 - RNA, 13 nt, Mycobacterium avium subsp. paratuberculosis
cggcggggguucg

SEQ ID NO: 2834313 - RNA, 17 nt, Mycobacterium avium subsp. paratuberculosis
cggcggggguucgacgu

SEQ ID NO: 2834314 - RNA, 19 nt, Mycobacterium avium subsp. paratuberculosis
cggcggggucaagcggcag

SEQ ID NO: 2834315 - RNA, 20 nt, Mycobacterium avium subsp. paratuberculosis
cggcggggucaagcggcaga

SEQ ID NO: 2834316 - RNA, 19 nt, Mycobacterium avium subsp. paratuberculosis
cggcgggguccacgcagug

SEQ ID NO: 2834317 - RNA, 22 nt, Mycobacterium avium subsp. paratuberculosis
cggcggggugggcaccuggccg

SEQ ID NO: 2834318 - RNA, 19 nt, Mycobacterium avium subsp. paratuberculosis
cggcgggguuccgucgaac

SEQ ID NO: 2834319 - RNA, 21 nt, Mycobacterium avium subsp. paratuberculosis
cggcgggguuccgucgaacag

SEQ ID NO: 2834320 - RNA, 22 nt, Mycobacterium avium subsp. paratuberculosis
cggcgggguuccgucgaacagc

SEQ ID NO: 2834321 - RNA, 20 nt, Mycobacterium avium subsp. paratuberculosis
cggcggguaugucggcgacc

SEQ ID NO: 2834322 - RNA, 22 nt, Mycobacterium avium subsp. paratuberculosis
cggcggguaugucggcgacccg

SEQ ID NO: 2834323 - RNA, 17 nt, Mycobacterium avium subsp. paratuberculosis
cggcgggucacucgacc

SEQ ID NO: 2834324 - RNA, 13 nt, Mycobacterium avium subsp. paratuberculosis
cggcgggucagca

SEQ ID NO: 2834325 - RNA, 15 nt, Mycobacterium avium subsp. paratuberculosis
cggcgggucagcacc

SEQ ID NO: 2834326 - RNA, 18 nt, Mycobacterium avium subsp. paratuberculosis
cggcgggucagcacccgc

SEQ ID NO: 2834327 - RNA, 23 nt, Mycobacterium avium subsp. paratuberculosis
cggcgggucagcacccgcagccg

SEQ ID NO: 2834328 - RNA, 16 nt, Mycobacterium avium subsp. paratuberculosis
cggcgggucagcagcg

SEQ ID NO: 2834329 - RNA, 18 nt, Mycobacterium avium subsp. paratuberculosis
cggcgggucguagccguc

SEQ ID NO: 2834330 - RNA, 20 nt, Mycobacterium avium subsp. paratuberculosis
cggcgggucguagccgucga

SEQ ID NO: 2834331 - RNA, 21 nt, Mycobacterium avium subsp. paratuberculosis
cggcgggucugugaccacggu

SEQ ID NO: 2834332 - RNA, 22 nt, Mycobacterium avium subsp. paratuberculosis
cggcgggugagccggucgaacg

SEQ ID NO: 2834333 - RNA, 17 nt, Mycobacterium avium subsp. paratuberculosis
cggcgggugcgacggca

SEQ ID NO: 2834334 - RNA, 18 nt, Mycobacterium avium subsp. paratuberculosis
cggcgggugcgacggcaa

SEQ ID NO: 2834335 - RNA, 13 nt, Mycobacterium avium subsp. paratuberculosis
cggcgggugcggg

SEQ ID NO: 2834336 - RNA, 17 nt, Mycobacterium avium subsp. paratuberculosis
cggcgggugcgggcgcu

SEQ ID NO: 2834337 - RNA, 14 nt, Mycobacterium avium subsp. paratuberculosis
cggcggugagccgc

SEQ ID NO: 2834338 - RNA, 16 nt, Mycobacterium avium subsp. paratuberculosis
cggcggugagccgcca

SEQ ID NO: 2834339 - RNA, 20 nt, Mycobacterium avium subsp. paratuberculosis
cggcggugagccgccacagc

SEQ ID NO: 2834340 - RNA, 17 nt, Mycobacterium avium subsp. paratuberculosis
cggcggugagcgcgucg

SEQ ID NO: 2834341 - RNA, 23 nt, Mycobacterium avium subsp. paratuberculosis
cggcggugauccgcccggcccgc

SEQ ID NO: 2834342 - RNA, 14 nt, Mycobacterium avium subsp. paratuberculosis
cggcggugaucgcc

SEQ ID NO: 2834343 - RNA, 15 nt, Mycobacterium avium subsp. paratuberculosis
cggcggugaucgccg

SEQ ID NO: 2834344 - RNA, 17 nt, Mycobacterium avium subsp. paratuberculosis
cggcggugaucucgucg

SEQ ID NO: 2834345 - RNA, 20 nt, Mycobacterium avium subsp. paratuberculosis
cggcggugaugcgcgccgac

SEQ ID NO: 2834346 - RNA, 21 nt, Mycobacterium avium subsp. paratuberculosis
cggcggugaugcgcgccgacg

SEQ ID NO: 2834347 - RNA, 15 nt, Mycobacterium avium subsp. paratuberculosis
cggcggugauggaca

SEQ ID NO: 2834348 - RNA, 15 nt, Mycobacterium avium subsp. paratuberculosis
cggcggugccgagcc

SEQ ID NO: 2834349 - RNA, 20 nt, Mycobacterium avium subsp. paratuberculosis
cggcggugccgagcccgccg

SEQ ID NO: 2834350 - RNA, 22 nt, Mycobacterium avium subsp. paratuberculosis
cggcggugccgagcccgccggc

SEQ ID NO: 2834351 - RNA, 18 nt, Mycobacterium avium subsp. paratuberculosis
cggcggugccgcaggcga

SEQ ID NO: 2834352 - RNA, 21 nt, Mycobacterium avium subsp. paratuberculosis
cggcggugccgcaggcgaaca

SEQ ID NO: 2834353 - RNA, 17 nt, Mycobacterium avium subsp. paratuberculosis
cggcggugccggccaga

SEQ ID NO: 2834354 - RNA, 13 nt, Mycobacterium avium subsp. paratuberculosis
cggcggugccggu

SEQ ID NO: 2834355 - RNA, 21 nt, Mycobacterium avium subsp. paratuberculosis
cggcggugccguccucggccg

SEQ ID NO: 2834356 - RNA, 22 nt, Mycobacterium avium subsp. paratuberculosis
cggcggugccguccucggccgc

SEQ ID NO: 2834357 - RNA, 17 nt, Mycobacterium avium subsp. paratuberculosis
cggcggugccugguuga

SEQ ID NO: 2834358 - RNA, 16 nt, Mycobacterium avium subsp. paratuberculosis
cggcggugcgcagccg

SEQ ID NO: 2834359 - RNA, 20 nt, Mycobacterium avium subsp. paratuberculosis
cggcggugcgcagccgcugc

SEQ ID NO: 2834360 - RNA, 23 nt, Mycobacterium avium subsp. paratuberculosis
cggcggugcgcagccgcugcagc

SEQ ID NO: 2834361 - RNA, 13 nt, Mycobacterium avium subsp. paratuberculosis
cggcggugcggac

SEQ ID NO: 2834362 - RNA, 14 nt, Mycobacterium avium subsp. paratuberculosis
cggcggugcggacc

SEQ ID NO: 2834363 - RNA, 16 nt, Mycobacterium avium subsp. paratuberculosis
cggcggugcggacccg

SEQ ID NO: 2834364 - RNA, 12 nt, Mycobacterium avium subsp. paratuberculosis
cggcggugcggg

SEQ ID NO: 2834365 - RNA, 14 nt, Mycobacterium avium subsp. paratuberculosis
cggcggugcgggug

SEQ ID NO: 2834366 - RNA, 19 nt, Mycobacterium avium subsp. paratuberculosis
cggcggugcgucgggcgcc

SEQ ID NO: 2834367 - RNA, 21 nt, Mycobacterium avium subsp. paratuberculosis
cggcggugcgucgggcgccgg

SEQ ID NO: 2834368 - RNA, 15 nt, Mycobacterium avium subsp. paratuberculosis
cggcggugcucgcgc

SEQ ID NO: 2834369 - RNA, 19 nt, Mycobacterium avium subsp. paratuberculosis
cggcggugcucgcgccggg

SEQ ID NO: 2834370 - RNA, 17 nt, Mycobacterium avium subsp. paratuberculosis
cggcggugcucucgucg

SEQ ID NO: 2834371 - RNA, 18 nt, Mycobacterium avium subsp. paratuberculosis
cggcgguggccaugcgcg

SEQ ID NO: 2834372 - RNA, 22 nt, Mycobacterium avium subsp. paratuberculosis
cggcgguggccaugcgcgaguc

SEQ ID NO: 2834373 - RNA, 14 nt, Mycobacterium avium subsp. paratuberculosis
cggcgguggccugc

SEQ ID NO: 2834374 - RNA, 15 nt, Mycobacterium avium subsp. paratuberculosis
cggcgguggccugcc

SEQ ID NO: 2834375 - RNA, 16 nt, Mycobacterium avium subsp. paratuberculosis
cggcgguggccugccc

SEQ ID NO: 2834376 - RNA, 19 nt, Mycobacterium avium subsp. paratuberculosis
cggcgguggccugcccggc

SEQ ID NO: 2834377 - RNA, 15 nt, Mycobacterium avium subsp. paratuberculosis
cggcgguggccuggu

SEQ ID NO: 2834378 - RNA, 18 nt, Mycobacterium avium subsp. paratuberculosis
cggcgguggccuggucga

SEQ ID NO: 2834379 - RNA, 16 nt, Mycobacterium avium subsp. paratuberculosis
cggcgguggcgaugac

SEQ ID NO: 2834380 - RNA, 13 nt, Mycobacterium avium subsp. paratuberculosis
cggcgguggcgua

SEQ ID NO: 2834381 - RNA, 19 nt, Mycobacterium avium subsp. paratuberculosis
cggcgguggcguagcggug

SEQ ID NO: 2834382 - RNA, 23 nt, Mycobacterium avium subsp. paratuberculosis
cggcggugggcucggccaucccg

SEQ ID NO: 2834383 - RNA, 15 nt, Mycobacterium avium subsp. paratuberculosis
cggcggugggcuggg

SEQ ID NO: 2834384 - RNA, 18 nt, Mycobacterium avium subsp. paratuberculosis
cggcggugggcugggcga

SEQ ID NO: 2834385 - RNA, 13 nt, Mycobacterium avium subsp. paratuberculosis
cggcggugguccg

SEQ ID NO: 2834386 - RNA, 17 nt, Mycobacterium avium subsp. paratuberculosis
cggcggugguccgcgcg

SEQ ID NO: 2834387 - RNA, 14 nt, Mycobacterium avium subsp. paratuberculosis
cggcgguggugaac

SEQ ID NO: 2834388 - RNA, 21 nt, Mycobacterium avium subsp. paratuberculosis
cggcgguggugaacgcgucgg

SEQ ID NO: 2834389 - RNA, 20 nt, Mycobacterium avium subsp. paratuberculosis
cggcggugucgaaggccggg

SEQ ID NO: 2834390 - RNA, 24 nt, Mycobacterium avium subsp. paratuberculosis
cggcggugucgcccagcugggcca

SEQ ID NO: 2834391 - RNA, 17 nt, Mycobacterium avium subsp. paratuberculosis
cggcggugucggcgccc

SEQ ID NO: 2834392 - RNA, 15 nt, Mycobacterium avium subsp. paratuberculosis
cggcggugucggcgg

SEQ ID NO: 2834393 - RNA, 17 nt, Mycobacterium avium subsp. paratuberculosis
cggcggugucggcggca

SEQ ID NO: 2834394 - RNA, 18 nt, Mycobacterium avium subsp. paratuberculosis
cggcggugucggcggcaa

SEQ ID NO: 2834395 - RNA, 16 nt, Mycobacterium avium subsp. paratuberculosis
cggcggugucggugcc

SEQ ID NO: 2834396 - RNA, 17 nt, Mycobacterium avium subsp. paratuberculosis
cggcggugucggugccg

SEQ ID NO: 2834397 - RNA, 20 nt, Mycobacterium avium subsp. paratuberculosis
cggcggugucggugccgagc

SEQ ID NO: 2834398 - RNA, 21 nt, Mycobacterium avium subsp. paratuberculosis
cggcggugucggugccgagca

SEQ ID NO: 2834399 - RNA, 20 nt, Mycobacterium avium subsp. paratuberculosis
cggcgguucgauaccguccg

SEQ ID NO: 2834400 - RNA, 21 nt, Mycobacterium avium subsp. paratuberculosis
cggcgguucggaguccaccgg

SEQ ID NO: 2834401 - RNA, 18 nt, Mycobacterium avium subsp. paratuberculosis
cggcgguucggcgggccu

SEQ ID NO: 2834402 - RNA, 23 nt, Mycobacterium avium subsp. paratuberculosis
cggcgguugauacucgggcaacg

SEQ ID NO: 2834403 - RNA, 21 nt, Mycobacterium avium subsp. paratuberculosis
cggcgguugcucgucggccga

SEQ ID NO: 2834404 - RNA, 17 nt, Mycobacterium avium subsp. paratuberculosis
cggcgguuucggugccg

SEQ ID NO: 2834405 - RNA, 19 nt, Mycobacterium avium subsp. paratuberculosis
cggcgguuucggugccggc

SEQ ID NO: 2834406 - RNA, 20 nt, Mycobacterium avium subsp. paratuberculosis
cggcgguuucggugccggcc

SEQ ID NO: 2834407 - RNA, 21 nt, Mycobacterium avium subsp. paratuberculosis
cggcgguuucggugccggccc

SEQ ID NO: 2834408 - RNA, 19 nt, Mycobacterium avium subsp. paratuberculosis
cggcgguuucuuugaucuc

SEQ ID NO: 2834409 - RNA, 19 nt, Mycobacterium avium subsp. paratuberculosis
cggcgguuuuggucggcac

SEQ ID NO: 2834410 - RNA, 12 nt, Mycobacterium avium subsp. paratuberculosis
cggcgguuuugu

SEQ ID NO: 2834411 - RNA, 12 nt, Mycobacterium avium subsp. paratuberculosis
cggcguacagca

SEQ ID NO: 2834412 - RNA, 16 nt, Mycobacterium avium subsp. paratuberculosis
cggcguacagcccgcg

SEQ ID NO: 2834413 - RNA, 17 nt, Mycobacterium avium subsp. paratuberculosis
cggcguacagcccgcgg

SEQ ID NO: 2834414 - RNA, 20 nt, Mycobacterium avium subsp. paratuberculosis
cggcguacagcccgcggauc

SEQ ID NO: 2834415 - RNA, 16 nt, Mycobacterium avium subsp. paratuberculosis
cggcguacaggccguc

SEQ ID NO: 2834416 - RNA, 18 nt, Mycobacterium avium subsp. paratuberculosis
cggcguacaggccgucgg

SEQ ID NO: 2834417 - RNA, 19 nt, Mycobacterium avium subsp. paratuberculosis
cggcguacaggccgucggg

SEQ ID NO: 2834418 - RNA, 21 nt, Mycobacterium avium subsp. paratuberculosis
cggcguacaggccgucgggga

SEQ ID NO: 2834419 - RNA, 23 nt, Mycobacterium avium subsp. paratuberculosis
cggcguacccgcccaugcacgau

SEQ ID NO: 2834420 - RNA, 14 nt, Mycobacterium avium subsp. paratuberculosis
cggcguaccgcggc

SEQ ID NO: 2834421 - RNA, 18 nt, Mycobacterium avium subsp. paratuberculosis
cggcguccucgacgccgc

SEQ ID NO: 2834422 - RNA, 22 nt, Mycobacterium avium subsp. paratuberculosis
cggcguccucgacgccgcgcac

SEQ ID NO: 2834423 - RNA, 16 nt, Mycobacterium avium subsp. paratuberculosis
cggcguccugcagcag

SEQ ID NO: 2834424 - RNA, 17 nt, Mycobacterium avium subsp. paratuberculosis
cggcguccugcagcagc

SEQ ID NO: 2834425 - RNA, 20 nt, Mycobacterium avium subsp. paratuberculosis
cggcgucgaaauagcggcgc

SEQ ID NO: 2834426 - RNA, 23 nt, Mycobacterium avium subsp. paratuberculosis
cggcgucgaaauagcggcgcacc

SEQ ID NO: 2834427 - RNA, 23 nt, Mycobacterium avium subsp. paratuberculosis
cggcgucgaaauccacgaugccg

SEQ ID NO: 2834428 - RNA, 13 nt, Mycobacterium avium subsp. paratuberculosis
cggcgucgaacgg

SEQ ID NO: 2834429 - RNA, 14 nt, Mycobacterium avium subsp. paratuberculosis
cggcgucgaagcgc

SEQ ID NO: 2834430 - RNA, 17 nt, Mycobacterium avium subsp. paratuberculosis
cggcgucgacacccggg

SEQ ID NO: 2834431 - RNA, 19 nt, Mycobacterium avium subsp. paratuberculosis
cggcgucgacacccgggcg

SEQ ID NO: 2834432 - RNA, 14 nt, Mycobacterium avium subsp. paratuberculosis
cggcgucgacagcc

SEQ ID NO: 2834433 - RNA, 15 nt, Mycobacterium avium subsp. paratuberculosis
cggcgucgacagccg

SEQ ID NO: 2834434 - RNA, 16 nt, Mycobacterium avium subsp. paratuberculosis
cggcgucgacagccgg

SEQ ID NO: 2834435 - RNA, 19 nt, Mycobacterium avium subsp. paratuberculosis
cggcgucgacagccggucg

SEQ ID NO: 2834436 - RNA, 23 nt, Mycobacterium avium subsp. paratuberculosis
cggcgucgacagccggucgcgca

SEQ ID NO: 2834437 - RNA, 14 nt, Mycobacterium avium subsp. paratuberculosis
cggcgucgaccgcc

SEQ ID NO: 2834438 - RNA, 15 nt, Mycobacterium avium subsp. paratuberculosis
cggcgucgaccgccc

SEQ ID NO: 2834439 - RNA, 21 nt, Mycobacterium avium subsp. paratuberculosis
cggcgucgaccgccccgccgg

SEQ ID NO: 2834440 - RNA, 16 nt, Mycobacterium avium subsp. paratuberculosis
cggcgucgacgacggc

SEQ ID NO: 2834441 - RNA, 19 nt, Mycobacterium avium subsp. paratuberculosis
cggcgucgacgacggcgcc

SEQ ID NO: 2834442 - RNA, 21 nt, Mycobacterium avium subsp. paratuberculosis
cggcgucgacgacggcgccgc

SEQ ID NO: 2834443 - RNA, 21 nt, Mycobacterium avium subsp. paratuberculosis
cggcgucgacgucgggacccu

SEQ ID NO: 2834444 - RNA, 12 nt, Mycobacterium avium subsp. paratuberculosis
cggcgucgagca

SEQ ID NO: 2834445 - RNA, 20 nt, Mycobacterium avium subsp. paratuberculosis
cggcgucgagcguggggccu

SEQ ID NO: 2834446 - RNA, 18 nt, Mycobacterium avium subsp. paratuberculosis
cggcgucgaguucgccgu

SEQ ID NO: 2834447 - RNA, 19 nt, Mycobacterium avium subsp. paratuberculosis
cggcgucgaguucgccguc

SEQ ID NO: 2834448 - RNA, 20 nt, Mycobacterium avium subsp. paratuberculosis
cggcgucgaguucgccgucg

SEQ ID NO: 2834449 - RNA, 22 nt, Mycobacterium avium subsp. paratuberculosis
cggcgucgaguucgccgucgac

SEQ ID NO: 2834450 - RNA, 15 nt, Mycobacterium avium subsp. paratuberculosis
cggcgucgaucgccg

SEQ ID NO: 2834451 - RNA, 16 nt, Mycobacterium avium subsp. paratuberculosis
cggcgucgaucgccgu

SEQ ID NO: 2834452 - RNA, 17 nt, Mycobacterium avium subsp. paratuberculosis
cggcgucgaucgccguc

SEQ ID NO: 2834453 - RNA, 20 nt, Mycobacterium avium subsp. paratuberculosis
cggcgucgaucgccgucacg

SEQ ID NO: 2834454 - RNA, 22 nt, Mycobacterium avium subsp. paratuberculosis
cggcgucgaugaugccggcgga

SEQ ID NO: 2834455 - RNA, 13 nt, Mycobacterium avium subsp. paratuberculosis
cggcgucgauguc

SEQ ID NO: 2834456 - RNA, 14 nt, Mycobacterium avium subsp. paratuberculosis
cggcgucgaugucg

SEQ ID NO: 2834457 - RNA, 22 nt, Mycobacterium avium subsp. paratuberculosis
cggcgucgaugucgcccggcgc

SEQ ID NO: 2834458 - RNA, 20 nt, Mycobacterium avium subsp. paratuberculosis
cggcgucgaugucgucgucg

SEQ ID NO: 2834459 - RNA, 22 nt, Mycobacterium avium subsp. paratuberculosis
cggcgucgaugucgucgucgac

SEQ ID NO: 2834460 - RNA, 23 nt, Mycobacterium avium subsp. paratuberculosis
cggcgucgaugucgucgucgacg

SEQ ID NO: 2834461 - RNA, 13 nt, Mycobacterium avium subsp. paratuberculosis
cggcgucgccgag

SEQ ID NO: 2834462 - RNA, 13 nt, Mycobacterium avium subsp. paratuberculosis
cggcgucgccgcu

SEQ ID NO: 2834463 - RNA, 14 nt, Mycobacterium avium subsp. paratuberculosis
cggcgucgcggcgc

SEQ ID NO: 2834464 - RNA, 15 nt, Mycobacterium avium subsp. paratuberculosis
cggcgucgcggcgca

SEQ ID NO: 2834465 - RNA, 20 nt, Mycobacterium avium subsp. paratuberculosis
cggcgucgcggcgcacccgg

SEQ ID NO: 2834466 - RNA, 22 nt, Mycobacterium avium subsp. paratuberculosis
cggcgucgcggcgcacccgggc

SEQ ID NO: 2834467 - RNA, 14 nt, Mycobacterium avium subsp. paratuberculosis
cggcgucgcgguga

SEQ ID NO: 2834468 - RNA, 20 nt, Mycobacterium avium subsp. paratuberculosis
cggcgucgcucauguugugc

SEQ ID NO: 2834469 - RNA, 19 nt, Mycobacterium avium subsp. paratuberculosis
cggcgucggagaugcgggc

SEQ ID NO: 2834470 - RNA, 22 nt, Mycobacterium avium subsp. paratuberculosis
cggcgucggagaugcgggccac

SEQ ID NO: 2834471 - RNA, 18 nt, Mycobacterium avium subsp. paratuberculosis
cggcgucggaggcggcgu

SEQ ID NO: 2834472 - RNA, 13 nt, Mycobacterium avium subsp. paratuberculosis
cggcgucggccac

SEQ ID NO: 2834473 - RNA, 15 nt, Mycobacterium avium subsp. paratuberculosis
cggcgucggccaccg

SEQ ID NO: 2834474 - RNA, 18 nt, Mycobacterium avium subsp. paratuberculosis
cggcgucggccaccgcgc

SEQ ID NO: 2834475 - RNA, 20 nt, Mycobacterium avium subsp. paratuberculosis
cggcgucggccaccgcgccu

SEQ ID NO: 2834476 - RNA, 17 nt, Mycobacterium avium subsp. paratuberculosis
cggcgucggccgggcug

SEQ ID NO: 2834477 - RNA, 20 nt, Mycobacterium avium subsp. paratuberculosis
cggcgucggccgggcugccc

SEQ ID NO: 2834478 - RNA, 21 nt, Mycobacterium avium subsp. paratuberculosis
cggcgucggccgggcugccca

SEQ ID NO: 2834479 - RNA, 18 nt, Mycobacterium avium subsp. paratuberculosis
cggcgucggccugcccgc

SEQ ID NO: 2834480 - RNA, 12 nt, Mycobacterium avium subsp. paratuberculosis
cggcgucggcga

SEQ ID NO: 2834481 - RNA, 16 nt, Mycobacterium avium subsp. paratuberculosis
cggcgucggcgacggc

SEQ ID NO: 2834482 - RNA, 18 nt, Mycobacterium avium subsp. paratuberculosis
cggcgucggcgacggcgu

SEQ ID NO: 2834483 - RNA, 20 nt, Mycobacterium avium subsp. paratuberculosis
cggcgucggcgacggcgucc

SEQ ID NO: 2834484 - RNA, 13 nt, Mycobacterium avium subsp. paratuberculosis
cggcgucggcgag

SEQ ID NO: 2834485 - RNA, 14 nt, Mycobacterium avium subsp. paratuberculosis
cggcgucggcgauc

SEQ ID NO: 2834486 - RNA, 16 nt, Mycobacterium avium subsp. paratuberculosis
cggcgucggcgcgugc

SEQ ID NO: 2834487 - RNA, 14 nt, Mycobacterium avium subsp. paratuberculosis
cggcgucggcggcc

SEQ ID NO: 2834488 - RNA, 15 nt, Mycobacterium avium subsp. paratuberculosis
cggcgucggcggccu

SEQ ID NO: 2834489 - RNA, 14 nt, Mycobacterium avium subsp. paratuberculosis
cggcgucggcgucc

SEQ ID NO: 2834490 - RNA, 15 nt, Mycobacterium avium subsp. paratuberculosis
cggcgucggcgucca

SEQ ID NO: 2834491 - RNA, 18 nt, Mycobacterium avium subsp. paratuberculosis
cggcgucggcgucgggcg

SEQ ID NO: 2834492 - RNA, 19 nt, Mycobacterium avium subsp. paratuberculosis
cggcgucgggaccgucgcg

SEQ ID NO: 2834493 - RNA, 23 nt, Mycobacterium avium subsp. paratuberculosis
cggcgucgggaccgucgcgcagc

SEQ ID NO: 2834494 - RNA, 18 nt, Mycobacterium avium subsp. paratuberculosis
cggcgucgggauggucga

SEQ ID NO: 2834495 - RNA, 13 nt, Mycobacterium avium subsp. paratuberculosis
cggcgucgggccg

SEQ ID NO: 2834496 - RNA, 14 nt, Mycobacterium avium subsp. paratuberculosis
cggcgucgggccgg

SEQ ID NO: 2834497 - RNA, 16 nt, Mycobacterium avium subsp. paratuberculosis
cggcgucgggccgggg

SEQ ID NO: 2834498 - RNA, 18 nt, Mycobacterium avium subsp. paratuberculosis
cggcgucgggccgggggc

SEQ ID NO: 2834499 - RNA, 19 nt, Mycobacterium avium subsp. paratuberculosis
cggcgucgggccgggggcg

SEQ ID NO: 2834500 - RNA, 19 nt, Mycobacterium avium subsp. paratuberculosis
cggcgucgggcggggugug

SEQ ID NO: 2834501 - RNA, 22 nt, Mycobacterium avium subsp. paratuberculosis
cggcgucggguagggcgccguc

SEQ ID NO: 2834502 - RNA, 23 nt, Mycobacterium avium subsp. paratuberculosis
cggcgucggguagggcgccgucg

SEQ ID NO: 2834503 - RNA, 13 nt, Mycobacterium avium subsp. paratuberculosis
cggcgucgguguc

SEQ ID NO: 2834504 - RNA, 16 nt, Mycobacterium avium subsp. paratuberculosis
cggcgucggugucccg

SEQ ID NO: 2834505 - RNA, 15 nt, Mycobacterium avium subsp. paratuberculosis
cggcgugcugcgcag

SEQ ID NO: 2834506 - RNA, 16 nt, Mycobacterium avium subsp. paratuberculosis
cggcgugcugcgcagc

SEQ ID NO: 2834507 - RNA, 17 nt, Mycobacterium avium subsp. paratuberculosis
cggcgugcugcgcagca

SEQ ID NO: 2834508 - RNA, 18 nt, Mycobacterium avium subsp. paratuberculosis
cggcgugcugcgcagcag

SEQ ID NO: 2834509 - RNA, 19 nt, Mycobacterium avium subsp. paratuberculosis
cggcgugcugcgcagcagc

SEQ ID NO: 2834510 - RNA, 23 nt, Mycobacterium avium subsp. paratuberculosis
cggcgugcugcgcagcagcgcca

SEQ ID NO: 2834511 - RNA, 15 nt, Mycobacterium avium subsp. paratuberculosis
cggcgugcugggcca

SEQ ID NO: 2834512 - RNA, 17 nt, Mycobacterium avium subsp. paratuberculosis
cggcgugcugggccacg

SEQ ID NO: 2834513 - RNA, 18 nt, Mycobacterium avium subsp. paratuberculosis
cggcgugcugggccacga

SEQ ID NO: 2834514 - RNA, 22 nt, Mycobacterium avium subsp. paratuberculosis
cggcgugcugggccacgauccg

SEQ ID NO: 2834515 - RNA, 23 nt, Mycobacterium avium subsp. paratuberculosis
cggcguggaacacgcccagcgcc

SEQ ID NO: 2834516 - RNA, 14 nt, Mycobacterium avium subsp. paratuberculosis
cggcguggcaggcg

SEQ ID NO: 2834517 - RNA, 13 nt, Mycobacterium avium subsp. paratuberculosis
cggcguggccguc

SEQ ID NO: 2834518 - RNA, 15 nt, Mycobacterium avium subsp. paratuberculosis
cggcguggccguccg

SEQ ID NO: 2834519 - RNA, 16 nt, Mycobacterium avium subsp. paratuberculosis
cggcguggccguccga

SEQ ID NO: 2834520 - RNA, 16 nt, Mycobacterium avium subsp. paratuberculosis
cggcguggcgcucagc

SEQ ID NO: 2834521 - RNA, 19 nt, Mycobacterium avium subsp. paratuberculosis
cggcguggcgcucagcggc

SEQ ID NO: 2834522 - RNA, 21 nt, Mycobacterium avium subsp. paratuberculosis
cggcguggcgcucagcggcag

SEQ ID NO: 2834523 - RNA, 14 nt, Mycobacterium avium subsp. paratuberculosis
cggcguggcggugg

SEQ ID NO: 2834524 - RNA, 17 nt, Mycobacterium avium subsp. paratuberculosis
cggcguggcgguggcgg

SEQ ID NO: 2834525 - RNA, 18 nt, Mycobacterium avium subsp. paratuberculosis
cggcguggcgguggcggc

SEQ ID NO: 2834526 - RNA, 18 nt, Mycobacterium avium subsp. paratuberculosis
cggcguggcugaggccgc

SEQ ID NO: 2834527 - RNA, 14 nt, Mycobacterium avium subsp. paratuberculosis
cggcgugggccgca

SEQ ID NO: 2834528 - RNA, 18 nt, Mycobacterium avium subsp. paratuberculosis
cggcgugggccgcagcgc

SEQ ID NO: 2834529 - RNA, 19 nt, Mycobacterium avium subsp. paratuberculosis
cggcgugggccgcagcgcg

SEQ ID NO: 2834530 - RNA, 21 nt, Mycobacterium avium subsp. paratuberculosis
cggcgugggccgcagcgcggc

SEQ ID NO: 2834531 - RNA, 23 nt, Mycobacterium avium subsp. paratuberculosis
cggcguggggacccccucgucga

SEQ ID NO: 2834532 - RNA, 20 nt, Mycobacterium avium subsp. paratuberculosis
cggcgugggguucccggccg

SEQ ID NO: 2834533 - RNA, 21 nt, Mycobacterium avium subsp. paratuberculosis
cggcgugggguucccggccgg

SEQ ID NO: 2834534 - RNA, 16 nt, Mycobacterium avium subsp. paratuberculosis
cggcgugguagccgcc

SEQ ID NO: 2834535 - RNA, 17 nt, Mycobacterium avium subsp. paratuberculosis
cggcgugguagccgccg

SEQ ID NO: 2834536 - RNA, 19 nt, Mycobacterium avium subsp. paratuberculosis
cggcgugguagccgccguu

SEQ ID NO: 2834537 - RNA, 15 nt, Mycobacterium avium subsp. paratuberculosis
cggcguggucggcga

SEQ ID NO: 2834538 - RNA, 22 nt, Mycobacterium avium subsp. paratuberculosis
cggcguguaguacugcucgacg

SEQ ID NO: 2834539 - RNA, 23 nt, Mycobacterium avium subsp. paratuberculosis
cggcguguaguacugcucgacgu

SEQ ID NO: 2834540 - RNA, 14 nt, Mycobacterium avium subsp. paratuberculosis
cggcgugucggcgc

SEQ ID NO: 2834541 - RNA, 18 nt, Mycobacterium avium subsp. paratuberculosis
cggcgugucggcgccacc

SEQ ID NO: 2834542 - RNA, 19 nt, Mycobacterium avium subsp. paratuberculosis
cggcgugucggcgccaccg

SEQ ID NO: 2834543 - RNA, 20 nt, Mycobacterium avium subsp. paratuberculosis
cggcgugucggcgccaccgg

SEQ ID NO: 2834544 - RNA, 16 nt, Mycobacterium avium subsp. paratuberculosis
cggcgugucgggugcu

SEQ ID NO: 2834545 - RNA, 17 nt, Mycobacterium avium subsp. paratuberculosis
cggcgugucgggugcuu

SEQ ID NO: 2834546 - RNA, 23 nt, Mycobacterium avium subsp. paratuberculosis
cggcgugucgggugcuuucgcgu

SEQ ID NO: 2834547 - RNA, 19 nt, Mycobacterium avium subsp. paratuberculosis
cggcguguuccuugcggcc

SEQ ID NO: 2834548 - RNA, 20 nt, Mycobacterium avium subsp. paratuberculosis
cggcguguuccuugcggccg

SEQ ID NO: 2834549 - RNA, 21 nt, Mycobacterium avium subsp. paratuberculosis
cggcguguuccuugcggccgc

SEQ ID NO: 2834550 - RNA, 21 nt, Mycobacterium avium subsp. paratuberculosis
cggcguguuguagucagaccc

SEQ ID NO: 2834551 - RNA, 23 nt, Mycobacterium avium subsp. paratuberculosis
cggcguuacccgaacccagcgcc

SEQ ID NO: 2834552 - RNA, 14 nt, Mycobacterium avium subsp. paratuberculosis
cggcguucagcagc

SEQ ID NO: 2834553 - RNA, 16 nt, Mycobacterium avium subsp. paratuberculosis
cggcguucagcagcgc

SEQ ID NO: 2834554 - RNA, 19 nt, Mycobacterium avium subsp. paratuberculosis
cggcguucagccggagccg

SEQ ID NO: 2834555 - RNA, 21 nt, Mycobacterium avium subsp. paratuberculosis
cggcguucagccggagccggc

SEQ ID NO: 2834556 - RNA, 18 nt, Mycobacterium avium subsp. paratuberculosis
cggcguucagcggcaccg

SEQ ID NO: 2834557 - RNA, 16 nt, Mycobacterium avium subsp. paratuberculosis
cggcguucaucgugcc

SEQ ID NO: 2834558 - RNA, 23 nt, Mycobacterium avium subsp. paratuberculosis
cggcguucaucgugccgaacgug

SEQ ID NO: 2834559 - RNA, 15 nt, Mycobacterium avium subsp. paratuberculosis
cggcguucgauugcc

SEQ ID NO: 2834560 - RNA, 16 nt, Mycobacterium avium subsp. paratuberculosis
cggcguucgauugccg

SEQ ID NO: 2834561 - RNA, 15 nt, Mycobacterium avium subsp. paratuberculosis
cggcguucggugccc

SEQ ID NO: 2834562 - RNA, 18 nt, Mycobacterium avium subsp. paratuberculosis
cggcguucggugcccggg

SEQ ID NO: 2834563 - RNA, 16 nt, Mycobacterium avium subsp. paratuberculosis
cggcguucuccagcac

SEQ ID NO: 2834564 - RNA, 17 nt, Mycobacterium avium subsp. paratuberculosis
cggcguucuccagcacc

SEQ ID NO: 2834565 - RNA, 18 nt, Mycobacterium avium subsp. paratuberculosis
cggcguucuccagcaccc

SEQ ID NO: 2834566 - RNA, 20 nt, Mycobacterium avium subsp. paratuberculosis
cggcguucuccagcacccgc

SEQ ID NO: 2834567 - RNA, 16 nt, Mycobacterium avium subsp. paratuberculosis
cggcguugaccaacgc

SEQ ID NO: 2834568 - RNA, 19 nt, Mycobacterium avium subsp. paratuberculosis
cggcguugaccaacgccgc

SEQ ID NO: 2834569 - RNA, 22 nt, Mycobacterium avium subsp. paratuberculosis
cggcguugaccaacgccgccuc

SEQ ID NO: 2834570 - RNA, 15 nt, Mycobacterium avium subsp. paratuberculosis
cggcguugaccgggc

SEQ ID NO: 2834571 - RNA, 17 nt, Mycobacterium avium subsp. paratuberculosis
cggcguugaccgggccg

SEQ ID NO: 2834572 - RNA, 20 nt, Mycobacterium avium subsp. paratuberculosis
cggcguugaccgggccgcug

SEQ ID NO: 2834573 - RNA, 15 nt, Mycobacterium avium subsp. paratuberculosis
cggcguugacgauga

SEQ ID NO: 2834574 - RNA, 16 nt, Mycobacterium avium subsp. paratuberculosis
cggcguugagccggcg

SEQ ID NO: 2834575 - RNA, 18 nt, Mycobacterium avium subsp. paratuberculosis
cggcguugagccggcgca

SEQ ID NO: 2834576 - RNA, 20 nt, Mycobacterium avium subsp. paratuberculosis
cggcguugagccggcgcacc

SEQ ID NO: 2834577 - RNA, 21 nt, Mycobacterium avium subsp. paratuberculosis
cggcguugaggcguugcggau

SEQ ID NO: 2834578 - RNA, 19 nt, Mycobacterium avium subsp. paratuberculosis
cggcguugcauuucggcgu

SEQ ID NO: 2834579 - RNA, 15 nt, Mycobacterium avium subsp. paratuberculosis
cggcguugcccgcug

SEQ ID NO: 2834580 - RNA, 16 nt, Mycobacterium avium subsp. paratuberculosis
cggcguugcccgcugc

SEQ ID NO: 2834581 - RNA, 19 nt, Mycobacterium avium subsp. paratuberculosis
cggcguugcccgcugcggc

SEQ ID NO: 2834582 - RNA, 17 nt, Mycobacterium avium subsp. paratuberculosis
cggcguugcccgggucc

SEQ ID NO: 2834583 - RNA, 18 nt, Mycobacterium avium subsp. paratuberculosis
cggcguugccgccggcgc

SEQ ID NO: 2834584 - RNA, 19 nt, Mycobacterium avium subsp. paratuberculosis
cggcguugccgccggcgcg

SEQ ID NO: 2834585 - RNA, 22 nt, Mycobacterium avium subsp. paratuberculosis
cggcguugcuggcgcgauagcc

SEQ ID NO: 2834586 - RNA, 23 nt, Mycobacterium avium subsp. paratuberculosis
cggcguugcuggcgcgauagccg

SEQ ID NO: 2834587 - RNA, 15 nt, Mycobacterium avium subsp. paratuberculosis
cggcguuggacagcu

SEQ ID NO: 2834588 - RNA, 17 nt, Mycobacterium avium subsp. paratuberculosis
cggcguuggacagcucg

SEQ ID NO: 2834589 - RNA, 16 nt, Mycobacterium avium subsp. paratuberculosis
cggcucgagcucgucg

SEQ ID NO: 2834590 - RNA, 12 nt, Mycobacterium avium subsp. paratuberculosis
cggcucgaucgc

SEQ ID NO: 2834591 - RNA, 17 nt, Mycobacterium avium subsp. paratuberculosis
cggcucgaucgcgguca

SEQ ID NO: 2834592 - RNA, 19 nt, Mycobacterium avium subsp. paratuberculosis
cggcucgaucgcggucacc

SEQ ID NO: 2834593 - RNA, 19 nt, Mycobacterium avium subsp. paratuberculosis
cggcucgauggacgccagc

SEQ ID NO: 2834594 - RNA, 20 nt, Mycobacterium avium subsp. paratuberculosis
cggcucgauggacgccagca

SEQ ID NO: 2834595 - RNA, 13 nt, Mycobacterium avium subsp. paratuberculosis
cggcucgccaccu

SEQ ID NO: 2834596 - RNA, 16 nt, Mycobacterium avium subsp. paratuberculosis
cggcucgccaccucgg

SEQ ID NO: 2834597 - RNA, 14 nt, Mycobacterium avium subsp. paratuberculosis
cggcucgcccgcga

SEQ ID NO: 2834598 - RNA, 11 nt, Mycobacterium avium subsp. paratuberculosis
cggcucgccga

SEQ ID NO: 2834599 - RNA, 15 nt, Mycobacterium avium subsp. paratuberculosis
cggcucgccgauccg

SEQ ID NO: 2834600 - RNA, 12 nt, Mycobacterium avium subsp. paratuberculosis
cggcucgccgcg

SEQ ID NO: 2834601 - RNA, 15 nt, Mycobacterium avium subsp. paratuberculosis
cggcucgccgcgcau

SEQ ID NO: 2834602 - RNA, 22 nt, Mycobacterium avium subsp. paratuberculosis
cggcucgccgcgcaucaucgcc

SEQ ID NO: 2834603 - RNA, 12 nt, Mycobacterium avium subsp. paratuberculosis
cggcucgccggc

SEQ ID NO: 2834604 - RNA, 16 nt, Mycobacterium avium subsp. paratuberculosis
cggcucgccggcgcgc

SEQ ID NO: 2834605 - RNA, 19 nt, Mycobacterium avium subsp. paratuberculosis
cggcucgccggcgcgcacc

SEQ ID NO: 2834606 - RNA, 13 nt, Mycobacterium avium subsp. paratuberculosis
cggcucgccgggc

SEQ ID NO: 2834607 - RNA, 16 nt, Mycobacterium avium subsp. paratuberculosis
cggcucgccgggcugc

SEQ ID NO: 2834608 - RNA, 21 nt, Mycobacterium avium subsp. paratuberculosis
cggcucgccguugcgggucgg

SEQ ID NO: 2834609 - RNA, 17 nt, Mycobacterium avium subsp. paratuberculosis
cggcucgccucaacggu

SEQ ID NO: 2834610 - RNA, 15 nt, Mycobacterium avium subsp. paratuberculosis
cggcucgcgacgcgg

SEQ ID NO: 2834611 - RNA, 16 nt, Mycobacterium avium subsp. paratuberculosis
cggcucgcgacgcggc

SEQ ID NO: 2834612 - RNA, 17 nt, Mycobacterium avium subsp. paratuberculosis
cggcucgcgacgcggcu

SEQ ID NO: 2834613 - RNA, 19 nt, Mycobacterium avium subsp. paratuberculosis
cggcucgcgacgcggcucg

SEQ ID NO: 2834614 - RNA, 15 nt, Mycobacterium avium subsp. paratuberculosis
cggcucgcgcggugu

SEQ ID NO: 2834615 - RNA, 16 nt, Mycobacterium avium subsp. paratuberculosis
cggcucgcgcgguguu

SEQ ID NO: 2834616 - RNA, 15 nt, Mycobacterium avium subsp. paratuberculosis
cggcucgcgggcgau

SEQ ID NO: 2834617 - RNA, 12 nt, Mycobacterium avium subsp. paratuberculosis
cggcucgcgggg

SEQ ID NO: 2834618 - RNA, 14 nt, Mycobacterium avium subsp. paratuberculosis
cggcucgcgggugc

SEQ ID NO: 2834619 - RNA, 17 nt, Mycobacterium avium subsp. paratuberculosis
cggcucgcgggugcggc

SEQ ID NO: 2834620 - RNA, 20 nt, Mycobacterium avium subsp. paratuberculosis
cggcucgcgggugcggcgcu

SEQ ID NO: 2834621 - RNA, 22 nt, Mycobacterium avium subsp. paratuberculosis
cggcucgcugaucugcggcacc

SEQ ID NO: 2834622 - RNA, 23 nt, Mycobacterium avium subsp. paratuberculosis
cggcucgcugaucugcggcacca

SEQ ID NO: 2834623 - RNA, 12 nt, Mycobacterium avium subsp. paratuberculosis
cggcucggccgg

SEQ ID NO: 2834624 - RNA, 14 nt, Mycobacterium avium subsp. paratuberculosis
cggcucggccggcc

SEQ ID NO: 2834625 - RNA, 15 nt, Mycobacterium avium subsp. paratuberculosis
cggcucggccggccg

SEQ ID NO: 2834626 - RNA, 16 nt, Mycobacterium avium subsp. paratuberculosis
cggcucggccggccgg

SEQ ID NO: 2834627 - RNA, 15 nt, Mycobacterium avium subsp. paratuberculosis
cggcucggccuucgg

SEQ ID NO: 2834628 - RNA, 14 nt, Mycobacterium avium subsp. paratuberculosis
cggcucggcgcccc

SEQ ID NO: 2834629 - RNA, 15 nt, Mycobacterium avium subsp. paratuberculosis
cggcucggcgcccca

SEQ ID NO: 2834630 - RNA, 21 nt, Mycobacterium avium subsp. paratuberculosis
cggcucggcgccccacgccug

SEQ ID NO: 2834631 - RNA, 13 nt, Mycobacterium avium subsp. paratuberculosis
cggcucggcgcug

SEQ ID NO: 2834632 - RNA, 14 nt, Mycobacterium avium subsp. paratuberculosis
cggcucggcggcgu

SEQ ID NO: 2834633 - RNA, 13 nt, Mycobacterium avium subsp. paratuberculosis
cggcucggcggcu

SEQ ID NO: 2834634 - RNA, 13 nt, Mycobacterium avium subsp. paratuberculosis
cggcucggcucgg

SEQ ID NO: 2834635 - RNA, 16 nt, Mycobacterium avium subsp. paratuberculosis
cggcucggcucggccg

SEQ ID NO: 2834636 - RNA, 13 nt, Mycobacterium avium subsp. paratuberculosis
cggcucgggccaa

SEQ ID NO: 2834637 - RNA, 15 nt, Mycobacterium avium subsp. paratuberculosis
cggcucgggcggugg

SEQ ID NO: 2834638 - RNA, 20 nt, Mycobacterium avium subsp. paratuberculosis
cggcucgggcgguggcgccg

SEQ ID NO: 2834639 - RNA, 22 nt, Mycobacterium avium subsp. paratuberculosis
cggcucgggcgguggcgccggg

SEQ ID NO: 2834640 - RNA, 15 nt, Mycobacterium avium subsp. paratuberculosis
cggcucgggggccgc

SEQ ID NO: 2834641 - RNA, 17 nt, Mycobacterium avium subsp. paratuberculosis
cggcucgggggccgcuc

SEQ ID NO: 2834642 - RNA, 14 nt, Mycobacterium avium subsp. paratuberculosis
cggcucgggggugu

SEQ ID NO: 2834643 - RNA, 17 nt, Mycobacterium avium subsp. paratuberculosis
cggcucgggggugucgu

SEQ ID NO: 2834644 - RNA, 16 nt, Mycobacterium avium subsp. paratuberculosis
cggcucggggucggcc

SEQ ID NO: 2834645 - RNA, 18 nt, Mycobacterium avium subsp. paratuberculosis
cggcucggggucggccga

SEQ ID NO: 2834646 - RNA, 21 nt, Mycobacterium avium subsp. paratuberculosis
cggcucggggucggccgaggu

SEQ ID NO: 2834647 - RNA, 19 nt, Mycobacterium avium subsp. paratuberculosis
cggcucgguaugcggcgac

SEQ ID NO: 2834648 - RNA, 20 nt, Mycobacterium avium subsp. paratuberculosis
cggcucgguaugcggcgacg

SEQ ID NO: 2834649 - RNA, 19 nt, Mycobacterium avium subsp. paratuberculosis
cggcucggucaagccggcc

SEQ ID NO: 2834650 - RNA, 21 nt, Mycobacterium avium subsp. paratuberculosis
cggcucggucaagccggccag

SEQ ID NO: 2834651 - RNA, 15 nt, Mycobacterium avium subsp. paratuberculosis
cggcucggucgcgaa

SEQ ID NO: 2834652 - RNA, 15 nt, Mycobacterium avium subsp. paratuberculosis
cggcucggucuccuc

SEQ ID NO: 2834653 - RNA, 17 nt, Mycobacterium avium subsp. paratuberculosis
cggcucggucuccucca

SEQ ID NO: 2834654 - RNA, 22 nt, Mycobacterium avium subsp. paratuberculosis
cggcucggugcgccagaucagc

SEQ ID NO: 2834655 - RNA, 17 nt, Mycobacterium avium subsp. paratuberculosis
cggcucguagcuggugc

SEQ ID NO: 2834656 - RNA, 22 nt, Mycobacterium avium subsp. paratuberculosis
cggcucguagcuggugcgcagc

SEQ ID NO: 2834657 - RNA, 19 nt, Mycobacterium avium subsp. paratuberculosis
cggcucguccagcccgguc

SEQ ID NO: 2834658 - RNA, 20 nt, Mycobacterium avium subsp. paratuberculosis
cggcucguccagcccgguca

SEQ ID NO: 2834659 - RNA, 16 nt, Mycobacterium avium subsp. paratuberculosis
cggcucgucggcgaac

SEQ ID NO: 2834660 - RNA, 20 nt, Mycobacterium avium subsp. paratuberculosis
cggcucgucggcgaacagug

SEQ ID NO: 2834661 - RNA, 20 nt, Mycobacterium avium subsp. paratuberculosis
cggcucguggaacgacgcca

SEQ ID NO: 2834662 - RNA, 15 nt, Mycobacterium avium subsp. paratuberculosis
cggcucguggguggu

SEQ ID NO: 2834663 - RNA, 16 nt, Mycobacterium avium subsp. paratuberculosis
cggcucguguccgaug

SEQ ID NO: 2834664 - RNA, 20 nt, Mycobacterium avium subsp. paratuberculosis
cggcucguguccgaugacga

SEQ ID NO: 2834665 - RNA, 21 nt, Mycobacterium avium subsp. paratuberculosis
cggcucuccaucuucggcacg

SEQ ID NO: 2834666 - RNA, 16 nt, Mycobacterium avium subsp. paratuberculosis
cggcucuucgcggcgg

SEQ ID NO: 2834667 - RNA, 19 nt, Mycobacterium avium subsp. paratuberculosis
cggcucuucgcggcggggc

SEQ ID NO: 2834668 - RNA, 20 nt, Mycobacterium avium subsp. paratuberculosis
cggcucuucgcggcggggca

SEQ ID NO: 2834669 - RNA, 14 nt, Mycobacterium avium subsp. paratuberculosis
cggcucuucggcgc

SEQ ID NO: 2834670 - RNA, 17 nt, Mycobacterium avium subsp. paratuberculosis
cggcucuucggcgccga

SEQ ID NO: 2834671 - RNA, 20 nt, Mycobacterium avium subsp. paratuberculosis
cggcucuucggcgccgagcg

SEQ ID NO: 2834672 - RNA, 21 nt, Mycobacterium avium subsp. paratuberculosis
cggcucuucggcgccgagcgu

SEQ ID NO: 2834673 - RNA, 16 nt, Mycobacterium avium subsp. paratuberculosis
cggcucuuggcgaccu

SEQ ID NO: 2834674 - RNA, 20 nt, Mycobacterium avium subsp. paratuberculosis
cggcuggccgcacaccugca

SEQ ID NO: 2834675 - RNA, 22 nt, Mycobacterium avium subsp. paratuberculosis
cggcuggccgcacaccugcauc

SEQ ID NO: 2834676 - RNA, 24 nt, Mycobacterium avium subsp. paratuberculosis
cggcuggccgcacaccugcaucac

SEQ ID NO: 2834677 - RNA, 14 nt, Mycobacterium avium subsp. paratuberculosis
cggcuggccgcggc

SEQ ID NO: 2834678 - RNA, 15 nt, Mycobacterium avium subsp. paratuberculosis
cggcuggccgcggcg

SEQ ID NO: 2834679 - RNA, 16 nt, Mycobacterium avium subsp. paratuberculosis
cggcuggccgcggcga

SEQ ID NO: 2834680 - RNA, 19 nt, Mycobacterium avium subsp. paratuberculosis
cggcuggccgcggcgaucg

SEQ ID NO: 2834681 - RNA, 21 nt, Mycobacterium avium subsp. paratuberculosis
cggcuggccgcggcgaucggc

SEQ ID NO: 2834682 - RNA, 12 nt, Mycobacterium avium subsp. paratuberculosis
cggcuggccgga

SEQ ID NO: 2834683 - RNA, 13 nt, Mycobacterium avium subsp. paratuberculosis
cggcuggccgucg

SEQ ID NO: 2834684 - RNA, 15 nt, Mycobacterium avium subsp. paratuberculosis
cggcuggccgucguc

SEQ ID NO: 2834685 - RNA, 19 nt, Mycobacterium avium subsp. paratuberculosis
cggcuggccgucgucgagg

SEQ ID NO: 2834686 - RNA, 17 nt, Mycobacterium avium subsp. paratuberculosis
cggcuggcgggcgaucg

SEQ ID NO: 2834687 - RNA, 22 nt, Mycobacterium avium subsp. paratuberculosis
cggcuggcgggcgaucgccucg

SEQ ID NO: 2834688 - RNA, 18 nt, Mycobacterium avium subsp. paratuberculosis
cggcuggcgggugguugg

SEQ ID NO: 2834689 - RNA, 17 nt, Mycobacterium avium subsp. paratuberculosis
cggcuggcgugcggcgc

SEQ ID NO: 2834690 - RNA, 19 nt, Mycobacterium avium subsp. paratuberculosis
cggcugggcagccgcgcgu

SEQ ID NO: 2834691 - RNA, 13 nt, Mycobacterium avium subsp. paratuberculosis
cggcugggccgcg

SEQ ID NO: 2834692 - RNA, 14 nt, Mycobacterium avium subsp. paratuberculosis
cggcugggccgcgg

SEQ ID NO: 2834693 - RNA, 15 nt, Mycobacterium avium subsp. paratuberculosis
cggcugggccgcggc

SEQ ID NO: 2834694 - RNA, 16 nt, Mycobacterium avium subsp. paratuberculosis
cggcugggccgcggcg

SEQ ID NO: 2834695 - RNA, 17 nt, Mycobacterium avium subsp. paratuberculosis
cggcugggccgcggcgc

SEQ ID NO: 2834696 - RNA, 20 nt, Mycobacterium avium subsp. paratuberculosis
cggcugggccgcggcgccgu

SEQ ID NO: 2834697 - RNA, 14 nt, Mycobacterium avium subsp. paratuberculosis
cggcugggcgcgca

SEQ ID NO: 2834698 - RNA, 17 nt, Mycobacterium avium subsp. paratuberculosis
cggcugggcgcgcaacu

SEQ ID NO: 2834699 - RNA, 13 nt, Mycobacterium avium subsp. paratuberculosis
cggcuggucggcg

SEQ ID NO: 2834700 - RNA, 15 nt, Mycobacterium avium subsp. paratuberculosis
cggcuggucggcggg

SEQ ID NO: 2834701 - RNA, 16 nt, Mycobacterium avium subsp. paratuberculosis
cggcuggucggcgggu

SEQ ID NO: 2834702 - RNA, 15 nt, Mycobacterium avium subsp. paratuberculosis
cggcuggugcagcag

SEQ ID NO: 2834703 - RNA, 17 nt, Mycobacterium avium subsp. paratuberculosis
cggcuggugcagcagcu

SEQ ID NO: 2834704 - RNA, 13 nt, Mycobacterium avium subsp. paratuberculosis
cggcuguagcacc

SEQ ID NO: 2834705 - RNA, 17 nt, Mycobacterium avium subsp. paratuberculosis
cggcuguagcacccggc

SEQ ID NO: 2834706 - RNA, 19 nt, Mycobacterium avium subsp. paratuberculosis
cggcuguagcacccggccg

SEQ ID NO: 2834707 - RNA, 21 nt, Mycobacterium avium subsp. paratuberculosis
cggcuguagcacccggccggc

SEQ ID NO: 2834708 - RNA, 22 nt, Mycobacterium avium subsp. paratuberculosis
cggcuguagcacccggccggcg

SEQ ID NO: 2834709 - RNA, 18 nt, Mycobacterium avium subsp. paratuberculosis
cggcugucgacaggaucg

SEQ ID NO: 2834710 - RNA, 18 nt, Mycobacterium avium subsp. paratuberculosis
cggcugucguagcggccc

SEQ ID NO: 2834711 - RNA, 19 nt, Mycobacterium avium subsp. paratuberculosis
cggcugucguagcggccca

SEQ ID NO: 2834712 - RNA, 17 nt, Mycobacterium avium subsp. paratuberculosis
cggcuuaccgaccucga

SEQ ID NO: 2834713 - RNA, 21 nt, Mycobacterium avium subsp. paratuberculosis
cggcuuaccggcgggcggcgg

SEQ ID NO: 2834714 - RNA, 22 nt, Mycobacterium avium subsp. paratuberculosis
cggcuucaaaaaccuguccggg

SEQ ID NO: 2834715 - RNA, 17 nt, Mycobacterium avium subsp. paratuberculosis
cggcuucagucccgcga

SEQ ID NO: 2834716 - RNA, 14 nt, Mycobacterium avium subsp. paratuberculosis
cggcuuccuccucg

SEQ ID NO: 2834717 - RNA, 15 nt, Mycobacterium avium subsp. paratuberculosis
cggcuuccuccucgg

SEQ ID NO: 2834718 - RNA, 19 nt, Mycobacterium avium subsp. paratuberculosis
cggcuuccuccucggcgcg

SEQ ID NO: 2834719 - RNA, 19 nt, Mycobacterium avium subsp. paratuberculosis
cggcuucgccgccgcaccg

SEQ ID NO: 2834720 - RNA, 13 nt, Mycobacterium avium subsp. paratuberculosis
cggcuucgccgcg

SEQ ID NO: 2834721 - RNA, 14 nt, Mycobacterium avium subsp. paratuberculosis
cggcuucgcugcgc

SEQ ID NO: 2834722 - RNA, 15 nt, Mycobacterium avium subsp. paratuberculosis
cggcuucgcugcgcc

SEQ ID NO: 2834723 - RNA, 18 nt, Mycobacterium avium subsp. paratuberculosis
cggcuucgcugcgccggc

SEQ ID NO: 2834724 - RNA, 20 nt, Mycobacterium avium subsp. paratuberculosis
cggcuucgcugcgccggcgg

SEQ ID NO: 2834725 - RNA, 14 nt, Mycobacterium avium subsp. paratuberculosis
cggcuucggccaag

SEQ ID NO: 2834726 - RNA, 19 nt, Mycobacterium avium subsp. paratuberculosis
cggcuucgggaucagcggg

SEQ ID NO: 2834727 - RNA, 20 nt, Mycobacterium avium subsp. paratuberculosis
cggcuucgggaucagcggga

SEQ ID NO: 2834728 - RNA, 20 nt, Mycobacterium avium subsp. paratuberculosis
cggcuucguaacacccucgg

SEQ ID NO: 2834729 - RNA, 17 nt, Mycobacterium avium subsp. paratuberculosis
cggcuucguacggcccg

SEQ ID NO: 2834730 - RNA, 18 nt, Mycobacterium avium subsp. paratuberculosis
cggcuucguacggcccgg

SEQ ID NO: 2834731 - RNA, 21 nt, Mycobacterium avium subsp. paratuberculosis
cggcuucguacggcccgggaa

SEQ ID NO: 2834732 - RNA, 16 nt, Mycobacterium avium subsp. paratuberculosis
cggcuucucggcgugc

SEQ ID NO: 2834733 - RNA, 17 nt, Mycobacterium avium subsp. paratuberculosis
cggcuugaccggcucgc

SEQ ID NO: 2834734 - RNA, 20 nt, Mycobacterium avium subsp. paratuberculosis
cggcuugaccggcucgccgg

SEQ ID NO: 2834735 - RNA, 16 nt, Mycobacterium avium subsp. paratuberculosis
cggcuugacuucgucg

SEQ ID NO: 2834736 - RNA, 17 nt, Mycobacterium avium subsp. paratuberculosis
cggcuugacuucgucgg

SEQ ID NO: 2834737 - RNA, 17 nt, Mycobacterium avium subsp. paratuberculosis
cggcuugagccggaucg

SEQ ID NO: 2834738 - RNA, 18 nt, Mycobacterium avium subsp. paratuberculosis
cggcuugagcgccagcgc

SEQ ID NO: 2834739 - RNA, 23 nt, Mycobacterium avium subsp. paratuberculosis
cggcuugagcgccagcgcggugc

SEQ ID NO: 2834740 - RNA, 14 nt, Mycobacterium avium subsp. paratuberculosis
cggcuugccgccgc

SEQ ID NO: 2834741 - RNA, 24 nt, Mycobacterium avium subsp. paratuberculosis
cggcuugccgccgcagcgcagcgu

SEQ ID NO: 2834742 - RNA, 23 nt, Mycobacterium avium subsp. paratuberculosis
cggcuugcgcagguugucggcca

SEQ ID NO: 2834743 - RNA, 17 nt, Mycobacterium avium subsp. paratuberculosis
cggcuugcgcucggccg

SEQ ID NO: 2834744 - RNA, 17 nt, Mycobacterium avium subsp. paratuberculosis
cggcuugcgucgcuguc

SEQ ID NO: 2834745 - RNA, 14 nt, Mycobacterium avium subsp. paratuberculosis
cggcuuggccacca

SEQ ID NO: 2834746 - RNA, 16 nt, Mycobacterium avium subsp. paratuberculosis
cggcuuggccaccacc

SEQ ID NO: 2834747 - RNA, 23 nt, Mycobacterium avium subsp. paratuberculosis
cggcuuggccacgaugaucgucg

SEQ ID NO: 2834748 - RNA, 20 nt, Mycobacterium avium subsp. paratuberculosis
cggcuuggccgugcaggggg

SEQ ID NO: 2834749 - RNA, 14 nt, Mycobacterium avium subsp. paratuberculosis
cggcuuggcgguga

SEQ ID NO: 2834750 - RNA, 18 nt, Mycobacterium avium subsp. paratuberculosis
cggcuuggucaccagcuc

SEQ ID NO: 2834751 - RNA, 20 nt, Mycobacterium avium subsp. paratuberculosis
cggcuuggugggcgccggcg

SEQ ID NO: 2834752 - RNA, 21 nt, Mycobacterium avium subsp. paratuberculosis
cggcuuggugggcgccggcgu

SEQ ID NO: 2834753 - RNA, 22 nt, Mycobacterium avium subsp. paratuberculosis
cggcuuggugggcgccggcguc

SEQ ID NO: 2834754 - RNA, 20 nt, Mycobacterium avium subsp. paratuberculosis
cgggaaaauuuccuggccga

SEQ ID NO: 2834755 - RNA, 19 nt, Mycobacterium avium subsp. paratuberculosis
cgggaaagcgggugaccga

SEQ ID NO: 2834756 - RNA, 23 nt, Mycobacterium avium subsp. paratuberculosis
cgggaaagcgggugaccgacagc

SEQ ID NO: 2834757 - RNA, 23 nt, Mycobacterium avium subsp. paratuberculosis
cgggaaaguuguagcgcagcauc

SEQ ID NO: 2834758 - RNA, 17 nt, Mycobacterium avium subsp. paratuberculosis
cgggaccagcgcggugc

SEQ ID NO: 2834759 - RNA, 21 nt, Mycobacterium avium subsp. paratuberculosis
cgggaccagcgcggugccggu

SEQ ID NO: 2834760 - RNA, 12 nt, Mycobacterium avium subsp. paratuberculosis
cgggacccgcga

SEQ ID NO: 2834761 - RNA, 14 nt, Mycobacterium avium subsp. paratuberculosis
cgggacccgcgacc

SEQ ID NO: 2834762 - RNA, 14 nt, Mycobacterium avium subsp. paratuberculosis
cgggaccgaggugc

SEQ ID NO: 2834763 - RNA, 13 nt, Mycobacterium avium subsp. paratuberculosis
cgggaccgaugcc

SEQ ID NO: 2834764 - RNA, 15 nt, Mycobacterium avium subsp. paratuberculosis
cgggaccgaugccgc

SEQ ID NO: 2834765 - RNA, 15 nt, Mycobacterium avium subsp. paratuberculosis
cgggaccgcacgccg

SEQ ID NO: 2834766 - RNA, 17 nt, Mycobacterium avium subsp. paratuberculosis
cgggaccgcgggcgcau

SEQ ID NO: 2834767 - RNA, 16 nt, Mycobacterium avium subsp. paratuberculosis
cgggaccgggcccggc

SEQ ID NO: 2834768 - RNA, 20 nt, Mycobacterium avium subsp. paratuberculosis
cgggaccgggcccggcgcca

SEQ ID NO: 2834769 - RNA, 16 nt, Mycobacterium avium subsp. paratuberculosis
cgggaccgucgcgcag

SEQ ID NO: 2834770 - RNA, 17 nt, Mycobacterium avium subsp. paratuberculosis
cgggaccgucgcgcagc

SEQ ID NO: 2834771 - RNA, 18 nt, Mycobacterium avium subsp. paratuberculosis
cgggaccgucgcgcagcc

SEQ ID NO: 2834772 - RNA, 15 nt, Mycobacterium avium subsp. paratuberculosis
cgggaccugcugcuc

SEQ ID NO: 2834773 - RNA, 20 nt, Mycobacterium avium subsp. paratuberculosis
cgggaccugggucugcggcc

SEQ ID NO: 2834774 - RNA, 20 nt, Mycobacterium avium subsp. paratuberculosis
cgggacgaaggugcgcacga

SEQ ID NO: 2834775 - RNA, 12 nt, Mycobacterium avium subsp. paratuberculosis
cgggacgacggc

SEQ ID NO: 2834776 - RNA, 17 nt, Mycobacterium avium subsp. paratuberculosis
cgggacgacggcgccgc

SEQ ID NO: 2834777 - RNA, 18 nt, Mycobacterium avium subsp. paratuberculosis
cgggacgacggcgccgcc

SEQ ID NO: 2834778 - RNA, 19 nt, Mycobacterium avium subsp. paratuberculosis
cgggacgacggcgccgccc

SEQ ID NO: 2834779 - RNA, 20 nt, Mycobacterium avium subsp. paratuberculosis
cgggacgacggcgccgcccg

SEQ ID NO: 2834780 - RNA, 20 nt, Mycobacterium avium subsp. paratuberculosis
cgggacgaggggcagcagcg

SEQ ID NO: 2834781 - RNA, 22 nt, Mycobacterium avium subsp. paratuberculosis
cgggacgaggggcagcagcgcc

SEQ ID NO: 2834782 - RNA, 18 nt, Mycobacterium avium subsp. paratuberculosis
cgggacgaucugcgucau

SEQ ID NO: 2834783 - RNA, 14 nt, Mycobacterium avium subsp. paratuberculosis
cgggacgccacggc

SEQ ID NO: 2834784 - RNA, 16 nt, Mycobacterium avium subsp. paratuberculosis
cgggacgccacggcga

SEQ ID NO: 2834785 - RNA, 20 nt, Mycobacterium avium subsp. paratuberculosis
cgggacgccguugacaccgg

SEQ ID NO: 2834786 - RNA, 15 nt, Mycobacterium avium subsp. paratuberculosis
cgggacgccugccgc

SEQ ID NO: 2834787 - RNA, 14 nt, Mycobacterium avium subsp. paratuberculosis
cgggacgcggcagg

SEQ ID NO: 2834788 - RNA, 19 nt, Mycobacterium avium subsp. paratuberculosis
cgggacgcggcaggcgccc

SEQ ID NO: 2834789 - RNA, 12 nt, Mycobacterium avium subsp. paratuberculosis
cgggacgcgguc

SEQ ID NO: 2834790 - RNA, 13 nt, Mycobacterium avium subsp. paratuberculosis
cgggacggccagc

SEQ ID NO: 2834791 - RNA, 14 nt, Mycobacterium avium subsp. paratuberculosis
cgggacggccagca

SEQ ID NO: 2834792 - RNA, 15 nt, Mycobacterium avium subsp. paratuberculosis
cgggacggccagcag

SEQ ID NO: 2834793 - RNA, 18 nt, Mycobacterium avium subsp. paratuberculosis
cgggacggccagcagggc

SEQ ID NO: 2834794 - RNA, 13 nt, Mycobacterium avium subsp. paratuberculosis
cgggacggcggcg

SEQ ID NO: 2834795 - RNA, 14 nt, Mycobacterium avium subsp. paratuberculosis
cgggacggcggcga

SEQ ID NO: 2834796 - RNA, 17 nt, Mycobacterium avium subsp. paratuberculosis
cgggacgggggugccga

SEQ ID NO: 2834797 - RNA, 19 nt, Mycobacterium avium subsp. paratuberculosis
cgggacgggggugccgacc

SEQ ID NO: 2834798 - RNA, 21 nt, Mycobacterium avium subsp. paratuberculosis
cgggacgggggugccgaccgc

SEQ ID NO: 2834799 - RNA, 20 nt, Mycobacterium avium subsp. paratuberculosis
cgggacgucagcccgcgucg

SEQ ID NO: 2834800 - RNA, 14 nt, Mycobacterium avium subsp. paratuberculosis
cgggacguccgcgc

SEQ ID NO: 2834801 - RNA, 16 nt, Mycobacterium avium subsp. paratuberculosis
cgggacguccgcgcga

SEQ ID NO: 2834802 - RNA, 13 nt, Mycobacterium avium subsp. paratuberculosis
cgggacgucggcg

SEQ ID NO: 2834803 - RNA, 14 nt, Mycobacterium avium subsp. paratuberculosis
cgggacgucggcgc

SEQ ID NO: 2834804 - RNA, 23 nt, Mycobacterium avium subsp. paratuberculosis
cgggacgucggcgcgcucggugc

SEQ ID NO: 2834805 - RNA, 13 nt, Mycobacterium avium subsp. paratuberculosis
cgggacguggcuc

SEQ ID NO: 2834806 - RNA, 19 nt, Mycobacterium avium subsp. paratuberculosis
cgggacguggcucagcggc

SEQ ID NO: 2834807 - RNA, 16 nt, Mycobacterium avium subsp. paratuberculosis
cgggacugcagcgcgg

SEQ ID NO: 2834808 - RNA, 16 nt, Mycobacterium avium subsp. paratuberculosis
cgggacugggcgauug

SEQ ID NO: 2834809 - RNA, 19 nt, Mycobacterium avium subsp. paratuberculosis
cgggagaaaugggccaggu

SEQ ID NO: 2834810 - RNA, 23 nt, Mycobacterium avium subsp. paratuberculosis
cgggagaacagguaggacaccga

SEQ ID NO: 2834811 - RNA, 16 nt, Mycobacterium avium subsp. paratuberculosis
cgggagaacucgacga

SEQ ID NO: 2834812 - RNA, 14 nt, Mycobacterium avium subsp. paratuberculosis
cgggagacguccug

SEQ ID NO: 2834813 - RNA, 18 nt, Mycobacterium avium subsp. paratuberculosis
cgggagcaaggucgucgc

SEQ ID NO: 2834814 - RNA, 20 nt, Mycobacterium avium subsp. paratuberculosis
cgggagcaaggucgucgcgg

SEQ ID NO: 2834815 - RNA, 22 nt, Mycobacterium avium subsp. paratuberculosis
cgggagcaaggucgucgcggcc

SEQ ID NO: 2834816 - RNA, 12 nt, Mycobacterium avium subsp. paratuberculosis
cgggagccggcc

SEQ ID NO: 2834817 - RNA, 13 nt, Mycobacterium avium subsp. paratuberculosis
cgggagccggcca

SEQ ID NO: 2834818 - RNA, 16 nt, Mycobacterium avium subsp. paratuberculosis
cgggagccggccaggu

SEQ ID NO: 2834819 - RNA, 14 nt, Mycobacterium avium subsp. paratuberculosis
cgggagccggcggc

SEQ ID NO: 2834820 - RNA, 16 nt, Mycobacterium avium subsp. paratuberculosis
cgggagccggcggcgg

SEQ ID NO: 2834821 - RNA, 13 nt, Mycobacterium avium subsp. paratuberculosis
cgggagcgcuggu

SEQ ID NO: 2834822 - RNA, 19 nt, Mycobacterium avium subsp. paratuberculosis
cgggagcgcuggucggcga

SEQ ID NO: 2834823 - RNA, 21 nt, Mycobacterium avium subsp. paratuberculosis
cgggagcgcuggucggcgaac

SEQ ID NO: 2834824 - RNA, 23 nt, Mycobacterium avium subsp. paratuberculosis
cgggagcgcuggucggcgaaccg

SEQ ID NO: 2834825 - RNA, 14 nt, Mycobacterium avium subsp. paratuberculosis
cgggaggacagcgc

SEQ ID NO: 2834826 - RNA, 16 nt, Mycobacterium avium subsp. paratuberculosis
cgggaggacagcgcgg

SEQ ID NO: 2834827 - RNA, 20 nt, Mycobacterium avium subsp. paratuberculosis
cgggaggacagcgcgguggu

SEQ ID NO: 2834828 - RNA, 12 nt, Mycobacterium avium subsp. paratuberculosis
cgggaggccagc

SEQ ID NO: 2834829 - RNA, 14 nt, Mycobacterium avium subsp. paratuberculosis
cgggaggccagcac

SEQ ID NO: 2834830 - RNA, 17 nt, Mycobacterium avium subsp. paratuberculosis
cgggaguccacgccgug

SEQ ID NO: 2834831 - RNA, 17 nt, Mycobacterium avium subsp. paratuberculosis
cgggagucgggcccgcc

SEQ ID NO: 2834832 - RNA, 14 nt, Mycobacterium avium subsp. paratuberculosis
cgggagugcggccc

SEQ ID NO: 2834833 - RNA, 21 nt, Mycobacterium avium subsp. paratuberculosis
cgggagugcuggacggcccga

SEQ ID NO: 2834834 - RNA, 13 nt, Mycobacterium avium subsp. paratuberculosis
cgggaguggccgg

SEQ ID NO: 2834835 - RNA, 19 nt, Mycobacterium avium subsp. paratuberculosis
cgggauacccaugaucgcc

SEQ ID NO: 2834836 - RNA, 22 nt, Mycobacterium avium subsp. paratuberculosis
cgggauacccaugaucgccagu

SEQ ID NO: 2834837 - RNA, 16 nt, Mycobacterium avium subsp. paratuberculosis
cgggauaccgcgaccg

SEQ ID NO: 2834838 - RNA, 19 nt, Mycobacterium avium subsp. paratuberculosis
cgggauaccgcgaccgccu

SEQ ID NO: 2834839 - RNA, 19 nt, Mycobacterium avium subsp. paratuberculosis
cgggauacucguccucccg

SEQ ID NO: 2834840 - RNA, 21 nt, Mycobacterium avium subsp. paratuberculosis
cgggauacucguccucccggu

SEQ ID NO: 2834841 - RNA, 15 nt, Mycobacterium avium subsp. paratuberculosis
cgggauagagcaccg

SEQ ID NO: 2834842 - RNA, 16 nt, Mycobacterium avium subsp. paratuberculosis
cgggauagagcaccgc

SEQ ID NO: 2834843 - RNA, 18 nt, Mycobacterium avium subsp. paratuberculosis
cgggauggugagcccgau

SEQ ID NO: 2834844 - RNA, 15 nt, Mycobacterium avium subsp. paratuberculosis
cgggauguagccggu

SEQ ID NO: 2834845 - RNA, 21 nt, Mycobacterium avium subsp. paratuberculosis
cgggauguagccgguccuggc

SEQ ID NO: 2834846 - RNA, 20 nt, Mycobacterium avium subsp. paratuberculosis
cgggaugucgugggcgugcc

SEQ ID NO: 2834847 - RNA, 15 nt, Mycobacterium avium subsp. paratuberculosis
cgggaugugcguggu

SEQ ID NO: 2834848 - RNA, 15 nt, Mycobacterium avium subsp. paratuberculosis
cgggauucgcgcacc

SEQ ID NO: 2834849 - RNA, 19 nt, Mycobacterium avium subsp. paratuberculosis
cgggauugaggcuggcgau

SEQ ID NO: 2834850 - RNA, 18 nt, Mycobacterium avium subsp. paratuberculosis
cgggauuggacagcggcg

SEQ ID NO: 2834851 - RNA, 21 nt, Mycobacterium avium subsp. paratuberculosis
cgggauuggacagcggcgcgg

SEQ ID NO: 2834852 - RNA, 12 nt, Mycobacterium avium subsp. paratuberculosis
cgggauuggcgc

SEQ ID NO: 2834853 - RNA, 23 nt, Mycobacterium avium subsp. paratuberculosis
cgggauuggcgccacugccgccg

SEQ ID NO: 2834854 - RNA, 15 nt, Mycobacterium avium subsp. paratuberculosis
cgggauuggcggcca

SEQ ID NO: 2834855 - RNA, 23 nt, Mycobacterium avium subsp. paratuberculosis
cgggauuucccgggcgaucagcc

SEQ ID NO: 2834856 - RNA, 15 nt, Mycobacterium avium subsp. paratuberculosis
cgggcaacagcgcgc

SEQ ID NO: 2834857 - RNA, 16 nt, Mycobacterium avium subsp. paratuberculosis
cgggcaacagcgcgcc

SEQ ID NO: 2834858 - RNA, 19 nt, Mycobacterium avium subsp. paratuberculosis
cgggcaacagcgcgccggc

SEQ ID NO: 2834859 - RNA, 20 nt, Mycobacterium avium subsp. paratuberculosis
cgggcaacagcgcgccggcc

SEQ ID NO: 2834860 - RNA, 22 nt, Mycobacterium avium subsp. paratuberculosis
cgggcaacagcgcgccggccgg

SEQ ID NO: 2834861 - RNA, 17 nt, Mycobacterium avium subsp. paratuberculosis
cgggcaaccacagcggc

SEQ ID NO: 2834862 - RNA, 15 nt, Mycobacterium avium subsp. paratuberculosis
cgggcaacgcgccgg

SEQ ID NO: 2834863 - RNA, 16 nt, Mycobacterium avium subsp. paratuberculosis
cgggcaacgcgccggc

SEQ ID NO: 2834864 - RNA, 17 nt, Mycobacterium avium subsp. paratuberculosis
cgggcaacgcgccggcg

SEQ ID NO: 2834865 - RNA, 22 nt, Mycobacterium avium subsp. paratuberculosis
cgggcaacgcgccggcggucga

SEQ ID NO: 2834866 - RNA, 12 nt, Mycobacterium avium subsp. paratuberculosis
cgggcaagggca

SEQ ID NO: 2834867 - RNA, 14 nt, Mycobacterium avium subsp. paratuberculosis
cgggcaaucggacc

SEQ ID NO: 2834868 - RNA, 17 nt, Mycobacterium avium subsp. paratuberculosis
cgggcaaucggacccag

SEQ ID NO: 2834869 - RNA, 18 nt, Mycobacterium avium subsp. paratuberculosis
cgggcaaucggacccagc

SEQ ID NO: 2834870 - RNA, 21 nt, Mycobacterium avium subsp. paratuberculosis
cgggcaaucggacccagcccg

SEQ ID NO: 2834871 - RNA, 22 nt, Mycobacterium avium subsp. paratuberculosis
cgggcaaucggacccagcccga

SEQ ID NO: 2834872 - RNA, 18 nt, Mycobacterium avium subsp. paratuberculosis
cgggcaaugaugucggcg

SEQ ID NO: 2834873 - RNA, 20 nt, Mycobacterium avium subsp. paratuberculosis
cgggcaaugaugucggcggg

SEQ ID NO: 2834874 - RNA, 18 nt, Mycobacterium avium subsp. paratuberculosis
cgggcacaccgucgucca

SEQ ID NO: 2834875 - RNA, 20 nt, Mycobacterium avium subsp. paratuberculosis
cgggcacaccgucguccacg

SEQ ID NO: 2834876 - RNA, 22 nt, Mycobacterium avium subsp. paratuberculosis
cgggcacacgcgguccacuucc

SEQ ID NO: 2834877 - RNA, 14 nt, Mycobacterium avium subsp. paratuberculosis
cgggcacagccagc

SEQ ID NO: 2834878 - RNA, 18 nt, Mycobacterium avium subsp. paratuberculosis
cgggcacagccagcgccc

SEQ ID NO: 2834879 - RNA, 20 nt, Mycobacterium avium subsp. paratuberculosis
cgggcacagccagcgcccgg

SEQ ID NO: 2834880 - RNA, 21 nt, Mycobacterium avium subsp. paratuberculosis
cgggcacagccagcgcccggc

SEQ ID NO: 2834881 - RNA, 22 nt, Mycobacterium avium subsp. paratuberculosis
cgggcacagccagcgcccggcg

SEQ ID NO: 2834882 - RNA, 16 nt, Mycobacterium avium subsp. paratuberculosis
cgggcacauagcucag

SEQ ID NO: 2834883 - RNA, 16 nt, Mycobacterium avium subsp. paratuberculosis
cgggcacaucccgcaa

SEQ ID NO: 2834884 - RNA, 18 nt, Mycobacterium avium subsp. paratuberculosis
cgggcaccaccaccgaca

SEQ ID NO: 2834885 - RNA, 16 nt, Mycobacterium avium subsp. paratuberculosis
cgggcaccacgccgac

SEQ ID NO: 2834886 - RNA, 18 nt, Mycobacterium avium subsp. paratuberculosis
cgggcaccacgccgacgu

SEQ ID NO: 2834887 - RNA, 20 nt, Mycobacterium avium subsp. paratuberculosis
cgggcaccacgccgacgugg

SEQ ID NO: 2834888 - RNA, 15 nt, Mycobacterium avium subsp. paratuberculosis
cgggcaccacggcgg

SEQ ID NO: 2834889 - RNA, 17 nt, Mycobacterium avium subsp. paratuberculosis
cgggcaccacggcggca

SEQ ID NO: 2834890 - RNA, 13 nt, Mycobacterium avium subsp. paratuberculosis
cgggcaccagcac

SEQ ID NO: 2834891 - RNA, 16 nt, Mycobacterium avium subsp. paratuberculosis
cgggcaccagcaccga

SEQ ID NO: 2834892 - RNA, 17 nt, Mycobacterium avium subsp. paratuberculosis
cgggcaccagcaccgag

SEQ ID NO: 2834893 - RNA, 22 nt, Mycobacterium avium subsp. paratuberculosis
cgggcaccagcgacagcacccg

SEQ ID NO: 2834894 - RNA, 15 nt, Mycobacterium avium subsp. paratuberculosis
cgggcaccagcgcga

SEQ ID NO: 2834895 - RNA, 16 nt, Mycobacterium avium subsp. paratuberculosis
cgggcaccagcgcgac

SEQ ID NO: 2834896 - RNA, 18 nt, Mycobacterium avium subsp. paratuberculosis
cgggcaccagcgcgacgg

SEQ ID NO: 2834897 - RNA, 20 nt, Mycobacterium avium subsp. paratuberculosis
cgggcaccagcgcgacggug

SEQ ID NO: 2834898 - RNA, 22 nt, Mycobacterium avium subsp. paratuberculosis
cgggcaccaguaggucacccgg

SEQ ID NO: 2834899 - RNA, 20 nt, Mycobacterium avium subsp. paratuberculosis
cgggcaccccaucggccagg

SEQ ID NO: 2834900 - RNA, 15 nt, Mycobacterium avium subsp. paratuberculosis
cgggcacccccgggg

SEQ ID NO: 2834901 - RNA, 17 nt, Mycobacterium avium subsp. paratuberculosis
cgggcacccccggggug

SEQ ID NO: 2834902 - RNA, 12 nt, Mycobacterium avium subsp. paratuberculosis
cgggcaccccgg

SEQ ID NO: 2834903 - RNA, 17 nt, Mycobacterium avium subsp. paratuberculosis
cgggcaccccggucacc

SEQ ID NO: 2834904 - RNA, 21 nt, Mycobacterium avium subsp. paratuberculosis
cgggcaccccggucaccgguc

SEQ ID NO: 2834905 - RNA, 22 nt, Mycobacterium avium subsp. paratuberculosis
cgggcaccccggucaccggucc

SEQ ID NO: 2834906 - RNA, 17 nt, Mycobacterium avium subsp. paratuberculosis
cgggcaccccugccgcc

SEQ ID NO: 2834907 - RNA, 19 nt, Mycobacterium avium subsp. paratuberculosis
cgggcaccccugccgccac

SEQ ID NO: 2834908 - RNA, 17 nt, Mycobacterium avium subsp. paratuberculosis
cgggcacccgacgucga

SEQ ID NO: 2834909 - RNA, 19 nt, Mycobacterium avium subsp. paratuberculosis
cgggcacccgacgucgacg

SEQ ID NO: 2834910 - RNA, 15 nt, Mycobacterium avium subsp. paratuberculosis
cgggcacccgcgcgu

SEQ ID NO: 2834911 - RNA, 19 nt, Mycobacterium avium subsp. paratuberculosis
cgggcacccgcgcgucgcg

SEQ ID NO: 2834912 - RNA, 21 nt, Mycobacterium avium subsp. paratuberculosis
cgggcacccgcgcgucgcgca

SEQ ID NO: 2834913 - RNA, 12 nt, Mycobacterium avium subsp. paratuberculosis
cgggcacccggc

SEQ ID NO: 2834914 - RNA, 18 nt, Mycobacterium avium subsp. paratuberculosis
cgggcacccggcgcggcc

SEQ ID NO: 2834915 - RNA, 19 nt, Mycobacterium avium subsp. paratuberculosis
cgggcacccggcgcggccg

SEQ ID NO: 2834916 - RNA, 14 nt, Mycobacterium avium subsp. paratuberculosis
cgggcacccgggcg

SEQ ID NO: 2834917 - RNA, 15 nt, Mycobacterium avium subsp. paratuberculosis
cgggcacccgggcga

SEQ ID NO: 2834918 - RNA, 13 nt, Mycobacterium avium subsp. paratuberculosis
cgggcaccgucgu

SEQ ID NO: 2834919 - RNA, 23 nt, Mycobacterium avium subsp. paratuberculosis
cgggcaccgucgucgcaccggca

SEQ ID NO: 2834920 - RNA, 19 nt, Mycobacterium avium subsp. paratuberculosis
cgggcaccucgaugccgug

SEQ ID NO: 2834921 - RNA, 18 nt, Mycobacterium avium subsp. paratuberculosis
cgggcaccucggccaggu

SEQ ID NO: 2834922 - RNA, 18 nt, Mycobacterium avium subsp. paratuberculosis
cgggcaccucggcgucgg

SEQ ID NO: 2834923 - RNA, 22 nt, Mycobacterium avium subsp. paratuberculosis
cgggcaccugauaggggucggc

SEQ ID NO: 2834924 - RNA, 23 nt, Mycobacterium avium subsp. paratuberculosis
cgggcaccugauaggggucggcg

SEQ ID NO: 2834925 - RNA, 23 nt, Mycobacterium avium subsp. paratuberculosis
cgggcacgaauucgguggcgaug

SEQ ID NO: 2834926 - RNA, 22 nt, Mycobacterium avium subsp. paratuberculosis
cgggcacgacggucagcacgcu

SEQ ID NO: 2834927 - RNA, 15 nt, Mycobacterium avium subsp. paratuberculosis
cgggcauccgggccg

SEQ ID NO: 2834928 - RNA, 18 nt, Mycobacterium avium subsp. paratuberculosis
cgggcauccgggccgccg

SEQ ID NO: 2834929 - RNA, 19 nt, Mycobacterium avium subsp. paratuberculosis
cgggcauccgggccgccgc

SEQ ID NO: 2834930 - RNA, 20 nt, Mycobacterium avium subsp. paratuberculosis
cgggcauccgggccgccgcg

SEQ ID NO: 2834931 - RNA, 14 nt, Mycobacterium avium subsp. paratuberculosis
cgggcaucgccguc

SEQ ID NO: 2834932 - RNA, 16 nt, Mycobacterium avium subsp. paratuberculosis
cgggcaucgccgucau

SEQ ID NO: 2834933 - RNA, 22 nt, Mycobacterium avium subsp. paratuberculosis
cgggcaucgccgucaugguguc

SEQ ID NO: 2834934 - RNA, 22 nt, Mycobacterium avium subsp. paratuberculosis
cgggcaucgcugguggccgacg

SEQ ID NO: 2834935 - RNA, 22 nt, Mycobacterium avium subsp. paratuberculosis
cgggcaucucguugucgucggg

SEQ ID NO: 2834936 - RNA, 24 nt, Mycobacterium avium subsp. paratuberculosis
cgggcaucucguugucgucggggc

SEQ ID NO: 2834937 - RNA, 18 nt, Mycobacterium avium subsp. paratuberculosis
cgggcaugaaccaggccg

SEQ ID NO: 2834938 - RNA, 13 nt, Mycobacterium avium subsp. paratuberculosis
cgggcaugcccgu

SEQ ID NO: 2834939 - RNA, 20 nt, Mycobacterium avium subsp. paratuberculosis
cgggcaugcccguagaugcc

SEQ ID NO: 2834940 - RNA, 17 nt, Mycobacterium avium subsp. paratuberculosis
cgggcaugccggccggc

SEQ ID NO: 2834941 - RNA, 15 nt, Mycobacterium avium subsp. paratuberculosis
cgggcaugccgucgg

SEQ ID NO: 2834942 - RNA, 17 nt, Mycobacterium avium subsp. paratuberculosis
cgggcaugccgucggcg

SEQ ID NO: 2834943 - RNA, 18 nt, Mycobacterium avium subsp. paratuberculosis
cgggcaugccguucagcg

SEQ ID NO: 2834944 - RNA, 21 nt, Mycobacterium avium subsp. paratuberculosis
cgggcaugccguucagcgcgg

SEQ ID NO: 2834945 - RNA, 22 nt, Mycobacterium avium subsp. paratuberculosis
cgggcaugccguucagcgcggc

SEQ ID NO: 2834946 - RNA, 13 nt, Mycobacterium avium subsp. paratuberculosis
cgggcauggucac

SEQ ID NO: 2834947 - RNA, 17 nt, Mycobacterium avium subsp. paratuberculosis
cgggcaugguuccucgu

SEQ ID NO: 2834948 - RNA, 18 nt, Mycobacterium avium subsp. paratuberculosis
cgggcauuggcagcucgg

SEQ ID NO: 2834949 - RNA, 20 nt, Mycobacterium avium subsp. paratuberculosis
cgggcauuggcagcucgggc

SEQ ID NO: 2834950 - RNA, 23 nt, Mycobacterium avium subsp. paratuberculosis
cgggcauuggcagcucgggcagc

SEQ ID NO: 2834951 - RNA, 22 nt, Mycobacterium avium subsp. paratuberculosis
cgggccaaaucgcuugcgccgc

SEQ ID NO: 2834952 - RNA, 23 nt, Mycobacterium avium subsp. paratuberculosis
cgggccaaaucgcuugcgccgca

SEQ ID NO: 2834953 - RNA, 22 nt, Mycobacterium avium subsp. paratuberculosis
cgggccaacgguucggccgcuc

SEQ ID NO: 2834954 - RNA, 17 nt, Mycobacterium avium subsp. paratuberculosis
cgggccaagcaccggga

SEQ ID NO: 2834955 - RNA, 19 nt, Mycobacterium avium subsp. paratuberculosis
cgggccaagcaccgggaug

SEQ ID NO: 2834956 - RNA, 21 nt, Mycobacterium avium subsp. paratuberculosis
cgggccaauuacgcugcggcg

SEQ ID NO: 2834957 - RNA, 13 nt, Mycobacterium avium subsp. paratuberculosis
cgggccacacacu

SEQ ID NO: 2834958 - RNA, 15 nt, Mycobacterium avium subsp. paratuberculosis
cgggccacacccguc

SEQ ID NO: 2834959 - RNA, 19 nt, Mycobacterium avium subsp. paratuberculosis
cgggccacacccgucgacu

SEQ ID NO: 2834960 - RNA, 14 nt, Mycobacterium avium subsp. paratuberculosis
cgggccacagcggc

SEQ ID NO: 2834961 - RNA, 17 nt, Mycobacterium avium subsp. paratuberculosis
cgggccacagcggcgac

SEQ ID NO: 2834962 - RNA, 18 nt, Mycobacterium avium subsp. paratuberculosis
cgggccacagcggcgaca

SEQ ID NO: 2834963 - RNA, 22 nt, Mycobacterium avium subsp. paratuberculosis
cgggccaccacaguggccgcca

SEQ ID NO: 2834964 - RNA, 16 nt, Mycobacterium avium subsp. paratuberculosis
cgggccaccaccacgg

SEQ ID NO: 2834965 - RNA, 22 nt, Mycobacterium avium subsp. paratuberculosis
cgggccaccaccacggccgccg

SEQ ID NO: 2834966 - RNA, 15 nt, Mycobacterium avium subsp. paratuberculosis
cgggccaccagcgca

SEQ ID NO: 2834967 - RNA, 20 nt, Mycobacterium avium subsp. paratuberculosis
cgggccaccagcgcaggucc

SEQ ID NO: 2834968 - RNA, 15 nt, Mycobacterium avium subsp. paratuberculosis
cgggccaccggcgcc

SEQ ID NO: 2834969 - RNA, 21 nt, Mycobacterium avium subsp. paratuberculosis
cgggccaccgucccggugucg

SEQ ID NO: 2834970 - RNA, 16 nt, Mycobacterium avium subsp. paratuberculosis
cgggccaccgucuucg

SEQ ID NO: 2834971 - RNA, 15 nt, Mycobacterium avium subsp. paratuberculosis
cgggccacgcagucg

SEQ ID NO: 2834972 - RNA, 16 nt, Mycobacterium avium subsp. paratuberculosis
cgggccacgcagucgu

SEQ ID NO: 2834973 - RNA, 15 nt, Mycobacterium avium subsp. paratuberculosis
cgggccacgccgacu

SEQ ID NO: 2834974 - RNA, 13 nt, Mycobacterium avium subsp. paratuberculosis
cgggccagacugc

SEQ ID NO: 2834975 - RNA, 18 nt, Mycobacterium avium subsp. paratuberculosis
cgggccagacugcgcacc

SEQ ID NO: 2834976 - RNA, 20 nt, Mycobacterium avium subsp. paratuberculosis
cgggccagacugcgcaccgc

SEQ ID NO: 2834977 - RNA, 21 nt, Mycobacterium avium subsp. paratuberculosis
cgggccagacugcgcaccgcc

SEQ ID NO: 2834978 - RNA, 22 nt, Mycobacterium avium subsp. paratuberculosis
cgggccagacugcgcaccgcca

SEQ ID NO: 2834979 - RNA, 17 nt, Mycobacterium avium subsp. paratuberculosis
cgggccagcaacagcag

SEQ ID NO: 2834980 - RNA, 21 nt, Mycobacterium avium subsp. paratuberculosis
cgggccagcaacagcagcggc

SEQ ID NO: 2834981 - RNA, 14 nt, Mycobacterium avium subsp. paratuberculosis
cgggccagcacgac

SEQ ID NO: 2834982 - RNA, 22 nt, Mycobacterium avium subsp. paratuberculosis
cgggccagcagcagcaggucgu

SEQ ID NO: 2834983 - RNA, 13 nt, Mycobacterium avium subsp. paratuberculosis
cgggccagcagcc

SEQ ID NO: 2834984 - RNA, 14 nt, Mycobacterium avium subsp. paratuberculosis
cgggccagcagccg

SEQ ID NO: 2834985 - RNA, 19 nt, Mycobacterium avium subsp. paratuberculosis
cgggccagcagccgcgcga

SEQ ID NO: 2834986 - RNA, 15 nt, Mycobacterium avium subsp. paratuberculosis
cgggccagcagccgg

SEQ ID NO: 2834987 - RNA, 16 nt, Mycobacterium avium subsp. paratuberculosis
cgggccagcagccggg

SEQ ID NO: 2834988 - RNA, 17 nt, Mycobacterium avium subsp. paratuberculosis
cgggccagcagccgggu

SEQ ID NO: 2834989 - RNA, 18 nt, Mycobacterium avium subsp. paratuberculosis
cgggccagcagccggguc

SEQ ID NO: 2834990 - RNA, 13 nt, Mycobacterium avium subsp. paratuberculosis
cgggccagcagcu

SEQ ID NO: 2834991 - RNA, 12 nt, Mycobacterium avium subsp. paratuberculosis
cgggccagcagu

SEQ ID NO: 2834992 - RNA, 16 nt, Mycobacterium avium subsp. paratuberculosis
cgggccagcaguucgu

SEQ ID NO: 2834993 - RNA, 19 nt, Mycobacterium avium subsp. paratuberculosis
cgggccagcaguucgucca

SEQ ID NO: 2834994 - RNA, 14 nt, Mycobacterium avium subsp. paratuberculosis
cgggccagccaggu

SEQ ID NO: 2834995 - RNA, 15 nt, Mycobacterium avium subsp. paratuberculosis
cgggccagccggccc

SEQ ID NO: 2834996 - RNA, 12 nt, Mycobacterium avium subsp. paratuberculosis
cgggccagccgu

SEQ ID NO: 2834997 - RNA, 12 nt, Mycobacterium avium subsp. paratuberculosis
cgggccagcgca

SEQ ID NO: 2834998 - RNA, 14 nt, Mycobacterium avium subsp. paratuberculosis
cgggccagcgccga

SEQ ID NO: 2834999 - RNA, 15 nt, Mycobacterium avium subsp. paratuberculosis
cgggccagcgccgag

SEQ ID NO: 2835000 - RNA, 13 nt, Mycobacterium avium subsp. paratuberculosis
cgggccagcgccu

SEQ ID NO: 2835001 - RNA, 16 nt, Mycobacterium avium subsp. paratuberculosis
cgggccagcgccuucg

SEQ ID NO: 2835002 - RNA, 19 nt, Mycobacterium avium subsp. paratuberculosis
cgggccagcgccuucggcg

SEQ ID NO: 2835003 - RNA, 20 nt, Mycobacterium avium subsp. paratuberculosis
cgggccagcgccuucggcgc

SEQ ID NO: 2835004 - RNA, 21 nt, Mycobacterium avium subsp. paratuberculosis
cgggccagcguuuccagcgcc

SEQ ID NO: 2835005 - RNA, 13 nt, Mycobacterium avium subsp. paratuberculosis
cgggccagcucga

SEQ ID NO: 2835006 - RNA, 20 nt, Mycobacterium avium subsp. paratuberculosis
cgggccagcucgucgagccg

SEQ ID NO: 2835007 - RNA, 21 nt, Mycobacterium avium subsp. paratuberculosis
cgggccagcucgucgagccgg

SEQ ID NO: 2835008 - RNA, 16 nt, Mycobacterium avium subsp. paratuberculosis
cgggccagcuuguucg

SEQ ID NO: 2835009 - RNA, 21 nt, Mycobacterium avium subsp. paratuberculosis
cgggccagcuuguucgagagu

SEQ ID NO: 2835010 - RNA, 13 nt, Mycobacterium avium subsp. paratuberculosis
cgggccaggaccg

SEQ ID NO: 2835011 - RNA, 19 nt, Mycobacterium avium subsp. paratuberculosis
cgggccaggaugaccgccc

SEQ ID NO: 2835012 - RNA, 13 nt, Mycobacterium avium subsp. paratuberculosis
cgggccgacccgg

SEQ ID NO: 2835013 - RNA, 14 nt, Mycobacterium avium subsp. paratuberculosis
cgggccgacccggc

SEQ ID NO: 2835014 - RNA, 16 nt, Mycobacterium avium subsp. paratuberculosis
cgggccgacccggccg

SEQ ID NO: 2835015 - RNA, 13 nt, Mycobacterium avium subsp. paratuberculosis
cgggccgaccguc

SEQ ID NO: 2835016 - RNA, 19 nt, Mycobacterium avium subsp. paratuberculosis
cgggccgaccuggcggccg

SEQ ID NO: 2835017 - RNA, 20 nt, Mycobacterium avium subsp. paratuberculosis
cgggccgaccuggcggccgg

SEQ ID NO: 2835018 - RNA, 24 nt, Mycobacterium avium subsp. paratuberculosis
cgggccgaccuggcggccggauuc

SEQ ID NO: 2835019 - RNA, 17 nt, Mycobacterium avium subsp. paratuberculosis
cgggccgagcgcgccgc

SEQ ID NO: 2835020 - RNA, 18 nt, Mycobacterium avium subsp. paratuberculosis
cgggccgagcgcgccgcc

SEQ ID NO: 2835021 - RNA, 20 nt, Mycobacterium avium subsp. paratuberculosis
cgggccgagcgcgccgccgc

SEQ ID NO: 2835022 - RNA, 14 nt, Mycobacterium avium subsp. paratuberculosis
cgggccgaucacgc

SEQ ID NO: 2835023 - RNA, 20 nt, Mycobacterium avium subsp. paratuberculosis
cgggccgaucagugccgcgc

SEQ ID NO: 2835024 - RNA, 22 nt, Mycobacterium avium subsp. paratuberculosis
cgggccgcaauacggugcccgc

SEQ ID NO: 2835025 - RNA, 20 nt, Mycobacterium avium subsp. paratuberculosis
cgggccgcacugcaucucga

SEQ ID NO: 2835026 - RNA, 17 nt, Mycobacterium avium subsp. paratuberculosis
cgggccgcagcacggca

SEQ ID NO: 2835027 - RNA, 13 nt, Mycobacterium avium subsp. paratuberculosis
cgggccgcagccg

SEQ ID NO: 2835028 - RNA, 19 nt, Mycobacterium avium subsp. paratuberculosis
cgggccgcagccgcgcggc

SEQ ID NO: 2835029 - RNA, 21 nt, Mycobacterium avium subsp. paratuberculosis
cgggccgcagccgcgcggccg

SEQ ID NO: 2835030 - RNA, 17 nt, Mycobacterium avium subsp. paratuberculosis
cgggccgcagcgcgcgg

SEQ ID NO: 2835031 - RNA, 21 nt, Mycobacterium avium subsp. paratuberculosis
cgggccgcagcgcgcggguga

SEQ ID NO: 2835032 - RNA, 20 nt, Mycobacterium avium subsp. paratuberculosis
cgggccgcagcucgcccagc

SEQ ID NO: 2835033 - RNA, 23 nt, Mycobacterium avium subsp. paratuberculosis
cgggccgcagcucgcccagcacc

SEQ ID NO: 2835034 - RNA, 18 nt, Mycobacterium avium subsp. paratuberculosis
cgggccgcaggguggcca

SEQ ID NO: 2835035 - RNA, 19 nt, Mycobacterium avium subsp. paratuberculosis
cgggccgcaggguggccag

SEQ ID NO: 2835036 - RNA, 23 nt, Mycobacterium avium subsp. paratuberculosis
cgggccgcaggguggccagcacc

SEQ ID NO: 2835037 - RNA, 15 nt, Mycobacterium avium subsp. paratuberculosis
cgggccgcauccagc

SEQ ID NO: 2835038 - RNA, 17 nt, Mycobacterium avium subsp. paratuberculosis
cgggccgcauccagcgc

SEQ ID NO: 2835039 - RNA, 20 nt, Mycobacterium avium subsp. paratuberculosis
cgggccgcauccagcgccgc

SEQ ID NO: 2835040 - RNA, 13 nt, Mycobacterium avium subsp. paratuberculosis
cgggccgcauccg

SEQ ID NO: 2835041 - RNA, 18 nt, Mycobacterium avium subsp. paratuberculosis
cgggccgcauccgcgagc

SEQ ID NO: 2835042 - RNA, 17 nt, Mycobacterium avium subsp. paratuberculosis
cgggccgccagguuggc

SEQ ID NO: 2835043 - RNA, 12 nt, Mycobacterium avium subsp. paratuberculosis
cgggccgccauc

SEQ ID NO: 2835044 - RNA, 15 nt, Mycobacterium avium subsp. paratuberculosis
cgggccgccaucacc

SEQ ID NO: 2835045 - RNA, 18 nt, Mycobacterium avium subsp. paratuberculosis
cgggccgccaucaccgcg

SEQ ID NO: 2835046 - RNA, 13 nt, Mycobacterium avium subsp. paratuberculosis
cgggccgcccgcg

SEQ ID NO: 2835047 - RNA, 13 nt, Mycobacterium avium subsp. paratuberculosis
cgggccgcccggc

SEQ ID NO: 2835048 - RNA, 15 nt, Mycobacterium avium subsp. paratuberculosis
cgggccgcccggcgc

SEQ ID NO: 2835049 - RNA, 16 nt, Mycobacterium avium subsp. paratuberculosis
cgggccgccgacgucg

SEQ ID NO: 2835050 - RNA, 22 nt, Mycobacterium avium subsp. paratuberculosis
cgggccgccgacgucgugggcg

SEQ ID NO: 2835051 - RNA, 14 nt, Mycobacterium avium subsp. paratuberculosis
cgggccgccgaugc

SEQ ID NO: 2835052 - RNA, 20 nt, Mycobacterium avium subsp. paratuberculosis
cgggccgccgaugcgcccgc

SEQ ID NO: 2835053 - RNA, 13 nt, Mycobacterium avium subsp. paratuberculosis
cgggccgccgcgg

SEQ ID NO: 2835054 - RNA, 15 nt, Mycobacterium avium subsp. paratuberculosis
cgggccgccgcggac

SEQ ID NO: 2835055 - RNA, 14 nt, Mycobacterium avium subsp. paratuberculosis
cgggccgccgcggc

SEQ ID NO: 2835056 - RNA, 15 nt, Mycobacterium avium subsp. paratuberculosis
cgggccgccgcggcc

SEQ ID NO: 2835057 - RNA, 13 nt, Mycobacterium avium subsp. paratuberculosis
cgggccgccggcc

SEQ ID NO: 2835058 - RNA, 22 nt, Mycobacterium avium subsp. paratuberculosis
cgggccgccggccgcggcgugc

SEQ ID NO: 2835059 - RNA, 17 nt, Mycobacterium avium subsp. paratuberculosis
cgggccgccucacgcag

SEQ ID NO: 2835060 - RNA, 23 nt, Mycobacterium avium subsp. paratuberculosis
cgggccgccucgaagucgccggc

SEQ ID NO: 2835061 - RNA, 13 nt, Mycobacterium avium subsp. paratuberculosis
cgggccgcgccca

SEQ ID NO: 2835062 - RNA, 16 nt, Mycobacterium avium subsp. paratuberculosis
cgggccgcgccgaggc

SEQ ID NO: 2835063 - RNA, 14 nt, Mycobacterium avium subsp. paratuberculosis
cgggccgcggcggu

SEQ ID NO: 2835064 - RNA, 15 nt, Mycobacterium avium subsp. paratuberculosis
cgggccgcggcggua

SEQ ID NO: 2835065 - RNA, 21 nt, Mycobacterium avium subsp. paratuberculosis
cgggccgcggcgguagcgggc

SEQ ID NO: 2835066 - RNA, 14 nt, Mycobacterium avium subsp. paratuberculosis
cgggccgcgggccc

SEQ ID NO: 2835067 - RNA, 15 nt, Mycobacterium avium subsp. paratuberculosis
cgggccgcgucggcc

SEQ ID NO: 2835068 - RNA, 13 nt, Mycobacterium avium subsp. paratuberculosis
cgggccgcuggug

SEQ ID NO: 2835069 - RNA, 17 nt, Mycobacterium avium subsp. paratuberculosis
cgggccgcuggugaggu

SEQ ID NO: 2835070 - RNA, 18 nt, Mycobacterium avium subsp. paratuberculosis
cgggccggaacgcccgau

SEQ ID NO: 2835071 - RNA, 16 nt, Mycobacterium avium subsp. paratuberculosis
cgggccggacacggcu

SEQ ID NO: 2835072 - RNA, 18 nt, Mycobacterium avium subsp. paratuberculosis
cgggccggacacggcugc

SEQ ID NO: 2835073 - RNA, 20 nt, Mycobacterium avium subsp. paratuberculosis
cgggccggacacggcugcac

SEQ ID NO: 2835074 - RNA, 21 nt, Mycobacterium avium subsp. paratuberculosis
cgggccggacacggcugcacc

SEQ ID NO: 2835075 - RNA, 24 nt, Mycobacterium avium subsp. paratuberculosis
cgggccggacacggcugcacccuc

SEQ ID NO: 2835076 - RNA, 17 nt, Mycobacterium avium subsp. paratuberculosis
cgggccggacagcggcc

SEQ ID NO: 2835077 - RNA, 16 nt, Mycobacterium avium subsp. paratuberculosis
cgggccggaucagcag

SEQ ID NO: 2835078 - RNA, 17 nt, Mycobacterium avium subsp. paratuberculosis
cgggccggaucagcagu

SEQ ID NO: 2835079 - RNA, 18 nt, Mycobacterium avium subsp. paratuberculosis
cgggccggaucgcgcagu

SEQ ID NO: 2835080 - RNA, 14 nt, Mycobacterium avium subsp. paratuberculosis
cgggccggcacccg

SEQ ID NO: 2835081 - RNA, 12 nt, Mycobacterium avium subsp. paratuberculosis
cgggccggcagc

SEQ ID NO: 2835082 - RNA, 16 nt, Mycobacterium avium subsp. paratuberculosis
cgggccggcagccggc

SEQ ID NO: 2835083 - RNA, 18 nt, Mycobacterium avium subsp. paratuberculosis
cgggccggcagccggcca

SEQ ID NO: 2835084 - RNA, 12 nt, Mycobacterium avium subsp. paratuberculosis
cgggccggccag

SEQ ID NO: 2835085 - RNA, 13 nt, Mycobacterium avium subsp. paratuberculosis
cgggccggccaga

SEQ ID NO: 2835086 - RNA, 12 nt, Mycobacterium avium subsp. paratuberculosis
cgggccggccga

SEQ ID NO: 2835087 - RNA, 15 nt, Mycobacterium avium subsp. paratuberculosis
cgggccggccgauga

SEQ ID NO: 2835088 - RNA, 14 nt, Mycobacterium avium subsp. paratuberculosis
cgggccggcgccga

SEQ ID NO: 2835089 - RNA, 15 nt, Mycobacterium avium subsp. paratuberculosis
cgggccggcgccgac

SEQ ID NO: 2835090 - RNA, 16 nt, Mycobacterium avium subsp. paratuberculosis
cgggccggcgccgacg

SEQ ID NO: 2835091 - RNA, 21 nt, Mycobacterium avium subsp. paratuberculosis
cgggccggcgccggugccgca

SEQ ID NO: 2835092 - RNA, 13 nt, Mycobacterium avium subsp. paratuberculosis
cgggccggcggcc

SEQ ID NO: 2835093 - RNA, 14 nt, Mycobacterium avium subsp. paratuberculosis
cgggccggcggcca

SEQ ID NO: 2835094 - RNA, 12 nt, Mycobacterium avium subsp. paratuberculosis
cgggccggcggg

SEQ ID NO: 2835095 - RNA, 18 nt, Mycobacterium avium subsp. paratuberculosis
cgggccggcggggugggc

SEQ ID NO: 2835096 - RNA, 13 nt, Mycobacterium avium subsp. paratuberculosis
cgggccggcgucg

SEQ ID NO: 2835097 - RNA, 23 nt, Mycobacterium avium subsp. paratuberculosis
cgggcgaccugcgggcccaccgc

SEQ ID NO: 2835098 - RNA, 15 nt, Mycobacterium avium subsp. paratuberculosis
cgggcgaccuggugc

SEQ ID NO: 2835099 - RNA, 15 nt, Mycobacterium avium subsp. paratuberculosis
cgggcgacgacgcgg

SEQ ID NO: 2835100 - RNA, 17 nt, Mycobacterium avium subsp. paratuberculosis
cgggcgacgacgcgguc

SEQ ID NO: 2835101 - RNA, 15 nt, Mycobacterium avium subsp. paratuberculosis
cgggcgacgucaacu

SEQ ID NO: 2835102 - RNA, 18 nt, Mycobacterium avium subsp. paratuberculosis
cgggcgacgucaacuucc

SEQ ID NO: 2835103 - RNA, 22 nt, Mycobacterium avium subsp. paratuberculosis
cgggcgacgucggggucgucgc

SEQ ID NO: 2835104 - RNA, 16 nt, Mycobacterium avium subsp. paratuberculosis
cgggcgacugcgugcu

SEQ ID NO: 2835105 - RNA, 20 nt, Mycobacterium avium subsp. paratuberculosis
cgggcgacuucuucgccggc

SEQ ID NO: 2835106 - RNA, 21 nt, Mycobacterium avium subsp. paratuberculosis
cgggcgacuucuucgccggcg

SEQ ID NO: 2835107 - RNA, 22 nt, Mycobacterium avium subsp. paratuberculosis
cgggcgacuucuucgccggcgc

SEQ ID NO: 2835108 - RNA, 14 nt, Mycobacterium avium subsp. paratuberculosis
cgggcgagcagcgc

SEQ ID NO: 2835109 - RNA, 15 nt, Mycobacterium avium subsp. paratuberculosis
cgggcgagcagcgcc

SEQ ID NO: 2835110 - RNA, 22 nt, Mycobacterium avium subsp. paratuberculosis
cgggcgagcagcgcccgggugc

SEQ ID NO: 2835111 - RNA, 14 nt, Mycobacterium avium subsp. paratuberculosis
cgggcgagccgaca

SEQ ID NO: 2835112 - RNA, 19 nt, Mycobacterium avium subsp. paratuberculosis
cgggcgagccgacagucgc

SEQ ID NO: 2835113 - RNA, 21 nt, Mycobacterium avium subsp. paratuberculosis
cgggcgagccgacagucgcgg

SEQ ID NO: 2835114 - RNA, 22 nt, Mycobacterium avium subsp. paratuberculosis
cgggcgagccgacagucgcggg

SEQ ID NO: 2835115 - RNA, 20 nt, Mycobacterium avium subsp. paratuberculosis
cgggcgagcgucgccgcgug

SEQ ID NO: 2835116 - RNA, 16 nt, Mycobacterium avium subsp. paratuberculosis
cgggcgaucagcccgc

SEQ ID NO: 2835117 - RNA, 14 nt, Mycobacterium avium subsp. paratuberculosis
cgggcgauccgcag

SEQ ID NO: 2835118 - RNA, 11 nt, Mycobacterium avium subsp. paratuberculosis
cgggcgaucgc

SEQ ID NO: 2835119 - RNA, 16 nt, Mycobacterium avium subsp. paratuberculosis
cgggcgaucuccagcg

SEQ ID NO: 2835120 - RNA, 20 nt, Mycobacterium avium subsp. paratuberculosis
cgggcgaucuccagcggccg

SEQ ID NO: 2835121 - RNA, 21 nt, Mycobacterium avium subsp. paratuberculosis
cgggcgaucuccagcggccgg

SEQ ID NO: 2835122 - RNA, 13 nt, Mycobacterium avium subsp. paratuberculosis
cgggcgaucucga

SEQ ID NO: 2835123 - RNA, 16 nt, Mycobacterium avium subsp. paratuberculosis
cgggcgaucucgaugg

SEQ ID NO: 2835124 - RNA, 21 nt, Mycobacterium avium subsp. paratuberculosis
cgggcgaucucgauggccacg

SEQ ID NO: 2835125 - RNA, 15 nt, Mycobacterium avium subsp. paratuberculosis
cgggcgaugcggccc

SEQ ID NO: 2835126 - RNA, 16 nt, Mycobacterium avium subsp. paratuberculosis
cgggcgaugcggcccg

SEQ ID NO: 2835127 - RNA, 19 nt, Mycobacterium avium subsp. paratuberculosis
cgggcgauggcgggccgcu

SEQ ID NO: 2835128 - RNA, 17 nt, Mycobacterium avium subsp. paratuberculosis
cgggcgauggugccgcc

SEQ ID NO: 2835129 - RNA, 19 nt, Mycobacterium avium subsp. paratuberculosis
cgggcgauggugccgccgg

SEQ ID NO: 2835130 - RNA, 22 nt, Mycobacterium avium subsp. paratuberculosis
cgggcgauggugccgccgguga

SEQ ID NO: 2835131 - RNA, 19 nt, Mycobacterium avium subsp. paratuberculosis
cgggcgauucccggaugcu

SEQ ID NO: 2835132 - RNA, 21 nt, Mycobacterium avium subsp. paratuberculosis
cgggcgauucccggaugcugc

SEQ ID NO: 2835133 - RNA, 17 nt, Mycobacterium avium subsp. paratuberculosis
cgggcgauucgucgucg

SEQ ID NO: 2835134 - RNA, 18 nt, Mycobacterium avium subsp. paratuberculosis
cgggcgauucgucgucgu

SEQ ID NO: 2835135 - RNA, 17 nt, Mycobacterium avium subsp. paratuberculosis
cgggcgauuucgucggc

SEQ ID NO: 2835136 - RNA, 19 nt, Mycobacterium avium subsp. paratuberculosis
cgggcgauuucgucggcgg

SEQ ID NO: 2835137 - RNA, 13 nt, Mycobacterium avium subsp. paratuberculosis
cgggcgcaccgcg

SEQ ID NO: 2835138 - RNA, 16 nt, Mycobacterium avium subsp. paratuberculosis
cgggcgcaccgcgcgc

SEQ ID NO: 2835139 - RNA, 21 nt, Mycobacterium avium subsp. paratuberculosis
cgggcgcaccgcgcgccaggu

SEQ ID NO: 2835140 - RNA, 20 nt, Mycobacterium avium subsp. paratuberculosis
cgggcgcagcgccgucucga

SEQ ID NO: 2835141 - RNA, 14 nt, Mycobacterium avium subsp. paratuberculosis
cgggcgcagcucgu

SEQ ID NO: 2835142 - RNA, 20 nt, Mycobacterium avium subsp. paratuberculosis
cgggcgcaggugggcggugc

SEQ ID NO: 2835143 - RNA, 14 nt, Mycobacterium avium subsp. paratuberculosis
cgggcgccacgcug

SEQ ID NO: 2835144 - RNA, 20 nt, Mycobacterium avium subsp. paratuberculosis
cgggcgccacgcuggcguga

SEQ ID NO: 2835145 - RNA, 13 nt, Mycobacterium avium subsp. paratuberculosis
cgggcgccagccc

SEQ ID NO: 2835146 - RNA, 19 nt, Mycobacterium avium subsp. paratuberculosis
cgggcgccagcccgcccag

SEQ ID NO: 2835147 - RNA, 23 nt, Mycobacterium avium subsp. paratuberculosis
cgggcgccagcccgcccagcgcc

SEQ ID NO: 2835148 - RNA, 19 nt, Mycobacterium avium subsp. paratuberculosis
cgggcgccauccgcagccc

SEQ ID NO: 2835149 - RNA, 15 nt, Mycobacterium avium subsp. paratuberculosis
cgggcgccauccgcc

SEQ ID NO: 2835150 - RNA, 18 nt, Mycobacterium avium subsp. paratuberculosis
cgggcgccauccgccacc

SEQ ID NO: 2835151 - RNA, 17 nt, Mycobacterium avium subsp. paratuberculosis
cgggcgcccagaagccc

SEQ ID NO: 2835152 - RNA, 21 nt, Mycobacterium avium subsp. paratuberculosis
cgggcgcccagaagccccggu

SEQ ID NO: 2835153 - RNA, 12 nt, Mycobacterium avium subsp. paratuberculosis
cgggcgcccagc

SEQ ID NO: 2835154 - RNA, 13 nt, Mycobacterium avium subsp. paratuberculosis
cgggcgcccagca

SEQ ID NO: 2835155 - RNA, 15 nt, Mycobacterium avium subsp. paratuberculosis
cgggcgcccgagccg

SEQ ID NO: 2835156 - RNA, 16 nt, Mycobacterium avium subsp. paratuberculosis
cgggcgcccgagccgc

SEQ ID NO: 2835157 - RNA, 13 nt, Mycobacterium avium subsp. paratuberculosis
cgggcgcccgcgg

SEQ ID NO: 2835158 - RNA, 21 nt, Mycobacterium avium subsp. paratuberculosis
cgggcgccgaacgucgagcgc

SEQ ID NO: 2835159 - RNA, 17 nt, Mycobacterium avium subsp. paratuberculosis
cgggcgccgaagauggc

SEQ ID NO: 2835160 - RNA, 18 nt, Mycobacterium avium subsp. paratuberculosis
cgggcgccgagaacaggc

SEQ ID NO: 2835161 - RNA, 20 nt, Mycobacterium avium subsp. paratuberculosis
cgggcgccgagaacaggccg

SEQ ID NO: 2835162 - RNA, 14 nt, Mycobacterium avium subsp. paratuberculosis
cgggcgccggccgg

SEQ ID NO: 2835163 - RNA, 16 nt, Mycobacterium avium subsp. paratuberculosis
cgggcgccggccggcg

SEQ ID NO: 2835164 - RNA, 17 nt, Mycobacterium avium subsp. paratuberculosis
cgggcgccggccggcgc

SEQ ID NO: 2835165 - RNA, 12 nt, Mycobacterium avium subsp. paratuberculosis
cgggcgccggcg

SEQ ID NO: 2835166 - RNA, 14 nt, Mycobacterium avium subsp. paratuberculosis
cgggcgccggcgcg

SEQ ID NO: 2835167 - RNA, 14 nt, Mycobacterium avium subsp. paratuberculosis
cgggcgccggcugc

SEQ ID NO: 2835168 - RNA, 20 nt, Mycobacterium avium subsp. paratuberculosis
cgggcgccggcugcccgcga

SEQ ID NO: 2835169 - RNA, 21 nt, Mycobacterium avium subsp. paratuberculosis
cgggcgccggcugcccgcgac

SEQ ID NO: 2835170 - RNA, 13 nt, Mycobacterium avium subsp. paratuberculosis
cgggcgccggucg

SEQ ID NO: 2835171 - RNA, 15 nt, Mycobacterium avium subsp. paratuberculosis
cgggcgccggucggc

SEQ ID NO: 2835172 - RNA, 13 nt, Mycobacterium avium subsp. paratuberculosis
cgggcgccgguuc

SEQ ID NO: 2835173 - RNA, 20 nt, Mycobacterium avium subsp. paratuberculosis
cgggcgccgguuccuccgac

SEQ ID NO: 2835174 - RNA, 22 nt, Mycobacterium avium subsp. paratuberculosis
cgggcgccguaggccgcgcuga

SEQ ID NO: 2835175 - RNA, 13 nt, Mycobacterium avium subsp. paratuberculosis
cgggcgccgucgg

SEQ ID NO: 2835176 - RNA, 14 nt, Mycobacterium avium subsp. paratuberculosis
cgggcgccgucggg

SEQ ID NO: 2835177 - RNA, 20 nt, Mycobacterium avium subsp. paratuberculosis
cgggcgccucgaacaucggc

SEQ ID NO: 2835178 - RNA, 21 nt, Mycobacterium avium subsp. paratuberculosis
cgggcgccuucuuggccgcgc

SEQ ID NO: 2835179 - RNA, 16 nt, Mycobacterium avium subsp. paratuberculosis
cgggcgcgaacagcgc

SEQ ID NO: 2835180 - RNA, 18 nt, Mycobacterium avium subsp. paratuberculosis
cgggcgcgaacagcgccg

SEQ ID NO: 2835181 - RNA, 20 nt, Mycobacterium avium subsp. paratuberculosis
cgggcgcgaacagcgccgac

SEQ ID NO: 2835182 - RNA, 14 nt, Mycobacterium avium subsp. paratuberculosis
cgggcggcgccgaa

SEQ ID NO: 2835183 - RNA, 18 nt, Mycobacterium avium subsp. paratuberculosis
cgggcggcgccgaaccgg

SEQ ID NO: 2835184 - RNA, 22 nt, Mycobacterium avium subsp. paratuberculosis
cgggcggcgccgaacucggcgc

SEQ ID NO: 2835185 - RNA, 23 nt, Mycobacterium avium subsp. paratuberculosis
cgggcggcgccgaacucggcgcc

SEQ ID NO: 2835186 - RNA, 12 nt, Mycobacterium avium subsp. paratuberculosis
cgggcggcgcgg

SEQ ID NO: 2835187 - RNA, 14 nt, Mycobacterium avium subsp. paratuberculosis
cgggcggcgcggcg

SEQ ID NO: 2835188 - RNA, 16 nt, Mycobacterium avium subsp. paratuberculosis
cgggcggcgcggcgca

SEQ ID NO: 2835189 - RNA, 17 nt, Mycobacterium avium subsp. paratuberculosis
cgggcggcgcggcgcag

SEQ ID NO: 2835190 - RNA, 22 nt, Mycobacterium avium subsp. paratuberculosis
cgggcggcgcggcgcagcgcga

SEQ ID NO: 2835191 - RNA, 22 nt, Mycobacterium avium subsp. paratuberculosis
cgggcggcggaucagcaccgac

SEQ ID NO: 2835192 - RNA, 13 nt, Mycobacterium avium subsp. paratuberculosis
cgggcggcggccu

SEQ ID NO: 2835193 - RNA, 14 nt, Mycobacterium avium subsp. paratuberculosis
cgggcggcggcguu

SEQ ID NO: 2835194 - RNA, 14 nt, Mycobacterium avium subsp. paratuberculosis
cgggcggcgggggc

SEQ ID NO: 2835195 - RNA, 17 nt, Mycobacterium avium subsp. paratuberculosis
cgggcggcgguggccug

SEQ ID NO: 2835196 - RNA, 23 nt, Mycobacterium avium subsp. paratuberculosis
cgggcggcguccucgaccacccg

SEQ ID NO: 2835197 - RNA, 13 nt, Mycobacterium avium subsp. paratuberculosis
cgggcgggcaccc

SEQ ID NO: 2835198 - RNA, 16 nt, Mycobacterium avium subsp. paratuberculosis
cgggcgggcagauggu

SEQ ID NO: 2835199 - RNA, 14 nt, Mycobacterium avium subsp. paratuberculosis
cgggcgggccgcag

SEQ ID NO: 2835200 - RNA, 15 nt, Mycobacterium avium subsp. paratuberculosis
cgggcgggccgcagc

SEQ ID NO: 2835201 - RNA, 13 nt, Mycobacterium avium subsp. paratuberculosis
cgggcgggccgcc

SEQ ID NO: 2835202 - RNA, 12 nt, Mycobacterium avium subsp. paratuberculosis
cgggcggggccc

SEQ ID NO: 2835203 - RNA, 15 nt, Mycobacterium avium subsp. paratuberculosis
cgggcggggcccggg

SEQ ID NO: 2835204 - RNA, 16 nt, Mycobacterium avium subsp. paratuberculosis
cgggcggggcccgggc

SEQ ID NO: 2835205 - RNA, 18 nt, Mycobacterium avium subsp. paratuberculosis
cgggcggggcccgggccg

SEQ ID NO: 2835206 - RNA, 19 nt, Mycobacterium avium subsp. paratuberculosis
cgggcggggcccgggccgg

SEQ ID NO: 2835207 - RNA, 20 nt, Mycobacterium avium subsp. paratuberculosis
cgggcggggcccgggccgga

SEQ ID NO: 2835208 - RNA, 15 nt, Mycobacterium avium subsp. paratuberculosis
cgggcggggccugcg

SEQ ID NO: 2835209 - RNA, 16 nt, Mycobacterium avium subsp. paratuberculosis
cgggcggggcgccgac

SEQ ID NO: 2835210 - RNA, 17 nt, Mycobacterium avium subsp. paratuberculosis
cgggcggggcgccgaca

SEQ ID NO: 2835211 - RNA, 17 nt, Mycobacterium avium subsp. paratuberculosis
cgggcgggggaucggcg

SEQ ID NO: 2835212 - RNA, 22 nt, Mycobacterium avium subsp. paratuberculosis
cgggcgggggaucggcgggacc

SEQ ID NO: 2835213 - RNA, 16 nt, Mycobacterium avium subsp. paratuberculosis
cgggcgggggcugucc

SEQ ID NO: 2835214 - RNA, 18 nt, Mycobacterium avium subsp. paratuberculosis
cgggcggggggcgagccg

SEQ ID NO: 2835215 - RNA, 19 nt, Mycobacterium avium subsp. paratuberculosis
cgggcggggggcgagccgg

SEQ ID NO: 2835216 - RNA, 21 nt, Mycobacterium avium subsp. paratuberculosis
cgggcggggggcgagccggcc

SEQ ID NO: 2835217 - RNA, 22 nt, Mycobacterium avium subsp. paratuberculosis
cgggcggggggcgagccggccc

SEQ ID NO: 2835218 - RNA, 19 nt, Mycobacterium avium subsp. paratuberculosis
cgggcggggugguggacgu

SEQ ID NO: 2835219 - RNA, 23 nt, Mycobacterium avium subsp. paratuberculosis
cgggcggggugugcggcacggcg

SEQ ID NO: 2835220 - RNA, 17 nt, Mycobacterium avium subsp. paratuberculosis
cgggcgguacgcgccgc

SEQ ID NO: 2835221 - RNA, 22 nt, Mycobacterium avium subsp. paratuberculosis
cgggcggucagcauggcgauga

SEQ ID NO: 2835222 - RNA, 16 nt, Mycobacterium avium subsp. paratuberculosis
cgggcgguccaccgac

SEQ ID NO: 2835223 - RNA, 22 nt, Mycobacterium avium subsp. paratuberculosis
cgggcgguccaguacaccgcga

SEQ ID NO: 2835224 - RNA, 14 nt, Mycobacterium avium subsp. paratuberculosis
cgggcggucgcgca

SEQ ID NO: 2835225 - RNA, 15 nt, Mycobacterium avium subsp. paratuberculosis
cgggcggucgcgcag

SEQ ID NO: 2835226 - RNA, 18 nt, Mycobacterium avium subsp. paratuberculosis
cgggcggucgcgcagccg

SEQ ID NO: 2835227 - RNA, 22 nt, Mycobacterium avium subsp. paratuberculosis
cgggcggucgcgucgucggcgg

SEQ ID NO: 2835228 - RNA, 17 nt, Mycobacterium avium subsp. paratuberculosis
cgggcggucggacgcgg

SEQ ID NO: 2835229 - RNA, 22 nt, Mycobacterium avium subsp. paratuberculosis
cgggcggugauggucaccgugu

SEQ ID NO: 2835230 - RNA, 13 nt, Mycobacterium avium subsp. paratuberculosis
cgggcgguggcgc

SEQ ID NO: 2835231 - RNA, 23 nt, Mycobacterium avium subsp. paratuberculosis
cgggcgguugccugguucgacgu

SEQ ID NO: 2835232 - RNA, 21 nt, Mycobacterium avium subsp. paratuberculosis
cgggcgguuuccacgaugacg

SEQ ID NO: 2835233 - RNA, 16 nt, Mycobacterium avium subsp. paratuberculosis
cgggcguagucgaugg

SEQ ID NO: 2835234 - RNA, 16 nt, Mycobacterium avium subsp. paratuberculosis
cgggcguagugcagcu

SEQ ID NO: 2835235 - RNA, 18 nt, Mycobacterium avium subsp. paratuberculosis
cgggcgucacgccagcgu

SEQ ID NO: 2835236 - RNA, 19 nt, Mycobacterium avium subsp. paratuberculosis
cgggcgucacgccagcgug

SEQ ID NO: 2835237 - RNA, 22 nt, Mycobacterium avium subsp. paratuberculosis
cgggcgucacgccagcgugacg

SEQ ID NO: 2835238 - RNA, 20 nt, Mycobacterium avium subsp. paratuberculosis
cgggcgucacucuggcguga

SEQ ID NO: 2835239 - RNA, 22 nt, Mycobacterium avium subsp. paratuberculosis
cgggcgucacucuggcgugacg

SEQ ID NO: 2835240 - RNA, 13 nt, Mycobacterium avium subsp. paratuberculosis
cgggcguccacga

SEQ ID NO: 2835241 - RNA, 18 nt, Mycobacterium avium subsp. paratuberculosis
cgggcguccucgucggcg

SEQ ID NO: 2835242 - RNA, 15 nt, Mycobacterium avium subsp. paratuberculosis
cgggcguccugcggg

SEQ ID NO: 2835243 - RNA, 19 nt, Mycobacterium avium subsp. paratuberculosis
cgggcguccugcggggagg

SEQ ID NO: 2835244 - RNA, 15 nt, Mycobacterium avium subsp. paratuberculosis
cgggcguccuugacc

SEQ ID NO: 2835245 - RNA, 19 nt, Mycobacterium avium subsp. paratuberculosis
cgggcguccuugaccagcu

SEQ ID NO: 2835246 - RNA, 23 nt, Mycobacterium avium subsp. paratuberculosis
cgggcguccuugaccagcugcga

SEQ ID NO: 2835247 - RNA, 15 nt, Mycobacterium avium subsp. paratuberculosis
cgggcgucgacgaug

SEQ ID NO: 2835248 - RNA, 16 nt, Mycobacterium avium subsp. paratuberculosis
cgggcgucgacgaugg

SEQ ID NO: 2835249 - RNA, 20 nt, Mycobacterium avium subsp. paratuberculosis
cgggcgucgcagaucccgcc

SEQ ID NO: 2835250 - RNA, 22 nt, Mycobacterium avium subsp. paratuberculosis
cgggcgucgcagaucccgccgg

SEQ ID NO: 2835251 - RNA, 23 nt, Mycobacterium avium subsp. paratuberculosis
cgggcgucgcagaucccgccggc

SEQ ID NO: 2835252 - RNA, 13 nt, Mycobacterium avium subsp. paratuberculosis
cgggcgucgcgcu

SEQ ID NO: 2835253 - RNA, 14 nt, Mycobacterium avium subsp. paratuberculosis
cgggcgucgcgcuc

SEQ ID NO: 2835254 - RNA, 15 nt, Mycobacterium avium subsp. paratuberculosis
cgggcgucggcgggc

SEQ ID NO: 2835255 - RNA, 16 nt, Mycobacterium avium subsp. paratuberculosis
cgggcgucggcgggcg

SEQ ID NO: 2835256 - RNA, 15 nt, Mycobacterium avium subsp. paratuberculosis
cgggcgucggcggug

SEQ ID NO: 2835257 - RNA, 15 nt, Mycobacterium avium subsp. paratuberculosis
cgggcgucgggcagc

SEQ ID NO: 2835258 - RNA, 16 nt, Mycobacterium avium subsp. paratuberculosis
cgggcgucgggcagca

SEQ ID NO: 2835259 - RNA, 16 nt, Mycobacterium avium subsp. paratuberculosis
cgggcgugacggaugu

SEQ ID NO: 2835260 - RNA, 15 nt, Mycobacterium avium subsp. paratuberculosis
cgggcgugcccggcg

SEQ ID NO: 2835261 - RNA, 18 nt, Mycobacterium avium subsp. paratuberculosis
cgggcgugccggacaccg

SEQ ID NO: 2835262 - RNA, 14 nt, Mycobacterium avium subsp. paratuberculosis
cgggcgugccggcg

SEQ ID NO: 2835263 - RNA, 20 nt, Mycobacterium avium subsp. paratuberculosis
cgggcgugcgaaugacgcgc

SEQ ID NO: 2835264 - RNA, 15 nt, Mycobacterium avium subsp. paratuberculosis
cgggcgugcgcgugg

SEQ ID NO: 2835265 - RNA, 17 nt, Mycobacterium avium subsp. paratuberculosis
cgggcgugcgguuggcc

SEQ ID NO: 2835266 - RNA, 15 nt, Mycobacterium avium subsp. paratuberculosis
cgggcguggcggucg

SEQ ID NO: 2835267 - RNA, 20 nt, Mycobacterium avium subsp. paratuberculosis
cgggcuggcguaggacagca

SEQ ID NO: 2835268 - RNA, 21 nt, Mycobacterium avium subsp. paratuberculosis
cgggcuggcguaggacagcag

SEQ ID NO: 2835269 - RNA, 12 nt, Mycobacterium avium subsp. paratuberculosis
cgggcugggucc

SEQ ID NO: 2835270 - RNA, 18 nt, Mycobacterium avium subsp. paratuberculosis
cgggcuggguccgauugc

SEQ ID NO: 2835271 - RNA, 16 nt, Mycobacterium avium subsp. paratuberculosis
cgggcugguccggaac

SEQ ID NO: 2835272 - RNA, 18 nt, Mycobacterium avium subsp. paratuberculosis
cgggcuggugcgcagccg

SEQ ID NO: 2835273 - RNA, 19 nt, Mycobacterium avium subsp. paratuberculosis
cgggcuggugcgcagccgu

SEQ ID NO: 2835274 - RNA, 20 nt, Mycobacterium avium subsp. paratuberculosis
cgggcuggugcgcagccguc

SEQ ID NO: 2835275 - RNA, 21 nt, Mycobacterium avium subsp. paratuberculosis
cgggcuggugcgcagccgucg

SEQ ID NO: 2835276 - RNA, 22 nt, Mycobacterium avium subsp. paratuberculosis
cgggcuggugcgcagccgucgc

SEQ ID NO: 2835277 - RNA, 17 nt, Mycobacterium avium subsp. paratuberculosis
cgggcuggugucccgcg

SEQ ID NO: 2835278 - RNA, 20 nt, Mycobacterium avium subsp. paratuberculosis
cgggcuggugucccgcgugg

SEQ ID NO: 2835279 - RNA, 17 nt, Mycobacterium avium subsp. paratuberculosis
cgggcugucccggccgc

SEQ ID NO: 2835280 - RNA, 18 nt, Mycobacterium avium subsp. paratuberculosis
cgggcugucccggccgcg

SEQ ID NO: 2835281 - RNA, 20 nt, Mycobacterium avium subsp. paratuberculosis
cgggcugucccggccgcgac

SEQ ID NO: 2835282 - RNA, 21 nt, Mycobacterium avium subsp. paratuberculosis
cgggcugucccggccgcgaca

SEQ ID NO: 2835283 - RNA, 13 nt, Mycobacterium avium subsp. paratuberculosis
cgggcugucggcg

SEQ ID NO: 2835284 - RNA, 15 nt, Mycobacterium avium subsp. paratuberculosis
cgggcugucggcgcc

SEQ ID NO: 2835285 - RNA, 14 nt, Mycobacterium avium subsp. paratuberculosis
cgggcugucgggca

SEQ ID NO: 2835286 - RNA, 15 nt, Mycobacterium avium subsp. paratuberculosis
cgggcugucgggcag

SEQ ID NO: 2835287 - RNA, 19 nt, Mycobacterium avium subsp. paratuberculosis
cgggcugucgggcaggccg

SEQ ID NO: 2835288 - RNA, 18 nt, Mycobacterium avium subsp. paratuberculosis
cgggcugugccggcgggu

SEQ ID NO: 2835289 - RNA, 21 nt, Mycobacterium avium subsp. paratuberculosis
cgggcugugggcgcagggccg

SEQ ID NO: 2835290 - RNA, 18 nt, Mycobacterium avium subsp. paratuberculosis
cgggcuguugaccacggc

SEQ ID NO: 2835291 - RNA, 15 nt, Mycobacterium avium subsp. paratuberculosis
cgggcuucggcguca

SEQ ID NO: 2835292 - RNA, 17 nt, Mycobacterium avium subsp. paratuberculosis
cggggaacaccggcgag

SEQ ID NO: 2835293 - RNA, 18 nt, Mycobacterium avium subsp. paratuberculosis
cggggaacaccggcgagg

SEQ ID NO: 2835294 - RNA, 18 nt, Mycobacterium avium subsp. paratuberculosis
cggggaacuccugcagga

SEQ ID NO: 2835295 - RNA, 21 nt, Mycobacterium avium subsp. paratuberculosis
cggggaacuccugcaggauca

SEQ ID NO: 2835296 - RNA, 21 nt, Mycobacterium avium subsp. paratuberculosis
cggggaagaucucggccagga

SEQ ID NO: 2835297 - RNA, 22 nt, Mycobacterium avium subsp. paratuberculosis
cggggaagggcuccccggacag

SEQ ID NO: 2835298 - RNA, 18 nt, Mycobacterium avium subsp. paratuberculosis
cggggaaggugcgggcgg

SEQ ID NO: 2835299 - RNA, 19 nt, Mycobacterium avium subsp. paratuberculosis
cggggaaggugcgggcggg

SEQ ID NO: 2835300 - RNA, 18 nt, Mycobacterium avium subsp. paratuberculosis
cggggaauccuggccgau

SEQ ID NO: 2835301 - RNA, 14 nt, Mycobacterium avium subsp. paratuberculosis
cggggaauuccggc

SEQ ID NO: 2835302 - RNA, 18 nt, Mycobacterium avium subsp. paratuberculosis
cggggaauuccggcgcga

SEQ ID NO: 2835303 - RNA, 21 nt, Mycobacterium avium subsp. paratuberculosis
cggggaauuccggcgcgaucg

SEQ ID NO: 2835304 - RNA, 12 nt, Mycobacterium avium subsp. paratuberculosis
cggggacaccgg

SEQ ID NO: 2835305 - RNA, 17 nt, Mycobacterium avium subsp. paratuberculosis
cggggacaccgggcacc

SEQ ID NO: 2835306 - RNA, 13 nt, Mycobacterium avium subsp. paratuberculosis
cggggacgacggc

SEQ ID NO: 2835307 - RNA, 15 nt, Mycobacterium avium subsp. paratuberculosis
cggggacgacggcgg

SEQ ID NO: 2835308 - RNA, 16 nt, Mycobacterium avium subsp. paratuberculosis
cggggacgacggcggg

SEQ ID NO: 2835309 - RNA, 21 nt, Mycobacterium avium subsp. paratuberculosis
cggggacgcugaacagcccga

SEQ ID NO: 2835310 - RNA, 17 nt, Mycobacterium avium subsp. paratuberculosis
cggggacggguugcggu

SEQ ID NO: 2835311 - RNA, 15 nt, Mycobacterium avium subsp. paratuberculosis
cggggacgucgucgu

SEQ ID NO: 2835312 - RNA, 17 nt, Mycobacterium avium subsp. paratuberculosis
cggggacgucgucgucc

SEQ ID NO: 2835313 - RNA, 19 nt, Mycobacterium avium subsp. paratuberculosis
cggggacgugucggggugg

SEQ ID NO: 2835314 - RNA, 18 nt, Mycobacterium avium subsp. paratuberculosis
cggggacuugacgauccc

SEQ ID NO: 2835315 - RNA, 22 nt, Mycobacterium avium subsp. paratuberculosis
cggggacuugacgauccccugg

SEQ ID NO: 2835316 - RNA, 15 nt, Mycobacterium avium subsp. paratuberculosis
cggggaggcccagcc

SEQ ID NO: 2835317 - RNA, 15 nt, Mycobacterium avium subsp. paratuberculosis
cggggaguucgcggu

SEQ ID NO: 2835318 - RNA, 16 nt, Mycobacterium avium subsp. paratuberculosis
cggggaguucgcgguu

SEQ ID NO: 2835319 - RNA, 19 nt, Mycobacterium avium subsp. paratuberculosis
cggggaucagcgucgcgau

SEQ ID NO: 2835320 - RNA, 12 nt, Mycobacterium avium subsp. paratuberculosis
cggggaucccga

SEQ ID NO: 2835321 - RNA, 19 nt, Mycobacterium avium subsp. paratuberculosis
cggggauccgaucugcucg

SEQ ID NO: 2835322 - RNA, 14 nt, Mycobacterium avium subsp. paratuberculosis
cggggaucgccagg

SEQ ID NO: 2835323 - RNA, 21 nt, Mycobacterium avium subsp. paratuberculosis
cggggaucgcgcagccgcggu

SEQ ID NO: 2835324 - RNA, 16 nt, Mycobacterium avium subsp. paratuberculosis
cggggauguagccgcc

SEQ ID NO: 2835325 - RNA, 17 nt, Mycobacterium avium subsp. paratuberculosis
cggggauguagccgccg

SEQ ID NO: 2835326 - RNA, 19 nt, Mycobacterium avium subsp. paratuberculosis
cggggauguagccgccggu

SEQ ID NO: 2835327 - RNA, 22 nt, Mycobacterium avium subsp. paratuberculosis
cggggaugucgucgggcgcggu

SEQ ID NO: 2835328 - RNA, 17 nt, Mycobacterium avium subsp. paratuberculosis
cggggcaagcagcggca

SEQ ID NO: 2835329 - RNA, 19 nt, Mycobacterium avium subsp. paratuberculosis
cggggcaagcagcggcagc

SEQ ID NO: 2835330 - RNA, 19 nt, Mycobacterium avium subsp. paratuberculosis
cggggcaccacguccacca

SEQ ID NO: 2835331 - RNA, 22 nt, Mycobacterium avium subsp. paratuberculosis
cggggcaccauugcgggaaggg

SEQ ID NO: 2835332 - RNA, 19 nt, Mycobacterium avium subsp. paratuberculosis
cggggcacgcgcgcccggc

SEQ ID NO: 2835333 - RNA, 17 nt, Mycobacterium avium subsp. paratuberculosis
cggggcagaccgugugc

SEQ ID NO: 2835334 - RNA, 15 nt, Mycobacterium avium subsp. paratuberculosis
cggggcagcacccgc

SEQ ID NO: 2835335 - RNA, 18 nt, Mycobacterium avium subsp. paratuberculosis
cggggcagcacccgcacc

SEQ ID NO: 2835336 - RNA, 13 nt, Mycobacterium avium subsp. paratuberculosis
cggggcagcagca

SEQ ID NO: 2835337 - RNA, 15 nt, Mycobacterium avium subsp. paratuberculosis
cggggcagcaguguc

SEQ ID NO: 2835338 - RNA, 22 nt, Mycobacterium avium subsp. paratuberculosis
cggggcaguagugguccaccgc

SEQ ID NO: 2835339 - RNA, 22 nt, Mycobacterium avium subsp. paratuberculosis
cggggcaucccugacacgaccg

SEQ ID NO: 2835340 - RNA, 15 nt, Mycobacterium avium subsp. paratuberculosis
cggggcaucgcagcg

SEQ ID NO: 2835341 - RNA, 18 nt, Mycobacterium avium subsp. paratuberculosis
cggggcaucgcagcgcgc

SEQ ID NO: 2835342 - RNA, 20 nt, Mycobacterium avium subsp. paratuberculosis
cggggcaucgcagcgcgcgg

SEQ ID NO: 2835343 - RNA, 18 nt, Mycobacterium avium subsp. paratuberculosis
cggggcauggugucagga

SEQ ID NO: 2835344 - RNA, 19 nt, Mycobacterium avium subsp. paratuberculosis
cggggccaacuccggcggc

SEQ ID NO: 2835345 - RNA, 20 nt, Mycobacterium avium subsp. paratuberculosis
cggggccaacuccggcggca

SEQ ID NO: 2835346 - RNA, 14 nt, Mycobacterium avium subsp. paratuberculosis
cggggccaccaggc

SEQ ID NO: 2835347 - RNA, 16 nt, Mycobacterium avium subsp. paratuberculosis
cggggccaccaggcgc

SEQ ID NO: 2835348 - RNA, 20 nt, Mycobacterium avium subsp. paratuberculosis
cggggccaccaggcgccguc

SEQ ID NO: 2835349 - RNA, 12 nt, Mycobacterium avium subsp. paratuberculosis
cggggccagcac

SEQ ID NO: 2835350 - RNA, 15 nt, Mycobacterium avium subsp. paratuberculosis
cggggccagcaccca

SEQ ID NO: 2835351 - RNA, 15 nt, Mycobacterium avium subsp. paratuberculosis
cggggcgcgcaggcg

SEQ ID NO: 2835352 - RNA, 20 nt, Mycobacterium avium subsp. paratuberculosis
cggggcgcgcugggcuaacg

SEQ ID NO: 2835353 - RNA, 13 nt, Mycobacterium avium subsp. paratuberculosis
cggggcgcggacc

SEQ ID NO: 2835354 - RNA, 14 nt, Mycobacterium avium subsp. paratuberculosis
cggggcgcggaccg

SEQ ID NO: 2835355 - RNA, 16 nt, Mycobacterium avium subsp. paratuberculosis
cggggcgcggaccgca

SEQ ID NO: 2835356 - RNA, 17 nt, Mycobacterium avium subsp. paratuberculosis
cggggcgcggaccgcac

SEQ ID NO: 2835357 - RNA, 18 nt, Mycobacterium avium subsp. paratuberculosis
cggggcgcugagcagguc

SEQ ID NO: 2835358 - RNA, 20 nt, Mycobacterium avium subsp. paratuberculosis
cggggcgcuguccuggucgc

SEQ ID NO: 2835359 - RNA, 14 nt, Mycobacterium avium subsp. paratuberculosis
cggggcggaucccc

SEQ ID NO: 2835360 - RNA, 16 nt, Mycobacterium avium subsp. paratuberculosis
cggggcggauccccgc

SEQ ID NO: 2835361 - RNA, 20 nt, Mycobacterium avium subsp. paratuberculosis
cggggcggaugcgcuggugc

SEQ ID NO: 2835362 - RNA, 13 nt, Mycobacterium avium subsp. paratuberculosis
cggggcggccgcc

SEQ ID NO: 2835363 - RNA, 14 nt, Mycobacterium avium subsp. paratuberculosis
cggggcggccgccg

SEQ ID NO: 2835364 - RNA, 15 nt, Mycobacterium avium subsp. paratuberculosis
cggggcggccgccgg

SEQ ID NO: 2835365 - RNA, 22 nt, Mycobacterium avium subsp. paratuberculosis
cggggcggccgccgggccggcg

SEQ ID NO: 2835366 - RNA, 14 nt, Mycobacterium avium subsp. paratuberculosis
cggggcggcgaugc

SEQ ID NO: 2835367 - RNA, 14 nt, Mycobacterium avium subsp. paratuberculosis
cggggcggcggcgc

SEQ ID NO: 2835368 - RNA, 20 nt, Mycobacterium avium subsp. paratuberculosis
cggggcggcggcgccggggc

SEQ ID NO: 2835369 - RNA, 13 nt, Mycobacterium avium subsp. paratuberculosis
cggggcggcggua

SEQ ID NO: 2835370 - RNA, 17 nt, Mycobacterium avium subsp. paratuberculosis
cggggcgggcacgucgc

SEQ ID NO: 2835371 - RNA, 21 nt, Mycobacterium avium subsp. paratuberculosis
cggggcgggcacgucgcgcgg

SEQ ID NO: 2835372 - RNA, 13 nt, Mycobacterium avium subsp. paratuberculosis
cggggcgggcagc

SEQ ID NO: 2835373 - RNA, 15 nt, Mycobacterium avium subsp. paratuberculosis
cggggcgggcggcgg

SEQ ID NO: 2835374 - RNA, 17 nt, Mycobacterium avium subsp. paratuberculosis
cggggcgggcggcggcu

SEQ ID NO: 2835375 - RNA, 21 nt, Mycobacterium avium subsp. paratuberculosis
cggggcggugaccuugcgggc

SEQ ID NO: 2835376 - RNA, 12 nt, Mycobacterium avium subsp. paratuberculosis
cggggcguacgc

SEQ ID NO: 2835377 - RNA, 19 nt, Mycobacterium avium subsp. paratuberculosis
cggggcguacgcgcugccg

SEQ ID NO: 2835378 - RNA, 18 nt, Mycobacterium avium subsp. paratuberculosis
cggggcgucgcccgccga

SEQ ID NO: 2835379 - RNA, 14 nt, Mycobacterium avium subsp. paratuberculosis
cggggcgucggcgg

SEQ ID NO: 2835380 - RNA, 15 nt, Mycobacterium avium subsp. paratuberculosis
cggggcgucggcggc

SEQ ID NO: 2835381 - RNA, 19 nt, Mycobacterium avium subsp. paratuberculosis
cggggcgugcccggcgccg

SEQ ID NO: 2835382 - RNA, 15 nt, Mycobacterium avium subsp. paratuberculosis
cggggcguggcggaa

SEQ ID NO: 2835383 - RNA, 18 nt, Mycobacterium avium subsp. paratuberculosis
cggggcguggcggaagcg

SEQ ID NO: 2835384 - RNA, 19 nt, Mycobacterium avium subsp. paratuberculosis
cggggcguggcggaagcgc

SEQ ID NO: 2835385 - RNA, 22 nt, Mycobacterium avium subsp. paratuberculosis
cggggcguugguugcggccccg

SEQ ID NO: 2835386 - RNA, 15 nt, Mycobacterium avium subsp. paratuberculosis
cggggcuacaaaacc

SEQ ID NO: 2835387 - RNA, 22 nt, Mycobacterium avium subsp. paratuberculosis
cggggcuacaaaaccaagaccg

SEQ ID NO: 2835388 - RNA, 23 nt, Mycobacterium avium subsp. paratuberculosis
cggggcuacaaaaccaagaccgc

SEQ ID NO: 2835389 - RNA, 15 nt, Mycobacterium avium subsp. paratuberculosis
cggggcucauacggc

SEQ ID NO: 2835390 - RNA, 21 nt, Mycobacterium avium subsp. paratuberculosis
cggggcucauacggcggcucg

SEQ ID NO: 2835391 - RNA, 17 nt, Mycobacterium avium subsp. paratuberculosis
cggggcugcccaggucc

SEQ ID NO: 2835392 - RNA, 17 nt, Mycobacterium avium subsp. paratuberculosis
cggggcugcgcggcuug

SEQ ID NO: 2835393 - RNA, 18 nt, Mycobacterium avium subsp. paratuberculosis
cggggcugcgggccaggc

SEQ ID NO: 2835394 - RNA, 13 nt, Mycobacterium avium subsp. paratuberculosis
cggggcuggcggc

SEQ ID NO: 2835395 - RNA, 18 nt, Mycobacterium avium subsp. paratuberculosis
cggggcuggcggcgaaug

SEQ ID NO: 2835396 - RNA, 20 nt, Mycobacterium avium subsp. paratuberculosis
cggggcugggcuuccacagc

SEQ ID NO: 2835397 - RNA, 16 nt, Mycobacterium avium subsp. paratuberculosis
cggggcuucgaacgcc

SEQ ID NO: 2835398 - RNA, 23 nt, Mycobacterium avium subsp. paratuberculosis
cggggcuucgaacgcccgcacca

SEQ ID NO: 2835399 - RNA, 15 nt, Mycobacterium avium subsp. paratuberculosis
cgggggaagcccagc

SEQ ID NO: 2835400 - RNA, 17 nt, Mycobacterium avium subsp. paratuberculosis
cgggggagccgugcagc

SEQ ID NO: 2835401 - RNA, 15 nt, Mycobacterium avium subsp. paratuberculosis
cgggggagucggggu

SEQ ID NO: 2835402 - RNA, 18 nt, Mycobacterium avium subsp. paratuberculosis
cgggggagucggggugcu

SEQ ID NO: 2835403 - RNA, 16 nt, Mycobacterium avium subsp. paratuberculosis
cgggggaucggcggga

SEQ ID NO: 2835404 - RNA, 22 nt, Mycobacterium avium subsp. paratuberculosis
cgggggauuucacgucugcucg

SEQ ID NO: 2835405 - RNA, 23 nt, Mycobacterium avium subsp. paratuberculosis
cgggggcagggaauucagccugc

SEQ ID NO: 2835406 - RNA, 14 nt, Mycobacterium avium subsp. paratuberculosis
cgggggccgagcag

SEQ ID NO: 2835407 - RNA, 12 nt, Mycobacterium avium subsp. paratuberculosis
cgggggccgccg

SEQ ID NO: 2835408 - RNA, 12 nt, Mycobacterium avium subsp. paratuberculosis
cgggggccgcga

SEQ ID NO: 2835409 - RNA, 21 nt, Mycobacterium avium subsp. paratuberculosis
cgggggccgcuccauguucgg

SEQ ID NO: 2835410 - RNA, 16 nt, Mycobacterium avium subsp. paratuberculosis
cgggggccgucacagg

SEQ ID NO: 2835411 - RNA, 21 nt, Mycobacterium avium subsp. paratuberculosis
cgggggccgucacaggccgcc

SEQ ID NO: 2835412 - RNA, 22 nt, Mycobacterium avium subsp. paratuberculosis
cgggggccgucacaggccgccu

SEQ ID NO: 2835413 - RNA, 13 nt, Mycobacterium avium subsp. paratuberculosis
cgggggcggccgg

SEQ ID NO: 2835414 - RNA, 16 nt, Mycobacterium avium subsp. paratuberculosis
cgggggcggccgggcc

SEQ ID NO: 2835415 - RNA, 15 nt, Mycobacterium avium subsp. paratuberculosis
cgggggcggcggcgc

SEQ ID NO: 2835416 - RNA, 12 nt, Mycobacterium avium subsp. paratuberculosis
cgggggcgggca

SEQ ID NO: 2835417 - RNA, 22 nt, Mycobacterium avium subsp. paratuberculosis
cgggggcgggcaccucgaugcc

SEQ ID NO: 2835418 - RNA, 16 nt, Mycobacterium avium subsp. paratuberculosis
cgggggcgggccccac

SEQ ID NO: 2835419 - RNA, 18 nt, Mycobacterium avium subsp. paratuberculosis
cgggggcgggccccacgc

SEQ ID NO: 2835420 - RNA, 16 nt, Mycobacterium avium subsp. paratuberculosis
cgggggcggugcagcc

SEQ ID NO: 2835421 - RNA, 17 nt, Mycobacterium avium subsp. paratuberculosis
cgggggcggugcagccg

SEQ ID NO: 2835422 - RNA, 18 nt, Mycobacterium avium subsp. paratuberculosis
cgggggcuguccaccugc

SEQ ID NO: 2835423 - RNA, 14 nt, Mycobacterium avium subsp. paratuberculosis
cggggggagaggcg

SEQ ID NO: 2835424 - RNA, 22 nt, Mycobacterium avium subsp. paratuberculosis
cggggggcacguccccgugcag

SEQ ID NO: 2835425 - RNA, 14 nt, Mycobacterium avium subsp. paratuberculosis
cggggggcgagccg

SEQ ID NO: 2835426 - RNA, 20 nt, Mycobacterium avium subsp. paratuberculosis
cggggguaaaccgccagcag

SEQ ID NO: 2835427 - RNA, 13 nt, Mycobacterium avium subsp. paratuberculosis
cggggguagcggu

SEQ ID NO: 2835428 - RNA, 13 nt, Mycobacterium avium subsp. paratuberculosis
cggggguccaggg

SEQ ID NO: 2835429 - RNA, 14 nt, Mycobacterium avium subsp. paratuberculosis
cgggggucggagca

SEQ ID NO: 2835430 - RNA, 22 nt, Mycobacterium avium subsp. paratuberculosis
cgggggugaaggcggccaccgc

SEQ ID NO: 2835431 - RNA, 12 nt, Mycobacterium avium subsp. paratuberculosis
cgggggugccga

SEQ ID NO: 2835432 - RNA, 16 nt, Mycobacterium avium subsp. paratuberculosis
cgggggugccgcuccg

SEQ ID NO: 2835433 - RNA, 15 nt, Mycobacterium avium subsp. paratuberculosis
cggggguggccagcu

SEQ ID NO: 2835434 - RNA, 16 nt, Mycobacterium avium subsp. paratuberculosis
cgggggugggcuccca

SEQ ID NO: 2835435 - RNA, 19 nt, Mycobacterium avium subsp. paratuberculosis
cgggggugucguagcggcu

SEQ ID NO: 2835436 - RNA, 13 nt, Mycobacterium avium subsp. paratuberculosis
cgggguggccacc

SEQ ID NO: 2835437 - RNA, 13 nt, Mycobacterium avium subsp. paratuberculosis
cgggguggccggc

SEQ ID NO: 2835438 - RNA, 19 nt, Mycobacterium avium subsp. paratuberculosis
cgggguggccggccagcac

SEQ ID NO: 2835439 - RNA, 14 nt, Mycobacterium avium subsp. paratuberculosis
cgggguggcgccgg

SEQ ID NO: 2835440 - RNA, 15 nt, Mycobacterium avium subsp. paratuberculosis
cgggguggcgccggc

SEQ ID NO: 2835441 - RNA, 17 nt, Mycobacterium avium subsp. paratuberculosis
cgggguggcgccggcca

SEQ ID NO: 2835442 - RNA, 18 nt, Mycobacterium avium subsp. paratuberculosis
cgggguggcgccggccag

SEQ ID NO: 2835443 - RNA, 21 nt, Mycobacterium avium subsp. paratuberculosis
cgggguggcgccggccagcac

SEQ ID NO: 2835444 - RNA, 13 nt, Mycobacterium avium subsp. paratuberculosis
cggggugggcacg

SEQ ID NO: 2835445 - RNA, 17 nt, Mycobacterium avium subsp. paratuberculosis
cggggugggcacgucgg

SEQ ID NO: 2835446 - RNA, 20 nt, Mycobacterium avium subsp. paratuberculosis
cggggugggcacgucggcca

SEQ ID NO: 2835447 - RNA, 21 nt, Mycobacterium avium subsp. paratuberculosis
cggggugggcacgucggccag

SEQ ID NO: 2835448 - RNA, 20 nt, Mycobacterium avium subsp. paratuberculosis
cggggugggccaucggcaga

SEQ ID NO: 2835449 - RNA, 16 nt, Mycobacterium avium subsp. paratuberculosis
cggggugggcgacguc

SEQ ID NO: 2835450 - RNA, 23 nt, Mycobacterium avium subsp. paratuberculosis
cggggugggcgacgucgucgccc

SEQ ID NO: 2835451 - RNA, 14 nt, Mycobacterium avium subsp. paratuberculosis
cggggugggcugca

SEQ ID NO: 2835452 - RNA, 16 nt, Mycobacterium avium subsp. paratuberculosis
cgggguggggacgacg

SEQ ID NO: 2835453 - RNA, 19 nt, Mycobacterium avium subsp. paratuberculosis
cgggguggggacgacgccg

SEQ ID NO: 2835454 - RNA, 15 nt, Mycobacterium avium subsp. paratuberculosis
cgggguggucaccgg

SEQ ID NO: 2835455 - RNA, 19 nt, Mycobacterium avium subsp. paratuberculosis
cgggguggucaccggcaag

SEQ ID NO: 2835456 - RNA, 12 nt, Mycobacterium avium subsp. paratuberculosis
cgggguggugga

SEQ ID NO: 2835457 - RNA, 14 nt, Mycobacterium avium subsp. paratuberculosis
cggggugguggaag

SEQ ID NO: 2835458 - RNA, 22 nt, Mycobacterium avium subsp. paratuberculosis
cggggugguggacgucaggccg

SEQ ID NO: 2835459 - RNA, 17 nt, Mycobacterium avium subsp. paratuberculosis
cgggguggugggcgcga

SEQ ID NO: 2835460 - RNA, 19 nt, Mycobacterium avium subsp. paratuberculosis
cgggguguaggcgucggcg

SEQ ID NO: 2835461 - RNA, 14 nt, Mycobacterium avium subsp. paratuberculosis
cgggguguccagcg

SEQ ID NO: 2835462 - RNA, 14 nt, Mycobacterium avium subsp. paratuberculosis
cggggugucgaccc

SEQ ID NO: 2835463 - RNA, 15 nt, Mycobacterium avium subsp. paratuberculosis
cggggugucgaccca

SEQ ID NO: 2835464 - RNA, 21 nt, Mycobacterium avium subsp. paratuberculosis
cggggugucgacccaggucga

SEQ ID NO: 2835465 - RNA, 14 nt, Mycobacterium avium subsp. paratuberculosis
cggggugucgcggc

SEQ ID NO: 2835466 - RNA, 17 nt, Mycobacterium avium subsp. paratuberculosis
cggggugucgcggcugc

SEQ ID NO: 2835467 - RNA, 19 nt, Mycobacterium avium subsp. paratuberculosis
cggggugugcccgaacgcg

SEQ ID NO: 2835468 - RNA, 13 nt, Mycobacterium avium subsp. paratuberculosis
cggggugugcggc

SEQ ID NO: 2835469 - RNA, 17 nt, Mycobacterium avium subsp. paratuberculosis
cggggugugcggcacgg

SEQ ID NO: 2835470 - RNA, 15 nt, Mycobacterium avium subsp. paratuberculosis
cggggugugcucggc

SEQ ID NO: 2835471 - RNA, 18 nt, Mycobacterium avium subsp. paratuberculosis
cggggugugcucggcggc

SEQ ID NO: 2835472 - RNA, 21 nt, Mycobacterium avium subsp. paratuberculosis
cggggugugcucggcggcgca

SEQ ID NO: 2835473 - RNA, 22 nt, Mycobacterium avium subsp. paratuberculosis
cggggugugcucggcggcgcag

SEQ ID NO: 2835474 - RNA, 13 nt, Mycobacterium avium subsp. paratuberculosis
cgggguguucacc

SEQ ID NO: 2835475 - RNA, 16 nt, Mycobacterium avium subsp. paratuberculosis
cgggguguucaccgcg

SEQ ID NO: 2835476 - RNA, 19 nt, Mycobacterium avium subsp. paratuberculosis
cgggguguucaccgcgccg

SEQ ID NO: 2835477 - RNA, 21 nt, Mycobacterium avium subsp. paratuberculosis
cgggguguucaccgcgccggg

SEQ ID NO: 2835478 - RNA, 22 nt, Mycobacterium avium subsp. paratuberculosis
cgggguguucaccgcgccgggc

SEQ ID NO: 2835479 - RNA, 16 nt, Mycobacterium avium subsp. paratuberculosis
cgggguguuugaucac

SEQ ID NO: 2835480 - RNA, 19 nt, Mycobacterium avium subsp. paratuberculosis
cgggguucaguagcagcgu

SEQ ID NO: 2835481 - RNA, 23 nt, Mycobacterium avium subsp. paratuberculosis
cgggguucaguagcagcgucugc

SEQ ID NO: 2835482 - RNA, 18 nt, Mycobacterium avium subsp. paratuberculosis
cgggguugacccggccgg

SEQ ID NO: 2835483 - RNA, 22 nt, Mycobacterium avium subsp. paratuberculosis
cgggguugguuucgguccaggu

SEQ ID NO: 2835484 - RNA, 19 nt, Mycobacterium avium subsp. paratuberculosis
cgggguuuuugauugcgcg

SEQ ID NO: 2835485 - RNA, 16 nt, Mycobacterium avium subsp. paratuberculosis
cggguaacccuccggc

SEQ ID NO: 2835486 - RNA, 17 nt, Mycobacterium avium subsp. paratuberculosis
cggguaacccuccggcg

SEQ ID NO: 2835487 - RNA, 15 nt, Mycobacterium avium subsp. paratuberculosis
cggguaaccgcagcc

SEQ ID NO: 2835488 - RNA, 16 nt, Mycobacterium avium subsp. paratuberculosis
cggguaaccgcagccg

SEQ ID NO: 2835489 - RNA, 19 nt, Mycobacterium avium subsp. paratuberculosis
cggguaagugucguggggc

SEQ ID NO: 2835490 - RNA, 15 nt, Mycobacterium avium subsp. paratuberculosis
cggguacaccgacuu

SEQ ID NO: 2835491 - RNA, 17 nt, Mycobacterium avium subsp. paratuberculosis
cggguacaccgagccgg

SEQ ID NO: 2835492 - RNA, 13 nt, Mycobacterium avium subsp. paratuberculosis
cggguacaccggc

SEQ ID NO: 2835493 - RNA, 14 nt, Mycobacterium avium subsp. paratuberculosis
cggguacaccggcu

SEQ ID NO: 2835494 - RNA, 16 nt, Mycobacterium avium subsp. paratuberculosis
cggguacaccggcucg

SEQ ID NO: 2835495 - RNA, 13 nt, Mycobacterium avium subsp. paratuberculosis
cggguacggcggc

SEQ ID NO: 2835496 - RNA, 15 nt, Mycobacterium avium subsp. paratuberculosis
cggguacggcggccg

SEQ ID NO: 2835497 - RNA, 16 nt, Mycobacterium avium subsp. paratuberculosis
cggguacggcggccgc

SEQ ID NO: 2835498 - RNA, 18 nt, Mycobacterium avium subsp. paratuberculosis
cggguagaaccagcccgg

SEQ ID NO: 2835499 - RNA, 22 nt, Mycobacterium avium subsp. paratuberculosis
cggguagaaccagcccggcccg

SEQ ID NO: 2835500 - RNA, 20 nt, Mycobacterium avium subsp. paratuberculosis
cggguagacguucuccccgc

SEQ ID NO: 2835501 - RNA, 21 nt, Mycobacterium avium subsp. paratuberculosis
cggguagacguucuccccgcc

SEQ ID NO: 2835502 - RNA, 22 nt, Mycobacterium avium subsp. paratuberculosis
cggguagacguucuccccgccg

SEQ ID NO: 2835503 - RNA, 17 nt, Mycobacterium avium subsp. paratuberculosis
cggguagaucuccucgg

SEQ ID NO: 2835504 - RNA, 22 nt, Mycobacterium avium subsp. paratuberculosis
cggguagaucuccucggacccg

SEQ ID NO: 2835505 - RNA, 20 nt, Mycobacterium avium subsp. paratuberculosis
cggguagccaugggucucgg

SEQ ID NO: 2835506 - RNA, 22 nt, Mycobacterium avium subsp. paratuberculosis
cggguagccaugggucucggcg

SEQ ID NO: 2835507 - RNA, 14 nt, Mycobacterium avium subsp. paratuberculosis
cggguagcccgcgu

SEQ ID NO: 2835508 - RNA, 18 nt, Mycobacterium avium subsp. paratuberculosis
cggguagcccgcgugcac

SEQ ID NO: 2835509 - RNA, 19 nt, Mycobacterium avium subsp. paratuberculosis
cggguagcccgcgugcaca

SEQ ID NO: 2835510 - RNA, 17 nt, Mycobacterium avium subsp. paratuberculosis
cggguagcccgucgacg

SEQ ID NO: 2835511 - RNA, 18 nt, Mycobacterium avium subsp. paratuberculosis
cggguagcccgucgacgg

SEQ ID NO: 2835512 - RNA, 14 nt, Mycobacterium avium subsp. paratuberculosis
cggguagcgccgcc

SEQ ID NO: 2835513 - RNA, 16 nt, Mycobacterium avium subsp. paratuberculosis
cggguagcgccgccgg

SEQ ID NO: 2835514 - RNA, 19 nt, Mycobacterium avium subsp. paratuberculosis
cggguagcgccgccggggc

SEQ ID NO: 2835515 - RNA, 21 nt, Mycobacterium avium subsp. paratuberculosis
cggguaggcgccgaugcccgc

SEQ ID NO: 2835516 - RNA, 20 nt, Mycobacterium avium subsp. paratuberculosis
cggguaggcgucgcgcagca

SEQ ID NO: 2835517 - RNA, 23 nt, Mycobacterium avium subsp. paratuberculosis
cggguaggcgucgcgcagcagcg

SEQ ID NO: 2835518 - RNA, 15 nt, Mycobacterium avium subsp. paratuberculosis
cggguagggcagcca

SEQ ID NO: 2835519 - RNA, 19 nt, Mycobacterium avium subsp. paratuberculosis
cggguagggcgccgucggc

SEQ ID NO: 2835520 - RNA, 16 nt, Mycobacterium avium subsp. paratuberculosis
cggguaggugcccggg

SEQ ID NO: 2835521 - RNA, 20 nt, Mycobacterium avium subsp. paratuberculosis
cgggucgaucucggcgcagg

SEQ ID NO: 2835522 - RNA, 15 nt, Mycobacterium avium subsp. paratuberculosis
cgggucgauggcgac

SEQ ID NO: 2835523 - RNA, 19 nt, Mycobacterium avium subsp. paratuberculosis
cgggucgcacagccgcagc

SEQ ID NO: 2835524 - RNA, 22 nt, Mycobacterium avium subsp. paratuberculosis
cgggucgcacagccgcagcagc

SEQ ID NO: 2835525 - RNA, 13 nt, Mycobacterium avium subsp. paratuberculosis
cgggucgcacgcc

SEQ ID NO: 2835526 - RNA, 14 nt, Mycobacterium avium subsp. paratuberculosis
cgggucgcacgccg

SEQ ID NO: 2835527 - RNA, 15 nt, Mycobacterium avium subsp. paratuberculosis
cgggucgcacgccgg

SEQ ID NO: 2835528 - RNA, 19 nt, Mycobacterium avium subsp. paratuberculosis
cgggucgcacgccgguagc

SEQ ID NO: 2835529 - RNA, 21 nt, Mycobacterium avium subsp. paratuberculosis
cgggucgcacgccgguagccg

SEQ ID NO: 2835530 - RNA, 22 nt, Mycobacterium avium subsp. paratuberculosis
cgggucgcacgccgguagccgc

SEQ ID NO: 2835531 - RNA, 14 nt, Mycobacterium avium subsp. paratuberculosis
cgggucgcagcggc

SEQ ID NO: 2835532 - RNA, 16 nt, Mycobacterium avium subsp. paratuberculosis
cgggucgcagcggcac

SEQ ID NO: 2835533 - RNA, 13 nt, Mycobacterium avium subsp. paratuberculosis
cgggucgcaggca

SEQ ID NO: 2835534 - RNA, 15 nt, Mycobacterium avium subsp. paratuberculosis
cgggucgcaggcagc

SEQ ID NO: 2835535 - RNA, 16 nt, Mycobacterium avium subsp. paratuberculosis
cgggucgcaggcagca

SEQ ID NO: 2835536 - RNA, 18 nt, Mycobacterium avium subsp. paratuberculosis
cgggucgcaggcagcagc

SEQ ID NO: 2835537 - RNA, 19 nt, Mycobacterium avium subsp. paratuberculosis
cgggucgcaggcagcagca

SEQ ID NO: 2835538 - RNA, 21 nt, Mycobacterium avium subsp. paratuberculosis
cgggucgcaggcagcagcacc

SEQ ID NO: 2835539 - RNA, 22 nt, Mycobacterium avium subsp. paratuberculosis
cgggucgcaggcagcagcaccc

SEQ ID NO: 2835540 - RNA, 18 nt, Mycobacterium avium subsp. paratuberculosis
cgggucgccaaggucguc

SEQ ID NO: 2835541 - RNA, 22 nt, Mycobacterium avium subsp. paratuberculosis
cgggucgccaaggucgucaacg

SEQ ID NO: 2835542 - RNA, 14 nt, Mycobacterium avium subsp. paratuberculosis
cgggucgccgaucu

SEQ ID NO: 2835543 - RNA, 12 nt, Mycobacterium avium subsp. paratuberculosis
cgggucgccggg

SEQ ID NO: 2835544 - RNA, 15 nt, Mycobacterium avium subsp. paratuberculosis
cgggucgccgggcag

SEQ ID NO: 2835545 - RNA, 13 nt, Mycobacterium avium subsp. paratuberculosis
cgggucgccgguc

SEQ ID NO: 2835546 - RNA, 14 nt, Mycobacterium avium subsp. paratuberculosis
cgggucgccggucu

SEQ ID NO: 2835547 - RNA, 14 nt, Mycobacterium avium subsp. paratuberculosis
cgggucgccgucga

SEQ ID NO: 2835548 - RNA, 22 nt, Mycobacterium avium subsp. paratuberculosis
cgggucgcgcggcuacagcaac

SEQ ID NO: 2835549 - RNA, 14 nt, Mycobacterium avium subsp. paratuberculosis
cgggucgcggaucu

SEQ ID NO: 2835550 - RNA, 20 nt, Mycobacterium avium subsp. paratuberculosis
cgggucgcggaucucgucgg

SEQ ID NO: 2835551 - RNA, 18 nt, Mycobacterium avium subsp. paratuberculosis
cgggucgcggcccaccgc

SEQ ID NO: 2835552 - RNA, 20 nt, Mycobacterium avium subsp. paratuberculosis
cgggucgcggcuggugccgc

SEQ ID NO: 2835553 - RNA, 21 nt, Mycobacterium avium subsp. paratuberculosis
cgggucgcggcuggugccgcc

SEQ ID NO: 2835554 - RNA, 23 nt, Mycobacterium avium subsp. paratuberculosis
cgggucgcggcuggugccgccgg

SEQ ID NO: 2835555 - RNA, 11 nt, Mycobacterium avium subsp. paratuberculosis
cgggucgcggu

SEQ ID NO: 2835556 - RNA, 15 nt, Mycobacterium avium subsp. paratuberculosis
cgggucgcuggccgc

SEQ ID NO: 2835557 - RNA, 18 nt, Mycobacterium avium subsp. paratuberculosis
cgggucgcuggccgcgac

SEQ ID NO: 2835558 - RNA, 16 nt, Mycobacterium avium subsp. paratuberculosis
cgggucgcugugcagc

SEQ ID NO: 2835559 - RNA, 17 nt, Mycobacterium avium subsp. paratuberculosis
cgggucgcugugcagcg

SEQ ID NO: 2835560 - RNA, 19 nt, Mycobacterium avium subsp. paratuberculosis
cgggucgcugugcagcggg

SEQ ID NO: 2835561 - RNA, 13 nt, Mycobacterium avium subsp. paratuberculosis
cgggucggccggc

SEQ ID NO: 2835562 - RNA, 14 nt, Mycobacterium avium subsp. paratuberculosis
cgggucggccggcg

SEQ ID NO: 2835563 - RNA, 15 nt, Mycobacterium avium subsp. paratuberculosis
cgggucggccggcgg

SEQ ID NO: 2835564 - RNA, 14 nt, Mycobacterium avium subsp. paratuberculosis
cgggucggcgacca

SEQ ID NO: 2835565 - RNA, 15 nt, Mycobacterium avium subsp. paratuberculosis
cgggucggcgaccau

SEQ ID NO: 2835566 - RNA, 16 nt, Mycobacterium avium subsp. paratuberculosis
cgggucggcgacggcg

SEQ ID NO: 2835567 - RNA, 17 nt, Mycobacterium avium subsp. paratuberculosis
cgggucggcgacggcgc

SEQ ID NO: 2835568 - RNA, 15 nt, Mycobacterium avium subsp. paratuberculosis
cgggucggcgagcag

SEQ ID NO: 2835569 - RNA, 20 nt, Mycobacterium avium subsp. paratuberculosis
cgggucggcgagcagccgcg

SEQ ID NO: 2835570 - RNA, 22 nt, Mycobacterium avium subsp. paratuberculosis
cgggucggcgagcagccgcgcc

SEQ ID NO: 2835571 - RNA, 23 nt, Mycobacterium avium subsp. paratuberculosis
cgggucggcgagcagccgcgccg

SEQ ID NO: 2835572 - RNA, 13 nt, Mycobacterium avium subsp. paratuberculosis
cgggucggcgccg

SEQ ID NO: 2835573 - RNA, 17 nt, Mycobacterium avium subsp. paratuberculosis
cgggucggcgccggcca

SEQ ID NO: 2835574 - RNA, 18 nt, Mycobacterium avium subsp. paratuberculosis
cgggucggcgccggccag

SEQ ID NO: 2835575 - RNA, 19 nt, Mycobacterium avium subsp. paratuberculosis
cgggucggcgccggccagc

SEQ ID NO: 2835576 - RNA, 22 nt, Mycobacterium avium subsp. paratuberculosis
cgggucggcgccggccagcggc

SEQ ID NO: 2835577 - RNA, 14 nt, Mycobacterium avium subsp. paratuberculosis
cgggucggcggcga

SEQ ID NO: 2835578 - RNA, 18 nt, Mycobacterium avium subsp. paratuberculosis
cgggucgggaccgaugcc

SEQ ID NO: 2835579 - RNA, 18 nt, Mycobacterium avium subsp. paratuberculosis
cgggucgggaggcagcgc

SEQ ID NO: 2835580 - RNA, 19 nt, Mycobacterium avium subsp. paratuberculosis
cgggucgggaggcagcgcg

SEQ ID NO: 2835581 - RNA, 16 nt, Mycobacterium avium subsp. paratuberculosis
cgggucggucggcccg

SEQ ID NO: 2835582 - RNA, 18 nt, Mycobacterium avium subsp. paratuberculosis
cgggucggucggcccgcu

SEQ ID NO: 2835583 - RNA, 21 nt, Mycobacterium avium subsp. paratuberculosis
cgggucggugggcagcucguc

SEQ ID NO: 2835584 - RNA, 20 nt, Mycobacterium avium subsp. paratuberculosis
cgggucguagagcgcgaagc

SEQ ID NO: 2835585 - RNA, 13 nt, Mycobacterium avium subsp. paratuberculosis
cgggucguagccg

SEQ ID NO: 2835586 - RNA, 20 nt, Mycobacterium avium subsp. paratuberculosis
cgggucguagccgaagccgc

SEQ ID NO: 2835587 - RNA, 21 nt, Mycobacterium avium subsp. paratuberculosis
cgggucguagccgaagccgcc

SEQ ID NO: 2835588 - RNA, 24 nt, Mycobacterium avium subsp. paratuberculosis
cgggucguagccgaagccgccguc

SEQ ID NO: 2835589 - RNA, 20 nt, Mycobacterium avium subsp. paratuberculosis
cgggucguaggacaccacgg

SEQ ID NO: 2835590 - RNA, 14 nt, Mycobacterium avium subsp. paratuberculosis
cgggucguccgcga

SEQ ID NO: 2835591 - RNA, 15 nt, Mycobacterium avium subsp. paratuberculosis
cgggucguccgcgac

SEQ ID NO: 2835592 - RNA, 14 nt, Mycobacterium avium subsp. paratuberculosis
cgggucgucgaugc

SEQ ID NO: 2835593 - RNA, 13 nt, Mycobacterium avium subsp. paratuberculosis
cgggucgucgcgg

SEQ ID NO: 2835594 - RNA, 14 nt, Mycobacterium avium subsp. paratuberculosis
cgggucgucgcgga

SEQ ID NO: 2835595 - RNA, 15 nt, Mycobacterium avium subsp. paratuberculosis
cgggucgucgcggaa

SEQ ID NO: 2835596 - RNA, 17 nt, Mycobacterium avium subsp. paratuberculosis
cgggucgucgcggaacc

SEQ ID NO: 2835597 - RNA, 11 nt, Mycobacterium avium subsp. paratuberculosis
cgggucgucgg

SEQ ID NO: 2835598 - RNA, 16 nt, Mycobacterium avium subsp. paratuberculosis
cgggucgucgggccgg

SEQ ID NO: 2835599 - RNA, 15 nt, Mycobacterium avium subsp. paratuberculosis
cgggucgucgggcgg

SEQ ID NO: 2835600 - RNA, 18 nt, Mycobacterium avium subsp. paratuberculosis
cgggucgugcaucggcgc

SEQ ID NO: 2835601 - RNA, 21 nt, Mycobacterium avium subsp. paratuberculosis
cgggucgugcggcggcggugc

SEQ ID NO: 2835602 - RNA, 18 nt, Mycobacterium avium subsp. paratuberculosis
cgggucguuggcggcggu

SEQ ID NO: 2835603 - RNA, 18 nt, Mycobacterium avium subsp. paratuberculosis
cgggucguuugguggugg

SEQ ID NO: 2835604 - RNA, 21 nt, Mycobacterium avium subsp. paratuberculosis
cgggucuagaucuccaggcuc

SEQ ID NO: 2835605 - RNA, 22 nt, Mycobacterium avium subsp. paratuberculosis
cgggucucagcgcccgcccggc

SEQ ID NO: 2835606 - RNA, 16 nt, Mycobacterium avium subsp. paratuberculosis
cgggugcugcggcucc

SEQ ID NO: 2835607 - RNA, 19 nt, Mycobacterium avium subsp. paratuberculosis
cgggugcuggucagcaucg

SEQ ID NO: 2835608 - RNA, 22 nt, Mycobacterium avium subsp. paratuberculosis
cggguggaacuggacgccgugg

SEQ ID NO: 2835609 - RNA, 14 nt, Mycobacterium avium subsp. paratuberculosis
cggguggacaccgc

SEQ ID NO: 2835610 - RNA, 21 nt, Mycobacterium avium subsp. paratuberculosis
cggguggacaccgcgaucacc

SEQ ID NO: 2835611 - RNA, 11 nt, Mycobacterium avium subsp. paratuberculosis
cggguggacgc

SEQ ID NO: 2835612 - RNA, 22 nt, Mycobacterium avium subsp. paratuberculosis
cggguggaucuugacggcgacg

SEQ ID NO: 2835613 - RNA, 17 nt, Mycobacterium avium subsp. paratuberculosis
cggguggcaggaagcga

SEQ ID NO: 2835614 - RNA, 16 nt, Mycobacterium avium subsp. paratuberculosis
cggguggccagcacca

SEQ ID NO: 2835615 - RNA, 18 nt, Mycobacterium avium subsp. paratuberculosis
cggguggccagcaccagc

SEQ ID NO: 2835616 - RNA, 21 nt, Mycobacterium avium subsp. paratuberculosis
cggguggccagcaccagcccg

SEQ ID NO: 2835617 - RNA, 15 nt, Mycobacterium avium subsp. paratuberculosis
cggguggccagccag

SEQ ID NO: 2835618 - RNA, 21 nt, Mycobacterium avium subsp. paratuberculosis
cggguggcccaaucggugcgg

SEQ ID NO: 2835619 - RNA, 22 nt, Mycobacterium avium subsp. paratuberculosis
cggguggcccgcacguagacgg

SEQ ID NO: 2835620 - RNA, 23 nt, Mycobacterium avium subsp. paratuberculosis
cggguggcccgcacguagacggu

SEQ ID NO: 2835621 - RNA, 16 nt, Mycobacterium avium subsp. paratuberculosis
cggguggcccgcccgg

SEQ ID NO: 2835622 - RNA, 18 nt, Mycobacterium avium subsp. paratuberculosis
cggguggcccgcccgggc

SEQ ID NO: 2835623 - RNA, 14 nt, Mycobacterium avium subsp. paratuberculosis
cggguggccggggc

SEQ ID NO: 2835624 - RNA, 16 nt, Mycobacterium avium subsp. paratuberculosis
cggguggccggggcca

SEQ ID NO: 2835625 - RNA, 16 nt, Mycobacterium avium subsp. paratuberculosis
cggguggccgggucgc

SEQ ID NO: 2835626 - RNA, 18 nt, Mycobacterium avium subsp. paratuberculosis
cggguggccgggucgccg

SEQ ID NO: 2835627 - RNA, 22 nt, Mycobacterium avium subsp. paratuberculosis
cggguggccgggucgccgucga

SEQ ID NO: 2835628 - RNA, 13 nt, Mycobacterium avium subsp. paratuberculosis
cggguggccguga

SEQ ID NO: 2835629 - RNA, 15 nt, Mycobacterium avium subsp. paratuberculosis
cggguggccuccgga

SEQ ID NO: 2835630 - RNA, 15 nt, Mycobacterium avium subsp. paratuberculosis
cggguggccuucauc

SEQ ID NO: 2835631 - RNA, 17 nt, Mycobacterium avium subsp. paratuberculosis
cggguggccuucaucac

SEQ ID NO: 2835632 - RNA, 19 nt, Mycobacterium avium subsp. paratuberculosis
cggguggccuucaucaccg

SEQ ID NO: 2835633 - RNA, 13 nt, Mycobacterium avium subsp. paratuberculosis
cggguggcgauga

SEQ ID NO: 2835634 - RNA, 13 nt, Mycobacterium avium subsp. paratuberculosis
cggguggcggggc

SEQ ID NO: 2835635 - RNA, 17 nt, Mycobacterium avium subsp. paratuberculosis
cggguggcguccagaug

SEQ ID NO: 2835636 - RNA, 20 nt, Mycobacterium avium subsp. paratuberculosis
cggguggcguccagaugccg

SEQ ID NO: 2835637 - RNA, 18 nt, Mycobacterium avium subsp. paratuberculosis
cggguggcgucgccgccg

SEQ ID NO: 2835638 - RNA, 22 nt, Mycobacterium avium subsp. paratuberculosis
cggguggcgucgccgccggugc

SEQ ID NO: 2835639 - RNA, 17 nt, Mycobacterium avium subsp. paratuberculosis
cgggugggcagccccag

SEQ ID NO: 2835640 - RNA, 18 nt, Mycobacterium avium subsp. paratuberculosis
cgggugggcagccccagc

SEQ ID NO: 2835641 - RNA, 14 nt, Mycobacterium avium subsp. paratuberculosis
cgggugggcagcgc

SEQ ID NO: 2835642 - RNA, 20 nt, Mycobacterium avium subsp. paratuberculosis
cgggugggcagcgcgauccg

SEQ ID NO: 2835643 - RNA, 17 nt, Mycobacterium avium subsp. paratuberculosis
cgggugggccgaccugc

SEQ ID NO: 2835644 - RNA, 22 nt, Mycobacterium avium subsp. paratuberculosis
cgggugggccgaccugcacgcu

SEQ ID NO: 2835645 - RNA, 13 nt, Mycobacterium avium subsp. paratuberculosis
cgggugggcggca

SEQ ID NO: 2835646 - RNA, 17 nt, Mycobacterium avium subsp. paratuberculosis
cgggugggcggcacacc

SEQ ID NO: 2835647 - RNA, 21 nt, Mycobacterium avium subsp. paratuberculosis
cgggugggcggcacaccgcgc

SEQ ID NO: 2835648 - RNA, 23 nt, Mycobacterium avium subsp. paratuberculosis
cggguggggaucaggaugacgcc

SEQ ID NO: 2835649 - RNA, 22 nt, Mycobacterium avium subsp. paratuberculosis
cgggugguguggcgucggccgg

SEQ ID NO: 2835650 - RNA, 15 nt, Mycobacterium avium subsp. paratuberculosis
cgggugguuggccgc

SEQ ID NO: 2835651 - RNA, 16 nt, Mycobacterium avium subsp. paratuberculosis
cgggugguuggccgcc

SEQ ID NO: 2835652 - RNA, 17 nt, Mycobacterium avium subsp. paratuberculosis
cgggugguuggccgcca

SEQ ID NO: 2835653 - RNA, 15 nt, Mycobacterium avium subsp. paratuberculosis
cggguguaggcccga

SEQ ID NO: 2835654 - RNA, 16 nt, Mycobacterium avium subsp. paratuberculosis
cggguguauucgccca

SEQ ID NO: 2835655 - RNA, 21 nt, Mycobacterium avium subsp. paratuberculosis
cggguguauucgcccaccccg

SEQ ID NO: 2835656 - RNA, 16 nt, Mycobacterium avium subsp. paratuberculosis
cgggugucaggucggc

SEQ ID NO: 2835657 - RNA, 18 nt, Mycobacterium avium subsp. paratuberculosis
cgggugucaggucggcga

SEQ ID NO: 2835658 - RNA, 14 nt, Mycobacterium avium subsp. paratuberculosis
cgggugucgacgcc

SEQ ID NO: 2835659 - RNA, 16 nt, Mycobacterium avium subsp. paratuberculosis
cgggugucgacgccgg

SEQ ID NO: 2835660 - RNA, 18 nt, Mycobacterium avium subsp. paratuberculosis
cgggugucgacgccgggc

SEQ ID NO: 2835661 - RNA, 14 nt, Mycobacterium avium subsp. paratuberculosis
cgggugucgagcca

SEQ ID NO: 2835662 - RNA, 17 nt, Mycobacterium avium subsp. paratuberculosis
cgggugucgagccacca

SEQ ID NO: 2835663 - RNA, 19 nt, Mycobacterium avium subsp. paratuberculosis
cgggugucgagccaccacu

SEQ ID NO: 2835664 - RNA, 20 nt, Mycobacterium avium subsp. paratuberculosis
cgggugucgagccaccacug

SEQ ID NO: 2835665 - RNA, 21 nt, Mycobacterium avium subsp. paratuberculosis
cgggugucgccgagccgcacc

SEQ ID NO: 2835666 - RNA, 14 nt, Mycobacterium avium subsp. paratuberculosis
cgggugucgccggu

SEQ ID NO: 2835667 - RNA, 19 nt, Mycobacterium avium subsp. paratuberculosis
cgggugucgccgguggugc

SEQ ID NO: 2835668 - RNA, 18 nt, Mycobacterium avium subsp. paratuberculosis
cgggugugauugccagcu

SEQ ID NO: 2835669 - RNA, 14 nt, Mycobacterium avium subsp. paratuberculosis
cggguguggcgccg

SEQ ID NO: 2835670 - RNA, 21 nt, Mycobacterium avium subsp. paratuberculosis
cggguguggcgccgugcagga

SEQ ID NO: 2835671 - RNA, 16 nt, Mycobacterium avium subsp. paratuberculosis
cgggugugggcgccgu

SEQ ID NO: 2835672 - RNA, 14 nt, Mycobacterium avium subsp. paratuberculosis
cggguguucagccc

SEQ ID NO: 2835673 - RNA, 17 nt, Mycobacterium avium subsp. paratuberculosis
cggguguugcgcagcgu

SEQ ID NO: 2835674 - RNA, 18 nt, Mycobacterium avium subsp. paratuberculosis
cggguguugcgcagcguc

SEQ ID NO: 2835675 - RNA, 19 nt, Mycobacterium avium subsp. paratuberculosis
cggguguugcgcagcgucu

SEQ ID NO: 2835676 - RNA, 21 nt, Mycobacterium avium subsp. paratuberculosis
cggguguugcggcagggccac

SEQ ID NO: 2835677 - RNA, 19 nt, Mycobacterium avium subsp. paratuberculosis
cggguguuggagccguccg

SEQ ID NO: 2835678 - RNA, 21 nt, Mycobacterium avium subsp. paratuberculosis
cggguguuggagccguccggg

SEQ ID NO: 2835679 - RNA, 18 nt, Mycobacterium avium subsp. paratuberculosis
cggguguuggcgcacagc

SEQ ID NO: 2835680 - RNA, 15 nt, Mycobacterium avium subsp. paratuberculosis
cggguguuucggucg

SEQ ID NO: 2835681 - RNA, 17 nt, Mycobacterium avium subsp. paratuberculosis
cggguguuucggucggc

SEQ ID NO: 2835682 - RNA, 21 nt, Mycobacterium avium subsp. paratuberculosis
cggguguuucggucggcgucg

SEQ ID NO: 2835683 - RNA, 22 nt, Mycobacterium avium subsp. paratuberculosis
cggguuacguggacgcgcgcgg

SEQ ID NO: 2835684 - RNA, 17 nt, Mycobacterium avium subsp. paratuberculosis
cggguucacccuggcga

SEQ ID NO: 2835685 - RNA, 19 nt, Mycobacterium avium subsp. paratuberculosis
cggguuccgguuggccagg

SEQ ID NO: 2835686 - RNA, 13 nt, Mycobacterium avium subsp. paratuberculosis
cggguucgacgcc

SEQ ID NO: 2835687 - RNA, 20 nt, Mycobacterium avium subsp. paratuberculosis
cggguucgacgccucggugc

SEQ ID NO: 2835688 - RNA, 23 nt, Mycobacterium avium subsp. paratuberculosis
cggguucgacgccucggugcgga

SEQ ID NO: 2835689 - RNA, 16 nt, Mycobacterium avium subsp. paratuberculosis
cggguucgcccucccc

SEQ ID NO: 2835690 - RNA, 23 nt, Mycobacterium avium subsp. paratuberculosis
cgguaccagggcagcgccucggc

SEQ ID NO: 2835691 - RNA, 15 nt, Mycobacterium avium subsp. paratuberculosis
cgguacccccgccgg

SEQ ID NO: 2835692 - RNA, 21 nt, Mycobacterium avium subsp. paratuberculosis
cgguaccgaugaccaccgcug

SEQ ID NO: 2835693 - RNA, 17 nt, Mycobacterium avium subsp. paratuberculosis
cgguaccgccgaucgug

SEQ ID NO: 2835694 - RNA, 12 nt, Mycobacterium avium subsp. paratuberculosis
cgguaccgccgg

SEQ ID NO: 2835695 - RNA, 17 nt, Mycobacterium avium subsp. paratuberculosis
cgguaccgccggccagg

SEQ ID NO: 2835696 - RNA, 19 nt, Mycobacterium avium subsp. paratuberculosis
cgguacgcgccgcgcgccc

SEQ ID NO: 2835697 - RNA, 16 nt, Mycobacterium avium subsp. paratuberculosis
cgguacggaucgccgg

SEQ ID NO: 2835698 - RNA, 17 nt, Mycobacterium avium subsp. paratuberculosis
cgguacggccgacgccc

SEQ ID NO: 2835699 - RNA, 19 nt, Mycobacterium avium subsp. paratuberculosis
cgguacggccgacgcccag

SEQ ID NO: 2835700 - RNA, 20 nt, Mycobacterium avium subsp. paratuberculosis
cgguacggcucaacggccgg

SEQ ID NO: 2835701 - RNA, 17 nt, Mycobacterium avium subsp. paratuberculosis
cgguagacaccgccguu

SEQ ID NO: 2835702 - RNA, 15 nt, Mycobacterium avium subsp. paratuberculosis
cgguagagcggcacc

SEQ ID NO: 2835703 - RNA, 16 nt, Mycobacterium avium subsp. paratuberculosis
cgguagagcggcacca

SEQ ID NO: 2835704 - RNA, 18 nt, Mycobacterium avium subsp. paratuberculosis
cgguagagcggcaccagg

SEQ ID NO: 2835705 - RNA, 17 nt, Mycobacterium avium subsp. paratuberculosis
cgguagauauggcccuc

SEQ ID NO: 2835706 - RNA, 15 nt, Mycobacterium avium subsp. paratuberculosis
cgguagaucagcgcc

SEQ ID NO: 2835707 - RNA, 16 nt, Mycobacterium avium subsp. paratuberculosis
cgguagaucagcgccu

SEQ ID NO: 2835708 - RNA, 17 nt, Mycobacterium avium subsp. paratuberculosis
cgguagaucagcgccug

SEQ ID NO: 2835709 - RNA, 23 nt, Mycobacterium avium subsp. paratuberculosis
cgguagaucgccggaucgagcac

SEQ ID NO: 2835710 - RNA, 16 nt, Mycobacterium avium subsp. paratuberculosis
cgguagaugucggguc

SEQ ID NO: 2835711 - RNA, 13 nt, Mycobacterium avium subsp. paratuberculosis
cgguagccagcac

SEQ ID NO: 2835712 - RNA, 18 nt, Mycobacterium avium subsp. paratuberculosis
cgguagccagcaccgccc

SEQ ID NO: 2835713 - RNA, 21 nt, Mycobacterium avium subsp. paratuberculosis
cgguagccagcaccgccccgg

SEQ ID NO: 2835714 - RNA, 19 nt, Mycobacterium avium subsp. paratuberculosis
cgguagccgcucgcccagc

SEQ ID NO: 2835715 - RNA, 22 nt, Mycobacterium avium subsp. paratuberculosis
cgguagccgcucgcccagcgcg

SEQ ID NO: 2835716 - RNA, 23 nt, Mycobacterium avium subsp. paratuberculosis
cgguagccgcucgcccagcgcgg

SEQ ID NO: 2835717 - RNA, 16 nt, Mycobacterium avium subsp. paratuberculosis
cgguagccugcagugu

SEQ ID NO: 2835718 - RNA, 16 nt, Mycobacterium avium subsp. paratuberculosis
cgguagcgcagcacca

SEQ ID NO: 2835719 - RNA, 17 nt, Mycobacterium avium subsp. paratuberculosis
cgguagcgcagcaccag

SEQ ID NO: 2835720 - RNA, 19 nt, Mycobacterium avium subsp. paratuberculosis
cgguagcgcucgucguagu

SEQ ID NO: 2835721 - RNA, 17 nt, Mycobacterium avium subsp. paratuberculosis
cgguagcggcagauggu

SEQ ID NO: 2835722 - RNA, 22 nt, Mycobacterium avium subsp. paratuberculosis
cgguagcggcagauggucucga

SEQ ID NO: 2835723 - RNA, 15 nt, Mycobacterium avium subsp. paratuberculosis
cgguagcguggguuc

SEQ ID NO: 2835724 - RNA, 18 nt, Mycobacterium avium subsp. paratuberculosis
cgguaggccgccgcgacc

SEQ ID NO: 2835725 - RNA, 17 nt, Mycobacterium avium subsp. paratuberculosis
cgguaggccggccgcag

SEQ ID NO: 2835726 - RNA, 14 nt, Mycobacterium avium subsp. paratuberculosis
cgguaggccugcgu

SEQ ID NO: 2835727 - RNA, 23 nt, Mycobacterium avium subsp. paratuberculosis
cgguaggcgcaccgccgggcauc

SEQ ID NO: 2835728 - RNA, 15 nt, Mycobacterium avium subsp. paratuberculosis
cgguaggcgcggucg

SEQ ID NO: 2835729 - RNA, 18 nt, Mycobacterium avium subsp. paratuberculosis
cgguaggcgcggucggug

SEQ ID NO: 2835730 - RNA, 13 nt, Mycobacterium avium subsp. paratuberculosis
cgguaggcggcca

SEQ ID NO: 2835731 - RNA, 17 nt, Mycobacterium avium subsp. paratuberculosis
cgguaggcggccagcgc

SEQ ID NO: 2835732 - RNA, 13 nt, Mycobacterium avium subsp. paratuberculosis
cgguaggcggcga

SEQ ID NO: 2835733 - RNA, 15 nt, Mycobacterium avium subsp. paratuberculosis
cgguagggccgguca

SEQ ID NO: 2835734 - RNA, 23 nt, Mycobacterium avium subsp. paratuberculosis
cgguagggucgggugcggcggug

SEQ ID NO: 2835735 - RNA, 21 nt, Mycobacterium avium subsp. paratuberculosis
cgguaggugaucgccucgacc

SEQ ID NO: 2835736 - RNA, 14 nt, Mycobacterium avium subsp. paratuberculosis
cgguaggugccggc

SEQ ID NO: 2835737 - RNA, 15 nt, Mycobacterium avium subsp. paratuberculosis
cgguaggugucgaug

SEQ ID NO: 2835738 - RNA, 17 nt, Mycobacterium avium subsp. paratuberculosis
cgguagugcuugcccug

SEQ ID NO: 2835739 - RNA, 13 nt, Mycobacterium avium subsp. paratuberculosis
cgguaucgagcac

SEQ ID NO: 2835740 - RNA, 17 nt, Mycobacterium avium subsp. paratuberculosis
cgguaucgggucaccgu

SEQ ID NO: 2835741 - RNA, 21 nt, Mycobacterium avium subsp. paratuberculosis
cgguaucgguggauccgguga

SEQ ID NO: 2835742 - RNA, 20 nt, Mycobacterium avium subsp. paratuberculosis
cgguaugcccgggccgucau

SEQ ID NO: 2835743 - RNA, 19 nt, Mycobacterium avium subsp. paratuberculosis
cgguaugcgaucgcgucga

SEQ ID NO: 2835744 - RNA, 17 nt, Mycobacterium avium subsp. paratuberculosis
cgguaugcggcgacgau

SEQ ID NO: 2835745 - RNA, 18 nt, Mycobacterium avium subsp. paratuberculosis
cgguaugcggcgacgauc

SEQ ID NO: 2835746 - RNA, 22 nt, Mycobacterium avium subsp. paratuberculosis
cgguauucgucaccccaccagu

SEQ ID NO: 2835747 - RNA, 21 nt, Mycobacterium avium subsp. paratuberculosis
cggucaaacccauugucgccg

SEQ ID NO: 2835748 - RNA, 18 nt, Mycobacterium avium subsp. paratuberculosis
cggucaacacgaagccgg

SEQ ID NO: 2835749 - RNA, 21 nt, Mycobacterium avium subsp. paratuberculosis
cggucaagaacgaaucgucgc

SEQ ID NO: 2835750 - RNA, 23 nt, Mycobacterium avium subsp. paratuberculosis
cggucaagaacgaaucgucgccg

SEQ ID NO: 2835751 - RNA, 22 nt, Mycobacterium avium subsp. paratuberculosis
cggucaagaacgcaaucgccca

SEQ ID NO: 2835752 - RNA, 18 nt, Mycobacterium avium subsp. paratuberculosis
cggucaagccggccagca

SEQ ID NO: 2835753 - RNA, 19 nt, Mycobacterium avium subsp. paratuberculosis
cggucaagccggccagcag

SEQ ID NO: 2835754 - RNA, 19 nt, Mycobacterium avium subsp. paratuberculosis
cggucaagcgcuuucgccg

SEQ ID NO: 2835755 - RNA, 16 nt, Mycobacterium avium subsp. paratuberculosis
cggucaaguccgcgag

SEQ ID NO: 2835756 - RNA, 13 nt, Mycobacterium avium subsp. paratuberculosis
cggucacagccgc

SEQ ID NO: 2835757 - RNA, 14 nt, Mycobacterium avium subsp. paratuberculosis
cggucaccagcucc

SEQ ID NO: 2835758 - RNA, 23 nt, Mycobacterium avium subsp. paratuberculosis
cggucaccagcucccacgacgac

SEQ ID NO: 2835759 - RNA, 14 nt, Mycobacterium avium subsp. paratuberculosis
cggucaccaucagc

SEQ ID NO: 2835760 - RNA, 18 nt, Mycobacterium avium subsp. paratuberculosis
cggucaccaucagcaccg

SEQ ID NO: 2835761 - RNA, 19 nt, Mycobacterium avium subsp. paratuberculosis
cggucaccaucagcaccgc

SEQ ID NO: 2835762 - RNA, 20 nt, Mycobacterium avium subsp. paratuberculosis
cggucaccaucagcaccgcc

SEQ ID NO: 2835763 - RNA, 13 nt, Mycobacterium avium subsp. paratuberculosis
cggucacccaggc

SEQ ID NO: 2835764 - RNA, 21 nt, Mycobacterium avium subsp. paratuberculosis
cggucaccccgaguucggcca

SEQ ID NO: 2835765 - RNA, 22 nt, Mycobacterium avium subsp. paratuberculosis
cggucaccccgaguucggccag

SEQ ID NO: 2835766 - RNA, 23 nt, Mycobacterium avium subsp. paratuberculosis
cggucaccccggagauccggccg

SEQ ID NO: 2835767 - RNA, 13 nt, Mycobacterium avium subsp. paratuberculosis
cggucaccccggc

SEQ ID NO: 2835768 - RNA, 15 nt, Mycobacterium avium subsp. paratuberculosis
cggucaccccggcca

SEQ ID NO: 2835769 - RNA, 20 nt, Mycobacterium avium subsp. paratuberculosis
cggucacccgguugagcacc

SEQ ID NO: 2835770 - RNA, 15 nt, Mycobacterium avium subsp. paratuberculosis
cggucacccgugggc

SEQ ID NO: 2835771 - RNA, 23 nt, Mycobacterium avium subsp. paratuberculosis
cggucacccgugggccgaccggc

SEQ ID NO: 2835772 - RNA, 15 nt, Mycobacterium avium subsp. paratuberculosis
cggucaccgagcggc

SEQ ID NO: 2835773 - RNA, 17 nt, Mycobacterium avium subsp. paratuberculosis
cggucaccgagcggccg

SEQ ID NO: 2835774 - RNA, 11 nt, Mycobacterium avium subsp. paratuberculosis
cggucaggccg

SEQ ID NO: 2835775 - RNA, 15 nt, Mycobacterium avium subsp. paratuberculosis
cggucaggccggcgc

SEQ ID NO: 2835776 - RNA, 19 nt, Mycobacterium avium subsp. paratuberculosis
cggucaggccggcgccggg

SEQ ID NO: 2835777 - RNA, 12 nt, Mycobacterium avium subsp. paratuberculosis
cggucaggccgu

SEQ ID NO: 2835778 - RNA, 13 nt, Mycobacterium avium subsp. paratuberculosis
cggucaggccguc

SEQ ID NO: 2835779 - RNA, 17 nt, Mycobacterium avium subsp. paratuberculosis
cggucaggccgucucga

SEQ ID NO: 2835780 - RNA, 21 nt, Mycobacterium avium subsp. paratuberculosis
cggucaggccgucucgagccg

SEQ ID NO: 2835781 - RNA, 16 nt, Mycobacterium avium subsp. paratuberculosis
cggucaggcgcagcca

SEQ ID NO: 2835782 - RNA, 18 nt, Mycobacterium avium subsp. paratuberculosis
cggucaggcgcagccagc

SEQ ID NO: 2835783 - RNA, 19 nt, Mycobacterium avium subsp. paratuberculosis
cggucaggcgcagccagcg

SEQ ID NO: 2835784 - RNA, 15 nt, Mycobacterium avium subsp. paratuberculosis
cggucagggccagca

SEQ ID NO: 2835785 - RNA, 16 nt, Mycobacterium avium subsp. paratuberculosis
cggucagggccagcaa

SEQ ID NO: 2835786 - RNA, 15 nt, Mycobacterium avium subsp. paratuberculosis
cggucagggcucgca

SEQ ID NO: 2835787 - RNA, 17 nt, Mycobacterium avium subsp. paratuberculosis
cggucagggugugacgg

SEQ ID NO: 2835788 - RNA, 23 nt, Mycobacterium avium subsp. paratuberculosis
cggucaggguguuguccgagccg

SEQ ID NO: 2835789 - RNA, 22 nt, Mycobacterium avium subsp. paratuberculosis
cggucagguggauggucaccgg

SEQ ID NO: 2835790 - RNA, 18 nt, Mycobacterium avium subsp. paratuberculosis
cggucagguugacgccga

SEQ ID NO: 2835791 - RNA, 21 nt, Mycobacterium avium subsp. paratuberculosis
cggucaguucgucggucacgg

SEQ ID NO: 2835792 - RNA, 16 nt, Mycobacterium avium subsp. paratuberculosis
cggucauaggccgcgc

SEQ ID NO: 2835793 - RNA, 19 nt, Mycobacterium avium subsp. paratuberculosis
cggucauaggccgcgcaga

SEQ ID NO: 2835794 - RNA, 17 nt, Mycobacterium avium subsp. paratuberculosis
cggucauccgggccacc

SEQ ID NO: 2835795 - RNA, 16 nt, Mycobacterium avium subsp. paratuberculosis
cggucauccucgccgc

SEQ ID NO: 2835796 - RNA, 17 nt, Mycobacterium avium subsp. paratuberculosis
cggucauccucgccgcg

SEQ ID NO: 2835797 - RNA, 19 nt, Mycobacterium avium subsp. paratuberculosis
cggucauccucgccgcgcc

SEQ ID NO: 2835798 - RNA, 20 nt, Mycobacterium avium subsp. paratuberculosis
cggucauccucgccgcgcca

SEQ ID NO: 2835799 - RNA, 14 nt, Mycobacterium avium subsp. paratuberculosis
cggucaucgagccg

SEQ ID NO: 2835800 - RNA, 15 nt, Mycobacterium avium subsp. paratuberculosis
cggucaucgagccgg

SEQ ID NO: 2835801 - RNA, 19 nt, Mycobacterium avium subsp. paratuberculosis
cggucaucgugaucgccca

SEQ ID NO: 2835802 - RNA, 23 nt, Mycobacterium avium subsp. paratuberculosis
cggucaugccgagccgcuuggug

SEQ ID NO: 2835803 - RNA, 15 nt, Mycobacterium avium subsp. paratuberculosis
cggucaugcgcgggc

SEQ ID NO: 2835804 - RNA, 16 nt, Mycobacterium avium subsp. paratuberculosis
cggucaugcgcgggca

SEQ ID NO: 2835805 - RNA, 17 nt, Mycobacterium avium subsp. paratuberculosis
cggucaugcgcgggcaa

SEQ ID NO: 2835806 - RNA, 21 nt, Mycobacterium avium subsp. paratuberculosis
cggucauugaucuccgcggcg

SEQ ID NO: 2835807 - RNA, 22 nt, Mycobacterium avium subsp. paratuberculosis
cgguccaacgggcucagcacca

SEQ ID NO: 2835808 - RNA, 23 nt, Mycobacterium avium subsp. paratuberculosis
cgguccaacgggcucagcaccac

SEQ ID NO: 2835809 - RNA, 17 nt, Mycobacterium avium subsp. paratuberculosis
cgguccaccaauggcgg

SEQ ID NO: 2835810 - RNA, 18 nt, Mycobacterium avium subsp. paratuberculosis
cgguccaccaccacaccc

SEQ ID NO: 2835811 - RNA, 13 nt, Mycobacterium avium subsp. paratuberculosis
cgguccaccagaa

SEQ ID NO: 2835812 - RNA, 16 nt, Mycobacterium avium subsp. paratuberculosis
cgguccacgccggcga

SEQ ID NO: 2835813 - RNA, 15 nt, Mycobacterium avium subsp. paratuberculosis
cgguccacggucagc

SEQ ID NO: 2835814 - RNA, 17 nt, Mycobacterium avium subsp. paratuberculosis
cgguccacggucagcgc

SEQ ID NO: 2835815 - RNA, 21 nt, Mycobacterium avium subsp. paratuberculosis
cgguccacggucagcgcgucg

SEQ ID NO: 2835816 - RNA, 24 nt, Mycobacterium avium subsp. paratuberculosis
cgguccacggugucgcuguaggcc

SEQ ID NO: 2835817 - RNA, 15 nt, Mycobacterium avium subsp. paratuberculosis
cgguccacguuggcg

SEQ ID NO: 2835818 - RNA, 17 nt, Mycobacterium avium subsp. paratuberculosis
cgguccacucgucggcg

SEQ ID NO: 2835819 - RNA, 18 nt, Mycobacterium avium subsp. paratuberculosis
cgguccacucgucggcgg

SEQ ID NO: 2835820 - RNA, 19 nt, Mycobacterium avium subsp. paratuberculosis
cgguccacucgucggcggu

SEQ ID NO: 2835821 - RNA, 19 nt, Mycobacterium avium subsp. paratuberculosis
cgguccacuuccgcgcagg

SEQ ID NO: 2835822 - RNA, 18 nt, Mycobacterium avium subsp. paratuberculosis
cgguccagaucggcgcgc

SEQ ID NO: 2835823 - RNA, 20 nt, Mycobacterium avium subsp. paratuberculosis
cgguccagaucggcgcgcgg

SEQ ID NO: 2835824 - RNA, 21 nt, Mycobacterium avium subsp. paratuberculosis
cgguccagcccgguguccacg

SEQ ID NO: 2835825 - RNA, 14 nt, Mycobacterium avium subsp. paratuberculosis
cgguccagccgccg

SEQ ID NO: 2835826 - RNA, 15 nt, Mycobacterium avium subsp. paratuberculosis
cgguccagccgccgc

SEQ ID NO: 2835827 - RNA, 15 nt, Mycobacterium avium subsp. paratuberculosis
cgguccagcgagccc

SEQ ID NO: 2835828 - RNA, 23 nt, Mycobacterium avium subsp. paratuberculosis
cgguccagcguuuccuggugcac

SEQ ID NO: 2835829 - RNA, 21 nt, Mycobacterium avium subsp. paratuberculosis
cgguccaggauccgcaccggg

SEQ ID NO: 2835830 - RNA, 15 nt, Mycobacterium avium subsp. paratuberculosis
cgguccaggcgaccg

SEQ ID NO: 2835831 - RNA, 16 nt, Mycobacterium avium subsp. paratuberculosis
cgguccaggcgaccgg

SEQ ID NO: 2835832 - RNA, 20 nt, Mycobacterium avium subsp. paratuberculosis
cgguccaggcgaccggcccc

SEQ ID NO: 2835833 - RNA, 21 nt, Mycobacterium avium subsp. paratuberculosis
cgguccaggcgaccggcccca

SEQ ID NO: 2835834 - RNA, 20 nt, Mycobacterium avium subsp. paratuberculosis
cgguccagguggccaugggg

SEQ ID NO: 2835835 - RNA, 13 nt, Mycobacterium avium subsp. paratuberculosis
cgguccagguggg

SEQ ID NO: 2835836 - RNA, 18 nt, Mycobacterium avium subsp. paratuberculosis
cgguccaguacaccgcga

SEQ ID NO: 2835837 - RNA, 18 nt, Mycobacterium avium subsp. paratuberculosis
cgguccaguccggccgug

SEQ ID NO: 2835838 - RNA, 19 nt, Mycobacterium avium subsp. paratuberculosis
cgguccaguccggccguga

SEQ ID NO: 2835839 - RNA, 21 nt, Mycobacterium avium subsp. paratuberculosis
cgguccagugccggcgagugc

SEQ ID NO: 2835840 - RNA, 15 nt, Mycobacterium avium subsp. paratuberculosis
cgguccaucagcacc

SEQ ID NO: 2835841 - RNA, 16 nt, Mycobacterium avium subsp. paratuberculosis
cgguccauccagcgcc

SEQ ID NO: 2835842 - RNA, 17 nt, Mycobacterium avium subsp. paratuberculosis
cgguccauccagcgccg

SEQ ID NO: 2835843 - RNA, 20 nt, Mycobacterium avium subsp. paratuberculosis
cgguccaucuccagcuccgc

SEQ ID NO: 2835844 - RNA, 15 nt, Mycobacterium avium subsp. paratuberculosis
cggucccacucggga

SEQ ID NO: 2835845 - RNA, 16 nt, Mycobacterium avium subsp. paratuberculosis
cggucccaguccccgg

SEQ ID NO: 2835846 - RNA, 19 nt, Mycobacterium avium subsp. paratuberculosis
cggucccaguccccgguuc

SEQ ID NO: 2835847 - RNA, 15 nt, Mycobacterium avium subsp. paratuberculosis
cgguccccgcgcccg

SEQ ID NO: 2835848 - RNA, 15 nt, Mycobacterium avium subsp. paratuberculosis
cggucccgacgcggc

SEQ ID NO: 2835849 - RNA, 16 nt, Mycobacterium avium subsp. paratuberculosis
cggucccgacgcggcg

SEQ ID NO: 2835850 - RNA, 14 nt, Mycobacterium avium subsp. paratuberculosis
cggucccgccggug

SEQ ID NO: 2835851 - RNA, 22 nt, Mycobacterium avium subsp. paratuberculosis
cggucccgccggugaucucccg

SEQ ID NO: 2835852 - RNA, 13 nt, Mycobacterium avium subsp. paratuberculosis
cggucccgcggcg

SEQ ID NO: 2835853 - RNA, 17 nt, Mycobacterium avium subsp. paratuberculosis
cggucccgcggcggcgc

SEQ ID NO: 2835854 - RNA, 18 nt, Mycobacterium avium subsp. paratuberculosis
cggucccgcggcggcgcc

SEQ ID NO: 2835855 - RNA, 19 nt, Mycobacterium avium subsp. paratuberculosis
cggucccgcggcggcgcca

SEQ ID NO: 2835856 - RNA, 12 nt, Mycobacterium avium subsp. paratuberculosis
cggucccggcgg

SEQ ID NO: 2835857 - RNA, 19 nt, Mycobacterium avium subsp. paratuberculosis
cggucccggcgggggcggc

SEQ ID NO: 2835858 - RNA, 19 nt, Mycobacterium avium subsp. paratuberculosis
cggucccggggcucgacag

SEQ ID NO: 2835859 - RNA, 16 nt, Mycobacterium avium subsp. paratuberculosis
cggucgagccuggcgc

SEQ ID NO: 2835860 - RNA, 18 nt, Mycobacterium avium subsp. paratuberculosis
cggucgagccuggcgcgc

SEQ ID NO: 2835861 - RNA, 20 nt, Mycobacterium avium subsp. paratuberculosis
cggucgagccuggcgcgcaa

SEQ ID NO: 2835862 - RNA, 14 nt, Mycobacterium avium subsp. paratuberculosis
cggucgagucguag

SEQ ID NO: 2835863 - RNA, 15 nt, Mycobacterium avium subsp. paratuberculosis
cggucgagucguaga

SEQ ID NO: 2835864 - RNA, 23 nt, Mycobacterium avium subsp. paratuberculosis
cggucgagucguagaggggccgg

SEQ ID NO: 2835865 - RNA, 21 nt, Mycobacterium avium subsp. paratuberculosis
cggucgaucaacaccaacgac

SEQ ID NO: 2835866 - RNA, 13 nt, Mycobacterium avium subsp. paratuberculosis
cggucgaucaccu

SEQ ID NO: 2835867 - RNA, 14 nt, Mycobacterium avium subsp. paratuberculosis
cggucgaugacgcc

SEQ ID NO: 2835868 - RNA, 15 nt, Mycobacterium avium subsp. paratuberculosis
cggucgaugacgccg

SEQ ID NO: 2835869 - RNA, 23 nt, Mycobacterium avium subsp. paratuberculosis
cggucgaugacgccgcgccgccc

SEQ ID NO: 2835870 - RNA, 12 nt, Mycobacterium avium subsp. paratuberculosis
cggucgaugagc

SEQ ID NO: 2835871 - RNA, 20 nt, Mycobacterium avium subsp. paratuberculosis
cggucgaugagcuggugcag

SEQ ID NO: 2835872 - RNA, 18 nt, Mycobacterium avium subsp. paratuberculosis
cggucgaugaucuggcgg

SEQ ID NO: 2835873 - RNA, 22 nt, Mycobacterium avium subsp. paratuberculosis
cggucgaugaucuggcgguccc

SEQ ID NO: 2835874 - RNA, 16 nt, Mycobacterium avium subsp. paratuberculosis
cggucgaugugcgcgc

SEQ ID NO: 2835875 - RNA, 14 nt, Mycobacterium avium subsp. paratuberculosis
cggucgcaccgcgg

SEQ ID NO: 2835876 - RNA, 16 nt, Mycobacterium avium subsp. paratuberculosis
cggucgcaccgcggcg

SEQ ID NO: 2835877 - RNA, 19 nt, Mycobacterium avium subsp. paratuberculosis
cggucgcaccgcggcgugg

SEQ ID NO: 2835878 - RNA, 20 nt, Mycobacterium avium subsp. paratuberculosis
cggucgcaccgcggcgugga

SEQ ID NO: 2835879 - RNA, 22 nt, Mycobacterium avium subsp. paratuberculosis
cggucgcacuugaagcugaagc

SEQ ID NO: 2835880 - RNA, 12 nt, Mycobacterium avium subsp. paratuberculosis
cggucgcaggcc

SEQ ID NO: 2835881 - RNA, 15 nt, Mycobacterium avium subsp. paratuberculosis
cggucgcaggccgcc

SEQ ID NO: 2835882 - RNA, 17 nt, Mycobacterium avium subsp. paratuberculosis
cggucgcaggccgcccg

SEQ ID NO: 2835883 - RNA, 18 nt, Mycobacterium avium subsp. paratuberculosis
cggucgcaggccgcccgg

SEQ ID NO: 2835884 - RNA, 15 nt, Mycobacterium avium subsp. paratuberculosis
cggucgccaccacca

SEQ ID NO: 2835885 - RNA, 21 nt, Mycobacterium avium subsp. paratuberculosis
cggucgccaccaccacggggc

SEQ ID NO: 2835886 - RNA, 23 nt, Mycobacterium avium subsp. paratuberculosis
cggucgccaccaccacggggcgg

SEQ ID NO: 2835887 - RNA, 16 nt, Mycobacterium avium subsp. paratuberculosis
cggucgccaccaccag

SEQ ID NO: 2835888 - RNA, 18 nt, Mycobacterium avium subsp. paratuberculosis
cggucgccacucgggcgg

SEQ ID NO: 2835889 - RNA, 22 nt, Mycobacterium avium subsp. paratuberculosis
cggucgccacucgggcggccgc

SEQ ID NO: 2835890 - RNA, 15 nt, Mycobacterium avium subsp. paratuberculosis
cggucgccagcaccg

SEQ ID NO: 2835891 - RNA, 17 nt, Mycobacterium avium subsp. paratuberculosis
cggucgccagcaccgug

SEQ ID NO: 2835892 - RNA, 14 nt, Mycobacterium avium subsp. paratuberculosis
cggucgccagcgcc

SEQ ID NO: 2835893 - RNA, 15 nt, Mycobacterium avium subsp. paratuberculosis
cggucgccagcgcca

SEQ ID NO: 2835894 - RNA, 12 nt, Mycobacterium avium subsp. paratuberculosis
cggucgccccag

SEQ ID NO: 2835895 - RNA, 14 nt, Mycobacterium avium subsp. paratuberculosis
cggucgccccagaa

SEQ ID NO: 2835896 - RNA, 15 nt, Mycobacterium avium subsp. paratuberculosis
cggucgcccccucgg

SEQ ID NO: 2835897 - RNA, 16 nt, Mycobacterium avium subsp. paratuberculosis
cggucgcccccucggc

SEQ ID NO: 2835898 - RNA, 19 nt, Mycobacterium avium subsp. paratuberculosis
cggucgcccccucggccgg

SEQ ID NO: 2835899 - RNA, 20 nt, Mycobacterium avium subsp. paratuberculosis
cggucgcccccucggccggu

SEQ ID NO: 2835900 - RNA, 15 nt, Mycobacterium avium subsp. paratuberculosis
cggucgccccggccg

SEQ ID NO: 2835901 - RNA, 16 nt, Mycobacterium avium subsp. paratuberculosis
cggucgccccggccgc

SEQ ID NO: 2835902 - RNA, 18 nt, Mycobacterium avium subsp. paratuberculosis
cggucgccccggccgcgg

SEQ ID NO: 2835903 - RNA, 20 nt, Mycobacterium avium subsp. paratuberculosis
cggucgccccggccgcggug

SEQ ID NO: 2835904 - RNA, 19 nt, Mycobacterium avium subsp. paratuberculosis
cggucgccgaauccggcgg

SEQ ID NO: 2835905 - RNA, 18 nt, Mycobacterium avium subsp. paratuberculosis
cggucgccgacguagacg

SEQ ID NO: 2835906 - RNA, 20 nt, Mycobacterium avium subsp. paratuberculosis
cggucgccgacucgcaggug

SEQ ID NO: 2835907 - RNA, 19 nt, Mycobacterium avium subsp. paratuberculosis
cggucgccgauggugacgg

SEQ ID NO: 2835908 - RNA, 13 nt, Mycobacterium avium subsp. paratuberculosis
cggucgccgcgcc

SEQ ID NO: 2835909 - RNA, 16 nt, Mycobacterium avium subsp. paratuberculosis
cggucgccgcgccgcc

SEQ ID NO: 2835910 - RNA, 18 nt, Mycobacterium avium subsp. paratuberculosis
cggucgccgcgccgccgg

SEQ ID NO: 2835911 - RNA, 20 nt, Mycobacterium avium subsp. paratuberculosis
cggucgccgcgccgccggug

SEQ ID NO: 2835912 - RNA, 21 nt, Mycobacterium avium subsp. paratuberculosis
cggucgccggcuuaccgaccu

SEQ ID NO: 2835913 - RNA, 19 nt, Mycobacterium avium subsp. paratuberculosis
cggucgccgggccggccgg

SEQ ID NO: 2835914 - RNA, 13 nt, Mycobacterium avium subsp. paratuberculosis
cggucgccggugu

SEQ ID NO: 2835915 - RNA, 14 nt, Mycobacterium avium subsp. paratuberculosis
cggucgccugcuuc

SEQ ID NO: 2835916 - RNA, 15 nt, Mycobacterium avium subsp. paratuberculosis
cggucgcgacccggu

SEQ ID NO: 2835917 - RNA, 14 nt, Mycobacterium avium subsp. paratuberculosis
cggucgcgcagccg

SEQ ID NO: 2835918 - RNA, 15 nt, Mycobacterium avium subsp. paratuberculosis
cggucgcgcagccgc

SEQ ID NO: 2835919 - RNA, 18 nt, Mycobacterium avium subsp. paratuberculosis
cggucgcgcagccgccgg

SEQ ID NO: 2835920 - RNA, 20 nt, Mycobacterium avium subsp. paratuberculosis
cggucgcgcagccgggcggc

SEQ ID NO: 2835921 - RNA, 15 nt, Mycobacterium avium subsp. paratuberculosis
cggucgcgcaucgcc

SEQ ID NO: 2835922 - RNA, 21 nt, Mycobacterium avium subsp. paratuberculosis
cggucgcgcaucgccucggcg

SEQ ID NO: 2835923 - RNA, 20 nt, Mycobacterium avium subsp. paratuberculosis
cggucgcgccgaccuggucg

SEQ ID NO: 2835924 - RNA, 13 nt, Mycobacterium avium subsp. paratuberculosis
cggucgcgcgccg

SEQ ID NO: 2835925 - RNA, 15 nt, Mycobacterium avium subsp. paratuberculosis
cggucgcgcgccggc

SEQ ID NO: 2835926 - RNA, 18 nt, Mycobacterium avium subsp. paratuberculosis
cggucgcggaaccggccg

SEQ ID NO: 2835927 - RNA, 14 nt, Mycobacterium avium subsp. paratuberculosis
cggucgcggcaucc

SEQ ID NO: 2835928 - RNA, 15 nt, Mycobacterium avium subsp. paratuberculosis
cggucgcggcgaucg

SEQ ID NO: 2835929 - RNA, 14 nt, Mycobacterium avium subsp. paratuberculosis
cggucgcggcgccg

SEQ ID NO: 2835930 - RNA, 14 nt, Mycobacterium avium subsp. paratuberculosis
cggucgcggcgucg

SEQ ID NO: 2835931 - RNA, 17 nt, Mycobacterium avium subsp. paratuberculosis
cggucgcggcgucgcgg

SEQ ID NO: 2835932 - RNA, 18 nt, Mycobacterium avium subsp. paratuberculosis
cggucgcggcgucgcggu

SEQ ID NO: 2835933 - RNA, 14 nt, Mycobacterium avium subsp. paratuberculosis
cggucgcgggacaa

SEQ ID NO: 2835934 - RNA, 14 nt, Mycobacterium avium subsp. paratuberculosis
cggucgcggucggc

SEQ ID NO: 2835935 - RNA, 15 nt, Mycobacterium avium subsp. paratuberculosis
cggucgcggucggcg

SEQ ID NO: 2835936 - RNA, 17 nt, Mycobacterium avium subsp. paratuberculosis
cggucgcggucggcgcc

SEQ ID NO: 2835937 - RNA, 23 nt, Mycobacterium avium subsp. paratuberculosis
cggucgcggugaucaggcccucg

SEQ ID NO: 2835938 - RNA, 14 nt, Mycobacterium avium subsp. paratuberculosis
cggucgcggugccc

SEQ ID NO: 2835939 - RNA, 15 nt, Mycobacterium avium subsp. paratuberculosis
cggucgcggugccca

SEQ ID NO: 2835940 - RNA, 18 nt, Mycobacterium avium subsp. paratuberculosis
cggucgcggugcccagcc

SEQ ID NO: 2835941 - RNA, 20 nt, Mycobacterium avium subsp. paratuberculosis
cggucgcggugcccagccgc

SEQ ID NO: 2835942 - RNA, 12 nt, Mycobacterium avium subsp. paratuberculosis
cggucgcggugu

SEQ ID NO: 2835943 - RNA, 19 nt, Mycobacterium avium subsp. paratuberculosis
cggucgcggugucggcguc

SEQ ID NO: 2835944 - RNA, 17 nt, Mycobacterium avium subsp. paratuberculosis
cggucguagucggcccg

SEQ ID NO: 2835945 - RNA, 18 nt, Mycobacterium avium subsp. paratuberculosis
cggucguagucggcccgc

SEQ ID NO: 2835946 - RNA, 20 nt, Mycobacterium avium subsp. paratuberculosis
cggucguagucggcccgccg

SEQ ID NO: 2835947 - RNA, 22 nt, Mycobacterium avium subsp. paratuberculosis
cggucguagucggcccgccggg

SEQ ID NO: 2835948 - RNA, 16 nt, Mycobacterium avium subsp. paratuberculosis
cggucgucgagcaccg

SEQ ID NO: 2835949 - RNA, 19 nt, Mycobacterium avium subsp. paratuberculosis
cggucgucgagcaccggcu

SEQ ID NO: 2835950 - RNA, 18 nt, Mycobacterium avium subsp. paratuberculosis
cggucgucgcccaccgac

SEQ ID NO: 2835951 - RNA, 23 nt, Mycobacterium avium subsp. paratuberculosis
cggucgucgcccaccgacgcggc

SEQ ID NO: 2835952 - RNA, 13 nt, Mycobacterium avium subsp. paratuberculosis
cggucgucgcccg

SEQ ID NO: 2835953 - RNA, 13 nt, Mycobacterium avium subsp. paratuberculosis
cggucgucgccgg

SEQ ID NO: 2835954 - RNA, 16 nt, Mycobacterium avium subsp. paratuberculosis
cggucgucgccggaug

SEQ ID NO: 2835955 - RNA, 19 nt, Mycobacterium avium subsp. paratuberculosis
cggucgucgucgucgguga

SEQ ID NO: 2835956 - RNA, 19 nt, Mycobacterium avium subsp. paratuberculosis
cggucgucuucuuggccgc

SEQ ID NO: 2835957 - RNA, 21 nt, Mycobacterium avium subsp. paratuberculosis
cggucgucuucuuggccgcgg

SEQ ID NO: 2835958 - RNA, 22 nt, Mycobacterium avium subsp. paratuberculosis
cggucgucuucuuggccgcggc

SEQ ID NO: 2835959 - RNA, 13 nt, Mycobacterium avium subsp. paratuberculosis
cggucgugcggcu

SEQ ID NO: 2835960 - RNA, 19 nt, Mycobacterium avium subsp. paratuberculosis
cggucgugcugggccgggc

SEQ ID NO: 2835961 - RNA, 21 nt, Mycobacterium avium subsp. paratuberculosis
cggucgugcugggccgggcgg

SEQ ID NO: 2835962 - RNA, 22 nt, Mycobacterium avium subsp. paratuberculosis
cggucguucgauccgccggugc

SEQ ID NO: 2835963 - RNA, 16 nt, Mycobacterium avium subsp. paratuberculosis
cggucguuggccuccu

SEQ ID NO: 2835964 - RNA, 17 nt, Mycobacterium avium subsp. paratuberculosis
cggucguuggccuccuc

SEQ ID NO: 2835965 - RNA, 19 nt, Mycobacterium avium subsp. paratuberculosis
cggucguuggccuccucgg

SEQ ID NO: 2835966 - RNA, 23 nt, Mycobacterium avium subsp. paratuberculosis
cggucucgaacacgccgucgugg

SEQ ID NO: 2835967 - RNA, 17 nt, Mycobacterium avium subsp. paratuberculosis
cggucucgacaccggcg

SEQ ID NO: 2835968 - RNA, 18 nt, Mycobacterium avium subsp. paratuberculosis
cggucucgacaccggcgg

SEQ ID NO: 2835969 - RNA, 17 nt, Mycobacterium avium subsp. paratuberculosis
cggucucgaccgacugc

SEQ ID NO: 2835970 - RNA, 14 nt, Mycobacterium avium subsp. paratuberculosis
cggucucgaccgcg

SEQ ID NO: 2835971 - RNA, 15 nt, Mycobacterium avium subsp. paratuberculosis
cggucucgaccgcgg

SEQ ID NO: 2835972 - RNA, 18 nt, Mycobacterium avium subsp. paratuberculosis
cggucucgaccgcggcgc

SEQ ID NO: 2835973 - RNA, 19 nt, Mycobacterium avium subsp. paratuberculosis
cggucucgaccgcggcgcc

SEQ ID NO: 2835974 - RNA, 17 nt, Mycobacterium avium subsp. paratuberculosis
cggucucgaucugcacc

SEQ ID NO: 2835975 - RNA, 22 nt, Mycobacterium avium subsp. paratuberculosis
cggucucgaucugcaccagcgc

SEQ ID NO: 2835976 - RNA, 18 nt, Mycobacterium avium subsp. paratuberculosis
cggucucgccccggccgu

SEQ ID NO: 2835977 - RNA, 21 nt, Mycobacterium avium subsp. paratuberculosis
cggucucggcggcgcccagga

SEQ ID NO: 2835978 - RNA, 16 nt, Mycobacterium avium subsp. paratuberculosis
cggucucggucgcggc

SEQ ID NO: 2835979 - RNA, 14 nt, Mycobacterium avium subsp. paratuberculosis
cggucucgguggag

SEQ ID NO: 2835980 - RNA, 13 nt, Mycobacterium avium subsp. paratuberculosis
cggucucuggccu

SEQ ID NO: 2835981 - RNA, 17 nt, Mycobacterium avium subsp. paratuberculosis
cggucugaucgcccagc

SEQ ID NO: 2835982 - RNA, 20 nt, Mycobacterium avium subsp. paratuberculosis
cggucugaucgcccagcacc

SEQ ID NO: 2835983 - RNA, 22 nt, Mycobacterium avium subsp. paratuberculosis
cggucugaucgcccagcaccgc

SEQ ID NO: 2835984 - RNA, 15 nt, Mycobacterium avium subsp. paratuberculosis
cggucugcaccggga

SEQ ID NO: 2835985 - RNA, 17 nt, Mycobacterium avium subsp. paratuberculosis
cggucugcaccgggaug

SEQ ID NO: 2835986 - RNA, 22 nt, Mycobacterium avium subsp. paratuberculosis
cggucugcgccagcuccagcag

SEQ ID NO: 2835987 - RNA, 15 nt, Mycobacterium avium subsp. paratuberculosis
cggucugcgcccgau

SEQ ID NO: 2835988 - RNA, 18 nt, Mycobacterium avium subsp. paratuberculosis
cggucugcgcccgaucgg

SEQ ID NO: 2835989 - RNA, 13 nt, Mycobacterium avium subsp. paratuberculosis
cggucugcggccg

SEQ ID NO: 2835990 - RNA, 16 nt, Mycobacterium avium subsp. paratuberculosis
cggucugcggccgcga

SEQ ID NO: 2835991 - RNA, 13 nt, Mycobacterium avium subsp. paratuberculosis
cggucugcggugc

SEQ ID NO: 2835992 - RNA, 18 nt, Mycobacterium avium subsp. paratuberculosis
cggucugcggugcgccca

SEQ ID NO: 2835993 - RNA, 19 nt, Mycobacterium avium subsp. paratuberculosis
cggucugcggugcgcccag

SEQ ID NO: 2835994 - RNA, 21 nt, Mycobacterium avium subsp. paratuberculosis
cggucugcggugcgcccaggu

SEQ ID NO: 2835995 - RNA, 16 nt, Mycobacterium avium subsp. paratuberculosis
cggucugcgguguggg

SEQ ID NO: 2835996 - RNA, 15 nt, Mycobacterium avium subsp. paratuberculosis
cggucuggcugguga

SEQ ID NO: 2835997 - RNA, 16 nt, Mycobacterium avium subsp. paratuberculosis
cggucuggcuggugac

SEQ ID NO: 2835998 - RNA, 17 nt, Mycobacterium avium subsp. paratuberculosis
cggucugggaggcggcg

SEQ ID NO: 2835999 - RNA, 15 nt, Mycobacterium avium subsp. paratuberculosis
cggucugggcgaacg

SEQ ID NO: 2836000 - RNA, 17 nt, Mycobacterium avium subsp. paratuberculosis
cggucugggcgaacggc

SEQ ID NO: 2836001 - RNA, 15 nt, Mycobacterium avium subsp. paratuberculosis
cggucugggcgacca

SEQ ID NO: 2836002 - RNA, 22 nt, Mycobacterium avium subsp. paratuberculosis
cggucugggcgaccaugccgcg

SEQ ID NO: 2836003 - RNA, 18 nt, Mycobacterium avium subsp. paratuberculosis
cggucugguacccgaugg

SEQ ID NO: 2836004 - RNA, 15 nt, Mycobacterium avium subsp. paratuberculosis
cggucugguggcagc

SEQ ID NO: 2836005 - RNA, 20 nt, Mycobacterium avium subsp. paratuberculosis
cggucugguggcagcggacc

SEQ ID NO: 2836006 - RNA, 22 nt, Mycobacterium avium subsp. paratuberculosis
cggucugguggcagcggacccg

SEQ ID NO: 2836007 - RNA, 14 nt, Mycobacterium avium subsp. paratuberculosis
cggucugucgcgcg

SEQ ID NO: 2836008 - RNA, 15 nt, Mycobacterium avium subsp. paratuberculosis
cggucuucccgccgc

SEQ ID NO: 2836009 - RNA, 16 nt, Mycobacterium avium subsp. paratuberculosis
cggucuucccgccgcc

SEQ ID NO: 2836010 - RNA, 17 nt, Mycobacterium avium subsp. paratuberculosis
cggucuucccgccgccg

SEQ ID NO: 2836011 - RNA, 18 nt, Mycobacterium avium subsp. paratuberculosis
cggucuucccgccgccgu

SEQ ID NO: 2836012 - RNA, 16 nt, Mycobacterium avium subsp. paratuberculosis
cggucuucucggccag

SEQ ID NO: 2836013 - RNA, 17 nt, Mycobacterium avium subsp. paratuberculosis
cggucuucuuggccgcg

SEQ ID NO: 2836014 - RNA, 18 nt, Mycobacterium avium subsp. paratuberculosis
cggucuucuuggccgcgc

SEQ ID NO: 2836015 - RNA, 20 nt, Mycobacterium avium subsp. paratuberculosis
cggucuucuuggccgcgccg

SEQ ID NO: 2836016 - RNA, 23 nt, Mycobacterium avium subsp. paratuberculosis
cggucuugaucaggucgccgauc

SEQ ID NO: 2836017 - RNA, 14 nt, Mycobacterium avium subsp. paratuberculosis
cggucuugcggccg

SEQ ID NO: 2836018 - RNA, 17 nt, Mycobacterium avium subsp. paratuberculosis
cggucuuggacagcagc

SEQ ID NO: 2836019 - RNA, 18 nt, Mycobacterium avium subsp. paratuberculosis
cggucuuggacagcagca

SEQ ID NO: 2836020 - RNA, 21 nt, Mycobacterium avium subsp. paratuberculosis
cggucuuggacagcagcagcu

SEQ ID NO: 2836021 - RNA, 23 nt, Mycobacterium avium subsp. paratuberculosis
cggucuuggacagcagcagcucc

SEQ ID NO: 2836022 - RNA, 18 nt, Mycobacterium avium subsp. paratuberculosis
cggucuuggcggccagcg

SEQ ID NO: 2836023 - RNA, 19 nt, Mycobacterium avium subsp. paratuberculosis
cggucuuggcggccagcgc

SEQ ID NO: 2836024 - RNA, 14 nt, Mycobacterium avium subsp. paratuberculosis
cggucuugggcucg

SEQ ID NO: 2836025 - RNA, 18 nt, Mycobacterium avium subsp. paratuberculosis
cggucuugggcucggcgc

SEQ ID NO: 2836026 - RNA, 22 nt, Mycobacterium avium subsp. paratuberculosis
cggucuugggcucggcgcggga

SEQ ID NO: 2836027 - RNA, 16 nt, Mycobacterium avium subsp. paratuberculosis
cggucuuguugugcug

SEQ ID NO: 2836028 - RNA, 17 nt, Mycobacterium avium subsp. paratuberculosis
cggugacgaggagggug

SEQ ID NO: 2836029 - RNA, 17 nt, Mycobacterium avium subsp. paratuberculosis
cggugacgauccggucg

SEQ ID NO: 2836030 - RNA, 21 nt, Mycobacterium avium subsp. paratuberculosis
cggugacgaugaugucggccg

SEQ ID NO: 2836031 - RNA, 22 nt, Mycobacterium avium subsp. paratuberculosis
cggugacgaugaugucggccgg

SEQ ID NO: 2836032 - RNA, 17 nt, Mycobacterium avium subsp. paratuberculosis
cggugacgaugucgaug

SEQ ID NO: 2836033 - RNA, 21 nt, Mycobacterium avium subsp. paratuberculosis
cggugacgcccuuguccucga

SEQ ID NO: 2836034 - RNA, 12 nt, Mycobacterium avium subsp. paratuberculosis
cggugacgccgg

SEQ ID NO: 2836035 - RNA, 13 nt, Mycobacterium avium subsp. paratuberculosis
cggugacgcgccg

SEQ ID NO: 2836036 - RNA, 15 nt, Mycobacterium avium subsp. paratuberculosis
cggugacgcgccggc

SEQ ID NO: 2836037 - RNA, 16 nt, Mycobacterium avium subsp. paratuberculosis
cggugacgcgccggcc

SEQ ID NO: 2836038 - RNA, 12 nt, Mycobacterium avium subsp. paratuberculosis
cggugacggcgu

SEQ ID NO: 2836039 - RNA, 14 nt, Mycobacterium avium subsp. paratuberculosis
cggugacggcgucg

SEQ ID NO: 2836040 - RNA, 15 nt, Mycobacterium avium subsp. paratuberculosis
cggugacggcgucgg

SEQ ID NO: 2836041 - RNA, 19 nt, Mycobacterium avium subsp. paratuberculosis
cggugacggcgucggcgau

SEQ ID NO: 2836042 - RNA, 21 nt, Mycobacterium avium subsp. paratuberculosis
cggugacggcgucggcgaucu

SEQ ID NO: 2836043 - RNA, 20 nt, Mycobacterium avium subsp. paratuberculosis
cggugacggugugcgggucg

SEQ ID NO: 2836044 - RNA, 20 nt, Mycobacterium avium subsp. paratuberculosis
cggugacuccuccucggcca

SEQ ID NO: 2836045 - RNA, 22 nt, Mycobacterium avium subsp. paratuberculosis
cggugacuccuccucggccagc

SEQ ID NO: 2836046 - RNA, 19 nt, Mycobacterium avium subsp. paratuberculosis
cggugagcaacaccggcac

SEQ ID NO: 2836047 - RNA, 20 nt, Mycobacterium avium subsp. paratuberculosis
cggugagcaacaccggcacg

SEQ ID NO: 2836048 - RNA, 23 nt, Mycobacterium avium subsp. paratuberculosis
cggugagcaacaccggcacgauc

SEQ ID NO: 2836049 - RNA, 13 nt, Mycobacterium avium subsp. paratuberculosis
cggugagcaccgc

SEQ ID NO: 2836050 - RNA, 15 nt, Mycobacterium avium subsp. paratuberculosis
cggugagcaccgccg

SEQ ID NO: 2836051 - RNA, 17 nt, Mycobacterium avium subsp. paratuberculosis
cggugagcaccgggaac

SEQ ID NO: 2836052 - RNA, 22 nt, Mycobacterium avium subsp. paratuberculosis
cggugagcaccgggaacagcca

SEQ ID NO: 2836053 - RNA, 15 nt, Mycobacterium avium subsp. paratuberculosis
cggugagcacgaccg

SEQ ID NO: 2836054 - RNA, 20 nt, Mycobacterium avium subsp. paratuberculosis
cggugagcacgaccgccagc

SEQ ID NO: 2836055 - RNA, 15 nt, Mycobacterium avium subsp. paratuberculosis
cggugagcagcaugc

SEQ ID NO: 2836056 - RNA, 18 nt, Mycobacterium avium subsp. paratuberculosis
cggugagcagcaugccga

SEQ ID NO: 2836057 - RNA, 20 nt, Mycobacterium avium subsp. paratuberculosis
cggugagcagcaugccgagc

SEQ ID NO: 2836058 - RNA, 21 nt, Mycobacterium avium subsp. paratuberculosis
cggugagccgccacagcgccu

SEQ ID NO: 2836059 - RNA, 18 nt, Mycobacterium avium subsp. paratuberculosis
cggugagccgcuggaugu

SEQ ID NO: 2836060 - RNA, 22 nt, Mycobacterium avium subsp. paratuberculosis
cggugagccucagggcgcgcug

SEQ ID NO: 2836061 - RNA, 14 nt, Mycobacterium avium subsp. paratuberculosis
cggugagcgccacc

SEQ ID NO: 2836062 - RNA, 17 nt, Mycobacterium avium subsp. paratuberculosis
cggugagcgccaccccg

SEQ ID NO: 2836063 - RNA, 19 nt, Mycobacterium avium subsp. paratuberculosis
cggugagcgcgccggcccg

SEQ ID NO: 2836064 - RNA, 20 nt, Mycobacterium avium subsp. paratuberculosis
cggugagcgcgccggcccga

SEQ ID NO: 2836065 - RNA, 14 nt, Mycobacterium avium subsp. paratuberculosis
cggugagcgcgucg

SEQ ID NO: 2836066 - RNA, 13 nt, Mycobacterium avium subsp. paratuberculosis
cggugagcggccg

SEQ ID NO: 2836067 - RNA, 14 nt, Mycobacterium avium subsp. paratuberculosis
cggugagcgugguc

SEQ ID NO: 2836068 - RNA, 22 nt, Mycobacterium avium subsp. paratuberculosis
cggugagcugaucgcgucgacg

SEQ ID NO: 2836069 - RNA, 17 nt, Mycobacterium avium subsp. paratuberculosis
cggugagcuggccgcgc

SEQ ID NO: 2836070 - RNA, 19 nt, Mycobacterium avium subsp. paratuberculosis
cggugagcuggccgcgcag

SEQ ID NO: 2836071 - RNA, 21 nt, Mycobacterium avium subsp. paratuberculosis
cggugagcuggccgcgcagcg

SEQ ID NO: 2836072 - RNA, 13 nt, Mycobacterium avium subsp. paratuberculosis
cggugaggcuggg

SEQ ID NO: 2836073 - RNA, 18 nt, Mycobacterium avium subsp. paratuberculosis
cggugaggcuggguugcu

SEQ ID NO: 2836074 - RNA, 23 nt, Mycobacterium avium subsp. paratuberculosis
cggugaggcuggguugcucgccg

SEQ ID NO: 2836075 - RNA, 23 nt, Mycobacterium avium subsp. paratuberculosis
cggugaggguuuccacgugcacg

SEQ ID NO: 2836076 - RNA, 22 nt, Mycobacterium avium subsp. paratuberculosis
cggugagguggcguagucgucg

SEQ ID NO: 2836077 - RNA, 15 nt, Mycobacterium avium subsp. paratuberculosis
cggugaguucaucga

SEQ ID NO: 2836078 - RNA, 21 nt, Mycobacterium avium subsp. paratuberculosis
cggugaguucaucgacgucga

SEQ ID NO: 2836079 - RNA, 13 nt, Mycobacterium avium subsp. paratuberculosis
cggugaucacccg

SEQ ID NO: 2836080 - RNA, 15 nt, Mycobacterium avium subsp. paratuberculosis
cggugaucacccgcc

SEQ ID NO: 2836081 - RNA, 14 nt, Mycobacterium avium subsp. paratuberculosis
cggugaucagcagc

SEQ ID NO: 2836082 - RNA, 15 nt, Mycobacterium avium subsp. paratuberculosis
cggugaucagcagca

SEQ ID NO: 2836083 - RNA, 21 nt, Mycobacterium avium subsp. paratuberculosis
cggugaucaggcccucgucgg

SEQ ID NO: 2836084 - RNA, 20 nt, Mycobacterium avium subsp. paratuberculosis
cggugauccacuccagcacc

SEQ ID NO: 2836085 - RNA, 13 nt, Mycobacterium avium subsp. paratuberculosis
cggugaucccagg

SEQ ID NO: 2836086 - RNA, 22 nt, Mycobacterium avium subsp. paratuberculosis
cggugaucccaggaacgcgccc

SEQ ID NO: 2836087 - RNA, 19 nt, Mycobacterium avium subsp. paratuberculosis
cggugauccgcccggcccg

SEQ ID NO: 2836088 - RNA, 20 nt, Mycobacterium avium subsp. paratuberculosis
cggugauccgcccggcccgc

SEQ ID NO: 2836089 - RNA, 21 nt, Mycobacterium avium subsp. paratuberculosis
cggugaucgacauagucgagg

SEQ ID NO: 2836090 - RNA, 12 nt, Mycobacterium avium subsp. paratuberculosis
cggugaucgccg

SEQ ID NO: 2836091 - RNA, 13 nt, Mycobacterium avium subsp. paratuberculosis
cggugaucgccgc

SEQ ID NO: 2836092 - RNA, 15 nt, Mycobacterium avium subsp. paratuberculosis
cggugaucgccgccc

SEQ ID NO: 2836093 - RNA, 16 nt, Mycobacterium avium subsp. paratuberculosis
cggugaucgccgccca

SEQ ID NO: 2836094 - RNA, 15 nt, Mycobacterium avium subsp. paratuberculosis
cggugaucgcggcgc

SEQ ID NO: 2836095 - RNA, 16 nt, Mycobacterium avium subsp. paratuberculosis
cggugaucgcggcgcu

SEQ ID NO: 2836096 - RNA, 17 nt, Mycobacterium avium subsp. paratuberculosis
cggugaucgcggcgcug

SEQ ID NO: 2836097 - RNA, 18 nt, Mycobacterium avium subsp. paratuberculosis
cggugaucgcggcgcugc

SEQ ID NO: 2836098 - RNA, 20 nt, Mycobacterium avium subsp. paratuberculosis
cggugaucgcggcgcugccg

SEQ ID NO: 2836099 - RNA, 17 nt, Mycobacterium avium subsp. paratuberculosis
cggugaucucaccggcg

SEQ ID NO: 2836100 - RNA, 21 nt, Mycobacterium avium subsp. paratuberculosis
cggugaucucaccggcggcgg

SEQ ID NO: 2836101 - RNA, 17 nt, Mycobacterium avium subsp. paratuberculosis
cggugaucucgucggcg

SEQ ID NO: 2836102 - RNA, 19 nt, Mycobacterium avium subsp. paratuberculosis
cggugaucucgucggcggc

SEQ ID NO: 2836103 - RNA, 21 nt, Mycobacterium avium subsp. paratuberculosis
cggugaucucgucggcggcgg

SEQ ID NO: 2836104 - RNA, 23 nt, Mycobacterium avium subsp. paratuberculosis
cggugaucucgucggcggcggcc

SEQ ID NO: 2836105 - RNA, 15 nt, Mycobacterium avium subsp. paratuberculosis
cggugaucugcacca

SEQ ID NO: 2836106 - RNA, 16 nt, Mycobacterium avium subsp. paratuberculosis
cggugaucugcaccag

SEQ ID NO: 2836107 - RNA, 17 nt, Mycobacterium avium subsp. paratuberculosis
cggugaucugcaccagc

SEQ ID NO: 2836108 - RNA, 18 nt, Mycobacterium avium subsp. paratuberculosis
cggugaucugcaccagcg

SEQ ID NO: 2836109 - RNA, 21 nt, Mycobacterium avium subsp. paratuberculosis
cggugaucugcaccagcgugg

SEQ ID NO: 2836110 - RNA, 16 nt, Mycobacterium avium subsp. paratuberculosis
cggugaugaacgcgcc

SEQ ID NO: 2836111 - RNA, 17 nt, Mycobacterium avium subsp. paratuberculosis
cggugaugaacgcgccg

SEQ ID NO: 2836112 - RNA, 20 nt, Mycobacterium avium subsp. paratuberculosis
cggugcccgggguccaccgg

SEQ ID NO: 2836113 - RNA, 22 nt, Mycobacterium avium subsp. paratuberculosis
cggugcccgggguccaccggcc

SEQ ID NO: 2836114 - RNA, 14 nt, Mycobacterium avium subsp. paratuberculosis
cggugcccgucggc

SEQ ID NO: 2836115 - RNA, 16 nt, Mycobacterium avium subsp. paratuberculosis
cggugcccgucggcaa

SEQ ID NO: 2836116 - RNA, 18 nt, Mycobacterium avium subsp. paratuberculosis
cggugcccgucggcaacg

SEQ ID NO: 2836117 - RNA, 21 nt, Mycobacterium avium subsp. paratuberculosis
cggugcccgucggcaacgccg

SEQ ID NO: 2836118 - RNA, 22 nt, Mycobacterium avium subsp. paratuberculosis
cggugccgaagcgccacggggc

SEQ ID NO: 2836119 - RNA, 23 nt, Mycobacterium avium subsp. paratuberculosis
cggugccgaccugggcggccacc

SEQ ID NO: 2836120 - RNA, 24 nt, Mycobacterium avium subsp. paratuberculosis
cggugccgaccugggcggccaccg

SEQ ID NO: 2836121 - RNA, 16 nt, Mycobacterium avium subsp. paratuberculosis
cggugccgacgauccg

SEQ ID NO: 2836122 - RNA, 18 nt, Mycobacterium avium subsp. paratuberculosis
cggugccgacgauccggg

SEQ ID NO: 2836123 - RNA, 14 nt, Mycobacterium avium subsp. paratuberculosis
cggugccgacgaug

SEQ ID NO: 2836124 - RNA, 20 nt, Mycobacterium avium subsp. paratuberculosis
cggugccgagcacgcggccg

SEQ ID NO: 2836125 - RNA, 17 nt, Mycobacterium avium subsp. paratuberculosis
cggugccgagcccgccg

SEQ ID NO: 2836126 - RNA, 19 nt, Mycobacterium avium subsp. paratuberculosis
cggugccgagcccgccggc

SEQ ID NO: 2836127 - RNA, 22 nt, Mycobacterium avium subsp. paratuberculosis
cggugccgagcccgccggcggc

SEQ ID NO: 2836128 - RNA, 15 nt, Mycobacterium avium subsp. paratuberculosis
cggugccgagcgcgc

SEQ ID NO: 2836129 - RNA, 17 nt, Mycobacterium avium subsp. paratuberculosis
cggugccgaggcaguuc

SEQ ID NO: 2836130 - RNA, 18 nt, Mycobacterium avium subsp. paratuberculosis
cggugccgaguucgaccu

SEQ ID NO: 2836131 - RNA, 21 nt, Mycobacterium avium subsp. paratuberculosis
cggugccgaguucgaccucgg

SEQ ID NO: 2836132 - RNA, 13 nt, Mycobacterium avium subsp. paratuberculosis
cggugccgauccg

SEQ ID NO: 2836133 - RNA, 15 nt, Mycobacterium avium subsp. paratuberculosis
cggugccgcagccgu

SEQ ID NO: 2836134 - RNA, 16 nt, Mycobacterium avium subsp. paratuberculosis
cggugccgcagcucga

SEQ ID NO: 2836135 - RNA, 23 nt, Mycobacterium avium subsp. paratuberculosis
cggugccgcagcucgaucaccca

SEQ ID NO: 2836136 - RNA, 20 nt, Mycobacterium avium subsp. paratuberculosis
cggugccgcagugccggcgc

SEQ ID NO: 2836137 - RNA, 12 nt, Mycobacterium avium subsp. paratuberculosis
cggugccgccgu

SEQ ID NO: 2836138 - RNA, 14 nt, Mycobacterium avium subsp. paratuberculosis
cggugccgccgugc

SEQ ID NO: 2836139 - RNA, 18 nt, Mycobacterium avium subsp. paratuberculosis
cggugccgccgugcgcgg

SEQ ID NO: 2836140 - RNA, 19 nt, Mycobacterium avium subsp. paratuberculosis
cggugccgccgugcgcggc

SEQ ID NO: 2836141 - RNA, 20 nt, Mycobacterium avium subsp. paratuberculosis
cggugccgccgugcgcggcg

SEQ ID NO: 2836142 - RNA, 23 nt, Mycobacterium avium subsp. paratuberculosis
cggugccgccgugcgcggcgacc

SEQ ID NO: 2836143 - RNA, 12 nt, Mycobacterium avium subsp. paratuberculosis
cggugccgcggc

SEQ ID NO: 2836144 - RNA, 14 nt, Mycobacterium avium subsp. paratuberculosis
cggugccgcggcgc

SEQ ID NO: 2836145 - RNA, 19 nt, Mycobacterium avium subsp. paratuberculosis
cggugccgcggcggcgccg

SEQ ID NO: 2836146 - RNA, 20 nt, Mycobacterium avium subsp. paratuberculosis
cggugccgcggcggcgccga

SEQ ID NO: 2836147 - RNA, 16 nt, Mycobacterium avium subsp. paratuberculosis
cggugccgcguucgga

SEQ ID NO: 2836148 - RNA, 12 nt, Mycobacterium avium subsp. paratuberculosis
cggugccgcugg

SEQ ID NO: 2836149 - RNA, 13 nt, Mycobacterium avium subsp. paratuberculosis
cggugccggccca

SEQ ID NO: 2836150 - RNA, 15 nt, Mycobacterium avium subsp. paratuberculosis
cggugccggcccagu

SEQ ID NO: 2836151 - RNA, 17 nt, Mycobacterium avium subsp. paratuberculosis
cggugccggcccagugg

SEQ ID NO: 2836152 - RNA, 16 nt, Mycobacterium avium subsp. paratuberculosis
cggugccggccggguc

SEQ ID NO: 2836153 - RNA, 21 nt, Mycobacterium avium subsp. paratuberculosis
cggugccggccgggucgaccg

SEQ ID NO: 2836154 - RNA, 13 nt, Mycobacterium avium subsp. paratuberculosis
cggugccgggugc

SEQ ID NO: 2836155 - RNA, 16 nt, Mycobacterium avium subsp. paratuberculosis
cggugccgggugcuga

SEQ ID NO: 2836156 - RNA, 20 nt, Mycobacterium avium subsp. paratuberculosis
cggugccguccucggccgcc

SEQ ID NO: 2836157 - RNA, 21 nt, Mycobacterium avium subsp. paratuberculosis
cggugccguccucggccgcca

SEQ ID NO: 2836158 - RNA, 15 nt, Mycobacterium avium subsp. paratuberculosis
cggugccgucgaucg

SEQ ID NO: 2836159 - RNA, 17 nt, Mycobacterium avium subsp. paratuberculosis
cggugccgucgaucgcc

SEQ ID NO: 2836160 - RNA, 20 nt, Mycobacterium avium subsp. paratuberculosis
cggugccguugaucagggcg

SEQ ID NO: 2836161 - RNA, 19 nt, Mycobacterium avium subsp. paratuberculosis
cggugccucuucgucggcc

SEQ ID NO: 2836162 - RNA, 19 nt, Mycobacterium avium subsp. paratuberculosis
cggugcgaaaauggcugcc

SEQ ID NO: 2836163 - RNA, 13 nt, Mycobacterium avium subsp. paratuberculosis
cggugcgagccgc

SEQ ID NO: 2836164 - RNA, 23 nt, Mycobacterium avium subsp. paratuberculosis
cggugcgaugguggucgccgucg

SEQ ID NO: 2836165 - RNA, 14 nt, Mycobacterium avium subsp. paratuberculosis
cggugcgcaccccg

SEQ ID NO: 2836166 - RNA, 23 nt, Mycobacterium avium subsp. paratuberculosis
cggugcgcaccccguugccgccg

SEQ ID NO: 2836167 - RNA, 16 nt, Mycobacterium avium subsp. paratuberculosis
cggugcgcaccgacau

SEQ ID NO: 2836168 - RNA, 18 nt, Mycobacterium avium subsp. paratuberculosis
cggugcgcaccgacauca

SEQ ID NO: 2836169 - RNA, 12 nt, Mycobacterium avium subsp. paratuberculosis
cggugcgcagca

SEQ ID NO: 2836170 - RNA, 13 nt, Mycobacterium avium subsp. paratuberculosis
cggugcgcagcac

SEQ ID NO: 2836171 - RNA, 21 nt, Mycobacterium avium subsp. paratuberculosis
cggugcgcagccgcugcagcg

SEQ ID NO: 2836172 - RNA, 24 nt, Mycobacterium avium subsp. paratuberculosis
cggugcgcagccgcugcagcgccg

SEQ ID NO: 2836173 - RNA, 16 nt, Mycobacterium avium subsp. paratuberculosis
cggugcgcagucgcug

SEQ ID NO: 2836174 - RNA, 17 nt, Mycobacterium avium subsp. paratuberculosis
cggugcgcagucgcugg

SEQ ID NO: 2836175 - RNA, 21 nt, Mycobacterium avium subsp. paratuberculosis
cggugcgcagucgcuggucga

SEQ ID NO: 2836176 - RNA, 17 nt, Mycobacterium avium subsp. paratuberculosis
cggugcgccacgcccgc

SEQ ID NO: 2836177 - RNA, 20 nt, Mycobacterium avium subsp. paratuberculosis
cggugcgccacgcccgcagc

SEQ ID NO: 2836178 - RNA, 23 nt, Mycobacterium avium subsp. paratuberculosis
cggugcgccacgcccgcagcgca

SEQ ID NO: 2836179 - RNA, 17 nt, Mycobacterium avium subsp. paratuberculosis
cggugcgccagaucagc

SEQ ID NO: 2836180 - RNA, 23 nt, Mycobacterium avium subsp. paratuberculosis
cggugcgccagaucagcgugguc

SEQ ID NO: 2836181 - RNA, 13 nt, Mycobacterium avium subsp. paratuberculosis
cggugcgccagcg

SEQ ID NO: 2836182 - RNA, 15 nt, Mycobacterium avium subsp. paratuberculosis
cggugcgccagcgcc

SEQ ID NO: 2836183 - RNA, 17 nt, Mycobacterium avium subsp. paratuberculosis
cggugcgccagcgccgg

SEQ ID NO: 2836184 - RNA, 16 nt, Mycobacterium avium subsp. paratuberculosis
cggugcgccagcguga

SEQ ID NO: 2836185 - RNA, 21 nt, Mycobacterium avium subsp. paratuberculosis
cggugcgccagcgugaacagc

SEQ ID NO: 2836186 - RNA, 23 nt, Mycobacterium avium subsp. paratuberculosis
cggugcgcccagguacuccucgg

SEQ ID NO: 2836187 - RNA, 22 nt, Mycobacterium avium subsp. paratuberculosis
cggugcgcccgcgaucaacacc

SEQ ID NO: 2836188 - RNA, 19 nt, Mycobacterium avium subsp. paratuberculosis
cggugcgcccgucgucgcc

SEQ ID NO: 2836189 - RNA, 21 nt, Mycobacterium avium subsp. paratuberculosis
cggugcgcccgucgucgccga

SEQ ID NO: 2836190 - RNA, 12 nt, Mycobacterium avium subsp. paratuberculosis
cggugcgccgac

SEQ ID NO: 2836191 - RNA, 16 nt, Mycobacterium avium subsp. paratuberculosis
cggugcgccgacagcu

SEQ ID NO: 2836192 - RNA, 17 nt, Mycobacterium avium subsp. paratuberculosis
cggugcgccgacagcug

SEQ ID NO: 2836193 - RNA, 21 nt, Mycobacterium avium subsp. paratuberculosis
cggugcgccgacagcugagca

SEQ ID NO: 2836194 - RNA, 23 nt, Mycobacterium avium subsp. paratuberculosis
cggugcgccgacagcugagcagc

SEQ ID NO: 2836195 - RNA, 14 nt, Mycobacterium avium subsp. paratuberculosis
cggugcgccgaccg

SEQ ID NO: 2836196 - RNA, 17 nt, Mycobacterium avium subsp. paratuberculosis
cgguggaauucuggccg

SEQ ID NO: 2836197 - RNA, 18 nt, Mycobacterium avium subsp. paratuberculosis
cgguggaauucuggccga

SEQ ID NO: 2836198 - RNA, 21 nt, Mycobacterium avium subsp. paratuberculosis
cgguggaauucuggccgaccg

SEQ ID NO: 2836199 - RNA, 13 nt, Mycobacterium avium subsp. paratuberculosis
cgguggacagcgc

SEQ ID NO: 2836200 - RNA, 16 nt, Mycobacterium avium subsp. paratuberculosis
cgguggacagcgcgac

SEQ ID NO: 2836201 - RNA, 16 nt, Mycobacterium avium subsp. paratuberculosis
cgguggacagguagcg

SEQ ID NO: 2836202 - RNA, 12 nt, Mycobacterium avium subsp. paratuberculosis
cgguggacccga

SEQ ID NO: 2836203 - RNA, 23 nt, Mycobacterium avium subsp. paratuberculosis
cgguggacgaggugaccggcgag

SEQ ID NO: 2836204 - RNA, 15 nt, Mycobacterium avium subsp. paratuberculosis
cgguggacgccgcgc

SEQ ID NO: 2836205 - RNA, 17 nt, Mycobacterium avium subsp. paratuberculosis
cgguggacgccgcgcac

SEQ ID NO: 2836206 - RNA, 19 nt, Mycobacterium avium subsp. paratuberculosis
cgguggacgccgcgcacga

SEQ ID NO: 2836207 - RNA, 14 nt, Mycobacterium avium subsp. paratuberculosis
cgguggacgcgaug

SEQ ID NO: 2836208 - RNA, 19 nt, Mycobacterium avium subsp. paratuberculosis
cgguggacgcggucgccgc

SEQ ID NO: 2836209 - RNA, 17 nt, Mycobacterium avium subsp. paratuberculosis
cgguggacuccagcacc

SEQ ID NO: 2836210 - RNA, 19 nt, Mycobacterium avium subsp. paratuberculosis
cgguggacuccagcaccag

SEQ ID NO: 2836211 - RNA, 20 nt, Mycobacterium avium subsp. paratuberculosis
cgguggacuccagcaccagc

SEQ ID NO: 2836212 - RNA, 22 nt, Mycobacterium avium subsp. paratuberculosis
cgguggacuccagcaccagcac

SEQ ID NO: 2836213 - RNA, 19 nt, Mycobacterium avium subsp. paratuberculosis
cgguggagauggccagcac

SEQ ID NO: 2836214 - RNA, 22 nt, Mycobacterium avium subsp. paratuberculosis
cgguggagauggccagcaccac

SEQ ID NO: 2836215 - RNA, 14 nt, Mycobacterium avium subsp. paratuberculosis
cgguggagcacagc

SEQ ID NO: 2836216 - RNA, 17 nt, Mycobacterium avium subsp. paratuberculosis
cgguggagcacagcacg

SEQ ID NO: 2836217 - RNA, 13 nt, Mycobacterium avium subsp. paratuberculosis
cgguggagcgcgg

SEQ ID NO: 2836218 - RNA, 15 nt, Mycobacterium avium subsp. paratuberculosis
cgguggagcgcggca

SEQ ID NO: 2836219 - RNA, 17 nt, Mycobacterium avium subsp. paratuberculosis
cgguggagcgcggcaug

SEQ ID NO: 2836220 - RNA, 12 nt, Mycobacterium avium subsp. paratuberculosis
cgguggagcggc

SEQ ID NO: 2836221 - RNA, 17 nt, Mycobacterium avium subsp. paratuberculosis
cgguggagcggcccagc

SEQ ID NO: 2836222 - RNA, 19 nt, Mycobacterium avium subsp. paratuberculosis
cgguggauauuucgcggcc

SEQ ID NO: 2836223 - RNA, 20 nt, Mycobacterium avium subsp. paratuberculosis
cgguggauauuucgcggccg

SEQ ID NO: 2836224 - RNA, 21 nt, Mycobacterium avium subsp. paratuberculosis
cgguggauauuucgcggccga

SEQ ID NO: 2836225 - RNA, 19 nt, Mycobacterium avium subsp. paratuberculosis
cgguggauccggugaccgc

SEQ ID NO: 2836226 - RNA, 15 nt, Mycobacterium avium subsp. paratuberculosis
cgguggaugggcucg

SEQ ID NO: 2836227 - RNA, 18 nt, Mycobacterium avium subsp. paratuberculosis
cgguggcaccccgcgccg

SEQ ID NO: 2836228 - RNA, 19 nt, Mycobacterium avium subsp. paratuberculosis
cgguggcaccccgcgccgg

SEQ ID NO: 2836229 - RNA, 21 nt, Mycobacterium avium subsp. paratuberculosis
cgguggcaccccgcgccgggc

SEQ ID NO: 2836230 - RNA, 16 nt, Mycobacterium avium subsp. paratuberculosis
cgguggcagcccggcu

SEQ ID NO: 2836231 - RNA, 15 nt, Mycobacterium avium subsp. paratuberculosis
cgguggccaccaccg

SEQ ID NO: 2836232 - RNA, 12 nt, Mycobacterium avium subsp. paratuberculosis
cgguggccaccg

SEQ ID NO: 2836233 - RNA, 15 nt, Mycobacterium avium subsp. paratuberculosis
cgguggccaccgcga

SEQ ID NO: 2836234 - RNA, 17 nt, Mycobacterium avium subsp. paratuberculosis
cgguggccaccgcgacg

SEQ ID NO: 2836235 - RNA, 20 nt, Mycobacterium avium subsp. paratuberculosis
cgguggccaccgcgacgccc

SEQ ID NO: 2836236 - RNA, 22 nt, Mycobacterium avium subsp. paratuberculosis
cgguggccaccuuggacaggcc

SEQ ID NO: 2836237 - RNA, 15 nt, Mycobacterium avium subsp. paratuberculosis
cgguggccacggcgu

SEQ ID NO: 2836238 - RNA, 18 nt, Mycobacterium avium subsp. paratuberculosis
cgguggccacggcguuga

SEQ ID NO: 2836239 - RNA, 12 nt, Mycobacterium avium subsp. paratuberculosis
cgguggccagca

SEQ ID NO: 2836240 - RNA, 14 nt, Mycobacterium avium subsp. paratuberculosis
cgguggccagcagg

SEQ ID NO: 2836241 - RNA, 17 nt, Mycobacterium avium subsp. paratuberculosis
cgguggccagcaggguc

SEQ ID NO: 2836242 - RNA, 20 nt, Mycobacterium avium subsp. paratuberculosis
cgguggccaugcgcgagucg

SEQ ID NO: 2836243 - RNA, 19 nt, Mycobacterium avium subsp. paratuberculosis
cgguggcccagccggccga

SEQ ID NO: 2836244 - RNA, 20 nt, Mycobacterium avium subsp. paratuberculosis
cgguggcccagccggccgac

SEQ ID NO: 2836245 - RNA, 22 nt, Mycobacterium avium subsp. paratuberculosis
cgguggcccagccggccgacgc

SEQ ID NO: 2836246 - RNA, 15 nt, Mycobacterium avium subsp. paratuberculosis
cgguggcccccacca

SEQ ID NO: 2836247 - RNA, 23 nt, Mycobacterium avium subsp. paratuberculosis
cgguggcccccaccacgaagcug

SEQ ID NO: 2836248 - RNA, 16 nt, Mycobacterium avium subsp. paratuberculosis
cgguggccccgggccg

SEQ ID NO: 2836249 - RNA, 19 nt, Mycobacterium avium subsp. paratuberculosis
cgguggccccgggccgcag

SEQ ID NO: 2836250 - RNA, 22 nt, Mycobacterium avium subsp. paratuberculosis
cgguggccccgggccgcagggu

SEQ ID NO: 2836251 - RNA, 12 nt, Mycobacterium avium subsp. paratuberculosis
cgguggcccggu

SEQ ID NO: 2836252 - RNA, 22 nt, Mycobacterium avium subsp. paratuberculosis
cgguggcccgguacagcgccgc

SEQ ID NO: 2836253 - RNA, 18 nt, Mycobacterium avium subsp. paratuberculosis
cgguggcccggucgucga

SEQ ID NO: 2836254 - RNA, 21 nt, Mycobacterium avium subsp. paratuberculosis
cgguggcccggucgucgagca

SEQ ID NO: 2836255 - RNA, 12 nt, Mycobacterium avium subsp. paratuberculosis
cgguggccgcca

SEQ ID NO: 2836256 - RNA, 14 nt, Mycobacterium avium subsp. paratuberculosis
cgguggccgccacc

SEQ ID NO: 2836257 - RNA, 17 nt, Mycobacterium avium subsp. paratuberculosis
cgguggccgccaccaac

SEQ ID NO: 2836258 - RNA, 13 nt, Mycobacterium avium subsp. paratuberculosis
cgguggccgccgg

SEQ ID NO: 2836259 - RNA, 12 nt, Mycobacterium avium subsp. paratuberculosis
cgguggccgcga

SEQ ID NO: 2836260 - RNA, 16 nt, Mycobacterium avium subsp. paratuberculosis
cgguggccgcgcuggu

SEQ ID NO: 2836261 - RNA, 18 nt, Mycobacterium avium subsp. paratuberculosis
cgguggccgcgucgacca

SEQ ID NO: 2836262 - RNA, 23 nt, Mycobacterium avium subsp. paratuberculosis
cgguggccgguauacccccggug

SEQ ID NO: 2836263 - RNA, 20 nt, Mycobacterium avium subsp. paratuberculosis
cgguggccggugggcggcgc

SEQ ID NO: 2836264 - RNA, 18 nt, Mycobacterium avium subsp. paratuberculosis
cgguggccgucucgucgg

SEQ ID NO: 2836265 - RNA, 22 nt, Mycobacterium avium subsp. paratuberculosis
cgguggccucgcgcaaugccgc

SEQ ID NO: 2836266 - RNA, 20 nt, Mycobacterium avium subsp. paratuberculosis
cgguggccucggcgcugccc

SEQ ID NO: 2836267 - RNA, 16 nt, Mycobacterium avium subsp. paratuberculosis
cgguggccugcccggc

SEQ ID NO: 2836268 - RNA, 17 nt, Mycobacterium avium subsp. paratuberculosis
cgguggccugcccggcg

SEQ ID NO: 2836269 - RNA, 18 nt, Mycobacterium avium subsp. paratuberculosis
cgguggccugcccggcgg

SEQ ID NO: 2836270 - RNA, 21 nt, Mycobacterium avium subsp. paratuberculosis
cgguggccugcccggcggugc

SEQ ID NO: 2836271 - RNA, 18 nt, Mycobacterium avium subsp. paratuberculosis
cgguggccuggucgaaca

SEQ ID NO: 2836272 - RNA, 19 nt, Mycobacterium avium subsp. paratuberculosis
cgguggccuggucggcgac

SEQ ID NO: 2836273 - RNA, 20 nt, Mycobacterium avium subsp. paratuberculosis
cgguggccuggucggcgacc

SEQ ID NO: 2836274 - RNA, 18 nt, Mycobacterium avium subsp. paratuberculosis
cgguggccuuggccacca

SEQ ID NO: 2836275 - RNA, 21 nt, Mycobacterium avium subsp. paratuberculosis
cgguggccuuggccaccacgc

SEQ ID NO: 2836276 - RNA, 17 nt, Mycobacterium avium subsp. paratuberculosis
cgguggcgaagcacgac

SEQ ID NO: 2836277 - RNA, 19 nt, Mycobacterium avium subsp. paratuberculosis
cgguggcgaaguugaucgg

SEQ ID NO: 2836278 - RNA, 14 nt, Mycobacterium avium subsp. paratuberculosis
cgguggcgacaaca

SEQ ID NO: 2836279 - RNA, 18 nt, Mycobacterium avium subsp. paratuberculosis
cgguggcgacaacaggcg

SEQ ID NO: 2836280 - RNA, 16 nt, Mycobacterium avium subsp. paratuberculosis
cggugggggccaggcg

SEQ ID NO: 2836281 - RNA, 19 nt, Mycobacterium avium subsp. paratuberculosis
cgguggggugaggcacccg

SEQ ID NO: 2836282 - RNA, 22 nt, Mycobacterium avium subsp. paratuberculosis
cgguggggugaggcacccgcug

SEQ ID NO: 2836283 - RNA, 16 nt, Mycobacterium avium subsp. paratuberculosis
cgguggggugaugagg

SEQ ID NO: 2836284 - RNA, 14 nt, Mycobacterium avium subsp. paratuberculosis
cgguggguccgccg

SEQ ID NO: 2836285 - RNA, 19 nt, Mycobacterium avium subsp. paratuberculosis
cgguggguccgccgggcgc

SEQ ID NO: 2836286 - RNA, 14 nt, Mycobacterium avium subsp. paratuberculosis
cgguggucaacgcg

SEQ ID NO: 2836287 - RNA, 15 nt, Mycobacterium avium subsp. paratuberculosis
cgguggucagcggcg

SEQ ID NO: 2836288 - RNA, 16 nt, Mycobacterium avium subsp. paratuberculosis
cgguggucgaaaucgc

SEQ ID NO: 2836289 - RNA, 13 nt, Mycobacterium avium subsp. paratuberculosis
cgguggucgaaca

SEQ ID NO: 2836290 - RNA, 12 nt, Mycobacterium avium subsp. paratuberculosis
cgguggucgacg

SEQ ID NO: 2836291 - RNA, 19 nt, Mycobacterium avium subsp. paratuberculosis
cgguggucgacgagcccgc

SEQ ID NO: 2836292 - RNA, 13 nt, Mycobacterium avium subsp. paratuberculosis
cgguggucggcgu

SEQ ID NO: 2836293 - RNA, 18 nt, Mycobacterium avium subsp. paratuberculosis
cgguggugaacgcgucgg

SEQ ID NO: 2836294 - RNA, 21 nt, Mycobacterium avium subsp. paratuberculosis
cgguggugaacgcgucgguca

SEQ ID NO: 2836295 - RNA, 13 nt, Mycobacterium avium subsp. paratuberculosis
cgguggugacggu

SEQ ID NO: 2836296 - RNA, 12 nt, Mycobacterium avium subsp. paratuberculosis
cgguggugaucg

SEQ ID NO: 2836297 - RNA, 15 nt, Mycobacterium avium subsp. paratuberculosis
cgguggugcaccggu

SEQ ID NO: 2836298 - RNA, 12 nt, Mycobacterium avium subsp. paratuberculosis
cgguggugccgc

SEQ ID NO: 2836299 - RNA, 21 nt, Mycobacterium avium subsp. paratuberculosis
cgguggugccgccgucgacga

SEQ ID NO: 2836300 - RNA, 14 nt, Mycobacterium avium subsp. paratuberculosis
cgguggugcggccc

SEQ ID NO: 2836301 - RNA, 17 nt, Mycobacterium avium subsp. paratuberculosis
cgguggugcggcccugu

SEQ ID NO: 2836302 - RNA, 13 nt, Mycobacterium avium subsp. paratuberculosis
cggugguggcgaa

SEQ ID NO: 2836303 - RNA, 22 nt, Mycobacterium avium subsp. paratuberculosis
cggugguggcgaacagcggguu

SEQ ID NO: 2836304 - RNA, 13 nt, Mycobacterium avium subsp. paratuberculosis
cgguggugggcgc

SEQ ID NO: 2836305 - RNA, 15 nt, Mycobacterium avium subsp. paratuberculosis
cgguggugggcgcgg

SEQ ID NO: 2836306 - RNA, 19 nt, Mycobacterium avium subsp. paratuberculosis
cggugguggggccggcgaa

SEQ ID NO: 2836307 - RNA, 12 nt, Mycobacterium avium subsp. paratuberculosis
cgguggugucga

SEQ ID NO: 2836308 - RNA, 15 nt, Mycobacterium avium subsp. paratuberculosis
cgguggugucgacgg

SEQ ID NO: 2836309 - RNA, 20 nt, Mycobacterium avium subsp. paratuberculosis
cgguggugucgucgggccgc

SEQ ID NO: 2836310 - RNA, 22 nt, Mycobacterium avium subsp. paratuberculosis
cgguggugucgucgggccgcag

SEQ ID NO: 2836311 - RNA, 21 nt, Mycobacterium avium subsp. paratuberculosis
cggugguguggaucuccagca

SEQ ID NO: 2836312 - RNA, 22 nt, Mycobacterium avium subsp. paratuberculosis
cggugguguggaucuccagcag

SEQ ID NO: 2836313 - RNA, 12 nt, Mycobacterium avium subsp. paratuberculosis
cggugguguggc

SEQ ID NO: 2836314 - RNA, 16 nt, Mycobacterium avium subsp. paratuberculosis
cggugguguggcaggu

SEQ ID NO: 2836315 - RNA, 17 nt, Mycobacterium avium subsp. paratuberculosis
cggugguguggcaggug

SEQ ID NO: 2836316 - RNA, 21 nt, Mycobacterium avium subsp. paratuberculosis
cggugguguugcgguggucgg

SEQ ID NO: 2836317 - RNA, 22 nt, Mycobacterium avium subsp. paratuberculosis
cggugguuaccagcucaccggg

SEQ ID NO: 2836318 - RNA, 14 nt, Mycobacterium avium subsp. paratuberculosis
cggugguucgcgcg

SEQ ID NO: 2836319 - RNA, 21 nt, Mycobacterium avium subsp. paratuberculosis
cggugguugggguuggaaggg

SEQ ID NO: 2836320 - RNA, 17 nt, Mycobacterium avium subsp. paratuberculosis
cggugguuuugcggccc

SEQ ID NO: 2836321 - RNA, 22 nt, Mycobacterium avium subsp. paratuberculosis
cggugguuuugcggcccugcag

SEQ ID NO: 2836322 - RNA, 13 nt, Mycobacterium avium subsp. paratuberculosis
cgguguacagcgc

SEQ ID NO: 2836323 - RNA, 14 nt, Mycobacterium avium subsp. paratuberculosis
cgguguacagcgcc

SEQ ID NO: 2836324 - RNA, 18 nt, Mycobacterium avium subsp. paratuberculosis
cgguguacagcgcgccgc

SEQ ID NO: 2836325 - RNA, 20 nt, Mycobacterium avium subsp. paratuberculosis
cgguguacagcgcgccgcgg

SEQ ID NO: 2836326 - RNA, 22 nt, Mycobacterium avium subsp. paratuberculosis
cgguguacucaaaccgggccug

SEQ ID NO: 2836327 - RNA, 15 nt, Mycobacterium avium subsp. paratuberculosis
cgguguagacgcggg

SEQ ID NO: 2836328 - RNA, 19 nt, Mycobacterium avium subsp. paratuberculosis
cgguguagacgcgggccgg

SEQ ID NO: 2836329 - RNA, 23 nt, Mycobacterium avium subsp. paratuberculosis
cgguguagacgcgggccggcacc

SEQ ID NO: 2836330 - RNA, 18 nt, Mycobacterium avium subsp. paratuberculosis
cgguguagagcaccucga

SEQ ID NO: 2836331 - RNA, 22 nt, Mycobacterium avium subsp. paratuberculosis
cgguguagaucggcucaccgaa

SEQ ID NO: 2836332 - RNA, 15 nt, Mycobacterium avium subsp. paratuberculosis
cgguguagcccuccc

SEQ ID NO: 2836333 - RNA, 19 nt, Mycobacterium avium subsp. paratuberculosis
cgguguagcgagugccggc

SEQ ID NO: 2836334 - RNA, 20 nt, Mycobacterium avium subsp. paratuberculosis
cgguguagcgagugccggcc

SEQ ID NO: 2836335 - RNA, 22 nt, Mycobacterium avium subsp. paratuberculosis
cgguguagcgagugccggccag

SEQ ID NO: 2836336 - RNA, 13 nt, Mycobacterium avium subsp. paratuberculosis
cgguguagcggcg

SEQ ID NO: 2836337 - RNA, 15 nt, Mycobacterium avium subsp. paratuberculosis
cgguguagcggcggc

SEQ ID NO: 2836338 - RNA, 16 nt, Mycobacterium avium subsp. paratuberculosis
cgguguagcggcggcu

SEQ ID NO: 2836339 - RNA, 15 nt, Mycobacterium avium subsp. paratuberculosis
cgguguaggacgccg

SEQ ID NO: 2836340 - RNA, 16 nt, Mycobacterium avium subsp. paratuberculosis
cgguguaggacgccgu

SEQ ID NO: 2836341 - RNA, 14 nt, Mycobacterium avium subsp. paratuberculosis
cgguguagucgcug

SEQ ID NO: 2836342 - RNA, 20 nt, Mycobacterium avium subsp. paratuberculosis
cgguguagucggcgaucggc

SEQ ID NO: 2836343 - RNA, 19 nt, Mycobacterium avium subsp. paratuberculosis
cggugucaccgacgccagc

SEQ ID NO: 2836344 - RNA, 17 nt, Mycobacterium avium subsp. paratuberculosis
cggugucacguccacgc

SEQ ID NO: 2836345 - RNA, 22 nt, Mycobacterium avium subsp. paratuberculosis
cggugucacguccacgccgcgg

SEQ ID NO: 2836346 - RNA, 20 nt, Mycobacterium avium subsp. paratuberculosis
cgguguccacgaugcggugc

SEQ ID NO: 2836347 - RNA, 22 nt, Mycobacterium avium subsp. paratuberculosis
cgguguccacgaugcggugccg

SEQ ID NO: 2836348 - RNA, 20 nt, Mycobacterium avium subsp. paratuberculosis
cgguguccacgucgcccagc

SEQ ID NO: 2836349 - RNA, 16 nt, Mycobacterium avium subsp. paratuberculosis
cgguguccagccgcac

SEQ ID NO: 2836350 - RNA, 17 nt, Mycobacterium avium subsp. paratuberculosis
cgguguccagccgcacg

SEQ ID NO: 2836351 - RNA, 20 nt, Mycobacterium avium subsp. paratuberculosis
cgguguccagccgcacgaac

SEQ ID NO: 2836352 - RNA, 19 nt, Mycobacterium avium subsp. paratuberculosis
cggugucccgcgcccgcga

SEQ ID NO: 2836353 - RNA, 18 nt, Mycobacterium avium subsp. paratuberculosis
cgguguccgcggcgucgg

SEQ ID NO: 2836354 - RNA, 14 nt, Mycobacterium avium subsp. paratuberculosis
cgguguccgcgggc

SEQ ID NO: 2836355 - RNA, 20 nt, Mycobacterium avium subsp. paratuberculosis
cggugucgaaguacgccguc

SEQ ID NO: 2836356 - RNA, 16 nt, Mycobacterium avium subsp. paratuberculosis
cggugucgagaugacc

SEQ ID NO: 2836357 - RNA, 17 nt, Mycobacterium avium subsp. paratuberculosis
cggugucgagccggugc

SEQ ID NO: 2836358 - RNA, 16 nt, Mycobacterium avium subsp. paratuberculosis
cggugucgaggucguc

SEQ ID NO: 2836359 - RNA, 12 nt, Mycobacterium avium subsp. paratuberculosis
cggugucgccca

SEQ ID NO: 2836360 - RNA, 14 nt, Mycobacterium avium subsp. paratuberculosis
cggugucgcccagc

SEQ ID NO: 2836361 - RNA, 16 nt, Mycobacterium avium subsp. paratuberculosis
cggugucgcccagcug

SEQ ID NO: 2836362 - RNA, 17 nt, Mycobacterium avium subsp. paratuberculosis
cggugucgcccagcugg

SEQ ID NO: 2836363 - RNA, 23 nt, Mycobacterium avium subsp. paratuberculosis
cggugucgcccucgcgcagggcc

SEQ ID NO: 2836364 - RNA, 15 nt, Mycobacterium avium subsp. paratuberculosis
cggugucgccgucgc

SEQ ID NO: 2836365 - RNA, 21 nt, Mycobacterium avium subsp. paratuberculosis
cgguuccagaccggcggcgau

SEQ ID NO: 2836366 - RNA, 13 nt, Mycobacterium avium subsp. paratuberculosis
cgguuccagcggc

SEQ ID NO: 2836367 - RNA, 14 nt, Mycobacterium avium subsp. paratuberculosis
cgguuccagcggca

SEQ ID NO: 2836368 - RNA, 14 nt, Mycobacterium avium subsp. paratuberculosis
cgguucccggcacc

SEQ ID NO: 2836369 - RNA, 16 nt, Mycobacterium avium subsp. paratuberculosis
cgguucccggcaccac

SEQ ID NO: 2836370 - RNA, 21 nt, Mycobacterium avium subsp. paratuberculosis
cgguuccgcgacaucggugac

SEQ ID NO: 2836371 - RNA, 17 nt, Mycobacterium avium subsp. paratuberculosis
cgguuccggcgugcagc

SEQ ID NO: 2836372 - RNA, 14 nt, Mycobacterium avium subsp. paratuberculosis
cgguuccgggcgac

SEQ ID NO: 2836373 - RNA, 20 nt, Mycobacterium avium subsp. paratuberculosis
cgguuccgggcgaccccggc

SEQ ID NO: 2836374 - RNA, 16 nt, Mycobacterium avium subsp. paratuberculosis
cgguuccgggcgcucu

SEQ ID NO: 2836375 - RNA, 14 nt, Mycobacterium avium subsp. paratuberculosis
cgguuccucggcgu

SEQ ID NO: 2836376 - RNA, 20 nt, Mycobacterium avium subsp. paratuberculosis
cgguucgaagcgcagcgucu

SEQ ID NO: 2836377 - RNA, 22 nt, Mycobacterium avium subsp. paratuberculosis
cgguucgaggugcucgcgcagg

SEQ ID NO: 2836378 - RNA, 17 nt, Mycobacterium avium subsp. paratuberculosis
cgguucgaucuccucgg

SEQ ID NO: 2836379 - RNA, 21 nt, Mycobacterium avium subsp. paratuberculosis
cgguucgaucuccucggcgua

SEQ ID NO: 2836380 - RNA, 17 nt, Mycobacterium avium subsp. paratuberculosis
cgguucgaucucgucgg

SEQ ID NO: 2836381 - RNA, 20 nt, Mycobacterium avium subsp. paratuberculosis
cgguucggacacggcgccgu

SEQ ID NO: 2836382 - RNA, 19 nt, Mycobacterium avium subsp. paratuberculosis
cgguucggaguccaccggc

SEQ ID NO: 2836383 - RNA, 16 nt, Mycobacterium avium subsp. paratuberculosis
cgguucggccgcucgg

SEQ ID NO: 2836384 - RNA, 15 nt, Mycobacterium avium subsp. paratuberculosis
cgguucggcggcaua

SEQ ID NO: 2836385 - RNA, 16 nt, Mycobacterium avium subsp. paratuberculosis
cgguucggcgucgguc

SEQ ID NO: 2836386 - RNA, 19 nt, Mycobacterium avium subsp. paratuberculosis
cgguucgggaaccuggccg

SEQ ID NO: 2836387 - RNA, 18 nt, Mycobacterium avium subsp. paratuberculosis
cgguucgucgcggcggcc

SEQ ID NO: 2836388 - RNA, 14 nt, Mycobacterium avium subsp. paratuberculosis
cgguucgucguggc

SEQ ID NO: 2836389 - RNA, 20 nt, Mycobacterium avium subsp. paratuberculosis
cgguucgucguggccgacgg

SEQ ID NO: 2836390 - RNA, 13 nt, Mycobacterium avium subsp. paratuberculosis
cgguucuuguccu

SEQ ID NO: 2836391 - RNA, 16 nt, Mycobacterium avium subsp. paratuberculosis
cgguugaaggccgcgc

SEQ ID NO: 2836392 - RNA, 19 nt, Mycobacterium avium subsp. paratuberculosis
cgguugaaggccgcgcugu

SEQ ID NO: 2836393 - RNA, 18 nt, Mycobacterium avium subsp. paratuberculosis
cgguugaccccggccccg

SEQ ID NO: 2836394 - RNA, 23 nt, Mycobacterium avium subsp. paratuberculosis
cgguugaccccggccccggccgg

SEQ ID NO: 2836395 - RNA, 18 nt, Mycobacterium avium subsp. paratuberculosis
cgguugacccucagcagg

SEQ ID NO: 2836396 - RNA, 14 nt, Mycobacterium avium subsp. paratuberculosis
cgguugaccgccga

SEQ ID NO: 2836397 - RNA, 16 nt, Mycobacterium avium subsp. paratuberculosis
cgguugaccgccgaca

SEQ ID NO: 2836398 - RNA, 12 nt, Mycobacterium avium subsp. paratuberculosis
cgguugagcacc

SEQ ID NO: 2836399 - RNA, 13 nt, Mycobacterium avium subsp. paratuberculosis
cgguugagcacca

SEQ ID NO: 2836400 - RNA, 14 nt, Mycobacterium avium subsp. paratuberculosis
cgguugagcaccag

SEQ ID NO: 2836401 - RNA, 20 nt, Mycobacterium avium subsp. paratuberculosis
cgguugagcaccagcccggc

SEQ ID NO: 2836402 - RNA, 14 nt, Mycobacterium avium subsp. paratuberculosis
cgguugagcaccgc

SEQ ID NO: 2836403 - RNA, 21 nt, Mycobacterium avium subsp. paratuberculosis
cgguugagugcgccgugcagc

SEQ ID NO: 2836404 - RNA, 22 nt, Mycobacterium avium subsp. paratuberculosis
cgguugcaccgcgauggcccgc

SEQ ID NO: 2836405 - RNA, 12 nt, Mycobacterium avium subsp. paratuberculosis
cgguugcccgga

SEQ ID NO: 2836406 - RNA, 15 nt, Mycobacterium avium subsp. paratuberculosis
cgguugcccggaagc

SEQ ID NO: 2836407 - RNA, 18 nt, Mycobacterium avium subsp. paratuberculosis
cgguugcccgguuccgcg

SEQ ID NO: 2836408 - RNA, 14 nt, Mycobacterium avium subsp. paratuberculosis
cgguugccucggcc

SEQ ID NO: 2836409 - RNA, 20 nt, Mycobacterium avium subsp. paratuberculosis
cgguugccuuuccgcgcggc

SEQ ID NO: 2836410 - RNA, 21 nt, Mycobacterium avium subsp. paratuberculosis
cgguugccuuuccgcgcggcg

SEQ ID NO: 2836411 - RNA, 22 nt, Mycobacterium avium subsp. paratuberculosis
cgguugccuuuccgcgcggcgg

SEQ ID NO: 2836412 - RNA, 19 nt, Mycobacterium avium subsp. paratuberculosis
cgguugcgccgaggucacc

SEQ ID NO: 2836413 - RNA, 21 nt, Mycobacterium avium subsp. paratuberculosis
cgguugcgccgaggucaccgc

SEQ ID NO: 2836414 - RNA, 22 nt, Mycobacterium avium subsp. paratuberculosis
cgguugcgccgaggucaccgcg

SEQ ID NO: 2836415 - RNA, 16 nt, Mycobacterium avium subsp. paratuberculosis
cgguugcggcagcaca

SEQ ID NO: 2836416 - RNA, 19 nt, Mycobacterium avium subsp. paratuberculosis
cgguugcggguggcggccg

SEQ ID NO: 2836417 - RNA, 16 nt, Mycobacterium avium subsp. paratuberculosis
cgguugcuccggcguc

SEQ ID NO: 2836418 - RNA, 16 nt, Mycobacterium avium subsp. paratuberculosis
cgguugcucgucggcc

SEQ ID NO: 2836419 - RNA, 17 nt, Mycobacterium avium subsp. paratuberculosis
cgguuggacaggccggc

SEQ ID NO: 2836420 - RNA, 20 nt, Mycobacterium avium subsp. paratuberculosis
cgguuggacaggccggcgac

SEQ ID NO: 2836421 - RNA, 21 nt, Mycobacterium avium subsp. paratuberculosis
cgguuggacaggccggcgacg

SEQ ID NO: 2836422 - RNA, 24 nt, Mycobacterium avium subsp. paratuberculosis
cgguuggacaggccggcgacggcg

SEQ ID NO: 2836423 - RNA, 22 nt, Mycobacterium avium subsp. paratuberculosis
cgguuggacaugaagcccccgu

SEQ ID NO: 2836424 - RNA, 15 nt, Mycobacterium avium subsp. paratuberculosis
cgguuggcccgcggc

SEQ ID NO: 2836425 - RNA, 14 nt, Mycobacterium avium subsp. paratuberculosis
cgguuggccggccc

SEQ ID NO: 2836426 - RNA, 15 nt, Mycobacterium avium subsp. paratuberculosis
cgguuggccggccgg

SEQ ID NO: 2836427 - RNA, 15 nt, Mycobacterium avium subsp. paratuberculosis
cgguuggcgacgcug

SEQ ID NO: 2836428 - RNA, 12 nt, Mycobacterium avium subsp. paratuberculosis
cgguuggcggcc

SEQ ID NO: 2836429 - RNA, 14 nt, Mycobacterium avium subsp. paratuberculosis
cgguuggcggccgg

SEQ ID NO: 2836430 - RNA, 16 nt, Mycobacterium avium subsp. paratuberculosis
cgguugggccgccggc

SEQ ID NO: 2836431 - RNA, 22 nt, Mycobacterium avium subsp. paratuberculosis
cgguuggucaccaggucgcggu

SEQ ID NO: 2836432 - RNA, 13 nt, Mycobacterium avium subsp. paratuberculosis
cgguugucgcggu

SEQ ID NO: 2836433 - RNA, 18 nt, Mycobacterium avium subsp. paratuberculosis
cgguuguucaugaacauc

SEQ ID NO: 2836434 - RNA, 15 nt, Mycobacterium avium subsp. paratuberculosis
cgguuucaccgccgu

SEQ ID NO: 2836435 - RNA, 18 nt, Mycobacterium avium subsp. paratuberculosis
cgguuucaccgugcgcgc

SEQ ID NO: 2836436 - RNA, 18 nt, Mycobacterium avium subsp. paratuberculosis
cgguuucauucaccgcgg

SEQ ID NO: 2836437 - RNA, 13 nt, Mycobacterium avium subsp. paratuberculosis
cgguuuccaggac

SEQ ID NO: 2836438 - RNA, 18 nt, Mycobacterium avium subsp. paratuberculosis
cgguuuccaguccggcgc

SEQ ID NO: 2836439 - RNA, 19 nt, Mycobacterium avium subsp. paratuberculosis
cgguuuccaguccggcgcc

SEQ ID NO: 2836440 - RNA, 14 nt, Mycobacterium avium subsp. paratuberculosis
cgguuucgaacugg

SEQ ID NO: 2836441 - RNA, 17 nt, Mycobacterium avium subsp. paratuberculosis
cgguuugaccacggcgc

SEQ ID NO: 2836442 - RNA, 19 nt, Mycobacterium avium subsp. paratuberculosis
cgguuugaccacggcgcgg

SEQ ID NO: 2836443 - RNA, 15 nt, Mycobacterium avium subsp. paratuberculosis
cgguuugcccggcga

SEQ ID NO: 2836444 - RNA, 21 nt, Mycobacterium avium subsp. paratuberculosis
cgguuugcgccggcuccaccg

SEQ ID NO: 2836445 - RNA, 22 nt, Mycobacterium avium subsp. paratuberculosis
cgguuugcgccggcuccaccgc

SEQ ID NO: 2836446 - RNA, 15 nt, Mycobacterium avium subsp. paratuberculosis
cgguuugcgggucgg

SEQ ID NO: 2836447 - RNA, 21 nt, Mycobacterium avium subsp. paratuberculosis
cgguuuuccgucuucgaccgc

SEQ ID NO: 2836448 - RNA, 18 nt, Mycobacterium avium subsp. paratuberculosis
cgguuuugaugccgccgg

SEQ ID NO: 2836449 - RNA, 14 nt, Mycobacterium avium subsp. paratuberculosis
cgguuuuggucggc

SEQ ID NO: 2836450 - RNA, 16 nt, Mycobacterium avium subsp. paratuberculosis
cguagaacucgccgug

SEQ ID NO: 2836451 - RNA, 19 nt, Mycobacterium avium subsp. paratuberculosis
cguagaagcucagcugcug

SEQ ID NO: 2836452 - RNA, 17 nt, Mycobacterium avium subsp. paratuberculosis
cguagaaggcgccgucg

SEQ ID NO: 2836453 - RNA, 20 nt, Mycobacterium avium subsp. paratuberculosis
cguagaaggcgccgucggug

SEQ ID NO: 2836454 - RNA, 17 nt, Mycobacterium avium subsp. paratuberculosis
cguagaauccgccguug

SEQ ID NO: 2836455 - RNA, 17 nt, Mycobacterium avium subsp. paratuberculosis
cguagaccagcaucagc

SEQ ID NO: 2836456 - RNA, 15 nt, Mycobacterium avium subsp. paratuberculosis
cguagaccucuuggg

SEQ ID NO: 2836457 - RNA, 21 nt, Mycobacterium avium subsp. paratuberculosis
cguagacgaagcggccgggga

SEQ ID NO: 2836458 - RNA, 17 nt, Mycobacterium avium subsp. paratuberculosis
cguagacgacgucgacc

SEQ ID NO: 2836459 - RNA, 18 nt, Mycobacterium avium subsp. paratuberculosis
cguagacgacgucgaccg

SEQ ID NO: 2836460 - RNA, 23 nt, Mycobacterium avium subsp. paratuberculosis
cguagacgacgucgaccgcgccg

SEQ ID NO: 2836461 - RNA, 17 nt, Mycobacterium avium subsp. paratuberculosis
cguagacgagccgguug

SEQ ID NO: 2836462 - RNA, 15 nt, Mycobacterium avium subsp. paratuberculosis
cguagacggugucgc

SEQ ID NO: 2836463 - RNA, 20 nt, Mycobacterium avium subsp. paratuberculosis
cguagacggugucgcccucg

SEQ ID NO: 2836464 - RNA, 21 nt, Mycobacterium avium subsp. paratuberculosis
cguagagcaggaccgagccgc

SEQ ID NO: 2836465 - RNA, 21 nt, Mycobacterium avium subsp. paratuberculosis
cguagagccguuuggcgccgc

SEQ ID NO: 2836466 - RNA, 23 nt, Mycobacterium avium subsp. paratuberculosis
cguagagccguuuggcgccgccc

SEQ ID NO: 2836467 - RNA, 13 nt, Mycobacterium avium subsp. paratuberculosis
cguagagcgcgaa

SEQ ID NO: 2836468 - RNA, 15 nt, Mycobacterium avium subsp. paratuberculosis
cguagaggugcagcg

SEQ ID NO: 2836469 - RNA, 18 nt, Mycobacterium avium subsp. paratuberculosis
cguagaggugcagcgggc

SEQ ID NO: 2836470 - RNA, 20 nt, Mycobacterium avium subsp. paratuberculosis
cguagaggugcagcgggcug

SEQ ID NO: 2836471 - RNA, 17 nt, Mycobacterium avium subsp. paratuberculosis
cguagaucacgccggug

SEQ ID NO: 2836472 - RNA, 18 nt, Mycobacterium avium subsp. paratuberculosis
cguagaucacggcguuga

SEQ ID NO: 2836473 - RNA, 17 nt, Mycobacterium avium subsp. paratuberculosis
cguagaucaucuggcug

SEQ ID NO: 2836474 - RNA, 14 nt, Mycobacterium avium subsp. paratuberculosis
cguagaucgucgag

SEQ ID NO: 2836475 - RNA, 17 nt, Mycobacterium avium subsp. paratuberculosis
cguagaucucgcgccgc

SEQ ID NO: 2836476 - RNA, 20 nt, Mycobacterium avium subsp. paratuberculosis
cguagaucucgcgccgcgca

SEQ ID NO: 2836477 - RNA, 18 nt, Mycobacterium avium subsp. paratuberculosis
cguagaugcggcccagcc

SEQ ID NO: 2836478 - RNA, 12 nt, Mycobacterium avium subsp. paratuberculosis
cguagcagcaga

SEQ ID NO: 2836479 - RNA, 14 nt, Mycobacterium avium subsp. paratuberculosis
cguagcagcagacc

SEQ ID NO: 2836480 - RNA, 23 nt, Mycobacterium avium subsp. paratuberculosis
cguagcccaccucgagcacgccc

SEQ ID NO: 2836481 - RNA, 14 nt, Mycobacterium avium subsp. paratuberculosis
cguagcccagcgcg

SEQ ID NO: 2836482 - RNA, 15 nt, Mycobacterium avium subsp. paratuberculosis
cguagcccagcgcgu

SEQ ID NO: 2836483 - RNA, 23 nt, Mycobacterium avium subsp. paratuberculosis
cguagcccagcgcguugcggccg

SEQ ID NO: 2836484 - RNA, 13 nt, Mycobacterium avium subsp. paratuberculosis
cguagcccgccga

SEQ ID NO: 2836485 - RNA, 15 nt, Mycobacterium avium subsp. paratuberculosis
cguagcccgccgaau

SEQ ID NO: 2836486 - RNA, 15 nt, Mycobacterium avium subsp. paratuberculosis
cguagcccuaccggc

SEQ ID NO: 2836487 - RNA, 15 nt, Mycobacterium avium subsp. paratuberculosis
cguagcccugcaggu

SEQ ID NO: 2836488 - RNA, 18 nt, Mycobacterium avium subsp. paratuberculosis
cguagccgaccaacgggc

SEQ ID NO: 2836489 - RNA, 23 nt, Mycobacterium avium subsp. paratuberculosis
cguagccgccgguugaucacccg

SEQ ID NO: 2836490 - RNA, 15 nt, Mycobacterium avium subsp. paratuberculosis
cguagccgcggguga

SEQ ID NO: 2836491 - RNA, 19 nt, Mycobacterium avium subsp. paratuberculosis
cguagccgcgguucggcgu

SEQ ID NO: 2836492 - RNA, 14 nt, Mycobacterium avium subsp. paratuberculosis
cguagccggcggug

SEQ ID NO: 2836493 - RNA, 17 nt, Mycobacterium avium subsp. paratuberculosis
cguagccggcgguggcc

SEQ ID NO: 2836494 - RNA, 18 nt, Mycobacterium avium subsp. paratuberculosis
cguagccggcgguggcca

SEQ ID NO: 2836495 - RNA, 18 nt, Mycobacterium avium subsp. paratuberculosis
cguagccguagaucgucg

SEQ ID NO: 2836496 - RNA, 18 nt, Mycobacterium avium subsp. paratuberculosis
cguagccgugcaucgggc

SEQ ID NO: 2836497 - RNA, 16 nt, Mycobacterium avium subsp. paratuberculosis
cguagcgagcgcuggc

SEQ ID NO: 2836498 - RNA, 15 nt, Mycobacterium avium subsp. paratuberculosis
cguagcgcagcucca

SEQ ID NO: 2836499 - RNA, 12 nt, Mycobacterium avium subsp. paratuberculosis
cguagcgccgcc

SEQ ID NO: 2836500 - RNA, 17 nt, Mycobacterium avium subsp. paratuberculosis
cguagcgccgcccgucc

SEQ ID NO: 2836501 - RNA, 12 nt, Mycobacterium avium subsp. paratuberculosis
cguagcgccggc

SEQ ID NO: 2836502 - RNA, 13 nt, Mycobacterium avium subsp. paratuberculosis
cguagcgccggua

SEQ ID NO: 2836503 - RNA, 14 nt, Mycobacterium avium subsp. paratuberculosis
cguagcgcggccgc

SEQ ID NO: 2836504 - RNA, 20 nt, Mycobacterium avium subsp. paratuberculosis
cguagcgcugggugaacacc

SEQ ID NO: 2836505 - RNA, 20 nt, Mycobacterium avium subsp. paratuberculosis
cguagcggaagcugccguug

SEQ ID NO: 2836506 - RNA, 16 nt, Mycobacterium avium subsp. paratuberculosis
cguagcggacgacggc

SEQ ID NO: 2836507 - RNA, 14 nt, Mycobacterium avium subsp. paratuberculosis
cguagcggccgcac

SEQ ID NO: 2836508 - RNA, 18 nt, Mycobacterium avium subsp. paratuberculosis
cguagcggccgcacgcga

SEQ ID NO: 2836509 - RNA, 14 nt, Mycobacterium avium subsp. paratuberculosis
cguagcggcgccac

SEQ ID NO: 2836510 - RNA, 13 nt, Mycobacterium avium subsp. paratuberculosis
cguagcgggcgaa

SEQ ID NO: 2836511 - RNA, 18 nt, Mycobacterium avium subsp. paratuberculosis
cguagcgggucagcucca

SEQ ID NO: 2836512 - RNA, 20 nt, Mycobacterium avium subsp. paratuberculosis
cguagcgggucagcuccacc

SEQ ID NO: 2836513 - RNA, 16 nt, Mycobacterium avium subsp. paratuberculosis
cguagcgguccagcgu

SEQ ID NO: 2836514 - RNA, 16 nt, Mycobacterium avium subsp. paratuberculosis
cguagcggucgcccca

SEQ ID NO: 2836515 - RNA, 14 nt, Mycobacterium avium subsp. paratuberculosis
cguagcggucggga

SEQ ID NO: 2836516 - RNA, 14 nt, Mycobacterium avium subsp. paratuberculosis
cguagcucagcgga

SEQ ID NO: 2836517 - RNA, 16 nt, Mycobacterium avium subsp. paratuberculosis
cguagcucagugguag

SEQ ID NO: 2836518 - RNA, 17 nt, Mycobacterium avium subsp. paratuberculosis
cguagcucgccgcggcc

SEQ ID NO: 2836519 - RNA, 23 nt, Mycobacterium avium subsp. paratuberculosis
cguagcucgccgcggccacgcuc

SEQ ID NO: 2836520 - RNA, 21 nt, Mycobacterium avium subsp. paratuberculosis
cguagcucgcgccgacccgcc

SEQ ID NO: 2836521 - RNA, 19 nt, Mycobacterium avium subsp. paratuberculosis
cguagcuggugcgcagccc

SEQ ID NO: 2836522 - RNA, 20 nt, Mycobacterium avium subsp. paratuberculosis
cguagcuggugcgcagcccg

SEQ ID NO: 2836523 - RNA, 21 nt, Mycobacterium avium subsp. paratuberculosis
cguagcuggugcgcagcccgc

SEQ ID NO: 2836524 - RNA, 15 nt, Mycobacterium avium subsp. paratuberculosis
cguagcuuccgccuu

SEQ ID NO: 2836525 - RNA, 21 nt, Mycobacterium avium subsp. paratuberculosis
cguaggacaccacgguggcgu

SEQ ID NO: 2836526 - RNA, 16 nt, Mycobacterium avium subsp. paratuberculosis
cguaggacagcagccg

SEQ ID NO: 2836527 - RNA, 21 nt, Mycobacterium avium subsp. paratuberculosis
cguaggacaggaacgggccgg

SEQ ID NO: 2836528 - RNA, 23 nt, Mycobacterium avium subsp. paratuberculosis
cguaggacaggaacgggccggcg

SEQ ID NO: 2836529 - RNA, 19 nt, Mycobacterium avium subsp. paratuberculosis
cguaggccuugcugagccg

SEQ ID NO: 2836530 - RNA, 15 nt, Mycobacterium avium subsp. paratuberculosis
cguaggcgaggaccg

SEQ ID NO: 2836531 - RNA, 12 nt, Mycobacterium avium subsp. paratuberculosis
cguaggcgauca

SEQ ID NO: 2836532 - RNA, 14 nt, Mycobacterium avium subsp. paratuberculosis
cguaggcgaucagc

SEQ ID NO: 2836533 - RNA, 18 nt, Mycobacterium avium subsp. paratuberculosis
cguaggcgaugucgacgu

SEQ ID NO: 2836534 - RNA, 15 nt, Mycobacterium avium subsp. paratuberculosis
cguaggcgcggucga

SEQ ID NO: 2836535 - RNA, 18 nt, Mycobacterium avium subsp. paratuberculosis
cgucaccaaugcgccggc

SEQ ID NO: 2836536 - RNA, 21 nt, Mycobacterium avium subsp. paratuberculosis
cgucaccaaugcgccggcggc

SEQ ID NO: 2836537 - RNA, 16 nt, Mycobacterium avium subsp. paratuberculosis
cgucaccaccgggucg

SEQ ID NO: 2836538 - RNA, 23 nt, Mycobacterium avium subsp. paratuberculosis
cgucaccaggcugcucggcgggc

SEQ ID NO: 2836539 - RNA, 14 nt, Mycobacterium avium subsp. paratuberculosis
cgucacccagaucg

SEQ ID NO: 2836540 - RNA, 22 nt, Mycobacterium avium subsp. paratuberculosis
cgucacccagaucgcccgggcg

SEQ ID NO: 2836541 - RNA, 14 nt, Mycobacterium avium subsp. paratuberculosis
cgucacccccggcg

SEQ ID NO: 2836542 - RNA, 16 nt, Mycobacterium avium subsp. paratuberculosis
cgucacccccggcgcg

SEQ ID NO: 2836543 - RNA, 20 nt, Mycobacterium avium subsp. paratuberculosis
cgucacccccggcgcgacgg

SEQ ID NO: 2836544 - RNA, 22 nt, Mycobacterium avium subsp. paratuberculosis
cgucacccccggcgcgacggca

SEQ ID NO: 2836545 - RNA, 18 nt, Mycobacterium avium subsp. paratuberculosis
cgucaccgaccccucggc

SEQ ID NO: 2836546 - RNA, 20 nt, Mycobacterium avium subsp. paratuberculosis
cgucaccgccaggaccaccc

SEQ ID NO: 2836547 - RNA, 13 nt, Mycobacterium avium subsp. paratuberculosis
cgucaccgccgca

SEQ ID NO: 2836548 - RNA, 19 nt, Mycobacterium avium subsp. paratuberculosis
cgucaccgccgcaccgucg

SEQ ID NO: 2836549 - RNA, 22 nt, Mycobacterium avium subsp. paratuberculosis
cgucaccgccgcaccgucgugc

SEQ ID NO: 2836550 - RNA, 19 nt, Mycobacterium avium subsp. paratuberculosis
cgucaccgcgcuugccgcg

SEQ ID NO: 2836551 - RNA, 20 nt, Mycobacterium avium subsp. paratuberculosis
cgucaccgcgcuugccgcga

SEQ ID NO: 2836552 - RNA, 14 nt, Mycobacterium avium subsp. paratuberculosis
cgucaccgcgggug

SEQ ID NO: 2836553 - RNA, 18 nt, Mycobacterium avium subsp. paratuberculosis
cgucaccgcugaugccgc

SEQ ID NO: 2836554 - RNA, 19 nt, Mycobacterium avium subsp. paratuberculosis
cgucaccgcugaugccgcc

SEQ ID NO: 2836555 - RNA, 20 nt, Mycobacterium avium subsp. paratuberculosis
cgucaccgcugaugccgccg

SEQ ID NO: 2836556 - RNA, 22 nt, Mycobacterium avium subsp. paratuberculosis
cgucaccgcugaugccgccgaa

SEQ ID NO: 2836557 - RNA, 21 nt, Mycobacterium avium subsp. paratuberculosis
cgucaccggccauccgcugcg

SEQ ID NO: 2836558 - RNA, 23 nt, Mycobacterium avium subsp. paratuberculosis
cgucaccggccauccgcugcgcg

SEQ ID NO: 2836559 - RNA, 12 nt, Mycobacterium avium subsp. paratuberculosis
cgucaccggcug

SEQ ID NO: 2836560 - RNA, 18 nt, Mycobacterium avium subsp. paratuberculosis
cgucaccggcugcccgac

SEQ ID NO: 2836561 - RNA, 23 nt, Mycobacterium avium subsp. paratuberculosis
cgucaccggcugcccgacccgca

SEQ ID NO: 2836562 - RNA, 16 nt, Mycobacterium avium subsp. paratuberculosis
cgucaccgugccgucg

SEQ ID NO: 2836563 - RNA, 17 nt, Mycobacterium avium subsp. paratuberculosis
cgucaccgugccgucgc

SEQ ID NO: 2836564 - RNA, 23 nt, Mycobacterium avium subsp. paratuberculosis
cgucaccgugggcggcgcgaucg

SEQ ID NO: 2836565 - RNA, 22 nt, Mycobacterium avium subsp. paratuberculosis
cgucaccguggugugcccgcgg

SEQ ID NO: 2836566 - RNA, 21 nt, Mycobacterium avium subsp. paratuberculosis
cgucaccucgaccagauccuc

SEQ ID NO: 2836567 - RNA, 17 nt, Mycobacterium avium subsp. paratuberculosis
cgucaccuucaccacgg

SEQ ID NO: 2836568 - RNA, 23 nt, Mycobacterium avium subsp. paratuberculosis
cgucaccuucaccacggccauca

SEQ ID NO: 2836569 - RNA, 16 nt, Mycobacterium avium subsp. paratuberculosis
cgucaccuucaccccc

SEQ ID NO: 2836570 - RNA, 14 nt, Mycobacterium avium subsp. paratuberculosis
cgucacgcaucagg

SEQ ID NO: 2836571 - RNA, 14 nt, Mycobacterium avium subsp. paratuberculosis
cgucacgccagcgu

SEQ ID NO: 2836572 - RNA, 16 nt, Mycobacterium avium subsp. paratuberculosis
cgucacgccagcguga

SEQ ID NO: 2836573 - RNA, 18 nt, Mycobacterium avium subsp. paratuberculosis
cgucacgccagcgugacg

SEQ ID NO: 2836574 - RNA, 19 nt, Mycobacterium avium subsp. paratuberculosis
cgucacgccagcgugacgc

SEQ ID NO: 2836575 - RNA, 20 nt, Mycobacterium avium subsp. paratuberculosis
cgucacgccagcgugacgcc

SEQ ID NO: 2836576 - RNA, 22 nt, Mycobacterium avium subsp. paratuberculosis
cgucacgccagcgugacgcucg

SEQ ID NO: 2836577 - RNA, 21 nt, Mycobacterium avium subsp. paratuberculosis
cgucacgccaguguggccgcg

SEQ ID NO: 2836578 - RNA, 18 nt, Mycobacterium avium subsp. paratuberculosis
cgucacgcccguugacgc

SEQ ID NO: 2836579 - RNA, 22 nt, Mycobacterium avium subsp. paratuberculosis
cgucacgccgcgcccgucgagc

SEQ ID NO: 2836580 - RNA, 23 nt, Mycobacterium avium subsp. paratuberculosis
cgucacgccgcgcccgucgagcg

SEQ ID NO: 2836581 - RNA, 21 nt, Mycobacterium avium subsp. paratuberculosis
cgucacgccguauucgccgac

SEQ ID NO: 2836582 - RNA, 13 nt, Mycobacterium avium subsp. paratuberculosis
cgucacgcuagcg

SEQ ID NO: 2836583 - RNA, 19 nt, Mycobacterium avium subsp. paratuberculosis
cgucacgcuagcgugacag

SEQ ID NO: 2836584 - RNA, 17 nt, Mycobacterium avium subsp. paratuberculosis
cgucacgcugcgcgccg

SEQ ID NO: 2836585 - RNA, 18 nt, Mycobacterium avium subsp. paratuberculosis
cgucacgcugcgcgccga

SEQ ID NO: 2836586 - RNA, 14 nt, Mycobacterium avium subsp. paratuberculosis
cgucacgcuggcgu

SEQ ID NO: 2836587 - RNA, 16 nt, Mycobacterium avium subsp. paratuberculosis
cgucacgcuggcguga

SEQ ID NO: 2836588 - RNA, 18 nt, Mycobacterium avium subsp. paratuberculosis
cgucacgcuggcgugaca

SEQ ID NO: 2836589 - RNA, 19 nt, Mycobacterium avium subsp. paratuberculosis
cgucacgcuggcgugacac

SEQ ID NO: 2836590 - RNA, 22 nt, Mycobacterium avium subsp. paratuberculosis
cgucacgcuggcgugacggucg

SEQ ID NO: 2836591 - RNA, 19 nt, Mycobacterium avium subsp. paratuberculosis
cgucacgcuggcguggcac

SEQ ID NO: 2836592 - RNA, 20 nt, Mycobacterium avium subsp. paratuberculosis
cgucacgcuggcguggcacc

SEQ ID NO: 2836593 - RNA, 23 nt, Mycobacterium avium subsp. paratuberculosis
cgucacgcuggcguggcacccgg

SEQ ID NO: 2836594 - RNA, 24 nt, Mycobacterium avium subsp. paratuberculosis
cgucacgcuggcguggcucggccc

SEQ ID NO: 2836595 - RNA, 21 nt, Mycobacterium avium subsp. paratuberculosis
cgucacgcuggugacgugcac

SEQ ID NO: 2836596 - RNA, 22 nt, Mycobacterium avium subsp. paratuberculosis
cgucacgcuggugacgugcacc

SEQ ID NO: 2836597 - RNA, 19 nt, Mycobacterium avium subsp. paratuberculosis
cgucacggaucgcccaccc

SEQ ID NO: 2836598 - RNA, 23 nt, Mycobacterium avium subsp. paratuberculosis
cgucacggaucgcccacccgcac

SEQ ID NO: 2836599 - RNA, 19 nt, Mycobacterium avium subsp. paratuberculosis
cgucacgggccaggcgcgc

SEQ ID NO: 2836600 - RNA, 20 nt, Mycobacterium avium subsp. paratuberculosis
cgucacgggcugaccgccag

SEQ ID NO: 2836601 - RNA, 18 nt, Mycobacterium avium subsp. paratuberculosis
cgucacguagcgcggccg

SEQ ID NO: 2836602 - RNA, 21 nt, Mycobacterium avium subsp. paratuberculosis
cgucacguagcgcggccgccc

SEQ ID NO: 2836603 - RNA, 14 nt, Mycobacterium avium subsp. paratuberculosis
cgucacgucgacgg

SEQ ID NO: 2836604 - RNA, 15 nt, Mycobacterium avium subsp. paratuberculosis
cgucacgucgacggc

SEQ ID NO: 2836605 - RNA, 18 nt, Mycobacterium avium subsp. paratuberculosis
cgucacgucgacggccgc

SEQ ID NO: 2836606 - RNA, 20 nt, Mycobacterium avium subsp. paratuberculosis
cgucacgucgacggccgccg

SEQ ID NO: 2836607 - RNA, 22 nt, Mycobacterium avium subsp. paratuberculosis
cgucacgucgacggccgccgcg

SEQ ID NO: 2836608 - RNA, 12 nt, Mycobacterium avium subsp. paratuberculosis
cgucacgucggc

SEQ ID NO: 2836609 - RNA, 14 nt, Mycobacterium avium subsp. paratuberculosis
cgucacgucggccu

SEQ ID NO: 2836610 - RNA, 16 nt, Mycobacterium avium subsp. paratuberculosis
cgucacgucggccugc

SEQ ID NO: 2836611 - RNA, 17 nt, Mycobacterium avium subsp. paratuberculosis
cgucacgucggccugca

SEQ ID NO: 2836612 - RNA, 22 nt, Mycobacterium avium subsp. paratuberculosis
cgucacgucggccugcacgaag

SEQ ID NO: 2836613 - RNA, 14 nt, Mycobacterium avium subsp. paratuberculosis
cgucacguucacca

SEQ ID NO: 2836614 - RNA, 17 nt, Mycobacterium avium subsp. paratuberculosis
cgucacguucaccaccg

SEQ ID NO: 2836615 - RNA, 18 nt, Mycobacterium avium subsp. paratuberculosis
cgucacguucaccaccgg

SEQ ID NO: 2836616 - RNA, 19 nt, Mycobacterium avium subsp. paratuberculosis
cgucacguucaccaccgga

SEQ ID NO: 2836617 - RNA, 17 nt, Mycobacterium avium subsp. paratuberculosis
cgucacuccucgaucug

SEQ ID NO: 2836618 - RNA, 17 nt, Mycobacterium avium subsp. paratuberculosis
cgucacugcccagccau

SEQ ID NO: 2836619 - RNA, 19 nt, Mycobacterium avium subsp. paratuberculosis
cgucauuucggucggcagg

SEQ ID NO: 2836620 - RNA, 18 nt, Mycobacterium avium subsp. paratuberculosis
cguccaaaaugcguuccg

SEQ ID NO: 2836621 - RNA, 20 nt, Mycobacterium avium subsp. paratuberculosis
cguccaaugcgccgauggug

SEQ ID NO: 2836622 - RNA, 19 nt, Mycobacterium avium subsp. paratuberculosis
cguccacaccguugggggu

SEQ ID NO: 2836623 - RNA, 13 nt, Mycobacterium avium subsp. paratuberculosis
cguccacagccgg

SEQ ID NO: 2836624 - RNA, 15 nt, Mycobacterium avium subsp. paratuberculosis
cguccacagccggcg

SEQ ID NO: 2836625 - RNA, 16 nt, Mycobacterium avium subsp. paratuberculosis
cguccacagccggcgg

SEQ ID NO: 2836626 - RNA, 17 nt, Mycobacterium avium subsp. paratuberculosis
cguccacagccggcggc

SEQ ID NO: 2836627 - RNA, 20 nt, Mycobacterium avium subsp. paratuberculosis
cguccaccaccaacccgguc

SEQ ID NO: 2836628 - RNA, 13 nt, Mycobacterium avium subsp. paratuberculosis
cguccaccagauc

SEQ ID NO: 2836629 - RNA, 22 nt, Mycobacterium avium subsp. paratuberculosis
cguccaccagaucgccccgcug

SEQ ID NO: 2836630 - RNA, 13 nt, Mycobacterium avium subsp. paratuberculosis
cguccaccagcac

SEQ ID NO: 2836631 - RNA, 16 nt, Mycobacterium avium subsp. paratuberculosis
cguccaccagcaccag

SEQ ID NO: 2836632 - RNA, 22 nt, Mycobacterium avium subsp. paratuberculosis
cguccaccagcaccaggcgggu

SEQ ID NO: 2836633 - RNA, 14 nt, Mycobacterium avium subsp. paratuberculosis
cguccaccagcacg

SEQ ID NO: 2836634 - RNA, 13 nt, Mycobacterium avium subsp. paratuberculosis
cguccaccagcuc

SEQ ID NO: 2836635 - RNA, 14 nt, Mycobacterium avium subsp. paratuberculosis
cguccaccagcucg

SEQ ID NO: 2836636 - RNA, 22 nt, Mycobacterium avium subsp. paratuberculosis
cguccaccaggguggccgccac

SEQ ID NO: 2836637 - RNA, 16 nt, Mycobacterium avium subsp. paratuberculosis
cguccacccggcccac

SEQ ID NO: 2836638 - RNA, 17 nt, Mycobacterium avium subsp. paratuberculosis
cguccaccgacaggucg

SEQ ID NO: 2836639 - RNA, 17 nt, Mycobacterium avium subsp. paratuberculosis
cguccaccggauggcgc

SEQ ID NO: 2836640 - RNA, 13 nt, Mycobacterium avium subsp. paratuberculosis
cguccaccggcac

SEQ ID NO: 2836641 - RNA, 14 nt, Mycobacterium avium subsp. paratuberculosis
cguccaccggcacg

SEQ ID NO: 2836642 - RNA, 14 nt, Mycobacterium avium subsp. paratuberculosis
cguccaccuccucc

SEQ ID NO: 2836643 - RNA, 14 nt, Mycobacterium avium subsp. paratuberculosis
cguccacgaccccg

SEQ ID NO: 2836644 - RNA, 18 nt, Mycobacterium avium subsp. paratuberculosis
cguccacgaccccggcgg

SEQ ID NO: 2836645 - RNA, 19 nt, Mycobacterium avium subsp. paratuberculosis
cguccacgaccccggcggc

SEQ ID NO: 2836646 - RNA, 20 nt, Mycobacterium avium subsp. paratuberculosis
cguccacgaccccggcggca

SEQ ID NO: 2836647 - RNA, 14 nt, Mycobacterium avium subsp. paratuberculosis
cguccacgcccagc

SEQ ID NO: 2836648 - RNA, 15 nt, Mycobacterium avium subsp. paratuberculosis
cguccacgccgcggg

SEQ ID NO: 2836649 - RNA, 16 nt, Mycobacterium avium subsp. paratuberculosis
cguccacgccgcggga

SEQ ID NO: 2836650 - RNA, 17 nt, Mycobacterium avium subsp. paratuberculosis
cguccacgccgcgggag

SEQ ID NO: 2836651 - RNA, 15 nt, Mycobacterium avium subsp. paratuberculosis
cguccacgcuggcgg

SEQ ID NO: 2836652 - RNA, 16 nt, Mycobacterium avium subsp. paratuberculosis
cguccacgcuggcggu

SEQ ID NO: 2836653 - RNA, 17 nt, Mycobacterium avium subsp. paratuberculosis
cguccacgcuggcggug

SEQ ID NO: 2836654 - RNA, 13 nt, Mycobacterium avium subsp. paratuberculosis
cguccacggcggu

SEQ ID NO: 2836655 - RNA, 22 nt, Mycobacterium avium subsp. paratuberculosis
cguccacgggucgccguggccg

SEQ ID NO: 2836656 - RNA, 23 nt, Mycobacterium avium subsp. paratuberculosis
cguccacguugaugccgcccagc

SEQ ID NO: 2836657 - RNA, 14 nt, Mycobacterium avium subsp. paratuberculosis
cguccagaccggcc

SEQ ID NO: 2836658 - RNA, 15 nt, Mycobacterium avium subsp. paratuberculosis
cguccagaccggccg

SEQ ID NO: 2836659 - RNA, 16 nt, Mycobacterium avium subsp. paratuberculosis
cguccagaccggccgg

SEQ ID NO: 2836660 - RNA, 17 nt, Mycobacterium avium subsp. paratuberculosis
cguccagaccggccggg

SEQ ID NO: 2836661 - RNA, 20 nt, Mycobacterium avium subsp. paratuberculosis
cguccagaccggccggggcg

SEQ ID NO: 2836662 - RNA, 17 nt, Mycobacterium avium subsp. paratuberculosis
cguccagaucggccagc

SEQ ID NO: 2836663 - RNA, 18 nt, Mycobacterium avium subsp. paratuberculosis
cguccagaucggccagcg

SEQ ID NO: 2836664 - RNA, 20 nt, Mycobacterium avium subsp. paratuberculosis
cguccagaucggccagcgcg

SEQ ID NO: 2836665 - RNA, 24 nt, Mycobacterium avium subsp. paratuberculosis
cguccagaucggccagcgcggccg

SEQ ID NO: 2836666 - RNA, 15 nt, Mycobacterium avium subsp. paratuberculosis
cguccagcaacgccg

SEQ ID NO: 2836667 - RNA, 17 nt, Mycobacterium avium subsp. paratuberculosis
cguccagcaacgccgac

SEQ ID NO: 2836668 - RNA, 11 nt, Mycobacterium avium subsp. paratuberculosis
cguccagcagc

SEQ ID NO: 2836669 - RNA, 12 nt, Mycobacterium avium subsp. paratuberculosis
cguccagcagca

SEQ ID NO: 2836670 - RNA, 15 nt, Mycobacterium avium subsp. paratuberculosis
cguccagcagcagcg

SEQ ID NO: 2836671 - RNA, 19 nt, Mycobacterium avium subsp. paratuberculosis
cguccagcagcagcgcgcg

SEQ ID NO: 2836672 - RNA, 17 nt, Mycobacterium avium subsp. paratuberculosis
cguccagcaugcccacg

SEQ ID NO: 2836673 - RNA, 20 nt, Mycobacterium avium subsp. paratuberculosis
cguccagcaugcccacgccg

SEQ ID NO: 2836674 - RNA, 13 nt, Mycobacterium avium subsp. paratuberculosis
cguccagcccgcg

SEQ ID NO: 2836675 - RNA, 16 nt, Mycobacterium avium subsp. paratuberculosis
cguccagcccgcgcca

SEQ ID NO: 2836676 - RNA, 22 nt, Mycobacterium avium subsp. paratuberculosis
cguccagccgugcggcacgccg

SEQ ID NO: 2836677 - RNA, 18 nt, Mycobacterium avium subsp. paratuberculosis
cguccagcgagggggugg

SEQ ID NO: 2836678 - RNA, 13 nt, Mycobacterium avium subsp. paratuberculosis
cguccagcgccgc

SEQ ID NO: 2836679 - RNA, 15 nt, Mycobacterium avium subsp. paratuberculosis
cguccagcgccgcca

SEQ ID NO: 2836680 - RNA, 16 nt, Mycobacterium avium subsp. paratuberculosis
cguccagcgccgccac

SEQ ID NO: 2836681 - RNA, 22 nt, Mycobacterium avium subsp. paratuberculosis
cguccagcgccgccacggccac

SEQ ID NO: 2836682 - RNA, 16 nt, Mycobacterium avium subsp. paratuberculosis
cguccagcgccgccau

SEQ ID NO: 2836683 - RNA, 17 nt, Mycobacterium avium subsp. paratuberculosis
cguccagcgccgccauc

SEQ ID NO: 2836684 - RNA, 12 nt, Mycobacterium avium subsp. paratuberculosis
cguccagcgcga

SEQ ID NO: 2836685 - RNA, 14 nt, Mycobacterium avium subsp. paratuberculosis
cguccagcgcgucg

SEQ ID NO: 2836686 - RNA, 15 nt, Mycobacterium avium subsp. paratuberculosis
cguccagcggcccuc

SEQ ID NO: 2836687 - RNA, 23 nt, Mycobacterium avium subsp. paratuberculosis
cguccagcggguugccgcuggcg

SEQ ID NO: 2836688 - RNA, 15 nt, Mycobacterium avium subsp. paratuberculosis
cguccagcgucgacu

SEQ ID NO: 2836689 - RNA, 14 nt, Mycobacterium avium subsp. paratuberculosis
cguccagcgucgcg

SEQ ID NO: 2836690 - RNA, 16 nt, Mycobacterium avium subsp. paratuberculosis
cguccagcgucgcggc

SEQ ID NO: 2836691 - RNA, 18 nt, Mycobacterium avium subsp. paratuberculosis
cguccagcgucgcggccg

SEQ ID NO: 2836692 - RNA, 19 nt, Mycobacterium avium subsp. paratuberculosis
cguccagcgucgcggccgg

SEQ ID NO: 2836693 - RNA, 18 nt, Mycobacterium avium subsp. paratuberculosis
cguccagcgucuggcagc

SEQ ID NO: 2836694 - RNA, 21 nt, Mycobacterium avium subsp. paratuberculosis
cguccagcgugccgcgcacca

SEQ ID NO: 2836695 - RNA, 14 nt, Mycobacterium avium subsp. paratuberculosis
cguccagcuccgcc

SEQ ID NO: 2836696 - RNA, 15 nt, Mycobacterium avium subsp. paratuberculosis
cguccagcuccgccg

SEQ ID NO: 2836697 - RNA, 16 nt, Mycobacterium avium subsp. paratuberculosis
cguccagcuccgccga

SEQ ID NO: 2836698 - RNA, 18 nt, Mycobacterium avium subsp. paratuberculosis
cguccagcucgcguucgg

SEQ ID NO: 2836699 - RNA, 15 nt, Mycobacterium avium subsp. paratuberculosis
cguccagcugcgcgc

SEQ ID NO: 2836700 - RNA, 17 nt, Mycobacterium avium subsp. paratuberculosis
cguccagcugcgcgccg

SEQ ID NO: 2836701 - RNA, 19 nt, Mycobacterium avium subsp. paratuberculosis
cguccagcugcgcgccggc

SEQ ID NO: 2836702 - RNA, 20 nt, Mycobacterium avium subsp. paratuberculosis
cguccagcugcgcgccggcg

SEQ ID NO: 2836703 - RNA, 23 nt, Mycobacterium avium subsp. paratuberculosis
cguccagcugcgcgccggcggcc

SEQ ID NO: 2836704 - RNA, 16 nt, Mycobacterium avium subsp. paratuberculosis
cgucccguccgacggc

SEQ ID NO: 2836705 - RNA, 12 nt, Mycobacterium avium subsp. paratuberculosis
cgucccgucgac

SEQ ID NO: 2836706 - RNA, 13 nt, Mycobacterium avium subsp. paratuberculosis
cgucccgucgacc

SEQ ID NO: 2836707 - RNA, 15 nt, Mycobacterium avium subsp. paratuberculosis
cgucccgucggccag

SEQ ID NO: 2836708 - RNA, 13 nt, Mycobacterium avium subsp. paratuberculosis
cgucccgucggcg

SEQ ID NO: 2836709 - RNA, 14 nt, Mycobacterium avium subsp. paratuberculosis
cgucccgucggcgc

SEQ ID NO: 2836710 - RNA, 20 nt, Mycobacterium avium subsp. paratuberculosis
cgucccgucggcgcgaggcg

SEQ ID NO: 2836711 - RNA, 21 nt, Mycobacterium avium subsp. paratuberculosis
cgucccguuggcgccggucga

SEQ ID NO: 2836712 - RNA, 12 nt, Mycobacterium avium subsp. paratuberculosis
cgucccugcgcg

SEQ ID NO: 2836713 - RNA, 15 nt, Mycobacterium avium subsp. paratuberculosis
cgucccuggcgauga

SEQ ID NO: 2836714 - RNA, 18 nt, Mycobacterium avium subsp. paratuberculosis
cgucccuguucgcgccgg

SEQ ID NO: 2836715 - RNA, 19 nt, Mycobacterium avium subsp. paratuberculosis
cgucccuguucgcgccggu

SEQ ID NO: 2836716 - RNA, 20 nt, Mycobacterium avium subsp. paratuberculosis
cguccgaaaaacgcgucgcg

SEQ ID NO: 2836717 - RNA, 21 nt, Mycobacterium avium subsp. paratuberculosis
cguccgaaaaacgcgucgcgu

SEQ ID NO: 2836718 - RNA, 23 nt, Mycobacterium avium subsp. paratuberculosis
cguccgaacccguucccgacagc

SEQ ID NO: 2836719 - RNA, 17 nt, Mycobacterium avium subsp. paratuberculosis
cguccgaaucguugagc

SEQ ID NO: 2836720 - RNA, 13 nt, Mycobacterium avium subsp. paratuberculosis
cguccgacaccac

SEQ ID NO: 2836721 - RNA, 15 nt, Mycobacterium avium subsp. paratuberculosis
cguccgacaccaccu

SEQ ID NO: 2836722 - RNA, 16 nt, Mycobacterium avium subsp. paratuberculosis
cguccgacaccaccug

SEQ ID NO: 2836723 - RNA, 17 nt, Mycobacterium avium subsp. paratuberculosis
cguccgacaccaccugc

SEQ ID NO: 2836724 - RNA, 13 nt, Mycobacterium avium subsp. paratuberculosis
cguccgacagcgc

SEQ ID NO: 2836725 - RNA, 15 nt, Mycobacterium avium subsp. paratuberculosis
cguccgacagcgccu

SEQ ID NO: 2836726 - RNA, 17 nt, Mycobacterium avium subsp. paratuberculosis
cguccgaccguugaccg

SEQ ID NO: 2836727 - RNA, 21 nt, Mycobacterium avium subsp. paratuberculosis
cguccgacggcuaccugacca

SEQ ID NO: 2836728 - RNA, 17 nt, Mycobacterium avium subsp. paratuberculosis
cguccgacggcugggug

SEQ ID NO: 2836729 - RNA, 18 nt, Mycobacterium avium subsp. paratuberculosis
cguccgacggcugggugg

SEQ ID NO: 2836730 - RNA, 19 nt, Mycobacterium avium subsp. paratuberculosis
cguccgagaagggccgccg

SEQ ID NO: 2836731 - RNA, 20 nt, Mycobacterium avium subsp. paratuberculosis
cguccgagaagggccgccgc

SEQ ID NO: 2836732 - RNA, 23 nt, Mycobacterium avium subsp. paratuberculosis
cguccgagcagcagccgcagcgg

SEQ ID NO: 2836733 - RNA, 15 nt, Mycobacterium avium subsp. paratuberculosis
cguccgaggccccgc

SEQ ID NO: 2836734 - RNA, 16 nt, Mycobacterium avium subsp. paratuberculosis
cguccgauaccagccg

SEQ ID NO: 2836735 - RNA, 19 nt, Mycobacterium avium subsp. paratuberculosis
cguccgauaccagccgcgg

SEQ ID NO: 2836736 - RNA, 22 nt, Mycobacterium avium subsp. paratuberculosis
cguccgauaccagccgcggacg

SEQ ID NO: 2836737 - RNA, 23 nt, Mycobacterium avium subsp. paratuberculosis
cguccgauaccagccgcggacgg

SEQ ID NO: 2836738 - RNA, 16 nt, Mycobacterium avium subsp. paratuberculosis
cguccgcaaccgccgg

SEQ ID NO: 2836739 - RNA, 18 nt, Mycobacterium avium subsp. paratuberculosis
cguccgcaaccgccggca

SEQ ID NO: 2836740 - RNA, 20 nt, Mycobacterium avium subsp. paratuberculosis
cguccgcaaccgccggcagc

SEQ ID NO: 2836741 - RNA, 17 nt, Mycobacterium avium subsp. paratuberculosis
cguccgcaagcaccucg

SEQ ID NO: 2836742 - RNA, 20 nt, Mycobacterium avium subsp. paratuberculosis
cguccgccccgcugccggac

SEQ ID NO: 2836743 - RNA, 20 nt, Mycobacterium avium subsp. paratuberculosis
cguccgccuccgaccagccg

SEQ ID NO: 2836744 - RNA, 21 nt, Mycobacterium avium subsp. paratuberculosis
cguccgccuccgaccagccgg

SEQ ID NO: 2836745 - RNA, 15 nt, Mycobacterium avium subsp. paratuberculosis
cguccgcgacgcuga

SEQ ID NO: 2836746 - RNA, 21 nt, Mycobacterium avium subsp. paratuberculosis
cguccgcgacgcugagcgcca

SEQ ID NO: 2836747 - RNA, 22 nt, Mycobacterium avium subsp. paratuberculosis
cguccgcgacgcugagcgccag

SEQ ID NO: 2836748 - RNA, 12 nt, Mycobacterium avium subsp. paratuberculosis
cguccgcgaucg

SEQ ID NO: 2836749 - RNA, 20 nt, Mycobacterium avium subsp. paratuberculosis
cguccgcgaucgucucgucg

SEQ ID NO: 2836750 - RNA, 21 nt, Mycobacterium avium subsp. paratuberculosis
cguccgcgaucgucucgucga

SEQ ID NO: 2836751 - RNA, 15 nt, Mycobacterium avium subsp. paratuberculosis
cguccgcgcccaccc

SEQ ID NO: 2836752 - RNA, 18 nt, Mycobacterium avium subsp. paratuberculosis
cguccgcgcgagaguauc

SEQ ID NO: 2836753 - RNA, 13 nt, Mycobacterium avium subsp. paratuberculosis
cguccgcgcuggc

SEQ ID NO: 2836754 - RNA, 20 nt, Mycobacterium avium subsp. paratuberculosis
cguccgcgcuggcguugagc

SEQ ID NO: 2836755 - RNA, 14 nt, Mycobacterium avium subsp. paratuberculosis
cguccgcggccgcg

SEQ ID NO: 2836756 - RNA, 18 nt, Mycobacterium avium subsp. paratuberculosis
cguccgcggccgcggcgc

SEQ ID NO: 2836757 - RNA, 12 nt, Mycobacterium avium subsp. paratuberculosis
cguccgcggcgg

SEQ ID NO: 2836758 - RNA, 13 nt, Mycobacterium avium subsp. paratuberculosis
cguccgcggcgga

SEQ ID NO: 2836759 - RNA, 13 nt, Mycobacterium avium subsp. paratuberculosis
cguccgcggcggc

SEQ ID NO: 2836760 - RNA, 14 nt, Mycobacterium avium subsp. paratuberculosis
cguccgcggcggcc

SEQ ID NO: 2836761 - RNA, 15 nt, Mycobacterium avium subsp. paratuberculosis
cguccgcggcggcgu

SEQ ID NO: 2836762 - RNA, 16 nt, Mycobacterium avium subsp. paratuberculosis
cguccgcggcggcgug

SEQ ID NO: 2836763 - RNA, 21 nt, Mycobacterium avium subsp. paratuberculosis
cguccgcggcggcgugccgcc

SEQ ID NO: 2836764 - RNA, 19 nt, Mycobacterium avium subsp. paratuberculosis
cguccgcggugagcaccgg

SEQ ID NO: 2836765 - RNA, 23 nt, Mycobacterium avium subsp. paratuberculosis
cguccgcggugagcaccggaucg

SEQ ID NO: 2836766 - RNA, 20 nt, Mycobacterium avium subsp. paratuberculosis
cguccgcgguuucaccgugc

SEQ ID NO: 2836767 - RNA, 21 nt, Mycobacterium avium subsp. paratuberculosis
cguccgcgguuucaccgugcg

SEQ ID NO: 2836768 - RNA, 22 nt, Mycobacterium avium subsp. paratuberculosis
cguccgcgguuucaccgugcgc

SEQ ID NO: 2836769 - RNA, 23 nt, Mycobacterium avium subsp. paratuberculosis
cguccgcgguuucaccgugcgcg

SEQ ID NO: 2836770 - RNA, 16 nt, Mycobacterium avium subsp. paratuberculosis
cguccgcgucggcgcc

SEQ ID NO: 2836771 - RNA, 21 nt, Mycobacterium avium subsp. paratuberculosis
cguccgcgucggcgccggcca

SEQ ID NO: 2836772 - RNA, 17 nt, Mycobacterium avium subsp. paratuberculosis
cguccgcgucgucgagg

SEQ ID NO: 2836773 - RNA, 20 nt, Mycobacterium avium subsp. paratuberculosis
cguccgcgucgucgaggcgg

SEQ ID NO: 2836774 - RNA, 22 nt, Mycobacterium avium subsp. paratuberculosis
cguccggagaaccgcucgaugg

SEQ ID NO: 2836775 - RNA, 18 nt, Mycobacterium avium subsp. paratuberculosis
cguccggaggugccggcc

SEQ ID NO: 2836776 - RNA, 21 nt, Mycobacterium avium subsp. paratuberculosis
cguccggaggugccggccggu

SEQ ID NO: 2836777 - RNA, 18 nt, Mycobacterium avium subsp. paratuberculosis
cguccggauagccgucgg

SEQ ID NO: 2836778 - RNA, 17 nt, Mycobacterium avium subsp. paratuberculosis
cguccggcccggcgucc

SEQ ID NO: 2836779 - RNA, 12 nt, Mycobacterium avium subsp. paratuberculosis
cguccggcgaca

SEQ ID NO: 2836780 - RNA, 19 nt, Mycobacterium avium subsp. paratuberculosis
cguccggcgccagcccggu

SEQ ID NO: 2836781 - RNA, 14 nt, Mycobacterium avium subsp. paratuberculosis
cguccggcgcgcag

SEQ ID NO: 2836782 - RNA, 12 nt, Mycobacterium avium subsp. paratuberculosis
cguccggcggca

SEQ ID NO: 2836783 - RNA, 12 nt, Mycobacterium avium subsp. paratuberculosis
cguccgggccgc

SEQ ID NO: 2836784 - RNA, 20 nt, Mycobacterium avium subsp. paratuberculosis
cguccgggcguagugcagcu

SEQ ID NO: 2836785 - RNA, 21 nt, Mycobacterium avium subsp. paratuberculosis
cguccggggccggugcguccg

SEQ ID NO: 2836786 - RNA, 20 nt, Mycobacterium avium subsp. paratuberculosis
cguccgggguguaggcgucg

SEQ ID NO: 2836787 - RNA, 22 nt, Mycobacterium avium subsp. paratuberculosis
cguccgggguguaggcgucggc

SEQ ID NO: 2836788 - RNA, 21 nt, Mycobacterium avium subsp. paratuberculosis
cgucgaaauccacgaugccgg

SEQ ID NO: 2836789 - RNA, 13 nt, Mycobacterium avium subsp. paratuberculosis
cgucgaacacccu

SEQ ID NO: 2836790 - RNA, 21 nt, Mycobacterium avium subsp. paratuberculosis
cgucgaacacguugcgcauca

SEQ ID NO: 2836791 - RNA, 15 nt, Mycobacterium avium subsp. paratuberculosis
cgucgaacagccggg

SEQ ID NO: 2836792 - RNA, 17 nt, Mycobacterium avium subsp. paratuberculosis
cgucgaacagccgggcc

SEQ ID NO: 2836793 - RNA, 19 nt, Mycobacterium avium subsp. paratuberculosis
cgucgaacagccgggccgc

SEQ ID NO: 2836794 - RNA, 23 nt, Mycobacterium avium subsp. paratuberculosis
cgucgaacagccgggccgcccgc

SEQ ID NO: 2836795 - RNA, 12 nt, Mycobacterium avium subsp. paratuberculosis
cgucgaacagga

SEQ ID NO: 2836796 - RNA, 20 nt, Mycobacterium avium subsp. paratuberculosis
cgucgaacaggaugcagccg

SEQ ID NO: 2836797 - RNA, 23 nt, Mycobacterium avium subsp. paratuberculosis
cgucgaacccgaaaagcaccagg

SEQ ID NO: 2836798 - RNA, 16 nt, Mycobacterium avium subsp. paratuberculosis
cgucgaacccgacccc

SEQ ID NO: 2836799 - RNA, 18 nt, Mycobacterium avium subsp. paratuberculosis
cgucgaacccgaccccgg

SEQ ID NO: 2836800 - RNA, 22 nt, Mycobacterium avium subsp. paratuberculosis
cgucgaacccgaccccggcgag

SEQ ID NO: 2836801 - RNA, 22 nt, Mycobacterium avium subsp. paratuberculosis
cgucgaacgagaaggcggcguc

SEQ ID NO: 2836802 - RNA, 23 nt, Mycobacterium avium subsp. paratuberculosis
cgucgaacgagaaggcggcgucg

SEQ ID NO: 2836803 - RNA, 14 nt, Mycobacterium avium subsp. paratuberculosis
cgucgaacgcggcg

SEQ ID NO: 2836804 - RNA, 16 nt, Mycobacterium avium subsp. paratuberculosis
cgucgaacgcggcgaa

SEQ ID NO: 2836805 - RNA, 20 nt, Mycobacterium avium subsp. paratuberculosis
cgucgaacgcggcgaagcag

SEQ ID NO: 2836806 - RNA, 22 nt, Mycobacterium avium subsp. paratuberculosis
cgucgaacgcguacacggcccg

SEQ ID NO: 2836807 - RNA, 23 nt, Mycobacterium avium subsp. paratuberculosis
cgucgaacgcguacacggcccgc

SEQ ID NO: 2836808 - RNA, 14 nt, Mycobacterium avium subsp. paratuberculosis
cgucgaacggcguc

SEQ ID NO: 2836809 - RNA, 21 nt, Mycobacterium avium subsp. paratuberculosis
cgucgaacggcgucuggccgg

SEQ ID NO: 2836810 - RNA, 18 nt, Mycobacterium avium subsp. paratuberculosis
cgucgaacgggccgggca

SEQ ID NO: 2836811 - RNA, 21 nt, Mycobacterium avium subsp. paratuberculosis
cgucgaacgggccgggcaccg

SEQ ID NO: 2836812 - RNA, 22 nt, Mycobacterium avium subsp. paratuberculosis
cgucgaacgggccgggcaccgc

SEQ ID NO: 2836813 - RNA, 18 nt, Mycobacterium avium subsp. paratuberculosis
cgucgaacucgggcccga

SEQ ID NO: 2836814 - RNA, 22 nt, Mycobacterium avium subsp. paratuberculosis
cgucgaacucguggauguuguc

SEQ ID NO: 2836815 - RNA, 16 nt, Mycobacterium avium subsp. paratuberculosis
cgucgaacugcagccg

SEQ ID NO: 2836816 - RNA, 20 nt, Mycobacterium avium subsp. paratuberculosis
cgucgaacugcagccggcca

SEQ ID NO: 2836817 - RNA, 21 nt, Mycobacterium avium subsp. paratuberculosis
cgucgaacugcagccggccaa

SEQ ID NO: 2836818 - RNA, 19 nt, Mycobacterium avium subsp. paratuberculosis
cgucgaacugccaucccuc

SEQ ID NO: 2836819 - RNA, 21 nt, Mycobacterium avium subsp. paratuberculosis
cgucgaagaagucguucagcu

SEQ ID NO: 2836820 - RNA, 23 nt, Mycobacterium avium subsp. paratuberculosis
cgucgaagagcuggucgcccacc

SEQ ID NO: 2836821 - RNA, 21 nt, Mycobacterium avium subsp. paratuberculosis
cgucgaagccgaucaccggcg

SEQ ID NO: 2836822 - RNA, 17 nt, Mycobacterium avium subsp. paratuberculosis
cgucgaaggccgggcug

SEQ ID NO: 2836823 - RNA, 19 nt, Mycobacterium avium subsp. paratuberculosis
cgucgaaggccgggcuggu

SEQ ID NO: 2836824 - RNA, 15 nt, Mycobacterium avium subsp. paratuberculosis
cgucgaagggucggu

SEQ ID NO: 2836825 - RNA, 20 nt, Mycobacterium avium subsp. paratuberculosis
cgucgaagggucggucgagc

SEQ ID NO: 2836826 - RNA, 23 nt, Mycobacterium avium subsp. paratuberculosis
cgucgaagggucggucgagccug

SEQ ID NO: 2836827 - RNA, 19 nt, Mycobacterium avium subsp. paratuberculosis
cgucgaaggucugcagcag

SEQ ID NO: 2836828 - RNA, 20 nt, Mycobacterium avium subsp. paratuberculosis
cgucgaaggucugcagcagc

SEQ ID NO: 2836829 - RNA, 21 nt, Mycobacterium avium subsp. paratuberculosis
cgucgaaggucugcagcagcc

SEQ ID NO: 2836830 - RNA, 22 nt, Mycobacterium avium subsp. paratuberculosis
cgucgaaggucugcagcagccg

SEQ ID NO: 2836831 - RNA, 15 nt, Mycobacterium avium subsp. paratuberculosis
cgucgaaugcgcuca

SEQ ID NO: 2836832 - RNA, 13 nt, Mycobacterium avium subsp. paratuberculosis
cgucgacaccccg

SEQ ID NO: 2836833 - RNA, 19 nt, Mycobacterium avium subsp. paratuberculosis
cgucgacaccccgcucggc

SEQ ID NO: 2836834 - RNA, 13 nt, Mycobacterium avium subsp. paratuberculosis
cgucgacacgccg

SEQ ID NO: 2836835 - RNA, 14 nt, Mycobacterium avium subsp. paratuberculosis
cgucgacacgccgg

SEQ ID NO: 2836836 - RNA, 21 nt, Mycobacterium avium subsp. paratuberculosis
cgucgacagccggucgcgcau

SEQ ID NO: 2836837 - RNA, 13 nt, Mycobacterium avium subsp. paratuberculosis
cgucgaccaacgc

SEQ ID NO: 2836838 - RNA, 14 nt, Mycobacterium avium subsp. paratuberculosis
cgucgaccaacgcc

SEQ ID NO: 2836839 - RNA, 18 nt, Mycobacterium avium subsp. paratuberculosis
cgucgaccaacgccaugg

SEQ ID NO: 2836840 - RNA, 20 nt, Mycobacterium avium subsp. paratuberculosis
cgucgaccaacgccaugggc

SEQ ID NO: 2836841 - RNA, 12 nt, Mycobacterium avium subsp. paratuberculosis
cgucgaccacca

SEQ ID NO: 2836842 - RNA, 13 nt, Mycobacterium avium subsp. paratuberculosis
cgucgaccaccac

SEQ ID NO: 2836843 - RNA, 15 nt, Mycobacterium avium subsp. paratuberculosis
cgucgaccaccacga

SEQ ID NO: 2836844 - RNA, 19 nt, Mycobacterium avium subsp. paratuberculosis
cgucgaccaccacgaccag

SEQ ID NO: 2836845 - RNA, 19 nt, Mycobacterium avium subsp. paratuberculosis
cgucgaccaccgccggccc

SEQ ID NO: 2836846 - RNA, 23 nt, Mycobacterium avium subsp. paratuberculosis
cgucgaccacgaagggcgccagc

SEQ ID NO: 2836847 - RNA, 14 nt, Mycobacterium avium subsp. paratuberculosis
cgucgaccagccgc

SEQ ID NO: 2836848 - RNA, 15 nt, Mycobacterium avium subsp. paratuberculosis
cgucgaccagcgggc

SEQ ID NO: 2836849 - RNA, 12 nt, Mycobacterium avium subsp. paratuberculosis
cgucgaccagcu

SEQ ID NO: 2836850 - RNA, 13 nt, Mycobacterium avium subsp. paratuberculosis
cgucgaccaggac

SEQ ID NO: 2836851 - RNA, 19 nt, Mycobacterium avium subsp. paratuberculosis
cgucgaccaggacgucggc

SEQ ID NO: 2836852 - RNA, 23 nt, Mycobacterium avium subsp. paratuberculosis
cgucgaccaggacgucggccggc

SEQ ID NO: 2836853 - RNA, 20 nt, Mycobacterium avium subsp. paratuberculosis
cgucgaccagggcgaucacc

SEQ ID NO: 2836854 - RNA, 15 nt, Mycobacterium avium subsp. paratuberculosis
cgucgaccagguagg

SEQ ID NO: 2836855 - RNA, 21 nt, Mycobacterium avium subsp. paratuberculosis
cgucgaccccgccggcccggu

SEQ ID NO: 2836856 - RNA, 23 nt, Mycobacterium avium subsp. paratuberculosis
cgucgaccccgccggcccggucg

SEQ ID NO: 2836857 - RNA, 21 nt, Mycobacterium avium subsp. paratuberculosis
cgucgacccgcuccccgaucc

SEQ ID NO: 2836858 - RNA, 22 nt, Mycobacterium avium subsp. paratuberculosis
cgucgacccgcuccccgauccg

SEQ ID NO: 2836859 - RNA, 21 nt, Mycobacterium avium subsp. paratuberculosis
cgucgacccggccgcgccgga

SEQ ID NO: 2836860 - RNA, 22 nt, Mycobacterium avium subsp. paratuberculosis
cgucgacccguuccccggccga

SEQ ID NO: 2836861 - RNA, 14 nt, Mycobacterium avium subsp. paratuberculosis
cgucgaccgccacc

SEQ ID NO: 2836862 - RNA, 15 nt, Mycobacterium avium subsp. paratuberculosis
cgucgaccgccacca

SEQ ID NO: 2836863 - RNA, 17 nt, Mycobacterium avium subsp. paratuberculosis
cgucgaccgccaccaga

SEQ ID NO: 2836864 - RNA, 19 nt, Mycobacterium avium subsp. paratuberculosis
cgucgaccgccaccagauc

SEQ ID NO: 2836865 - RNA, 18 nt, Mycobacterium avium subsp. paratuberculosis
cgucgaccgccccgccgg

SEQ ID NO: 2836866 - RNA, 13 nt, Mycobacterium avium subsp. paratuberculosis
cgucgaccgccgc

SEQ ID NO: 2836867 - RNA, 15 nt, Mycobacterium avium subsp. paratuberculosis
cgucgaccgccgcga

SEQ ID NO: 2836868 - RNA, 22 nt, Mycobacterium avium subsp. paratuberculosis
cgucgaccgccgcgaacggguc

SEQ ID NO: 2836869 - RNA, 14 nt, Mycobacterium avium subsp. paratuberculosis
cgucgaccgcgacg

SEQ ID NO: 2836870 - RNA, 16 nt, Mycobacterium avium subsp. paratuberculosis
cgucgaccgcgacgac

SEQ ID NO: 2836871 - RNA, 15 nt, Mycobacterium avium subsp. paratuberculosis
cgucgaccgcgccgg

SEQ ID NO: 2836872 - RNA, 15 nt, Mycobacterium avium subsp. paratuberculosis
cgucgagccagcggg

SEQ ID NO: 2836873 - RNA, 19 nt, Mycobacterium avium subsp. paratuberculosis
cgucgagccgcucgcgcac

SEQ ID NO: 2836874 - RNA, 21 nt, Mycobacterium avium subsp. paratuberculosis
cgucgagccgcucgcgcaccg

SEQ ID NO: 2836875 - RNA, 14 nt, Mycobacterium avium subsp. paratuberculosis
cgucgagccggccg

SEQ ID NO: 2836876 - RNA, 16 nt, Mycobacterium avium subsp. paratuberculosis
cgucgagccggccgga

SEQ ID NO: 2836877 - RNA, 20 nt, Mycobacterium avium subsp. paratuberculosis
cgucgagccggccggacacc

SEQ ID NO: 2836878 - RNA, 12 nt, Mycobacterium avium subsp. paratuberculosis
cgucgagccggg

SEQ ID NO: 2836879 - RNA, 13 nt, Mycobacterium avium subsp. paratuberculosis
cgucgagccgggc

SEQ ID NO: 2836880 - RNA, 14 nt, Mycobacterium avium subsp. paratuberculosis
cgucgagccgggcc

SEQ ID NO: 2836881 - RNA, 15 nt, Mycobacterium avium subsp. paratuberculosis
cgucgagccgggccc

SEQ ID NO: 2836882 - RNA, 17 nt, Mycobacterium avium subsp. paratuberculosis
cgucgagccgggcccgg

SEQ ID NO: 2836883 - RNA, 14 nt, Mycobacterium avium subsp. paratuberculosis
cgucgagcgcggcc

SEQ ID NO: 2836884 - RNA, 16 nt, Mycobacterium avium subsp. paratuberculosis
cgucgagcgcggcccg

SEQ ID NO: 2836885 - RNA, 17 nt, Mycobacterium avium subsp. paratuberculosis
cgucgagcgcggcccgc

SEQ ID NO: 2836886 - RNA, 18 nt, Mycobacterium avium subsp. paratuberculosis
cgucgagcgcggcccgcc

SEQ ID NO: 2836887 - RNA, 19 nt, Mycobacterium avium subsp. paratuberculosis
cgucgagcgcggcccgccg

SEQ ID NO: 2836888 - RNA, 13 nt, Mycobacterium avium subsp. paratuberculosis
cgucgagcgcguc

SEQ ID NO: 2836889 - RNA, 14 nt, Mycobacterium avium subsp. paratuberculosis
cgucgagcgcgucg

SEQ ID NO: 2836890 - RNA, 15 nt, Mycobacterium avium subsp. paratuberculosis
cgucgagcgcgucgu

SEQ ID NO: 2836891 - RNA, 13 nt, Mycobacterium avium subsp. paratuberculosis
cgucgagcggccc

SEQ ID NO: 2836892 - RNA, 14 nt, Mycobacterium avium subsp. paratuberculosis
cgucgagcggcccg

SEQ ID NO: 2836893 - RNA, 15 nt, Mycobacterium avium subsp. paratuberculosis
cgucgagcggcccgu

SEQ ID NO: 2836894 - RNA, 17 nt, Mycobacterium avium subsp. paratuberculosis
cgucgagcggcccgucg

SEQ ID NO: 2836895 - RNA, 17 nt, Mycobacterium avium subsp. paratuberculosis
cgucgagcggcgccugg

SEQ ID NO: 2836896 - RNA, 18 nt, Mycobacterium avium subsp. paratuberculosis
cgucgagcggcgccuggu

SEQ ID NO: 2836897 - RNA, 23 nt, Mycobacterium avium subsp. paratuberculosis
cgucgagcggcgccuggucaagg

SEQ ID NO: 2836898 - RNA, 18 nt, Mycobacterium avium subsp. paratuberculosis
cgucgagcggcuugccgc

SEQ ID NO: 2836899 - RNA, 20 nt, Mycobacterium avium subsp. paratuberculosis
cgucgagcggcuugccgccg

SEQ ID NO: 2836900 - RNA, 21 nt, Mycobacterium avium subsp. paratuberculosis
cgucgagcggcuugccgccgc

SEQ ID NO: 2836901 - RNA, 22 nt, Mycobacterium avium subsp. paratuberculosis
cgucgagcggcuugccgccgca

SEQ ID NO: 2836902 - RNA, 17 nt, Mycobacterium avium subsp. paratuberculosis
cgucgagcgucacgccg

SEQ ID NO: 2836903 - RNA, 23 nt, Mycobacterium avium subsp. paratuberculosis
cgucgagcgucacgccgcgcccg

SEQ ID NO: 2836904 - RNA, 16 nt, Mycobacterium avium subsp. paratuberculosis
cgucgagcgucacgcu

SEQ ID NO: 2836905 - RNA, 20 nt, Mycobacterium avium subsp. paratuberculosis
cgucgagcgucauuccgccg

SEQ ID NO: 2836906 - RNA, 12 nt, Mycobacterium avium subsp. paratuberculosis
cgucgagcgugg

SEQ ID NO: 2836907 - RNA, 19 nt, Mycobacterium avium subsp. paratuberculosis
cgucgagcuccucggccag

SEQ ID NO: 2836908 - RNA, 20 nt, Mycobacterium avium subsp. paratuberculosis
cgucgagcuccucggccagc

SEQ ID NO: 2836909 - RNA, 22 nt, Mycobacterium avium subsp. paratuberculosis
cgucgagcuccucggccagcgg

SEQ ID NO: 2836910 - RNA, 21 nt, Mycobacterium avium subsp. paratuberculosis
cgucgaggccgaaccgcagcc

SEQ ID NO: 2836911 - RNA, 15 nt, Mycobacterium avium subsp. paratuberculosis
cgucgaggcgcugca

SEQ ID NO: 2836912 - RNA, 17 nt, Mycobacterium avium subsp. paratuberculosis
cgucgaggcgcugcagc

SEQ ID NO: 2836913 - RNA, 18 nt, Mycobacterium avium subsp. paratuberculosis
cgucgaggcgcugcagca

SEQ ID NO: 2836914 - RNA, 19 nt, Mycobacterium avium subsp. paratuberculosis
cgucgaggcgcugcagcau

SEQ ID NO: 2836915 - RNA, 20 nt, Mycobacterium avium subsp. paratuberculosis
cgucgagggccaccggcucc

SEQ ID NO: 2836916 - RNA, 16 nt, Mycobacterium avium subsp. paratuberculosis
cgucgagggcgccguu

SEQ ID NO: 2836917 - RNA, 17 nt, Mycobacterium avium subsp. paratuberculosis
cgucgagggcgccguug

SEQ ID NO: 2836918 - RNA, 23 nt, Mycobacterium avium subsp. paratuberculosis
cgucgagggugaugucgcugccg

SEQ ID NO: 2836919 - RNA, 13 nt, Mycobacterium avium subsp. paratuberculosis
cgucgaggucgcg

SEQ ID NO: 2836920 - RNA, 20 nt, Mycobacterium avium subsp. paratuberculosis
cgucgaggucggacgccucc

SEQ ID NO: 2836921 - RNA, 19 nt, Mycobacterium avium subsp. paratuberculosis
cgucgagguguugucgugc

SEQ ID NO: 2836922 - RNA, 18 nt, Mycobacterium avium subsp. paratuberculosis
cgucgagguucucgaacg

SEQ ID NO: 2836923 - RNA, 23 nt, Mycobacterium avium subsp. paratuberculosis
cgucgagguucucgaacgggucg

SEQ ID NO: 2836924 - RNA, 22 nt, Mycobacterium avium subsp. paratuberculosis
cgucgagguugaaucgccuacu

SEQ ID NO: 2836925 - RNA, 17 nt, Mycobacterium avium subsp. paratuberculosis
cgucgaguccguugggg

SEQ ID NO: 2836926 - RNA, 15 nt, Mycobacterium avium subsp. paratuberculosis
cgucgagucggccac

SEQ ID NO: 2836927 - RNA, 17 nt, Mycobacterium avium subsp. paratuberculosis
cgucgagucggccaccg

SEQ ID NO: 2836928 - RNA, 14 nt, Mycobacterium avium subsp. paratuberculosis
cgucgagugcucga

SEQ ID NO: 2836929 - RNA, 15 nt, Mycobacterium avium subsp. paratuberculosis
cgucgagugugaacc

SEQ ID NO: 2836930 - RNA, 14 nt, Mycobacterium avium subsp. paratuberculosis
cgucgaguucgccg

SEQ ID NO: 2836931 - RNA, 21 nt, Mycobacterium avium subsp. paratuberculosis
cgucgaguucgccgucgacgg

SEQ ID NO: 2836932 - RNA, 18 nt, Mycobacterium avium subsp. paratuberculosis
cgucgaguucgcggcgca

SEQ ID NO: 2836933 - RNA, 23 nt, Mycobacterium avium subsp. paratuberculosis
cgucgaguucgcggcgcagcacg

SEQ ID NO: 2836934 - RNA, 13 nt, Mycobacterium avium subsp. paratuberculosis
cgucgaguuguug

SEQ ID NO: 2836935 - RNA, 15 nt, Mycobacterium avium subsp. paratuberculosis
cgucgaucaccugcg

SEQ ID NO: 2836936 - RNA, 18 nt, Mycobacterium avium subsp. paratuberculosis
cgucgaucaccugcgggc

SEQ ID NO: 2836937 - RNA, 19 nt, Mycobacterium avium subsp. paratuberculosis
cgucgaucaccugcgggcg

SEQ ID NO: 2836938 - RNA, 14 nt, Mycobacterium avium subsp. paratuberculosis
cgucgaucacgccg

SEQ ID NO: 2836939 - RNA, 21 nt, Mycobacterium avium subsp. paratuberculosis
cgucgaucacgccgccggggc

SEQ ID NO: 2836940 - RNA, 13 nt, Mycobacterium avium subsp. paratuberculosis
cgucgaucagcgc

SEQ ID NO: 2836941 - RNA, 20 nt, Mycobacterium avium subsp. paratuberculosis
cgucgaucagcgcgccgccc

SEQ ID NO: 2836942 - RNA, 21 nt, Mycobacterium avium subsp. paratuberculosis
cgucgaucagcgcgccgccca

SEQ ID NO: 2836943 - RNA, 17 nt, Mycobacterium avium subsp. paratuberculosis
cgucgauccccacgucg

SEQ ID NO: 2836944 - RNA, 20 nt, Mycobacterium avium subsp. paratuberculosis
cgucgauccccacgucgccg

SEQ ID NO: 2836945 - RNA, 15 nt, Mycobacterium avium subsp. paratuberculosis
cgucgauccccgcag

SEQ ID NO: 2836946 - RNA, 23 nt, Mycobacterium avium subsp. paratuberculosis
cgucgaucccggacuccucggug

SEQ ID NO: 2836947 - RNA, 14 nt, Mycobacterium avium subsp. paratuberculosis
cgucgaucgacgcc

SEQ ID NO: 2836948 - RNA, 18 nt, Mycobacterium avium subsp. paratuberculosis
cgucgaucgacgccgaca

SEQ ID NO: 2836949 - RNA, 15 nt, Mycobacterium avium subsp. paratuberculosis
cgucgaucgcccgcu

SEQ ID NO: 2836950 - RNA, 14 nt, Mycobacterium avium subsp. paratuberculosis
cgucgaucgccguc

SEQ ID NO: 2836951 - RNA, 15 nt, Mycobacterium avium subsp. paratuberculosis
cgucgaucgcggcga

SEQ ID NO: 2836952 - RNA, 17 nt, Mycobacterium avium subsp. paratuberculosis
cgucgaucgcggcgaug

SEQ ID NO: 2836953 - RNA, 17 nt, Mycobacterium avium subsp. paratuberculosis
cgucgaucgcgucgaug

SEQ ID NO: 2836954 - RNA, 18 nt, Mycobacterium avium subsp. paratuberculosis
cgucgaucgcgucgaugc

SEQ ID NO: 2836955 - RNA, 19 nt, Mycobacterium avium subsp. paratuberculosis
cgucgaucgcgucgaugcc

SEQ ID NO: 2836956 - RNA, 21 nt, Mycobacterium avium subsp. paratuberculosis
cgucgaucgcgucgaugccgg

SEQ ID NO: 2836957 - RNA, 21 nt, Mycobacterium avium subsp. paratuberculosis
cgucgcccaccgacgcggcgg

SEQ ID NO: 2836958 - RNA, 15 nt, Mycobacterium avium subsp. paratuberculosis
cgucgcccaccgugu

SEQ ID NO: 2836959 - RNA, 14 nt, Mycobacterium avium subsp. paratuberculosis
cgucgcccacgccg

SEQ ID NO: 2836960 - RNA, 17 nt, Mycobacterium avium subsp. paratuberculosis
cgucgcccacgccggug

SEQ ID NO: 2836961 - RNA, 13 nt, Mycobacterium avium subsp. paratuberculosis
cgucgcccagcgu

SEQ ID NO: 2836962 - RNA, 18 nt, Mycobacterium avium subsp. paratuberculosis
cgucgcccagcgugucgg

SEQ ID NO: 2836963 - RNA, 20 nt, Mycobacterium avium subsp. paratuberculosis
cgucgcccagcgugucggcg

SEQ ID NO: 2836964 - RNA, 23 nt, Mycobacterium avium subsp. paratuberculosis
cgucgcccagcgugucggcgauc

SEQ ID NO: 2836965 - RNA, 19 nt, Mycobacterium avium subsp. paratuberculosis
cgucgcccaucaccagcag

SEQ ID NO: 2836966 - RNA, 22 nt, Mycobacterium avium subsp. paratuberculosis
cgucgcccaucaccagcagacc

SEQ ID NO: 2836967 - RNA, 15 nt, Mycobacterium avium subsp. paratuberculosis
cgucgccccgcaccg

SEQ ID NO: 2836968 - RNA, 18 nt, Mycobacterium avium subsp. paratuberculosis
cgucgccccgcaccgagc

SEQ ID NO: 2836969 - RNA, 15 nt, Mycobacterium avium subsp. paratuberculosis
cgucgcccgaacuca

SEQ ID NO: 2836970 - RNA, 21 nt, Mycobacterium avium subsp. paratuberculosis
cgucgcccgaacucauggcgu

SEQ ID NO: 2836971 - RNA, 14 nt, Mycobacterium avium subsp. paratuberculosis
cgucgcccgcccag

SEQ ID NO: 2836972 - RNA, 14 nt, Mycobacterium avium subsp. paratuberculosis
cgucgcccgccgac

SEQ ID NO: 2836973 - RNA, 13 nt, Mycobacterium avium subsp. paratuberculosis
cgucgcccggcgu

SEQ ID NO: 2836974 - RNA, 14 nt, Mycobacterium avium subsp. paratuberculosis
cgucgcccggcguc

SEQ ID NO: 2836975 - RNA, 15 nt, Mycobacterium avium subsp. paratuberculosis
cgucgcccggcgucc

SEQ ID NO: 2836976 - RNA, 19 nt, Mycobacterium avium subsp. paratuberculosis
cgucgcccgucucggcgug

SEQ ID NO: 2836977 - RNA, 21 nt, Mycobacterium avium subsp. paratuberculosis
cgucgcccugacacagcaccg

SEQ ID NO: 2836978 - RNA, 22 nt, Mycobacterium avium subsp. paratuberculosis
cgucgcccugacacagcaccgg

SEQ ID NO: 2836979 - RNA, 12 nt, Mycobacterium avium subsp. paratuberculosis
cgucgccgacca

SEQ ID NO: 2836980 - RNA, 14 nt, Mycobacterium avium subsp. paratuberculosis
cgucgccgaccagc

SEQ ID NO: 2836981 - RNA, 17 nt, Mycobacterium avium subsp. paratuberculosis
cgucgccgaccagccga

SEQ ID NO: 2836982 - RNA, 22 nt, Mycobacterium avium subsp. paratuberculosis
cgucgccgaccagccgaggcgc

SEQ ID NO: 2836983 - RNA, 23 nt, Mycobacterium avium subsp. paratuberculosis
cgucgccgaccaguucggccacc

SEQ ID NO: 2836984 - RNA, 16 nt, Mycobacterium avium subsp. paratuberculosis
cgucgccgacgggccc

SEQ ID NO: 2836985 - RNA, 16 nt, Mycobacterium avium subsp. paratuberculosis
cgucgccgacguuguu

SEQ ID NO: 2836986 - RNA, 17 nt, Mycobacterium avium subsp. paratuberculosis
cgucgccgagccgcgcc

SEQ ID NO: 2836987 - RNA, 18 nt, Mycobacterium avium subsp. paratuberculosis
cgucgccgagccgcgcca

SEQ ID NO: 2836988 - RNA, 20 nt, Mycobacterium avium subsp. paratuberculosis
cgucgccgagcucgugaugg

SEQ ID NO: 2836989 - RNA, 17 nt, Mycobacterium avium subsp. paratuberculosis
cgucgccgaucaccuga

SEQ ID NO: 2836990 - RNA, 24 nt, Mycobacterium avium subsp. paratuberculosis
cgucgccgaucaccugacagaccc

SEQ ID NO: 2836991 - RNA, 17 nt, Mycobacterium avium subsp. paratuberculosis
cgucgccgaucagcacc

SEQ ID NO: 2836992 - RNA, 20 nt, Mycobacterium avium subsp. paratuberculosis
cgucgccgaucagcaccagg

SEQ ID NO: 2836993 - RNA, 14 nt, Mycobacterium avium subsp. paratuberculosis
cgucgccgaucgcc

SEQ ID NO: 2836994 - RNA, 20 nt, Mycobacterium avium subsp. paratuberculosis
cgucgccgaucgcccgguag

SEQ ID NO: 2836995 - RNA, 13 nt, Mycobacterium avium subsp. paratuberculosis
cgucgccgaugcg

SEQ ID NO: 2836996 - RNA, 23 nt, Mycobacterium avium subsp. paratuberculosis
cgucgccgaugcgccgcaccagu

SEQ ID NO: 2836997 - RNA, 14 nt, Mycobacterium avium subsp. paratuberculosis
cgucgccgauggcg

SEQ ID NO: 2836998 - RNA, 22 nt, Mycobacterium avium subsp. paratuberculosis
cgucgccgauguaguccagccc

SEQ ID NO: 2836999 - RNA, 12 nt, Mycobacterium avium subsp. paratuberculosis
cgucgccgcccc

SEQ ID NO: 2837000 - RNA, 13 nt, Mycobacterium avium subsp. paratuberculosis
cgucgccgccccc

SEQ ID NO: 2837001 - RNA, 14 nt, Mycobacterium avium subsp. paratuberculosis
cgucgccgcccccg

SEQ ID NO: 2837002 - RNA, 19 nt, Mycobacterium avium subsp. paratuberculosis
cgucgccgcccccgauagc

SEQ ID NO: 2837003 - RNA, 15 nt, Mycobacterium avium subsp. paratuberculosis
cgucgccgccccgag

SEQ ID NO: 2837004 - RNA, 14 nt, Mycobacterium avium subsp. paratuberculosis
cgucgccgccgggc

SEQ ID NO: 2837005 - RNA, 13 nt, Mycobacterium avium subsp. paratuberculosis
cgucgccgccggu

SEQ ID NO: 2837006 - RNA, 14 nt, Mycobacterium avium subsp. paratuberculosis
cgucgccgccggug

SEQ ID NO: 2837007 - RNA, 19 nt, Mycobacterium avium subsp. paratuberculosis
cgucgccgccggugccgac

SEQ ID NO: 2837008 - RNA, 14 nt, Mycobacterium avium subsp. paratuberculosis
cgucgccgccguga

SEQ ID NO: 2837009 - RNA, 15 nt, Mycobacterium avium subsp. paratuberculosis
cgucgccgcgcccgc

SEQ ID NO: 2837010 - RNA, 13 nt, Mycobacterium avium subsp. paratuberculosis
cgucgccgcgcgc

SEQ ID NO: 2837011 - RNA, 13 nt, Mycobacterium avium subsp. paratuberculosis
cgucgccgcggua

SEQ ID NO: 2837012 - RNA, 13 nt, Mycobacterium avium subsp. paratuberculosis
cgucgccgcgugg

SEQ ID NO: 2837013 - RNA, 21 nt, Mycobacterium avium subsp. paratuberculosis
cgucgccgcuggugaacucgc

SEQ ID NO: 2837014 - RNA, 18 nt, Mycobacterium avium subsp. paratuberculosis
cgucgccggaggcgauca

SEQ ID NO: 2837015 - RNA, 15 nt, Mycobacterium avium subsp. paratuberculosis
cgucgccggccgcca

SEQ ID NO: 2837016 - RNA, 14 nt, Mycobacterium avium subsp. paratuberculosis
cgucgccggccgcg

SEQ ID NO: 2837017 - RNA, 16 nt, Mycobacterium avium subsp. paratuberculosis
cgucgccggccgcggu

SEQ ID NO: 2837018 - RNA, 17 nt, Mycobacterium avium subsp. paratuberculosis
cgucgccggccugcccg

SEQ ID NO: 2837019 - RNA, 18 nt, Mycobacterium avium subsp. paratuberculosis
cgucgccggccugcccgc

SEQ ID NO: 2837020 - RNA, 20 nt, Mycobacterium avium subsp. paratuberculosis
cgucgccggcgaccgccacc

SEQ ID NO: 2837021 - RNA, 14 nt, Mycobacterium avium subsp. paratuberculosis
cgucgccggcgcgc

SEQ ID NO: 2837022 - RNA, 15 nt, Mycobacterium avium subsp. paratuberculosis
cgucgccggcgcgca

SEQ ID NO: 2837023 - RNA, 17 nt, Mycobacterium avium subsp. paratuberculosis
cgucgccggcgcgcagc

SEQ ID NO: 2837024 - RNA, 23 nt, Mycobacterium avium subsp. paratuberculosis
cgucgccggcgcgggccgcagcg

SEQ ID NO: 2837025 - RNA, 14 nt, Mycobacterium avium subsp. paratuberculosis
cgucgccggcgggg

SEQ ID NO: 2837026 - RNA, 19 nt, Mycobacterium avium subsp. paratuberculosis
cgucgccggcggggcgucg

SEQ ID NO: 2837027 - RNA, 19 nt, Mycobacterium avium subsp. paratuberculosis
cgucgccggcugacugccg

SEQ ID NO: 2837028 - RNA, 17 nt, Mycobacterium avium subsp. paratuberculosis
cgucgccgggcggggug

SEQ ID NO: 2837029 - RNA, 20 nt, Mycobacterium avium subsp. paratuberculosis
cgucgccggugagcacggug

SEQ ID NO: 2837030 - RNA, 21 nt, Mycobacterium avium subsp. paratuberculosis
cgucgccggugagcacgguga

SEQ ID NO: 2837031 - RNA, 17 nt, Mycobacterium avium subsp. paratuberculosis
cgucgccgguggccgcc

SEQ ID NO: 2837032 - RNA, 15 nt, Mycobacterium avium subsp. paratuberculosis
cgucgccgucggggu

SEQ ID NO: 2837033 - RNA, 23 nt, Mycobacterium avium subsp. paratuberculosis
cgucgccgucggggucgcgccgg

SEQ ID NO: 2837034 - RNA, 17 nt, Mycobacterium avium subsp. paratuberculosis
cgucgccgugccggacc

SEQ ID NO: 2837035 - RNA, 14 nt, Mycobacterium avium subsp. paratuberculosis
cgucgccguggcgg

SEQ ID NO: 2837036 - RNA, 18 nt, Mycobacterium avium subsp. paratuberculosis
cgucgccguggcggcccg

SEQ ID NO: 2837037 - RNA, 20 nt, Mycobacterium avium subsp. paratuberculosis
cgucgccguggcggcccgac

SEQ ID NO: 2837038 - RNA, 23 nt, Mycobacterium avium subsp. paratuberculosis
cgucgccguggcggcccgaccag

SEQ ID NO: 2837039 - RNA, 18 nt, Mycobacterium avium subsp. paratuberculosis
cgucgccuccugcuggcg

SEQ ID NO: 2837040 - RNA, 19 nt, Mycobacterium avium subsp. paratuberculosis
cgucgccuccugcuggcgc

SEQ ID NO: 2837041 - RNA, 23 nt, Mycobacterium avium subsp. paratuberculosis
cgucgccuccugcuggcgcugcc

SEQ ID NO: 2837042 - RNA, 23 nt, Mycobacterium avium subsp. paratuberculosis
cgucgcgguugaucacaccgucg

SEQ ID NO: 2837043 - RNA, 17 nt, Mycobacterium avium subsp. paratuberculosis
cgucgcgucccuggcga

SEQ ID NO: 2837044 - RNA, 14 nt, Mycobacterium avium subsp. paratuberculosis
cgucgcguccgagc

SEQ ID NO: 2837045 - RNA, 16 nt, Mycobacterium avium subsp. paratuberculosis
cgucgcguccgagcag

SEQ ID NO: 2837046 - RNA, 17 nt, Mycobacterium avium subsp. paratuberculosis
cgucgcguccgagcagc

SEQ ID NO: 2837047 - RNA, 16 nt, Mycobacterium avium subsp. paratuberculosis
cgucgcuaccucacca

SEQ ID NO: 2837048 - RNA, 20 nt, Mycobacterium avium subsp. paratuberculosis
cgucgcuaguugcacuuucg

SEQ ID NO: 2837049 - RNA, 14 nt, Mycobacterium avium subsp. paratuberculosis
cgucgcugacgccg

SEQ ID NO: 2837050 - RNA, 15 nt, Mycobacterium avium subsp. paratuberculosis
cgucgcugacgccga

SEQ ID NO: 2837051 - RNA, 20 nt, Mycobacterium avium subsp. paratuberculosis
cgucgcugacgccgagcagc

SEQ ID NO: 2837052 - RNA, 14 nt, Mycobacterium avium subsp. paratuberculosis
cgucgcugaucgcg

SEQ ID NO: 2837053 - RNA, 22 nt, Mycobacterium avium subsp. paratuberculosis
cgucgcugaucgcgauccgggc

SEQ ID NO: 2837054 - RNA, 21 nt, Mycobacterium avium subsp. paratuberculosis
cgucgcugcaguagccggcca

SEQ ID NO: 2837055 - RNA, 20 nt, Mycobacterium avium subsp. paratuberculosis
cgucgcugccguagcgcugg

SEQ ID NO: 2837056 - RNA, 19 nt, Mycobacterium avium subsp. paratuberculosis
cgucgcugggcagccgucc

SEQ ID NO: 2837057 - RNA, 23 nt, Mycobacterium avium subsp. paratuberculosis
cgucgcuguccucgagcgcgucg

SEQ ID NO: 2837058 - RNA, 14 nt, Mycobacterium avium subsp. paratuberculosis
cgucgcugucggcg

SEQ ID NO: 2837059 - RNA, 15 nt, Mycobacterium avium subsp. paratuberculosis
cgucgcugucggcga

SEQ ID NO: 2837060 - RNA, 18 nt, Mycobacterium avium subsp. paratuberculosis
cgucggaauacagcagcu

SEQ ID NO: 2837061 - RNA, 23 nt, Mycobacterium avium subsp. paratuberculosis
cgucggaauacagcagcugcguc

SEQ ID NO: 2837062 - RNA, 15 nt, Mycobacterium avium subsp. paratuberculosis
cgucggacaccagca

SEQ ID NO: 2837063 - RNA, 16 nt, Mycobacterium avium subsp. paratuberculosis
cgucggacaccagcau

SEQ ID NO: 2837064 - RNA, 18 nt, Mycobacterium avium subsp. paratuberculosis
cgucggacaccagcaugg

SEQ ID NO: 2837065 - RNA, 16 nt, Mycobacterium avium subsp. paratuberculosis
cgucggacagcagcac

SEQ ID NO: 2837066 - RNA, 18 nt, Mycobacterium avium subsp. paratuberculosis
cgucggacagcagcaccg

SEQ ID NO: 2837067 - RNA, 22 nt, Mycobacterium avium subsp. paratuberculosis
cgucggacagcagcaccggcac

SEQ ID NO: 2837068 - RNA, 15 nt, Mycobacterium avium subsp. paratuberculosis
cgucggacaugccgg

SEQ ID NO: 2837069 - RNA, 22 nt, Mycobacterium avium subsp. paratuberculosis
cgucggacaugccggcgccgau

SEQ ID NO: 2837070 - RNA, 15 nt, Mycobacterium avium subsp. paratuberculosis
cgucggacgcggccg

SEQ ID NO: 2837071 - RNA, 18 nt, Mycobacterium avium subsp. paratuberculosis
cgucggagacguugccgc

SEQ ID NO: 2837072 - RNA, 18 nt, Mycobacterium avium subsp. paratuberculosis
cgucggagaucaccggca

SEQ ID NO: 2837073 - RNA, 20 nt, Mycobacterium avium subsp. paratuberculosis
cgucggagaucaccggcacc

SEQ ID NO: 2837074 - RNA, 22 nt, Mycobacterium avium subsp. paratuberculosis
cgucggaggacaacgcgucgaa

SEQ ID NO: 2837075 - RNA, 16 nt, Mycobacterium avium subsp. paratuberculosis
cgucggaggcggcgua

SEQ ID NO: 2837076 - RNA, 16 nt, Mycobacterium avium subsp. paratuberculosis
cgucggaggcgucgac

SEQ ID NO: 2837077 - RNA, 17 nt, Mycobacterium avium subsp. paratuberculosis
cgucggaggcgucgacg

SEQ ID NO: 2837078 - RNA, 21 nt, Mycobacterium avium subsp. paratuberculosis
cgucggaggcgucgacgcgcu

SEQ ID NO: 2837079 - RNA, 15 nt, Mycobacterium avium subsp. paratuberculosis
cgucggagucgcugu

SEQ ID NO: 2837080 - RNA, 16 nt, Mycobacterium avium subsp. paratuberculosis
cgucggcaacgccggg

SEQ ID NO: 2837081 - RNA, 17 nt, Mycobacterium avium subsp. paratuberculosis
cgucggcaacgccgggu

SEQ ID NO: 2837082 - RNA, 19 nt, Mycobacterium avium subsp. paratuberculosis
cgucggcaacgccgggucc

SEQ ID NO: 2837083 - RNA, 20 nt, Mycobacterium avium subsp. paratuberculosis
cgucggcaacgccgggucca

SEQ ID NO: 2837084 - RNA, 18 nt, Mycobacterium avium subsp. paratuberculosis
cgucggcaaugaccggca

SEQ ID NO: 2837085 - RNA, 20 nt, Mycobacterium avium subsp. paratuberculosis
cgucggcaaugaccggcacc

SEQ ID NO: 2837086 - RNA, 21 nt, Mycobacterium avium subsp. paratuberculosis
cgucggcaaugaccggcacca

SEQ ID NO: 2837087 - RNA, 24 nt, Mycobacterium avium subsp. paratuberculosis
cgucggcaaugaccggcaccagca

SEQ ID NO: 2837088 - RNA, 13 nt, Mycobacterium avium subsp. paratuberculosis
cgucggcaccagc

SEQ ID NO: 2837089 - RNA, 15 nt, Mycobacterium avium subsp. paratuberculosis
cgucggcaccagcgg

SEQ ID NO: 2837090 - RNA, 16 nt, Mycobacterium avium subsp. paratuberculosis
cgucggcaccagcggc

SEQ ID NO: 2837091 - RNA, 18 nt, Mycobacterium avium subsp. paratuberculosis
cgucggcagcgacgcggu

SEQ ID NO: 2837092 - RNA, 19 nt, Mycobacterium avium subsp. paratuberculosis
cgucggcaguugcacuuuc

SEQ ID NO: 2837093 - RNA, 16 nt, Mycobacterium avium subsp. paratuberculosis
cgucggcauccacccg

SEQ ID NO: 2837094 - RNA, 13 nt, Mycobacterium avium subsp. paratuberculosis
cgucggccaccgc

SEQ ID NO: 2837095 - RNA, 14 nt, Mycobacterium avium subsp. paratuberculosis
cgucggccaccgcg

SEQ ID NO: 2837096 - RNA, 15 nt, Mycobacterium avium subsp. paratuberculosis
cgucggccaccgcgc

SEQ ID NO: 2837097 - RNA, 17 nt, Mycobacterium avium subsp. paratuberculosis
cgucggccaccgcgccu

SEQ ID NO: 2837098 - RNA, 13 nt, Mycobacterium avium subsp. paratuberculosis
cgucggccacgcc

SEQ ID NO: 2837099 - RNA, 15 nt, Mycobacterium avium subsp. paratuberculosis
cgucggccacgccgg

SEQ ID NO: 2837100 - RNA, 13 nt, Mycobacterium avium subsp. paratuberculosis
cgucggccacgcu

SEQ ID NO: 2837101 - RNA, 16 nt, Mycobacterium avium subsp. paratuberculosis
cgucggccacgcucgc

SEQ ID NO: 2837102 - RNA, 16 nt, Mycobacterium avium subsp. paratuberculosis
cgucggccagcaccac

SEQ ID NO: 2837103 - RNA, 13 nt, Mycobacterium avium subsp. paratuberculosis
cgucggccagcag

SEQ ID NO: 2837104 - RNA, 18 nt, Mycobacterium avium subsp. paratuberculosis
cgucggccagcagcgcgu

SEQ ID NO: 2837105 - RNA, 14 nt, Mycobacterium avium subsp. paratuberculosis
cgucggccagcgag

SEQ ID NO: 2837106 - RNA, 14 nt, Mycobacterium avium subsp. paratuberculosis
cgucggccagcgcg

SEQ ID NO: 2837107 - RNA, 15 nt, Mycobacterium avium subsp. paratuberculosis
cgucggccagcgcgc

SEQ ID NO: 2837108 - RNA, 17 nt, Mycobacterium avium subsp. paratuberculosis
cgucggccagcgcgcgg

SEQ ID NO: 2837109 - RNA, 18 nt, Mycobacterium avium subsp. paratuberculosis
cgucggccagcgcgcggg

SEQ ID NO: 2837110 - RNA, 21 nt, Mycobacterium avium subsp. paratuberculosis
cgucggccagcgcgcgggcgc

SEQ ID NO: 2837111 - RNA, 15 nt, Mycobacterium avium subsp. paratuberculosis
cgucggccagcgcgu

SEQ ID NO: 2837112 - RNA, 13 nt, Mycobacterium avium subsp. paratuberculosis
cgucggccagcgg

SEQ ID NO: 2837113 - RNA, 14 nt, Mycobacterium avium subsp. paratuberculosis
cgucggccagcggc

SEQ ID NO: 2837114 - RNA, 15 nt, Mycobacterium avium subsp. paratuberculosis
cgucggccagcggca

SEQ ID NO: 2837115 - RNA, 19 nt, Mycobacterium avium subsp. paratuberculosis
cgucggccagcggcagcga

SEQ ID NO: 2837116 - RNA, 17 nt, Mycobacterium avium subsp. paratuberculosis
cgucggccaggaucucg

SEQ ID NO: 2837117 - RNA, 19 nt, Mycobacterium avium subsp. paratuberculosis
cgucggccaguucaccgcg

SEQ ID NO: 2837118 - RNA, 22 nt, Mycobacterium avium subsp. paratuberculosis
cgucggccaguucaccgcgcuc

SEQ ID NO: 2837119 - RNA, 16 nt, Mycobacterium avium subsp. paratuberculosis
cgucggccaucagccg

SEQ ID NO: 2837120 - RNA, 19 nt, Mycobacterium avium subsp. paratuberculosis
cgucggccaucagccgccg

SEQ ID NO: 2837121 - RNA, 20 nt, Mycobacterium avium subsp. paratuberculosis
cgucggcccagacgaugucg

SEQ ID NO: 2837122 - RNA, 23 nt, Mycobacterium avium subsp. paratuberculosis
cgucggcccagacgaugucgucg

SEQ ID NO: 2837123 - RNA, 21 nt, Mycobacterium avium subsp. paratuberculosis
cgucggcccaguccagucgcg

SEQ ID NO: 2837124 - RNA, 11 nt, Mycobacterium avium subsp. paratuberculosis
cgucggcccgc

SEQ ID NO: 2837125 - RNA, 12 nt, Mycobacterium avium subsp. paratuberculosis
cgucggcccgcc

SEQ ID NO: 2837126 - RNA, 14 nt, Mycobacterium avium subsp. paratuberculosis
cgucggcccgccaa

SEQ ID NO: 2837127 - RNA, 14 nt, Mycobacterium avium subsp. paratuberculosis
cgucggcggacugg

SEQ ID NO: 2837128 - RNA, 23 nt, Mycobacterium avium subsp. paratuberculosis
cgucggcggagaugacguggauc

SEQ ID NO: 2837129 - RNA, 21 nt, Mycobacterium avium subsp. paratuberculosis
cgucggcggaggucauggcga

SEQ ID NO: 2837130 - RNA, 13 nt, Mycobacterium avium subsp. paratuberculosis
cgucggcggccga

SEQ ID NO: 2837131 - RNA, 14 nt, Mycobacterium avium subsp. paratuberculosis
cgucggcggccgac

SEQ ID NO: 2837132 - RNA, 20 nt, Mycobacterium avium subsp. paratuberculosis
cgucggcggccgacccugcg

SEQ ID NO: 2837133 - RNA, 13 nt, Mycobacterium avium subsp. paratuberculosis
cgucggcggccgc

SEQ ID NO: 2837134 - RNA, 15 nt, Mycobacterium avium subsp. paratuberculosis
cgucggcggccgcga

SEQ ID NO: 2837135 - RNA, 14 nt, Mycobacterium avium subsp. paratuberculosis
cgucggcggccugc

SEQ ID NO: 2837136 - RNA, 19 nt, Mycobacterium avium subsp. paratuberculosis
cgucggcggccugcuccag

SEQ ID NO: 2837137 - RNA, 17 nt, Mycobacterium avium subsp. paratuberculosis
cgucggcggccuugacg

SEQ ID NO: 2837138 - RNA, 18 nt, Mycobacterium avium subsp. paratuberculosis
cgucggcggcgacggcga

SEQ ID NO: 2837139 - RNA, 21 nt, Mycobacterium avium subsp. paratuberculosis
cgucggcggcgacggcgacca

SEQ ID NO: 2837140 - RNA, 14 nt, Mycobacterium avium subsp. paratuberculosis
cgucggcggcggcc

SEQ ID NO: 2837141 - RNA, 15 nt, Mycobacterium avium subsp. paratuberculosis
cgucggcggcggcgg

SEQ ID NO: 2837142 - RNA, 15 nt, Mycobacterium avium subsp. paratuberculosis
cgucggcgggcaccu

SEQ ID NO: 2837143 - RNA, 22 nt, Mycobacterium avium subsp. paratuberculosis
cgucggcgggcaccucggccag

SEQ ID NO: 2837144 - RNA, 19 nt, Mycobacterium avium subsp. paratuberculosis
cgucggcgggcugcagcga

SEQ ID NO: 2837145 - RNA, 21 nt, Mycobacterium avium subsp. paratuberculosis
cgucggcgggggauccgccug

SEQ ID NO: 2837146 - RNA, 16 nt, Mycobacterium avium subsp. paratuberculosis
cgucggcggucgccag

SEQ ID NO: 2837147 - RNA, 19 nt, Mycobacterium avium subsp. paratuberculosis
cgucggcggucuuggcggc

SEQ ID NO: 2837148 - RNA, 14 nt, Mycobacterium avium subsp. paratuberculosis
cgucggcggugccg

SEQ ID NO: 2837149 - RNA, 16 nt, Mycobacterium avium subsp. paratuberculosis
cgucggcggugguccg

SEQ ID NO: 2837150 - RNA, 21 nt, Mycobacterium avium subsp. paratuberculosis
cgucggcggugguccgcgcga

SEQ ID NO: 2837151 - RNA, 18 nt, Mycobacterium avium subsp. paratuberculosis
cgucggcggugucgaagg

SEQ ID NO: 2837152 - RNA, 23 nt, Mycobacterium avium subsp. paratuberculosis
cgucggcggugucgaaggccggg

SEQ ID NO: 2837153 - RNA, 22 nt, Mycobacterium avium subsp. paratuberculosis
cgucggcgguuucggugccggc

SEQ ID NO: 2837154 - RNA, 13 nt, Mycobacterium avium subsp. paratuberculosis
cgucggcguacac

SEQ ID NO: 2837155 - RNA, 19 nt, Mycobacterium avium subsp. paratuberculosis
cgucggcguacugcgcgac

SEQ ID NO: 2837156 - RNA, 19 nt, Mycobacterium avium subsp. paratuberculosis
cgucggcguagggcagccc

SEQ ID NO: 2837157 - RNA, 20 nt, Mycobacterium avium subsp. paratuberculosis
cgucggcguagggcagcccg

SEQ ID NO: 2837158 - RNA, 15 nt, Mycobacterium avium subsp. paratuberculosis
cgucggcgucaucga

SEQ ID NO: 2837159 - RNA, 13 nt, Mycobacterium avium subsp. paratuberculosis
cgucggcgucgac

SEQ ID NO: 2837160 - RNA, 20 nt, Mycobacterium avium subsp. paratuberculosis
cgucggcgucgacgacggcg

SEQ ID NO: 2837161 - RNA, 15 nt, Mycobacterium avium subsp. paratuberculosis
cgucggcgugcccgc

SEQ ID NO: 2837162 - RNA, 16 nt, Mycobacterium avium subsp. paratuberculosis
cgucggcgugcccgcc

SEQ ID NO: 2837163 - RNA, 17 nt, Mycobacterium avium subsp. paratuberculosis
cgucggcgugcccgccg

SEQ ID NO: 2837164 - RNA, 21 nt, Mycobacterium avium subsp. paratuberculosis
cgucggcgugcccgccgacca

SEQ ID NO: 2837165 - RNA, 18 nt, Mycobacterium avium subsp. paratuberculosis
cgucggcguucagcggca

SEQ ID NO: 2837166 - RNA, 16 nt, Mycobacterium avium subsp. paratuberculosis
cgucggcuagcggcug

SEQ ID NO: 2837167 - RNA, 17 nt, Mycobacterium avium subsp. paratuberculosis
cgucggcuuccuccucg

SEQ ID NO: 2837168 - RNA, 20 nt, Mycobacterium avium subsp. paratuberculosis
cgucggcuuccuccucggcg

SEQ ID NO: 2837169 - RNA, 24 nt, Mycobacterium avium subsp. paratuberculosis
cgucggcuuccuccucggcgcgga

SEQ ID NO: 2837170 - RNA, 22 nt, Mycobacterium avium subsp. paratuberculosis
cgucgggaacgccgaucaccgc

SEQ ID NO: 2837171 - RNA, 21 nt, Mycobacterium avium subsp. paratuberculosis
cgucgggaaugucggcguugg

SEQ ID NO: 2837172 - RNA, 16 nt, Mycobacterium avium subsp. paratuberculosis
cgucgggaccgucgcg

SEQ ID NO: 2837173 - RNA, 20 nt, Mycobacterium avium subsp. paratuberculosis
cgucgggaccgucgcgcagc

SEQ ID NO: 2837174 - RNA, 14 nt, Mycobacterium avium subsp. paratuberculosis
cgucgggacgcggc

SEQ ID NO: 2837175 - RNA, 17 nt, Mycobacterium avium subsp. paratuberculosis
cgucgggacggccagca

SEQ ID NO: 2837176 - RNA, 18 nt, Mycobacterium avium subsp. paratuberculosis
cgucgggacggccagcag

SEQ ID NO: 2837177 - RNA, 17 nt, Mycobacterium avium subsp. paratuberculosis
cgucgggcacaucccgc

SEQ ID NO: 2837178 - RNA, 15 nt, Mycobacterium avium subsp. paratuberculosis
cgucgggcaccacgg

SEQ ID NO: 2837179 - RNA, 20 nt, Mycobacterium avium subsp. paratuberculosis
cgucgggcaccacggcggca

SEQ ID NO: 2837180 - RNA, 16 nt, Mycobacterium avium subsp. paratuberculosis
cgucgggcaccagcac

SEQ ID NO: 2837181 - RNA, 18 nt, Mycobacterium avium subsp. paratuberculosis
cgucgggcaccagcaccg

SEQ ID NO: 2837182 - RNA, 15 nt, Mycobacterium avium subsp. paratuberculosis
cgucgggcaccgcca

SEQ ID NO: 2837183 - RNA, 16 nt, Mycobacterium avium subsp. paratuberculosis
cgucgggcaccgccag

SEQ ID NO: 2837184 - RNA, 17 nt, Mycobacterium avium subsp. paratuberculosis
cgucgggcaccgccagg

SEQ ID NO: 2837185 - RNA, 15 nt, Mycobacterium avium subsp. paratuberculosis
cgucgggcacgguca

SEQ ID NO: 2837186 - RNA, 11 nt, Mycobacterium avium subsp. paratuberculosis
cgucgggcagc

SEQ ID NO: 2837187 - RNA, 15 nt, Mycobacterium avium subsp. paratuberculosis
cgucgggcagcagcu

SEQ ID NO: 2837188 - RNA, 14 nt, Mycobacterium avium subsp. paratuberculosis
cgucgggccacaac

SEQ ID NO: 2837189 - RNA, 15 nt, Mycobacterium avium subsp. paratuberculosis
cgucgggccgcagca

SEQ ID NO: 2837190 - RNA, 12 nt, Mycobacterium avium subsp. paratuberculosis
cgucgggccggg

SEQ ID NO: 2837191 - RNA, 13 nt, Mycobacterium avium subsp. paratuberculosis
cgucgggccgggg

SEQ ID NO: 2837192 - RNA, 18 nt, Mycobacterium avium subsp. paratuberculosis
cgucgggccguccgccgg

SEQ ID NO: 2837193 - RNA, 12 nt, Mycobacterium avium subsp. paratuberculosis
cgucgggcgcca

SEQ ID NO: 2837194 - RNA, 17 nt, Mycobacterium avium subsp. paratuberculosis
cgucgggcgccagcccg

SEQ ID NO: 2837195 - RNA, 18 nt, Mycobacterium avium subsp. paratuberculosis
cgucgggcgccagcccgc

SEQ ID NO: 2837196 - RNA, 22 nt, Mycobacterium avium subsp. paratuberculosis
cgucgggcgccagcccgcccag

SEQ ID NO: 2837197 - RNA, 13 nt, Mycobacterium avium subsp. paratuberculosis
cgucgggcgccgg

SEQ ID NO: 2837198 - RNA, 14 nt, Mycobacterium avium subsp. paratuberculosis
cgucgggcgccggc

SEQ ID NO: 2837199 - RNA, 15 nt, Mycobacterium avium subsp. paratuberculosis
cgucgggcgccggcg

SEQ ID NO: 2837200 - RNA, 21 nt, Mycobacterium avium subsp. paratuberculosis
cgucgggcgccggcgcguccg

SEQ ID NO: 2837201 - RNA, 14 nt, Mycobacterium avium subsp. paratuberculosis
cgucgggcgcggcg

SEQ ID NO: 2837202 - RNA, 15 nt, Mycobacterium avium subsp. paratuberculosis
cgucgggcgcggcgg

SEQ ID NO: 2837203 - RNA, 22 nt, Mycobacterium avium subsp. paratuberculosis
cgucgggcgcggugugggcgau

SEQ ID NO: 2837204 - RNA, 15 nt, Mycobacterium avium subsp. paratuberculosis
cgucgggcggcagga

SEQ ID NO: 2837205 - RNA, 14 nt, Mycobacterium avium subsp. paratuberculosis
cgucgggcggggug

SEQ ID NO: 2837206 - RNA, 22 nt, Mycobacterium avium subsp. paratuberculosis
cgucgggcgggguggccaccac

SEQ ID NO: 2837207 - RNA, 21 nt, Mycobacterium avium subsp. paratuberculosis
cgucgggcggggugugcggca

SEQ ID NO: 2837208 - RNA, 22 nt, Mycobacterium avium subsp. paratuberculosis
cgucgggcggggugugcggcac

SEQ ID NO: 2837209 - RNA, 13 nt, Mycobacterium avium subsp. paratuberculosis
cgucgggcucgcc

SEQ ID NO: 2837210 - RNA, 15 nt, Mycobacterium avium subsp. paratuberculosis
cgucgggcucgcggu

SEQ ID NO: 2837211 - RNA, 14 nt, Mycobacterium avium subsp. paratuberculosis
cgucgggcucggcc

SEQ ID NO: 2837212 - RNA, 20 nt, Mycobacterium avium subsp. paratuberculosis
cgucggugggccgccgcggc

SEQ ID NO: 2837213 - RNA, 19 nt, Mycobacterium avium subsp. paratuberculosis
cgucggugggggccaggcg

SEQ ID NO: 2837214 - RNA, 21 nt, Mycobacterium avium subsp. paratuberculosis
cgucgguggggugaggcaccc

SEQ ID NO: 2837215 - RNA, 22 nt, Mycobacterium avium subsp. paratuberculosis
cgucgguggggugaggcacccg

SEQ ID NO: 2837216 - RNA, 23 nt, Mycobacterium avium subsp. paratuberculosis
cgucgguggggugaggcacccgc

SEQ ID NO: 2837217 - RNA, 17 nt, Mycobacterium avium subsp. paratuberculosis
cgucgguggucucguac

SEQ ID NO: 2837218 - RNA, 14 nt, Mycobacterium avium subsp. paratuberculosis
cgucgguggugacg

SEQ ID NO: 2837219 - RNA, 21 nt, Mycobacterium avium subsp. paratuberculosis
cgucgguguagcccucccgga

SEQ ID NO: 2837220 - RNA, 20 nt, Mycobacterium avium subsp. paratuberculosis
cgucgguguagcgagugccg

SEQ ID NO: 2837221 - RNA, 15 nt, Mycobacterium avium subsp. paratuberculosis
cgucgguguagucgg

SEQ ID NO: 2837222 - RNA, 17 nt, Mycobacterium avium subsp. paratuberculosis
cgucgguguagucggcg

SEQ ID NO: 2837223 - RNA, 20 nt, Mycobacterium avium subsp. paratuberculosis
cgucgguguagucggcgauc

SEQ ID NO: 2837224 - RNA, 21 nt, Mycobacterium avium subsp. paratuberculosis
cgucgguguagucggcgaucg

SEQ ID NO: 2837225 - RNA, 22 nt, Mycobacterium avium subsp. paratuberculosis
cgucgguguagucggcgaucgg

SEQ ID NO: 2837226 - RNA, 23 nt, Mycobacterium avium subsp. paratuberculosis
cgucgguguccaggucguuggag

SEQ ID NO: 2837227 - RNA, 20 nt, Mycobacterium avium subsp. paratuberculosis
cgucggugucccgcgcccgc

SEQ ID NO: 2837228 - RNA, 16 nt, Mycobacterium avium subsp. paratuberculosis
cgucgguuucggucgc

SEQ ID NO: 2837229 - RNA, 19 nt, Mycobacterium avium subsp. paratuberculosis
cgucguacaccucggucgg

SEQ ID NO: 2837230 - RNA, 22 nt, Mycobacterium avium subsp. paratuberculosis
cgucguacaccucggucgggga

SEQ ID NO: 2837231 - RNA, 14 nt, Mycobacterium avium subsp. paratuberculosis
cgucguacagcagc

SEQ ID NO: 2837232 - RNA, 18 nt, Mycobacterium avium subsp. paratuberculosis
cgucguacagcagccccu

SEQ ID NO: 2837233 - RNA, 17 nt, Mycobacterium avium subsp. paratuberculosis
cgucguacucgaccgcg

SEQ ID NO: 2837234 - RNA, 15 nt, Mycobacterium avium subsp. paratuberculosis
cgucguagacgcugc

SEQ ID NO: 2837235 - RNA, 18 nt, Mycobacterium avium subsp. paratuberculosis
cgucguagacgcugccgc

SEQ ID NO: 2837236 - RNA, 19 nt, Mycobacterium avium subsp. paratuberculosis
cgucguagacgcugccgcu

SEQ ID NO: 2837237 - RNA, 23 nt, Mycobacterium avium subsp. paratuberculosis
cgucguagacgcugccgcuggcg

SEQ ID NO: 2837238 - RNA, 22 nt, Mycobacterium avium subsp. paratuberculosis
cgucguagagcaggaccgagcc

SEQ ID NO: 2837239 - RNA, 23 nt, Mycobacterium avium subsp. paratuberculosis
cgucguagagcaggaccgagccg

SEQ ID NO: 2837240 - RNA, 16 nt, Mycobacterium avium subsp. paratuberculosis
cgucguagccgcgggu

SEQ ID NO: 2837241 - RNA, 18 nt, Mycobacterium avium subsp. paratuberculosis
cgucguagccggcacgca

SEQ ID NO: 2837242 - RNA, 15 nt, Mycobacterium avium subsp. paratuberculosis
cgucguaggcgcgga

SEQ ID NO: 2837243 - RNA, 16 nt, Mycobacterium avium subsp. paratuberculosis
cgucguaggcgcggac

SEQ ID NO: 2837244 - RNA, 15 nt, Mycobacterium avium subsp. paratuberculosis
cgucguagucgcucg

SEQ ID NO: 2837245 - RNA, 21 nt, Mycobacterium avium subsp. paratuberculosis
cgucguagucgcucggcggcg

SEQ ID NO: 2837246 - RNA, 22 nt, Mycobacterium avium subsp. paratuberculosis
cgucguagucgcucggcggcga

SEQ ID NO: 2837247 - RNA, 15 nt, Mycobacterium avium subsp. paratuberculosis
cgucguaguugcggc

SEQ ID NO: 2837248 - RNA, 19 nt, Mycobacterium avium subsp. paratuberculosis
cgucguaguugcggccggc

SEQ ID NO: 2837249 - RNA, 18 nt, Mycobacterium avium subsp. paratuberculosis
cgucguauucgacggcga

SEQ ID NO: 2837250 - RNA, 14 nt, Mycobacterium avium subsp. paratuberculosis
cgucgucaccucga

SEQ ID NO: 2837251 - RNA, 15 nt, Mycobacterium avium subsp. paratuberculosis
cgucgucagccgggc

SEQ ID NO: 2837252 - RNA, 17 nt, Mycobacterium avium subsp. paratuberculosis
cgucgucagccgggcca

SEQ ID NO: 2837253 - RNA, 18 nt, Mycobacterium avium subsp. paratuberculosis
cgucgucagccgggccag

SEQ ID NO: 2837254 - RNA, 21 nt, Mycobacterium avium subsp. paratuberculosis
cgucgucagccgggccagccc

SEQ ID NO: 2837255 - RNA, 15 nt, Mycobacterium avium subsp. paratuberculosis
cgucgucagguccgc

SEQ ID NO: 2837256 - RNA, 22 nt, Mycobacterium avium subsp. paratuberculosis
cgucgucaucgucuccgcuguc

SEQ ID NO: 2837257 - RNA, 15 nt, Mycobacterium avium subsp. paratuberculosis
cgucguccacgccca

SEQ ID NO: 2837258 - RNA, 16 nt, Mycobacterium avium subsp. paratuberculosis
cgucguccacgcccag

SEQ ID NO: 2837259 - RNA, 17 nt, Mycobacterium avium subsp. paratuberculosis
cgucguccacgcccagc

SEQ ID NO: 2837260 - RNA, 23 nt, Mycobacterium avium subsp. paratuberculosis
cgucguccagcuucucggcgucc

SEQ ID NO: 2837261 - RNA, 20 nt, Mycobacterium avium subsp. paratuberculosis
cgucgucccaggguugccgc

SEQ ID NO: 2837262 - RNA, 14 nt, Mycobacterium avium subsp. paratuberculosis
cgucgucccgucgg

SEQ ID NO: 2837263 - RNA, 19 nt, Mycobacterium avium subsp. paratuberculosis
cgucgucccgucggcgcga

SEQ ID NO: 2837264 - RNA, 20 nt, Mycobacterium avium subsp. paratuberculosis
cgucguccgcaaccgccggc

SEQ ID NO: 2837265 - RNA, 22 nt, Mycobacterium avium subsp. paratuberculosis
cgucguccgcaaccgccggcag

SEQ ID NO: 2837266 - RNA, 18 nt, Mycobacterium avium subsp. paratuberculosis
cgucguccggcgcgcagc

SEQ ID NO: 2837267 - RNA, 21 nt, Mycobacterium avium subsp. paratuberculosis
cgucguccuugagcccccacc

SEQ ID NO: 2837268 - RNA, 22 nt, Mycobacterium avium subsp. paratuberculosis
cgucguccuugagcccccaccu

SEQ ID NO: 2837269 - RNA, 15 nt, Mycobacterium avium subsp. paratuberculosis
cgucgucgacccgcu

SEQ ID NO: 2837270 - RNA, 12 nt, Mycobacterium avium subsp. paratuberculosis
cgucgucgagca

SEQ ID NO: 2837271 - RNA, 15 nt, Mycobacterium avium subsp. paratuberculosis
cgucgucgagcaccg

SEQ ID NO: 2837272 - RNA, 20 nt, Mycobacterium avium subsp. paratuberculosis
cgucgucgaugcgcagcagc

SEQ ID NO: 2837273 - RNA, 23 nt, Mycobacterium avium subsp. paratuberculosis
cgucgucgaugcgcagcagcggc

SEQ ID NO: 2837274 - RNA, 13 nt, Mycobacterium avium subsp. paratuberculosis
cgucgucgcaccg

SEQ ID NO: 2837275 - RNA, 15 nt, Mycobacterium avium subsp. paratuberculosis
cgucgucgcagugcc

SEQ ID NO: 2837276 - RNA, 14 nt, Mycobacterium avium subsp. paratuberculosis
cgucgucgccgaaa

SEQ ID NO: 2837277 - RNA, 13 nt, Mycobacterium avium subsp. paratuberculosis
cgucgucgccgau

SEQ ID NO: 2837278 - RNA, 13 nt, Mycobacterium avium subsp. paratuberculosis
cgucgucgccgcc

SEQ ID NO: 2837279 - RNA, 15 nt, Mycobacterium avium subsp. paratuberculosis
cgucgucgccgccgg

SEQ ID NO: 2837280 - RNA, 18 nt, Mycobacterium avium subsp. paratuberculosis
cgucgucgccgccgguga

SEQ ID NO: 2837281 - RNA, 13 nt, Mycobacterium avium subsp. paratuberculosis
cgucgucgccggg

SEQ ID NO: 2837282 - RNA, 12 nt, Mycobacterium avium subsp. paratuberculosis
cgucgucgccgu

SEQ ID NO: 2837283 - RNA, 14 nt, Mycobacterium avium subsp. paratuberculosis
cgucgucgcgcagg

SEQ ID NO: 2837284 - RNA, 16 nt, Mycobacterium avium subsp. paratuberculosis
cgucgucgcggcgcug

SEQ ID NO: 2837285 - RNA, 19 nt, Mycobacterium avium subsp. paratuberculosis
cgucgucgcuccacaucug

SEQ ID NO: 2837286 - RNA, 14 nt, Mycobacterium avium subsp. paratuberculosis
cgucgucgcugcag

SEQ ID NO: 2837287 - RNA, 18 nt, Mycobacterium avium subsp. paratuberculosis
cgucgucggacaccagca

SEQ ID NO: 2837288 - RNA, 15 nt, Mycobacterium avium subsp. paratuberculosis
cgucgucggacagca

SEQ ID NO: 2837289 - RNA, 18 nt, Mycobacterium avium subsp. paratuberculosis
cgucgucggacagcagca

SEQ ID NO: 2837290 - RNA, 23 nt, Mycobacterium avium subsp. paratuberculosis
cgucgucggacagcagcaccggc

SEQ ID NO: 2837291 - RNA, 14 nt, Mycobacterium avium subsp. paratuberculosis
cgucgucggagacg

SEQ ID NO: 2837292 - RNA, 12 nt, Mycobacterium avium subsp. paratuberculosis
cgucgucggccc

SEQ ID NO: 2837293 - RNA, 13 nt, Mycobacterium avium subsp. paratuberculosis
cgucgucggccca

SEQ ID NO: 2837294 - RNA, 14 nt, Mycobacterium avium subsp. paratuberculosis
cgucgucggccggc

SEQ ID NO: 2837295 - RNA, 17 nt, Mycobacterium avium subsp. paratuberculosis
cgucgucggccucggcg

SEQ ID NO: 2837296 - RNA, 16 nt, Mycobacterium avium subsp. paratuberculosis
cgucucccccgaucag

SEQ ID NO: 2837297 - RNA, 17 nt, Mycobacterium avium subsp. paratuberculosis
cgucuccggcgggcugg

SEQ ID NO: 2837298 - RNA, 23 nt, Mycobacterium avium subsp. paratuberculosis
cgucuccucgaccagcgcgccgc

SEQ ID NO: 2837299 - RNA, 14 nt, Mycobacterium avium subsp. paratuberculosis
cgucuccuggggca

SEQ ID NO: 2837300 - RNA, 18 nt, Mycobacterium avium subsp. paratuberculosis
cgucuccuggggcagauc

SEQ ID NO: 2837301 - RNA, 20 nt, Mycobacterium avium subsp. paratuberculosis
cgucuccuggggcagaucgu

SEQ ID NO: 2837302 - RNA, 11 nt, Mycobacterium avium subsp. paratuberculosis
cgucucgaacc

SEQ ID NO: 2837303 - RNA, 18 nt, Mycobacterium avium subsp. paratuberculosis
cgucucgaaccgucuagc

SEQ ID NO: 2837304 - RNA, 22 nt, Mycobacterium avium subsp. paratuberculosis
cgucucgaaccgucuagcggcg

SEQ ID NO: 2837305 - RNA, 16 nt, Mycobacterium avium subsp. paratuberculosis
cgucucgaccacccgg

SEQ ID NO: 2837306 - RNA, 19 nt, Mycobacterium avium subsp. paratuberculosis
cgucucgaccacccggcgg

SEQ ID NO: 2837307 - RNA, 16 nt, Mycobacterium avium subsp. paratuberculosis
cgucucgacccgggcc

SEQ ID NO: 2837308 - RNA, 18 nt, Mycobacterium avium subsp. paratuberculosis
cgucucgacccgggccag

SEQ ID NO: 2837309 - RNA, 15 nt, Mycobacterium avium subsp. paratuberculosis
cgucucgacggcgcc

SEQ ID NO: 2837310 - RNA, 16 nt, Mycobacterium avium subsp. paratuberculosis
cgucucgacggcgccg

SEQ ID NO: 2837311 - RNA, 19 nt, Mycobacterium avium subsp. paratuberculosis
cgucucgacggcgccgacg

SEQ ID NO: 2837312 - RNA, 16 nt, Mycobacterium avium subsp. paratuberculosis
cgucucgagccggcgc

SEQ ID NO: 2837313 - RNA, 17 nt, Mycobacterium avium subsp. paratuberculosis
cgucucgagccggcgca

SEQ ID NO: 2837314 - RNA, 18 nt, Mycobacterium avium subsp. paratuberculosis
cgucucgagccggcgcac

SEQ ID NO: 2837315 - RNA, 15 nt, Mycobacterium avium subsp. paratuberculosis
cgucucgccggggaa

SEQ ID NO: 2837316 - RNA, 16 nt, Mycobacterium avium subsp. paratuberculosis
cgucucggagcggugu

SEQ ID NO: 2837317 - RNA, 19 nt, Mycobacterium avium subsp. paratuberculosis
cgucucggagcggugucgc

SEQ ID NO: 2837318 - RNA, 14 nt, Mycobacterium avium subsp. paratuberculosis
cgucucggccagcc

SEQ ID NO: 2837319 - RNA, 15 nt, Mycobacterium avium subsp. paratuberculosis
cgucucggccagccg

SEQ ID NO: 2837320 - RNA, 17 nt, Mycobacterium avium subsp. paratuberculosis
cgucucggccagccggu

SEQ ID NO: 2837321 - RNA, 13 nt, Mycobacterium avium subsp. paratuberculosis
cgucucggccgcg

SEQ ID NO: 2837322 - RNA, 14 nt, Mycobacterium avium subsp. paratuberculosis
cgucucggccgcgg

SEQ ID NO: 2837323 - RNA, 16 nt, Mycobacterium avium subsp. paratuberculosis
cgucucggccgcggug

SEQ ID NO: 2837324 - RNA, 18 nt, Mycobacterium avium subsp. paratuberculosis
cgucucggccgcggugcg

SEQ ID NO: 2837325 - RNA, 13 nt, Mycobacterium avium subsp. paratuberculosis
cgucucggcgauc

SEQ ID NO: 2837326 - RNA, 13 nt, Mycobacterium avium subsp. paratuberculosis
cgucucggcggcc

SEQ ID NO: 2837327 - RNA, 14 nt, Mycobacterium avium subsp. paratuberculosis
cgucucggcggccg

SEQ ID NO: 2837328 - RNA, 15 nt, Mycobacterium avium subsp. paratuberculosis
cgucucggcggccga

SEQ ID NO: 2837329 - RNA, 19 nt, Mycobacterium avium subsp. paratuberculosis
cgucucggcggccgagcgc

SEQ ID NO: 2837330 - RNA, 18 nt, Mycobacterium avium subsp. paratuberculosis
cgucucggcgucucggcc

SEQ ID NO: 2837331 - RNA, 19 nt, Mycobacterium avium subsp. paratuberculosis
cgucucggcgucucggccc

SEQ ID NO: 2837332 - RNA, 20 nt, Mycobacterium avium subsp. paratuberculosis
cgucucggcgucucggcccg

SEQ ID NO: 2837333 - RNA, 21 nt, Mycobacterium avium subsp. paratuberculosis
cgucucggcgugcucggccac

SEQ ID NO: 2837334 - RNA, 14 nt, Mycobacterium avium subsp. paratuberculosis
cgucucggugucgg

SEQ ID NO: 2837335 - RNA, 18 nt, Mycobacterium avium subsp. paratuberculosis
cgucucggugucggacuu

SEQ ID NO: 2837336 - RNA, 20 nt, Mycobacterium avium subsp. paratuberculosis
cgucucggugucggacuugu

SEQ ID NO: 2837337 - RNA, 17 nt, Mycobacterium avium subsp. paratuberculosis
cgucucgucggccgcga

SEQ ID NO: 2837338 - RNA, 15 nt, Mycobacterium avium subsp. paratuberculosis
cgucucugucgucga

SEQ ID NO: 2837339 - RNA, 16 nt, Mycobacterium avium subsp. paratuberculosis
cgucucugucgucgac

SEQ ID NO: 2837340 - RNA, 18 nt, Mycobacterium avium subsp. paratuberculosis
cgucucuuccucgggcag

SEQ ID NO: 2837341 - RNA, 15 nt, Mycobacterium avium subsp. paratuberculosis
cgucugcgccccggc

SEQ ID NO: 2837342 - RNA, 22 nt, Mycobacterium avium subsp. paratuberculosis
cgucugcgccccggcgucgaug

SEQ ID NO: 2837343 - RNA, 14 nt, Mycobacterium avium subsp. paratuberculosis
cgucugcgccguca

SEQ ID NO: 2837344 - RNA, 16 nt, Mycobacterium avium subsp. paratuberculosis
cgucugcggcucggcg

SEQ ID NO: 2837345 - RNA, 18 nt, Mycobacterium avium subsp. paratuberculosis
cgucugcggcucggcgcu

SEQ ID NO: 2837346 - RNA, 22 nt, Mycobacterium avium subsp. paratuberculosis
cgucugcgggaagcccaccgcg

SEQ ID NO: 2837347 - RNA, 22 nt, Mycobacterium avium subsp. paratuberculosis
cgucugcucccaggacggcgcg

SEQ ID NO: 2837348 - RNA, 14 nt, Mycobacterium avium subsp. paratuberculosis
cgucugcucgccag

SEQ ID NO: 2837349 - RNA, 22 nt, Mycobacterium avium subsp. paratuberculosis
cgucugcucgccgucacaccgc

SEQ ID NO: 2837350 - RNA, 14 nt, Mycobacterium avium subsp. paratuberculosis
cgucugcucgcgcc

SEQ ID NO: 2837351 - RNA, 13 nt, Mycobacterium avium subsp. paratuberculosis
cgucugcucggcg

SEQ ID NO: 2837352 - RNA, 16 nt, Mycobacterium avium subsp. paratuberculosis
cgucugcucggcggcu

SEQ ID NO: 2837353 - RNA, 15 nt, Mycobacterium avium subsp. paratuberculosis
cgucugcucggcggg

SEQ ID NO: 2837354 - RNA, 16 nt, Mycobacterium avium subsp. paratuberculosis
cgucugcucggcgggu

SEQ ID NO: 2837355 - RNA, 17 nt, Mycobacterium avium subsp. paratuberculosis
cgucugcugcgccaucu

SEQ ID NO: 2837356 - RNA, 14 nt, Mycobacterium avium subsp. paratuberculosis
cgucugcuggaugg

SEQ ID NO: 2837357 - RNA, 20 nt, Mycobacterium avium subsp. paratuberculosis
cgucuggcagccggccggca

SEQ ID NO: 2837358 - RNA, 21 nt, Mycobacterium avium subsp. paratuberculosis
cgucuggcagccggccggcag

SEQ ID NO: 2837359 - RNA, 13 nt, Mycobacterium avium subsp. paratuberculosis
cgucuggccaccg

SEQ ID NO: 2837360 - RNA, 22 nt, Mycobacterium avium subsp. paratuberculosis
cgucuggccaccgaagccgacg

SEQ ID NO: 2837361 - RNA, 13 nt, Mycobacterium avium subsp. paratuberculosis
cgucuggccguug

SEQ ID NO: 2837362 - RNA, 19 nt, Mycobacterium avium subsp. paratuberculosis
cgucugguuggccggcggg

SEQ ID NO: 2837363 - RNA, 15 nt, Mycobacterium avium subsp. paratuberculosis
cgucuuccgggccac

SEQ ID NO: 2837364 - RNA, 18 nt, Mycobacterium avium subsp. paratuberculosis
cgucuuccgggccaccgu

SEQ ID NO: 2837365 - RNA, 17 nt, Mycobacterium avium subsp. paratuberculosis
cgucuucggggccgccg

SEQ ID NO: 2837366 - RNA, 13 nt, Mycobacterium avium subsp. paratuberculosis
cgucuucuuggcc

SEQ ID NO: 2837367 - RNA, 16 nt, Mycobacterium avium subsp. paratuberculosis
cgucuucuuggccgcg

SEQ ID NO: 2837368 - RNA, 19 nt, Mycobacterium avium subsp. paratuberculosis
cgucuucuuggccgcggcc

SEQ ID NO: 2837369 - RNA, 13 nt, Mycobacterium avium subsp. paratuberculosis
cgucuugaccgcc

SEQ ID NO: 2837370 - RNA, 16 nt, Mycobacterium avium subsp. paratuberculosis
cgucuugaccgcccgg

SEQ ID NO: 2837371 - RNA, 19 nt, Mycobacterium avium subsp. paratuberculosis
cgucuugaucucggcggcg

SEQ ID NO: 2837372 - RNA, 13 nt, Mycobacterium avium subsp. paratuberculosis
cgucuugcagccg

SEQ ID NO: 2837373 - RNA, 15 nt, Mycobacterium avium subsp. paratuberculosis
cgucuugcagccggg

SEQ ID NO: 2837374 - RNA, 15 nt, Mycobacterium avium subsp. paratuberculosis
cgucuugcccagcgg

SEQ ID NO: 2837375 - RNA, 15 nt, Mycobacterium avium subsp. paratuberculosis
cgucuugccguugac

SEQ ID NO: 2837376 - RNA, 15 nt, Mycobacterium avium subsp. paratuberculosis
cgucuuggacgcccg

SEQ ID NO: 2837377 - RNA, 18 nt, Mycobacterium avium subsp. paratuberculosis
cgucuuggccaggcccug

SEQ ID NO: 2837378 - RNA, 17 nt, Mycobacterium avium subsp. paratuberculosis
cgucuuggugcgagcca

SEQ ID NO: 2837379 - RNA, 22 nt, Mycobacterium avium subsp. paratuberculosis
cgucuuggugugugcgucggca

SEQ ID NO: 2837380 - RNA, 14 nt, Mycobacterium avium subsp. paratuberculosis
cgucuugucgggga

SEQ ID NO: 2837381 - RNA, 16 nt, Mycobacterium avium subsp. paratuberculosis
cgugacgcucggcggc

SEQ ID NO: 2837382 - RNA, 14 nt, Mycobacterium avium subsp. paratuberculosis
cgugacgcucgggc

SEQ ID NO: 2837383 - RNA, 18 nt, Mycobacterium avium subsp. paratuberculosis
cgugacgcucgggcuucg

SEQ ID NO: 2837384 - RNA, 19 nt, Mycobacterium avium subsp. paratuberculosis
cgugacgcucgggcuucgg

SEQ ID NO: 2837385 - RNA, 19 nt, Mycobacterium avium subsp. paratuberculosis
cgugacgcucggggccggu

SEQ ID NO: 2837386 - RNA, 22 nt, Mycobacterium avium subsp. paratuberculosis
cgugacggcaucggcgcccucg

SEQ ID NO: 2837387 - RNA, 14 nt, Mycobacterium avium subsp. paratuberculosis
cgugacggccgcgg

SEQ ID NO: 2837388 - RNA, 15 nt, Mycobacterium avium subsp. paratuberculosis
cgugacggccgcggc

SEQ ID NO: 2837389 - RNA, 13 nt, Mycobacterium avium subsp. paratuberculosis
cgugacggcgggg

SEQ ID NO: 2837390 - RNA, 20 nt, Mycobacterium avium subsp. paratuberculosis
cgugacggucgaccucgagc

SEQ ID NO: 2837391 - RNA, 14 nt, Mycobacterium avium subsp. paratuberculosis
cgugacgucgacgu

SEQ ID NO: 2837392 - RNA, 22 nt, Mycobacterium avium subsp. paratuberculosis
cgugacgugccccucgacccga

SEQ ID NO: 2837393 - RNA, 15 nt, Mycobacterium avium subsp. paratuberculosis
cgugacguucggcca

SEQ ID NO: 2837394 - RNA, 16 nt, Mycobacterium avium subsp. paratuberculosis
cgugacguucggccaa

SEQ ID NO: 2837395 - RNA, 16 nt, Mycobacterium avium subsp. paratuberculosis
cgugacguucgucagc

SEQ ID NO: 2837396 - RNA, 15 nt, Mycobacterium avium subsp. paratuberculosis
cgugacuggguggga

SEQ ID NO: 2837397 - RNA, 19 nt, Mycobacterium avium subsp. paratuberculosis
cgugacuugucgggccgca

SEQ ID NO: 2837398 - RNA, 17 nt, Mycobacterium avium subsp. paratuberculosis
cgugagauccagcagcc

SEQ ID NO: 2837399 - RNA, 22 nt, Mycobacterium avium subsp. paratuberculosis
cgugagcgguggccacgcccca

SEQ ID NO: 2837400 - RNA, 19 nt, Mycobacterium avium subsp. paratuberculosis
cgugaguucgcugaccgcc

SEQ ID NO: 2837401 - RNA, 20 nt, Mycobacterium avium subsp. paratuberculosis
cgugaguucgcugaccgcca

SEQ ID NO: 2837402 - RNA, 15 nt, Mycobacterium avium subsp. paratuberculosis
cgugauagcggccgc

SEQ ID NO: 2837403 - RNA, 16 nt, Mycobacterium avium subsp. paratuberculosis
cgugauagcggccgcg

SEQ ID NO: 2837404 - RNA, 17 nt, Mycobacterium avium subsp. paratuberculosis
cgugauagcggccgcgg

SEQ ID NO: 2837405 - RNA, 18 nt, Mycobacterium avium subsp. paratuberculosis
cgugauagcggccgcgga

SEQ ID NO: 2837406 - RNA, 15 nt, Mycobacterium avium subsp. paratuberculosis
cgugauaguggucgu

SEQ ID NO: 2837407 - RNA, 20 nt, Mycobacterium avium subsp. paratuberculosis
cgugauaucccuugccgccg

SEQ ID NO: 2837408 - RNA, 18 nt, Mycobacterium avium subsp. paratuberculosis
cgugauccggcacugaag

SEQ ID NO: 2837409 - RNA, 16 nt, Mycobacterium avium subsp. paratuberculosis
cgugaucgccaccacc

SEQ ID NO: 2837410 - RNA, 19 nt, Mycobacterium avium subsp. paratuberculosis
cgugaucgccaccaccagc

SEQ ID NO: 2837411 - RNA, 17 nt, Mycobacterium avium subsp. paratuberculosis
cgugaucgccacggcgg

SEQ ID NO: 2837412 - RNA, 19 nt, Mycobacterium avium subsp. paratuberculosis
cgugaucgccacggcggug

SEQ ID NO: 2837413 - RNA, 13 nt, Mycobacterium avium subsp. paratuberculosis
cgugaucgcggug

SEQ ID NO: 2837414 - RNA, 14 nt, Mycobacterium avium subsp. paratuberculosis
cgugaucgcggugg

SEQ ID NO: 2837415 - RNA, 14 nt, Mycobacterium avium subsp. paratuberculosis
cgugaucggccagc

SEQ ID NO: 2837416 - RNA, 13 nt, Mycobacterium avium subsp. paratuberculosis
cgugaucggcggc

SEQ ID NO: 2837417 - RNA, 14 nt, Mycobacterium avium subsp. paratuberculosis
cgugaucggcggcc

SEQ ID NO: 2837418 - RNA, 20 nt, Mycobacterium avium subsp. paratuberculosis
cgugaucggcggccugcggc

SEQ ID NO: 2837419 - RNA, 22 nt, Mycobacterium avium subsp. paratuberculosis
cgugaucuggucggccagcgcg

SEQ ID NO: 2837420 - RNA, 18 nt, Mycobacterium avium subsp. paratuberculosis
cgugaucuggugggcggg

SEQ ID NO: 2837421 - RNA, 21 nt, Mycobacterium avium subsp. paratuberculosis
cgugaucuggugggcgggcac

SEQ ID NO: 2837422 - RNA, 17 nt, Mycobacterium avium subsp. paratuberculosis
cgugaucuguucggcgg

SEQ ID NO: 2837423 - RNA, 21 nt, Mycobacterium avium subsp. paratuberculosis
cgugaucuguucggcggcgau

SEQ ID NO: 2837424 - RNA, 22 nt, Mycobacterium avium subsp. paratuberculosis
cgugaucuguucggcggcgauc

SEQ ID NO: 2837425 - RNA, 19 nt, Mycobacterium avium subsp. paratuberculosis
cgugaugaccagggccucg

SEQ ID NO: 2837426 - RNA, 14 nt, Mycobacterium avium subsp. paratuberculosis
cgugaugacggcgg

SEQ ID NO: 2837427 - RNA, 15 nt, Mycobacterium avium subsp. paratuberculosis
cgugaugacggcggc

SEQ ID NO: 2837428 - RNA, 17 nt, Mycobacterium avium subsp. paratuberculosis
cgugaugacggcggcgg

SEQ ID NO: 2837429 - RNA, 19 nt, Mycobacterium avium subsp. paratuberculosis
cgugaugacggcggcggug

SEQ ID NO: 2837430 - RNA, 23 nt, Mycobacterium avium subsp. paratuberculosis
cgugaugacggcggcggugccgc

SEQ ID NO: 2837431 - RNA, 17 nt, Mycobacterium avium subsp. paratuberculosis
cgugaugcacccggacg

SEQ ID NO: 2837432 - RNA, 14 nt, Mycobacterium avium subsp. paratuberculosis
cgugaugcagcagg

SEQ ID NO: 2837433 - RNA, 21 nt, Mycobacterium avium subsp. paratuberculosis
cgugaugcagcagguugcggu

SEQ ID NO: 2837434 - RNA, 15 nt, Mycobacterium avium subsp. paratuberculosis
cgugaugccgggcaa

SEQ ID NO: 2837435 - RNA, 17 nt, Mycobacterium avium subsp. paratuberculosis
cgugaugccguggucgg

SEQ ID NO: 2837436 - RNA, 20 nt, Mycobacterium avium subsp. paratuberculosis
cgugaugccguggucggcga

SEQ ID NO: 2837437 - RNA, 22 nt, Mycobacterium avium subsp. paratuberculosis
cgugaugcgcaagcaccggcug

SEQ ID NO: 2837438 - RNA, 19 nt, Mycobacterium avium subsp. paratuberculosis
cgugaugcgccggcggucc

SEQ ID NO: 2837439 - RNA, 17 nt, Mycobacterium avium subsp. paratuberculosis
cgugauggcgaaccagc

SEQ ID NO: 2837440 - RNA, 18 nt, Mycobacterium avium subsp. paratuberculosis
cgugaugggugggcagcu

SEQ ID NO: 2837441 - RNA, 23 nt, Mycobacterium avium subsp. paratuberculosis
cgugaugguccagcaccggcgcc

SEQ ID NO: 2837442 - RNA, 19 nt, Mycobacterium avium subsp. paratuberculosis
cgugauggucgucguggug

SEQ ID NO: 2837443 - RNA, 17 nt, Mycobacterium avium subsp. paratuberculosis
cgugcaaaccggaccgc

SEQ ID NO: 2837444 - RNA, 20 nt, Mycobacterium avium subsp. paratuberculosis
cgugcaaaccggaccgccgc

SEQ ID NO: 2837445 - RNA, 15 nt, Mycobacterium avium subsp. paratuberculosis
cgugcaacucccgcg

SEQ ID NO: 2837446 - RNA, 16 nt, Mycobacterium avium subsp. paratuberculosis
cgugcaacucccgcgc

SEQ ID NO: 2837447 - RNA, 21 nt, Mycobacterium avium subsp. paratuberculosis
cgugcaaggccugcgccuugg

SEQ ID NO: 2837448 - RNA, 20 nt, Mycobacterium avium subsp. paratuberculosis
cgugcacacccgcagcgacc

SEQ ID NO: 2837449 - RNA, 21 nt, Mycobacterium avium subsp. paratuberculosis
cgugcacacccgcagcgaccg

SEQ ID NO: 2837450 - RNA, 15 nt, Mycobacterium avium subsp. paratuberculosis
cgugcacaccggccu

SEQ ID NO: 2837451 - RNA, 15 nt, Mycobacterium avium subsp. paratuberculosis
cgugcacaggccgcc

SEQ ID NO: 2837452 - RNA, 17 nt, Mycobacterium avium subsp. paratuberculosis
cgugcacaggccgccgc

SEQ ID NO: 2837453 - RNA, 17 nt, Mycobacterium avium subsp. paratuberculosis
cgugcacaugcccgucg

SEQ ID NO: 2837454 - RNA, 20 nt, Mycobacterium avium subsp. paratuberculosis
cgugcacaugcccgucgggc

SEQ ID NO: 2837455 - RNA, 23 nt, Mycobacterium avium subsp. paratuberculosis
cgugcacaugcccgucgggcggg

SEQ ID NO: 2837456 - RNA, 12 nt, Mycobacterium avium subsp. paratuberculosis
cgugcaccaccg

SEQ ID NO: 2837457 - RNA, 23 nt, Mycobacterium avium subsp. paratuberculosis
cgugcaccaccgcguugaucagc

SEQ ID NO: 2837458 - RNA, 12 nt, Mycobacterium avium subsp. paratuberculosis
cgugcaccacga

SEQ ID NO: 2837459 - RNA, 16 nt, Mycobacterium avium subsp. paratuberculosis
cgugcacccacgccag

SEQ ID NO: 2837460 - RNA, 22 nt, Mycobacterium avium subsp. paratuberculosis
cgugcacccacgccagccgggu

SEQ ID NO: 2837461 - RNA, 12 nt, Mycobacterium avium subsp. paratuberculosis
cgugcaccgccc

SEQ ID NO: 2837462 - RNA, 14 nt, Mycobacterium avium subsp. paratuberculosis
cgugcaccgcccgc

SEQ ID NO: 2837463 - RNA, 18 nt, Mycobacterium avium subsp. paratuberculosis
cgugcaccgcccgcgcga

SEQ ID NO: 2837464 - RNA, 15 nt, Mycobacterium avium subsp. paratuberculosis
cgugcaccgcggcca

SEQ ID NO: 2837465 - RNA, 16 nt, Mycobacterium avium subsp. paratuberculosis
cgugcaccgcggccaa

SEQ ID NO: 2837466 - RNA, 16 nt, Mycobacterium avium subsp. paratuberculosis
cgugccaccgcugggc

SEQ ID NO: 2837467 - RNA, 17 nt, Mycobacterium avium subsp. paratuberculosis
cgugccaccgcugggcg

SEQ ID NO: 2837468 - RNA, 20 nt, Mycobacterium avium subsp. paratuberculosis
cgugccaccgcugggcggcg

SEQ ID NO: 2837469 - RNA, 14 nt, Mycobacterium avium subsp. paratuberculosis
cgugccacggccgc

SEQ ID NO: 2837470 - RNA, 17 nt, Mycobacterium avium subsp. paratuberculosis
cgugccacggccgcggc

SEQ ID NO: 2837471 - RNA, 22 nt, Mycobacterium avium subsp. paratuberculosis
cgugccacggccgcggcccggc

SEQ ID NO: 2837472 - RNA, 18 nt, Mycobacterium avium subsp. paratuberculosis
cgugccacuggcgccacc

SEQ ID NO: 2837473 - RNA, 22 nt, Mycobacterium avium subsp. paratuberculosis
cgugccacuggcgccaccuccg

SEQ ID NO: 2837474 - RNA, 13 nt, Mycobacterium avium subsp. paratuberculosis
cgugccagcagcu

SEQ ID NO: 2837475 - RNA, 15 nt, Mycobacterium avium subsp. paratuberculosis
cgugccagccggccg

SEQ ID NO: 2837476 - RNA, 17 nt, Mycobacterium avium subsp. paratuberculosis
cgugccagccggccgcu

SEQ ID NO: 2837477 - RNA, 20 nt, Mycobacterium avium subsp. paratuberculosis
cgugccagcgcaguucaccg

SEQ ID NO: 2837478 - RNA, 21 nt, Mycobacterium avium subsp. paratuberculosis
cgugccagcgcaguucaccga

SEQ ID NO: 2837479 - RNA, 17 nt, Mycobacterium avium subsp. paratuberculosis
cgugccagggcagcgcg

SEQ ID NO: 2837480 - RNA, 18 nt, Mycobacterium avium subsp. paratuberculosis
cgugccagggcagcgcga

SEQ ID NO: 2837481 - RNA, 20 nt, Mycobacterium avium subsp. paratuberculosis
cgugccagggcagcgcgacc

SEQ ID NO: 2837482 - RNA, 23 nt, Mycobacterium avium subsp. paratuberculosis
cgugccagggcagcgcgaccagc

SEQ ID NO: 2837483 - RNA, 15 nt, Mycobacterium avium subsp. paratuberculosis
cgugcccaccagccg

SEQ ID NO: 2837484 - RNA, 16 nt, Mycobacterium avium subsp. paratuberculosis
cgugcccaccagccgg

SEQ ID NO: 2837485 - RNA, 18 nt, Mycobacterium avium subsp. paratuberculosis
cgugcccaccagccggcc

SEQ ID NO: 2837486 - RNA, 20 nt, Mycobacterium avium subsp. paratuberculosis
cgugcccaccagccggccgg

SEQ ID NO: 2837487 - RNA, 13 nt, Mycobacterium avium subsp. paratuberculosis
cgugcccagcccg

SEQ ID NO: 2837488 - RNA, 14 nt, Mycobacterium avium subsp. paratuberculosis
cgugcccagcccgc

SEQ ID NO: 2837489 - RNA, 15 nt, Mycobacterium avium subsp. paratuberculosis
cgugcccagcccgcg

SEQ ID NO: 2837490 - RNA, 20 nt, Mycobacterium avium subsp. paratuberculosis
cgugcccagcccgcgcgagc

SEQ ID NO: 2837491 - RNA, 18 nt, Mycobacterium avium subsp. paratuberculosis
cgugccccaggucggggu

SEQ ID NO: 2837492 - RNA, 22 nt, Mycobacterium avium subsp. paratuberculosis
cgugccccaggucggggugggc

SEQ ID NO: 2837493 - RNA, 15 nt, Mycobacterium avium subsp. paratuberculosis
cgugccccuccucgg

SEQ ID NO: 2837494 - RNA, 19 nt, Mycobacterium avium subsp. paratuberculosis
cgugccccuccucggucag

SEQ ID NO: 2837495 - RNA, 17 nt, Mycobacterium avium subsp. paratuberculosis
cgugcccgagccgaugg

SEQ ID NO: 2837496 - RNA, 20 nt, Mycobacterium avium subsp. paratuberculosis
cgugcccgaucucgucggug

SEQ ID NO: 2837497 - RNA, 13 nt, Mycobacterium avium subsp. paratuberculosis
cgugcccgccgaa

SEQ ID NO: 2837498 - RNA, 18 nt, Mycobacterium avium subsp. paratuberculosis
cgugcccgccgaccagga

SEQ ID NO: 2837499 - RNA, 14 nt, Mycobacterium avium subsp. paratuberculosis
cgugcccgccgugc

SEQ ID NO: 2837500 - RNA, 14 nt, Mycobacterium avium subsp. paratuberculosis
cgugcccgcgccca

SEQ ID NO: 2837501 - RNA, 16 nt, Mycobacterium avium subsp. paratuberculosis
cgugcccgcgcccacc

SEQ ID NO: 2837502 - RNA, 20 nt, Mycobacterium avium subsp. paratuberculosis
cgugcccgcgcccaccugga

SEQ ID NO: 2837503 - RNA, 23 nt, Mycobacterium avium subsp. paratuberculosis
cgugcccgcgcccaccuggaggc

SEQ ID NO: 2837504 - RNA, 13 nt, Mycobacterium avium subsp. paratuberculosis
cgugcccgcggga

SEQ ID NO: 2837505 - RNA, 23 nt, Mycobacterium avium subsp. paratuberculosis
cgugcccgcgggacacggcggcg

SEQ ID NO: 2837506 - RNA, 11 nt, Mycobacterium avium subsp. paratuberculosis
cgugcccgcuc

SEQ ID NO: 2837507 - RNA, 17 nt, Mycobacterium avium subsp. paratuberculosis
cgugcccggaucgccga

SEQ ID NO: 2837508 - RNA, 13 nt, Mycobacterium avium subsp. paratuberculosis
cgugcccggccag

SEQ ID NO: 2837509 - RNA, 13 nt, Mycobacterium avium subsp. paratuberculosis
cgugcccggccca

SEQ ID NO: 2837510 - RNA, 17 nt, Mycobacterium avium subsp. paratuberculosis
cgugcccggcgcccugc

SEQ ID NO: 2837511 - RNA, 14 nt, Mycobacterium avium subsp. paratuberculosis
cgugcccggcgccg

SEQ ID NO: 2837512 - RNA, 17 nt, Mycobacterium avium subsp. paratuberculosis
cgugcccggcgccgacc

SEQ ID NO: 2837513 - RNA, 18 nt, Mycobacterium avium subsp. paratuberculosis
cgugcccggcgccgacca

SEQ ID NO: 2837514 - RNA, 14 nt, Mycobacterium avium subsp. paratuberculosis
cgugcccuuccccg

SEQ ID NO: 2837515 - RNA, 16 nt, Mycobacterium avium subsp. paratuberculosis
cgugcccuuccccggc

SEQ ID NO: 2837516 - RNA, 19 nt, Mycobacterium avium subsp. paratuberculosis
cgugcccuuccccggcggc

SEQ ID NO: 2837517 - RNA, 20 nt, Mycobacterium avium subsp. paratuberculosis
cgugcccuuccccggcggcc

SEQ ID NO: 2837518 - RNA, 21 nt, Mycobacterium avium subsp. paratuberculosis
cgugcccuuccccggcggccg

SEQ ID NO: 2837519 - RNA, 23 nt, Mycobacterium avium subsp. paratuberculosis
cgugcccuuccccggcggccggc

SEQ ID NO: 2837520 - RNA, 13 nt, Mycobacterium avium subsp. paratuberculosis
cgugccgaccagc

SEQ ID NO: 2837521 - RNA, 16 nt, Mycobacterium avium subsp. paratuberculosis
cgugccgaugccggcc

SEQ ID NO: 2837522 - RNA, 16 nt, Mycobacterium avium subsp. paratuberculosis
cgugccgauggccacc

SEQ ID NO: 2837523 - RNA, 23 nt, Mycobacterium avium subsp. paratuberculosis
cgugccgcacccgauccacggcg

SEQ ID NO: 2837524 - RNA, 15 nt, Mycobacterium avium subsp. paratuberculosis
cgugccgccauaccc

SEQ ID NO: 2837525 - RNA, 16 nt, Mycobacterium avium subsp. paratuberculosis
cgugccgcccggaccg

SEQ ID NO: 2837526 - RNA, 22 nt, Mycobacterium avium subsp. paratuberculosis
cgugccgcccggaccgcggucg

SEQ ID NO: 2837527 - RNA, 14 nt, Mycobacterium avium subsp. paratuberculosis
cgugccgcccgucg

SEQ ID NO: 2837528 - RNA, 15 nt, Mycobacterium avium subsp. paratuberculosis
cgugccgcccgucgc

SEQ ID NO: 2837529 - RNA, 16 nt, Mycobacterium avium subsp. paratuberculosis
cgugccgcgcaccacc

SEQ ID NO: 2837530 - RNA, 15 nt, Mycobacterium avium subsp. paratuberculosis
cgugccgcgcggcga

SEQ ID NO: 2837531 - RNA, 16 nt, Mycobacterium avium subsp. paratuberculosis
cgugccgcgcggcgau

SEQ ID NO: 2837532 - RNA, 17 nt, Mycobacterium avium subsp. paratuberculosis
cgugccgcgcggcgaug

SEQ ID NO: 2837533 - RNA, 17 nt, Mycobacterium avium subsp. paratuberculosis
cgugccgcgcggcggug

SEQ ID NO: 2837534 - RNA, 20 nt, Mycobacterium avium subsp. paratuberculosis
cgugccgcgcggcggugacc

SEQ ID NO: 2837535 - RNA, 12 nt, Mycobacterium avium subsp. paratuberculosis
cgugccgcuggg

SEQ ID NO: 2837536 - RNA, 17 nt, Mycobacterium avium subsp. paratuberculosis
cgugccggacaccggca

SEQ ID NO: 2837537 - RNA, 21 nt, Mycobacterium avium subsp. paratuberculosis
cgugccggacaccggcacguc

SEQ ID NO: 2837538 - RNA, 22 nt, Mycobacterium avium subsp. paratuberculosis
cgugccggacaccggcacgucg

SEQ ID NO: 2837539 - RNA, 17 nt, Mycobacterium avium subsp. paratuberculosis
cgugccggaccgcgcgg

SEQ ID NO: 2837540 - RNA, 20 nt, Mycobacterium avium subsp. paratuberculosis
cgugccggaccgcgcgggcc

SEQ ID NO: 2837541 - RNA, 17 nt, Mycobacterium avium subsp. paratuberculosis
cgugccggaugcggucg

SEQ ID NO: 2837542 - RNA, 18 nt, Mycobacterium avium subsp. paratuberculosis
cgugccggaugcggucga

SEQ ID NO: 2837543 - RNA, 21 nt, Mycobacterium avium subsp. paratuberculosis
cgugccggaugcggucgauga

SEQ ID NO: 2837544 - RNA, 15 nt, Mycobacterium avium subsp. paratuberculosis
cgugccggcccggcg

SEQ ID NO: 2837545 - RNA, 12 nt, Mycobacterium avium subsp. paratuberculosis
cgugccggcgau

SEQ ID NO: 2837546 - RNA, 13 nt, Mycobacterium avium subsp. paratuberculosis
cgugccggcgaug

SEQ ID NO: 2837547 - RNA, 18 nt, Mycobacterium avium subsp. paratuberculosis
cgugccggcgaugguggc

SEQ ID NO: 2837548 - RNA, 13 nt, Mycobacterium avium subsp. paratuberculosis
cgugccggcgcug

SEQ ID NO: 2837549 - RNA, 15 nt, Mycobacterium avium subsp. paratuberculosis
cgugccggcgcugcc

SEQ ID NO: 2837550 - RNA, 22 nt, Mycobacterium avium subsp. paratuberculosis
cgugccggcgcugcccgucgac

SEQ ID NO: 2837551 - RNA, 21 nt, Mycobacterium avium subsp. paratuberculosis
cgugcuccagcaggcgcgccg

SEQ ID NO: 2837552 - RNA, 22 nt, Mycobacterium avium subsp. paratuberculosis
cgugcuccagcaggcgcgccga

SEQ ID NO: 2837553 - RNA, 23 nt, Mycobacterium avium subsp. paratuberculosis
cgugcuccagcaggcgcgccgag

SEQ ID NO: 2837554 - RNA, 16 nt, Mycobacterium avium subsp. paratuberculosis
cgugcucccgccgaga

SEQ ID NO: 2837555 - RNA, 21 nt, Mycobacterium avium subsp. paratuberculosis
cgugcucgagcaucucggugc

SEQ ID NO: 2837556 - RNA, 22 nt, Mycobacterium avium subsp. paratuberculosis
cgugcucggaguaguccagcac

SEQ ID NO: 2837557 - RNA, 21 nt, Mycobacterium avium subsp. paratuberculosis
cgugcucggccacgacgcgcc

SEQ ID NO: 2837558 - RNA, 17 nt, Mycobacterium avium subsp. paratuberculosis
cgugcucggcgagcacc

SEQ ID NO: 2837559 - RNA, 14 nt, Mycobacterium avium subsp. paratuberculosis
cgugcucggcggcg

SEQ ID NO: 2837560 - RNA, 13 nt, Mycobacterium avium subsp. paratuberculosis
cgugcucgucgcg

SEQ ID NO: 2837561 - RNA, 15 nt, Mycobacterium avium subsp. paratuberculosis
cgugcucgucgcgga

SEQ ID NO: 2837562 - RNA, 17 nt, Mycobacterium avium subsp. paratuberculosis
cgugcucgucgcggagg

SEQ ID NO: 2837563 - RNA, 23 nt, Mycobacterium avium subsp. paratuberculosis
cgugcucugccuacuugcggccg

SEQ ID NO: 2837564 - RNA, 15 nt, Mycobacterium avium subsp. paratuberculosis
cgugcugacgucguc

SEQ ID NO: 2837565 - RNA, 22 nt, Mycobacterium avium subsp. paratuberculosis
cgugcugacgucgucgcccacc

SEQ ID NO: 2837566 - RNA, 20 nt, Mycobacterium avium subsp. paratuberculosis
cgugcugauccacgcccgga

SEQ ID NO: 2837567 - RNA, 19 nt, Mycobacterium avium subsp. paratuberculosis
cgugcugccggacaccccg

SEQ ID NO: 2837568 - RNA, 14 nt, Mycobacterium avium subsp. paratuberculosis
cgugcugccggccg

SEQ ID NO: 2837569 - RNA, 15 nt, Mycobacterium avium subsp. paratuberculosis
cgugcugcgcagcag

SEQ ID NO: 2837570 - RNA, 17 nt, Mycobacterium avium subsp. paratuberculosis
cgugcugcgcagcagcg

SEQ ID NO: 2837571 - RNA, 19 nt, Mycobacterium avium subsp. paratuberculosis
cgugcugcgcagcagcgcc

SEQ ID NO: 2837572 - RNA, 21 nt, Mycobacterium avium subsp. paratuberculosis
cgugcugcgcagcagcgccag

SEQ ID NO: 2837573 - RNA, 14 nt, Mycobacterium avium subsp. paratuberculosis
cgugcuggccacca

SEQ ID NO: 2837574 - RNA, 16 nt, Mycobacterium avium subsp. paratuberculosis
cgugcuggccggguug

SEQ ID NO: 2837575 - RNA, 15 nt, Mycobacterium avium subsp. paratuberculosis
cgugcugggacagcg

SEQ ID NO: 2837576 - RNA, 13 nt, Mycobacterium avium subsp. paratuberculosis
cgugcugggcacc

SEQ ID NO: 2837577 - RNA, 21 nt, Mycobacterium avium subsp. paratuberculosis
cgugcugggccacgauccgcg

SEQ ID NO: 2837578 - RNA, 22 nt, Mycobacterium avium subsp. paratuberculosis
cgugcugggccacgauccgcgc

SEQ ID NO: 2837579 - RNA, 13 nt, Mycobacterium avium subsp. paratuberculosis
cgugcugggccgg

SEQ ID NO: 2837580 - RNA, 21 nt, Mycobacterium avium subsp. paratuberculosis
cgugcuggggguggcgucgac

SEQ ID NO: 2837581 - RNA, 22 nt, Mycobacterium avium subsp. paratuberculosis
cgugcuggggguggcgucgacg

SEQ ID NO: 2837582 - RNA, 23 nt, Mycobacterium avium subsp. paratuberculosis
cgugcuggggguggcgucgacgg

SEQ ID NO: 2837583 - RNA, 23 nt, Mycobacterium avium subsp. paratuberculosis
cgugcugugagcuuccugccaac

SEQ ID NO: 2837584 - RNA, 15 nt, Mycobacterium avium subsp. paratuberculosis
cgugcugugcgggcg

SEQ ID NO: 2837585 - RNA, 16 nt, Mycobacterium avium subsp. paratuberculosis
cgugcugugcgggcgg

SEQ ID NO: 2837586 - RNA, 19 nt, Mycobacterium avium subsp. paratuberculosis
cgugcugugcugccugccg

SEQ ID NO: 2837587 - RNA, 22 nt, Mycobacterium avium subsp. paratuberculosis
cgugcuguggaacacgucggcg

SEQ ID NO: 2837588 - RNA, 17 nt, Mycobacterium avium subsp. paratuberculosis
cgugcuguugcaggugc

SEQ ID NO: 2837589 - RNA, 20 nt, Mycobacterium avium subsp. paratuberculosis
cgugcuugaacgccgccccc

SEQ ID NO: 2837590 - RNA, 22 nt, Mycobacterium avium subsp. paratuberculosis
cgugcuugaacgccgcccccgc

SEQ ID NO: 2837591 - RNA, 16 nt, Mycobacterium avium subsp. paratuberculosis
cgugcuuggccagcuc

SEQ ID NO: 2837592 - RNA, 19 nt, Mycobacterium avium subsp. paratuberculosis
cgugcuuggccagcucggc

SEQ ID NO: 2837593 - RNA, 23 nt, Mycobacterium avium subsp. paratuberculosis
cgugcuuggccagcucggcggcc

SEQ ID NO: 2837594 - RNA, 17 nt, Mycobacterium avium subsp. paratuberculosis
cgugcuuuugcgucugc

SEQ ID NO: 2837595 - RNA, 18 nt, Mycobacterium avium subsp. paratuberculosis
cguggaaaucgagcgcgc

SEQ ID NO: 2837596 - RNA, 20 nt, Mycobacterium avium subsp. paratuberculosis
cguggaaaucgagcgcgcug

SEQ ID NO: 2837597 - RNA, 22 nt, Mycobacterium avium subsp. paratuberculosis
cguggaaaucgagcgcgcugug

SEQ ID NO: 2837598 - RNA, 15 nt, Mycobacterium avium subsp. paratuberculosis
cguggaacacgccca

SEQ ID NO: 2837599 - RNA, 22 nt, Mycobacterium avium subsp. paratuberculosis
cguggaacacgcccagcgccgc

SEQ ID NO: 2837600 - RNA, 16 nt, Mycobacterium avium subsp. paratuberculosis
cguggaacgacgccag

SEQ ID NO: 2837601 - RNA, 20 nt, Mycobacterium avium subsp. paratuberculosis
cguggaacgcgucgcgccag

SEQ ID NO: 2837602 - RNA, 19 nt, Mycobacterium avium subsp. paratuberculosis
cguggaagauguugccgcc

SEQ ID NO: 2837603 - RNA, 20 nt, Mycobacterium avium subsp. paratuberculosis
cguggaagauguugccgcca

SEQ ID NO: 2837604 - RNA, 17 nt, Mycobacterium avium subsp. paratuberculosis
cguggaagucgccgucc

SEQ ID NO: 2837605 - RNA, 18 nt, Mycobacterium avium subsp. paratuberculosis
cguggaagucgccguccg

SEQ ID NO: 2837606 - RNA, 22 nt, Mycobacterium avium subsp. paratuberculosis
cguggaagucgccguccggggc

SEQ ID NO: 2837607 - RNA, 16 nt, Mycobacterium avium subsp. paratuberculosis
cguggaauccuuccuc

SEQ ID NO: 2837608 - RNA, 12 nt, Mycobacterium avium subsp. paratuberculosis
cguggacaccgc

SEQ ID NO: 2837609 - RNA, 17 nt, Mycobacterium avium subsp. paratuberculosis
cguggacaccgcaccca

SEQ ID NO: 2837610 - RNA, 17 nt, Mycobacterium avium subsp. paratuberculosis
cguggacccgccccgac

SEQ ID NO: 2837611 - RNA, 20 nt, Mycobacterium avium subsp. paratuberculosis
cguggacccgccccgacagc

SEQ ID NO: 2837612 - RNA, 18 nt, Mycobacterium avium subsp. paratuberculosis
cguggaccgagcgcgcga

SEQ ID NO: 2837613 - RNA, 22 nt, Mycobacterium avium subsp. paratuberculosis
cguggacgaacgcggcgaacac

SEQ ID NO: 2837614 - RNA, 15 nt, Mycobacterium avium subsp. paratuberculosis
cguggacggcgagcg

SEQ ID NO: 2837615 - RNA, 17 nt, Mycobacterium avium subsp. paratuberculosis
cguggacggcgagcggc

SEQ ID NO: 2837616 - RNA, 15 nt, Mycobacterium avium subsp. paratuberculosis
cguggaucaucccga

SEQ ID NO: 2837617 - RNA, 23 nt, Mycobacterium avium subsp. paratuberculosis
cguggaucaucccgaccagcuga

SEQ ID NO: 2837618 - RNA, 16 nt, Mycobacterium avium subsp. paratuberculosis
cguggaucucgaacgg

SEQ ID NO: 2837619 - RNA, 15 nt, Mycobacterium avium subsp. paratuberculosis
cguggauggccggcc

SEQ ID NO: 2837620 - RNA, 17 nt, Mycobacterium avium subsp. paratuberculosis
cguggauguugucgugg

SEQ ID NO: 2837621 - RNA, 18 nt, Mycobacterium avium subsp. paratuberculosis
cguggcaauucgaccguc

SEQ ID NO: 2837622 - RNA, 13 nt, Mycobacterium avium subsp. paratuberculosis
cguggcaccgggu

SEQ ID NO: 2837623 - RNA, 14 nt, Mycobacterium avium subsp. paratuberculosis
cguggcaccgggug

SEQ ID NO: 2837624 - RNA, 21 nt, Mycobacterium avium subsp. paratuberculosis
cguggcaccgggugggccgac

SEQ ID NO: 2837625 - RNA, 22 nt, Mycobacterium avium subsp. paratuberculosis
cguggcaccgggugggccgacc

SEQ ID NO: 2837626 - RNA, 15 nt, Mycobacterium avium subsp. paratuberculosis
cguggcagcggucgg

SEQ ID NO: 2837627 - RNA, 16 nt, Mycobacterium avium subsp. paratuberculosis
cguggcagcggucggc

SEQ ID NO: 2837628 - RNA, 17 nt, Mycobacterium avium subsp. paratuberculosis
cguggcagcggucggcg

SEQ ID NO: 2837629 - RNA, 21 nt, Mycobacterium avium subsp. paratuberculosis
cguggcagcggucggcggcug

SEQ ID NO: 2837630 - RNA, 15 nt, Mycobacterium avium subsp. paratuberculosis
cguggcaggcacgag

SEQ ID NO: 2837631 - RNA, 20 nt, Mycobacterium avium subsp. paratuberculosis
cguggcaggcacgagcgaac

SEQ ID NO: 2837632 - RNA, 20 nt, Mycobacterium avium subsp. paratuberculosis
cguggcaggccaucagcccg

SEQ ID NO: 2837633 - RNA, 22 nt, Mycobacterium avium subsp. paratuberculosis
cguggcaggcgauggcgucggc

SEQ ID NO: 2837634 - RNA, 18 nt, Mycobacterium avium subsp. paratuberculosis
cguggcaggcgauggugc

SEQ ID NO: 2837635 - RNA, 17 nt, Mycobacterium avium subsp. paratuberculosis
cgugggcccgugcgggu

SEQ ID NO: 2837636 - RNA, 14 nt, Mycobacterium avium subsp. paratuberculosis
cgugggccgaccgg

SEQ ID NO: 2837637 - RNA, 14 nt, Mycobacterium avium subsp. paratuberculosis
cgugggccgcagcg

SEQ ID NO: 2837638 - RNA, 19 nt, Mycobacterium avium subsp. paratuberculosis
cgugggccgcagcgcggcg

SEQ ID NO: 2837639 - RNA, 20 nt, Mycobacterium avium subsp. paratuberculosis
cgugggccgcagcgcggcga

SEQ ID NO: 2837640 - RNA, 21 nt, Mycobacterium avium subsp. paratuberculosis
cgugggccgcagcgcggcgac

SEQ ID NO: 2837641 - RNA, 18 nt, Mycobacterium avium subsp. paratuberculosis
cgugggcgauccgcaggc

SEQ ID NO: 2837642 - RNA, 22 nt, Mycobacterium avium subsp. paratuberculosis
cgugggcgauccgcaggccguc

SEQ ID NO: 2837643 - RNA, 13 nt, Mycobacterium avium subsp. paratuberculosis
cgugggcgccguc

SEQ ID NO: 2837644 - RNA, 20 nt, Mycobacterium avium subsp. paratuberculosis
cgugggcgccgucgccgccg

SEQ ID NO: 2837645 - RNA, 22 nt, Mycobacterium avium subsp. paratuberculosis
cgugggcgccgucgccgccgug

SEQ ID NO: 2837646 - RNA, 15 nt, Mycobacterium avium subsp. paratuberculosis
cgugggcggccacca

SEQ ID NO: 2837647 - RNA, 14 nt, Mycobacterium avium subsp. paratuberculosis
cgugggcggcgcga

SEQ ID NO: 2837648 - RNA, 20 nt, Mycobacterium avium subsp. paratuberculosis
cgugggcggcgcgaucgucg

SEQ ID NO: 2837649 - RNA, 19 nt, Mycobacterium avium subsp. paratuberculosis
cguggggacccccucgucg

SEQ ID NO: 2837650 - RNA, 18 nt, Mycobacterium avium subsp. paratuberculosis
cguggggcgucgccgccc

SEQ ID NO: 2837651 - RNA, 13 nt, Mycobacterium avium subsp. paratuberculosis
cguggggcucagc

SEQ ID NO: 2837652 - RNA, 17 nt, Mycobacterium avium subsp. paratuberculosis
cgugggggucgacccgc

SEQ ID NO: 2837653 - RNA, 22 nt, Mycobacterium avium subsp. paratuberculosis
cgugggggucgacccgccgcag

SEQ ID NO: 2837654 - RNA, 15 nt, Mycobacterium avium subsp. paratuberculosis
cgugggguucccggc

SEQ ID NO: 2837655 - RNA, 18 nt, Mycobacterium avium subsp. paratuberculosis
cgugggguuuucggcgcg

SEQ ID NO: 2837656 - RNA, 13 nt, Mycobacterium avium subsp. paratuberculosis
cgugggugacccg

SEQ ID NO: 2837657 - RNA, 19 nt, Mycobacterium avium subsp. paratuberculosis
cgugggugacccggccguu

SEQ ID NO: 2837658 - RNA, 17 nt, Mycobacterium avium subsp. paratuberculosis
cguggguggucugcugg

SEQ ID NO: 2837659 - RNA, 20 nt, Mycobacterium avium subsp. paratuberculosis
cguggguggucugcugggcg

SEQ ID NO: 2837660 - RNA, 23 nt, Mycobacterium avium subsp. paratuberculosis
cguggguggugaccaggcuugcc

SEQ ID NO: 2837661 - RNA, 24 nt, Mycobacterium avium subsp. paratuberculosis
cguggguguccuugcgcaccacgu

SEQ ID NO: 2837662 - RNA, 14 nt, Mycobacterium avium subsp. paratuberculosis
cgugggugucggcg

SEQ ID NO: 2837663 - RNA, 15 nt, Mycobacterium avium subsp. paratuberculosis
cgugggugucggcga

SEQ ID NO: 2837664 - RNA, 16 nt, Mycobacterium avium subsp. paratuberculosis
cguggguuccgccguc

SEQ ID NO: 2837665 - RNA, 16 nt, Mycobacterium avium subsp. paratuberculosis
cgugguaccggcgcca

SEQ ID NO: 2837666 - RNA, 22 nt, Mycobacterium avium subsp. paratuberculosis
cgugguaccggcgccaggccgg

SEQ ID NO: 2837667 - RNA, 18 nt, Mycobacterium avium subsp. paratuberculosis
cgugguagacgccggacg

SEQ ID NO: 2837668 - RNA, 18 nt, Mycobacterium avium subsp. paratuberculosis
cgugguagcggucggggu

SEQ ID NO: 2837669 - RNA, 18 nt, Mycobacterium avium subsp. paratuberculosis
cguggucacccgcagccc

SEQ ID NO: 2837670 - RNA, 20 nt, Mycobacterium avium subsp. paratuberculosis
cguggucacccgcagcccga

SEQ ID NO: 2837671 - RNA, 22 nt, Mycobacterium avium subsp. paratuberculosis
cguggucagcgucucgccgggg

SEQ ID NO: 2837672 - RNA, 21 nt, Mycobacterium avium subsp. paratuberculosis
cguggucaggggugggcgacg

SEQ ID NO: 2837673 - RNA, 22 nt, Mycobacterium avium subsp. paratuberculosis
cgugguccagcacgugcccagc

SEQ ID NO: 2837674 - RNA, 14 nt, Mycobacterium avium subsp. paratuberculosis
cgugguccagccgg

SEQ ID NO: 2837675 - RNA, 22 nt, Mycobacterium avium subsp. paratuberculosis
cgugguccagccggucgcaggu

SEQ ID NO: 2837676 - RNA, 14 nt, Mycobacterium avium subsp. paratuberculosis
cguggucccacacc

SEQ ID NO: 2837677 - RNA, 12 nt, Mycobacterium avium subsp. paratuberculosis
cguggucgacgc

SEQ ID NO: 2837678 - RNA, 15 nt, Mycobacterium avium subsp. paratuberculosis
cguggucgacgccgu

SEQ ID NO: 2837679 - RNA, 22 nt, Mycobacterium avium subsp. paratuberculosis
cguggucgaugaacucgcgggc

SEQ ID NO: 2837680 - RNA, 16 nt, Mycobacterium avium subsp. paratuberculosis
cguggucgcgcagcau

SEQ ID NO: 2837681 - RNA, 13 nt, Mycobacterium avium subsp. paratuberculosis
cguggucgcugcu

SEQ ID NO: 2837682 - RNA, 18 nt, Mycobacterium avium subsp. paratuberculosis
cguggucggcagcaccgg

SEQ ID NO: 2837683 - RNA, 22 nt, Mycobacterium avium subsp. paratuberculosis
cguggucggcagcaccggcagc

SEQ ID NO: 2837684 - RNA, 12 nt, Mycobacterium avium subsp. paratuberculosis
cguggucggcga

SEQ ID NO: 2837685 - RNA, 17 nt, Mycobacterium avium subsp. paratuberculosis
cguggucggcgaacgcc

SEQ ID NO: 2837686 - RNA, 21 nt, Mycobacterium avium subsp. paratuberculosis
cguggucggcgaacgcccggu

SEQ ID NO: 2837687 - RNA, 16 nt, Mycobacterium avium subsp. paratuberculosis
cguggucggcgaagcg

SEQ ID NO: 2837688 - RNA, 16 nt, Mycobacterium avium subsp. paratuberculosis
cguggucggcgcgguc

SEQ ID NO: 2837689 - RNA, 18 nt, Mycobacterium avium subsp. paratuberculosis
cguggucggcgcggucca

SEQ ID NO: 2837690 - RNA, 19 nt, Mycobacterium avium subsp. paratuberculosis
cguggucggcgcgguccac

SEQ ID NO: 2837691 - RNA, 18 nt, Mycobacterium avium subsp. paratuberculosis
cguggucgggcaugccgg

SEQ ID NO: 2837692 - RNA, 23 nt, Mycobacterium avium subsp. paratuberculosis
cguggucgggcaugccggccggc

SEQ ID NO: 2837693 - RNA, 13 nt, Mycobacterium avium subsp. paratuberculosis
cguggucggugcc

SEQ ID NO: 2837694 - RNA, 20 nt, Mycobacterium avium subsp. paratuberculosis
cguggucuccuggccgccgu

SEQ ID NO: 2837695 - RNA, 14 nt, Mycobacterium avium subsp. paratuberculosis
cguggucucgcacc

SEQ ID NO: 2837696 - RNA, 20 nt, Mycobacterium avium subsp. paratuberculosis
cguggucucguugugcaccg

SEQ ID NO: 2837697 - RNA, 14 nt, Mycobacterium avium subsp. paratuberculosis
cguggugacccgga

SEQ ID NO: 2837698 - RNA, 18 nt, Mycobacterium avium subsp. paratuberculosis
cguggugacccggaccgg

SEQ ID NO: 2837699 - RNA, 19 nt, Mycobacterium avium subsp. paratuberculosis
cguggugacccggaccggg

SEQ ID NO: 2837700 - RNA, 21 nt, Mycobacterium avium subsp. paratuberculosis
cguggugacccggaccgggug

SEQ ID NO: 2837701 - RNA, 20 nt, Mycobacterium avium subsp. paratuberculosis
cguggugacgggcgucggcg

SEQ ID NO: 2837702 - RNA, 18 nt, Mycobacterium avium subsp. paratuberculosis
cguggugaucgccgcgga

SEQ ID NO: 2837703 - RNA, 14 nt, Mycobacterium avium subsp. paratuberculosis
cguggugcaccgcc

SEQ ID NO: 2837704 - RNA, 23 nt, Mycobacterium avium subsp. paratuberculosis
cguggugcaccgccagcgcggcg

SEQ ID NO: 2837705 - RNA, 13 nt, Mycobacterium avium subsp. paratuberculosis
cguggugcccuca

SEQ ID NO: 2837706 - RNA, 15 nt, Mycobacterium avium subsp. paratuberculosis
cguggugcgcccguc

SEQ ID NO: 2837707 - RNA, 19 nt, Mycobacterium avium subsp. paratuberculosis
cguggugcgcccgucggug

SEQ ID NO: 2837708 - RNA, 20 nt, Mycobacterium avium subsp. paratuberculosis
cguggugcgcccgucggugg

SEQ ID NO: 2837709 - RNA, 20 nt, Mycobacterium avium subsp. paratuberculosis
cguggugcggugcaccgcgg

SEQ ID NO: 2837710 - RNA, 21 nt, Mycobacterium avium subsp. paratuberculosis
cguggugcggugcaccgcggc

SEQ ID NO: 2837711 - RNA, 13 nt, Mycobacterium avium subsp. paratuberculosis
cgugguggacggu

SEQ ID NO: 2837712 - RNA, 17 nt, Mycobacterium avium subsp. paratuberculosis
cgugguggaugaugccg

SEQ ID NO: 2837713 - RNA, 22 nt, Mycobacterium avium subsp. paratuberculosis
cgugguggaugaugccggcggu

SEQ ID NO: 2837714 - RNA, 14 nt, Mycobacterium avium subsp. paratuberculosis
cgugguggcggcga

SEQ ID NO: 2837715 - RNA, 20 nt, Mycobacterium avium subsp. paratuberculosis
cguggugggcagaugcccgc

SEQ ID NO: 2837716 - RNA, 21 nt, Mycobacterium avium subsp. paratuberculosis
cguggugggcgaacagcagca

SEQ ID NO: 2837717 - RNA, 14 nt, Mycobacterium avium subsp. paratuberculosis
cgugguggggccga

SEQ ID NO: 2837718 - RNA, 21 nt, Mycobacterium avium subsp. paratuberculosis
cgugguggggccgaugaccgc

SEQ ID NO: 2837719 - RNA, 11 nt, Mycobacterium avium subsp. paratuberculosis
cguucaucacc

SEQ ID NO: 2837720 - RNA, 18 nt, Mycobacterium avium subsp. paratuberculosis
cguucauuaucccgcacc

SEQ ID NO: 2837721 - RNA, 16 nt, Mycobacterium avium subsp. paratuberculosis
cguuccagcacccggc

SEQ ID NO: 2837722 - RNA, 18 nt, Mycobacterium avium subsp. paratuberculosis
cguuccagcacccggccc

SEQ ID NO: 2837723 - RNA, 19 nt, Mycobacterium avium subsp. paratuberculosis
cguuccagcacccggccca

SEQ ID NO: 2837724 - RNA, 22 nt, Mycobacterium avium subsp. paratuberculosis
cguuccagcacccggcccacgc

SEQ ID NO: 2837725 - RNA, 23 nt, Mycobacterium avium subsp. paratuberculosis
cguuccagcacccggcccacgcc

SEQ ID NO: 2837726 - RNA, 13 nt, Mycobacterium avium subsp. paratuberculosis
cguuccagcacgc

SEQ ID NO: 2837727 - RNA, 17 nt, Mycobacterium avium subsp. paratuberculosis
cguuccagcacgcccag

SEQ ID NO: 2837728 - RNA, 19 nt, Mycobacterium avium subsp. paratuberculosis
cguuccagcacgcccagau

SEQ ID NO: 2837729 - RNA, 14 nt, Mycobacterium avium subsp. paratuberculosis
cguuccagccggcc

SEQ ID NO: 2837730 - RNA, 12 nt, Mycobacterium avium subsp. paratuberculosis
cguuccagccgu

SEQ ID NO: 2837731 - RNA, 13 nt, Mycobacterium avium subsp. paratuberculosis
cguuccagguccg

SEQ ID NO: 2837732 - RNA, 23 nt, Mycobacterium avium subsp. paratuberculosis
cguuccagguucagcccggcgcu

SEQ ID NO: 2837733 - RNA, 21 nt, Mycobacterium avium subsp. paratuberculosis
cguuccaucagcgcccgcgcg

SEQ ID NO: 2837734 - RNA, 14 nt, Mycobacterium avium subsp. paratuberculosis
cguucccaccggcu

SEQ ID NO: 2837735 - RNA, 17 nt, Mycobacterium avium subsp. paratuberculosis
cguuccccggccgacgu

SEQ ID NO: 2837736 - RNA, 12 nt, Mycobacterium avium subsp. paratuberculosis
cguucccgcgcg

SEQ ID NO: 2837737 - RNA, 13 nt, Mycobacterium avium subsp. paratuberculosis
cguucccugcgcg

SEQ ID NO: 2837738 - RNA, 16 nt, Mycobacterium avium subsp. paratuberculosis
cguucccugcgcggcg

SEQ ID NO: 2837739 - RNA, 21 nt, Mycobacterium avium subsp. paratuberculosis
cguucccugcgcggcgaugcg

SEQ ID NO: 2837740 - RNA, 15 nt, Mycobacterium avium subsp. paratuberculosis
cguuccgaugaagaa

SEQ ID NO: 2837741 - RNA, 14 nt, Mycobacterium avium subsp. paratuberculosis
cguuccgccacggc

SEQ ID NO: 2837742 - RNA, 16 nt, Mycobacterium avium subsp. paratuberculosis
cguuccgccacggcgg

SEQ ID NO: 2837743 - RNA, 18 nt, Mycobacterium avium subsp. paratuberculosis
cguuccgccacggcgggg

SEQ ID NO: 2837744 - RNA, 18 nt, Mycobacterium avium subsp. paratuberculosis
cguuccggcgagaucuuc

SEQ ID NO: 2837745 - RNA, 12 nt, Mycobacterium avium subsp. paratuberculosis
cguuccggcggc

SEQ ID NO: 2837746 - RNA, 14 nt, Mycobacterium avium subsp. paratuberculosis
cguuccggcggccg

SEQ ID NO: 2837747 - RNA, 18 nt, Mycobacterium avium subsp. paratuberculosis
cguuccggcggccggcgg

SEQ ID NO: 2837748 - RNA, 23 nt, Mycobacterium avium subsp. paratuberculosis
cguuccucgacguaggccagauc

SEQ ID NO: 2837749 - RNA, 15 nt, Mycobacterium avium subsp. paratuberculosis
cguucgagcgccgga

SEQ ID NO: 2837750 - RNA, 22 nt, Mycobacterium avium subsp. paratuberculosis
cguucgagcgccggacgcuaag

SEQ ID NO: 2837751 - RNA, 17 nt, Mycobacterium avium subsp. paratuberculosis
cguucgaguucgucgac

SEQ ID NO: 2837752 - RNA, 17 nt, Mycobacterium avium subsp. paratuberculosis
cguucgauccgccggug

SEQ ID NO: 2837753 - RNA, 20 nt, Mycobacterium avium subsp. paratuberculosis
cguucgauccgccggugccg

SEQ ID NO: 2837754 - RNA, 15 nt, Mycobacterium avium subsp. paratuberculosis
cguucgauugcacca

SEQ ID NO: 2837755 - RNA, 17 nt, Mycobacterium avium subsp. paratuberculosis
cguucgauugcaccacc

SEQ ID NO: 2837756 - RNA, 18 nt, Mycobacterium avium subsp. paratuberculosis
cguucgauugcaccaccg

SEQ ID NO: 2837757 - RNA, 18 nt, Mycobacterium avium subsp. paratuberculosis
cguucgccgacagcagcu

SEQ ID NO: 2837758 - RNA, 19 nt, Mycobacterium avium subsp. paratuberculosis
cguucgccggccagcacgc

SEQ ID NO: 2837759 - RNA, 20 nt, Mycobacterium avium subsp. paratuberculosis
cguucgccggcgacggccag

SEQ ID NO: 2837760 - RNA, 18 nt, Mycobacterium avium subsp. paratuberculosis
cguucgccggcguagacc

SEQ ID NO: 2837761 - RNA, 18 nt, Mycobacterium avium subsp. paratuberculosis
cguucgccgguaccgccg

SEQ ID NO: 2837762 - RNA, 15 nt, Mycobacterium avium subsp. paratuberculosis
cguucgcgcacggcg

SEQ ID NO: 2837763 - RNA, 23 nt, Mycobacterium avium subsp. paratuberculosis
cguucgcggugggcucgucgaac

SEQ ID NO: 2837764 - RNA, 14 nt, Mycobacterium avium subsp. paratuberculosis
cguucgcguugagc

SEQ ID NO: 2837765 - RNA, 19 nt, Mycobacterium avium subsp. paratuberculosis
cguucgcguugagcgucgc

SEQ ID NO: 2837766 - RNA, 18 nt, Mycobacterium avium subsp. paratuberculosis
cguucgcuuucgccgggc

SEQ ID NO: 2837767 - RNA, 21 nt, Mycobacterium avium subsp. paratuberculosis
cguucgcuuucgccgggcguc

SEQ ID NO: 2837768 - RNA, 14 nt, Mycobacterium avium subsp. paratuberculosis
cguucggccagcac

SEQ ID NO: 2837769 - RNA, 18 nt, Mycobacterium avium subsp. paratuberculosis
cguucggccagcaccagg

SEQ ID NO: 2837770 - RNA, 17 nt, Mycobacterium avium subsp. paratuberculosis
cguucggccagcgccgc

SEQ ID NO: 2837771 - RNA, 19 nt, Mycobacterium avium subsp. paratuberculosis
cguucggccagcgccgcca

SEQ ID NO: 2837772 - RNA, 14 nt, Mycobacterium avium subsp. paratuberculosis
cguucggcgaguga

SEQ ID NO: 2837773 - RNA, 13 nt, Mycobacterium avium subsp. paratuberculosis
cguucggcgauca

SEQ ID NO: 2837774 - RNA, 15 nt, Mycobacterium avium subsp. paratuberculosis
cguucggcgaucagc

SEQ ID NO: 2837775 - RNA, 19 nt, Mycobacterium avium subsp. paratuberculosis
cguucggcgaucagcugga

SEQ ID NO: 2837776 - RNA, 14 nt, Mycobacterium avium subsp. paratuberculosis
cguucggcgauccg

SEQ ID NO: 2837777 - RNA, 15 nt, Mycobacterium avium subsp. paratuberculosis
cguucggcgccaccc

SEQ ID NO: 2837778 - RNA, 13 nt, Mycobacterium avium subsp. paratuberculosis
cguucggcgcgga

SEQ ID NO: 2837779 - RNA, 15 nt, Mycobacterium avium subsp. paratuberculosis
cguucggcggcgcgc

SEQ ID NO: 2837780 - RNA, 22 nt, Mycobacterium avium subsp. paratuberculosis
cguucggcggcgcgcugcaggc

SEQ ID NO: 2837781 - RNA, 23 nt, Mycobacterium avium subsp. paratuberculosis
cguucggcggcgcgcugcaggcc

SEQ ID NO: 2837782 - RNA, 11 nt, Mycobacterium avium subsp. paratuberculosis
cguucggcggg

SEQ ID NO: 2837783 - RNA, 12 nt, Mycobacterium avium subsp. paratuberculosis
cguucggcgggc

SEQ ID NO: 2837784 - RNA, 16 nt, Mycobacterium avium subsp. paratuberculosis
cguucggcgguucgga

SEQ ID NO: 2837785 - RNA, 16 nt, Mycobacterium avium subsp. paratuberculosis
cguucgggcagcgccu

SEQ ID NO: 2837786 - RNA, 13 nt, Mycobacterium avium subsp. paratuberculosis
cguucgggugcga

SEQ ID NO: 2837787 - RNA, 20 nt, Mycobacterium avium subsp. paratuberculosis
cguucggguuacguggacgc

SEQ ID NO: 2837788 - RNA, 15 nt, Mycobacterium avium subsp. paratuberculosis
cguucgguggccacc

SEQ ID NO: 2837789 - RNA, 17 nt, Mycobacterium avium subsp. paratuberculosis
cguucgguggccaccgc

SEQ ID NO: 2837790 - RNA, 22 nt, Mycobacterium avium subsp. paratuberculosis
cguucguagaaccggcccagca

SEQ ID NO: 2837791 - RNA, 16 nt, Mycobacterium avium subsp. paratuberculosis
cguucguagggacugc

SEQ ID NO: 2837792 - RNA, 13 nt, Mycobacterium avium subsp. paratuberculosis
cguucgucgccgg

SEQ ID NO: 2837793 - RNA, 15 nt, Mycobacterium avium subsp. paratuberculosis
cguucgucgccggug

SEQ ID NO: 2837794 - RNA, 14 nt, Mycobacterium avium subsp. paratuberculosis
cguucgucgucgcg

SEQ ID NO: 2837795 - RNA, 20 nt, Mycobacterium avium subsp. paratuberculosis
cguucgugagcgguggccac

SEQ ID NO: 2837796 - RNA, 17 nt, Mycobacterium avium subsp. paratuberculosis
cguucguuuuucgucca

SEQ ID NO: 2837797 - RNA, 14 nt, Mycobacterium avium subsp. paratuberculosis
cguucuccaccgcg

SEQ ID NO: 2837798 - RNA, 16 nt, Mycobacterium avium subsp. paratuberculosis
cguucuccaccgcgcg

SEQ ID NO: 2837799 - RNA, 19 nt, Mycobacterium avium subsp. paratuberculosis
cguucuccaccgcgcgcgg

SEQ ID NO: 2837800 - RNA, 15 nt, Mycobacterium avium subsp. paratuberculosis
cguucuccagcaccc

SEQ ID NO: 2837801 - RNA, 21 nt, Mycobacterium avium subsp. paratuberculosis
cguucuccagcacccgcaacg

SEQ ID NO: 2837802 - RNA, 21 nt, Mycobacterium avium subsp. paratuberculosis
cguucuccauccgggcggcca

SEQ ID NO: 2837803 - RNA, 22 nt, Mycobacterium avium subsp. paratuberculosis
cguucuccauccgggcggccag

SEQ ID NO: 2837804 - RNA, 19 nt, Mycobacterium avium subsp. paratuberculosis
cguugccgccgcgcgcggc

SEQ ID NO: 2837805 - RNA, 20 nt, Mycobacterium avium subsp. paratuberculosis
cguugccgccgcgcgcggcc

SEQ ID NO: 2837806 - RNA, 18 nt, Mycobacterium avium subsp. paratuberculosis
cguugccgccggcgcggu

SEQ ID NO: 2837807 - RNA, 15 nt, Mycobacterium avium subsp. paratuberculosis
cguugccgcgcgccc

SEQ ID NO: 2837808 - RNA, 17 nt, Mycobacterium avium subsp. paratuberculosis
cguugccgcgcgcccgc

SEQ ID NO: 2837809 - RNA, 13 nt, Mycobacterium avium subsp. paratuberculosis
cguugccggcccg

SEQ ID NO: 2837810 - RNA, 17 nt, Mycobacterium avium subsp. paratuberculosis
cguugccggcccgcagc

SEQ ID NO: 2837811 - RNA, 18 nt, Mycobacterium avium subsp. paratuberculosis
cguugccggcccgcagcg

SEQ ID NO: 2837812 - RNA, 13 nt, Mycobacterium avium subsp. paratuberculosis
cguugccggcggc

SEQ ID NO: 2837813 - RNA, 16 nt, Mycobacterium avium subsp. paratuberculosis
cguugccggcggccag

SEQ ID NO: 2837814 - RNA, 20 nt, Mycobacterium avium subsp. paratuberculosis
cguugccggcggccagcauc

SEQ ID NO: 2837815 - RNA, 15 nt, Mycobacterium avium subsp. paratuberculosis
cguugccggcggcga

SEQ ID NO: 2837816 - RNA, 18 nt, Mycobacterium avium subsp. paratuberculosis
cguugccggcggcgaagc

SEQ ID NO: 2837817 - RNA, 13 nt, Mycobacterium avium subsp. paratuberculosis
cguugccgguccc

SEQ ID NO: 2837818 - RNA, 14 nt, Mycobacterium avium subsp. paratuberculosis
cguugccggugccg

SEQ ID NO: 2837819 - RNA, 15 nt, Mycobacterium avium subsp. paratuberculosis
cguugccggugccga

SEQ ID NO: 2837820 - RNA, 21 nt, Mycobacterium avium subsp. paratuberculosis
cguugccgugggggucgaccc

SEQ ID NO: 2837821 - RNA, 16 nt, Mycobacterium avium subsp. paratuberculosis
cguugcgaaacaacgc

SEQ ID NO: 2837822 - RNA, 23 nt, Mycobacterium avium subsp. paratuberculosis
cguugcgagucaucgccacccgc

SEQ ID NO: 2837823 - RNA, 15 nt, Mycobacterium avium subsp. paratuberculosis
cguugcgcaucagcg

SEQ ID NO: 2837824 - RNA, 19 nt, Mycobacterium avium subsp. paratuberculosis
cguugcgcaucagcgccac

SEQ ID NO: 2837825 - RNA, 21 nt, Mycobacterium avium subsp. paratuberculosis
cguugcgcaucagcgccacca

SEQ ID NO: 2837826 - RNA, 18 nt, Mycobacterium avium subsp. paratuberculosis
cguugcgccagcaccgac

SEQ ID NO: 2837827 - RNA, 14 nt, Mycobacterium avium subsp. paratuberculosis
cguugcgccagcgg

SEQ ID NO: 2837828 - RNA, 13 nt, Mycobacterium avium subsp. paratuberculosis
cguugcgccccag

SEQ ID NO: 2837829 - RNA, 14 nt, Mycobacterium avium subsp. paratuberculosis
cguugcgcccggcc

SEQ ID NO: 2837830 - RNA, 17 nt, Mycobacterium avium subsp. paratuberculosis
cguugcgcccggccauc

SEQ ID NO: 2837831 - RNA, 11 nt, Mycobacterium avium subsp. paratuberculosis
cguugcgccgc

SEQ ID NO: 2837832 - RNA, 14 nt, Mycobacterium avium subsp. paratuberculosis
cguugcgccgccag

SEQ ID NO: 2837833 - RNA, 15 nt, Mycobacterium avium subsp. paratuberculosis
cguugcgccgccagg

SEQ ID NO: 2837834 - RNA, 14 nt, Mycobacterium avium subsp. paratuberculosis
cguugcgcggccgc

SEQ ID NO: 2837835 - RNA, 15 nt, Mycobacterium avium subsp. paratuberculosis
cguugcgcggccgca

SEQ ID NO: 2837836 - RNA, 17 nt, Mycobacterium avium subsp. paratuberculosis
cguugcgcggccgcaug

SEQ ID NO: 2837837 - RNA, 13 nt, Mycobacterium avium subsp. paratuberculosis
cguugcgcggcgg

SEQ ID NO: 2837838 - RNA, 15 nt, Mycobacterium avium subsp. paratuberculosis
cguugcgcggcggcc

SEQ ID NO: 2837839 - RNA, 21 nt, Mycobacterium avium subsp. paratuberculosis
cguugcgcguucaagccgccg

SEQ ID NO: 2837840 - RNA, 17 nt, Mycobacterium avium subsp. paratuberculosis
cguugcggaucgaacgg

SEQ ID NO: 2837841 - RNA, 21 nt, Mycobacterium avium subsp. paratuberculosis
cguugcggaucgaacggcgga

SEQ ID NO: 2837842 - RNA, 20 nt, Mycobacterium avium subsp. paratuberculosis
cguugcggaucucgaccucg

SEQ ID NO: 2837843 - RNA, 23 nt, Mycobacterium avium subsp. paratuberculosis
cguugcggaucucgaccucgucg

SEQ ID NO: 2837844 - RNA, 21 nt, Mycobacterium avium subsp. paratuberculosis
cguugcggcacaggcgaaucg

SEQ ID NO: 2837845 - RNA, 16 nt, Mycobacterium avium subsp. paratuberculosis
cguugcggccguccag

SEQ ID NO: 2837846 - RNA, 17 nt, Mycobacterium avium subsp. paratuberculosis
cguugcggccguccagc

SEQ ID NO: 2837847 - RNA, 15 nt, Mycobacterium avium subsp. paratuberculosis
cguugcggcgcagcg

SEQ ID NO: 2837848 - RNA, 13 nt, Mycobacterium avium subsp. paratuberculosis
cguugcgggccag

SEQ ID NO: 2837849 - RNA, 14 nt, Mycobacterium avium subsp. paratuberculosis
cguugcgggccagg

SEQ ID NO: 2837850 - RNA, 14 nt, Mycobacterium avium subsp. paratuberculosis
cguugcgggcggcg

SEQ ID NO: 2837851 - RNA, 16 nt, Mycobacterium avium subsp. paratuberculosis
cguugcgggucggcgu

SEQ ID NO: 2837852 - RNA, 19 nt, Mycobacterium avium subsp. paratuberculosis
cguugcgggugucgccggu

SEQ ID NO: 2837853 - RNA, 17 nt, Mycobacterium avium subsp. paratuberculosis
cguugcggugcucgucg

SEQ ID NO: 2837854 - RNA, 20 nt, Mycobacterium avium subsp. paratuberculosis
cguugcggugcucgucgagc

SEQ ID NO: 2837855 - RNA, 15 nt, Mycobacterium avium subsp. paratuberculosis
cguugcgucccgcgc

SEQ ID NO: 2837856 - RNA, 18 nt, Mycobacterium avium subsp. paratuberculosis
cguugcgucccgcgccgg

SEQ ID NO: 2837857 - RNA, 15 nt, Mycobacterium avium subsp. paratuberculosis
cguuggacuccaccg

SEQ ID NO: 2837858 - RNA, 16 nt, Mycobacterium avium subsp. paratuberculosis
cguuggacuccaccgc

SEQ ID NO: 2837859 - RNA, 15 nt, Mycobacterium avium subsp. paratuberculosis
cguuggagccgacca

SEQ ID NO: 2837860 - RNA, 17 nt, Mycobacterium avium subsp. paratuberculosis
cguuggagccgaccagc

SEQ ID NO: 2837861 - RNA, 21 nt, Mycobacterium avium subsp. paratuberculosis
cguuggaggugaucgccagcc

SEQ ID NO: 2837862 - RNA, 21 nt, Mycobacterium avium subsp. paratuberculosis
cguuggcacccgaccgacgcc

SEQ ID NO: 2837863 - RNA, 22 nt, Mycobacterium avium subsp. paratuberculosis
cguuggcacccgaccgacgccc

SEQ ID NO: 2837864 - RNA, 20 nt, Mycobacterium avium subsp. paratuberculosis
cguuggccagaugcccgccc

SEQ ID NO: 2837865 - RNA, 14 nt, Mycobacterium avium subsp. paratuberculosis
cguuggccagcacc

SEQ ID NO: 2837866 - RNA, 16 nt, Mycobacterium avium subsp. paratuberculosis
cguuggccagcaccgc

SEQ ID NO: 2837867 - RNA, 15 nt, Mycobacterium avium subsp. paratuberculosis
cguuggccagcgccu

SEQ ID NO: 2837868 - RNA, 18 nt, Mycobacterium avium subsp. paratuberculosis
cguuggccagcgccucca

SEQ ID NO: 2837869 - RNA, 18 nt, Mycobacterium avium subsp. paratuberculosis
cguuggccgagcagccgg

SEQ ID NO: 2837870 - RNA, 21 nt, Mycobacterium avium subsp. paratuberculosis
cguuggccgagcagccgggcc

SEQ ID NO: 2837871 - RNA, 11 nt, Mycobacterium avium subsp. paratuberculosis
cguuggccgcc

SEQ ID NO: 2837872 - RNA, 20 nt, Mycobacterium avium subsp. paratuberculosis
cguuggccgccacgaugcug

SEQ ID NO: 2837873 - RNA, 14 nt, Mycobacterium avium subsp. paratuberculosis
cguuggccggcucc

SEQ ID NO: 2837874 - RNA, 14 nt, Mycobacterium avium subsp. paratuberculosis
cguuggccuccucg

SEQ ID NO: 2837875 - RNA, 16 nt, Mycobacterium avium subsp. paratuberculosis
cguuggccugcgcgac

SEQ ID NO: 2837876 - RNA, 15 nt, Mycobacterium avium subsp. paratuberculosis
cguuggccugguagc

SEQ ID NO: 2837877 - RNA, 14 nt, Mycobacterium avium subsp. paratuberculosis
cguuggcgccgacg

SEQ ID NO: 2837878 - RNA, 18 nt, Mycobacterium avium subsp. paratuberculosis
cguuggcgccggucgacg

SEQ ID NO: 2837879 - RNA, 19 nt, Mycobacterium avium subsp. paratuberculosis
cguuggcgccggucgacgc

SEQ ID NO: 2837880 - RNA, 19 nt, Mycobacterium avium subsp. paratuberculosis
cguuggcgccguccgcggc

SEQ ID NO: 2837881 - RNA, 21 nt, Mycobacterium avium subsp. paratuberculosis
cguuggcggccagcgcgccgc

SEQ ID NO: 2837882 - RNA, 14 nt, Mycobacterium avium subsp. paratuberculosis
cguuggcggcggug

SEQ ID NO: 2837883 - RNA, 16 nt, Mycobacterium avium subsp. paratuberculosis
cguuggcggcgucgag

SEQ ID NO: 2837884 - RNA, 17 nt, Mycobacterium avium subsp. paratuberculosis
cguuggcggcgucgagu

SEQ ID NO: 2837885 - RNA, 17 nt, Mycobacterium avium subsp. paratuberculosis
cguuggcguagucgacu

SEQ ID NO: 2837886 - RNA, 15 nt, Mycobacterium avium subsp. paratuberculosis
cguuggcguggaugg

SEQ ID NO: 2837887 - RNA, 16 nt, Mycobacterium avium subsp. paratuberculosis
cguugggcagcucggc

SEQ ID NO: 2837888 - RNA, 15 nt, Mycobacterium avium subsp. paratuberculosis
cguugggccagcggc

SEQ ID NO: 2837889 - RNA, 15 nt, Mycobacterium avium subsp. paratuberculosis
cuaccgacggcaccu

SEQ ID NO: 2837890 - RNA, 16 nt, Mycobacterium avium subsp. paratuberculosis
cuaccgccgagcguga

SEQ ID NO: 2837891 - RNA, 15 nt, Mycobacterium avium subsp. paratuberculosis
cuaccgccgggcggg

SEQ ID NO: 2837892 - RNA, 18 nt, Mycobacterium avium subsp. paratuberculosis
cuaccgccgggcgggccg

SEQ ID NO: 2837893 - RNA, 14 nt, Mycobacterium avium subsp. paratuberculosis
cuaccgccucgcca

SEQ ID NO: 2837894 - RNA, 15 nt, Mycobacterium avium subsp. paratuberculosis
cuaccgccucgccag

SEQ ID NO: 2837895 - RNA, 16 nt, Mycobacterium avium subsp. paratuberculosis
cuaccgccucgccagc

SEQ ID NO: 2837896 - RNA, 20 nt, Mycobacterium avium subsp. paratuberculosis
cuaccgcgcucaccgucgcg

SEQ ID NO: 2837897 - RNA, 17 nt, Mycobacterium avium subsp. paratuberculosis
cuaccggguggccagca

SEQ ID NO: 2837898 - RNA, 19 nt, Mycobacterium avium subsp. paratuberculosis
cuaccggguggccagcacc

SEQ ID NO: 2837899 - RNA, 21 nt, Mycobacterium avium subsp. paratuberculosis
cuaccggguggccagcaccag

SEQ ID NO: 2837900 - RNA, 23 nt, Mycobacterium avium subsp. paratuberculosis
cuaccggguggccagcaccagcc

SEQ ID NO: 2837901 - RNA, 14 nt, Mycobacterium avium subsp. paratuberculosis
cuaccuaggcgucg

SEQ ID NO: 2837902 - RNA, 16 nt, Mycobacterium avium subsp. paratuberculosis
cuaccuaggcgucguc

SEQ ID NO: 2837903 - RNA, 16 nt, Mycobacterium avium subsp. paratuberculosis
cuaccugaccagcggc

SEQ ID NO: 2837904 - RNA, 20 nt, Mycobacterium avium subsp. paratuberculosis
cuaccuuguugugacacagc

SEQ ID NO: 2837905 - RNA, 19 nt, Mycobacterium avium subsp. paratuberculosis
cuacgacauccugcgcauc

SEQ ID NO: 2837906 - RNA, 23 nt, Mycobacterium avium subsp. paratuberculosis
cuacgacauccugcgcaucgagc

SEQ ID NO: 2837907 - RNA, 23 nt, Mycobacterium avium subsp. paratuberculosis
cuacgccggcucggucuccucca

SEQ ID NO: 2837908 - RNA, 21 nt, Mycobacterium avium subsp. paratuberculosis
cuacgcgagcugcuucgucgc

SEQ ID NO: 2837909 - RNA, 13 nt, Mycobacterium avium subsp. paratuberculosis
cuacggcgccggu

SEQ ID NO: 2837910 - RNA, 13 nt, Mycobacterium avium subsp. paratuberculosis
cuacggcgggccg

SEQ ID NO: 2837911 - RNA, 14 nt, Mycobacterium avium subsp. paratuberculosis
cuacggcgggccgg

SEQ ID NO: 2837912 - RNA, 16 nt, Mycobacterium avium subsp. paratuberculosis
cuacggcgggccggcg

SEQ ID NO: 2837913 - RNA, 17 nt, Mycobacterium avium subsp. paratuberculosis
cuacggcgggccggcgc

SEQ ID NO: 2837914 - RNA, 20 nt, Mycobacterium avium subsp. paratuberculosis
cuacggcgggccggcgccgg

SEQ ID NO: 2837915 - RNA, 21 nt, Mycobacterium avium subsp. paratuberculosis
cuacggcgggccggcgccggu

SEQ ID NO: 2837916 - RNA, 14 nt, Mycobacterium avium subsp. paratuberculosis
cuacgggcgcaccg

SEQ ID NO: 2837917 - RNA, 21 nt, Mycobacterium avium subsp. paratuberculosis
cuacgggcgcaccgcgcgcca

SEQ ID NO: 2837918 - RNA, 13 nt, Mycobacterium avium subsp. paratuberculosis
cuacgucggcugg

SEQ ID NO: 2837919 - RNA, 18 nt, Mycobacterium avium subsp. paratuberculosis
cuacgucggcuggcgugc

SEQ ID NO: 2837920 - RNA, 15 nt, Mycobacterium avium subsp. paratuberculosis
cuacucggacgccgg

SEQ ID NO: 2837921 - RNA, 18 nt, Mycobacterium avium subsp. paratuberculosis
cuacucggacgccggcag

SEQ ID NO: 2837922 - RNA, 21 nt, Mycobacterium avium subsp. paratuberculosis
cuacugcugcgggugcggcca

SEQ ID NO: 2837923 - RNA, 16 nt, Mycobacterium avium subsp. paratuberculosis
cuacuucgucagcagc

SEQ ID NO: 2837924 - RNA, 20 nt, Mycobacterium avium subsp. paratuberculosis
cuacuugcguugcgcggcgg

SEQ ID NO: 2837925 - RNA, 22 nt, Mycobacterium avium subsp. paratuberculosis
cuacuugcguugcgcggcggcc

SEQ ID NO: 2837926 - RNA, 19 nt, Mycobacterium avium subsp. paratuberculosis
cuagaccgauggcggcggc

SEQ ID NO: 2837927 - RNA, 23 nt, Mycobacterium avium subsp. paratuberculosis
cuagaccgauggcggcggcccgc

SEQ ID NO: 2837928 - RNA, 16 nt, Mycobacterium avium subsp. paratuberculosis
cuagacgcgcaccagg

SEQ ID NO: 2837929 - RNA, 17 nt, Mycobacterium avium subsp. paratuberculosis
cuagacgcgcaccaggg

SEQ ID NO: 2837930 - RNA, 19 nt, Mycobacterium avium subsp. paratuberculosis
cuagccgccgagcgucacg

SEQ ID NO: 2837931 - RNA, 15 nt, Mycobacterium avium subsp. paratuberculosis
cuagcgacggccguu

SEQ ID NO: 2837932 - RNA, 22 nt, Mycobacterium avium subsp. paratuberculosis
cuagcgagcgggcacgccgccg

SEQ ID NO: 2837933 - RNA, 23 nt, Mycobacterium avium subsp. paratuberculosis
cuagcgagcgggcacgccgccgc

SEQ ID NO: 2837934 - RNA, 14 nt, Mycobacterium avium subsp. paratuberculosis
cuagcgcaauugaa

SEQ ID NO: 2837935 - RNA, 17 nt, Mycobacterium avium subsp. paratuberculosis
cuagcgcggcggccucg

SEQ ID NO: 2837936 - RNA, 21 nt, Mycobacterium avium subsp. paratuberculosis
cuagcggccuaggacgccgcc

SEQ ID NO: 2837937 - RNA, 23 nt, Mycobacterium avium subsp. paratuberculosis
cuagcggcguguuguagucagac

SEQ ID NO: 2837938 - RNA, 20 nt, Mycobacterium avium subsp. paratuberculosis
cuagcggcugacccgcccgg

SEQ ID NO: 2837939 - RNA, 14 nt, Mycobacterium avium subsp. paratuberculosis
cuagcgggccagga

SEQ ID NO: 2837940 - RNA, 15 nt, Mycobacterium avium subsp. paratuberculosis
cuagcgggccaggau

SEQ ID NO: 2837941 - RNA, 18 nt, Mycobacterium avium subsp. paratuberculosis
cuagcgggcgcgcagcca

SEQ ID NO: 2837942 - RNA, 22 nt, Mycobacterium avium subsp. paratuberculosis
cuagcgugacagucgaccucgc

SEQ ID NO: 2837943 - RNA, 20 nt, Mycobacterium avium subsp. paratuberculosis
cuagcgugacgcucgcgugg

SEQ ID NO: 2837944 - RNA, 18 nt, Mycobacterium avium subsp. paratuberculosis
cuagcuucacgcucggca

SEQ ID NO: 2837945 - RNA, 23 nt, Mycobacterium avium subsp. paratuberculosis
cuagcuucacggucggagcccag

SEQ ID NO: 2837946 - RNA, 17 nt, Mycobacterium avium subsp. paratuberculosis
cuagcuucacguucggc

SEQ ID NO: 2837947 - RNA, 19 nt, Mycobacterium avium subsp. paratuberculosis
cuagcuucacguucggcga

SEQ ID NO: 2837948 - RNA, 20 nt, Mycobacterium avium subsp. paratuberculosis
cuagcuucacguucggcgag

SEQ ID NO: 2837949 - RNA, 14 nt, Mycobacterium avium subsp. paratuberculosis
cuagcuugggugag

SEQ ID NO: 2837950 - RNA, 13 nt, Mycobacterium avium subsp. paratuberculosis
cuaggaccccggc

SEQ ID NO: 2837951 - RNA, 16 nt, Mycobacterium avium subsp. paratuberculosis
cuaggaccccggcugc

SEQ ID NO: 2837952 - RNA, 19 nt, Mycobacterium avium subsp. paratuberculosis
cuaggacgugcucugccua

SEQ ID NO: 2837953 - RNA, 19 nt, Mycobacterium avium subsp. paratuberculosis
cuaggccagcagcgcggcg

SEQ ID NO: 2837954 - RNA, 14 nt, Mycobacterium avium subsp. paratuberculosis
cuaggcggccgggc

SEQ ID NO: 2837955 - RNA, 15 nt, Mycobacterium avium subsp. paratuberculosis
cuaggcggccgggcg

SEQ ID NO: 2837956 - RNA, 16 nt, Mycobacterium avium subsp. paratuberculosis
cuaggcggccgggcgg

SEQ ID NO: 2837957 - RNA, 18 nt, Mycobacterium avium subsp. paratuberculosis
cuaggcggccgggcggcc

SEQ ID NO: 2837958 - RNA, 19 nt, Mycobacterium avium subsp. paratuberculosis
cuaggcgucgucggcccag

SEQ ID NO: 2837959 - RNA, 14 nt, Mycobacterium avium subsp. paratuberculosis
cuaggcucggcagc

SEQ ID NO: 2837960 - RNA, 15 nt, Mycobacterium avium subsp. paratuberculosis
cuaggcucggcagcc

SEQ ID NO: 2837961 - RNA, 19 nt, Mycobacterium avium subsp. paratuberculosis
cuagggcccacgcucgacg

SEQ ID NO: 2837962 - RNA, 13 nt, Mycobacterium avium subsp. paratuberculosis
cuaggucaccgga

SEQ ID NO: 2837963 - RNA, 15 nt, Mycobacterium avium subsp. paratuberculosis
cuagguccggcgcga

SEQ ID NO: 2837964 - RNA, 16 nt, Mycobacterium avium subsp. paratuberculosis
cuagguccggcgcgac

SEQ ID NO: 2837965 - RNA, 18 nt, Mycobacterium avium subsp. paratuberculosis
cuagguccggcgcgacca

SEQ ID NO: 2837966 - RNA, 22 nt, Mycobacterium avium subsp. paratuberculosis
cuaggugacccaauccggcuga

SEQ ID NO: 2837967 - RNA, 19 nt, Mycobacterium avium subsp. paratuberculosis
cuagguuuggccagcaccg

SEQ ID NO: 2837968 - RNA, 23 nt, Mycobacterium avium subsp. paratuberculosis
cuagguuuggccagcaccgcggc

SEQ ID NO: 2837969 - RNA, 19 nt, Mycobacterium avium subsp. paratuberculosis
cuagucgacgccgauggug

SEQ ID NO: 2837970 - RNA, 14 nt, Mycobacterium avium subsp. paratuberculosis
cuagucgcccagca

SEQ ID NO: 2837971 - RNA, 16 nt, Mycobacterium avium subsp. paratuberculosis
cuagucgcccagcagc

SEQ ID NO: 2837972 - RNA, 21 nt, Mycobacterium avium subsp. paratuberculosis
cuagucgcccagcagcccggc

SEQ ID NO: 2837973 - RNA, 16 nt, Mycobacterium avium subsp. paratuberculosis
cucagcccggcccagc

SEQ ID NO: 2837974 - RNA, 13 nt, Mycobacterium avium subsp. paratuberculosis
cucagcccggcgc

SEQ ID NO: 2837975 - RNA, 14 nt, Mycobacterium avium subsp. paratuberculosis
cucagcccggcgcu

SEQ ID NO: 2837976 - RNA, 18 nt, Mycobacterium avium subsp. paratuberculosis
cucagccgaagccggcgc

SEQ ID NO: 2837977 - RNA, 22 nt, Mycobacterium avium subsp. paratuberculosis
cucagccgaagccggcgcaggu

SEQ ID NO: 2837978 - RNA, 20 nt, Mycobacterium avium subsp. paratuberculosis
cucagccggcggugcgucga

SEQ ID NO: 2837979 - RNA, 22 nt, Mycobacterium avium subsp. paratuberculosis
cucagccguucgcugcccucgg

SEQ ID NO: 2837980 - RNA, 19 nt, Mycobacterium avium subsp. paratuberculosis
cucagcgauugcggccgcc

SEQ ID NO: 2837981 - RNA, 20 nt, Mycobacterium avium subsp. paratuberculosis
cucagcgauugcggccgccg

SEQ ID NO: 2837982 - RNA, 22 nt, Mycobacterium avium subsp. paratuberculosis
cucagcgauugcggccgccggc

SEQ ID NO: 2837983 - RNA, 24 nt, Mycobacterium avium subsp. paratuberculosis
cucagcgauugcggccgccggcca

SEQ ID NO: 2837984 - RNA, 18 nt, Mycobacterium avium subsp. paratuberculosis
cucagcgcccaggaugac

SEQ ID NO: 2837985 - RNA, 23 nt, Mycobacterium avium subsp. paratuberculosis
cucagcgcccaggaugacgccga

SEQ ID NO: 2837986 - RNA, 13 nt, Mycobacterium avium subsp. paratuberculosis
cucagcgcccgcc

SEQ ID NO: 2837987 - RNA, 21 nt, Mycobacterium avium subsp. paratuberculosis
cucagcgcccgcccggcccgg

SEQ ID NO: 2837988 - RNA, 22 nt, Mycobacterium avium subsp. paratuberculosis
cucagcgcccgcccggcccggc

SEQ ID NO: 2837989 - RNA, 12 nt, Mycobacterium avium subsp. paratuberculosis
cucagcgcggcg

SEQ ID NO: 2837990 - RNA, 13 nt, Mycobacterium avium subsp. paratuberculosis
cucagcgcggcgg

SEQ ID NO: 2837991 - RNA, 13 nt, Mycobacterium avium subsp. paratuberculosis
cucagcggcagcg

SEQ ID NO: 2837992 - RNA, 16 nt, Mycobacterium avium subsp. paratuberculosis
cucagcggcagcgucg

SEQ ID NO: 2837993 - RNA, 20 nt, Mycobacterium avium subsp. paratuberculosis
cucagcggcagcgucgccag

SEQ ID NO: 2837994 - RNA, 13 nt, Mycobacterium avium subsp. paratuberculosis
cucagcggccauc

SEQ ID NO: 2837995 - RNA, 19 nt, Mycobacterium avium subsp. paratuberculosis
cucagcggccaucgccgcc

SEQ ID NO: 2837996 - RNA, 12 nt, Mycobacterium avium subsp. paratuberculosis
cucagcggcgcu

SEQ ID NO: 2837997 - RNA, 22 nt, Mycobacterium avium subsp. paratuberculosis
cucagcgggaagccgaggucgc

SEQ ID NO: 2837998 - RNA, 23 nt, Mycobacterium avium subsp. paratuberculosis
cucagcgggaagccgaggucgcc

SEQ ID NO: 2837999 - RNA, 13 nt, Mycobacterium avium subsp. paratuberculosis
cucagcgggcggc

SEQ ID NO: 2838000 - RNA, 16 nt, Mycobacterium avium subsp. paratuberculosis
cucagcgggcggccag

SEQ ID NO: 2838001 - RNA, 18 nt, Mycobacterium avium subsp. paratuberculosis
cucagcgggcggccagcc

SEQ ID NO: 2838002 - RNA, 13 nt, Mycobacterium avium subsp. paratuberculosis
cucagcgucgaug

SEQ ID NO: 2838003 - RNA, 19 nt, Mycobacterium avium subsp. paratuberculosis
cucagcguucacgucgauc

SEQ ID NO: 2838004 - RNA, 20 nt, Mycobacterium avium subsp. paratuberculosis
cucagcguucacgucgauca

SEQ ID NO: 2838005 - RNA, 15 nt, Mycobacterium avium subsp. paratuberculosis
cucagcucccgagca

SEQ ID NO: 2838006 - RNA, 18 nt, Mycobacterium avium subsp. paratuberculosis
cucagcugcugcgcggcg

SEQ ID NO: 2838007 - RNA, 19 nt, Mycobacterium avium subsp. paratuberculosis
cucagcugcugcgcggcgg

SEQ ID NO: 2838008 - RNA, 20 nt, Mycobacterium avium subsp. paratuberculosis
cucagcugcugcgcggcggc

SEQ ID NO: 2838009 - RNA, 20 nt, Mycobacterium avium subsp. paratuberculosis
cucaggagugguagggcucc

SEQ ID NO: 2838010 - RNA, 23 nt, Mycobacterium avium subsp. paratuberculosis
cucaggagugguagggcuccgcg

SEQ ID NO: 2838011 - RNA, 16 nt, Mycobacterium avium subsp. paratuberculosis
cucaggaucagcagcc

SEQ ID NO: 2838012 - RNA, 11 nt, Mycobacterium avium subsp. paratuberculosis
cucaggaugau

SEQ ID NO: 2838013 - RNA, 20 nt, Mycobacterium avium subsp. paratuberculosis
cucaggaugauuucggcgug

SEQ ID NO: 2838014 - RNA, 22 nt, Mycobacterium avium subsp. paratuberculosis
cucaggaugauuucggcguggc

SEQ ID NO: 2838015 - RNA, 16 nt, Mycobacterium avium subsp. paratuberculosis
cucaggcgagcacccg

SEQ ID NO: 2838016 - RNA, 17 nt, Mycobacterium avium subsp. paratuberculosis
cucaggcgagcacccgg

SEQ ID NO: 2838017 - RNA, 14 nt, Mycobacterium avium subsp. paratuberculosis
cucaggcguccagc

SEQ ID NO: 2838018 - RNA, 16 nt, Mycobacterium avium subsp. paratuberculosis
cucaggcguccagcac

SEQ ID NO: 2838019 - RNA, 19 nt, Mycobacterium avium subsp. paratuberculosis
cucaggcguccagccagcg

SEQ ID NO: 2838020 - RNA, 18 nt, Mycobacterium avium subsp. paratuberculosis
cucaggcgucggucagca

SEQ ID NO: 2838021 - RNA, 18 nt, Mycobacterium avium subsp. paratuberculosis
cucagggcgcgcugucga

SEQ ID NO: 2838022 - RNA, 13 nt, Mycobacterium avium subsp. paratuberculosis
cucaggggaucuc

SEQ ID NO: 2838023 - RNA, 17 nt, Mycobacterium avium subsp. paratuberculosis
cucagggugcgcuggcc

SEQ ID NO: 2838024 - RNA, 21 nt, Mycobacterium avium subsp. paratuberculosis
cucagggugcgcuggccgacc

SEQ ID NO: 2838025 - RNA, 14 nt, Mycobacterium avium subsp. paratuberculosis
cucaggucggccgc

SEQ ID NO: 2838026 - RNA, 17 nt, Mycobacterium avium subsp. paratuberculosis
cucaggucggccgcggc

SEQ ID NO: 2838027 - RNA, 18 nt, Mycobacterium avium subsp. paratuberculosis
cucaggucggccgcggcc

SEQ ID NO: 2838028 - RNA, 19 nt, Mycobacterium avium subsp. paratuberculosis
cucaggucggccgcggccg

SEQ ID NO: 2838029 - RNA, 21 nt, Mycobacterium avium subsp. paratuberculosis
cucagguggacagaugccaga

SEQ ID NO: 2838030 - RNA, 17 nt, Mycobacterium avium subsp. paratuberculosis
cucaguccgacgcgacg

SEQ ID NO: 2838031 - RNA, 19 nt, Mycobacterium avium subsp. paratuberculosis
cucaguccgccccgaugcg

SEQ ID NO: 2838032 - RNA, 14 nt, Mycobacterium avium subsp. paratuberculosis
cucaguccucgccg

SEQ ID NO: 2838033 - RNA, 14 nt, Mycobacterium avium subsp. paratuberculosis
cucagucggccacc

SEQ ID NO: 2838034 - RNA, 22 nt, Mycobacterium avium subsp. paratuberculosis
cucagucggccaccgcgaucuc

SEQ ID NO: 2838035 - RNA, 18 nt, Mycobacterium avium subsp. paratuberculosis
cucagugcacgcucggcg

SEQ ID NO: 2838036 - RNA, 22 nt, Mycobacterium avium subsp. paratuberculosis
cucagugcacgcucggcgcgac

SEQ ID NO: 2838037 - RNA, 18 nt, Mycobacterium avium subsp. paratuberculosis
cucagugucguggcgaca

SEQ ID NO: 2838038 - RNA, 21 nt, Mycobacterium avium subsp. paratuberculosis
cucagugucguggcgacaucg

SEQ ID NO: 2838039 - RNA, 16 nt, Mycobacterium avium subsp. paratuberculosis
cucauacagcggcgcg

SEQ ID NO: 2838040 - RNA, 21 nt, Mycobacterium avium subsp. paratuberculosis
cucauacagcggcgcgcgccg

SEQ ID NO: 2838041 - RNA, 22 nt, Mycobacterium avium subsp. paratuberculosis
cucauacagcggcgcgcgccgc

SEQ ID NO: 2838042 - RNA, 15 nt, Mycobacterium avium subsp. paratuberculosis
cucauacggcggcuc

SEQ ID NO: 2838043 - RNA, 17 nt, Mycobacterium avium subsp. paratuberculosis
cucauagccggccgcgu

SEQ ID NO: 2838044 - RNA, 19 nt, Mycobacterium avium subsp. paratuberculosis
cucauaggcguacaccagg

SEQ ID NO: 2838045 - RNA, 17 nt, Mycobacterium avium subsp. paratuberculosis
cucauaucccgucaggu

SEQ ID NO: 2838046 - RNA, 14 nt, Mycobacterium avium subsp. paratuberculosis
cucaucaccggcgc

SEQ ID NO: 2838047 - RNA, 16 nt, Mycobacterium avium subsp. paratuberculosis
cucaucaccggcgcgc

SEQ ID NO: 2838048 - RNA, 23 nt, Mycobacterium avium subsp. paratuberculosis
cucaucaggcggccggcccggcc

SEQ ID NO: 2838049 - RNA, 13 nt, Mycobacterium avium subsp. paratuberculosis
cucaucccgccga

SEQ ID NO: 2838050 - RNA, 22 nt, Mycobacterium avium subsp. paratuberculosis
cucaucccuagcgugccgucca

SEQ ID NO: 2838051 - RNA, 18 nt, Mycobacterium avium subsp. paratuberculosis
cucaucgcccagccggcg

SEQ ID NO: 2838052 - RNA, 19 nt, Mycobacterium avium subsp. paratuberculosis
cucaucgcccagccggcgg

SEQ ID NO: 2838053 - RNA, 23 nt, Mycobacterium avium subsp. paratuberculosis
cucaucgucgaguaccucgcugu

SEQ ID NO: 2838054 - RNA, 16 nt, Mycobacterium avium subsp. paratuberculosis
cucaucuacgucgucg

SEQ ID NO: 2838055 - RNA, 20 nt, Mycobacterium avium subsp. paratuberculosis
cucaucuacgucgucgccgg

SEQ ID NO: 2838056 - RNA, 18 nt, Mycobacterium avium subsp. paratuberculosis
cucaugagcccuccagcu

SEQ ID NO: 2838057 - RNA, 16 nt, Mycobacterium avium subsp. paratuberculosis
cuccagcggccgcagc

SEQ ID NO: 2838058 - RNA, 20 nt, Mycobacterium avium subsp. paratuberculosis
cuccagcggccgcagcgcga

SEQ ID NO: 2838059 - RNA, 21 nt, Mycobacterium avium subsp. paratuberculosis
cuccagcggccgcagcgcgac

SEQ ID NO: 2838060 - RNA, 18 nt, Mycobacterium avium subsp. paratuberculosis
cuccagcggccgggcgau

SEQ ID NO: 2838061 - RNA, 14 nt, Mycobacterium avium subsp. paratuberculosis
cuccagcggcggcc

SEQ ID NO: 2838062 - RNA, 13 nt, Mycobacterium avium subsp. paratuberculosis
cuccagcgggcgg

SEQ ID NO: 2838063 - RNA, 14 nt, Mycobacterium avium subsp. paratuberculosis
cuccagcgggcggc

SEQ ID NO: 2838064 - RNA, 17 nt, Mycobacterium avium subsp. paratuberculosis
cuccagcgggcggcggu

SEQ ID NO: 2838065 - RNA, 23 nt, Mycobacterium avium subsp. paratuberculosis
cuccagcggguccagccgccggc

SEQ ID NO: 2838066 - RNA, 21 nt, Mycobacterium avium subsp. paratuberculosis
cuccagcuaggagccugcuga

SEQ ID NO: 2838067 - RNA, 19 nt, Mycobacterium avium subsp. paratuberculosis
cuccagcuccgcggccagc

SEQ ID NO: 2838068 - RNA, 16 nt, Mycobacterium avium subsp. paratuberculosis
cuccagcuccucgguc

SEQ ID NO: 2838069 - RNA, 23 nt, Mycobacterium avium subsp. paratuberculosis
cuccagcuguugacgggccgcgg

SEQ ID NO: 2838070 - RNA, 18 nt, Mycobacterium avium subsp. paratuberculosis
cuccagcuuugccagcag

SEQ ID NO: 2838071 - RNA, 19 nt, Mycobacterium avium subsp. paratuberculosis
cuccagcuuugccagcaga

SEQ ID NO: 2838072 - RNA, 19 nt, Mycobacterium avium subsp. paratuberculosis
cuccaggaagaacccggcg

SEQ ID NO: 2838073 - RNA, 11 nt, Mycobacterium avium subsp. paratuberculosis
cuccaggaugu

SEQ ID NO: 2838074 - RNA, 17 nt, Mycobacterium avium subsp. paratuberculosis
cuccaggcucgacaacu

SEQ ID NO: 2838075 - RNA, 20 nt, Mycobacterium avium subsp. paratuberculosis
cuccaggguucucgcggcgg

SEQ ID NO: 2838076 - RNA, 21 nt, Mycobacterium avium subsp. paratuberculosis
cuccaggguucucgcggcggc

SEQ ID NO: 2838077 - RNA, 23 nt, Mycobacterium avium subsp. paratuberculosis
cuccagguagacgaugcccagcc

SEQ ID NO: 2838078 - RNA, 23 nt, Mycobacterium avium subsp. paratuberculosis
cuccaggugaaugcucagcggga

SEQ ID NO: 2838079 - RNA, 21 nt, Mycobacterium avium subsp. paratuberculosis
cuccagguucgccgcccagau

SEQ ID NO: 2838080 - RNA, 20 nt, Mycobacterium avium subsp. paratuberculosis
cuccagguuguggugcacga

SEQ ID NO: 2838081 - RNA, 16 nt, Mycobacterium avium subsp. paratuberculosis
cuccaguugacggcgc

SEQ ID NO: 2838082 - RNA, 16 nt, Mycobacterium avium subsp. paratuberculosis
cuccaguugcgacccc

SEQ ID NO: 2838083 - RNA, 13 nt, Mycobacterium avium subsp. paratuberculosis
cuccauccgccgu

SEQ ID NO: 2838084 - RNA, 14 nt, Mycobacterium avium subsp. paratuberculosis
cuccauccgccguc

SEQ ID NO: 2838085 - RNA, 16 nt, Mycobacterium avium subsp. paratuberculosis
cuccauccgccgucga

SEQ ID NO: 2838086 - RNA, 13 nt, Mycobacterium avium subsp. paratuberculosis
cuccauccgggcg

SEQ ID NO: 2838087 - RNA, 16 nt, Mycobacterium avium subsp. paratuberculosis
cuccauccgggcggcc

SEQ ID NO: 2838088 - RNA, 17 nt, Mycobacterium avium subsp. paratuberculosis
cuccauccgggcggcca

SEQ ID NO: 2838089 - RNA, 20 nt, Mycobacterium avium subsp. paratuberculosis
cuccauccgggcggccagcc

SEQ ID NO: 2838090 - RNA, 14 nt, Mycobacterium avium subsp. paratuberculosis
cuccaugaaccggu

SEQ ID NO: 2838091 - RNA, 15 nt, Mycobacterium avium subsp. paratuberculosis
cuccauggcggcgac

SEQ ID NO: 2838092 - RNA, 16 nt, Mycobacterium avium subsp. paratuberculosis
cuccauggcggcgacc

SEQ ID NO: 2838093 - RNA, 16 nt, Mycobacterium avium subsp. paratuberculosis
cuccaugucgucggcg

SEQ ID NO: 2838094 - RNA, 20 nt, Mycobacterium avium subsp. paratuberculosis
cuccauucgggccagcgccg

SEQ ID NO: 2838095 - RNA, 16 nt, Mycobacterium avium subsp. paratuberculosis
cucccaacgcagcgca

SEQ ID NO: 2838096 - RNA, 14 nt, Mycobacterium avium subsp. paratuberculosis
cucccaccacggcc

SEQ ID NO: 2838097 - RNA, 17 nt, Mycobacterium avium subsp. paratuberculosis
cucccaccacggccgau

SEQ ID NO: 2838098 - RNA, 23 nt, Mycobacterium avium subsp. paratuberculosis
cucccaccguguuugcugcaugc

SEQ ID NO: 2838099 - RNA, 22 nt, Mycobacterium avium subsp. paratuberculosis
cucccacucguagucguuggug

SEQ ID NO: 2838100 - RNA, 14 nt, Mycobacterium avium subsp. paratuberculosis
cucccagacgucga

SEQ ID NO: 2838101 - RNA, 19 nt, Mycobacterium avium subsp. paratuberculosis
cucccagacgucgaccuug

SEQ ID NO: 2838102 - RNA, 20 nt, Mycobacterium avium subsp. paratuberculosis
cucccagacgucgaccuugc

SEQ ID NO: 2838103 - RNA, 12 nt, Mycobacterium avium subsp. paratuberculosis
cucccagccgcc

SEQ ID NO: 2838104 - RNA, 13 nt, Mycobacterium avium subsp. paratuberculosis
cucccagccgccg

SEQ ID NO: 2838105 - RNA, 17 nt, Mycobacterium avium subsp. paratuberculosis
cucccagccgccggcca

SEQ ID NO: 2838106 - RNA, 22 nt, Mycobacterium avium subsp. paratuberculosis
cucccagcgcccgggcgcgugc

SEQ ID NO: 2838107 - RNA, 14 nt, Mycobacterium avium subsp. paratuberculosis
cuccccauccgcgg

SEQ ID NO: 2838108 - RNA, 16 nt, Mycobacterium avium subsp. paratuberculosis
cuccccauccgcggcc

SEQ ID NO: 2838109 - RNA, 17 nt, Mycobacterium avium subsp. paratuberculosis
cuccccauccgcggcca

SEQ ID NO: 2838110 - RNA, 20 nt, Mycobacterium avium subsp. paratuberculosis
cuccccauccgcggccaccg

SEQ ID NO: 2838111 - RNA, 14 nt, Mycobacterium avium subsp. paratuberculosis
cucccccaccacgu

SEQ ID NO: 2838112 - RNA, 13 nt, Mycobacterium avium subsp. paratuberculosis
cucccccacccgc

SEQ ID NO: 2838113 - RNA, 14 nt, Mycobacterium avium subsp. paratuberculosis
cucccccacccgca

SEQ ID NO: 2838114 - RNA, 14 nt, Mycobacterium avium subsp. paratuberculosis
cucccccgacgccg

SEQ ID NO: 2838115 - RNA, 17 nt, Mycobacterium avium subsp. paratuberculosis
cucccccgacgccgaca

SEQ ID NO: 2838116 - RNA, 23 nt, Mycobacterium avium subsp. paratuberculosis
cucccccgacgccgacaccagcg

SEQ ID NO: 2838117 - RNA, 18 nt, Mycobacterium avium subsp. paratuberculosis
cucccccgaucagcguca

SEQ ID NO: 2838118 - RNA, 13 nt, Mycobacterium avium subsp. paratuberculosis
cuccccgagcacg

SEQ ID NO: 2838119 - RNA, 15 nt, Mycobacterium avium subsp. paratuberculosis
cuccccgagcacguc

SEQ ID NO: 2838120 - RNA, 16 nt, Mycobacterium avium subsp. paratuberculosis
cuccccgagcacgucg

SEQ ID NO: 2838121 - RNA, 17 nt, Mycobacterium avium subsp. paratuberculosis
cuccccgagcacgucga

SEQ ID NO: 2838122 - RNA, 18 nt, Mycobacterium avium subsp. paratuberculosis
cuccccgcggugccgcag

SEQ ID NO: 2838123 - RNA, 19 nt, Mycobacterium avium subsp. paratuberculosis
cuccccggacagccacucc

SEQ ID NO: 2838124 - RNA, 20 nt, Mycobacterium avium subsp. paratuberculosis
cuccccggacagccacucca

SEQ ID NO: 2838125 - RNA, 21 nt, Mycobacterium avium subsp. paratuberculosis
cuccccggacagccacuccau

SEQ ID NO: 2838126 - RNA, 24 nt, Mycobacterium avium subsp. paratuberculosis
cuccccggcgaucucgagcauccg

SEQ ID NO: 2838127 - RNA, 14 nt, Mycobacterium avium subsp. paratuberculosis
cuccccguugaucu

SEQ ID NO: 2838128 - RNA, 16 nt, Mycobacterium avium subsp. paratuberculosis
cucccgagcaucgccg

SEQ ID NO: 2838129 - RNA, 19 nt, Mycobacterium avium subsp. paratuberculosis
cucccgagcaucgccgagc

SEQ ID NO: 2838130 - RNA, 12 nt, Mycobacterium avium subsp. paratuberculosis
cucccgcacccg

SEQ ID NO: 2838131 - RNA, 13 nt, Mycobacterium avium subsp. paratuberculosis
cucccgcagcgcc

SEQ ID NO: 2838132 - RNA, 14 nt, Mycobacterium avium subsp. paratuberculosis
cucccgcgccgcgg

SEQ ID NO: 2838133 - RNA, 15 nt, Mycobacterium avium subsp. paratuberculosis
cucccgcgccgcggc

SEQ ID NO: 2838134 - RNA, 16 nt, Mycobacterium avium subsp. paratuberculosis
cucccgcgccgcggcc

SEQ ID NO: 2838135 - RNA, 17 nt, Mycobacterium avium subsp. paratuberculosis
cucccgcgcgcaggcac

SEQ ID NO: 2838136 - RNA, 14 nt, Mycobacterium avium subsp. paratuberculosis
cucccgcgcgcugu

SEQ ID NO: 2838137 - RNA, 14 nt, Mycobacterium avium subsp. paratuberculosis
cucccgcggcagcc

SEQ ID NO: 2838138 - RNA, 19 nt, Mycobacterium avium subsp. paratuberculosis
cucccgcggcagccgggcg

SEQ ID NO: 2838139 - RNA, 20 nt, Mycobacterium avium subsp. paratuberculosis
cucccgcggcagccgggcga

SEQ ID NO: 2838140 - RNA, 14 nt, Mycobacterium avium subsp. paratuberculosis
cucccgcuccaugg

SEQ ID NO: 2838141 - RNA, 16 nt, Mycobacterium avium subsp. paratuberculosis
cucccgcuccauggcg

SEQ ID NO: 2838142 - RNA, 16 nt, Mycobacterium avium subsp. paratuberculosis
cuccggcaggccgcgg

SEQ ID NO: 2838143 - RNA, 14 nt, Mycobacterium avium subsp. paratuberculosis
cuccggccccgagc

SEQ ID NO: 2838144 - RNA, 15 nt, Mycobacterium avium subsp. paratuberculosis
cuccggccccgagcc

SEQ ID NO: 2838145 - RNA, 18 nt, Mycobacterium avium subsp. paratuberculosis
cuccggcccgagcaccac

SEQ ID NO: 2838146 - RNA, 19 nt, Mycobacterium avium subsp. paratuberculosis
cuccggcccgagcaccacc

SEQ ID NO: 2838147 - RNA, 16 nt, Mycobacterium avium subsp. paratuberculosis
cuccggcccgcucggc

SEQ ID NO: 2838148 - RNA, 17 nt, Mycobacterium avium subsp. paratuberculosis
cuccggcccgcucggcg

SEQ ID NO: 2838149 - RNA, 15 nt, Mycobacterium avium subsp. paratuberculosis
cuccggccgcgccgg

SEQ ID NO: 2838150 - RNA, 18 nt, Mycobacterium avium subsp. paratuberculosis
cuccggccgcgccggccu

SEQ ID NO: 2838151 - RNA, 13 nt, Mycobacterium avium subsp. paratuberculosis
cuccggcgacacg

SEQ ID NO: 2838152 - RNA, 19 nt, Mycobacterium avium subsp. paratuberculosis
cuccggcgacacguccagc

SEQ ID NO: 2838153 - RNA, 13 nt, Mycobacterium avium subsp. paratuberculosis
cuccggcgccggu

SEQ ID NO: 2838154 - RNA, 18 nt, Mycobacterium avium subsp. paratuberculosis
cuccggcgcgguugcccg

SEQ ID NO: 2838155 - RNA, 21 nt, Mycobacterium avium subsp. paratuberculosis
cuccggcgcgguugcccgcac

SEQ ID NO: 2838156 - RNA, 20 nt, Mycobacterium avium subsp. paratuberculosis
cuccggcggacccagcuccu

SEQ ID NO: 2838157 - RNA, 21 nt, Mycobacterium avium subsp. paratuberculosis
cuccggcggacccagcuccuc

SEQ ID NO: 2838158 - RNA, 17 nt, Mycobacterium avium subsp. paratuberculosis
cuccggcgggcuggugc

SEQ ID NO: 2838159 - RNA, 21 nt, Mycobacterium avium subsp. paratuberculosis
cuccggcgggcuggugcgcag

SEQ ID NO: 2838160 - RNA, 15 nt, Mycobacterium avium subsp. paratuberculosis
cuccggcguaucucc

SEQ ID NO: 2838161 - RNA, 19 nt, Mycobacterium avium subsp. paratuberculosis
cuccgggaacgcggcgaag

SEQ ID NO: 2838162 - RNA, 14 nt, Mycobacterium avium subsp. paratuberculosis
cuccgggcugaccu

SEQ ID NO: 2838163 - RNA, 12 nt, Mycobacterium avium subsp. paratuberculosis
cuccgggcugcc

SEQ ID NO: 2838164 - RNA, 13 nt, Mycobacterium avium subsp. paratuberculosis
cuccgggcugugg

SEQ ID NO: 2838165 - RNA, 20 nt, Mycobacterium avium subsp. paratuberculosis
cuccgggcugugggcgcagg

SEQ ID NO: 2838166 - RNA, 18 nt, Mycobacterium avium subsp. paratuberculosis
cuccgggggcaccgccag

SEQ ID NO: 2838167 - RNA, 18 nt, Mycobacterium avium subsp. paratuberculosis
cuccggguaggacaccgu

SEQ ID NO: 2838168 - RNA, 23 nt, Mycobacterium avium subsp. paratuberculosis
cuccggguccccgccgccgugca

SEQ ID NO: 2838169 - RNA, 18 nt, Mycobacterium avium subsp. paratuberculosis
cuccgggucgaccgccuc

SEQ ID NO: 2838170 - RNA, 20 nt, Mycobacterium avium subsp. paratuberculosis
cuccgguaccacgccgucga

SEQ ID NO: 2838171 - RNA, 16 nt, Mycobacterium avium subsp. paratuberculosis
cuccgguccgggcugc

SEQ ID NO: 2838172 - RNA, 20 nt, Mycobacterium avium subsp. paratuberculosis
cuccggucgcgucgugcggc

SEQ ID NO: 2838173 - RNA, 23 nt, Mycobacterium avium subsp. paratuberculosis
cuccggugauucgugcagugcga

SEQ ID NO: 2838174 - RNA, 18 nt, Mycobacterium avium subsp. paratuberculosis
cuccgguuugcgccggcu

SEQ ID NO: 2838175 - RNA, 13 nt, Mycobacterium avium subsp. paratuberculosis
cuccgucagcgcc

SEQ ID NO: 2838176 - RNA, 16 nt, Mycobacterium avium subsp. paratuberculosis
cuccgucagcgccgcc

SEQ ID NO: 2838177 - RNA, 17 nt, Mycobacterium avium subsp. paratuberculosis
cuccguccaccggcacg

SEQ ID NO: 2838178 - RNA, 19 nt, Mycobacterium avium subsp. paratuberculosis
cuccguccaccggcacggc

SEQ ID NO: 2838179 - RNA, 14 nt, Mycobacterium avium subsp. paratuberculosis
cuccgucgcgauca

SEQ ID NO: 2838180 - RNA, 13 nt, Mycobacterium avium subsp. paratuberculosis
cuccgucggcgcu

SEQ ID NO: 2838181 - RNA, 17 nt, Mycobacterium avium subsp. paratuberculosis
cuccgugcuggccgggu

SEQ ID NO: 2838182 - RNA, 19 nt, Mycobacterium avium subsp. paratuberculosis
cuccgugcuggccggguug

SEQ ID NO: 2838183 - RNA, 21 nt, Mycobacterium avium subsp. paratuberculosis
cuccguggacggcgagcggcc

SEQ ID NO: 2838184 - RNA, 21 nt, Mycobacterium avium subsp. paratuberculosis
cuccguugucgaggucgguga

SEQ ID NO: 2838185 - RNA, 18 nt, Mycobacterium avium subsp. paratuberculosis
cuccuaugucggugcggc

SEQ ID NO: 2838186 - RNA, 22 nt, Mycobacterium avium subsp. paratuberculosis
cuccucauaggcguacaccagg

SEQ ID NO: 2838187 - RNA, 23 nt, Mycobacterium avium subsp. paratuberculosis
cuccucauaggcguacaccaggg

SEQ ID NO: 2838188 - RNA, 19 nt, Mycobacterium avium subsp. paratuberculosis
cuccucccagcccucgucg

SEQ ID NO: 2838189 - RNA, 20 nt, Mycobacterium avium subsp. paratuberculosis
cuccucccagcccucgucga

SEQ ID NO: 2838190 - RNA, 15 nt, Mycobacterium avium subsp. paratuberculosis
cuccuccucgcgccg

SEQ ID NO: 2838191 - RNA, 19 nt, Mycobacterium avium subsp. paratuberculosis
cuccuccucgcgccgccac

SEQ ID NO: 2838192 - RNA, 20 nt, Mycobacterium avium subsp. paratuberculosis
cuccuccucgcgccgccacg

SEQ ID NO: 2838193 - RNA, 14 nt, Mycobacterium avium subsp. paratuberculosis
cuccuccucgucgc

SEQ ID NO: 2838194 - RNA, 17 nt, Mycobacterium avium subsp. paratuberculosis
cuccuccugcggugggc

SEQ ID NO: 2838195 - RNA, 16 nt, Mycobacterium avium subsp. paratuberculosis
cuccucgaacaccgca

SEQ ID NO: 2838196 - RNA, 16 nt, Mycobacterium avium subsp. paratuberculosis
cuccucgaaccucgcg

SEQ ID NO: 2838197 - RNA, 23 nt, Mycobacterium avium subsp. paratuberculosis
cuccucgaccagcgcgccgccca

SEQ ID NO: 2838198 - RNA, 21 nt, Mycobacterium avium subsp. paratuberculosis
cuccucgaucguccgaggccc

SEQ ID NO: 2838199 - RNA, 16 nt, Mycobacterium avium subsp. paratuberculosis
cuccucgcgccgccac

SEQ ID NO: 2838200 - RNA, 14 nt, Mycobacterium avium subsp. paratuberculosis
cuccucgcgcggca

SEQ ID NO: 2838201 - RNA, 19 nt, Mycobacterium avium subsp. paratuberculosis
cuccucgcgcggcaccacc

SEQ ID NO: 2838202 - RNA, 20 nt, Mycobacterium avium subsp. paratuberculosis
cuccucgcggaacugcuccc

SEQ ID NO: 2838203 - RNA, 13 nt, Mycobacterium avium subsp. paratuberculosis
cuccucgcugccg

SEQ ID NO: 2838204 - RNA, 15 nt, Mycobacterium avium subsp. paratuberculosis
cuccucgcugccggc

SEQ ID NO: 2838205 - RNA, 13 nt, Mycobacterium avium subsp. paratuberculosis
cuccucggacccg

SEQ ID NO: 2838206 - RNA, 13 nt, Mycobacterium avium subsp. paratuberculosis
cuccucggccagc

SEQ ID NO: 2838207 - RNA, 20 nt, Mycobacterium avium subsp. paratuberculosis
cuccucggccagcaccagca

SEQ ID NO: 2838208 - RNA, 24 nt, Mycobacterium avium subsp. paratuberculosis
cuccucggccagcaccagcagccg

SEQ ID NO: 2838209 - RNA, 21 nt, Mycobacterium avium subsp. paratuberculosis
cuccucggccagccccaccac

SEQ ID NO: 2838210 - RNA, 13 nt, Mycobacterium avium subsp. paratuberculosis
cuccucggcggcc

SEQ ID NO: 2838211 - RNA, 23 nt, Mycobacterium avium subsp. paratuberculosis
cuccucggcguagaggugcagcg

SEQ ID NO: 2838212 - RNA, 14 nt, Mycobacterium avium subsp. paratuberculosis
cuccucggucagcu

SEQ ID NO: 2838213 - RNA, 19 nt, Mycobacterium avium subsp. paratuberculosis
cuccucgguguacagcgcc

SEQ ID NO: 2838214 - RNA, 20 nt, Mycobacterium avium subsp. paratuberculosis
cuccucgguguacagcgcca

SEQ ID NO: 2838215 - RNA, 18 nt, Mycobacterium avium subsp. paratuberculosis
cuccucuucgcugccgcc

SEQ ID NO: 2838216 - RNA, 22 nt, Mycobacterium avium subsp. paratuberculosis
cuccucuucgcugccgccgccg

SEQ ID NO: 2838217 - RNA, 14 nt, Mycobacterium avium subsp. paratuberculosis
cuccugcaaggccc

SEQ ID NO: 2838218 - RNA, 17 nt, Mycobacterium avium subsp. paratuberculosis
cuccugcacccguccga

SEQ ID NO: 2838219 - RNA, 13 nt, Mycobacterium avium subsp. paratuberculosis
cuccugcacgcgc

SEQ ID NO: 2838220 - RNA, 23 nt, Mycobacterium avium subsp. paratuberculosis
cuccugcacgcgcgggucgucgg

SEQ ID NO: 2838221 - RNA, 14 nt, Mycobacterium avium subsp. paratuberculosis
cuccugcagcgcgg

SEQ ID NO: 2838222 - RNA, 17 nt, Mycobacterium avium subsp. paratuberculosis
cuccugccguucggcca

SEQ ID NO: 2838223 - RNA, 21 nt, Mycobacterium avium subsp. paratuberculosis
cuccugccguucggccagcgc

SEQ ID NO: 2838224 - RNA, 23 nt, Mycobacterium avium subsp. paratuberculosis
cuccugccguucggccagcgccg

SEQ ID NO: 2838225 - RNA, 14 nt, Mycobacterium avium subsp. paratuberculosis
cuccugcgccggca

SEQ ID NO: 2838226 - RNA, 19 nt, Mycobacterium avium subsp. paratuberculosis
cucgaccgugaggcccggc

SEQ ID NO: 2838227 - RNA, 23 nt, Mycobacterium avium subsp. paratuberculosis
cucgaccgugaggcccggcgugg

SEQ ID NO: 2838228 - RNA, 15 nt, Mycobacterium avium subsp. paratuberculosis
cucgaccucaccccg

SEQ ID NO: 2838229 - RNA, 16 nt, Mycobacterium avium subsp. paratuberculosis
cucgaccucaccccgc

SEQ ID NO: 2838230 - RNA, 16 nt, Mycobacterium avium subsp. paratuberculosis
cucgaccucggcgacc

SEQ ID NO: 2838231 - RNA, 23 nt, Mycobacterium avium subsp. paratuberculosis
cucgaccucggcgaccagcgacg

SEQ ID NO: 2838232 - RNA, 17 nt, Mycobacterium avium subsp. paratuberculosis
cucgaccucggcggcca

SEQ ID NO: 2838233 - RNA, 18 nt, Mycobacterium avium subsp. paratuberculosis
cucgaccucggcggccag

SEQ ID NO: 2838234 - RNA, 22 nt, Mycobacterium avium subsp. paratuberculosis
cucgaccucggcggccagcgcg

SEQ ID NO: 2838235 - RNA, 20 nt, Mycobacterium avium subsp. paratuberculosis
cucgaccucuucggcgccgg

SEQ ID NO: 2838236 - RNA, 14 nt, Mycobacterium avium subsp. paratuberculosis
cucgaccuggguca

SEQ ID NO: 2838237 - RNA, 19 nt, Mycobacterium avium subsp. paratuberculosis
cucgaccuucgagccgccg

SEQ ID NO: 2838238 - RNA, 21 nt, Mycobacterium avium subsp. paratuberculosis
cucgaccuucgagccgccgcc

SEQ ID NO: 2838239 - RNA, 20 nt, Mycobacterium avium subsp. paratuberculosis
cucgacgaacuccgcgcgcg

SEQ ID NO: 2838240 - RNA, 22 nt, Mycobacterium avium subsp. paratuberculosis
cucgacgaacuccgcgcgcggc

SEQ ID NO: 2838241 - RNA, 14 nt, Mycobacterium avium subsp. paratuberculosis
cucgacgaggcggg

SEQ ID NO: 2838242 - RNA, 15 nt, Mycobacterium avium subsp. paratuberculosis
cucgacgaggcgggc

SEQ ID NO: 2838243 - RNA, 21 nt, Mycobacterium avium subsp. paratuberculosis
cucgacgaguuccucgugcgu

SEQ ID NO: 2838244 - RNA, 23 nt, Mycobacterium avium subsp. paratuberculosis
cucgacgaguuccucgugcgugc

SEQ ID NO: 2838245 - RNA, 15 nt, Mycobacterium avium subsp. paratuberculosis
cucgacgaucagcac

SEQ ID NO: 2838246 - RNA, 19 nt, Mycobacterium avium subsp. paratuberculosis
cucgacgaucagcacgucg

SEQ ID NO: 2838247 - RNA, 16 nt, Mycobacterium avium subsp. paratuberculosis
cucgacgaugucgacg

SEQ ID NO: 2838248 - RNA, 17 nt, Mycobacterium avium subsp. paratuberculosis
cucgacgaugucgacgc

SEQ ID NO: 2838249 - RNA, 23 nt, Mycobacterium avium subsp. paratuberculosis
cucgacgauugucggggccgcac

SEQ ID NO: 2838250 - RNA, 18 nt, Mycobacterium avium subsp. paratuberculosis
cucgacgccgggcagcgc

SEQ ID NO: 2838251 - RNA, 19 nt, Mycobacterium avium subsp. paratuberculosis
cucgacgccgggcagcgcg

SEQ ID NO: 2838252 - RNA, 20 nt, Mycobacterium avium subsp. paratuberculosis
cucgacgccgggcagcgcgc

SEQ ID NO: 2838253 - RNA, 16 nt, Mycobacterium avium subsp. paratuberculosis
cucgacgcgcacccgg

SEQ ID NO: 2838254 - RNA, 17 nt, Mycobacterium avium subsp. paratuberculosis
cucgacggcacccggcc

SEQ ID NO: 2838255 - RNA, 13 nt, Mycobacterium avium subsp. paratuberculosis
cucgacggccggc

SEQ ID NO: 2838256 - RNA, 15 nt, Mycobacterium avium subsp. paratuberculosis
cucgacggccggcgu

SEQ ID NO: 2838257 - RNA, 17 nt, Mycobacterium avium subsp. paratuberculosis
cucgacggccggcguca

SEQ ID NO: 2838258 - RNA, 14 nt, Mycobacterium avium subsp. paratuberculosis
cucgacggccugca

SEQ ID NO: 2838259 - RNA, 11 nt, Mycobacterium avium subsp. paratuberculosis
cucgacggcga

SEQ ID NO: 2838260 - RNA, 13 nt, Mycobacterium avium subsp. paratuberculosis
cucgacggcgaag

SEQ ID NO: 2838261 - RNA, 22 nt, Mycobacterium avium subsp. paratuberculosis
cucgacggcgaagccggcguca

SEQ ID NO: 2838262 - RNA, 14 nt, Mycobacterium avium subsp. paratuberculosis
cucgacggcgccga

SEQ ID NO: 2838263 - RNA, 17 nt, Mycobacterium avium subsp. paratuberculosis
cucgacggcgccgacga

SEQ ID NO: 2838264 - RNA, 22 nt, Mycobacterium avium subsp. paratuberculosis
cucgacggcguggucggcgaag

SEQ ID NO: 2838265 - RNA, 19 nt, Mycobacterium avium subsp. paratuberculosis
cucgacggugaccggcucg

SEQ ID NO: 2838266 - RNA, 14 nt, Mycobacterium avium subsp. paratuberculosis
cucgacggugaccu

SEQ ID NO: 2838267 - RNA, 21 nt, Mycobacterium avium subsp. paratuberculosis
cucgacgguggagcggcccag

SEQ ID NO: 2838268 - RNA, 20 nt, Mycobacterium avium subsp. paratuberculosis
cucgacgguggccucggcgc

SEQ ID NO: 2838269 - RNA, 22 nt, Mycobacterium avium subsp. paratuberculosis
cucgacgguggccucggcgcug

SEQ ID NO: 2838270 - RNA, 16 nt, Mycobacterium avium subsp. paratuberculosis
cucgacguacaucagc

SEQ ID NO: 2838271 - RNA, 20 nt, Mycobacterium avium subsp. paratuberculosis
cucgacguacaucagcucgu

SEQ ID NO: 2838272 - RNA, 14 nt, Mycobacterium avium subsp. paratuberculosis
cucgacguaggcca

SEQ ID NO: 2838273 - RNA, 19 nt, Mycobacterium avium subsp. paratuberculosis
cucgacguaguccggccag

SEQ ID NO: 2838274 - RNA, 14 nt, Mycobacterium avium subsp. paratuberculosis
cucgacguagucgc

SEQ ID NO: 2838275 - RNA, 16 nt, Mycobacterium avium subsp. paratuberculosis
cucgacguccaggccg

SEQ ID NO: 2838276 - RNA, 18 nt, Mycobacterium avium subsp. paratuberculosis
cucgacguccaggccggc

SEQ ID NO: 2838277 - RNA, 21 nt, Mycobacterium avium subsp. paratuberculosis
cucgacguccaggccggcgcc

SEQ ID NO: 2838278 - RNA, 22 nt, Mycobacterium avium subsp. paratuberculosis
cucgacguccaggccggcgccg

SEQ ID NO: 2838279 - RNA, 13 nt, Mycobacterium avium subsp. paratuberculosis
cucgacguucggc

SEQ ID NO: 2838280 - RNA, 16 nt, Mycobacterium avium subsp. paratuberculosis
cucgacguucggcggg

SEQ ID NO: 2838281 - RNA, 18 nt, Mycobacterium avium subsp. paratuberculosis
cucgacguucggcgggca

SEQ ID NO: 2838282 - RNA, 20 nt, Mycobacterium avium subsp. paratuberculosis
cucgagagucgcuggcgcgc

SEQ ID NO: 2838283 - RNA, 17 nt, Mycobacterium avium subsp. paratuberculosis
cucgagauucugcagcc

SEQ ID NO: 2838284 - RNA, 17 nt, Mycobacterium avium subsp. paratuberculosis
cucgagcaacaccaccu

SEQ ID NO: 2838285 - RNA, 19 nt, Mycobacterium avium subsp. paratuberculosis
cucgagcaaccgcaccuug

SEQ ID NO: 2838286 - RNA, 18 nt, Mycobacterium avium subsp. paratuberculosis
cucgagcaacggccgcag

SEQ ID NO: 2838287 - RNA, 20 nt, Mycobacterium avium subsp. paratuberculosis
cucgagcaacggccgcagcg

SEQ ID NO: 2838288 - RNA, 12 nt, Mycobacterium avium subsp. paratuberculosis
cucgagcaccac

SEQ ID NO: 2838289 - RNA, 16 nt, Mycobacterium avium subsp. paratuberculosis
cucgagcaccacggcc

SEQ ID NO: 2838290 - RNA, 20 nt, Mycobacterium avium subsp. paratuberculosis
cucgagcaccacggcccgcg

SEQ ID NO: 2838291 - RNA, 22 nt, Mycobacterium avium subsp. paratuberculosis
cucgagcaccacggcccgcgcc

SEQ ID NO: 2838292 - RNA, 18 nt, Mycobacterium avium subsp. paratuberculosis
cucgagcaccggcggcag

SEQ ID NO: 2838293 - RNA, 20 nt, Mycobacterium avium subsp. paratuberculosis
cucgagcacgcccugcggcu

SEQ ID NO: 2838294 - RNA, 15 nt, Mycobacterium avium subsp. paratuberculosis
cucgagcagcgcgcg

SEQ ID NO: 2838295 - RNA, 22 nt, Mycobacterium avium subsp. paratuberculosis
cucgagcagugcaucgcugccg

SEQ ID NO: 2838296 - RNA, 14 nt, Mycobacterium avium subsp. paratuberculosis
cucgagcaucacga

SEQ ID NO: 2838297 - RNA, 15 nt, Mycobacterium avium subsp. paratuberculosis
cucgagcaucacgaa

SEQ ID NO: 2838298 - RNA, 19 nt, Mycobacterium avium subsp. paratuberculosis
cucgagcauccggugccga

SEQ ID NO: 2838299 - RNA, 22 nt, Mycobacterium avium subsp. paratuberculosis
cucgagcaucuccagccggcga

SEQ ID NO: 2838300 - RNA, 17 nt, Mycobacterium avium subsp. paratuberculosis
cucgagcaucucgaacc

SEQ ID NO: 2838301 - RNA, 21 nt, Mycobacterium avium subsp. paratuberculosis
cucgagccauaaaccggccgg

SEQ ID NO: 2838302 - RNA, 23 nt, Mycobacterium avium subsp. paratuberculosis
cucgagccauaaaccggccggcg

SEQ ID NO: 2838303 - RNA, 16 nt, Mycobacterium avium subsp. paratuberculosis
cucgagccccaguucg

SEQ ID NO: 2838304 - RNA, 15 nt, Mycobacterium avium subsp. paratuberculosis
cucgagccggcgcac

SEQ ID NO: 2838305 - RNA, 16 nt, Mycobacterium avium subsp. paratuberculosis
cucgagccggcgcacu

SEQ ID NO: 2838306 - RNA, 15 nt, Mycobacterium avium subsp. paratuberculosis
cucgagcgcgucgac

SEQ ID NO: 2838307 - RNA, 19 nt, Mycobacterium avium subsp. paratuberculosis
cucgagcgcgucgaccagc

SEQ ID NO: 2838308 - RNA, 18 nt, Mycobacterium avium subsp. paratuberculosis
cucgagcgugcccgcgcc

SEQ ID NO: 2838309 - RNA, 23 nt, Mycobacterium avium subsp. paratuberculosis
cucgagcgugcccgcgcccaccu

SEQ ID NO: 2838310 - RNA, 19 nt, Mycobacterium avium subsp. paratuberculosis
cucgauggccagcgcgucg

SEQ ID NO: 2838311 - RNA, 15 nt, Mycobacterium avium subsp. paratuberculosis
cucgauggcccgcuc

SEQ ID NO: 2838312 - RNA, 17 nt, Mycobacterium avium subsp. paratuberculosis
cucgauggcccgcucgg

SEQ ID NO: 2838313 - RNA, 14 nt, Mycobacterium avium subsp. paratuberculosis
cucgauggccucgu

SEQ ID NO: 2838314 - RNA, 13 nt, Mycobacterium avium subsp. paratuberculosis
cucgauggcgacg

SEQ ID NO: 2838315 - RNA, 17 nt, Mycobacterium avium subsp. paratuberculosis
cucgauggcgacgcacg

SEQ ID NO: 2838316 - RNA, 12 nt, Mycobacterium avium subsp. paratuberculosis
cucgauggcggc

SEQ ID NO: 2838317 - RNA, 13 nt, Mycobacterium avium subsp. paratuberculosis
cucgauggcggcg

SEQ ID NO: 2838318 - RNA, 14 nt, Mycobacterium avium subsp. paratuberculosis
cucgauggcggcga

SEQ ID NO: 2838319 - RNA, 21 nt, Mycobacterium avium subsp. paratuberculosis
cucgauggcggcgaugaagcc

SEQ ID NO: 2838320 - RNA, 14 nt, Mycobacterium avium subsp. paratuberculosis
cucgauggcggcgg

SEQ ID NO: 2838321 - RNA, 16 nt, Mycobacterium avium subsp. paratuberculosis
cucgauggcggcggcu

SEQ ID NO: 2838322 - RNA, 18 nt, Mycobacterium avium subsp. paratuberculosis
cucgaugggggugccgca

SEQ ID NO: 2838323 - RNA, 19 nt, Mycobacterium avium subsp. paratuberculosis
cucgaugggggugccgcag

SEQ ID NO: 2838324 - RNA, 20 nt, Mycobacterium avium subsp. paratuberculosis
cucgaugggggugccgcagc

SEQ ID NO: 2838325 - RNA, 20 nt, Mycobacterium avium subsp. paratuberculosis
cucgauggguguggcgucga

SEQ ID NO: 2838326 - RNA, 12 nt, Mycobacterium avium subsp. paratuberculosis
cucgauggucgc

SEQ ID NO: 2838327 - RNA, 15 nt, Mycobacterium avium subsp. paratuberculosis
cucgauggucgccuu

SEQ ID NO: 2838328 - RNA, 15 nt, Mycobacterium avium subsp. paratuberculosis
cucgauggucgucgg

SEQ ID NO: 2838329 - RNA, 17 nt, Mycobacterium avium subsp. paratuberculosis
cucgaugucgguggugg

SEQ ID NO: 2838330 - RNA, 13 nt, Mycobacterium avium subsp. paratuberculosis
cucgaugucgucg

SEQ ID NO: 2838331 - RNA, 14 nt, Mycobacterium avium subsp. paratuberculosis
cucgaugucgucga

SEQ ID NO: 2838332 - RNA, 22 nt, Mycobacterium avium subsp. paratuberculosis
cucgcaaacgaaucgagccgcc

SEQ ID NO: 2838333 - RNA, 18 nt, Mycobacterium avium subsp. paratuberculosis
cucgcaaccgucuuggcu

SEQ ID NO: 2838334 - RNA, 16 nt, Mycobacterium avium subsp. paratuberculosis
cucgcacagcaccagu

SEQ ID NO: 2838335 - RNA, 17 nt, Mycobacterium avium subsp. paratuberculosis
cucgcacagcaccaguu

SEQ ID NO: 2838336 - RNA, 14 nt, Mycobacterium avium subsp. paratuberculosis
cucgcacagccggc

SEQ ID NO: 2838337 - RNA, 18 nt, Mycobacterium avium subsp. paratuberculosis
cucgcacagccggcgcgc

SEQ ID NO: 2838338 - RNA, 13 nt, Mycobacterium avium subsp. paratuberculosis
cucgcaccugccg

SEQ ID NO: 2838339 - RNA, 14 nt, Mycobacterium avium subsp. paratuberculosis
cucgcaccugccgu

SEQ ID NO: 2838340 - RNA, 19 nt, Mycobacterium avium subsp. paratuberculosis
cucgcaccugccgucgacg

SEQ ID NO: 2838341 - RNA, 23 nt, Mycobacterium avium subsp. paratuberculosis
cucgcaccugccgucgacgacca

SEQ ID NO: 2838342 - RNA, 23 nt, Mycobacterium avium subsp. paratuberculosis
cucgcagauggucgggacgucgg

SEQ ID NO: 2838343 - RNA, 12 nt, Mycobacterium avium subsp. paratuberculosis
cucgcagcgaca

SEQ ID NO: 2838344 - RNA, 14 nt, Mycobacterium avium subsp. paratuberculosis
cucgcagcgacaau

SEQ ID NO: 2838345 - RNA, 17 nt, Mycobacterium avium subsp. paratuberculosis
cucgcaggcgagccgac

SEQ ID NO: 2838346 - RNA, 14 nt, Mycobacterium avium subsp. paratuberculosis
cucgcagucgauca

SEQ ID NO: 2838347 - RNA, 21 nt, Mycobacterium avium subsp. paratuberculosis
cucgcagucgaucagcgacgg

SEQ ID NO: 2838348 - RNA, 12 nt, Mycobacterium avium subsp. paratuberculosis
cucgccaccucg

SEQ ID NO: 2838349 - RNA, 21 nt, Mycobacterium avium subsp. paratuberculosis
cucgccacugggcgucggcgc

SEQ ID NO: 2838350 - RNA, 14 nt, Mycobacterium avium subsp. paratuberculosis
cucgccagaccggu

SEQ ID NO: 2838351 - RNA, 15 nt, Mycobacterium avium subsp. paratuberculosis
cucgccagaccgguu

SEQ ID NO: 2838352 - RNA, 23 nt, Mycobacterium avium subsp. paratuberculosis
cucgccagaccgguugcggcgaa

SEQ ID NO: 2838353 - RNA, 20 nt, Mycobacterium avium subsp. paratuberculosis
cucgccagacucacggcggc

SEQ ID NO: 2838354 - RNA, 22 nt, Mycobacterium avium subsp. paratuberculosis
cucgccagacucacggcggcag

SEQ ID NO: 2838355 - RNA, 23 nt, Mycobacterium avium subsp. paratuberculosis
cucgccagacucacggcggcagc

SEQ ID NO: 2838356 - RNA, 15 nt, Mycobacterium avium subsp. paratuberculosis
cucgccagccccacc

SEQ ID NO: 2838357 - RNA, 19 nt, Mycobacterium avium subsp. paratuberculosis
cucgccagccccaccggcc

SEQ ID NO: 2838358 - RNA, 20 nt, Mycobacterium avium subsp. paratuberculosis
cucgccagccguccuggucg

SEQ ID NO: 2838359 - RNA, 22 nt, Mycobacterium avium subsp. paratuberculosis
cucgccagccguccuggucguc

SEQ ID NO: 2838360 - RNA, 24 nt, Mycobacterium avium subsp. paratuberculosis
cucgccaggauguacccgcaggcc

SEQ ID NO: 2838361 - RNA, 16 nt, Mycobacterium avium subsp. paratuberculosis
cucgcccaccuuggcg

SEQ ID NO: 2838362 - RNA, 12 nt, Mycobacterium avium subsp. paratuberculosis
cucgcccagcac

SEQ ID NO: 2838363 - RNA, 15 nt, Mycobacterium avium subsp. paratuberculosis
cucgcccagcaccgu

SEQ ID NO: 2838364 - RNA, 14 nt, Mycobacterium avium subsp. paratuberculosis
cucgcccagcgccg

SEQ ID NO: 2838365 - RNA, 15 nt, Mycobacterium avium subsp. paratuberculosis
cucgcccagcgccgc

SEQ ID NO: 2838366 - RNA, 22 nt, Mycobacterium avium subsp. paratuberculosis
cucgcccagcgccgcggcgaaa

SEQ ID NO: 2838367 - RNA, 13 nt, Mycobacterium avium subsp. paratuberculosis
cucgcccagcgcg

SEQ ID NO: 2838368 - RNA, 14 nt, Mycobacterium avium subsp. paratuberculosis
cucgcccagcgcgg

SEQ ID NO: 2838369 - RNA, 22 nt, Mycobacterium avium subsp. paratuberculosis
cucgcccagggcgugcgcggcc

SEQ ID NO: 2838370 - RNA, 15 nt, Mycobacterium avium subsp. paratuberculosis
cucgccccgcccgau

SEQ ID NO: 2838371 - RNA, 15 nt, Mycobacterium avium subsp. paratuberculosis
cucgcccgccgcgac

SEQ ID NO: 2838372 - RNA, 13 nt, Mycobacterium avium subsp. paratuberculosis
cucgcccgggcua

SEQ ID NO: 2838373 - RNA, 23 nt, Mycobacterium avium subsp. paratuberculosis
cucgcccgggcuaucgcccggcg

SEQ ID NO: 2838374 - RNA, 17 nt, Mycobacterium avium subsp. paratuberculosis
cucgcccugcagccggg

SEQ ID NO: 2838375 - RNA, 14 nt, Mycobacterium avium subsp. paratuberculosis
cucgcccugcagcg

SEQ ID NO: 2838376 - RNA, 17 nt, Mycobacterium avium subsp. paratuberculosis
cucgcccugcagcgcga

SEQ ID NO: 2838377 - RNA, 20 nt, Mycobacterium avium subsp. paratuberculosis
cucgcccugcagcgcgaaca

SEQ ID NO: 2838378 - RNA, 17 nt, Mycobacterium avium subsp. paratuberculosis
cucgccgaaccggggcc

SEQ ID NO: 2838379 - RNA, 14 nt, Mycobacterium avium subsp. paratuberculosis
cucgccgaaggccg

SEQ ID NO: 2838380 - RNA, 13 nt, Mycobacterium avium subsp. paratuberculosis
cucgccgaccugu

SEQ ID NO: 2838381 - RNA, 17 nt, Mycobacterium avium subsp. paratuberculosis
cucgccgaccuuggcgu

SEQ ID NO: 2838382 - RNA, 22 nt, Mycobacterium avium subsp. paratuberculosis
cucgccgacgguguccgcgggc

SEQ ID NO: 2838383 - RNA, 19 nt, Mycobacterium avium subsp. paratuberculosis
cucgccgagcacaccgucg

SEQ ID NO: 2838384 - RNA, 11 nt, Mycobacterium avium subsp. paratuberculosis
cucgccgagcg

SEQ ID NO: 2838385 - RNA, 13 nt, Mycobacterium avium subsp. paratuberculosis
cucgccgagcggg

SEQ ID NO: 2838386 - RNA, 13 nt, Mycobacterium avium subsp. paratuberculosis
cucgccgaucggg

SEQ ID NO: 2838387 - RNA, 16 nt, Mycobacterium avium subsp. paratuberculosis
cucgccgaucgggacc

SEQ ID NO: 2838388 - RNA, 21 nt, Mycobacterium avium subsp. paratuberculosis
cucgccgaucgggaccgucac

SEQ ID NO: 2838389 - RNA, 18 nt, Mycobacterium avium subsp. paratuberculosis
cucgccgaucucgaccag

SEQ ID NO: 2838390 - RNA, 19 nt, Mycobacterium avium subsp. paratuberculosis
cucgccgaucucgaccagc

SEQ ID NO: 2838391 - RNA, 19 nt, Mycobacterium avium subsp. paratuberculosis
cucgccgaucuggcgcagc

SEQ ID NO: 2838392 - RNA, 17 nt, Mycobacterium avium subsp. paratuberculosis
cucgccgaucuuggcga

SEQ ID NO: 2838393 - RNA, 18 nt, Mycobacterium avium subsp. paratuberculosis
cucgccgaugucggccgg

SEQ ID NO: 2838394 - RNA, 18 nt, Mycobacterium avium subsp. paratuberculosis
cucgccgcaggcguccuu

SEQ ID NO: 2838395 - RNA, 23 nt, Mycobacterium avium subsp. paratuberculosis
cucgcgcaccgcgggcucgaaca

SEQ ID NO: 2838396 - RNA, 14 nt, Mycobacterium avium subsp. paratuberculosis
cucgcgcaccggcu

SEQ ID NO: 2838397 - RNA, 22 nt, Mycobacterium avium subsp. paratuberculosis
cucgcgcaccgggaccagcgcg

SEQ ID NO: 2838398 - RNA, 18 nt, Mycobacterium avium subsp. paratuberculosis
cucgcgcacuucgcgggc

SEQ ID NO: 2838399 - RNA, 23 nt, Mycobacterium avium subsp. paratuberculosis
cucgcgcacuucgcgggcggcgc

SEQ ID NO: 2838400 - RNA, 19 nt, Mycobacterium avium subsp. paratuberculosis
cucgcgcagccggccgacc

SEQ ID NO: 2838401 - RNA, 14 nt, Mycobacterium avium subsp. paratuberculosis
cucgcgcagcgcgu

SEQ ID NO: 2838402 - RNA, 16 nt, Mycobacterium avium subsp. paratuberculosis
cucgcgcagcuggccg

SEQ ID NO: 2838403 - RNA, 19 nt, Mycobacterium avium subsp. paratuberculosis
cucgcgcagcuggccgugc

SEQ ID NO: 2838404 - RNA, 14 nt, Mycobacterium avium subsp. paratuberculosis
cucgcgcaggaaca

SEQ ID NO: 2838405 - RNA, 23 nt, Mycobacterium avium subsp. paratuberculosis
cucgcgcaggaacagcgacccga

SEQ ID NO: 2838406 - RNA, 19 nt, Mycobacterium avium subsp. paratuberculosis
cucgcgcaggaacuccagc

SEQ ID NO: 2838407 - RNA, 21 nt, Mycobacterium avium subsp. paratuberculosis
cucgcgcagggccagcgccuc

SEQ ID NO: 2838408 - RNA, 19 nt, Mycobacterium avium subsp. paratuberculosis
cucgcgcaucagcggagug

SEQ ID NO: 2838409 - RNA, 12 nt, Mycobacterium avium subsp. paratuberculosis
cucgcgccacca

SEQ ID NO: 2838410 - RNA, 17 nt, Mycobacterium avium subsp. paratuberculosis
cucgcgcccggcgccgg

SEQ ID NO: 2838411 - RNA, 18 nt, Mycobacterium avium subsp. paratuberculosis
cucgcgcccggcgccggc

SEQ ID NO: 2838412 - RNA, 22 nt, Mycobacterium avium subsp. paratuberculosis
cucgcgcccggcgccggcccgc

SEQ ID NO: 2838413 - RNA, 23 nt, Mycobacterium avium subsp. paratuberculosis
cucgcgcccuaacgugcccggcc

SEQ ID NO: 2838414 - RNA, 13 nt, Mycobacterium avium subsp. paratuberculosis
cucgcgccgaccc

SEQ ID NO: 2838415 - RNA, 12 nt, Mycobacterium avium subsp. paratuberculosis
cucgcgccgcca

SEQ ID NO: 2838416 - RNA, 19 nt, Mycobacterium avium subsp. paratuberculosis
cucgcgccgccacgcggcg

SEQ ID NO: 2838417 - RNA, 22 nt, Mycobacterium avium subsp. paratuberculosis
cucgcgccgccacgcggcgcgc

SEQ ID NO: 2838418 - RNA, 23 nt, Mycobacterium avium subsp. paratuberculosis
cucgcgccgccacgcggcgcgca

SEQ ID NO: 2838419 - RNA, 11 nt, Mycobacterium avium subsp. paratuberculosis
cucgcgccgga

SEQ ID NO: 2838420 - RNA, 13 nt, Mycobacterium avium subsp. paratuberculosis
cucgcgccgggcg

SEQ ID NO: 2838421 - RNA, 15 nt, Mycobacterium avium subsp. paratuberculosis
cucgcgccgggcggc

SEQ ID NO: 2838422 - RNA, 22 nt, Mycobacterium avium subsp. paratuberculosis
cucgcgcggcaccaccagcgug

SEQ ID NO: 2838423 - RNA, 19 nt, Mycobacterium avium subsp. paratuberculosis
cucgcgcggggcggccgcc

SEQ ID NO: 2838424 - RNA, 23 nt, Mycobacterium avium subsp. paratuberculosis
cucgcgcggggcggccgccgggc

SEQ ID NO: 2838425 - RNA, 14 nt, Mycobacterium avium subsp. paratuberculosis
cucgcgcgggucga

SEQ ID NO: 2838426 - RNA, 16 nt, Mycobacterium avium subsp. paratuberculosis
cucgcgcgggucgagc

SEQ ID NO: 2838427 - RNA, 13 nt, Mycobacterium avium subsp. paratuberculosis
cucgcgcgguguu

SEQ ID NO: 2838428 - RNA, 22 nt, Mycobacterium avium subsp. paratuberculosis
cucgcgcgguguuuggccgcgc

SEQ ID NO: 2838429 - RNA, 16 nt, Mycobacterium avium subsp. paratuberculosis
cucgcgcucccggcgc

SEQ ID NO: 2838430 - RNA, 19 nt, Mycobacterium avium subsp. paratuberculosis
cucgcgcucuugggcggcc

SEQ ID NO: 2838431 - RNA, 17 nt, Mycobacterium avium subsp. paratuberculosis
cucgcgcugcaugccgg

SEQ ID NO: 2838432 - RNA, 22 nt, Mycobacterium avium subsp. paratuberculosis
cucgcgcugccgcgcgccgaca

SEQ ID NO: 2838433 - RNA, 23 nt, Mycobacterium avium subsp. paratuberculosis
cucgcgcugccgcgcgccgacag

SEQ ID NO: 2838434 - RNA, 14 nt, Mycobacterium avium subsp. paratuberculosis
cucgcgcuggcggc

SEQ ID NO: 2838435 - RNA, 16 nt, Mycobacterium avium subsp. paratuberculosis
cucgcgcuggcggcca

SEQ ID NO: 2838436 - RNA, 14 nt, Mycobacterium avium subsp. paratuberculosis
cucgcggauccgca

SEQ ID NO: 2838437 - RNA, 18 nt, Mycobacterium avium subsp. paratuberculosis
cucgcggauguccgaccg

SEQ ID NO: 2838438 - RNA, 15 nt, Mycobacterium avium subsp. paratuberculosis
cucgcggcaaggcgc

SEQ ID NO: 2838439 - RNA, 18 nt, Mycobacterium avium subsp. paratuberculosis
cucgcggcaaggcgcaga

SEQ ID NO: 2838440 - RNA, 21 nt, Mycobacterium avium subsp. paratuberculosis
cucgcggccguagccggaccg

SEQ ID NO: 2838441 - RNA, 23 nt, Mycobacterium avium subsp. paratuberculosis
cucgcggccguagccggaccgcu

SEQ ID NO: 2838442 - RNA, 22 nt, Mycobacterium avium subsp. paratuberculosis
cucgcggcgcagcucgcgcagc

SEQ ID NO: 2838443 - RNA, 13 nt, Mycobacterium avium subsp. paratuberculosis
cucgcggcggccg

SEQ ID NO: 2838444 - RNA, 12 nt, Mycobacterium avium subsp. paratuberculosis
cucgcggcggcg

SEQ ID NO: 2838445 - RNA, 13 nt, Mycobacterium avium subsp. paratuberculosis
cucgcggcggcgu

SEQ ID NO: 2838446 - RNA, 17 nt, Mycobacterium avium subsp. paratuberculosis
cucgcggcggcgucggc

SEQ ID NO: 2838447 - RNA, 14 nt, Mycobacterium avium subsp. paratuberculosis
cucgcggcggguca

SEQ ID NO: 2838448 - RNA, 14 nt, Mycobacterium avium subsp. paratuberculosis
cucgcggcggucau

SEQ ID NO: 2838449 - RNA, 17 nt, Mycobacterium avium subsp. paratuberculosis
cucgcgggacggcggcg

SEQ ID NO: 2838450 - RNA, 19 nt, Mycobacterium avium subsp. paratuberculosis
cucgcgggaguggccggcg

SEQ ID NO: 2838451 - RNA, 16 nt, Mycobacterium avium subsp. paratuberculosis
cucgcgggccacagcg

SEQ ID NO: 2838452 - RNA, 19 nt, Mycobacterium avium subsp. paratuberculosis
cucgcgggccacagcggcg

SEQ ID NO: 2838453 - RNA, 20 nt, Mycobacterium avium subsp. paratuberculosis
cucgcgggccacagcggcga

SEQ ID NO: 2838454 - RNA, 18 nt, Mycobacterium avium subsp. paratuberculosis
cucgcgggccaccgcggc

SEQ ID NO: 2838455 - RNA, 13 nt, Mycobacterium avium subsp. paratuberculosis
cucgcgggcccgc

SEQ ID NO: 2838456 - RNA, 16 nt, Mycobacterium avium subsp. paratuberculosis
cucgcgggcccgcgcc

SEQ ID NO: 2838457 - RNA, 18 nt, Mycobacterium avium subsp. paratuberculosis
cucgcgggcccgcgccgc

SEQ ID NO: 2838458 - RNA, 18 nt, Mycobacterium avium subsp. paratuberculosis
cucgcgggcccgcgcggc

SEQ ID NO: 2838459 - RNA, 13 nt, Mycobacterium avium subsp. paratuberculosis
cucgcgggccugc

SEQ ID NO: 2838460 - RNA, 13 nt, Mycobacterium avium subsp. paratuberculosis
cucgcgggcgacc

SEQ ID NO: 2838461 - RNA, 18 nt, Mycobacterium avium subsp. paratuberculosis
cucgcgggcgaccuggug

SEQ ID NO: 2838462 - RNA, 14 nt, Mycobacterium avium subsp. paratuberculosis
cucgcgggcgagca

SEQ ID NO: 2838463 - RNA, 19 nt, Mycobacterium avium subsp. paratuberculosis
cucgcgggcgagcagcgcc

SEQ ID NO: 2838464 - RNA, 20 nt, Mycobacterium avium subsp. paratuberculosis
cucgcgggcgagcagcgccc

SEQ ID NO: 2838465 - RNA, 15 nt, Mycobacterium avium subsp. paratuberculosis
cucgcgggcgaucuc

SEQ ID NO: 2838466 - RNA, 19 nt, Mycobacterium avium subsp. paratuberculosis
cucgcgggcgaucuccagc

SEQ ID NO: 2838467 - RNA, 22 nt, Mycobacterium avium subsp. paratuberculosis
cucgcgggcgaucuccagcggc

SEQ ID NO: 2838468 - RNA, 17 nt, Mycobacterium avium subsp. paratuberculosis
cucgcgggcgaugcggc

SEQ ID NO: 2838469 - RNA, 19 nt, Mycobacterium avium subsp. paratuberculosis
cucgcgggcgaugcggccc

SEQ ID NO: 2838470 - RNA, 21 nt, Mycobacterium avium subsp. paratuberculosis
cucgcgggcgaugcggcccgg

SEQ ID NO: 2838471 - RNA, 15 nt, Mycobacterium avium subsp. paratuberculosis
cucgcgggggccgcg

SEQ ID NO: 2838472 - RNA, 23 nt, Mycobacterium avium subsp. paratuberculosis
cucgcgggugcgcugcagcgaga

SEQ ID NO: 2838473 - RNA, 14 nt, Mycobacterium avium subsp. paratuberculosis
cucgcgggugcggc

SEQ ID NO: 2838474 - RNA, 18 nt, Mycobacterium avium subsp. paratuberculosis
cucgcgggugcggcgcug

SEQ ID NO: 2838475 - RNA, 23 nt, Mycobacterium avium subsp. paratuberculosis
cucgcgggugcugggcggauccg

SEQ ID NO: 2838476 - RNA, 16 nt, Mycobacterium avium subsp. paratuberculosis
cucgcgggugucgagc

SEQ ID NO: 2838477 - RNA, 18 nt, Mycobacterium avium subsp. paratuberculosis
cucgcgggugucgagcca

SEQ ID NO: 2838478 - RNA, 16 nt, Mycobacterium avium subsp. paratuberculosis
cucgcgguugcgggug

SEQ ID NO: 2838479 - RNA, 21 nt, Mycobacterium avium subsp. paratuberculosis
cucggccagcaccagcagccg

SEQ ID NO: 2838480 - RNA, 18 nt, Mycobacterium avium subsp. paratuberculosis
cucggccagccaggccgu

SEQ ID NO: 2838481 - RNA, 19 nt, Mycobacterium avium subsp. paratuberculosis
cucggccagccccaccacc

SEQ ID NO: 2838482 - RNA, 23 nt, Mycobacterium avium subsp. paratuberculosis
cucggccagccccaccaccgcca

SEQ ID NO: 2838483 - RNA, 12 nt, Mycobacterium avium subsp. paratuberculosis
cucggccagcgc

SEQ ID NO: 2838484 - RNA, 13 nt, Mycobacterium avium subsp. paratuberculosis
cucggccagcgcc

SEQ ID NO: 2838485 - RNA, 14 nt, Mycobacterium avium subsp. paratuberculosis
cucggccagcgccg

SEQ ID NO: 2838486 - RNA, 17 nt, Mycobacterium avium subsp. paratuberculosis
cucggccagcgccgcgc

SEQ ID NO: 2838487 - RNA, 18 nt, Mycobacterium avium subsp. paratuberculosis
cucggccagcgcgccgca

SEQ ID NO: 2838488 - RNA, 23 nt, Mycobacterium avium subsp. paratuberculosis
cucggccagcgcgccgcacagcc

SEQ ID NO: 2838489 - RNA, 20 nt, Mycobacterium avium subsp. paratuberculosis
cucggccagcgggcggcccc

SEQ ID NO: 2838490 - RNA, 18 nt, Mycobacterium avium subsp. paratuberculosis
cucggccagcgggugaug

SEQ ID NO: 2838491 - RNA, 19 nt, Mycobacterium avium subsp. paratuberculosis
cucggccagcgggugaugg

SEQ ID NO: 2838492 - RNA, 20 nt, Mycobacterium avium subsp. paratuberculosis
cucggccagcuggucguagc

SEQ ID NO: 2838493 - RNA, 13 nt, Mycobacterium avium subsp. paratuberculosis
cucggccaggaug

SEQ ID NO: 2838494 - RNA, 20 nt, Mycobacterium avium subsp. paratuberculosis
cucggccaggaugaaccggg

SEQ ID NO: 2838495 - RNA, 13 nt, Mycobacterium avium subsp. paratuberculosis
cucggccaggcuc

SEQ ID NO: 2838496 - RNA, 13 nt, Mycobacterium avium subsp. paratuberculosis
cucggccagggug

SEQ ID NO: 2838497 - RNA, 14 nt, Mycobacterium avium subsp. paratuberculosis
cucggccaggguga

SEQ ID NO: 2838498 - RNA, 17 nt, Mycobacterium avium subsp. paratuberculosis
cucggccagggugacgg

SEQ ID NO: 2838499 - RNA, 23 nt, Mycobacterium avium subsp. paratuberculosis
cucggccagguacugaucaccgc

SEQ ID NO: 2838500 - RNA, 13 nt, Mycobacterium avium subsp. paratuberculosis
cucggccaucccg

SEQ ID NO: 2838501 - RNA, 16 nt, Mycobacterium avium subsp. paratuberculosis
cucggcccgccacccg

SEQ ID NO: 2838502 - RNA, 17 nt, Mycobacterium avium subsp. paratuberculosis
cucggcccgccgggcgc

SEQ ID NO: 2838503 - RNA, 19 nt, Mycobacterium avium subsp. paratuberculosis
cucggcccgccgggcgcca

SEQ ID NO: 2838504 - RNA, 19 nt, Mycobacterium avium subsp. paratuberculosis
cucggcccgcugcgcggcc

SEQ ID NO: 2838505 - RNA, 23 nt, Mycobacterium avium subsp. paratuberculosis
cucggcccgcugcgcggccgaac

SEQ ID NO: 2838506 - RNA, 14 nt, Mycobacterium avium subsp. paratuberculosis
cucggccgccaccg

SEQ ID NO: 2838507 - RNA, 20 nt, Mycobacterium avium subsp. paratuberculosis
cucggccgcggucucgaccg

SEQ ID NO: 2838508 - RNA, 13 nt, Mycobacterium avium subsp. paratuberculosis
cucggccgcggug

SEQ ID NO: 2838509 - RNA, 14 nt, Mycobacterium avium subsp. paratuberculosis
cucggccgcggugc

SEQ ID NO: 2838510 - RNA, 12 nt, Mycobacterium avium subsp. paratuberculosis
cucggccggcac

SEQ ID NO: 2838511 - RNA, 15 nt, Mycobacterium avium subsp. paratuberculosis
cucggccggcaccuc

SEQ ID NO: 2838512 - RNA, 16 nt, Mycobacterium avium subsp. paratuberculosis
cucggccggcaccucg

SEQ ID NO: 2838513 - RNA, 16 nt, Mycobacterium avium subsp. paratuberculosis
cucggccggggcgacc

SEQ ID NO: 2838514 - RNA, 19 nt, Mycobacterium avium subsp. paratuberculosis
cucggccggguccuggaag

SEQ ID NO: 2838515 - RNA, 16 nt, Mycobacterium avium subsp. paratuberculosis
cucggccguaccggcg

SEQ ID NO: 2838516 - RNA, 18 nt, Mycobacterium avium subsp. paratuberculosis
cucggccguggccgucac

SEQ ID NO: 2838517 - RNA, 19 nt, Mycobacterium avium subsp. paratuberculosis
cucggccucccgguaggcg

SEQ ID NO: 2838518 - RNA, 23 nt, Mycobacterium avium subsp. paratuberculosis
cucggccucccgguaggcggcga

SEQ ID NO: 2838519 - RNA, 16 nt, Mycobacterium avium subsp. paratuberculosis
cucggccucgucgacg

SEQ ID NO: 2838520 - RNA, 19 nt, Mycobacterium avium subsp. paratuberculosis
cucggccucgucgacgucg

SEQ ID NO: 2838521 - RNA, 22 nt, Mycobacterium avium subsp. paratuberculosis
cucggccucgucgacgucgggg

SEQ ID NO: 2838522 - RNA, 23 nt, Mycobacterium avium subsp. paratuberculosis
cucggccuuacgcugcgcgaccu

SEQ ID NO: 2838523 - RNA, 16 nt, Mycobacterium avium subsp. paratuberculosis
cucggccuuggccacc

SEQ ID NO: 2838524 - RNA, 17 nt, Mycobacterium avium subsp. paratuberculosis
cucggccuuggccaccg

SEQ ID NO: 2838525 - RNA, 19 nt, Mycobacterium avium subsp. paratuberculosis
cucggccuuggccaccgcc

SEQ ID NO: 2838526 - RNA, 19 nt, Mycobacterium avium subsp. paratuberculosis
cucggcgaacagcggggug

SEQ ID NO: 2838527 - RNA, 19 nt, Mycobacterium avium subsp. paratuberculosis
cucggcgaagucaucaccg

SEQ ID NO: 2838528 - RNA, 20 nt, Mycobacterium avium subsp. paratuberculosis
cucggcgacaacagcgccga

SEQ ID NO: 2838529 - RNA, 13 nt, Mycobacterium avium subsp. paratuberculosis
cucggcgaccacg

SEQ ID NO: 2838530 - RNA, 21 nt, Mycobacterium avium subsp. paratuberculosis
cucggcgaccgcccggggcgc

SEQ ID NO: 2838531 - RNA, 13 nt, Mycobacterium avium subsp. paratuberculosis
cucggcgaccugc

SEQ ID NO: 2838532 - RNA, 14 nt, Mycobacterium avium subsp. paratuberculosis
cucggcgacgaugg

SEQ ID NO: 2838533 - RNA, 23 nt, Mycobacterium avium subsp. paratuberculosis
cucggcgacgauggccaggccca

SEQ ID NO: 2838534 - RNA, 15 nt, Mycobacterium avium subsp. paratuberculosis
cucggcgacgcugug

SEQ ID NO: 2838535 - RNA, 14 nt, Mycobacterium avium subsp. paratuberculosis
cucggcgagcaccg

SEQ ID NO: 2838536 - RNA, 22 nt, Mycobacterium avium subsp. paratuberculosis
cucggcgagcaccgugccgucg

SEQ ID NO: 2838537 - RNA, 18 nt, Mycobacterium avium subsp. paratuberculosis
cucggcgagcgaggccau

SEQ ID NO: 2838538 - RNA, 19 nt, Mycobacterium avium subsp. paratuberculosis
cucggcgagguagaccgcc

SEQ ID NO: 2838539 - RNA, 17 nt, Mycobacterium avium subsp. paratuberculosis
cucggcgaggucguucg

SEQ ID NO: 2838540 - RNA, 18 nt, Mycobacterium avium subsp. paratuberculosis
cucggcgaggucguucga

SEQ ID NO: 2838541 - RNA, 17 nt, Mycobacterium avium subsp. paratuberculosis
cucggcgaucagcugcc

SEQ ID NO: 2838542 - RNA, 19 nt, Mycobacterium avium subsp. paratuberculosis
cucggcgaucuggcgguug

SEQ ID NO: 2838543 - RNA, 13 nt, Mycobacterium avium subsp. paratuberculosis
cucggcgccgacc

SEQ ID NO: 2838544 - RNA, 14 nt, Mycobacterium avium subsp. paratuberculosis
cucggcgccgagcg

SEQ ID NO: 2838545 - RNA, 13 nt, Mycobacterium avium subsp. paratuberculosis
cucggcgccgccg

SEQ ID NO: 2838546 - RNA, 15 nt, Mycobacterium avium subsp. paratuberculosis
cucggcgccgccggu

SEQ ID NO: 2838547 - RNA, 20 nt, Mycobacterium avium subsp. paratuberculosis
cucggcgccgccggucgccc

SEQ ID NO: 2838548 - RNA, 19 nt, Mycobacterium avium subsp. paratuberculosis
cucggcgccgcggggcgag

SEQ ID NO: 2838549 - RNA, 21 nt, Mycobacterium avium subsp. paratuberculosis
cucggcgccggccgucacgcu

SEQ ID NO: 2838550 - RNA, 14 nt, Mycobacterium avium subsp. paratuberculosis
cucggcgccggugg

SEQ ID NO: 2838551 - RNA, 23 nt, Mycobacterium avium subsp. paratuberculosis
cucggcgccgguggugucgacgg

SEQ ID NO: 2838552 - RNA, 16 nt, Mycobacterium avium subsp. paratuberculosis
cucggcgccguccagc

SEQ ID NO: 2838553 - RNA, 14 nt, Mycobacterium avium subsp. paratuberculosis
cucggcgccgucgc

SEQ ID NO: 2838554 - RNA, 18 nt, Mycobacterium avium subsp. paratuberculosis
cucggcgccgucgccgga

SEQ ID NO: 2838555 - RNA, 15 nt, Mycobacterium avium subsp. paratuberculosis
cucggcgccucggcg

SEQ ID NO: 2838556 - RNA, 12 nt, Mycobacterium avium subsp. paratuberculosis
cucggcgcgucg

SEQ ID NO: 2838557 - RNA, 20 nt, Mycobacterium avium subsp. paratuberculosis
cucggcgcucgccgcgcggc

SEQ ID NO: 2838558 - RNA, 15 nt, Mycobacterium avium subsp. paratuberculosis
cucggcgcugaacug

SEQ ID NO: 2838559 - RNA, 22 nt, Mycobacterium avium subsp. paratuberculosis
cucggcgcugaacugcucgacc

SEQ ID NO: 2838560 - RNA, 16 nt, Mycobacterium avium subsp. paratuberculosis
cucggcgcugcccgcc

SEQ ID NO: 2838561 - RNA, 20 nt, Mycobacterium avium subsp. paratuberculosis
cucggcgcugcccgccgcgg

SEQ ID NO: 2838562 - RNA, 18 nt, Mycobacterium avium subsp. paratuberculosis
cucggcgcugucggcggg

SEQ ID NO: 2838563 - RNA, 21 nt, Mycobacterium avium subsp. paratuberculosis
cucggcggacaucgccucggc

SEQ ID NO: 2838564 - RNA, 20 nt, Mycobacterium avium subsp. paratuberculosis
cucgggcgcgaacagcgccg

SEQ ID NO: 2838565 - RNA, 21 nt, Mycobacterium avium subsp. paratuberculosis
cucgggcgcgaacagcgccga

SEQ ID NO: 2838566 - RNA, 12 nt, Mycobacterium avium subsp. paratuberculosis
cucgggcggccg

SEQ ID NO: 2838567 - RNA, 15 nt, Mycobacterium avium subsp. paratuberculosis
cucgggcggccgcgg

SEQ ID NO: 2838568 - RNA, 15 nt, Mycobacterium avium subsp. paratuberculosis
cucgggcucgucguu

SEQ ID NO: 2838569 - RNA, 17 nt, Mycobacterium avium subsp. paratuberculosis
cucgggcucgucguugc

SEQ ID NO: 2838570 - RNA, 15 nt, Mycobacterium avium subsp. paratuberculosis
cucggggcguggcgg

SEQ ID NO: 2838571 - RNA, 16 nt, Mycobacterium avium subsp. paratuberculosis
cucggggcucaccaca

SEQ ID NO: 2838572 - RNA, 13 nt, Mycobacterium avium subsp. paratuberculosis
cucggggcucgcg

SEQ ID NO: 2838573 - RNA, 17 nt, Mycobacterium avium subsp. paratuberculosis
cucggggcucgcggugu

SEQ ID NO: 2838574 - RNA, 13 nt, Mycobacterium avium subsp. paratuberculosis
cucggggcugcgc

SEQ ID NO: 2838575 - RNA, 14 nt, Mycobacterium avium subsp. paratuberculosis
cucgggggccgcuc

SEQ ID NO: 2838576 - RNA, 15 nt, Mycobacterium avium subsp. paratuberculosis
cucgggggugucgua

SEQ ID NO: 2838577 - RNA, 16 nt, Mycobacterium avium subsp. paratuberculosis
cucgggguagccggcc

SEQ ID NO: 2838578 - RNA, 18 nt, Mycobacterium avium subsp. paratuberculosis
cucgggguagccggcccg

SEQ ID NO: 2838579 - RNA, 19 nt, Mycobacterium avium subsp. paratuberculosis
cucgggguagccggcccgc

SEQ ID NO: 2838580 - RNA, 15 nt, Mycobacterium avium subsp. paratuberculosis
cucggggucggccga

SEQ ID NO: 2838581 - RNA, 22 nt, Mycobacterium avium subsp. paratuberculosis
cucggggucggcgucgggccgg

SEQ ID NO: 2838582 - RNA, 21 nt, Mycobacterium avium subsp. paratuberculosis
cucgggguugacccggccggu

SEQ ID NO: 2838583 - RNA, 16 nt, Mycobacterium avium subsp. paratuberculosis
cucgggugaguagucc

SEQ ID NO: 2838584 - RNA, 17 nt, Mycobacterium avium subsp. paratuberculosis
cucggguguaggcccga

SEQ ID NO: 2838585 - RNA, 18 nt, Mycobacterium avium subsp. paratuberculosis
cucggguguaggcccgau

SEQ ID NO: 2838586 - RNA, 15 nt, Mycobacterium avium subsp. paratuberculosis
cucgggugucgccga

SEQ ID NO: 2838587 - RNA, 19 nt, Mycobacterium avium subsp. paratuberculosis
cucgggugucgccgagccg

SEQ ID NO: 2838588 - RNA, 16 nt, Mycobacterium avium subsp. paratuberculosis
cucggguguggacggc

SEQ ID NO: 2838589 - RNA, 17 nt, Mycobacterium avium subsp. paratuberculosis
cucggguguggacggcg

SEQ ID NO: 2838590 - RNA, 16 nt, Mycobacterium avium subsp. paratuberculosis
cucggguuugccgacg

SEQ ID NO: 2838591 - RNA, 21 nt, Mycobacterium avium subsp. paratuberculosis
cucggguuugccgacgguguc

SEQ ID NO: 2838592 - RNA, 18 nt, Mycobacterium avium subsp. paratuberculosis
cucgguacccccgccggg

SEQ ID NO: 2838593 - RNA, 19 nt, Mycobacterium avium subsp. paratuberculosis
cucgguacccccgccgggg

SEQ ID NO: 2838594 - RNA, 22 nt, Mycobacterium avium subsp. paratuberculosis
cucgguacccccgccggggccg

SEQ ID NO: 2838595 - RNA, 17 nt, Mycobacterium avium subsp. paratuberculosis
cucgguaugcggcgacg

SEQ ID NO: 2838596 - RNA, 21 nt, Mycobacterium avium subsp. paratuberculosis
cucgguaugcggcgacgaucg

SEQ ID NO: 2838597 - RNA, 16 nt, Mycobacterium avium subsp. paratuberculosis
cucggucaaguccgcg

SEQ ID NO: 2838598 - RNA, 13 nt, Mycobacterium avium subsp. paratuberculosis
cucggucaccagc

SEQ ID NO: 2838599 - RNA, 15 nt, Mycobacterium avium subsp. paratuberculosis
cucggucaccagcgg

SEQ ID NO: 2838600 - RNA, 20 nt, Mycobacterium avium subsp. paratuberculosis
cucggucaccagcggcccgc

SEQ ID NO: 2838601 - RNA, 15 nt, Mycobacterium avium subsp. paratuberculosis
cucggucaccccgga

SEQ ID NO: 2838602 - RNA, 13 nt, Mycobacterium avium subsp. paratuberculosis
cucggucaccgag

SEQ ID NO: 2838603 - RNA, 22 nt, Mycobacterium avium subsp. paratuberculosis
cucggucacggucuggcuggug

SEQ ID NO: 2838604 - RNA, 13 nt, Mycobacterium avium subsp. paratuberculosis
cucggucagcacc

SEQ ID NO: 2838605 - RNA, 14 nt, Mycobacterium avium subsp. paratuberculosis
cucggucagcaccg

SEQ ID NO: 2838606 - RNA, 13 nt, Mycobacterium avium subsp. paratuberculosis
cucggucagccgg

SEQ ID NO: 2838607 - RNA, 16 nt, Mycobacterium avium subsp. paratuberculosis
cucggucagccgggcg

SEQ ID NO: 2838608 - RNA, 13 nt, Mycobacterium avium subsp. paratuberculosis
cucggucaggauc

SEQ ID NO: 2838609 - RNA, 19 nt, Mycobacterium avium subsp. paratuberculosis
cucggucaggaucgacucc

SEQ ID NO: 2838610 - RNA, 16 nt, Mycobacterium avium subsp. paratuberculosis
cucggucagguagccg

SEQ ID NO: 2838611 - RNA, 16 nt, Mycobacterium avium subsp. paratuberculosis
cucggucgccacggcc

SEQ ID NO: 2838612 - RNA, 20 nt, Mycobacterium avium subsp. paratuberculosis
cucggucgccacggccggca

SEQ ID NO: 2838613 - RNA, 21 nt, Mycobacterium avium subsp. paratuberculosis
cucggucgccacggccggcag

SEQ ID NO: 2838614 - RNA, 16 nt, Mycobacterium avium subsp. paratuberculosis
cucggucgccagcacc

SEQ ID NO: 2838615 - RNA, 23 nt, Mycobacterium avium subsp. paratuberculosis
cucggucgcgaagacgcuggcca

SEQ ID NO: 2838616 - RNA, 15 nt, Mycobacterium avium subsp. paratuberculosis
cucggucgcggcgau

SEQ ID NO: 2838617 - RNA, 20 nt, Mycobacterium avium subsp. paratuberculosis
cucggucgcggcgucgcggu

SEQ ID NO: 2838618 - RNA, 22 nt, Mycobacterium avium subsp. paratuberculosis
cucggucgcggcgucgcgguag

SEQ ID NO: 2838619 - RNA, 18 nt, Mycobacterium avium subsp. paratuberculosis
cucggucgcgugaccggc

SEQ ID NO: 2838620 - RNA, 22 nt, Mycobacterium avium subsp. paratuberculosis
cucggucgcgugaccggcggug

SEQ ID NO: 2838621 - RNA, 23 nt, Mycobacterium avium subsp. paratuberculosis
cucggucgcgugaccggcggugc

SEQ ID NO: 2838622 - RNA, 14 nt, Mycobacterium avium subsp. paratuberculosis
cucggucuccucca

SEQ ID NO: 2838623 - RNA, 16 nt, Mycobacterium avium subsp. paratuberculosis
cucggucucguccagu

SEQ ID NO: 2838624 - RNA, 14 nt, Mycobacterium avium subsp. paratuberculosis
cucggucugggcga

SEQ ID NO: 2838625 - RNA, 19 nt, Mycobacterium avium subsp. paratuberculosis
cucggucuugaucaggucg

SEQ ID NO: 2838626 - RNA, 13 nt, Mycobacterium avium subsp. paratuberculosis
cucggugaagccg

SEQ ID NO: 2838627 - RNA, 14 nt, Mycobacterium avium subsp. paratuberculosis
cucggugaagccgc

SEQ ID NO: 2838628 - RNA, 17 nt, Mycobacterium avium subsp. paratuberculosis
cucggugaagccgcgga

SEQ ID NO: 2838629 - RNA, 23 nt, Mycobacterium avium subsp. paratuberculosis
cucggugacgaacucaagggcgu

SEQ ID NO: 2838630 - RNA, 13 nt, Mycobacterium avium subsp. paratuberculosis
cucggugagcagc

SEQ ID NO: 2838631 - RNA, 16 nt, Mycobacterium avium subsp. paratuberculosis
cucggugagcagcucg

SEQ ID NO: 2838632 - RNA, 17 nt, Mycobacterium avium subsp. paratuberculosis
cucggugaucacccgcc

SEQ ID NO: 2838633 - RNA, 14 nt, Mycobacterium avium subsp. paratuberculosis
cucggugaucucac

SEQ ID NO: 2838634 - RNA, 15 nt, Mycobacterium avium subsp. paratuberculosis
cucggugaugaucgc

SEQ ID NO: 2838635 - RNA, 20 nt, Mycobacterium avium subsp. paratuberculosis
cucggugaugaucgccgggu

SEQ ID NO: 2838636 - RNA, 23 nt, Mycobacterium avium subsp. paratuberculosis
cucggugaugaucgccgggucgc

SEQ ID NO: 2838637 - RNA, 15 nt, Mycobacterium avium subsp. paratuberculosis
cucggugaugccgag

SEQ ID NO: 2838638 - RNA, 16 nt, Mycobacterium avium subsp. paratuberculosis
cucggugaugccggcc

SEQ ID NO: 2838639 - RNA, 17 nt, Mycobacterium avium subsp. paratuberculosis
cucggugaugccggcca

SEQ ID NO: 2838640 - RNA, 21 nt, Mycobacterium avium subsp. paratuberculosis
cucggugaugccggccagccg

SEQ ID NO: 2838641 - RNA, 13 nt, Mycobacterium avium subsp. paratuberculosis
cucggugcagacc

SEQ ID NO: 2838642 - RNA, 17 nt, Mycobacterium avium subsp. paratuberculosis
cucggugccgucgaucg

SEQ ID NO: 2838643 - RNA, 14 nt, Mycobacterium avium subsp. paratuberculosis
cucggugcgcaccc

SEQ ID NO: 2838644 - RNA, 18 nt, Mycobacterium avium subsp. paratuberculosis
cucggugcggaacaccgc

SEQ ID NO: 2838645 - RNA, 20 nt, Mycobacterium avium subsp. paratuberculosis
cucgguggacagguagcggu

SEQ ID NO: 2838646 - RNA, 15 nt, Mycobacterium avium subsp. paratuberculosis
cucgguggacgccgc

SEQ ID NO: 2838647 - RNA, 16 nt, Mycobacterium avium subsp. paratuberculosis
cucgguggacgccgcg

SEQ ID NO: 2838648 - RNA, 23 nt, Mycobacterium avium subsp. paratuberculosis
cucgguggacgccgcgcacgacg

SEQ ID NO: 2838649 - RNA, 16 nt, Mycobacterium avium subsp. paratuberculosis
cucgucggcgaacucc

SEQ ID NO: 2838650 - RNA, 13 nt, Mycobacterium avium subsp. paratuberculosis
cucgucggcgagc

SEQ ID NO: 2838651 - RNA, 16 nt, Mycobacterium avium subsp. paratuberculosis
cucgucggcgagcagc

SEQ ID NO: 2838652 - RNA, 14 nt, Mycobacterium avium subsp. paratuberculosis
cucgucggcgccgu

SEQ ID NO: 2838653 - RNA, 16 nt, Mycobacterium avium subsp. paratuberculosis
cucgucggcgccgucg

SEQ ID NO: 2838654 - RNA, 14 nt, Mycobacterium avium subsp. paratuberculosis
cucgucggcgcgcc

SEQ ID NO: 2838655 - RNA, 15 nt, Mycobacterium avium subsp. paratuberculosis
cucgucggcgcgcca

SEQ ID NO: 2838656 - RNA, 14 nt, Mycobacterium avium subsp. paratuberculosis
cucgucggcgcggg

SEQ ID NO: 2838657 - RNA, 17 nt, Mycobacterium avium subsp. paratuberculosis
cucgucggcgcgggcca

SEQ ID NO: 2838658 - RNA, 21 nt, Mycobacterium avium subsp. paratuberculosis
cucgucggcgcgggccagcag

SEQ ID NO: 2838659 - RNA, 13 nt, Mycobacterium avium subsp. paratuberculosis
cucgucggcggcg

SEQ ID NO: 2838660 - RNA, 17 nt, Mycobacterium avium subsp. paratuberculosis
cucgucggcggcgacgg

SEQ ID NO: 2838661 - RNA, 20 nt, Mycobacterium avium subsp. paratuberculosis
cucgucggcggcgacggcga

SEQ ID NO: 2838662 - RNA, 23 nt, Mycobacterium avium subsp. paratuberculosis
cucgucggcggcgacggcgacca

SEQ ID NO: 2838663 - RNA, 15 nt, Mycobacterium avium subsp. paratuberculosis
cucgucggcggcggc

SEQ ID NO: 2838664 - RNA, 16 nt, Mycobacterium avium subsp. paratuberculosis
cucgucggcggcggcc

SEQ ID NO: 2838665 - RNA, 19 nt, Mycobacterium avium subsp. paratuberculosis
cucgucggcggcggccugc

SEQ ID NO: 2838666 - RNA, 13 nt, Mycobacterium avium subsp. paratuberculosis
cucgucggcgggc

SEQ ID NO: 2838667 - RNA, 23 nt, Mycobacterium avium subsp. paratuberculosis
cucgucggcgggcaccucggcca

SEQ ID NO: 2838668 - RNA, 13 nt, Mycobacterium avium subsp. paratuberculosis
cucgucggcggug

SEQ ID NO: 2838669 - RNA, 19 nt, Mycobacterium avium subsp. paratuberculosis
cucgucgggaacgccgauc

SEQ ID NO: 2838670 - RNA, 20 nt, Mycobacterium avium subsp. paratuberculosis
cucgucgggaaugucggcgu

SEQ ID NO: 2838671 - RNA, 20 nt, Mycobacterium avium subsp. paratuberculosis
cucgucgggcgccagcccgc

SEQ ID NO: 2838672 - RNA, 20 nt, Mycobacterium avium subsp. paratuberculosis
cucgucggggaacuccugca

SEQ ID NO: 2838673 - RNA, 22 nt, Mycobacterium avium subsp. paratuberculosis
cucgucggggcagccgucgaug

SEQ ID NO: 2838674 - RNA, 16 nt, Mycobacterium avium subsp. paratuberculosis
cucgucggggcgccua

SEQ ID NO: 2838675 - RNA, 18 nt, Mycobacterium avium subsp. paratuberculosis
cucgucggggcgccuacc

SEQ ID NO: 2838676 - RNA, 24 nt, Mycobacterium avium subsp. paratuberculosis
cucgucggguguggcgccgugcag

SEQ ID NO: 2838677 - RNA, 21 nt, Mycobacterium avium subsp. paratuberculosis
cucgucggucaggaacgcgga

SEQ ID NO: 2838678 - RNA, 14 nt, Mycobacterium avium subsp. paratuberculosis
cucgucggugacgg

SEQ ID NO: 2838679 - RNA, 16 nt, Mycobacterium avium subsp. paratuberculosis
cucgucguagucgagg

SEQ ID NO: 2838680 - RNA, 17 nt, Mycobacterium avium subsp. paratuberculosis
cucgucgucgaugaaca

SEQ ID NO: 2838681 - RNA, 14 nt, Mycobacterium avium subsp. paratuberculosis
cucgucgucgguga

SEQ ID NO: 2838682 - RNA, 22 nt, Mycobacterium avium subsp. paratuberculosis
cucgucgucggugaacgccggu

SEQ ID NO: 2838683 - RNA, 21 nt, Mycobacterium avium subsp. paratuberculosis
cucgucgugggugacccggcc

SEQ ID NO: 2838684 - RNA, 17 nt, Mycobacterium avium subsp. paratuberculosis
cucgucguugcgcagcg

SEQ ID NO: 2838685 - RNA, 14 nt, Mycobacterium avium subsp. paratuberculosis
cucgucuccggcgg

SEQ ID NO: 2838686 - RNA, 15 nt, Mycobacterium avium subsp. paratuberculosis
cucgucuuccgcggc

SEQ ID NO: 2838687 - RNA, 18 nt, Mycobacterium avium subsp. paratuberculosis
cucgucuuccgcggcggc

SEQ ID NO: 2838688 - RNA, 19 nt, Mycobacterium avium subsp. paratuberculosis
cucgugcaaaccggaccgc

SEQ ID NO: 2838689 - RNA, 15 nt, Mycobacterium avium subsp. paratuberculosis
cucgugcacaugccc

SEQ ID NO: 2838690 - RNA, 20 nt, Mycobacterium avium subsp. paratuberculosis
cucgugcacaugcccgucgg

SEQ ID NO: 2838691 - RNA, 18 nt, Mycobacterium avium subsp. paratuberculosis
cucgugcagccggcggcg

SEQ ID NO: 2838692 - RNA, 13 nt, Mycobacterium avium subsp. paratuberculosis
cucgugcccgggc

SEQ ID NO: 2838693 - RNA, 15 nt, Mycobacterium avium subsp. paratuberculosis
cucgugcccgggccc

SEQ ID NO: 2838694 - RNA, 16 nt, Mycobacterium avium subsp. paratuberculosis
cucgugcggcgccgcc

SEQ ID NO: 2838695 - RNA, 19 nt, Mycobacterium avium subsp. paratuberculosis
cucgugcguagcggcccga

SEQ ID NO: 2838696 - RNA, 22 nt, Mycobacterium avium subsp. paratuberculosis
cucguggaaaucgagcgcgcug

SEQ ID NO: 2838697 - RNA, 14 nt, Mycobacterium avium subsp. paratuberculosis
cucgugggccacca

SEQ ID NO: 2838698 - RNA, 14 nt, Mycobacterium avium subsp. paratuberculosis
cucgugggucagcu

SEQ ID NO: 2838699 - RNA, 20 nt, Mycobacterium avium subsp. paratuberculosis
cucguggucccaggaccacu

SEQ ID NO: 2838700 - RNA, 23 nt, Mycobacterium avium subsp. paratuberculosis
cucgugguggacggucagcgcgc

SEQ ID NO: 2838701 - RNA, 22 nt, Mycobacterium avium subsp. paratuberculosis
cucgugguucuccgcgacaucg

SEQ ID NO: 2838702 - RNA, 15 nt, Mycobacterium avium subsp. paratuberculosis
cucguguccgaugac

SEQ ID NO: 2838703 - RNA, 16 nt, Mycobacterium avium subsp. paratuberculosis
cucguguccgaugacg

SEQ ID NO: 2838704 - RNA, 20 nt, Mycobacterium avium subsp. paratuberculosis
cucguguccgaugacgagca

SEQ ID NO: 2838705 - RNA, 23 nt, Mycobacterium avium subsp. paratuberculosis
cucguucgaauuguggcggccca

SEQ ID NO: 2838706 - RNA, 20 nt, Mycobacterium avium subsp. paratuberculosis
cucguucgaguaggcgacca

SEQ ID NO: 2838707 - RNA, 16 nt, Mycobacterium avium subsp. paratuberculosis
cucguucucggcgaac

SEQ ID NO: 2838708 - RNA, 15 nt, Mycobacterium avium subsp. paratuberculosis
cucguucugcgugcg

SEQ ID NO: 2838709 - RNA, 14 nt, Mycobacterium avium subsp. paratuberculosis
cucguucuggcccg

SEQ ID NO: 2838710 - RNA, 16 nt, Mycobacterium avium subsp. paratuberculosis
cucguucuggcccgcc

SEQ ID NO: 2838711 - RNA, 20 nt, Mycobacterium avium subsp. paratuberculosis
cucguugaccgggucgccga

SEQ ID NO: 2838712 - RNA, 16 nt, Mycobacterium avium subsp. paratuberculosis
cucguugauccagacg

SEQ ID NO: 2838713 - RNA, 20 nt, Mycobacterium avium subsp. paratuberculosis
cucguugcaguagacguugc

SEQ ID NO: 2838714 - RNA, 15 nt, Mycobacterium avium subsp. paratuberculosis
cucguugccagccgg

SEQ ID NO: 2838715 - RNA, 18 nt, Mycobacterium avium subsp. paratuberculosis
cucguugccagccggugc

SEQ ID NO: 2838716 - RNA, 17 nt, Mycobacterium avium subsp. paratuberculosis
cucguugccggcggcca

SEQ ID NO: 2838717 - RNA, 23 nt, Mycobacterium avium subsp. paratuberculosis
cucguugccggcggccagcaucg

SEQ ID NO: 2838718 - RNA, 12 nt, Mycobacterium avium subsp. paratuberculosis
cucguuggccag

SEQ ID NO: 2838719 - RNA, 16 nt, Mycobacterium avium subsp. paratuberculosis
cucguuggccagcucg

SEQ ID NO: 2838720 - RNA, 22 nt, Mycobacterium avium subsp. paratuberculosis
cucguuggccagcucggccauc

SEQ ID NO: 2838721 - RNA, 16 nt, Mycobacterium avium subsp. paratuberculosis
cucguuggggccacca

SEQ ID NO: 2838722 - RNA, 17 nt, Mycobacterium avium subsp. paratuberculosis
cucguuggggccaccag

SEQ ID NO: 2838723 - RNA, 23 nt, Mycobacterium avium subsp. paratuberculosis
cucguugugcaccggcacgucga

SEQ ID NO: 2838724 - RNA, 23 nt, Mycobacterium avium subsp. paratuberculosis
cucguugugcauguggccgucgc

SEQ ID NO: 2838725 - RNA, 20 nt, Mycobacterium avium subsp. paratuberculosis
cucuaacuccgcucgggccc

SEQ ID NO: 2838726 - RNA, 22 nt, Mycobacterium avium subsp. paratuberculosis
cucucgccggucagcacgucgg

SEQ ID NO: 2838727 - RNA, 13 nt, Mycobacterium avium subsp. paratuberculosis
cucucggcgccgu

SEQ ID NO: 2838728 - RNA, 19 nt, Mycobacterium avium subsp. paratuberculosis
cucucgggaaacgcgucgc

SEQ ID NO: 2838729 - RNA, 20 nt, Mycobacterium avium subsp. paratuberculosis
cucucgggaaacgcgucgcu

SEQ ID NO: 2838730 - RNA, 22 nt, Mycobacterium avium subsp. paratuberculosis
cucucguccucgaacaggcucu

SEQ ID NO: 2838731 - RNA, 16 nt, Mycobacterium avium subsp. paratuberculosis
cucucgucgacgaugg

SEQ ID NO: 2838732 - RNA, 17 nt, Mycobacterium avium subsp. paratuberculosis
cucucgucgucggcggg

SEQ ID NO: 2838733 - RNA, 13 nt, Mycobacterium avium subsp. paratuberculosis
cugaccaccgagg

SEQ ID NO: 2838734 - RNA, 15 nt, Mycobacterium avium subsp. paratuberculosis
cugaccacgcuccag

SEQ ID NO: 2838735 - RNA, 21 nt, Mycobacterium avium subsp. paratuberculosis
cugaccagcccgcucagagcu

SEQ ID NO: 2838736 - RNA, 12 nt, Mycobacterium avium subsp. paratuberculosis
cugaccagcgcc

SEQ ID NO: 2838737 - RNA, 14 nt, Mycobacterium avium subsp. paratuberculosis
cugaccagcgccuc

SEQ ID NO: 2838738 - RNA, 20 nt, Mycobacterium avium subsp. paratuberculosis
cugaccagcgccucgcgggu

SEQ ID NO: 2838739 - RNA, 16 nt, Mycobacterium avium subsp. paratuberculosis
cugaccagcggcgcgc

SEQ ID NO: 2838740 - RNA, 18 nt, Mycobacterium avium subsp. paratuberculosis
cugaccagcggcgcgccg

SEQ ID NO: 2838741 - RNA, 19 nt, Mycobacterium avium subsp. paratuberculosis
cugaccagcggcgcgccgg

SEQ ID NO: 2838742 - RNA, 13 nt, Mycobacterium avium subsp. paratuberculosis
cugaccagcguga

SEQ ID NO: 2838743 - RNA, 13 nt, Mycobacterium avium subsp. paratuberculosis
cugaccaggccgu

SEQ ID NO: 2838744 - RNA, 13 nt, Mycobacterium avium subsp. paratuberculosis
cugacccagcgcg

SEQ ID NO: 2838745 - RNA, 16 nt, Mycobacterium avium subsp. paratuberculosis
cugacccagcgcgggg

SEQ ID NO: 2838746 - RNA, 15 nt, Mycobacterium avium subsp. paratuberculosis
cugaccccccgacgc

SEQ ID NO: 2838747 - RNA, 18 nt, Mycobacterium avium subsp. paratuberculosis
cugaccccccgacgccga

SEQ ID NO: 2838748 - RNA, 22 nt, Mycobacterium avium subsp. paratuberculosis
cugaccccccgacgccgacggc

SEQ ID NO: 2838749 - RNA, 20 nt, Mycobacterium avium subsp. paratuberculosis
cugaccccgcucggcguggc

SEQ ID NO: 2838750 - RNA, 13 nt, Mycobacterium avium subsp. paratuberculosis
cugacccgccgca

SEQ ID NO: 2838751 - RNA, 16 nt, Mycobacterium avium subsp. paratuberculosis
cugacccgccgcaaca

SEQ ID NO: 2838752 - RNA, 17 nt, Mycobacterium avium subsp. paratuberculosis
cugacccgccgcaacag

SEQ ID NO: 2838753 - RNA, 18 nt, Mycobacterium avium subsp. paratuberculosis
cugacccgccgcaacagc

SEQ ID NO: 2838754 - RNA, 18 nt, Mycobacterium avium subsp. paratuberculosis
cugacccggucgcggccg

SEQ ID NO: 2838755 - RNA, 13 nt, Mycobacterium avium subsp. paratuberculosis
cugaccgacggcg

SEQ ID NO: 2838756 - RNA, 15 nt, Mycobacterium avium subsp. paratuberculosis
cugaccgacggcgac

SEQ ID NO: 2838757 - RNA, 17 nt, Mycobacterium avium subsp. paratuberculosis
cugaccgacggcgacca

SEQ ID NO: 2838758 - RNA, 20 nt, Mycobacterium avium subsp. paratuberculosis
cugaccgacggcgaccagua

SEQ ID NO: 2838759 - RNA, 12 nt, Mycobacterium avium subsp. paratuberculosis
cugaccgagcag

SEQ ID NO: 2838760 - RNA, 14 nt, Mycobacterium avium subsp. paratuberculosis
cugaccgagcagcg

SEQ ID NO: 2838761 - RNA, 14 nt, Mycobacterium avium subsp. paratuberculosis
cugaccgagcggcg

SEQ ID NO: 2838762 - RNA, 17 nt, Mycobacterium avium subsp. paratuberculosis
cugaccgagcggcgcug

SEQ ID NO: 2838763 - RNA, 17 nt, Mycobacterium avium subsp. paratuberculosis
cugaccgauggccgccc

SEQ ID NO: 2838764 - RNA, 22 nt, Mycobacterium avium subsp. paratuberculosis
cugaccgauggccgcccgcagg

SEQ ID NO: 2838765 - RNA, 15 nt, Mycobacterium avium subsp. paratuberculosis
cugaccgccgcgcuc

SEQ ID NO: 2838766 - RNA, 21 nt, Mycobacterium avium subsp. paratuberculosis
cugaccgccgcgcucggccau

SEQ ID NO: 2838767 - RNA, 14 nt, Mycobacterium avium subsp. paratuberculosis
cugaccgcgggccc

SEQ ID NO: 2838768 - RNA, 15 nt, Mycobacterium avium subsp. paratuberculosis
cugaccgcgggcccg

SEQ ID NO: 2838769 - RNA, 16 nt, Mycobacterium avium subsp. paratuberculosis
cugaccgcgggcccgc

SEQ ID NO: 2838770 - RNA, 19 nt, Mycobacterium avium subsp. paratuberculosis
cugaccgcgggcccgccgu

SEQ ID NO: 2838771 - RNA, 14 nt, Mycobacterium avium subsp. paratuberculosis
cugaccggccaccu

SEQ ID NO: 2838772 - RNA, 16 nt, Mycobacterium avium subsp. paratuberculosis
cugaccggccaccucg

SEQ ID NO: 2838773 - RNA, 22 nt, Mycobacterium avium subsp. paratuberculosis
cugaccggccaccucgucggcg

SEQ ID NO: 2838774 - RNA, 17 nt, Mycobacterium avium subsp. paratuberculosis
cugaccggcgaucguca

SEQ ID NO: 2838775 - RNA, 20 nt, Mycobacterium avium subsp. paratuberculosis
cugaccggcggugccggcca

SEQ ID NO: 2838776 - RNA, 21 nt, Mycobacterium avium subsp. paratuberculosis
cugaccggcggugccggccag

SEQ ID NO: 2838777 - RNA, 21 nt, Mycobacterium avium subsp. paratuberculosis
cugaccgugcuuggcggcgca

SEQ ID NO: 2838778 - RNA, 17 nt, Mycobacterium avium subsp. paratuberculosis
cugaccucgccgcccuc

SEQ ID NO: 2838779 - RNA, 18 nt, Mycobacterium avium subsp. paratuberculosis
cugaccucgccgcccucg

SEQ ID NO: 2838780 - RNA, 14 nt, Mycobacterium avium subsp. paratuberculosis
cugaccucgcgccg

SEQ ID NO: 2838781 - RNA, 16 nt, Mycobacterium avium subsp. paratuberculosis
cugaccucgcgccgcg

SEQ ID NO: 2838782 - RNA, 13 nt, Mycobacterium avium subsp. paratuberculosis
cugaccuggcuga

SEQ ID NO: 2838783 - RNA, 20 nt, Mycobacterium avium subsp. paratuberculosis
cugaccuucucccgcggcag

SEQ ID NO: 2838784 - RNA, 16 nt, Mycobacterium avium subsp. paratuberculosis
cugacgaacgcgccgc

SEQ ID NO: 2838785 - RNA, 16 nt, Mycobacterium avium subsp. paratuberculosis
cugacgaucgucgacg

SEQ ID NO: 2838786 - RNA, 17 nt, Mycobacterium avium subsp. paratuberculosis
cugacgaucgucgacgu

SEQ ID NO: 2838787 - RNA, 17 nt, Mycobacterium avium subsp. paratuberculosis
cugacgaugcggccggc

SEQ ID NO: 2838788 - RNA, 18 nt, Mycobacterium avium subsp. paratuberculosis
cugacgaugcggccggcg

SEQ ID NO: 2838789 - RNA, 21 nt, Mycobacterium avium subsp. paratuberculosis
cugacgaugcggccggcgggc

SEQ ID NO: 2838790 - RNA, 16 nt, Mycobacterium avium subsp. paratuberculosis
cugacgauggcgaccg

SEQ ID NO: 2838791 - RNA, 19 nt, Mycobacterium avium subsp. paratuberculosis
cugacgauggcgaccgcgc

SEQ ID NO: 2838792 - RNA, 15 nt, Mycobacterium avium subsp. paratuberculosis
cugacgcaccucgcu

SEQ ID NO: 2838793 - RNA, 20 nt, Mycobacterium avium subsp. paratuberculosis
cugacgcaccucgcucagcc

SEQ ID NO: 2838794 - RNA, 15 nt, Mycobacterium avium subsp. paratuberculosis
cugacgcaucaccac

SEQ ID NO: 2838795 - RNA, 19 nt, Mycobacterium avium subsp. paratuberculosis
cugacgccgagcagcucag

SEQ ID NO: 2838796 - RNA, 13 nt, Mycobacterium avium subsp. paratuberculosis
cugacgccgcggu

SEQ ID NO: 2838797 - RNA, 15 nt, Mycobacterium avium subsp. paratuberculosis
cugacgccgcggugc

SEQ ID NO: 2838798 - RNA, 16 nt, Mycobacterium avium subsp. paratuberculosis
cugacgccgcggugca

SEQ ID NO: 2838799 - RNA, 17 nt, Mycobacterium avium subsp. paratuberculosis
cugacgccgcggugcag

SEQ ID NO: 2838800 - RNA, 13 nt, Mycobacterium avium subsp. paratuberculosis
cugacgccggucg

SEQ ID NO: 2838801 - RNA, 14 nt, Mycobacterium avium subsp. paratuberculosis
cugacgcggcgggc

SEQ ID NO: 2838802 - RNA, 20 nt, Mycobacterium avium subsp. paratuberculosis
cugacggcucuucggcgccg

SEQ ID NO: 2838803 - RNA, 23 nt, Mycobacterium avium subsp. paratuberculosis
cugacggcucuucggcgccgagc

SEQ ID NO: 2838804 - RNA, 19 nt, Mycobacterium avium subsp. paratuberculosis
cugacgggaccgcacgccg

SEQ ID NO: 2838805 - RNA, 22 nt, Mycobacterium avium subsp. paratuberculosis
cugacgggagucgggcccgccc

SEQ ID NO: 2838806 - RNA, 15 nt, Mycobacterium avium subsp. paratuberculosis
cugacgggccggcgg

SEQ ID NO: 2838807 - RNA, 17 nt, Mycobacterium avium subsp. paratuberculosis
cugacgggccggcgggg

SEQ ID NO: 2838808 - RNA, 22 nt, Mycobacterium avium subsp. paratuberculosis
cugacgggccggcggggugggc

SEQ ID NO: 2838809 - RNA, 14 nt, Mycobacterium avium subsp. paratuberculosis
cugacgucgaaggu

SEQ ID NO: 2838810 - RNA, 24 nt, Mycobacterium avium subsp. paratuberculosis
cugacgucgaugccggccagcggc

SEQ ID NO: 2838811 - RNA, 19 nt, Mycobacterium avium subsp. paratuberculosis
cugacuccaucccgugcgg

SEQ ID NO: 2838812 - RNA, 21 nt, Mycobacterium avium subsp. paratuberculosis
cugacugagucaagccggcau

SEQ ID NO: 2838813 - RNA, 12 nt, Mycobacterium avium subsp. paratuberculosis
cugacugccggc

SEQ ID NO: 2838814 - RNA, 16 nt, Mycobacterium avium subsp. paratuberculosis
cugacugccggcgacg

SEQ ID NO: 2838815 - RNA, 19 nt, Mycobacterium avium subsp. paratuberculosis
cugacugcgaucgccgacg

SEQ ID NO: 2838816 - RNA, 21 nt, Mycobacterium avium subsp. paratuberculosis
cugacuucggaggucagcagg

SEQ ID NO: 2838817 - RNA, 23 nt, Mycobacterium avium subsp. paratuberculosis
cugacuuucuugcugagcugcgc

SEQ ID NO: 2838818 - RNA, 13 nt, Mycobacterium avium subsp. paratuberculosis
cugaucuucucga

SEQ ID NO: 2838819 - RNA, 14 nt, Mycobacterium avium subsp. paratuberculosis
cugaugaagccgcc

SEQ ID NO: 2838820 - RNA, 19 nt, Mycobacterium avium subsp. paratuberculosis
cugaugcccucgccgguca

SEQ ID NO: 2838821 - RNA, 12 nt, Mycobacterium avium subsp. paratuberculosis
cugaugccgccg

SEQ ID NO: 2838822 - RNA, 17 nt, Mycobacterium avium subsp. paratuberculosis
cugaugcgcaacagcau

SEQ ID NO: 2838823 - RNA, 15 nt, Mycobacterium avium subsp. paratuberculosis
cugaugcggacacca

SEQ ID NO: 2838824 - RNA, 11 nt, Mycobacterium avium subsp. paratuberculosis
cugaugcggcc

SEQ ID NO: 2838825 - RNA, 20 nt, Mycobacterium avium subsp. paratuberculosis
cugauggcggcggcccgccg

SEQ ID NO: 2838826 - RNA, 22 nt, Mycobacterium avium subsp. paratuberculosis
cugauggcggcggcccgccgcg

SEQ ID NO: 2838827 - RNA, 15 nt, Mycobacterium avium subsp. paratuberculosis
cugaugguggcgcgc

SEQ ID NO: 2838828 - RNA, 20 nt, Mycobacterium avium subsp. paratuberculosis
cugauucgcgguggcgaacu

SEQ ID NO: 2838829 - RNA, 23 nt, Mycobacterium avium subsp. paratuberculosis
cugauugcccuuggacaccugca

SEQ ID NO: 2838830 - RNA, 16 nt, Mycobacterium avium subsp. paratuberculosis
cugcaacgcgucggcg

SEQ ID NO: 2838831 - RNA, 18 nt, Mycobacterium avium subsp. paratuberculosis
cugcaacgcgucggcgcc

SEQ ID NO: 2838832 - RNA, 14 nt, Mycobacterium avium subsp. paratuberculosis
cugcaacggcuggc

SEQ ID NO: 2838833 - RNA, 15 nt, Mycobacterium avium subsp. paratuberculosis
cugcaacggcuggcg

SEQ ID NO: 2838834 - RNA, 17 nt, Mycobacterium avium subsp. paratuberculosis
cugcaacuacgcacccg

SEQ ID NO: 2838835 - RNA, 22 nt, Mycobacterium avium subsp. paratuberculosis
cugcaacuggucgugcagcacc

SEQ ID NO: 2838836 - RNA, 17 nt, Mycobacterium avium subsp. paratuberculosis
cugcaagaacccgaacg

SEQ ID NO: 2838837 - RNA, 14 nt, Mycobacterium avium subsp. paratuberculosis
cugcaaggcccccg

SEQ ID NO: 2838838 - RNA, 23 nt, Mycobacterium avium subsp. paratuberculosis
cugcaaggcccccgccucgccgg

SEQ ID NO: 2838839 - RNA, 14 nt, Mycobacterium avium subsp. paratuberculosis
cugcacacgggccc

SEQ ID NO: 2838840 - RNA, 18 nt, Mycobacterium avium subsp. paratuberculosis
cugcacagcuucggcgcc

SEQ ID NO: 2838841 - RNA, 19 nt, Mycobacterium avium subsp. paratuberculosis
cugcacagcuucggcgccg

SEQ ID NO: 2838842 - RNA, 23 nt, Mycobacterium avium subsp. paratuberculosis
cugcacagcuucggcgccgagca

SEQ ID NO: 2838843 - RNA, 18 nt, Mycobacterium avium subsp. paratuberculosis
cugcacagugcgucgccc

SEQ ID NO: 2838844 - RNA, 19 nt, Mycobacterium avium subsp. paratuberculosis
cugcacagugcgucgccca

SEQ ID NO: 2838845 - RNA, 20 nt, Mycobacterium avium subsp. paratuberculosis
cugcaccaccacacccagcg

SEQ ID NO: 2838846 - RNA, 13 nt, Mycobacterium avium subsp. paratuberculosis
cugcaccagcacg

SEQ ID NO: 2838847 - RNA, 14 nt, Mycobacterium avium subsp. paratuberculosis
cugcaccagcacga

SEQ ID NO: 2838848 - RNA, 16 nt, Mycobacterium avium subsp. paratuberculosis
cugcaccagcacgaca

SEQ ID NO: 2838849 - RNA, 13 nt, Mycobacterium avium subsp. paratuberculosis
cugcaccagcccg

SEQ ID NO: 2838850 - RNA, 16 nt, Mycobacterium avium subsp. paratuberculosis
cugcaccagcccgucg

SEQ ID NO: 2838851 - RNA, 13 nt, Mycobacterium avium subsp. paratuberculosis
cugcaccagcgcg

SEQ ID NO: 2838852 - RNA, 13 nt, Mycobacterium avium subsp. paratuberculosis
cugcaccagcggc

SEQ ID NO: 2838853 - RNA, 15 nt, Mycobacterium avium subsp. paratuberculosis
cugcaccagcggcgc

SEQ ID NO: 2838854 - RNA, 17 nt, Mycobacterium avium subsp. paratuberculosis
cugcaccagcggcgccc

SEQ ID NO: 2838855 - RNA, 19 nt, Mycobacterium avium subsp. paratuberculosis
cugcaccagcggcgcccac

SEQ ID NO: 2838856 - RNA, 12 nt, Mycobacterium avium subsp. paratuberculosis
cugcaccagcgu

SEQ ID NO: 2838857 - RNA, 16 nt, Mycobacterium avium subsp. paratuberculosis
cugcaccagcguggug

SEQ ID NO: 2838858 - RNA, 20 nt, Mycobacterium avium subsp. paratuberculosis
cugcaccagcguggugcgcc

SEQ ID NO: 2838859 - RNA, 12 nt, Mycobacterium avium subsp. paratuberculosis
cugcaccagcuc

SEQ ID NO: 2838860 - RNA, 13 nt, Mycobacterium avium subsp. paratuberculosis
cugcaccagcucg

SEQ ID NO: 2838861 - RNA, 19 nt, Mycobacterium avium subsp. paratuberculosis
cugcaccagcucggugauc

SEQ ID NO: 2838862 - RNA, 17 nt, Mycobacterium avium subsp. paratuberculosis
cugcaccagggcgucga

SEQ ID NO: 2838863 - RNA, 18 nt, Mycobacterium avium subsp. paratuberculosis
cugcacccaccggcccag

SEQ ID NO: 2838864 - RNA, 22 nt, Mycobacterium avium subsp. paratuberculosis
cugcacccaccggcccagccgg

SEQ ID NO: 2838865 - RNA, 15 nt, Mycobacterium avium subsp. paratuberculosis
cugcacccaccggcg

SEQ ID NO: 2838866 - RNA, 19 nt, Mycobacterium avium subsp. paratuberculosis
cugcacccaccggcgcagc

SEQ ID NO: 2838867 - RNA, 12 nt, Mycobacterium avium subsp. paratuberculosis
cugcacccagcc

SEQ ID NO: 2838868 - RNA, 15 nt, Mycobacterium avium subsp. paratuberculosis
cugcacccgcuccac

SEQ ID NO: 2838869 - RNA, 19 nt, Mycobacterium avium subsp. paratuberculosis
cugcacccgcuccaccgaa

SEQ ID NO: 2838870 - RNA, 19 nt, Mycobacterium avium subsp. paratuberculosis
cugcacccucugccacggc

SEQ ID NO: 2838871 - RNA, 16 nt, Mycobacterium avium subsp. paratuberculosis
cugcaccgacuccuug

SEQ ID NO: 2838872 - RNA, 13 nt, Mycobacterium avium subsp. paratuberculosis
cugcaccggcgac

SEQ ID NO: 2838873 - RNA, 14 nt, Mycobacterium avium subsp. paratuberculosis
cugcaccggcgacg

SEQ ID NO: 2838874 - RNA, 16 nt, Mycobacterium avium subsp. paratuberculosis
cugcaccggcgacggc

SEQ ID NO: 2838875 - RNA, 17 nt, Mycobacterium avium subsp. paratuberculosis
cugcaccggcgacggcg

SEQ ID NO: 2838876 - RNA, 16 nt, Mycobacterium avium subsp. paratuberculosis
cugcaccgggaugaca

SEQ ID NO: 2838877 - RNA, 19 nt, Mycobacterium avium subsp. paratuberculosis
cugcaccggggccggcggg

SEQ ID NO: 2838878 - RNA, 20 nt, Mycobacterium avium subsp. paratuberculosis
cugcaccggggccggcgggg

SEQ ID NO: 2838879 - RNA, 19 nt, Mycobacterium avium subsp. paratuberculosis
cugcaccggguacaccggc

SEQ ID NO: 2838880 - RNA, 18 nt, Mycobacterium avium subsp. paratuberculosis
cugcaccguuuccggugc

SEQ ID NO: 2838881 - RNA, 16 nt, Mycobacterium avium subsp. paratuberculosis
cugcaccugcggcagg

SEQ ID NO: 2838882 - RNA, 13 nt, Mycobacterium avium subsp. paratuberculosis
cugcaccugggug

SEQ ID NO: 2838883 - RNA, 16 nt, Mycobacterium avium subsp. paratuberculosis
cugcaccugggugauc

SEQ ID NO: 2838884 - RNA, 13 nt, Mycobacterium avium subsp. paratuberculosis
cugcaccuugccc

SEQ ID NO: 2838885 - RNA, 18 nt, Mycobacterium avium subsp. paratuberculosis
cugcaccuugcccgucgc

SEQ ID NO: 2838886 - RNA, 17 nt, Mycobacterium avium subsp. paratuberculosis
cugcacgaaauaaccgc

SEQ ID NO: 2838887 - RNA, 22 nt, Mycobacterium avium subsp. paratuberculosis
cugcacgaaauaaccgcgcggc

SEQ ID NO: 2838888 - RNA, 23 nt, Mycobacterium avium subsp. paratuberculosis
cugcacgaaauaaccgcgcggcg

SEQ ID NO: 2838889 - RNA, 18 nt, Mycobacterium avium subsp. paratuberculosis
cugcacgaagucgaccgc

SEQ ID NO: 2838890 - RNA, 21 nt, Mycobacterium avium subsp. paratuberculosis
cugcacgaagucgaccgcggc

SEQ ID NO: 2838891 - RNA, 21 nt, Mycobacterium avium subsp. paratuberculosis
cugcacgacgaacaccaccgg

SEQ ID NO: 2838892 - RNA, 22 nt, Mycobacterium avium subsp. paratuberculosis
cugcacgacgaacaccaccggc

SEQ ID NO: 2838893 - RNA, 14 nt, Mycobacterium avium subsp. paratuberculosis
cugcacgacgaccg

SEQ ID NO: 2838894 - RNA, 22 nt, Mycobacterium avium subsp. paratuberculosis
cugcacgacgaccgcgacggcg

SEQ ID NO: 2838895 - RNA, 21 nt, Mycobacterium avium subsp. paratuberculosis
cugcacgaugccgaccaacac

SEQ ID NO: 2838896 - RNA, 21 nt, Mycobacterium avium subsp. paratuberculosis
cugcacgcaaaaaccaugcca

SEQ ID NO: 2838897 - RNA, 22 nt, Mycobacterium avium subsp. paratuberculosis
cugcacgcaaaaaccaugccag

SEQ ID NO: 2838898 - RNA, 15 nt, Mycobacterium avium subsp. paratuberculosis
cugcacgcacggcga

SEQ ID NO: 2838899 - RNA, 18 nt, Mycobacterium avium subsp. paratuberculosis
cugcacgcacggcgaacg

SEQ ID NO: 2838900 - RNA, 22 nt, Mycobacterium avium subsp. paratuberculosis
cugcacgcacggcgaacggccg

SEQ ID NO: 2838901 - RNA, 15 nt, Mycobacterium avium subsp. paratuberculosis
cugcacgcaggccuc

SEQ ID NO: 2838902 - RNA, 13 nt, Mycobacterium avium subsp. paratuberculosis
cugcacgcgcggg

SEQ ID NO: 2838903 - RNA, 17 nt, Mycobacterium avium subsp. paratuberculosis
cugcagggauucggcca

SEQ ID NO: 2838904 - RNA, 14 nt, Mycobacterium avium subsp. paratuberculosis
cugcagggccgggu

SEQ ID NO: 2838905 - RNA, 15 nt, Mycobacterium avium subsp. paratuberculosis
cugcaggucgcggug

SEQ ID NO: 2838906 - RNA, 20 nt, Mycobacterium avium subsp. paratuberculosis
cugcaggucguaguaggcgc

SEQ ID NO: 2838907 - RNA, 22 nt, Mycobacterium avium subsp. paratuberculosis
cugcaggucguaguaggcgccg

SEQ ID NO: 2838908 - RNA, 23 nt, Mycobacterium avium subsp. paratuberculosis
cugcaggucguaguaggcgccga

SEQ ID NO: 2838909 - RNA, 16 nt, Mycobacterium avium subsp. paratuberculosis
cugcagguggcccaca

SEQ ID NO: 2838910 - RNA, 20 nt, Mycobacterium avium subsp. paratuberculosis
cugcagguggcccacacgcg

SEQ ID NO: 2838911 - RNA, 12 nt, Mycobacterium avium subsp. paratuberculosis
cugcaguagccg

SEQ ID NO: 2838912 - RNA, 15 nt, Mycobacterium avium subsp. paratuberculosis
cugcaguagccggcc

SEQ ID NO: 2838913 - RNA, 20 nt, Mycobacterium avium subsp. paratuberculosis
cugcaguagccggccagcuc

SEQ ID NO: 2838914 - RNA, 21 nt, Mycobacterium avium subsp. paratuberculosis
cugcaguagccggccagcucg

SEQ ID NO: 2838915 - RNA, 22 nt, Mycobacterium avium subsp. paratuberculosis
cugcaguagccggccagcucga

SEQ ID NO: 2838916 - RNA, 22 nt, Mycobacterium avium subsp. paratuberculosis
cugcagugucggaaucggcgcc

SEQ ID NO: 2838917 - RNA, 21 nt, Mycobacterium avium subsp. paratuberculosis
cugcauagucggcccgaucgc

SEQ ID NO: 2838918 - RNA, 17 nt, Mycobacterium avium subsp. paratuberculosis
cugcaucauguccaggu

SEQ ID NO: 2838919 - RNA, 12 nt, Mycobacterium avium subsp. paratuberculosis
cugcauccgcag

SEQ ID NO: 2838920 - RNA, 13 nt, Mycobacterium avium subsp. paratuberculosis
cugcauccgcagc

SEQ ID NO: 2838921 - RNA, 16 nt, Mycobacterium avium subsp. paratuberculosis
cugcauccgcagcacc

SEQ ID NO: 2838922 - RNA, 15 nt, Mycobacterium avium subsp. paratuberculosis
cugcaucgccagcac

SEQ ID NO: 2838923 - RNA, 13 nt, Mycobacterium avium subsp. paratuberculosis
cugcaucuccagc

SEQ ID NO: 2838924 - RNA, 16 nt, Mycobacterium avium subsp. paratuberculosis
cugcaucucgacccgg

SEQ ID NO: 2838925 - RNA, 15 nt, Mycobacterium avium subsp. paratuberculosis
cugcaugccgggcag

SEQ ID NO: 2838926 - RNA, 13 nt, Mycobacterium avium subsp. paratuberculosis
cugcaugccggug

SEQ ID NO: 2838927 - RNA, 17 nt, Mycobacterium avium subsp. paratuberculosis
cugcaugccggugucgg

SEQ ID NO: 2838928 - RNA, 14 nt, Mycobacterium avium subsp. paratuberculosis
cugcaugccgucga

SEQ ID NO: 2838929 - RNA, 17 nt, Mycobacterium avium subsp. paratuberculosis
cugcaugccgucgaucu

SEQ ID NO: 2838930 - RNA, 17 nt, Mycobacterium avium subsp. paratuberculosis
cugcauuucggacggcg

SEQ ID NO: 2838931 - RNA, 18 nt, Mycobacterium avium subsp. paratuberculosis
cugcauuucggacggcga

SEQ ID NO: 2838932 - RNA, 13 nt, Mycobacterium avium subsp. paratuberculosis
cugccaaaguugg

SEQ ID NO: 2838933 - RNA, 14 nt, Mycobacterium avium subsp. paratuberculosis
cugccaaccgaggc

SEQ ID NO: 2838934 - RNA, 17 nt, Mycobacterium avium subsp. paratuberculosis
cugccaagacguccgcg

SEQ ID NO: 2838935 - RNA, 19 nt, Mycobacterium avium subsp. paratuberculosis
cugccaagacguccgcguc

SEQ ID NO: 2838936 - RNA, 20 nt, Mycobacterium avium subsp. paratuberculosis
cugccaagauugggccacag

SEQ ID NO: 2838937 - RNA, 16 nt, Mycobacterium avium subsp. paratuberculosis
cugccacagcgacagg

SEQ ID NO: 2838938 - RNA, 12 nt, Mycobacterium avium subsp. paratuberculosis
cugccaccgcga

SEQ ID NO: 2838939 - RNA, 12 nt, Mycobacterium avium subsp. paratuberculosis
cugccacgccca

SEQ ID NO: 2838940 - RNA, 13 nt, Mycobacterium avium subsp. paratuberculosis
cugccacgcccac

SEQ ID NO: 2838941 - RNA, 14 nt, Mycobacterium avium subsp. paratuberculosis
cugccacgcccacc

SEQ ID NO: 2838942 - RNA, 17 nt, Mycobacterium avium subsp. paratuberculosis
cugccacgguuucgccg

SEQ ID NO: 2838943 - RNA, 23 nt, Mycobacterium avium subsp. paratuberculosis
cugccacgguuucgccguacagc

SEQ ID NO: 2838944 - RNA, 14 nt, Mycobacterium avium subsp. paratuberculosis
cugccagaacggcg

SEQ ID NO: 2838945 - RNA, 19 nt, Mycobacterium avium subsp. paratuberculosis
cugccagaacggcggcagc

SEQ ID NO: 2838946 - RNA, 21 nt, Mycobacterium avium subsp. paratuberculosis
cugccagaacggcggcagcga

SEQ ID NO: 2838947 - RNA, 12 nt, Mycobacterium avium subsp. paratuberculosis
cugccagcgccc

SEQ ID NO: 2838948 - RNA, 15 nt, Mycobacterium avium subsp. paratuberculosis
cugccagcgcccgcu

SEQ ID NO: 2838949 - RNA, 16 nt, Mycobacterium avium subsp. paratuberculosis
cugccagcgcccgcug

SEQ ID NO: 2838950 - RNA, 17 nt, Mycobacterium avium subsp. paratuberculosis
cugccagcgcccgcugc

SEQ ID NO: 2838951 - RNA, 15 nt, Mycobacterium avium subsp. paratuberculosis
cugccagcggcgcaa

SEQ ID NO: 2838952 - RNA, 23 nt, Mycobacterium avium subsp. paratuberculosis
cugccaggacaggaugcguucgg

SEQ ID NO: 2838953 - RNA, 14 nt, Mycobacterium avium subsp. paratuberculosis
cugccaggcggugg

SEQ ID NO: 2838954 - RNA, 20 nt, Mycobacterium avium subsp. paratuberculosis
cugccaggcgguggccgaac

SEQ ID NO: 2838955 - RNA, 22 nt, Mycobacterium avium subsp. paratuberculosis
cugccaggcgguggccgaaccg

SEQ ID NO: 2838956 - RNA, 14 nt, Mycobacterium avium subsp. paratuberculosis
cugccagggccggg

SEQ ID NO: 2838957 - RNA, 16 nt, Mycobacterium avium subsp. paratuberculosis
cugccagggccgggcg

SEQ ID NO: 2838958 - RNA, 17 nt, Mycobacterium avium subsp. paratuberculosis
cugccagggccgggcgu

SEQ ID NO: 2838959 - RNA, 19 nt, Mycobacterium avium subsp. paratuberculosis
cugccagggccgggcgugc

SEQ ID NO: 2838960 - RNA, 23 nt, Mycobacterium avium subsp. paratuberculosis
cugccagggggaguagucggcga

SEQ ID NO: 2838961 - RNA, 23 nt, Mycobacterium avium subsp. paratuberculosis
cugccaguugucgaucuccucgc

SEQ ID NO: 2838962 - RNA, 22 nt, Mycobacterium avium subsp. paratuberculosis
cugcccaaccguuggugcggug

SEQ ID NO: 2838963 - RNA, 14 nt, Mycobacterium avium subsp. paratuberculosis
cugcccaacgucga

SEQ ID NO: 2838964 - RNA, 21 nt, Mycobacterium avium subsp. paratuberculosis
cugcccaaugaucugggccgc

SEQ ID NO: 2838965 - RNA, 14 nt, Mycobacterium avium subsp. paratuberculosis
cugcccaccaccag

SEQ ID NO: 2838966 - RNA, 16 nt, Mycobacterium avium subsp. paratuberculosis
cugcccaccaccaggg

SEQ ID NO: 2838967 - RNA, 18 nt, Mycobacterium avium subsp. paratuberculosis
cugcccaccaccaggggc

SEQ ID NO: 2838968 - RNA, 13 nt, Mycobacterium avium subsp. paratuberculosis
cugcccaccagca

SEQ ID NO: 2838969 - RNA, 14 nt, Mycobacterium avium subsp. paratuberculosis
cugcccaccagcag

SEQ ID NO: 2838970 - RNA, 20 nt, Mycobacterium avium subsp. paratuberculosis
cugcccagccaucugcugac

SEQ ID NO: 2838971 - RNA, 14 nt, Mycobacterium avium subsp. paratuberculosis
cugcccagcgcggu

SEQ ID NO: 2838972 - RNA, 16 nt, Mycobacterium avium subsp. paratuberculosis
cugcccagcgcggucg

SEQ ID NO: 2838973 - RNA, 18 nt, Mycobacterium avium subsp. paratuberculosis
cugcccagcgcggucgcc

SEQ ID NO: 2838974 - RNA, 15 nt, Mycobacterium avium subsp. paratuberculosis
cugcccagcggcacg

SEQ ID NO: 2838975 - RNA, 13 nt, Mycobacterium avium subsp. paratuberculosis
cugcccaggucca

SEQ ID NO: 2838976 - RNA, 19 nt, Mycobacterium avium subsp. paratuberculosis
cugcccauccaggccagca

SEQ ID NO: 2838977 - RNA, 19 nt, Mycobacterium avium subsp. paratuberculosis
cugccccacacgcucggcg

SEQ ID NO: 2838978 - RNA, 20 nt, Mycobacterium avium subsp. paratuberculosis
cugccccacacgcucggcgc

SEQ ID NO: 2838979 - RNA, 21 nt, Mycobacterium avium subsp. paratuberculosis
cugccccacacgcucggcgcg

SEQ ID NO: 2838980 - RNA, 22 nt, Mycobacterium avium subsp. paratuberculosis
cugccccacacgcucggcgcgc

SEQ ID NO: 2838981 - RNA, 18 nt, Mycobacterium avium subsp. paratuberculosis
cugccccagccacagccg

SEQ ID NO: 2838982 - RNA, 20 nt, Mycobacterium avium subsp. paratuberculosis
cugccccagggaccaguggu

SEQ ID NO: 2838983 - RNA, 14 nt, Mycobacterium avium subsp. paratuberculosis
cugccccgcuccuc

SEQ ID NO: 2838984 - RNA, 13 nt, Mycobacterium avium subsp. paratuberculosis
cugccccggcgaa

SEQ ID NO: 2838985 - RNA, 17 nt, Mycobacterium avium subsp. paratuberculosis
cugccccggcgaacgcc

SEQ ID NO: 2838986 - RNA, 14 nt, Mycobacterium avium subsp. paratuberculosis
cugccccuucgcga

SEQ ID NO: 2838987 - RNA, 19 nt, Mycobacterium avium subsp. paratuberculosis
cugccccuucgcgacacug

SEQ ID NO: 2838988 - RNA, 21 nt, Mycobacterium avium subsp. paratuberculosis
cugccgcuggcgucgaucgcg

SEQ ID NO: 2838989 - RNA, 17 nt, Mycobacterium avium subsp. paratuberculosis
cugccggaacgagccgg

SEQ ID NO: 2838990 - RNA, 15 nt, Mycobacterium avium subsp. paratuberculosis
cugccggacaccccg

SEQ ID NO: 2838991 - RNA, 16 nt, Mycobacterium avium subsp. paratuberculosis
cugccggacaccccgg

SEQ ID NO: 2838992 - RNA, 18 nt, Mycobacterium avium subsp. paratuberculosis
cugccggacaccccggcc

SEQ ID NO: 2838993 - RNA, 20 nt, Mycobacterium avium subsp. paratuberculosis
cugccggacaccccggccag

SEQ ID NO: 2838994 - RNA, 19 nt, Mycobacterium avium subsp. paratuberculosis
cugccggaccucgaccagc

SEQ ID NO: 2838995 - RNA, 17 nt, Mycobacterium avium subsp. paratuberculosis
cugccggaugccgcgcg

SEQ ID NO: 2838996 - RNA, 24 nt, Mycobacterium avium subsp. paratuberculosis
cugccggaugccgcgcggcgccag

SEQ ID NO: 2838997 - RNA, 23 nt, Mycobacterium avium subsp. paratuberculosis
cugccggcauaggccagcaccag

SEQ ID NO: 2838998 - RNA, 18 nt, Mycobacterium avium subsp. paratuberculosis
cugccggccaaggcaagu

SEQ ID NO: 2838999 - RNA, 22 nt, Mycobacterium avium subsp. paratuberculosis
cugccggccaaggcaagucguc

SEQ ID NO: 2839000 - RNA, 14 nt, Mycobacterium avium subsp. paratuberculosis
cugccggccgaagg

SEQ ID NO: 2839001 - RNA, 12 nt, Mycobacterium avium subsp. paratuberculosis
cugccggccgcc

SEQ ID NO: 2839002 - RNA, 13 nt, Mycobacterium avium subsp. paratuberculosis
cugccggccgccg

SEQ ID NO: 2839003 - RNA, 14 nt, Mycobacterium avium subsp. paratuberculosis
cugccggccgccgc

SEQ ID NO: 2839004 - RNA, 14 nt, Mycobacterium avium subsp. paratuberculosis
cugccggccggggc

SEQ ID NO: 2839005 - RNA, 15 nt, Mycobacterium avium subsp. paratuberculosis
cugccggccggggcg

SEQ ID NO: 2839006 - RNA, 17 nt, Mycobacterium avium subsp. paratuberculosis
cugccggccggggcggc

SEQ ID NO: 2839007 - RNA, 21 nt, Mycobacterium avium subsp. paratuberculosis
cugccggccggggcggcggua

SEQ ID NO: 2839008 - RNA, 17 nt, Mycobacterium avium subsp. paratuberculosis
cugccggccguugcggg

SEQ ID NO: 2839009 - RNA, 12 nt, Mycobacterium avium subsp. paratuberculosis
cugccggcgacc

SEQ ID NO: 2839010 - RNA, 19 nt, Mycobacterium avium subsp. paratuberculosis
cugccggcgaccagccccu

SEQ ID NO: 2839011 - RNA, 22 nt, Mycobacterium avium subsp. paratuberculosis
cugccggcgaccagccccucga

SEQ ID NO: 2839012 - RNA, 15 nt, Mycobacterium avium subsp. paratuberculosis
cugccggcgcacccg

SEQ ID NO: 2839013 - RNA, 16 nt, Mycobacterium avium subsp. paratuberculosis
cugccggcgcacccgc

SEQ ID NO: 2839014 - RNA, 17 nt, Mycobacterium avium subsp. paratuberculosis
cugccggcgcacccgca

SEQ ID NO: 2839015 - RNA, 22 nt, Mycobacterium avium subsp. paratuberculosis
cugccggcgcuucugcgccggu

SEQ ID NO: 2839016 - RNA, 13 nt, Mycobacterium avium subsp. paratuberculosis
cugccggcggccg

SEQ ID NO: 2839017 - RNA, 16 nt, Mycobacterium avium subsp. paratuberculosis
cugccggcggccgccg

SEQ ID NO: 2839018 - RNA, 13 nt, Mycobacterium avium subsp. paratuberculosis
cugccgggccgca

SEQ ID NO: 2839019 - RNA, 16 nt, Mycobacterium avium subsp. paratuberculosis
cugccgggccgcaucc

SEQ ID NO: 2839020 - RNA, 22 nt, Mycobacterium avium subsp. paratuberculosis
cugccgggccgcauccagcgcc

SEQ ID NO: 2839021 - RNA, 23 nt, Mycobacterium avium subsp. paratuberculosis
cugccgggccgcauccagcgccg

SEQ ID NO: 2839022 - RNA, 13 nt, Mycobacterium avium subsp. paratuberculosis
cugccgggcggcg

SEQ ID NO: 2839023 - RNA, 14 nt, Mycobacterium avium subsp. paratuberculosis
cugccgggcggcga

SEQ ID NO: 2839024 - RNA, 15 nt, Mycobacterium avium subsp. paratuberculosis
cugccgggcggcgac

SEQ ID NO: 2839025 - RNA, 16 nt, Mycobacterium avium subsp. paratuberculosis
cugccgggcggcgacg

SEQ ID NO: 2839026 - RNA, 16 nt, Mycobacterium avium subsp. paratuberculosis
cugccgggcgucgacg

SEQ ID NO: 2839027 - RNA, 14 nt, Mycobacterium avium subsp. paratuberculosis
cugccggggcgcag

SEQ ID NO: 2839028 - RNA, 16 nt, Mycobacterium avium subsp. paratuberculosis
cugccggggcgcagcu

SEQ ID NO: 2839029 - RNA, 19 nt, Mycobacterium avium subsp. paratuberculosis
cugccggggugcagcacca

SEQ ID NO: 2839030 - RNA, 15 nt, Mycobacterium avium subsp. paratuberculosis
cugccggugccgccg

SEQ ID NO: 2839031 - RNA, 18 nt, Mycobacterium avium subsp. paratuberculosis
cugccggugccgccggcg

SEQ ID NO: 2839032 - RNA, 21 nt, Mycobacterium avium subsp. paratuberculosis
cugccggugccgccggcgcau

SEQ ID NO: 2839033 - RNA, 15 nt, Mycobacterium avium subsp. paratuberculosis
cugccggugcugcuc

SEQ ID NO: 2839034 - RNA, 17 nt, Mycobacterium avium subsp. paratuberculosis
cugccggugcugcucga

SEQ ID NO: 2839035 - RNA, 18 nt, Mycobacterium avium subsp. paratuberculosis
cugccggugcugcucgag

SEQ ID NO: 2839036 - RNA, 19 nt, Mycobacterium avium subsp. paratuberculosis
cugccggugcugcucgagg

SEQ ID NO: 2839037 - RNA, 13 nt, Mycobacterium avium subsp. paratuberculosis
cugccgguggccu

SEQ ID NO: 2839038 - RNA, 17 nt, Mycobacterium avium subsp. paratuberculosis
cugccgguggucccggu

SEQ ID NO: 2839039 - RNA, 17 nt, Mycobacterium avium subsp. paratuberculosis
cugccguagaaccgcuc

SEQ ID NO: 2839040 - RNA, 14 nt, Mycobacterium avium subsp. paratuberculosis
cugccguagcgcug

SEQ ID NO: 2839041 - RNA, 19 nt, Mycobacterium avium subsp. paratuberculosis
cugccguagcgcuggguga

SEQ ID NO: 2839042 - RNA, 16 nt, Mycobacterium avium subsp. paratuberculosis
cugccgucaccggcca

SEQ ID NO: 2839043 - RNA, 17 nt, Mycobacterium avium subsp. paratuberculosis
cugccgucaccggccau

SEQ ID NO: 2839044 - RNA, 20 nt, Mycobacterium avium subsp. paratuberculosis
cugccgucaccggccauccg

SEQ ID NO: 2839045 - RNA, 15 nt, Mycobacterium avium subsp. paratuberculosis
cugccguccacccgg

SEQ ID NO: 2839046 - RNA, 16 nt, Mycobacterium avium subsp. paratuberculosis
cugccguccacccggc

SEQ ID NO: 2839047 - RNA, 16 nt, Mycobacterium avium subsp. paratuberculosis
cugccguccggguccg

SEQ ID NO: 2839048 - RNA, 19 nt, Mycobacterium avium subsp. paratuberculosis
cugccguccggguccggcu

SEQ ID NO: 2839049 - RNA, 14 nt, Mycobacterium avium subsp. paratuberculosis
cugccguccuucuc

SEQ ID NO: 2839050 - RNA, 15 nt, Mycobacterium avium subsp. paratuberculosis
cugccguccuucucg

SEQ ID NO: 2839051 - RNA, 23 nt, Mycobacterium avium subsp. paratuberculosis
cugccguccuucucgaaccgggg

SEQ ID NO: 2839052 - RNA, 19 nt, Mycobacterium avium subsp. paratuberculosis
cugccgucgacgaccacca

SEQ ID NO: 2839053 - RNA, 13 nt, Mycobacterium avium subsp. paratuberculosis
cugccguucgccg

SEQ ID NO: 2839054 - RNA, 15 nt, Mycobacterium avium subsp. paratuberculosis
cugccguucgccggu

SEQ ID NO: 2839055 - RNA, 12 nt, Mycobacterium avium subsp. paratuberculosis
cugccguucggc

SEQ ID NO: 2839056 - RNA, 17 nt, Mycobacterium avium subsp. paratuberculosis
cugccguucggccagcg

SEQ ID NO: 2839057 - RNA, 19 nt, Mycobacterium avium subsp. paratuberculosis
cugccguucggccagcgcc

SEQ ID NO: 2839058 - RNA, 17 nt, Mycobacterium avium subsp. paratuberculosis
cugccguugcgccagcg

SEQ ID NO: 2839059 - RNA, 19 nt, Mycobacterium avium subsp. paratuberculosis
cugccguugcgccagcggg

SEQ ID NO: 2839060 - RNA, 13 nt, Mycobacterium avium subsp. paratuberculosis
cugccguugggca

SEQ ID NO: 2839061 - RNA, 21 nt, Mycobacterium avium subsp. paratuberculosis
cugccguugggcacgguguag

SEQ ID NO: 2839062 - RNA, 17 nt, Mycobacterium avium subsp. paratuberculosis
cugccuacuugcggccg

SEQ ID NO: 2839063 - RNA, 23 nt, Mycobacterium avium subsp. paratuberculosis
cugccuacuugcggccgcgacgc

SEQ ID NO: 2839064 - RNA, 15 nt, Mycobacterium avium subsp. paratuberculosis
cugccucgacgaugg

SEQ ID NO: 2839065 - RNA, 21 nt, Mycobacterium avium subsp. paratuberculosis
cugccucgacgaugggugugg

SEQ ID NO: 2839066 - RNA, 23 nt, Mycobacterium avium subsp. paratuberculosis
cugccugguuggucaauccgggc

SEQ ID NO: 2839067 - RNA, 17 nt, Mycobacterium avium subsp. paratuberculosis
cugcgaaucgucggcga

SEQ ID NO: 2839068 - RNA, 20 nt, Mycobacterium avium subsp. paratuberculosis
cugcgaaucgucggcgaugg

SEQ ID NO: 2839069 - RNA, 20 nt, Mycobacterium avium subsp. paratuberculosis
cugcgacagcacgggcgggc

SEQ ID NO: 2839070 - RNA, 15 nt, Mycobacterium avium subsp. paratuberculosis
cugcgacaggucggc

SEQ ID NO: 2839071 - RNA, 18 nt, Mycobacterium avium subsp. paratuberculosis
cugcgacaggucggcggu

SEQ ID NO: 2839072 - RNA, 14 nt, Mycobacterium avium subsp. paratuberculosis
cugcgaccacccgg

SEQ ID NO: 2839073 - RNA, 16 nt, Mycobacterium avium subsp. paratuberculosis
cugcgcgcggugcacg

SEQ ID NO: 2839074 - RNA, 23 nt, Mycobacterium avium subsp. paratuberculosis
cugcgcgcguuguccagcagcgc

SEQ ID NO: 2839075 - RNA, 14 nt, Mycobacterium avium subsp. paratuberculosis
cugcgcggcacggg

SEQ ID NO: 2839076 - RNA, 15 nt, Mycobacterium avium subsp. paratuberculosis
cugcgcggccgaacu

SEQ ID NO: 2839077 - RNA, 14 nt, Mycobacterium avium subsp. paratuberculosis
cugcgcggccgcgu

SEQ ID NO: 2839078 - RNA, 15 nt, Mycobacterium avium subsp. paratuberculosis
cugcgcggccgcguc

SEQ ID NO: 2839079 - RNA, 19 nt, Mycobacterium avium subsp. paratuberculosis
cugcgcggccgcgucggcg

SEQ ID NO: 2839080 - RNA, 15 nt, Mycobacterium avium subsp. paratuberculosis
cugcgcggccggcgu

SEQ ID NO: 2839081 - RNA, 22 nt, Mycobacterium avium subsp. paratuberculosis
cugcgcggccugcagcaccgaa

SEQ ID NO: 2839082 - RNA, 14 nt, Mycobacterium avium subsp. paratuberculosis
cugcgcggcggcgu

SEQ ID NO: 2839083 - RNA, 21 nt, Mycobacterium avium subsp. paratuberculosis
cugcgcggcggcguccgcggc

SEQ ID NO: 2839084 - RNA, 22 nt, Mycobacterium avium subsp. paratuberculosis
cugcgcggcggcguccgcggcc

SEQ ID NO: 2839085 - RNA, 17 nt, Mycobacterium avium subsp. paratuberculosis
cugcgcgggcgcggaca

SEQ ID NO: 2839086 - RNA, 19 nt, Mycobacterium avium subsp. paratuberculosis
cugcgcgggcgcggacagc

SEQ ID NO: 2839087 - RNA, 22 nt, Mycobacterium avium subsp. paratuberculosis
cugcgcgggcgcggccagcgcg

SEQ ID NO: 2839088 - RNA, 19 nt, Mycobacterium avium subsp. paratuberculosis
cugcgcgggucggcgccgg

SEQ ID NO: 2839089 - RNA, 22 nt, Mycobacterium avium subsp. paratuberculosis
cugcgcgggucggcgccggcca

SEQ ID NO: 2839090 - RNA, 13 nt, Mycobacterium avium subsp. paratuberculosis
cugcgcgguggcg

SEQ ID NO: 2839091 - RNA, 17 nt, Mycobacterium avium subsp. paratuberculosis
cugcgcgguggcgcggg

SEQ ID NO: 2839092 - RNA, 18 nt, Mycobacterium avium subsp. paratuberculosis
cugcgcgguggcgcgggu

SEQ ID NO: 2839093 - RNA, 16 nt, Mycobacterium avium subsp. paratuberculosis
cugcgcgucgagcagc

SEQ ID NO: 2839094 - RNA, 17 nt, Mycobacterium avium subsp. paratuberculosis
cugcgcgucgagcagca

SEQ ID NO: 2839095 - RNA, 21 nt, Mycobacterium avium subsp. paratuberculosis
cugcgcgucggagaucaccgg

SEQ ID NO: 2839096 - RNA, 16 nt, Mycobacterium avium subsp. paratuberculosis
cugcgcgucggccgca

SEQ ID NO: 2839097 - RNA, 17 nt, Mycobacterium avium subsp. paratuberculosis
cugcgcgucggccgcac

SEQ ID NO: 2839098 - RNA, 14 nt, Mycobacterium avium subsp. paratuberculosis
cugcgcgucgucgc

SEQ ID NO: 2839099 - RNA, 19 nt, Mycobacterium avium subsp. paratuberculosis
cugcgcuaccaggcgugca

SEQ ID NO: 2839100 - RNA, 17 nt, Mycobacterium avium subsp. paratuberculosis
cugcgcucgccgucggc

SEQ ID NO: 2839101 - RNA, 15 nt, Mycobacterium avium subsp. paratuberculosis
cugcgcuucgagcag

SEQ ID NO: 2839102 - RNA, 17 nt, Mycobacterium avium subsp. paratuberculosis
cugcgcuucgagcagau

SEQ ID NO: 2839103 - RNA, 14 nt, Mycobacterium avium subsp. paratuberculosis
cugcgcuugcggcg

SEQ ID NO: 2839104 - RNA, 18 nt, Mycobacterium avium subsp. paratuberculosis
cugcgcuugcggcgcagc

SEQ ID NO: 2839105 - RNA, 23 nt, Mycobacterium avium subsp. paratuberculosis
cugcggaaaugcccgcgccccgg

SEQ ID NO: 2839106 - RNA, 24 nt, Mycobacterium avium subsp. paratuberculosis
cugcggaacccacgugcggcgccc

SEQ ID NO: 2839107 - RNA, 21 nt, Mycobacterium avium subsp. paratuberculosis
cugcggaaucacuuccgcggc

SEQ ID NO: 2839108 - RNA, 22 nt, Mycobacterium avium subsp. paratuberculosis
cugcggaaucacuuccgcggca

SEQ ID NO: 2839109 - RNA, 18 nt, Mycobacterium avium subsp. paratuberculosis
cugcggauaaccguccac

SEQ ID NO: 2839110 - RNA, 21 nt, Mycobacterium avium subsp. paratuberculosis
cugcggauaaccguccacacc

SEQ ID NO: 2839111 - RNA, 18 nt, Mycobacterium avium subsp. paratuberculosis
cugcggauccgacgaacc

SEQ ID NO: 2839112 - RNA, 19 nt, Mycobacterium avium subsp. paratuberculosis
cugcggaucgcgggcgacc

SEQ ID NO: 2839113 - RNA, 21 nt, Mycobacterium avium subsp. paratuberculosis
cugcggcaacagcaccagcac

SEQ ID NO: 2839114 - RNA, 14 nt, Mycobacterium avium subsp. paratuberculosis
cugcggcaaugccg

SEQ ID NO: 2839115 - RNA, 13 nt, Mycobacterium avium subsp. paratuberculosis
cugcggcacacca

SEQ ID NO: 2839116 - RNA, 15 nt, Mycobacterium avium subsp. paratuberculosis
cugcggcacaccagc

SEQ ID NO: 2839117 - RNA, 16 nt, Mycobacterium avium subsp. paratuberculosis
cugcggcacaccagcg

SEQ ID NO: 2839118 - RNA, 13 nt, Mycobacterium avium subsp. paratuberculosis
cugcggcaccacg

SEQ ID NO: 2839119 - RNA, 14 nt, Mycobacterium avium subsp. paratuberculosis
cugcggcaccacgc

SEQ ID NO: 2839120 - RNA, 16 nt, Mycobacterium avium subsp. paratuberculosis
cugcggcaccucggcc

SEQ ID NO: 2839121 - RNA, 19 nt, Mycobacterium avium subsp. paratuberculosis
cugcggcagaccgguggcg

SEQ ID NO: 2839122 - RNA, 20 nt, Mycobacterium avium subsp. paratuberculosis
cugcggcagaccgguggcga

SEQ ID NO: 2839123 - RNA, 22 nt, Mycobacterium avium subsp. paratuberculosis
cugcggcaggucggccagcgcc

SEQ ID NO: 2839124 - RNA, 23 nt, Mycobacterium avium subsp. paratuberculosis
cugcggcaggucggccagcgccg

SEQ ID NO: 2839125 - RNA, 18 nt, Mycobacterium avium subsp. paratuberculosis
cugcggccagugccgggc

SEQ ID NO: 2839126 - RNA, 19 nt, Mycobacterium avium subsp. paratuberculosis
cugcggccagugccgggcc

SEQ ID NO: 2839127 - RNA, 20 nt, Mycobacterium avium subsp. paratuberculosis
cugcggccagugccgggcca

SEQ ID NO: 2839128 - RNA, 21 nt, Mycobacterium avium subsp. paratuberculosis
cugcggccagugccgggccag

SEQ ID NO: 2839129 - RNA, 20 nt, Mycobacterium avium subsp. paratuberculosis
cugcggcccagcguagaaca

SEQ ID NO: 2839130 - RNA, 14 nt, Mycobacterium avium subsp. paratuberculosis
cugcggcccgucgc

SEQ ID NO: 2839131 - RNA, 15 nt, Mycobacterium avium subsp. paratuberculosis
cugcggcccgucgcc

SEQ ID NO: 2839132 - RNA, 16 nt, Mycobacterium avium subsp. paratuberculosis
cugcggcccgucgccg

SEQ ID NO: 2839133 - RNA, 12 nt, Mycobacterium avium subsp. paratuberculosis
cugcggccgcga

SEQ ID NO: 2839134 - RNA, 13 nt, Mycobacterium avium subsp. paratuberculosis
cugcggccgcgac

SEQ ID NO: 2839135 - RNA, 16 nt, Mycobacterium avium subsp. paratuberculosis
cugcggccgcgacugc

SEQ ID NO: 2839136 - RNA, 22 nt, Mycobacterium avium subsp. paratuberculosis
cugcggccgcgacugcacccga

SEQ ID NO: 2839137 - RNA, 13 nt, Mycobacterium avium subsp. paratuberculosis
cugcggcgccggg

SEQ ID NO: 2839138 - RNA, 15 nt, Mycobacterium avium subsp. paratuberculosis
cugcggcgccgggca

SEQ ID NO: 2839139 - RNA, 12 nt, Mycobacterium avium subsp. paratuberculosis
cugcggcgcggc

SEQ ID NO: 2839140 - RNA, 16 nt, Mycobacterium avium subsp. paratuberculosis
cugcggcgcggccacc

SEQ ID NO: 2839141 - RNA, 17 nt, Mycobacterium avium subsp. paratuberculosis
cugcggcgcggccaccc

SEQ ID NO: 2839142 - RNA, 13 nt, Mycobacterium avium subsp. paratuberculosis
cugcggcggccgc

SEQ ID NO: 2839143 - RNA, 23 nt, Mycobacterium avium subsp. paratuberculosis
cugcggcgucgucuuggccugcu

SEQ ID NO: 2839144 - RNA, 12 nt, Mycobacterium avium subsp. paratuberculosis
cugcggcucggc

SEQ ID NO: 2839145 - RNA, 13 nt, Mycobacterium avium subsp. paratuberculosis
cugcggcucggcg

SEQ ID NO: 2839146 - RNA, 13 nt, Mycobacterium avium subsp. paratuberculosis
cugcggcucgucg

SEQ ID NO: 2839147 - RNA, 14 nt, Mycobacterium avium subsp. paratuberculosis
cugcggcucgucgg

SEQ ID NO: 2839148 - RNA, 17 nt, Mycobacterium avium subsp. paratuberculosis
cugcggcucgucggcga

SEQ ID NO: 2839149 - RNA, 21 nt, Mycobacterium avium subsp. paratuberculosis
cugcggcucgucggcgaacag

SEQ ID NO: 2839150 - RNA, 18 nt, Mycobacterium avium subsp. paratuberculosis
cugcgggaagcccaccgc

SEQ ID NO: 2839151 - RNA, 17 nt, Mycobacterium avium subsp. paratuberculosis
cugcgggaagccgaguu

SEQ ID NO: 2839152 - RNA, 14 nt, Mycobacterium avium subsp. paratuberculosis
cugcgggaccagcg

SEQ ID NO: 2839153 - RNA, 16 nt, Mycobacterium avium subsp. paratuberculosis
cugcgggaccagcgcc

SEQ ID NO: 2839154 - RNA, 20 nt, Mycobacterium avium subsp. paratuberculosis
cugcgggaccagcgccucgg

SEQ ID NO: 2839155 - RNA, 21 nt, Mycobacterium avium subsp. paratuberculosis
cugcgggaccagcgccucggc

SEQ ID NO: 2839156 - RNA, 13 nt, Mycobacterium avium subsp. paratuberculosis
cugcgggccagcg

SEQ ID NO: 2839157 - RNA, 16 nt, Mycobacterium avium subsp. paratuberculosis
cugcgggccaggcggg

SEQ ID NO: 2839158 - RNA, 13 nt, Mycobacterium avium subsp. paratuberculosis
cugcucggcgggc

SEQ ID NO: 2839159 - RNA, 13 nt, Mycobacterium avium subsp. paratuberculosis
cugcucggcgggu

SEQ ID NO: 2839160 - RNA, 19 nt, Mycobacterium avium subsp. paratuberculosis
cugcucggugaugccgagc

SEQ ID NO: 2839161 - RNA, 20 nt, Mycobacterium avium subsp. paratuberculosis
cugcucggugaugccgagcg

SEQ ID NO: 2839162 - RNA, 23 nt, Mycobacterium avium subsp. paratuberculosis
cugcucggugaugccgagcgccg

SEQ ID NO: 2839163 - RNA, 12 nt, Mycobacterium avium subsp. paratuberculosis
cugcucgguguc

SEQ ID NO: 2839164 - RNA, 14 nt, Mycobacterium avium subsp. paratuberculosis
cugcucggugucga

SEQ ID NO: 2839165 - RNA, 15 nt, Mycobacterium avium subsp. paratuberculosis
cugcucguccuggcg

SEQ ID NO: 2839166 - RNA, 22 nt, Mycobacterium avium subsp. paratuberculosis
cugcucguccuggcgcuggugc

SEQ ID NO: 2839167 - RNA, 14 nt, Mycobacterium avium subsp. paratuberculosis
cugcucgucgcggg

SEQ ID NO: 2839168 - RNA, 15 nt, Mycobacterium avium subsp. paratuberculosis
cugcucgucgcgggc

SEQ ID NO: 2839169 - RNA, 14 nt, Mycobacterium avium subsp. paratuberculosis
cugcucgucggacu

SEQ ID NO: 2839170 - RNA, 14 nt, Mycobacterium avium subsp. paratuberculosis
cugcucgucgguga

SEQ ID NO: 2839171 - RNA, 15 nt, Mycobacterium avium subsp. paratuberculosis
cugcucgucggugac

SEQ ID NO: 2839172 - RNA, 16 nt, Mycobacterium avium subsp. paratuberculosis
cugcucgugcaaaccg

SEQ ID NO: 2839173 - RNA, 22 nt, Mycobacterium avium subsp. paratuberculosis
cugcucgugcaaaccggaccgc

SEQ ID NO: 2839174 - RNA, 14 nt, Mycobacterium avium subsp. paratuberculosis
cugcucguucguca

SEQ ID NO: 2839175 - RNA, 23 nt, Mycobacterium avium subsp. paratuberculosis
cugcucguucgucaugacgaaca

SEQ ID NO: 2839176 - RNA, 20 nt, Mycobacterium avium subsp. paratuberculosis
cugcucuucgcgcgcggcgu

SEQ ID NO: 2839177 - RNA, 22 nt, Mycobacterium avium subsp. paratuberculosis
cugcucuucgcgcgcggcgugg

SEQ ID NO: 2839178 - RNA, 17 nt, Mycobacterium avium subsp. paratuberculosis
cugcugaugcggacacc

SEQ ID NO: 2839179 - RNA, 16 nt, Mycobacterium avium subsp. paratuberculosis
cugcugcacgacgacc

SEQ ID NO: 2839180 - RNA, 22 nt, Mycobacterium avium subsp. paratuberculosis
cugcugcacgacgaccgcgacg

SEQ ID NO: 2839181 - RNA, 16 nt, Mycobacterium avium subsp. paratuberculosis
cugcugcacgucgccg

SEQ ID NO: 2839182 - RNA, 18 nt, Mycobacterium avium subsp. paratuberculosis
cugcugcacgucgccggc

SEQ ID NO: 2839183 - RNA, 13 nt, Mycobacterium avium subsp. paratuberculosis
cugcugcagcgcc

SEQ ID NO: 2839184 - RNA, 14 nt, Mycobacterium avium subsp. paratuberculosis
cugcugcagcgccc

SEQ ID NO: 2839185 - RNA, 15 nt, Mycobacterium avium subsp. paratuberculosis
cugcugcagcgcccg

SEQ ID NO: 2839186 - RNA, 19 nt, Mycobacterium avium subsp. paratuberculosis
cugcugcagcgcccgggcc

SEQ ID NO: 2839187 - RNA, 20 nt, Mycobacterium avium subsp. paratuberculosis
cugcugcagcgcccgggcca

SEQ ID NO: 2839188 - RNA, 21 nt, Mycobacterium avium subsp. paratuberculosis
cugcugcagcgcccgggccag

SEQ ID NO: 2839189 - RNA, 16 nt, Mycobacterium avium subsp. paratuberculosis
cugcugcccgcgacgg

SEQ ID NO: 2839190 - RNA, 20 nt, Mycobacterium avium subsp. paratuberculosis
cugcugccgccgcagcagcc

SEQ ID NO: 2839191 - RNA, 24 nt, Mycobacterium avium subsp. paratuberculosis
cugcugcgcagacccgguggccga

SEQ ID NO: 2839192 - RNA, 21 nt, Mycobacterium avium subsp. paratuberculosis
cugcugcgcggcacgggccgu

SEQ ID NO: 2839193 - RNA, 13 nt, Mycobacterium avium subsp. paratuberculosis
cugcugcgggugc

SEQ ID NO: 2839194 - RNA, 16 nt, Mycobacterium avium subsp. paratuberculosis
cugcugcgggugcggc

SEQ ID NO: 2839195 - RNA, 13 nt, Mycobacterium avium subsp. paratuberculosis
cugcugcucggcc

SEQ ID NO: 2839196 - RNA, 14 nt, Mycobacterium avium subsp. paratuberculosis
cugcugcucggccg

SEQ ID NO: 2839197 - RNA, 15 nt, Mycobacterium avium subsp. paratuberculosis
cugcugcucggccgc

SEQ ID NO: 2839198 - RNA, 16 nt, Mycobacterium avium subsp. paratuberculosis
cugcugcucggccgca

SEQ ID NO: 2839199 - RNA, 16 nt, Mycobacterium avium subsp. paratuberculosis
cugcugcucgucgcgg

SEQ ID NO: 2839200 - RNA, 14 nt, Mycobacterium avium subsp. paratuberculosis
cugcugcuucuggg

SEQ ID NO: 2839201 - RNA, 21 nt, Mycobacterium avium subsp. paratuberculosis
cugcugcuucuggguguaggu

SEQ ID NO: 2839202 - RNA, 15 nt, Mycobacterium avium subsp. paratuberculosis
cugcuggcugcggcc

SEQ ID NO: 2839203 - RNA, 16 nt, Mycobacterium avium subsp. paratuberculosis
cugcugggcggcacca

SEQ ID NO: 2839204 - RNA, 16 nt, Mycobacterium avium subsp. paratuberculosis
cugcugguagacccgg

SEQ ID NO: 2839205 - RNA, 18 nt, Mycobacterium avium subsp. paratuberculosis
cugcuggucgacgucauc

SEQ ID NO: 2839206 - RNA, 21 nt, Mycobacterium avium subsp. paratuberculosis
cugcuggucuugccgugcagc

SEQ ID NO: 2839207 - RNA, 22 nt, Mycobacterium avium subsp. paratuberculosis
cugcuguagcucacggugucgg

SEQ ID NO: 2839208 - RNA, 20 nt, Mycobacterium avium subsp. paratuberculosis
cugcuguuccucgaacaggc

SEQ ID NO: 2839209 - RNA, 22 nt, Mycobacterium avium subsp. paratuberculosis
cugcuguuccucgaacaggcug

SEQ ID NO: 2839210 - RNA, 15 nt, Mycobacterium avium subsp. paratuberculosis
cugcuucgucgccgg

SEQ ID NO: 2839211 - RNA, 22 nt, Mycobacterium avium subsp. paratuberculosis
cugcuucgucgccgggcugggu

SEQ ID NO: 2839212 - RNA, 13 nt, Mycobacterium avium subsp. paratuberculosis
cugcuugaacagc

SEQ ID NO: 2839213 - RNA, 21 nt, Mycobacterium avium subsp. paratuberculosis
cugcuugaacagcacccccuc

SEQ ID NO: 2839214 - RNA, 24 nt, Mycobacterium avium subsp. paratuberculosis
cugcuugacccgcuccagcggcca

SEQ ID NO: 2839215 - RNA, 14 nt, Mycobacterium avium subsp. paratuberculosis
cugcuugaccgugg

SEQ ID NO: 2839216 - RNA, 14 nt, Mycobacterium avium subsp. paratuberculosis
cugcuugagccgcc

SEQ ID NO: 2839217 - RNA, 15 nt, Mycobacterium avium subsp. paratuberculosis
cugcuugaugaugcc

SEQ ID NO: 2839218 - RNA, 16 nt, Mycobacterium avium subsp. paratuberculosis
cugcuugaugaugccg

SEQ ID NO: 2839219 - RNA, 21 nt, Mycobacterium avium subsp. paratuberculosis
cugcuugaugaugccggccgc

SEQ ID NO: 2839220 - RNA, 22 nt, Mycobacterium avium subsp. paratuberculosis
cugcuugaugaugccggccgcg

SEQ ID NO: 2839221 - RNA, 23 nt, Mycobacterium avium subsp. paratuberculosis
cugcuugaugaugccggccgcgu

SEQ ID NO: 2839222 - RNA, 22 nt, Mycobacterium avium subsp. paratuberculosis
cugcuugaugaugucggcggcc

SEQ ID NO: 2839223 - RNA, 23 nt, Mycobacterium avium subsp. paratuberculosis
cugcuugaugaugucggcggccg

SEQ ID NO: 2839224 - RNA, 16 nt, Mycobacterium avium subsp. paratuberculosis
cugcuugccgucgacg

SEQ ID NO: 2839225 - RNA, 19 nt, Mycobacterium avium subsp. paratuberculosis
cugcuuggcggccugcgcc

SEQ ID NO: 2839226 - RNA, 17 nt, Mycobacterium avium subsp. paratuberculosis
cugcuugggcagcagcu

SEQ ID NO: 2839227 - RNA, 12 nt, Mycobacterium avium subsp. paratuberculosis
cugcuugggcgc

SEQ ID NO: 2839228 - RNA, 22 nt, Mycobacterium avium subsp. paratuberculosis
cugcuugggcgccucgccgacc

SEQ ID NO: 2839229 - RNA, 20 nt, Mycobacterium avium subsp. paratuberculosis
cugcuuggucaccugacgcu

SEQ ID NO: 2839230 - RNA, 20 nt, Mycobacterium avium subsp. paratuberculosis
cugcuuggucuccggccccg

SEQ ID NO: 2839231 - RNA, 23 nt, Mycobacterium avium subsp. paratuberculosis
cugcuuguugagggugacggugg

SEQ ID NO: 2839232 - RNA, 23 nt, Mycobacterium avium subsp. paratuberculosis
cugcuuugucucacgccucgucg

SEQ ID NO: 2839233 - RNA, 18 nt, Mycobacterium avium subsp. paratuberculosis
cuggaaauaggccgggca

SEQ ID NO: 2839234 - RNA, 17 nt, Mycobacterium avium subsp. paratuberculosis
cuggaacacccaggucu

SEQ ID NO: 2839235 - RNA, 16 nt, Mycobacterium avium subsp. paratuberculosis
cuggaacagcgggccg

SEQ ID NO: 2839236 - RNA, 18 nt, Mycobacterium avium subsp. paratuberculosis
cuggaacagcgggccggc

SEQ ID NO: 2839237 - RNA, 19 nt, Mycobacterium avium subsp. paratuberculosis
cuggaacagguaguagcgc

SEQ ID NO: 2839238 - RNA, 21 nt, Mycobacterium avium subsp. paratuberculosis
cuggaaccgaaucggucgacc

SEQ ID NO: 2839239 - RNA, 20 nt, Mycobacterium avium subsp. paratuberculosis
cuggaagaagucggugucga

SEQ ID NO: 2839240 - RNA, 16 nt, Mycobacterium avium subsp. paratuberculosis
cuggaagaugacccgc

SEQ ID NO: 2839241 - RNA, 21 nt, Mycobacterium avium subsp. paratuberculosis
cuggaagcgcaucgccggcgc

SEQ ID NO: 2839242 - RNA, 20 nt, Mycobacterium avium subsp. paratuberculosis
cuggccagguauucgcggga

SEQ ID NO: 2839243 - RNA, 23 nt, Mycobacterium avium subsp. paratuberculosis
cuggccaugcuuucgaucaucga

SEQ ID NO: 2839244 - RNA, 16 nt, Mycobacterium avium subsp. paratuberculosis
cuggcccacgcagccg

SEQ ID NO: 2839245 - RNA, 20 nt, Mycobacterium avium subsp. paratuberculosis
cuggcccacgcagccgucga

SEQ ID NO: 2839246 - RNA, 18 nt, Mycobacterium avium subsp. paratuberculosis
cuggcccagacaggccgg

SEQ ID NO: 2839247 - RNA, 20 nt, Mycobacterium avium subsp. paratuberculosis
cuggcccagacaggccggcc

SEQ ID NO: 2839248 - RNA, 14 nt, Mycobacterium avium subsp. paratuberculosis
cuggcccagccgcg

SEQ ID NO: 2839249 - RNA, 18 nt, Mycobacterium avium subsp. paratuberculosis
cuggccccagaaccgcuc

SEQ ID NO: 2839250 - RNA, 22 nt, Mycobacterium avium subsp. paratuberculosis
cuggccccagaaccgcucggcg

SEQ ID NO: 2839251 - RNA, 23 nt, Mycobacterium avium subsp. paratuberculosis
cuggccccagaaccgcucggcgg

SEQ ID NO: 2839252 - RNA, 15 nt, Mycobacterium avium subsp. paratuberculosis
cuggcccccgcccca

SEQ ID NO: 2839253 - RNA, 22 nt, Mycobacterium avium subsp. paratuberculosis
cuggcccccgccccagcccggc

SEQ ID NO: 2839254 - RNA, 19 nt, Mycobacterium avium subsp. paratuberculosis
cuggcccgccaucgcccgg

SEQ ID NO: 2839255 - RNA, 15 nt, Mycobacterium avium subsp. paratuberculosis
cuggcccggcgcggc

SEQ ID NO: 2839256 - RNA, 21 nt, Mycobacterium avium subsp. paratuberculosis
cuggcccggcguuccagcgca

SEQ ID NO: 2839257 - RNA, 22 nt, Mycobacterium avium subsp. paratuberculosis
cuggcccggugcgacgccgcgc

SEQ ID NO: 2839258 - RNA, 19 nt, Mycobacterium avium subsp. paratuberculosis
cuggcccgguuccagcggc

SEQ ID NO: 2839259 - RNA, 13 nt, Mycobacterium avium subsp. paratuberculosis
cuggcccuggcag

SEQ ID NO: 2839260 - RNA, 15 nt, Mycobacterium avium subsp. paratuberculosis
cuggccgaagguggg

SEQ ID NO: 2839261 - RNA, 18 nt, Mycobacterium avium subsp. paratuberculosis
cuggccgaccccgaugcg

SEQ ID NO: 2839262 - RNA, 14 nt, Mycobacterium avium subsp. paratuberculosis
cuggccgaccgccg

SEQ ID NO: 2839263 - RNA, 15 nt, Mycobacterium avium subsp. paratuberculosis
cuggccgaccgccgc

SEQ ID NO: 2839264 - RNA, 17 nt, Mycobacterium avium subsp. paratuberculosis
cuggccgaccgccgcca

SEQ ID NO: 2839265 - RNA, 18 nt, Mycobacterium avium subsp. paratuberculosis
cuggccgaccgccgccau

SEQ ID NO: 2839266 - RNA, 19 nt, Mycobacterium avium subsp. paratuberculosis
cuggccgaccgccgccauc

SEQ ID NO: 2839267 - RNA, 16 nt, Mycobacterium avium subsp. paratuberculosis
cuggccgagcggcugc

SEQ ID NO: 2839268 - RNA, 15 nt, Mycobacterium avium subsp. paratuberculosis
cuggccgaggccucc

SEQ ID NO: 2839269 - RNA, 16 nt, Mycobacterium avium subsp. paratuberculosis
cuggccgaggccucca

SEQ ID NO: 2839270 - RNA, 20 nt, Mycobacterium avium subsp. paratuberculosis
cuggccgaggccuccaggua

SEQ ID NO: 2839271 - RNA, 19 nt, Mycobacterium avium subsp. paratuberculosis
cuggccgaguaggaagcca

SEQ ID NO: 2839272 - RNA, 23 nt, Mycobacterium avium subsp. paratuberculosis
cuggccgaucccggccacgucga

SEQ ID NO: 2839273 - RNA, 16 nt, Mycobacterium avium subsp. paratuberculosis
cuggccgauggucagc

SEQ ID NO: 2839274 - RNA, 21 nt, Mycobacterium avium subsp. paratuberculosis
cuggccgauggucagcugccg

SEQ ID NO: 2839275 - RNA, 14 nt, Mycobacterium avium subsp. paratuberculosis
cuggccgcacggug

SEQ ID NO: 2839276 - RNA, 18 nt, Mycobacterium avium subsp. paratuberculosis
cuggccgcacggugcagc

SEQ ID NO: 2839277 - RNA, 19 nt, Mycobacterium avium subsp. paratuberculosis
cuggccgcacggugcagca

SEQ ID NO: 2839278 - RNA, 21 nt, Mycobacterium avium subsp. paratuberculosis
cuggccgcacggugcagcagc

SEQ ID NO: 2839279 - RNA, 12 nt, Mycobacterium avium subsp. paratuberculosis
cuggccgccgug

SEQ ID NO: 2839280 - RNA, 19 nt, Mycobacterium avium subsp. paratuberculosis
cuggccgcgaacggcccgc

SEQ ID NO: 2839281 - RNA, 13 nt, Mycobacterium avium subsp. paratuberculosis
cuggccgcgcagc

SEQ ID NO: 2839282 - RNA, 16 nt, Mycobacterium avium subsp. paratuberculosis
cuggccgcgccacagc

SEQ ID NO: 2839283 - RNA, 14 nt, Mycobacterium avium subsp. paratuberculosis
cuggccgcggccag

SEQ ID NO: 2839284 - RNA, 20 nt, Mycobacterium avium subsp. paratuberculosis
cuggccgcggccagcugccc

SEQ ID NO: 2839285 - RNA, 22 nt, Mycobacterium avium subsp. paratuberculosis
cuggccgcggccagcugcccgc

SEQ ID NO: 2839286 - RNA, 17 nt, Mycobacterium avium subsp. paratuberculosis
cuggccgcggcgaucgg

SEQ ID NO: 2839287 - RNA, 13 nt, Mycobacterium avium subsp. paratuberculosis
cuggccggacggg

SEQ ID NO: 2839288 - RNA, 20 nt, Mycobacterium avium subsp. paratuberculosis
cuggccggacgggucgaccg

SEQ ID NO: 2839289 - RNA, 21 nt, Mycobacterium avium subsp. paratuberculosis
cuggccggagcggugcggcuc

SEQ ID NO: 2839290 - RNA, 14 nt, Mycobacterium avium subsp. paratuberculosis
cuggccggccacca

SEQ ID NO: 2839291 - RNA, 18 nt, Mycobacterium avium subsp. paratuberculosis
cuggccggccaccagcgg

SEQ ID NO: 2839292 - RNA, 14 nt, Mycobacterium avium subsp. paratuberculosis
cuggccggccaucu

SEQ ID NO: 2839293 - RNA, 13 nt, Mycobacterium avium subsp. paratuberculosis
cuggccggccucg

SEQ ID NO: 2839294 - RNA, 21 nt, Mycobacterium avium subsp. paratuberculosis
cuggccggccucgaugucguc

SEQ ID NO: 2839295 - RNA, 13 nt, Mycobacterium avium subsp. paratuberculosis
cuggccgggcucg

SEQ ID NO: 2839296 - RNA, 20 nt, Mycobacterium avium subsp. paratuberculosis
cuggccgggcucgagggcgg

SEQ ID NO: 2839297 - RNA, 21 nt, Mycobacterium avium subsp. paratuberculosis
cuggccgggcucgagggcggc

SEQ ID NO: 2839298 - RNA, 22 nt, Mycobacterium avium subsp. paratuberculosis
cuggccgggcucgagggcggcg

SEQ ID NO: 2839299 - RNA, 18 nt, Mycobacterium avium subsp. paratuberculosis
cuggccggguuggcaucc

SEQ ID NO: 2839300 - RNA, 19 nt, Mycobacterium avium subsp. paratuberculosis
cuggccggguuggcaucca

SEQ ID NO: 2839301 - RNA, 14 nt, Mycobacterium avium subsp. paratuberculosis
cuggccggugcgga

SEQ ID NO: 2839302 - RNA, 22 nt, Mycobacterium avium subsp. paratuberculosis
cuggccggugcggaugaagugc

SEQ ID NO: 2839303 - RNA, 22 nt, Mycobacterium avium subsp. paratuberculosis
cuggccguccggauagccgucg

SEQ ID NO: 2839304 - RNA, 13 nt, Mycobacterium avium subsp. paratuberculosis
cuggccgucgcgg

SEQ ID NO: 2839305 - RNA, 14 nt, Mycobacterium avium subsp. paratuberculosis
cuggccgucgcggc

SEQ ID NO: 2839306 - RNA, 20 nt, Mycobacterium avium subsp. paratuberculosis
cuggccgucgucgaggccga

SEQ ID NO: 2839307 - RNA, 17 nt, Mycobacterium avium subsp. paratuberculosis
cuggccgugcaccgucg

SEQ ID NO: 2839308 - RNA, 18 nt, Mycobacterium avium subsp. paratuberculosis
cuggccgugcaccgucgc

SEQ ID NO: 2839309 - RNA, 21 nt, Mycobacterium avium subsp. paratuberculosis
cuggccguggccgugaugcgc

SEQ ID NO: 2839310 - RNA, 16 nt, Mycobacterium avium subsp. paratuberculosis
cuggccguggucggcg

SEQ ID NO: 2839311 - RNA, 17 nt, Mycobacterium avium subsp. paratuberculosis
cuggccguggucggcga

SEQ ID NO: 2839312 - RNA, 17 nt, Mycobacterium avium subsp. paratuberculosis
cuggccguucaggucga

SEQ ID NO: 2839313 - RNA, 22 nt, Mycobacterium avium subsp. paratuberculosis
cuggccguucaggucgaucagc

SEQ ID NO: 2839314 - RNA, 22 nt, Mycobacterium avium subsp. paratuberculosis
cuggccuccagcuuugccagca

SEQ ID NO: 2839315 - RNA, 20 nt, Mycobacterium avium subsp. paratuberculosis
cuggccugauugacggccca

SEQ ID NO: 2839316 - RNA, 14 nt, Mycobacterium avium subsp. paratuberculosis
cuggccuggucggc

SEQ ID NO: 2839317 - RNA, 18 nt, Mycobacterium avium subsp. paratuberculosis
cuggccuggucggccggc

SEQ ID NO: 2839318 - RNA, 19 nt, Mycobacterium avium subsp. paratuberculosis
cuggccuggucggccggca

SEQ ID NO: 2839319 - RNA, 17 nt, Mycobacterium avium subsp. paratuberculosis
cuggccuugaucgggua

SEQ ID NO: 2839320 - RNA, 14 nt, Mycobacterium avium subsp. paratuberculosis
cuggcgaaccgcgg

SEQ ID NO: 2839321 - RNA, 15 nt, Mycobacterium avium subsp. paratuberculosis
cuggcgaaccgcggc

SEQ ID NO: 2839322 - RNA, 16 nt, Mycobacterium avium subsp. paratuberculosis
cuggcgaaccgcggcg

SEQ ID NO: 2839323 - RNA, 19 nt, Mycobacterium avium subsp. paratuberculosis
cuggcgaauccgggccucc

SEQ ID NO: 2839324 - RNA, 23 nt, Mycobacterium avium subsp. paratuberculosis
cuggcgaauucggaacccugccc

SEQ ID NO: 2839325 - RNA, 14 nt, Mycobacterium avium subsp. paratuberculosis
cuggcgaucaccuu

SEQ ID NO: 2839326 - RNA, 16 nt, Mycobacterium avium subsp. paratuberculosis
cuggcguggcucggcc

SEQ ID NO: 2839327 - RNA, 15 nt, Mycobacterium avium subsp. paratuberculosis
cuggcguucgccgag

SEQ ID NO: 2839328 - RNA, 18 nt, Mycobacterium avium subsp. paratuberculosis
cuggcguucgccgaggaa

SEQ ID NO: 2839329 - RNA, 18 nt, Mycobacterium avium subsp. paratuberculosis
cuggcguugagcacgcgg

SEQ ID NO: 2839330 - RNA, 21 nt, Mycobacterium avium subsp. paratuberculosis
cuggcguugagcacgcggacc

SEQ ID NO: 2839331 - RNA, 22 nt, Mycobacterium avium subsp. paratuberculosis
cuggcguugaugcgggcgugcg

SEQ ID NO: 2839332 - RNA, 21 nt, Mycobacterium avium subsp. paratuberculosis
cuggcucaacacguccuggcg

SEQ ID NO: 2839333 - RNA, 20 nt, Mycobacterium avium subsp. paratuberculosis
cuggcucggcaccagagcgc

SEQ ID NO: 2839334 - RNA, 22 nt, Mycobacterium avium subsp. paratuberculosis
cuggcucggcaccagagcgccg

SEQ ID NO: 2839335 - RNA, 13 nt, Mycobacterium avium subsp. paratuberculosis
cuggcugagcagc

SEQ ID NO: 2839336 - RNA, 23 nt, Mycobacterium avium subsp. paratuberculosis
cuggcugagcagcacccgacuuc

SEQ ID NO: 2839337 - RNA, 14 nt, Mycobacterium avium subsp. paratuberculosis
cuggcugccugguu

SEQ ID NO: 2839338 - RNA, 15 nt, Mycobacterium avium subsp. paratuberculosis
cuggcuggucaccca

SEQ ID NO: 2839339 - RNA, 17 nt, Mycobacterium avium subsp. paratuberculosis
cuggcuggugauggcca

SEQ ID NO: 2839340 - RNA, 23 nt, Mycobacterium avium subsp. paratuberculosis
cuggcuguagcggucgugcggga

SEQ ID NO: 2839341 - RNA, 17 nt, Mycobacterium avium subsp. paratuberculosis
cugggacagccggucga

SEQ ID NO: 2839342 - RNA, 17 nt, Mycobacterium avium subsp. paratuberculosis
cugggacgggucggcgg

SEQ ID NO: 2839343 - RNA, 20 nt, Mycobacterium avium subsp. paratuberculosis
cugggacgggucggcggcga

SEQ ID NO: 2839344 - RNA, 12 nt, Mycobacterium avium subsp. paratuberculosis
cugggagcggcc

SEQ ID NO: 2839345 - RNA, 15 nt, Mycobacterium avium subsp. paratuberculosis
cugggaggcgcacaa

SEQ ID NO: 2839346 - RNA, 16 nt, Mycobacterium avium subsp. paratuberculosis
cugggaggcggcggua

SEQ ID NO: 2839347 - RNA, 16 nt, Mycobacterium avium subsp. paratuberculosis
cugggaguugacuccu

SEQ ID NO: 2839348 - RNA, 14 nt, Mycobacterium avium subsp. paratuberculosis
cugggaucggugcg

SEQ ID NO: 2839349 - RNA, 20 nt, Mycobacterium avium subsp. paratuberculosis
cugggaugucuagccgccga

SEQ ID NO: 2839350 - RNA, 16 nt, Mycobacterium avium subsp. paratuberculosis
cugggauugccgggca

SEQ ID NO: 2839351 - RNA, 20 nt, Mycobacterium avium subsp. paratuberculosis
cugggcaaaaacgcgcgauc

SEQ ID NO: 2839352 - RNA, 14 nt, Mycobacterium avium subsp. paratuberculosis
cugggcaauggccg

SEQ ID NO: 2839353 - RNA, 13 nt, Mycobacterium avium subsp. paratuberculosis
cugggcagccaga

SEQ ID NO: 2839354 - RNA, 16 nt, Mycobacterium avium subsp. paratuberculosis
cugggcagccgcgcgu

SEQ ID NO: 2839355 - RNA, 21 nt, Mycobacterium avium subsp. paratuberculosis
cugggcagccgcgcgugcagc

SEQ ID NO: 2839356 - RNA, 12 nt, Mycobacterium avium subsp. paratuberculosis
cugggcagccgu

SEQ ID NO: 2839357 - RNA, 14 nt, Mycobacterium avium subsp. paratuberculosis
cugggcagccgucc

SEQ ID NO: 2839358 - RNA, 15 nt, Mycobacterium avium subsp. paratuberculosis
cugggcagccguccc

SEQ ID NO: 2839359 - RNA, 18 nt, Mycobacterium avium subsp. paratuberculosis
cugggcagccgucccugu

SEQ ID NO: 2839360 - RNA, 19 nt, Mycobacterium avium subsp. paratuberculosis
cugggcaucaucggcacgc

SEQ ID NO: 2839361 - RNA, 23 nt, Mycobacterium avium subsp. paratuberculosis
cugggcaucaucggcacgccggg

SEQ ID NO: 2839362 - RNA, 21 nt, Mycobacterium avium subsp. paratuberculosis
cugggccacgauccgcgcggc

SEQ ID NO: 2839363 - RNA, 23 nt, Mycobacterium avium subsp. paratuberculosis
cugggccacgauccgcgcggcca

SEQ ID NO: 2839364 - RNA, 14 nt, Mycobacterium avium subsp. paratuberculosis
cugggccagaucga

SEQ ID NO: 2839365 - RNA, 13 nt, Mycobacterium avium subsp. paratuberculosis
cugggccaggauc

SEQ ID NO: 2839366 - RNA, 21 nt, Mycobacterium avium subsp. paratuberculosis
cugggccaggaucucgucggg

SEQ ID NO: 2839367 - RNA, 14 nt, Mycobacterium avium subsp. paratuberculosis
cugggccaggucgc

SEQ ID NO: 2839368 - RNA, 13 nt, Mycobacterium avium subsp. paratuberculosis
cugggccccucca

SEQ ID NO: 2839369 - RNA, 15 nt, Mycobacterium avium subsp. paratuberculosis
cugggccccuccagc

SEQ ID NO: 2839370 - RNA, 17 nt, Mycobacterium avium subsp. paratuberculosis
cugggccccuccagccg

SEQ ID NO: 2839371 - RNA, 18 nt, Mycobacterium avium subsp. paratuberculosis
cugggccccuccagccgc

SEQ ID NO: 2839372 - RNA, 19 nt, Mycobacterium avium subsp. paratuberculosis
cugggccccuccagccgcc

SEQ ID NO: 2839373 - RNA, 20 nt, Mycobacterium avium subsp. paratuberculosis
cugggccccuccagccgccg

SEQ ID NO: 2839374 - RNA, 21 nt, Mycobacterium avium subsp. paratuberculosis
cugggccccuccagccgccgg

SEQ ID NO: 2839375 - RNA, 22 nt, Mycobacterium avium subsp. paratuberculosis
cugggccccuccagccgccggu

SEQ ID NO: 2839376 - RNA, 15 nt, Mycobacterium avium subsp. paratuberculosis
cugggccgccaacgg

SEQ ID NO: 2839377 - RNA, 15 nt, Mycobacterium avium subsp. paratuberculosis
cugggccgccagccg

SEQ ID NO: 2839378 - RNA, 14 nt, Mycobacterium avium subsp. paratuberculosis
cugggccgccgagc

SEQ ID NO: 2839379 - RNA, 13 nt, Mycobacterium avium subsp. paratuberculosis
cugggccgccguc

SEQ ID NO: 2839380 - RNA, 22 nt, Mycobacterium avium subsp. paratuberculosis
cugggccgccgucgccaccacc

SEQ ID NO: 2839381 - RNA, 12 nt, Mycobacterium avium subsp. paratuberculosis
cugggccgcggc

SEQ ID NO: 2839382 - RNA, 14 nt, Mycobacterium avium subsp. paratuberculosis
cugggccggcgccg

SEQ ID NO: 2839383 - RNA, 15 nt, Mycobacterium avium subsp. paratuberculosis
cugggccggcgccga

SEQ ID NO: 2839384 - RNA, 16 nt, Mycobacterium avium subsp. paratuberculosis
cugggccggcgccgaa

SEQ ID NO: 2839385 - RNA, 17 nt, Mycobacterium avium subsp. paratuberculosis
cugggccgucgcccgga

SEQ ID NO: 2839386 - RNA, 16 nt, Mycobacterium avium subsp. paratuberculosis
cugggccuccggcggc

SEQ ID NO: 2839387 - RNA, 18 nt, Mycobacterium avium subsp. paratuberculosis
cugggccuccggcggcag

SEQ ID NO: 2839388 - RNA, 17 nt, Mycobacterium avium subsp. paratuberculosis
cugggccucguccaggg

SEQ ID NO: 2839389 - RNA, 16 nt, Mycobacterium avium subsp. paratuberculosis
cugggccuggcgcucc

SEQ ID NO: 2839390 - RNA, 16 nt, Mycobacterium avium subsp. paratuberculosis
cugggcgaacggcaac

SEQ ID NO: 2839391 - RNA, 15 nt, Mycobacterium avium subsp. paratuberculosis
cugggcgaccaugcc

SEQ ID NO: 2839392 - RNA, 20 nt, Mycobacterium avium subsp. paratuberculosis
cugggcgaccaugccgcggg

SEQ ID NO: 2839393 - RNA, 23 nt, Mycobacterium avium subsp. paratuberculosis
cugggcgauugcguugaucgacg

SEQ ID NO: 2839394 - RNA, 24 nt, Mycobacterium avium subsp. paratuberculosis
cugggcgauugcguugaucgacgg

SEQ ID NO: 2839395 - RNA, 23 nt, Mycobacterium avium subsp. paratuberculosis
cugggcgccauggcccacgacgu

SEQ ID NO: 2839396 - RNA, 19 nt, Mycobacterium avium subsp. paratuberculosis
cugggcgcccagaugccgc

SEQ ID NO: 2839397 - RNA, 22 nt, Mycobacterium avium subsp. paratuberculosis
cugggcgcccagaugccgccgc

SEQ ID NO: 2839398 - RNA, 14 nt, Mycobacterium avium subsp. paratuberculosis
cugggcgccgccgg

SEQ ID NO: 2839399 - RNA, 15 nt, Mycobacterium avium subsp. paratuberculosis
cugggcgccgccggc

SEQ ID NO: 2839400 - RNA, 16 nt, Mycobacterium avium subsp. paratuberculosis
cugggcgccgccggcg

SEQ ID NO: 2839401 - RNA, 18 nt, Mycobacterium avium subsp. paratuberculosis
cugggcgccgccggcguc

SEQ ID NO: 2839402 - RNA, 16 nt, Mycobacterium avium subsp. paratuberculosis
cugggcgccgucgccg

SEQ ID NO: 2839403 - RNA, 23 nt, Mycobacterium avium subsp. paratuberculosis
cugggcgcgcaacucguccacca

SEQ ID NO: 2839404 - RNA, 13 nt, Mycobacterium avium subsp. paratuberculosis
cugggcgcgcacc

SEQ ID NO: 2839405 - RNA, 23 nt, Mycobacterium avium subsp. paratuberculosis
cugggcgcuagcugcgccggcuu

SEQ ID NO: 2839406 - RNA, 14 nt, Mycobacterium avium subsp. paratuberculosis
cugggcggacggga

SEQ ID NO: 2839407 - RNA, 21 nt, Mycobacterium avium subsp. paratuberculosis
cugggcggccaccgcgccccg

SEQ ID NO: 2839408 - RNA, 23 nt, Mycobacterium avium subsp. paratuberculosis
cugggcggccaccgcgccccggc

SEQ ID NO: 2839409 - RNA, 23 nt, Mycobacterium avium subsp. paratuberculosis
cugggcggcgacaucgccgagac

SEQ ID NO: 2839410 - RNA, 15 nt, Mycobacterium avium subsp. paratuberculosis
cugguccugcggcug

SEQ ID NO: 2839411 - RNA, 16 nt, Mycobacterium avium subsp. paratuberculosis
cugguccugcggcugg

SEQ ID NO: 2839412 - RNA, 20 nt, Mycobacterium avium subsp. paratuberculosis
cugguccuuaaucgggacgu

SEQ ID NO: 2839413 - RNA, 14 nt, Mycobacterium avium subsp. paratuberculosis
cuggucgaacagca

SEQ ID NO: 2839414 - RNA, 18 nt, Mycobacterium avium subsp. paratuberculosis
cuggucgaacagcacgcc

SEQ ID NO: 2839415 - RNA, 19 nt, Mycobacterium avium subsp. paratuberculosis
cuggucgaacagcacgccg

SEQ ID NO: 2839416 - RNA, 19 nt, Mycobacterium avium subsp. paratuberculosis
cuggucgaacagcgcgccc

SEQ ID NO: 2839417 - RNA, 20 nt, Mycobacterium avium subsp. paratuberculosis
cuggucgaacagcgcgcccg

SEQ ID NO: 2839418 - RNA, 16 nt, Mycobacterium avium subsp. paratuberculosis
cuggucgaaccgcgag

SEQ ID NO: 2839419 - RNA, 18 nt, Mycobacterium avium subsp. paratuberculosis
cuggucgaaccgcgagcg

SEQ ID NO: 2839420 - RNA, 18 nt, Mycobacterium avium subsp. paratuberculosis
cuggucgaagauggccag

SEQ ID NO: 2839421 - RNA, 19 nt, Mycobacterium avium subsp. paratuberculosis
cuggucgaagauggccagg

SEQ ID NO: 2839422 - RNA, 20 nt, Mycobacterium avium subsp. paratuberculosis
cuggucgaagauggccaggu

SEQ ID NO: 2839423 - RNA, 22 nt, Mycobacterium avium subsp. paratuberculosis
cuggucgacgucauccggcugc

SEQ ID NO: 2839424 - RNA, 21 nt, Mycobacterium avium subsp. paratuberculosis
cuggucgccgaacgugcgcgg

SEQ ID NO: 2839425 - RNA, 13 nt, Mycobacterium avium subsp. paratuberculosis
cuggucgccgccg

SEQ ID NO: 2839426 - RNA, 14 nt, Mycobacterium avium subsp. paratuberculosis
cuggucgccgccgu

SEQ ID NO: 2839427 - RNA, 16 nt, Mycobacterium avium subsp. paratuberculosis
cuggucgccgccgucc

SEQ ID NO: 2839428 - RNA, 13 nt, Mycobacterium avium subsp. paratuberculosis
cuggucggccagc

SEQ ID NO: 2839429 - RNA, 14 nt, Mycobacterium avium subsp. paratuberculosis
cuggucggccaggg

SEQ ID NO: 2839430 - RNA, 15 nt, Mycobacterium avium subsp. paratuberculosis
cuggucggccagggc

SEQ ID NO: 2839431 - RNA, 19 nt, Mycobacterium avium subsp. paratuberculosis
cuggucggccagggcgugg

SEQ ID NO: 2839432 - RNA, 19 nt, Mycobacterium avium subsp. paratuberculosis
cuggucggccggcaggccg

SEQ ID NO: 2839433 - RNA, 21 nt, Mycobacterium avium subsp. paratuberculosis
cuggucggccggcaggccgcc

SEQ ID NO: 2839434 - RNA, 17 nt, Mycobacterium avium subsp. paratuberculosis
cuggucggccuggccca

SEQ ID NO: 2839435 - RNA, 14 nt, Mycobacterium avium subsp. paratuberculosis
cuggucggcgaacc

SEQ ID NO: 2839436 - RNA, 23 nt, Mycobacterium avium subsp. paratuberculosis
cuggucggcgaaccguucgucgu

SEQ ID NO: 2839437 - RNA, 23 nt, Mycobacterium avium subsp. paratuberculosis
cuggucggcggguaugucggcga

SEQ ID NO: 2839438 - RNA, 17 nt, Mycobacterium avium subsp. paratuberculosis
cuggucgggguggaucg

SEQ ID NO: 2839439 - RNA, 16 nt, Mycobacterium avium subsp. paratuberculosis
cuggucgucccagggu

SEQ ID NO: 2839440 - RNA, 18 nt, Mycobacterium avium subsp. paratuberculosis
cuggucgucgagcugaca

SEQ ID NO: 2839441 - RNA, 17 nt, Mycobacterium avium subsp. paratuberculosis
cuggucgugcagcaccg

SEQ ID NO: 2839442 - RNA, 19 nt, Mycobacterium avium subsp. paratuberculosis
cuggucgugcagcaccgcc

SEQ ID NO: 2839443 - RNA, 18 nt, Mycobacterium avium subsp. paratuberculosis
cuggucgugcucgucggc

SEQ ID NO: 2839444 - RNA, 20 nt, Mycobacterium avium subsp. paratuberculosis
cuggucgugcucgucggcgg

SEQ ID NO: 2839445 - RNA, 16 nt, Mycobacterium avium subsp. paratuberculosis
cuggucgugcuggagc

SEQ ID NO: 2839446 - RNA, 19 nt, Mycobacterium avium subsp. paratuberculosis
cuggucguugcacacccgg

SEQ ID NO: 2839447 - RNA, 19 nt, Mycobacterium avium subsp. paratuberculosis
cuggucuugccgugcagca

SEQ ID NO: 2839448 - RNA, 20 nt, Mycobacterium avium subsp. paratuberculosis
cuggucuugccgugcagcag

SEQ ID NO: 2839449 - RNA, 16 nt, Mycobacterium avium subsp. paratuberculosis
cuggugaagcugccga

SEQ ID NO: 2839450 - RNA, 19 nt, Mycobacterium avium subsp. paratuberculosis
cuggugaagcugccgacca

SEQ ID NO: 2839451 - RNA, 18 nt, Mycobacterium avium subsp. paratuberculosis
cuggugaaguucuccagc

SEQ ID NO: 2839452 - RNA, 15 nt, Mycobacterium avium subsp. paratuberculosis
cuggugaccgacgac

SEQ ID NO: 2839453 - RNA, 22 nt, Mycobacterium avium subsp. paratuberculosis
cuggugacgugcaccugcagcc

SEQ ID NO: 2839454 - RNA, 16 nt, Mycobacterium avium subsp. paratuberculosis
cuggugaggucgcgca

SEQ ID NO: 2839455 - RNA, 21 nt, Mycobacterium avium subsp. paratuberculosis
cuggugauccucgucuccggc

SEQ ID NO: 2839456 - RNA, 16 nt, Mycobacterium avium subsp. paratuberculosis
cuggugauggccaucu

SEQ ID NO: 2839457 - RNA, 22 nt, Mycobacterium avium subsp. paratuberculosis
cuggugauggccaucuggccgc

SEQ ID NO: 2839458 - RNA, 17 nt, Mycobacterium avium subsp. paratuberculosis
cuggugcaacaccgaaa

SEQ ID NO: 2839459 - RNA, 17 nt, Mycobacterium avium subsp. paratuberculosis
cuggugcacccgaugcu

SEQ ID NO: 2839460 - RNA, 14 nt, Mycobacterium avium subsp. paratuberculosis
cuggugcagcagcu

SEQ ID NO: 2839461 - RNA, 17 nt, Mycobacterium avium subsp. paratuberculosis
cuggugcagcagcugga

SEQ ID NO: 2839462 - RNA, 16 nt, Mycobacterium avium subsp. paratuberculosis
cuggugcagcagggcg

SEQ ID NO: 2839463 - RNA, 19 nt, Mycobacterium avium subsp. paratuberculosis
cuggugcagcagggcgcgc

SEQ ID NO: 2839464 - RNA, 14 nt, Mycobacterium avium subsp. paratuberculosis
cuggugcagcgacu

SEQ ID NO: 2839465 - RNA, 12 nt, Mycobacterium avium subsp. paratuberculosis
cuggugccgccg

SEQ ID NO: 2839466 - RNA, 17 nt, Mycobacterium avium subsp. paratuberculosis
cuggugccgccgaugac

SEQ ID NO: 2839467 - RNA, 14 nt, Mycobacterium avium subsp. paratuberculosis
cuggugcgcagccc

SEQ ID NO: 2839468 - RNA, 18 nt, Mycobacterium avium subsp. paratuberculosis
cuggugcgcagcccgccg

SEQ ID NO: 2839469 - RNA, 13 nt, Mycobacterium avium subsp. paratuberculosis
cuggugcgcgccg

SEQ ID NO: 2839470 - RNA, 15 nt, Mycobacterium avium subsp. paratuberculosis
cuggugcgcgccggc

SEQ ID NO: 2839471 - RNA, 19 nt, Mycobacterium avium subsp. paratuberculosis
cuggugcgcgccggcgucg

SEQ ID NO: 2839472 - RNA, 20 nt, Mycobacterium avium subsp. paratuberculosis
cuggugcgcgccggcgucgg

SEQ ID NO: 2839473 - RNA, 12 nt, Mycobacterium avium subsp. paratuberculosis
cuggugcgcgcg

SEQ ID NO: 2839474 - RNA, 19 nt, Mycobacterium avium subsp. paratuberculosis
cuggugcgcgcgcaucacc

SEQ ID NO: 2839475 - RNA, 13 nt, Mycobacterium avium subsp. paratuberculosis
cuggugcgggcca

SEQ ID NO: 2839476 - RNA, 16 nt, Mycobacterium avium subsp. paratuberculosis
cuggugcgggccagca

SEQ ID NO: 2839477 - RNA, 18 nt, Mycobacterium avium subsp. paratuberculosis
cuggugcgggccagcacg

SEQ ID NO: 2839478 - RNA, 19 nt, Mycobacterium avium subsp. paratuberculosis
cuggugcgggccagcacga

SEQ ID NO: 2839479 - RNA, 16 nt, Mycobacterium avium subsp. paratuberculosis
cuggugcucgcgcucg

SEQ ID NO: 2839480 - RNA, 16 nt, Mycobacterium avium subsp. paratuberculosis
cuggugcugcugcccc

SEQ ID NO: 2839481 - RNA, 13 nt, Mycobacterium avium subsp. paratuberculosis
cugguggcagcgg

SEQ ID NO: 2839482 - RNA, 16 nt, Mycobacterium avium subsp. paratuberculosis
cugguggccgacgugc

SEQ ID NO: 2839483 - RNA, 17 nt, Mycobacterium avium subsp. paratuberculosis
cugguggccgacgugcc

SEQ ID NO: 2839484 - RNA, 20 nt, Mycobacterium avium subsp. paratuberculosis
cugguggccgacgugccggu

SEQ ID NO: 2839485 - RNA, 13 nt, Mycobacterium avium subsp. paratuberculosis
cuggugggcgggc

SEQ ID NO: 2839486 - RNA, 14 nt, Mycobacterium avium subsp. paratuberculosis
cuggugggcgggca

SEQ ID NO: 2839487 - RNA, 13 nt, Mycobacterium avium subsp. paratuberculosis
cuggugggcgucg

SEQ ID NO: 2839488 - RNA, 18 nt, Mycobacterium avium subsp. paratuberculosis
cugguggugaucacccag

SEQ ID NO: 2839489 - RNA, 20 nt, Mycobacterium avium subsp. paratuberculosis
cugguggugaucacccagcc

SEQ ID NO: 2839490 - RNA, 16 nt, Mycobacterium avium subsp. paratuberculosis
cuggugucccgcgugg

SEQ ID NO: 2839491 - RNA, 21 nt, Mycobacterium avium subsp. paratuberculosis
cuggugucccgcguggccgcc

SEQ ID NO: 2839492 - RNA, 16 nt, Mycobacterium avium subsp. paratuberculosis
cuggugugacgcucgc

SEQ ID NO: 2839493 - RNA, 16 nt, Mycobacterium avium subsp. paratuberculosis
cugguucaccgccacc

SEQ ID NO: 2839494 - RNA, 20 nt, Mycobacterium avium subsp. paratuberculosis
cugguucaccgccaccagca

SEQ ID NO: 2839495 - RNA, 19 nt, Mycobacterium avium subsp. paratuberculosis
cuguucgccgucgcgggug

SEQ ID NO: 2839496 - RNA, 14 nt, Mycobacterium avium subsp. paratuberculosis
cuguucgcgccggu

SEQ ID NO: 2839497 - RNA, 21 nt, Mycobacterium avium subsp. paratuberculosis
cuguucgcggcuggccgcggc

SEQ ID NO: 2839498 - RNA, 22 nt, Mycobacterium avium subsp. paratuberculosis
cuguucgcggcuggccgcggcg

SEQ ID NO: 2839499 - RNA, 18 nt, Mycobacterium avium subsp. paratuberculosis
cuguucggcggcgauccg

SEQ ID NO: 2839500 - RNA, 23 nt, Mycobacterium avium subsp. paratuberculosis
cuguucgggcagauggucgccga

SEQ ID NO: 2839501 - RNA, 21 nt, Mycobacterium avium subsp. paratuberculosis
cuguucggguagacgaucacc

SEQ ID NO: 2839502 - RNA, 12 nt, Mycobacterium avium subsp. paratuberculosis
cuguucgucgag

SEQ ID NO: 2839503 - RNA, 14 nt, Mycobacterium avium subsp. paratuberculosis
cuguugacgggccg

SEQ ID NO: 2839504 - RNA, 15 nt, Mycobacterium avium subsp. paratuberculosis
cuguugacgggccgc

SEQ ID NO: 2839505 - RNA, 18 nt, Mycobacterium avium subsp. paratuberculosis
cuguugacgggccgcggc

SEQ ID NO: 2839506 - RNA, 23 nt, Mycobacterium avium subsp. paratuberculosis
cuguugacgggccgcggccagcu

SEQ ID NO: 2839507 - RNA, 14 nt, Mycobacterium avium subsp. paratuberculosis
cuguugcacguagg

SEQ ID NO: 2839508 - RNA, 18 nt, Mycobacterium avium subsp. paratuberculosis
cuguuggaaccggccacc

SEQ ID NO: 2839509 - RNA, 22 nt, Mycobacterium avium subsp. paratuberculosis
cuguuggccagauacuccucgg

SEQ ID NO: 2839510 - RNA, 13 nt, Mycobacterium avium subsp. paratuberculosis
cuguuggccagcu

SEQ ID NO: 2839511 - RNA, 17 nt, Mycobacterium avium subsp. paratuberculosis
cuguugucggcucgccg

SEQ ID NO: 2839512 - RNA, 15 nt, Mycobacterium avium subsp. paratuberculosis
cuguuuuuccgccgg

SEQ ID NO: 2839513 - RNA, 21 nt, Mycobacterium avium subsp. paratuberculosis
cuuaacuucacgcucggcgag

SEQ ID NO: 2839514 - RNA, 21 nt, Mycobacterium avium subsp. paratuberculosis
cuuaccggccggccgccugga

SEQ ID NO: 2839515 - RNA, 16 nt, Mycobacterium avium subsp. paratuberculosis
cuuaccggcgggcggc

SEQ ID NO: 2839516 - RNA, 21 nt, Mycobacterium avium subsp. paratuberculosis
cuuagccccucccaccacggc

SEQ ID NO: 2839517 - RNA, 15 nt, Mycobacterium avium subsp. paratuberculosis
cuuagcccggccgcg

SEQ ID NO: 2839518 - RNA, 23 nt, Mycobacterium avium subsp. paratuberculosis
cuuagcggggugagcuaugcuga

SEQ ID NO: 2839519 - RNA, 21 nt, Mycobacterium avium subsp. paratuberculosis
cuucaacuugcgcgacgccgu

SEQ ID NO: 2839520 - RNA, 18 nt, Mycobacterium avium subsp. paratuberculosis
cuucacccccacccaggu

SEQ ID NO: 2839521 - RNA, 14 nt, Mycobacterium avium subsp. paratuberculosis
cuucaccgaccagc

SEQ ID NO: 2839522 - RNA, 15 nt, Mycobacterium avium subsp. paratuberculosis
cuucaccgaccagcu

SEQ ID NO: 2839523 - RNA, 17 nt, Mycobacterium avium subsp. paratuberculosis
cuucaccgaccagcugu

SEQ ID NO: 2839524 - RNA, 12 nt, Mycobacterium avium subsp. paratuberculosis
cuucaccgcgcc

SEQ ID NO: 2839525 - RNA, 13 nt, Mycobacterium avium subsp. paratuberculosis
cuucaccgcgccg

SEQ ID NO: 2839526 - RNA, 15 nt, Mycobacterium avium subsp. paratuberculosis
cuucaccgcgccggu

SEQ ID NO: 2839527 - RNA, 14 nt, Mycobacterium avium subsp. paratuberculosis
cuucaccucggccu

SEQ ID NO: 2839528 - RNA, 17 nt, Mycobacterium avium subsp. paratuberculosis
cuucaccucggccuugc

SEQ ID NO: 2839529 - RNA, 16 nt, Mycobacterium avium subsp. paratuberculosis
cuucacgaagugcccg

SEQ ID NO: 2839530 - RNA, 18 nt, Mycobacterium avium subsp. paratuberculosis
cuucacgaagugcccggc

SEQ ID NO: 2839531 - RNA, 20 nt, Mycobacterium avium subsp. paratuberculosis
cuucacgaagugcccggcgc

SEQ ID NO: 2839532 - RNA, 20 nt, Mycobacterium avium subsp. paratuberculosis
cuucacgaccggcagcaccg

SEQ ID NO: 2839533 - RNA, 22 nt, Mycobacterium avium subsp. paratuberculosis
cuucacgaccggcagcaccggc

SEQ ID NO: 2839534 - RNA, 18 nt, Mycobacterium avium subsp. paratuberculosis
cuucacgcucgcaggcga

SEQ ID NO: 2839535 - RNA, 14 nt, Mycobacterium avium subsp. paratuberculosis
cuucacgcucgcgu

SEQ ID NO: 2839536 - RNA, 14 nt, Mycobacterium avium subsp. paratuberculosis
cuucacgcucggcg

SEQ ID NO: 2839537 - RNA, 15 nt, Mycobacterium avium subsp. paratuberculosis
cuucacgcucggcga

SEQ ID NO: 2839538 - RNA, 17 nt, Mycobacterium avium subsp. paratuberculosis
cuucacgcucggcgagc

SEQ ID NO: 2839539 - RNA, 18 nt, Mycobacterium avium subsp. paratuberculosis
cuucacgcucggcgagca

SEQ ID NO: 2839540 - RNA, 19 nt, Mycobacterium avium subsp. paratuberculosis
cuucacgcucggcgccgag

SEQ ID NO: 2839541 - RNA, 24 nt, Mycobacterium avium subsp. paratuberculosis
cuucacgcucggcgccgagcguga

SEQ ID NO: 2839542 - RNA, 14 nt, Mycobacterium avium subsp. paratuberculosis
cuucacgcuggccu

SEQ ID NO: 2839543 - RNA, 15 nt, Mycobacterium avium subsp. paratuberculosis
cuucacgcuggccuc

SEQ ID NO: 2839544 - RNA, 15 nt, Mycobacterium avium subsp. paratuberculosis
cuucacgugcgcggc

SEQ ID NO: 2839545 - RNA, 16 nt, Mycobacterium avium subsp. paratuberculosis
cuucacgugcgcggcg

SEQ ID NO: 2839546 - RNA, 18 nt, Mycobacterium avium subsp. paratuberculosis
cuucacgugcgcggcguc

SEQ ID NO: 2839547 - RNA, 19 nt, Mycobacterium avium subsp. paratuberculosis
cuucacguucggcgaguga

SEQ ID NO: 2839548 - RNA, 23 nt, Mycobacterium avium subsp. paratuberculosis
cuucagccccucggggcugcgcg

SEQ ID NO: 2839549 - RNA, 15 nt, Mycobacterium avium subsp. paratuberculosis
cuucagcccgcgcau

SEQ ID NO: 2839550 - RNA, 15 nt, Mycobacterium avium subsp. paratuberculosis
cuucagcccucgagc

SEQ ID NO: 2839551 - RNA, 14 nt, Mycobacterium avium subsp. paratuberculosis
cuucagccgcagcu

SEQ ID NO: 2839552 - RNA, 19 nt, Mycobacterium avium subsp. paratuberculosis
cuucagcgggcgcagcucg

SEQ ID NO: 2839553 - RNA, 19 nt, Mycobacterium avium subsp. paratuberculosis
cuucagcucgcugaucagc

SEQ ID NO: 2839554 - RNA, 17 nt, Mycobacterium avium subsp. paratuberculosis
cuucagcuugaccguga

SEQ ID NO: 2839555 - RNA, 14 nt, Mycobacterium avium subsp. paratuberculosis
cuucaggaacccga

SEQ ID NO: 2839556 - RNA, 22 nt, Mycobacterium avium subsp. paratuberculosis
cuucaggcagcgcacgauguga

SEQ ID NO: 2839557 - RNA, 16 nt, Mycobacterium avium subsp. paratuberculosis
cuucaguucggccggc

SEQ ID NO: 2839558 - RNA, 14 nt, Mycobacterium avium subsp. paratuberculosis
cuucaucagcaccg

SEQ ID NO: 2839559 - RNA, 17 nt, Mycobacterium avium subsp. paratuberculosis
cuucaucagcaccgcga

SEQ ID NO: 2839560 - RNA, 14 nt, Mycobacterium avium subsp. paratuberculosis
cuucaugcccuugg

SEQ ID NO: 2839561 - RNA, 16 nt, Mycobacterium avium subsp. paratuberculosis
cuucaugcccuuggcc

SEQ ID NO: 2839562 - RNA, 22 nt, Mycobacterium avium subsp. paratuberculosis
cuucaugcccuuggcccgggcg

SEQ ID NO: 2839563 - RNA, 14 nt, Mycobacterium avium subsp. paratuberculosis
cuucaugugguugg

SEQ ID NO: 2839564 - RNA, 13 nt, Mycobacterium avium subsp. paratuberculosis
cuuccacagcccg

SEQ ID NO: 2839565 - RNA, 14 nt, Mycobacterium avium subsp. paratuberculosis
cuuccaccaccgcg

SEQ ID NO: 2839566 - RNA, 16 nt, Mycobacterium avium subsp. paratuberculosis
cuuccaccaccgcggc

SEQ ID NO: 2839567 - RNA, 22 nt, Mycobacterium avium subsp. paratuberculosis
cuuccaccaccgcggcgccguc

SEQ ID NO: 2839568 - RNA, 14 nt, Mycobacterium avium subsp. paratuberculosis
cuuccaccugcggu

SEQ ID NO: 2839569 - RNA, 16 nt, Mycobacterium avium subsp. paratuberculosis
cuuccacgaccuggcg

SEQ ID NO: 2839570 - RNA, 14 nt, Mycobacterium avium subsp. paratuberculosis
cuuccagcaccacc

SEQ ID NO: 2839571 - RNA, 18 nt, Mycobacterium avium subsp. paratuberculosis
cuuccagcaccacccggu

SEQ ID NO: 2839572 - RNA, 18 nt, Mycobacterium avium subsp. paratuberculosis
cuuccagcaccggcuggu

SEQ ID NO: 2839573 - RNA, 14 nt, Mycobacterium avium subsp. paratuberculosis
cuuccaucacgccc

SEQ ID NO: 2839574 - RNA, 21 nt, Mycobacterium avium subsp. paratuberculosis
cuuccaucacgccccggcguc

SEQ ID NO: 2839575 - RNA, 14 nt, Mycobacterium avium subsp. paratuberculosis
cuuccaucgacgcu

SEQ ID NO: 2839576 - RNA, 15 nt, Mycobacterium avium subsp. paratuberculosis
cuuccaucgacgcug

SEQ ID NO: 2839577 - RNA, 11 nt, Mycobacterium avium subsp. paratuberculosis
cuucccacccg

SEQ ID NO: 2839578 - RNA, 15 nt, Mycobacterium avium subsp. paratuberculosis
cuucccacgccuugc

SEQ ID NO: 2839579 - RNA, 13 nt, Mycobacterium avium subsp. paratuberculosis
cuuccccggcggc

SEQ ID NO: 2839580 - RNA, 21 nt, Mycobacterium avium subsp. paratuberculosis
cuucguaacacccucggucgg

SEQ ID NO: 2839581 - RNA, 23 nt, Mycobacterium avium subsp. paratuberculosis
cuucguaacacccucggucgggc

SEQ ID NO: 2839582 - RNA, 15 nt, Mycobacterium avium subsp. paratuberculosis
cuucguacggcccgg

SEQ ID NO: 2839583 - RNA, 13 nt, Mycobacterium avium subsp. paratuberculosis
cuucgucagcagc

SEQ ID NO: 2839584 - RNA, 17 nt, Mycobacterium avium subsp. paratuberculosis
cuucgucagcagcgaca

SEQ ID NO: 2839585 - RNA, 12 nt, Mycobacterium avium subsp. paratuberculosis
cuucgucgccgg

SEQ ID NO: 2839586 - RNA, 14 nt, Mycobacterium avium subsp. paratuberculosis
cuucgucgccgggc

SEQ ID NO: 2839587 - RNA, 12 nt, Mycobacterium avium subsp. paratuberculosis
cuucgucggccg

SEQ ID NO: 2839588 - RNA, 14 nt, Mycobacterium avium subsp. paratuberculosis
cuucgucggccggc

SEQ ID NO: 2839589 - RNA, 16 nt, Mycobacterium avium subsp. paratuberculosis
cuucgugucaccgccc

SEQ ID NO: 2839590 - RNA, 14 nt, Mycobacterium avium subsp. paratuberculosis
cuucuacggcgggc

SEQ ID NO: 2839591 - RNA, 19 nt, Mycobacterium avium subsp. paratuberculosis
cuucuacggcgggccggcg

SEQ ID NO: 2839592 - RNA, 15 nt, Mycobacterium avium subsp. paratuberculosis
cuucucccgcggcag

SEQ ID NO: 2839593 - RNA, 12 nt, Mycobacterium avium subsp. paratuberculosis
cuucuccgccgg

SEQ ID NO: 2839594 - RNA, 15 nt, Mycobacterium avium subsp. paratuberculosis
cuucuccgccggcag

SEQ ID NO: 2839595 - RNA, 16 nt, Mycobacterium avium subsp. paratuberculosis
cuucuccgccggcagu

SEQ ID NO: 2839596 - RNA, 13 nt, Mycobacterium avium subsp. paratuberculosis
cuucuccgcggcc

SEQ ID NO: 2839597 - RNA, 19 nt, Mycobacterium avium subsp. paratuberculosis
cuucuccgcggccgcgcgc

SEQ ID NO: 2839598 - RNA, 21 nt, Mycobacterium avium subsp. paratuberculosis
cuucuccgcggccgcgcgccc

SEQ ID NO: 2839599 - RNA, 22 nt, Mycobacterium avium subsp. paratuberculosis
cuucuccgcggccgcgcgcccg

SEQ ID NO: 2839600 - RNA, 22 nt, Mycobacterium avium subsp. paratuberculosis
cuucucgaaccggggcaccacg

SEQ ID NO: 2839601 - RNA, 15 nt, Mycobacterium avium subsp. paratuberculosis
cuucucgaccaggcu

SEQ ID NO: 2839602 - RNA, 16 nt, Mycobacterium avium subsp. paratuberculosis
cuucucgcgcaccgcg

SEQ ID NO: 2839603 - RNA, 13 nt, Mycobacterium avium subsp. paratuberculosis
cuucucgcugcuc

SEQ ID NO: 2839604 - RNA, 15 nt, Mycobacterium avium subsp. paratuberculosis
cuucucggacgcccg

SEQ ID NO: 2839605 - RNA, 18 nt, Mycobacterium avium subsp. paratuberculosis
cuucucggcguccccggc

SEQ ID NO: 2839606 - RNA, 17 nt, Mycobacterium avium subsp. paratuberculosis
cuucucggugaucaccc

SEQ ID NO: 2839607 - RNA, 17 nt, Mycobacterium avium subsp. paratuberculosis
cuucucggugucgucga

SEQ ID NO: 2839608 - RNA, 18 nt, Mycobacterium avium subsp. paratuberculosis
cuucucggugucgucgac

SEQ ID NO: 2839609 - RNA, 19 nt, Mycobacterium avium subsp. paratuberculosis
cuucugccacucgucgaug

SEQ ID NO: 2839610 - RNA, 18 nt, Mycobacterium avium subsp. paratuberculosis
cuucugcccggccagcag

SEQ ID NO: 2839611 - RNA, 20 nt, Mycobacterium avium subsp. paratuberculosis
cuucuggcgcugcucggagg

SEQ ID NO: 2839612 - RNA, 17 nt, Mycobacterium avium subsp. paratuberculosis
cuucuggcucaacacgu

SEQ ID NO: 2839613 - RNA, 22 nt, Mycobacterium avium subsp. paratuberculosis
cuucuggucaugaaggcgacgu

SEQ ID NO: 2839614 - RNA, 22 nt, Mycobacterium avium subsp. paratuberculosis
cuucuucagcuugaccgugacg

SEQ ID NO: 2839615 - RNA, 20 nt, Mycobacterium avium subsp. paratuberculosis
cuucuucgccgcaaccuucu

SEQ ID NO: 2839616 - RNA, 20 nt, Mycobacterium avium subsp. paratuberculosis
cuucuucgccgcagccuucu

SEQ ID NO: 2839617 - RNA, 14 nt, Mycobacterium avium subsp. paratuberculosis
cuucuucgccggcg

SEQ ID NO: 2839618 - RNA, 19 nt, Mycobacterium avium subsp. paratuberculosis
cuucuucgcgggugccuuc

SEQ ID NO: 2839619 - RNA, 21 nt, Mycobacterium avium subsp. paratuberculosis
cuucuucgcgggugccuucuu

SEQ ID NO: 2839620 - RNA, 17 nt, Mycobacterium avium subsp. paratuberculosis
cuucuugaacagcgccg

SEQ ID NO: 2839621 - RNA, 21 nt, Mycobacterium avium subsp. paratuberculosis
cuucuugaccgcagccuucuu

SEQ ID NO: 2839622 - RNA, 14 nt, Mycobacterium avium subsp. paratuberculosis
cuucuuggccgcgc

SEQ ID NO: 2839623 - RNA, 19 nt, Mycobacterium avium subsp. paratuberculosis
cuucuuggccgcgccgccg

SEQ ID NO: 2839624 - RNA, 15 nt, Mycobacterium avium subsp. paratuberculosis
cuucuuggccgcggc

SEQ ID NO: 2839625 - RNA, 13 nt, Mycobacterium avium subsp. paratuberculosis
cuucuuggccgga

SEQ ID NO: 2839626 - RNA, 21 nt, Mycobacterium avium subsp. paratuberculosis
cuucuuggccggagccuucuu

SEQ ID NO: 2839627 - RNA, 13 nt, Mycobacterium avium subsp. paratuberculosis
cuucuuggcggcg

SEQ ID NO: 2839628 - RNA, 18 nt, Mycobacterium avium subsp. paratuberculosis
cuucuuggcggcggccuu

SEQ ID NO: 2839629 - RNA, 21 nt, Mycobacterium avium subsp. paratuberculosis
cuucuuggcggcggccuucuu

SEQ ID NO: 2839630 - RNA, 14 nt, Mycobacterium avium subsp. paratuberculosis
cuugaacagcaccc

SEQ ID NO: 2839631 - RNA, 18 nt, Mycobacterium avium subsp. paratuberculosis
cuugaacagcacccccuc

SEQ ID NO: 2839632 - RNA, 13 nt, Mycobacterium avium subsp. paratuberculosis
cuugaacgccgcc

SEQ ID NO: 2839633 - RNA, 16 nt, Mycobacterium avium subsp. paratuberculosis
cuugaacgccgccccc

SEQ ID NO: 2839634 - RNA, 18 nt, Mycobacterium avium subsp. paratuberculosis
cuugaacgccgcccccgc

SEQ ID NO: 2839635 - RNA, 22 nt, Mycobacterium avium subsp. paratuberculosis
cuugaacgcguacagcgcccgg

SEQ ID NO: 2839636 - RNA, 20 nt, Mycobacterium avium subsp. paratuberculosis
cuugaacggcgcgucguagu

SEQ ID NO: 2839637 - RNA, 15 nt, Mycobacterium avium subsp. paratuberculosis
cuugaacucggccag

SEQ ID NO: 2839638 - RNA, 14 nt, Mycobacterium avium subsp. paratuberculosis
cuugaagaaccggg

SEQ ID NO: 2839639 - RNA, 20 nt, Mycobacterium avium subsp. paratuberculosis
cuugaaggaggcggucgacu

SEQ ID NO: 2839640 - RNA, 15 nt, Mycobacterium avium subsp. paratuberculosis
cuugaagucggugug

SEQ ID NO: 2839641 - RNA, 19 nt, Mycobacterium avium subsp. paratuberculosis
cuugaaucgguucggccag

SEQ ID NO: 2839642 - RNA, 14 nt, Mycobacterium avium subsp. paratuberculosis
cuugaccacccggu

SEQ ID NO: 2839643 - RNA, 19 nt, Mycobacterium avium subsp. paratuberculosis
cuugaccaccgaccggcuc

SEQ ID NO: 2839644 - RNA, 17 nt, Mycobacterium avium subsp. paratuberculosis
cuugaccaccuuggccg

SEQ ID NO: 2839645 - RNA, 12 nt, Mycobacterium avium subsp. paratuberculosis
cuugaccagcaa

SEQ ID NO: 2839646 - RNA, 16 nt, Mycobacterium avium subsp. paratuberculosis
cuugaccagcaacacc

SEQ ID NO: 2839647 - RNA, 14 nt, Mycobacterium avium subsp. paratuberculosis
cuugaccagcugcg

SEQ ID NO: 2839648 - RNA, 13 nt, Mycobacterium avium subsp. paratuberculosis
cuugaccaggaug

SEQ ID NO: 2839649 - RNA, 22 nt, Mycobacterium avium subsp. paratuberculosis
cuugaccaggaugucuccgcgc

SEQ ID NO: 2839650 - RNA, 22 nt, Mycobacterium avium subsp. paratuberculosis
cuugaccaugaguugcgggucc

SEQ ID NO: 2839651 - RNA, 20 nt, Mycobacterium avium subsp. paratuberculosis
cuugacccgcaaggccgcca

SEQ ID NO: 2839652 - RNA, 23 nt, Mycobacterium avium subsp. paratuberculosis
cuugacccgcaaggccgccagcc

SEQ ID NO: 2839653 - RNA, 16 nt, Mycobacterium avium subsp. paratuberculosis
cuugacccgcuccagc

SEQ ID NO: 2839654 - RNA, 19 nt, Mycobacterium avium subsp. paratuberculosis
cuugacccgcuccagcggc

SEQ ID NO: 2839655 - RNA, 16 nt, Mycobacterium avium subsp. paratuberculosis
cuugacccggccgcac

SEQ ID NO: 2839656 - RNA, 14 nt, Mycobacterium avium subsp. paratuberculosis
cuugaccgcagccu

SEQ ID NO: 2839657 - RNA, 16 nt, Mycobacterium avium subsp. paratuberculosis
cuugaccgccugcuug

SEQ ID NO: 2839658 - RNA, 17 nt, Mycobacterium avium subsp. paratuberculosis
cuugaccggcucgccgg

SEQ ID NO: 2839659 - RNA, 18 nt, Mycobacterium avium subsp. paratuberculosis
cuugaccgggcuccagcg

SEQ ID NO: 2839660 - RNA, 13 nt, Mycobacterium avium subsp. paratuberculosis
cuugaccuugggc

SEQ ID NO: 2839661 - RNA, 20 nt, Mycobacterium avium subsp. paratuberculosis
cuugaccuugggcauccgcu

SEQ ID NO: 2839662 - RNA, 19 nt, Mycobacterium avium subsp. paratuberculosis
cuugacgaacgccaccacg

SEQ ID NO: 2839663 - RNA, 22 nt, Mycobacterium avium subsp. paratuberculosis
cuugacgaacuccugcucgcgg

SEQ ID NO: 2839664 - RNA, 17 nt, Mycobacterium avium subsp. paratuberculosis
cuugacgacggccaccg

SEQ ID NO: 2839665 - RNA, 17 nt, Mycobacterium avium subsp. paratuberculosis
cuuggcgggcgccuucu

SEQ ID NO: 2839666 - RNA, 19 nt, Mycobacterium avium subsp. paratuberculosis
cuuggcgggcgccuucuug

SEQ ID NO: 2839667 - RNA, 23 nt, Mycobacterium avium subsp. paratuberculosis
cuuggcgggcgccuucuuggccg

SEQ ID NO: 2839668 - RNA, 16 nt, Mycobacterium avium subsp. paratuberculosis
cuuggcguaguggugc

SEQ ID NO: 2839669 - RNA, 20 nt, Mycobacterium avium subsp. paratuberculosis
cuuggcguauucggcgcgca

SEQ ID NO: 2839670 - RNA, 21 nt, Mycobacterium avium subsp. paratuberculosis
cuuggcguauucggcgcgcaa

SEQ ID NO: 2839671 - RNA, 13 nt, Mycobacterium avium subsp. paratuberculosis
cuuggcgucgauc

SEQ ID NO: 2839672 - RNA, 16 nt, Mycobacterium avium subsp. paratuberculosis
cuuggcgucgaucagc

SEQ ID NO: 2839673 - RNA, 19 nt, Mycobacterium avium subsp. paratuberculosis
cuuggcgucgaucagcgcg

SEQ ID NO: 2839674 - RNA, 21 nt, Mycobacterium avium subsp. paratuberculosis
cuuggcgucgaucagcgcgcc

SEQ ID NO: 2839675 - RNA, 23 nt, Mycobacterium avium subsp. paratuberculosis
cuuggcgucgaucagcgcgccgc

SEQ ID NO: 2839676 - RNA, 20 nt, Mycobacterium avium subsp. paratuberculosis
cuuggcguugaugucggcca

SEQ ID NO: 2839677 - RNA, 15 nt, Mycobacterium avium subsp. paratuberculosis
cuugggaaugucgua

SEQ ID NO: 2839678 - RNA, 15 nt, Mycobacterium avium subsp. paratuberculosis
cuugggagacuucca

SEQ ID NO: 2839679 - RNA, 15 nt, Mycobacterium avium subsp. paratuberculosis
cuugggcacguacgc

SEQ ID NO: 2839680 - RNA, 14 nt, Mycobacterium avium subsp. paratuberculosis
cuugggcagcagcu

SEQ ID NO: 2839681 - RNA, 17 nt, Mycobacterium avium subsp. paratuberculosis
cuugggcagcagcucga

SEQ ID NO: 2839682 - RNA, 21 nt, Mycobacterium avium subsp. paratuberculosis
cuugggcauggugaagcccag

SEQ ID NO: 2839683 - RNA, 13 nt, Mycobacterium avium subsp. paratuberculosis
cuugggccggucg

SEQ ID NO: 2839684 - RNA, 15 nt, Mycobacterium avium subsp. paratuberculosis
cuugggccggugcag

SEQ ID NO: 2839685 - RNA, 18 nt, Mycobacterium avium subsp. paratuberculosis
cuugggccggugcagcac

SEQ ID NO: 2839686 - RNA, 22 nt, Mycobacterium avium subsp. paratuberculosis
cuugggcgaaucugucgauggc

SEQ ID NO: 2839687 - RNA, 13 nt, Mycobacterium avium subsp. paratuberculosis
cuugggcucggcg

SEQ ID NO: 2839688 - RNA, 22 nt, Mycobacterium avium subsp. paratuberculosis
cuuggggaugguccccgggccc

SEQ ID NO: 2839689 - RNA, 16 nt, Mycobacterium avium subsp. paratuberculosis
cuugggggccgacgcu

SEQ ID NO: 2839690 - RNA, 22 nt, Mycobacterium avium subsp. paratuberculosis
cuugggucccaucgcugccacg

SEQ ID NO: 2839691 - RNA, 13 nt, Mycobacterium avium subsp. paratuberculosis
cuugggucgccgg

SEQ ID NO: 2839692 - RNA, 15 nt, Mycobacterium avium subsp. paratuberculosis
cuugggucgccgggu

SEQ ID NO: 2839693 - RNA, 22 nt, Mycobacterium avium subsp. paratuberculosis
cuugggugagcuaucagcucgc

SEQ ID NO: 2839694 - RNA, 15 nt, Mycobacterium avium subsp. paratuberculosis
cuugguagaugcguu

SEQ ID NO: 2839695 - RNA, 21 nt, Mycobacterium avium subsp. paratuberculosis
cuugguagaugcguuccaggu

SEQ ID NO: 2839696 - RNA, 22 nt, Mycobacterium avium subsp. paratuberculosis
cuugguagaugcguuccaggug

SEQ ID NO: 2839697 - RNA, 16 nt, Mycobacterium avium subsp. paratuberculosis
cuuggucacaaagccc

SEQ ID NO: 2839698 - RNA, 18 nt, Mycobacterium avium subsp. paratuberculosis
cuuggucacaaagcccgg

SEQ ID NO: 2839699 - RNA, 14 nt, Mycobacterium avium subsp. paratuberculosis
cuuggucagccgcg

SEQ ID NO: 2839700 - RNA, 19 nt, Mycobacterium avium subsp. paratuberculosis
cuuggucagccgcggcggc

SEQ ID NO: 2839701 - RNA, 22 nt, Mycobacterium avium subsp. paratuberculosis
cuuggucagcgcggcccgcggc

SEQ ID NO: 2839702 - RNA, 15 nt, Mycobacterium avium subsp. paratuberculosis
cuuggucgcggccuu

SEQ ID NO: 2839703 - RNA, 18 nt, Mycobacterium avium subsp. paratuberculosis
cuuggucgcggccuucuu

SEQ ID NO: 2839704 - RNA, 20 nt, Mycobacterium avium subsp. paratuberculosis
cuuggucgcggccuucuugg

SEQ ID NO: 2839705 - RNA, 17 nt, Mycobacterium avium subsp. paratuberculosis
cuuggugaagaucgacg

SEQ ID NO: 2839706 - RNA, 17 nt, Mycobacterium avium subsp. paratuberculosis
cuuggugaaggacucca

SEQ ID NO: 2839707 - RNA, 19 nt, Mycobacterium avium subsp. paratuberculosis
cuuggugaugggcagcgcc

SEQ ID NO: 2839708 - RNA, 19 nt, Mycobacterium avium subsp. paratuberculosis
cuuggugcgagccaccucg

SEQ ID NO: 2839709 - RNA, 23 nt, Mycobacterium avium subsp. paratuberculosis
cuugguggccagcaccacguccg

SEQ ID NO: 2839710 - RNA, 13 nt, Mycobacterium avium subsp. paratuberculosis
cuugguggccgcg

SEQ ID NO: 2839711 - RNA, 20 nt, Mycobacterium avium subsp. paratuberculosis
cuugguggccgcggccgccu

SEQ ID NO: 2839712 - RNA, 14 nt, Mycobacterium avium subsp. paratuberculosis
cuugguggcgccgg

SEQ ID NO: 2839713 - RNA, 16 nt, Mycobacterium avium subsp. paratuberculosis
cuuguacaugucgucg

SEQ ID NO: 2839714 - RNA, 17 nt, Mycobacterium avium subsp. paratuberculosis
cuuguacaugucgucgc

SEQ ID NO: 2839715 - RNA, 17 nt, Mycobacterium avium subsp. paratuberculosis
cuuguaggucaucagcg

SEQ ID NO: 2839716 - RNA, 18 nt, Mycobacterium avium subsp. paratuberculosis
cuuguaggugaucguguu

SEQ ID NO: 2839717 - RNA, 14 nt, Mycobacterium avium subsp. paratuberculosis
cuugucaccgaacc

SEQ ID NO: 2839718 - RNA, 13 nt, Mycobacterium avium subsp. paratuberculosis
cuugucagcggcc

SEQ ID NO: 2839719 - RNA, 15 nt, Mycobacterium avium subsp. paratuberculosis
cuugucagcggccuc

SEQ ID NO: 2839720 - RNA, 19 nt, Mycobacterium avium subsp. paratuberculosis
cuuguccaccauggcuucc

SEQ ID NO: 2839721 - RNA, 12 nt, Mycobacterium avium subsp. paratuberculosis
cuuguccaggau

SEQ ID NO: 2839722 - RNA, 14 nt, Mycobacterium avium subsp. paratuberculosis
cuugucccagugcu

SEQ ID NO: 2839723 - RNA, 19 nt, Mycobacterium avium subsp. paratuberculosis
cuugucccagugcuugggc

SEQ ID NO: 2839724 - RNA, 14 nt, Mycobacterium avium subsp. paratuberculosis
cuuguccggcgucc

SEQ ID NO: 2839725 - RNA, 18 nt, Mycobacterium avium subsp. paratuberculosis
cuuguccuuguuggccuc

SEQ ID NO: 2839726 - RNA, 14 nt, Mycobacterium avium subsp. paratuberculosis
cuugucgcagaccc

SEQ ID NO: 2839727 - RNA, 17 nt, Mycobacterium avium subsp. paratuberculosis
cuugucgcagacccucg

SEQ ID NO: 2839728 - RNA, 14 nt, Mycobacterium avium subsp. paratuberculosis
cuugucgcgcaccc

SEQ ID NO: 2839729 - RNA, 18 nt, Mycobacterium avium subsp. paratuberculosis
cuugucgcgcaccgcggc

SEQ ID NO: 2839730 - RNA, 18 nt, Mycobacterium avium subsp. paratuberculosis
cuugucgcugaccaccga

SEQ ID NO: 2839731 - RNA, 14 nt, Mycobacterium avium subsp. paratuberculosis
cuugucggcgagcu

SEQ ID NO: 2839732 - RNA, 14 nt, Mycobacterium avium subsp. paratuberculosis
cuugucggcgccca

SEQ ID NO: 2839733 - RNA, 16 nt, Mycobacterium avium subsp. paratuberculosis
cuugucggcgcccagg

SEQ ID NO: 2839734 - RNA, 15 nt, Mycobacterium avium subsp. paratuberculosis
cuugucgggccgcgg

SEQ ID NO: 2839735 - RNA, 17 nt, Mycobacterium avium subsp. paratuberculosis
cuugucgggccgcgggc

SEQ ID NO: 2839736 - RNA, 18 nt, Mycobacterium avium subsp. paratuberculosis
cuugucggggaagggcgc

SEQ ID NO: 2839737 - RNA, 16 nt, Mycobacterium avium subsp. paratuberculosis
cuuguggaaggcgccg

SEQ ID NO: 2839738 - RNA, 15 nt, Mycobacterium avium subsp. paratuberculosis
cuuguggcccaggcc

SEQ ID NO: 2839739 - RNA, 18 nt, Mycobacterium avium subsp. paratuberculosis
cuuguggcccaggccggc

SEQ ID NO: 2839740 - RNA, 20 nt, Mycobacterium avium subsp. paratuberculosis
cuuguggucgaugcccgcgc

SEQ ID NO: 2839741 - RNA, 18 nt, Mycobacterium avium subsp. paratuberculosis
cuuguuggucagccugau

SEQ ID NO: 2839742 - RNA, 17 nt, Mycobacterium avium subsp. paratuberculosis
cuuguuguuggugccgc

SEQ ID NO: 2839743 - RNA, 19 nt, Mycobacterium avium subsp. paratuberculosis
cuuuacgaggcgugcagcc

SEQ ID NO: 2839744 - RNA, 21 nt, Mycobacterium avium subsp. paratuberculosis
cuuuauucggcuucguaacac

SEQ ID NO: 2839745 - RNA, 14 nt, Mycobacterium avium subsp. paratuberculosis
cuuucaucgccccg

SEQ ID NO: 2839746 - RNA, 20 nt, Mycobacterium avium subsp. paratuberculosis
cuuucaucgccccggcgacg

SEQ ID NO: 2839747 - RNA, 15 nt, Mycobacterium avium subsp. paratuberculosis
cuuuccgcgcggcgg

SEQ ID NO: 2839748 - RNA, 20 nt, Mycobacterium avium subsp. paratuberculosis
cuuucgauuucgccugcagc

SEQ ID NO: 2839749 - RNA, 21 nt, Mycobacterium avium subsp. paratuberculosis
cuuucgcgcacgccaucgccu

SEQ ID NO: 2839750 - RNA, 12 nt, Mycobacterium avium subsp. paratuberculosis
gaaaggcagcag

SEQ ID NO: 2839751 - RNA, 14 nt, Mycobacterium avium subsp. paratuberculosis
gaaaggcagcagcc

SEQ ID NO: 2839752 - RNA, 18 nt, Mycobacterium avium subsp. paratuberculosis
gaaaggccagcacgcagg

SEQ ID NO: 2839753 - RNA, 16 nt, Mycobacterium avium subsp. paratuberculosis
gaaagggucugcgaag

SEQ ID NO: 2839754 - RNA, 15 nt, Mycobacterium avium subsp. paratuberculosis
gaaaguccgccgaca

SEQ ID NO: 2839755 - RNA, 21 nt, Mycobacterium avium subsp. paratuberculosis
gaaaguccgccgacagcggga

SEQ ID NO: 2839756 - RNA, 23 nt, Mycobacterium avium subsp. paratuberculosis
gaaaguccuugcugcccagggcg

SEQ ID NO: 2839757 - RNA, 14 nt, Mycobacterium avium subsp. paratuberculosis
gaaagugcaacugg

SEQ ID NO: 2839758 - RNA, 21 nt, Mycobacterium avium subsp. paratuberculosis
gaaaguuguagcgcagcauca

SEQ ID NO: 2839759 - RNA, 21 nt, Mycobacterium avium subsp. paratuberculosis
gaaauagccgcgccgcgguag

SEQ ID NO: 2839760 - RNA, 21 nt, Mycobacterium avium subsp. paratuberculosis
gaaauaggccgggcagugcgc

SEQ ID NO: 2839761 - RNA, 13 nt, Mycobacterium avium subsp. paratuberculosis
gaaaucaacgcgc

SEQ ID NO: 2839762 - RNA, 16 nt, Mycobacterium avium subsp. paratuberculosis
gaaauccacgaugccg

SEQ ID NO: 2839763 - RNA, 20 nt, Mycobacterium avium subsp. paratuberculosis
gaaauccacgaugccgggca

SEQ ID NO: 2839764 - RNA, 17 nt, Mycobacterium avium subsp. paratuberculosis
gaaauccggggucaggg

SEQ ID NO: 2839765 - RNA, 22 nt, Mycobacterium avium subsp. paratuberculosis
gaaauccggggucagggcgcuc

SEQ ID NO: 2839766 - RNA, 17 nt, Mycobacterium avium subsp. paratuberculosis
gaaaucgagcgcgcugu

SEQ ID NO: 2839767 - RNA, 13 nt, Mycobacterium avium subsp. paratuberculosis
gaaaucgcagacg

SEQ ID NO: 2839768 - RNA, 18 nt, Mycobacterium avium subsp. paratuberculosis
gaaaucggacccagcccg

SEQ ID NO: 2839769 - RNA, 16 nt, Mycobacterium avium subsp. paratuberculosis
gaaaucggguccagcg

SEQ ID NO: 2839770 - RNA, 22 nt, Mycobacterium avium subsp. paratuberculosis
gaaaucggguccagcgccgagc

SEQ ID NO: 2839771 - RNA, 13 nt, Mycobacterium avium subsp. paratuberculosis
gaaaucucucgac

SEQ ID NO: 2839772 - RNA, 22 nt, Mycobacterium avium subsp. paratuberculosis
gaaaucuucgccgucagugcgc

SEQ ID NO: 2839773 - RNA, 23 nt, Mycobacterium avium subsp. paratuberculosis
gaaaugcaacgcacgggcggcgg

SEQ ID NO: 2839774 - RNA, 13 nt, Mycobacterium avium subsp. paratuberculosis
gaaaugcccgcgc

SEQ ID NO: 2839775 - RNA, 14 nt, Mycobacterium avium subsp. paratuberculosis
gaaaugccgugcca

SEQ ID NO: 2839776 - RNA, 17 nt, Mycobacterium avium subsp. paratuberculosis
gaaaugccgugccagcc

SEQ ID NO: 2839777 - RNA, 13 nt, Mycobacterium avium subsp. paratuberculosis
gaaaugccuuggc

SEQ ID NO: 2839778 - RNA, 23 nt, Mycobacterium avium subsp. paratuberculosis
gaaaugggccagguccucgcugg

SEQ ID NO: 2839779 - RNA, 20 nt, Mycobacterium avium subsp. paratuberculosis
gaaaugggccaugccggccu

SEQ ID NO: 2839780 - RNA, 22 nt, Mycobacterium avium subsp. paratuberculosis
gaaaugggccaugccggccuga

SEQ ID NO: 2839781 - RNA, 12 nt, Mycobacterium avium subsp. paratuberculosis
gaacaacagggc

SEQ ID NO: 2839782 - RNA, 13 nt, Mycobacterium avium subsp. paratuberculosis
gaacaacagggcc

SEQ ID NO: 2839783 - RNA, 14 nt, Mycobacterium avium subsp. paratuberculosis
gaacaacagggccg

SEQ ID NO: 2839784 - RNA, 16 nt, Mycobacterium avium subsp. paratuberculosis
gaacaacagggccgcg

SEQ ID NO: 2839785 - RNA, 15 nt, Mycobacterium avium subsp. paratuberculosis
gaacaacccggccgc

SEQ ID NO: 2839786 - RNA, 17 nt, Mycobacterium avium subsp. paratuberculosis
gaacaaccgcagcggcu

SEQ ID NO: 2839787 - RNA, 20 nt, Mycobacterium avium subsp. paratuberculosis
gaacaacgcggugaccgcgg

SEQ ID NO: 2839788 - RNA, 22 nt, Mycobacterium avium subsp. paratuberculosis
gaacaacggcggaccggcggcc

SEQ ID NO: 2839789 - RNA, 14 nt, Mycobacterium avium subsp. paratuberculosis
gaacaauagagggg

SEQ ID NO: 2839790 - RNA, 22 nt, Mycobacterium avium subsp. paratuberculosis
gaacaauuccucugcgcgccaa

SEQ ID NO: 2839791 - RNA, 13 nt, Mycobacterium avium subsp. paratuberculosis
gaacaccaccggc

SEQ ID NO: 2839792 - RNA, 14 nt, Mycobacterium avium subsp. paratuberculosis
gaacaccaccggca

SEQ ID NO: 2839793 - RNA, 13 nt, Mycobacterium avium subsp. paratuberculosis
gaacaccacggcc

SEQ ID NO: 2839794 - RNA, 17 nt, Mycobacterium avium subsp. paratuberculosis
gaacaccacggccggca

SEQ ID NO: 2839795 - RNA, 14 nt, Mycobacterium avium subsp. paratuberculosis
gaacaccacggugu

SEQ ID NO: 2839796 - RNA, 19 nt, Mycobacterium avium subsp. paratuberculosis
gaacaccacgucguccagc

SEQ ID NO: 2839797 - RNA, 13 nt, Mycobacterium avium subsp. paratuberculosis
gaacaccagcacc

SEQ ID NO: 2839798 - RNA, 18 nt, Mycobacterium avium subsp. paratuberculosis
gaacaccagcacccagca

SEQ ID NO: 2839799 - RNA, 16 nt, Mycobacterium avium subsp. paratuberculosis
gaacaccagcccggcc

SEQ ID NO: 2839800 - RNA, 14 nt, Mycobacterium avium subsp. paratuberculosis
gaacaccagcgcau

SEQ ID NO: 2839801 - RNA, 14 nt, Mycobacterium avium subsp. paratuberculosis
gaacaccccgcggg

SEQ ID NO: 2839802 - RNA, 21 nt, Mycobacterium avium subsp. paratuberculosis
gaacaccgaauuguccagcag

SEQ ID NO: 2839803 - RNA, 17 nt, Mycobacterium avium subsp. paratuberculosis
gaacaccgagccggcgg

SEQ ID NO: 2839804 - RNA, 15 nt, Mycobacterium avium subsp. paratuberculosis
gaacaccgcaccggu

SEQ ID NO: 2839805 - RNA, 20 nt, Mycobacterium avium subsp. paratuberculosis
gaacaccgcguuggccgcca

SEQ ID NO: 2839806 - RNA, 12 nt, Mycobacterium avium subsp. paratuberculosis
gaacaccggcag

SEQ ID NO: 2839807 - RNA, 20 nt, Mycobacterium avium subsp. paratuberculosis
gaacaccggcagcgccacca

SEQ ID NO: 2839808 - RNA, 17 nt, Mycobacterium avium subsp. paratuberculosis
gaacaccggcgcgacca

SEQ ID NO: 2839809 - RNA, 16 nt, Mycobacterium avium subsp. paratuberculosis
gaacaccugcggcggc

SEQ ID NO: 2839810 - RNA, 15 nt, Mycobacterium avium subsp. paratuberculosis
gaacacgaacccggc

SEQ ID NO: 2839811 - RNA, 16 nt, Mycobacterium avium subsp. paratuberculosis
gaacacgaacccggcg

SEQ ID NO: 2839812 - RNA, 19 nt, Mycobacterium avium subsp. paratuberculosis
gaacacgaacccggcggcc

SEQ ID NO: 2839813 - RNA, 14 nt, Mycobacterium avium subsp. paratuberculosis
gaacacgcaggugc

SEQ ID NO: 2839814 - RNA, 20 nt, Mycobacterium avium subsp. paratuberculosis
gaacacgcaggugcgccgcu

SEQ ID NO: 2839815 - RNA, 23 nt, Mycobacterium avium subsp. paratuberculosis
gaacacgcgaugaucagcucgcg

SEQ ID NO: 2839816 - RNA, 20 nt, Mycobacterium avium subsp. paratuberculosis
gaacacggccgccuccagca

SEQ ID NO: 2839817 - RNA, 22 nt, Mycobacterium avium subsp. paratuberculosis
gaacacggcucgggggccgcuc

SEQ ID NO: 2839818 - RNA, 22 nt, Mycobacterium avium subsp. paratuberculosis
gaacacgggcggcagggccagc

SEQ ID NO: 2839819 - RNA, 16 nt, Mycobacterium avium subsp. paratuberculosis
gaacacggucgccggc

SEQ ID NO: 2839820 - RNA, 16 nt, Mycobacterium avium subsp. paratuberculosis
gaacacgucggccagc

SEQ ID NO: 2839821 - RNA, 17 nt, Mycobacterium avium subsp. paratuberculosis
gaacacgucggccagcg

SEQ ID NO: 2839822 - RNA, 19 nt, Mycobacterium avium subsp. paratuberculosis
gaacacgucggccagcgcg

SEQ ID NO: 2839823 - RNA, 15 nt, Mycobacterium avium subsp. paratuberculosis
gaacacgugcagcuc

SEQ ID NO: 2839824 - RNA, 17 nt, Mycobacterium avium subsp. paratuberculosis
gaacacgugcagcucgg

SEQ ID NO: 2839825 - RNA, 21 nt, Mycobacterium avium subsp. paratuberculosis
gaacacguugcgcaucagcgc

SEQ ID NO: 2839826 - RNA, 22 nt, Mycobacterium avium subsp. paratuberculosis
gaacacguugcgcaucagcgcc

SEQ ID NO: 2839827 - RNA, 23 nt, Mycobacterium avium subsp. paratuberculosis
gaacacguuucggcccuccagca

SEQ ID NO: 2839828 - RNA, 13 nt, Mycobacterium avium subsp. paratuberculosis
gaacagacacagc

SEQ ID NO: 2839829 - RNA, 18 nt, Mycobacterium avium subsp. paratuberculosis
gaacagacacagcacgcc

SEQ ID NO: 2839830 - RNA, 16 nt, Mycobacterium avium subsp. paratuberculosis
gaacagacucagcccg

SEQ ID NO: 2839831 - RNA, 18 nt, Mycobacterium avium subsp. paratuberculosis
gaacagacucagcccggc

SEQ ID NO: 2839832 - RNA, 14 nt, Mycobacterium avium subsp. paratuberculosis
gaacagcacccccu

SEQ ID NO: 2839833 - RNA, 13 nt, Mycobacterium avium subsp. paratuberculosis
gaacagcaccgcc

SEQ ID NO: 2839834 - RNA, 14 nt, Mycobacterium avium subsp. paratuberculosis
gaacagcaccgcca

SEQ ID NO: 2839835 - RNA, 15 nt, Mycobacterium avium subsp. paratuberculosis
gaacauggcggccag

SEQ ID NO: 2839836 - RNA, 16 nt, Mycobacterium avium subsp. paratuberculosis
gaacauggcggccagc

SEQ ID NO: 2839837 - RNA, 22 nt, Mycobacterium avium subsp. paratuberculosis
gaacauggucgcccacaccgga

SEQ ID NO: 2839838 - RNA, 12 nt, Mycobacterium avium subsp. paratuberculosis
gaaccaacgcgg

SEQ ID NO: 2839839 - RNA, 14 nt, Mycobacterium avium subsp. paratuberculosis
gaaccaacgcggcg

SEQ ID NO: 2839840 - RNA, 19 nt, Mycobacterium avium subsp. paratuberculosis
gaaccaacugagcgcggcg

SEQ ID NO: 2839841 - RNA, 13 nt, Mycobacterium avium subsp. paratuberculosis
gaaccacaccccg

SEQ ID NO: 2839842 - RNA, 15 nt, Mycobacterium avium subsp. paratuberculosis
gaaccacaccccggc

SEQ ID NO: 2839843 - RNA, 19 nt, Mycobacterium avium subsp. paratuberculosis
gaaccacaccccggccacc

SEQ ID NO: 2839844 - RNA, 15 nt, Mycobacterium avium subsp. paratuberculosis
gaaccaccggaaggc

SEQ ID NO: 2839845 - RNA, 20 nt, Mycobacterium avium subsp. paratuberculosis
gaaccaccggaaggccaggu

SEQ ID NO: 2839846 - RNA, 20 nt, Mycobacterium avium subsp. paratuberculosis
gaaccaccugggcgucgucg

SEQ ID NO: 2839847 - RNA, 15 nt, Mycobacterium avium subsp. paratuberculosis
gaaccacgcggcggc

SEQ ID NO: 2839848 - RNA, 18 nt, Mycobacterium avium subsp. paratuberculosis
gaaccacgcggcggcggu

SEQ ID NO: 2839849 - RNA, 19 nt, Mycobacterium avium subsp. paratuberculosis
gaaccacuucuggcgcugc

SEQ ID NO: 2839850 - RNA, 16 nt, Mycobacterium avium subsp. paratuberculosis
gaaccagcaccgccgc

SEQ ID NO: 2839851 - RNA, 19 nt, Mycobacterium avium subsp. paratuberculosis
gaaccagcaccgccgcggc

SEQ ID NO: 2839852 - RNA, 20 nt, Mycobacterium avium subsp. paratuberculosis
gaaccagcaccgccgcggcc

SEQ ID NO: 2839853 - RNA, 20 nt, Mycobacterium avium subsp. paratuberculosis
gaaccagcaugcgccagagc

SEQ ID NO: 2839854 - RNA, 16 nt, Mycobacterium avium subsp. paratuberculosis
gaaccagcccggcccg

SEQ ID NO: 2839855 - RNA, 18 nt, Mycobacterium avium subsp. paratuberculosis
gaaccagcucgugcagcu

SEQ ID NO: 2839856 - RNA, 19 nt, Mycobacterium avium subsp. paratuberculosis
gaaccaggccgcgcuggcg

SEQ ID NO: 2839857 - RNA, 21 nt, Mycobacterium avium subsp. paratuberculosis
gaaccaggccgcgcuggcgca

SEQ ID NO: 2839858 - RNA, 22 nt, Mycobacterium avium subsp. paratuberculosis
gaaccaggccgcgcuggcgcag

SEQ ID NO: 2839859 - RNA, 20 nt, Mycobacterium avium subsp. paratuberculosis
gaaccaggcgccggccagca

SEQ ID NO: 2839860 - RNA, 16 nt, Mycobacterium avium subsp. paratuberculosis
gaaccagggcagccag

SEQ ID NO: 2839861 - RNA, 17 nt, Mycobacterium avium subsp. paratuberculosis
gaaccagggcagccagc

SEQ ID NO: 2839862 - RNA, 18 nt, Mycobacterium avium subsp. paratuberculosis
gaaccagggcagccagcc

SEQ ID NO: 2839863 - RNA, 20 nt, Mycobacterium avium subsp. paratuberculosis
gaaccagggcagccagcccg

SEQ ID NO: 2839864 - RNA, 17 nt, Mycobacterium avium subsp. paratuberculosis
gaaccaguucgccacca

SEQ ID NO: 2839865 - RNA, 17 nt, Mycobacterium avium subsp. paratuberculosis
gaaccauuugcccagca

SEQ ID NO: 2839866 - RNA, 21 nt, Mycobacterium avium subsp. paratuberculosis
gaaccauuugcccagcagggc

SEQ ID NO: 2839867 - RNA, 17 nt, Mycobacterium avium subsp. paratuberculosis
gaacccaccagcgccug

SEQ ID NO: 2839868 - RNA, 13 nt, Mycobacterium avium subsp. paratuberculosis
gaacccagcaccc

SEQ ID NO: 2839869 - RNA, 15 nt, Mycobacterium avium subsp. paratuberculosis
gaacccagcaccccg

SEQ ID NO: 2839870 - RNA, 16 nt, Mycobacterium avium subsp. paratuberculosis
gaacccccucgcgcaa

SEQ ID NO: 2839871 - RNA, 16 nt, Mycobacterium avium subsp. paratuberculosis
gaacccgaacgcgucg

SEQ ID NO: 2839872 - RNA, 16 nt, Mycobacterium avium subsp. paratuberculosis
gaacccgaccccggcg

SEQ ID NO: 2839873 - RNA, 18 nt, Mycobacterium avium subsp. paratuberculosis
gaacccgaccccggcgag

SEQ ID NO: 2839874 - RNA, 22 nt, Mycobacterium avium subsp. paratuberculosis
gaacccgccagggcgacgccgc

SEQ ID NO: 2839875 - RNA, 16 nt, Mycobacterium avium subsp. paratuberculosis
gaacccgcccucgccc

SEQ ID NO: 2839876 - RNA, 13 nt, Mycobacterium avium subsp. paratuberculosis
gaacccgccggcg

SEQ ID NO: 2839877 - RNA, 24 nt, Mycobacterium avium subsp. paratuberculosis
gaacccgccggcgaacgacgucga

SEQ ID NO: 2839878 - RNA, 12 nt, Mycobacterium avium subsp. paratuberculosis
gaacccggcggc

SEQ ID NO: 2839879 - RNA, 12 nt, Mycobacterium avium subsp. paratuberculosis
gaacccggcgug

SEQ ID NO: 2839880 - RNA, 21 nt, Mycobacterium avium subsp. paratuberculosis
gaacccggcgugcuccagcag

SEQ ID NO: 2839881 - RNA, 23 nt, Mycobacterium avium subsp. paratuberculosis
gaacccggcgugcuccagcaggc

SEQ ID NO: 2839882 - RNA, 18 nt, Mycobacterium avium subsp. paratuberculosis
gaacccgggcgcgcccac

SEQ ID NO: 2839883 - RNA, 18 nt, Mycobacterium avium subsp. paratuberculosis
gaacccggguggcccgca

SEQ ID NO: 2839884 - RNA, 19 nt, Mycobacterium avium subsp. paratuberculosis
gaacccggguggcccgcac

SEQ ID NO: 2839885 - RNA, 20 nt, Mycobacterium avium subsp. paratuberculosis
gaacccguggauggacgccc

SEQ ID NO: 2839886 - RNA, 21 nt, Mycobacterium avium subsp. paratuberculosis
gaacccguggauggacgccca

SEQ ID NO: 2839887 - RNA, 23 nt, Mycobacterium avium subsp. paratuberculosis
gaacccguggauggacgcccaga

SEQ ID NO: 2839888 - RNA, 13 nt, Mycobacterium avium subsp. paratuberculosis
gaacccugcccca

SEQ ID NO: 2839889 - RNA, 21 nt, Mycobacterium avium subsp. paratuberculosis
gaacccugccccacggcccgg

SEQ ID NO: 2839890 - RNA, 19 nt, Mycobacterium avium subsp. paratuberculosis
gaacccugggcggcgacac

SEQ ID NO: 2839891 - RNA, 21 nt, Mycobacterium avium subsp. paratuberculosis
gaacccugggcggcgacacgc

SEQ ID NO: 2839892 - RNA, 21 nt, Mycobacterium avium subsp. paratuberculosis
gaaccgaaucggucgaccagc

SEQ ID NO: 2839893 - RNA, 23 nt, Mycobacterium avium subsp. paratuberculosis
gaaccgaaucggucgaccagcuc

SEQ ID NO: 2839894 - RNA, 20 nt, Mycobacterium avium subsp. paratuberculosis
gaaccgacaccucgccgucc

SEQ ID NO: 2839895 - RNA, 22 nt, Mycobacterium avium subsp. paratuberculosis
gaaccgaucaccggcagcagcg

SEQ ID NO: 2839896 - RNA, 19 nt, Mycobacterium avium subsp. paratuberculosis
gaaccgcaacaccagcacg

SEQ ID NO: 2839897 - RNA, 13 nt, Mycobacterium avium subsp. paratuberculosis
gaaccgcaccccg

SEQ ID NO: 2839898 - RNA, 16 nt, Mycobacterium avium subsp. paratuberculosis
gaaccgcccgcccggc

SEQ ID NO: 2839899 - RNA, 19 nt, Mycobacterium avium subsp. paratuberculosis
gaaccgcccgcccggcacg

SEQ ID NO: 2839900 - RNA, 16 nt, Mycobacterium avium subsp. paratuberculosis
gaaccgcccuuccagc

SEQ ID NO: 2839901 - RNA, 17 nt, Mycobacterium avium subsp. paratuberculosis
gaaccgcccuuccagca

SEQ ID NO: 2839902 - RNA, 14 nt, Mycobacterium avium subsp. paratuberculosis
gaaccgccgcaccc

SEQ ID NO: 2839903 - RNA, 17 nt, Mycobacterium avium subsp. paratuberculosis
gaaccgccgcacccagc

SEQ ID NO: 2839904 - RNA, 15 nt, Mycobacterium avium subsp. paratuberculosis
gaaccgccgcgcucg

SEQ ID NO: 2839905 - RNA, 23 nt, Mycobacterium avium subsp. paratuberculosis
gaaccgccgcgcucgcaccagcg

SEQ ID NO: 2839906 - RNA, 14 nt, Mycobacterium avium subsp. paratuberculosis
gaaccgcgacgcga

SEQ ID NO: 2839907 - RNA, 16 nt, Mycobacterium avium subsp. paratuberculosis
gaaccgcgacgcgauc

SEQ ID NO: 2839908 - RNA, 18 nt, Mycobacterium avium subsp. paratuberculosis
gaaccgcgagcagacgcg

SEQ ID NO: 2839909 - RNA, 17 nt, Mycobacterium avium subsp. paratuberculosis
gaaccgcgagcgcgcgg

SEQ ID NO: 2839910 - RNA, 15 nt, Mycobacterium avium subsp. paratuberculosis
gaaccgcgcacucga

SEQ ID NO: 2839911 - RNA, 14 nt, Mycobacterium avium subsp. paratuberculosis
gaaccgcgccuucg

SEQ ID NO: 2839912 - RNA, 20 nt, Mycobacterium avium subsp. paratuberculosis
gaaccgcggcggcagcagcc

SEQ ID NO: 2839913 - RNA, 23 nt, Mycobacterium avium subsp. paratuberculosis
gaaccgcguccacgaccccggcg

SEQ ID NO: 2839914 - RNA, 14 nt, Mycobacterium avium subsp. paratuberculosis
gaaccgcuccccga

SEQ ID NO: 2839915 - RNA, 20 nt, Mycobacterium avium subsp. paratuberculosis
gaaccgcucgaacacccggc

SEQ ID NO: 2839916 - RNA, 23 nt, Mycobacterium avium subsp. paratuberculosis
gaaccgcucgauggcgccgaucg

SEQ ID NO: 2839917 - RNA, 17 nt, Mycobacterium avium subsp. paratuberculosis
gaaccgcucggcggcgc

SEQ ID NO: 2839918 - RNA, 22 nt, Mycobacterium avium subsp. paratuberculosis
gaaccgcucggcggcgccgucg

SEQ ID NO: 2839919 - RNA, 22 nt, Mycobacterium avium subsp. paratuberculosis
gaacgccaccaccuccucgcgg

SEQ ID NO: 2839920 - RNA, 20 nt, Mycobacterium avium subsp. paratuberculosis
gaacgccaccuucaccgcgc

SEQ ID NO: 2839921 - RNA, 22 nt, Mycobacterium avium subsp. paratuberculosis
gaacgccaccuucaccgcgccg

SEQ ID NO: 2839922 - RNA, 13 nt, Mycobacterium avium subsp. paratuberculosis
gaacgccagcagc

SEQ ID NO: 2839923 - RNA, 15 nt, Mycobacterium avium subsp. paratuberculosis
gaacgccagcagccg

SEQ ID NO: 2839924 - RNA, 17 nt, Mycobacterium avium subsp. paratuberculosis
gaacgccagcagccgca

SEQ ID NO: 2839925 - RNA, 18 nt, Mycobacterium avium subsp. paratuberculosis
gaacgccagcagccgcag

SEQ ID NO: 2839926 - RNA, 13 nt, Mycobacterium avium subsp. paratuberculosis
gaacgccagcgcc

SEQ ID NO: 2839927 - RNA, 14 nt, Mycobacterium avium subsp. paratuberculosis
gaacgccagcgccg

SEQ ID NO: 2839928 - RNA, 20 nt, Mycobacterium avium subsp. paratuberculosis
gaacgccagcgccgcaacgg

SEQ ID NO: 2839929 - RNA, 19 nt, Mycobacterium avium subsp. paratuberculosis
gaacgccaucaccagcgcg

SEQ ID NO: 2839930 - RNA, 20 nt, Mycobacterium avium subsp. paratuberculosis
gaacgccccguggaucaucc

SEQ ID NO: 2839931 - RNA, 23 nt, Mycobacterium avium subsp. paratuberculosis
gaacgcccgaucugggaucggug

SEQ ID NO: 2839932 - RNA, 16 nt, Mycobacterium avium subsp. paratuberculosis
gaacgcccgcaacucc

SEQ ID NO: 2839933 - RNA, 14 nt, Mycobacterium avium subsp. paratuberculosis
gaacgcccgcacca

SEQ ID NO: 2839934 - RNA, 17 nt, Mycobacterium avium subsp. paratuberculosis
gaacgcccgcaccacga

SEQ ID NO: 2839935 - RNA, 19 nt, Mycobacterium avium subsp. paratuberculosis
gaacgccgaggaggccgcg

SEQ ID NO: 2839936 - RNA, 18 nt, Mycobacterium avium subsp. paratuberculosis
gaacgccgaucaccgcgu

SEQ ID NO: 2839937 - RNA, 18 nt, Mycobacterium avium subsp. paratuberculosis
gaacgccgaucaccggca

SEQ ID NO: 2839938 - RNA, 23 nt, Mycobacterium avium subsp. paratuberculosis
gaacgccgcauacaccuugucgg

SEQ ID NO: 2839939 - RNA, 17 nt, Mycobacterium avium subsp. paratuberculosis
gaacgccgcccccgccc

SEQ ID NO: 2839940 - RNA, 18 nt, Mycobacterium avium subsp. paratuberculosis
gaacgccgcguccucguc

SEQ ID NO: 2839941 - RNA, 19 nt, Mycobacterium avium subsp. paratuberculosis
gaacgccgcguccucgucg

SEQ ID NO: 2839942 - RNA, 20 nt, Mycobacterium avium subsp. paratuberculosis
gaacgccggauuggcgucgg

SEQ ID NO: 2839943 - RNA, 21 nt, Mycobacterium avium subsp. paratuberculosis
gaacgccggugagguggcgua

SEQ ID NO: 2839944 - RNA, 22 nt, Mycobacterium avium subsp. paratuberculosis
gaacgccuccgccgccccgucg

SEQ ID NO: 2839945 - RNA, 17 nt, Mycobacterium avium subsp. paratuberculosis
gaacgccucgagcgccc

SEQ ID NO: 2839946 - RNA, 19 nt, Mycobacterium avium subsp. paratuberculosis
gaacgccucgagcgcccgg

SEQ ID NO: 2839947 - RNA, 14 nt, Mycobacterium avium subsp. paratuberculosis
gaacgccucggcga

SEQ ID NO: 2839948 - RNA, 19 nt, Mycobacterium avium subsp. paratuberculosis
gaacgccucggcgagccgc

SEQ ID NO: 2839949 - RNA, 21 nt, Mycobacterium avium subsp. paratuberculosis
gaacgccucgggccggcagcc

SEQ ID NO: 2839950 - RNA, 20 nt, Mycobacterium avium subsp. paratuberculosis
gaacgccucgguggucgacg

SEQ ID NO: 2839951 - RNA, 14 nt, Mycobacterium avium subsp. paratuberculosis
gaacgccucguugg

SEQ ID NO: 2839952 - RNA, 23 nt, Mycobacterium avium subsp. paratuberculosis
gaacgccucguuggccagcucgg

SEQ ID NO: 2839953 - RNA, 12 nt, Mycobacterium avium subsp. paratuberculosis
gaacgccugccg

SEQ ID NO: 2839954 - RNA, 16 nt, Mycobacterium avium subsp. paratuberculosis
gaacgccugcgggaag

SEQ ID NO: 2839955 - RNA, 23 nt, Mycobacterium avium subsp. paratuberculosis
gaacgccuugcacacggccuugc

SEQ ID NO: 2839956 - RNA, 18 nt, Mycobacterium avium subsp. paratuberculosis
gaacgcgaaguccgacga

SEQ ID NO: 2839957 - RNA, 16 nt, Mycobacterium avium subsp. paratuberculosis
gaacgcgaccgucggg

SEQ ID NO: 2839958 - RNA, 20 nt, Mycobacterium avium subsp. paratuberculosis
gaacgcgaccugcaucucga

SEQ ID NO: 2839959 - RNA, 22 nt, Mycobacterium avium subsp. paratuberculosis
gaacgcgacgaucagcagccgg

SEQ ID NO: 2839960 - RNA, 18 nt, Mycobacterium avium subsp. paratuberculosis
gaacgcgccccgccggga

SEQ ID NO: 2839961 - RNA, 14 nt, Mycobacterium avium subsp. paratuberculosis
gaacgcgcccggcg

SEQ ID NO: 2839962 - RNA, 15 nt, Mycobacterium avium subsp. paratuberculosis
gaacgcgcccggcgg

SEQ ID NO: 2839963 - RNA, 16 nt, Mycobacterium avium subsp. paratuberculosis
gaacgcgccgccgagc

SEQ ID NO: 2839964 - RNA, 22 nt, Mycobacterium avium subsp. paratuberculosis
gaacgcgccgggcaacagcgcg

SEQ ID NO: 2839965 - RNA, 23 nt, Mycobacterium avium subsp. paratuberculosis
gaacgcgccgggcaacagcgcgc

SEQ ID NO: 2839966 - RNA, 22 nt, Mycobacterium avium subsp. paratuberculosis
gaacgcgccggugaccccgucg

SEQ ID NO: 2839967 - RNA, 13 nt, Mycobacterium avium subsp. paratuberculosis
gaacgcgccgucg

SEQ ID NO: 2839968 - RNA, 14 nt, Mycobacterium avium subsp. paratuberculosis
gaacgcgccgucgu

SEQ ID NO: 2839969 - RNA, 21 nt, Mycobacterium avium subsp. paratuberculosis
gaacgcgcggaugcccaggcc

SEQ ID NO: 2839970 - RNA, 14 nt, Mycobacterium avium subsp. paratuberculosis
gaacgcgcgggugc

SEQ ID NO: 2839971 - RNA, 20 nt, Mycobacterium avium subsp. paratuberculosis
gaacgcgcggucgucgcccg

SEQ ID NO: 2839972 - RNA, 23 nt, Mycobacterium avium subsp. paratuberculosis
gaacgcgcugucgcccucgaucg

SEQ ID NO: 2839973 - RNA, 14 nt, Mycobacterium avium subsp. paratuberculosis
gaacgcggacagcu

SEQ ID NO: 2839974 - RNA, 15 nt, Mycobacterium avium subsp. paratuberculosis
gaacgcggacagcuc

SEQ ID NO: 2839975 - RNA, 18 nt, Mycobacterium avium subsp. paratuberculosis
gaacgcggccagcgggcc

SEQ ID NO: 2839976 - RNA, 13 nt, Mycobacterium avium subsp. paratuberculosis
gaacgcggccagg

SEQ ID NO: 2839977 - RNA, 16 nt, Mycobacterium avium subsp. paratuberculosis
gaacgcggccgccagc

SEQ ID NO: 2839978 - RNA, 20 nt, Mycobacterium avium subsp. paratuberculosis
gaacgcggccgccagcgcac

SEQ ID NO: 2839979 - RNA, 22 nt, Mycobacterium avium subsp. paratuberculosis
gaacgcggcgaaggccagcgau

SEQ ID NO: 2839980 - RNA, 12 nt, Mycobacterium avium subsp. paratuberculosis
gaacgcggcgga

SEQ ID NO: 2839981 - RNA, 19 nt, Mycobacterium avium subsp. paratuberculosis
gaacgcggugagcgugccg

SEQ ID NO: 2839982 - RNA, 12 nt, Mycobacterium avium subsp. paratuberculosis
gaacgcgguggg

SEQ ID NO: 2839983 - RNA, 16 nt, Mycobacterium avium subsp. paratuberculosis
gaacgcggugggcacc

SEQ ID NO: 2839984 - RNA, 21 nt, Mycobacterium avium subsp. paratuberculosis
gaacgcggugggcaccagcag

SEQ ID NO: 2839985 - RNA, 20 nt, Mycobacterium avium subsp. paratuberculosis
gaacgcgguuuugaugccgc

SEQ ID NO: 2839986 - RNA, 19 nt, Mycobacterium avium subsp. paratuberculosis
gaacgcguacacggcccgc

SEQ ID NO: 2839987 - RNA, 16 nt, Mycobacterium avium subsp. paratuberculosis
gaacgcguacagcgcc

SEQ ID NO: 2839988 - RNA, 17 nt, Mycobacterium avium subsp. paratuberculosis
gaacgcgucgaccgccg

SEQ ID NO: 2839989 - RNA, 18 nt, Mycobacterium avium subsp. paratuberculosis
gaacgcgucgaccgccgc

SEQ ID NO: 2839990 - RNA, 19 nt, Mycobacterium avium subsp. paratuberculosis
gaacgcgucgaccgccgcg

SEQ ID NO: 2839991 - RNA, 15 nt, Mycobacterium avium subsp. paratuberculosis
gaacgcgucgcccac

SEQ ID NO: 2839992 - RNA, 15 nt, Mycobacterium avium subsp. paratuberculosis
gaacgcgucgccgug

SEQ ID NO: 2839993 - RNA, 14 nt, Mycobacterium avium subsp. paratuberculosis
gaacgcgucgcgcc

SEQ ID NO: 2839994 - RNA, 15 nt, Mycobacterium avium subsp. paratuberculosis
gaacgcgucgcgcca

SEQ ID NO: 2839995 - RNA, 18 nt, Mycobacterium avium subsp. paratuberculosis
gaacgcgucgcgccagcg

SEQ ID NO: 2839996 - RNA, 22 nt, Mycobacterium avium subsp. paratuberculosis
gaacgcgucguugucgucgccg

SEQ ID NO: 2839997 - RNA, 14 nt, Mycobacterium avium subsp. paratuberculosis
gaacgcguucgucg

SEQ ID NO: 2839998 - RNA, 15 nt, Mycobacterium avium subsp. paratuberculosis
gaacgcguucgucgg

SEQ ID NO: 2839999 - RNA, 17 nt, Mycobacterium avium subsp. paratuberculosis
gaacgcguucgucggcg

SEQ ID NO: 2840000 - RNA, 20 nt, Mycobacterium avium subsp. paratuberculosis
gaacgcugccaggcgguggc

SEQ ID NO: 2840001 - RNA, 16 nt, Mycobacterium avium subsp. paratuberculosis
gaacggcaaccugggc

SEQ ID NO: 2840002 - RNA, 17 nt, Mycobacterium avium subsp. paratuberculosis
gaacggcaaccugggcg

SEQ ID NO: 2840003 - RNA, 14 nt, Mycobacterium avium subsp. paratuberculosis
gaacucggcgccgc

SEQ ID NO: 2840004 - RNA, 15 nt, Mycobacterium avium subsp. paratuberculosis
gaacucggcgccgcc

SEQ ID NO: 2840005 - RNA, 20 nt, Mycobacterium avium subsp. paratuberculosis
gaacucggcgccgccggucg

SEQ ID NO: 2840006 - RNA, 15 nt, Mycobacterium avium subsp. paratuberculosis
gaacucggcggcggu

SEQ ID NO: 2840007 - RNA, 19 nt, Mycobacterium avium subsp. paratuberculosis
gaacucgggauuggacagc

SEQ ID NO: 2840008 - RNA, 16 nt, Mycobacterium avium subsp. paratuberculosis
gaacucggugaugccg

SEQ ID NO: 2840009 - RNA, 13 nt, Mycobacterium avium subsp. paratuberculosis
gaacucgucgacg

SEQ ID NO: 2840010 - RNA, 19 nt, Mycobacterium avium subsp. paratuberculosis
gaacucgucgacgcccacc

SEQ ID NO: 2840011 - RNA, 17 nt, Mycobacterium avium subsp. paratuberculosis
gaacucgucgccaccga

SEQ ID NO: 2840012 - RNA, 19 nt, Mycobacterium avium subsp. paratuberculosis
gaacucguggauguugucg

SEQ ID NO: 2840013 - RNA, 20 nt, Mycobacterium avium subsp. paratuberculosis
gaacugaagcuucaagauag

SEQ ID NO: 2840014 - RNA, 20 nt, Mycobacterium avium subsp. paratuberculosis
gaacugcaccagcacgacac

SEQ ID NO: 2840015 - RNA, 23 nt, Mycobacterium avium subsp. paratuberculosis
gaacugcaccagcacgacaccga

SEQ ID NO: 2840016 - RNA, 12 nt, Mycobacterium avium subsp. paratuberculosis
gaacugcagccc

SEQ ID NO: 2840017 - RNA, 13 nt, Mycobacterium avium subsp. paratuberculosis
gaacugcagcccg

SEQ ID NO: 2840018 - RNA, 14 nt, Mycobacterium avium subsp. paratuberculosis
gaacugcagccggc

SEQ ID NO: 2840019 - RNA, 23 nt, Mycobacterium avium subsp. paratuberculosis
gaacugcagcgacuggcccucgg

SEQ ID NO: 2840020 - RNA, 19 nt, Mycobacterium avium subsp. paratuberculosis
gaacugccgaugcugagcg

SEQ ID NO: 2840021 - RNA, 11 nt, Mycobacterium avium subsp. paratuberculosis
gaacugccgcg

SEQ ID NO: 2840022 - RNA, 20 nt, Mycobacterium avium subsp. paratuberculosis
gaacugcgguaugccaagcc

SEQ ID NO: 2840023 - RNA, 16 nt, Mycobacterium avium subsp. paratuberculosis
gaacugcucgaccagc

SEQ ID NO: 2840024 - RNA, 19 nt, Mycobacterium avium subsp. paratuberculosis
gaacugcucgaccagcgcc

SEQ ID NO: 2840025 - RNA, 20 nt, Mycobacterium avium subsp. paratuberculosis
gaacugcucgaccagcgccg

SEQ ID NO: 2840026 - RNA, 21 nt, Mycobacterium avium subsp. paratuberculosis
gaacugggccgccgucgccac

SEQ ID NO: 2840027 - RNA, 12 nt, Mycobacterium avium subsp. paratuberculosis
gaacugggugcc

SEQ ID NO: 2840028 - RNA, 17 nt, Mycobacterium avium subsp. paratuberculosis
gaacugggugccccgcc

SEQ ID NO: 2840029 - RNA, 18 nt, Mycobacterium avium subsp. paratuberculosis
gaacugggugggcagcgg

SEQ ID NO: 2840030 - RNA, 19 nt, Mycobacterium avium subsp. paratuberculosis
gaacugggugggcagcgga

SEQ ID NO: 2840031 - RNA, 19 nt, Mycobacterium avium subsp. paratuberculosis
gaacuggucgaacagcgcg

SEQ ID NO: 2840032 - RNA, 18 nt, Mycobacterium avium subsp. paratuberculosis
gaacugguuccacaccac

SEQ ID NO: 2840033 - RNA, 20 nt, Mycobacterium avium subsp. paratuberculosis
gaacugguuccacaccacca

SEQ ID NO: 2840034 - RNA, 12 nt, Mycobacterium avium subsp. paratuberculosis
gaacuguuuuuc

SEQ ID NO: 2840035 - RNA, 20 nt, Mycobacterium avium subsp. paratuberculosis
gaacuuaacuucacgcucgg

SEQ ID NO: 2840036 - RNA, 19 nt, Mycobacterium avium subsp. paratuberculosis
gaacuucaccgucugcugg

SEQ ID NO: 2840037 - RNA, 20 nt, Mycobacterium avium subsp. paratuberculosis
gaacuucaccgucugcuggc

SEQ ID NO: 2840038 - RNA, 16 nt, Mycobacterium avium subsp. paratuberculosis
gaacuucgccagcggg

SEQ ID NO: 2840039 - RNA, 17 nt, Mycobacterium avium subsp. paratuberculosis
gaacuucuccgccggca

SEQ ID NO: 2840040 - RNA, 15 nt, Mycobacterium avium subsp. paratuberculosis
gaacuugaucaccgc

SEQ ID NO: 2840041 - RNA, 16 nt, Mycobacterium avium subsp. paratuberculosis
gaacuugaucaccgcg

SEQ ID NO: 2840042 - RNA, 11 nt, Mycobacterium avium subsp. paratuberculosis
gaacuuggccg

SEQ ID NO: 2840043 - RNA, 20 nt, Mycobacterium avium subsp. paratuberculosis
gaacuugucgucgucggcga

SEQ ID NO: 2840044 - RNA, 16 nt, Mycobacterium avium subsp. paratuberculosis
gaagaacaccccgacc

SEQ ID NO: 2840045 - RNA, 20 nt, Mycobacterium avium subsp. paratuberculosis
gaagaaccgcaacaccagca

SEQ ID NO: 2840046 - RNA, 13 nt, Mycobacterium avium subsp. paratuberculosis
gaagaacgacgcc

SEQ ID NO: 2840047 - RNA, 20 nt, Mycobacterium avium subsp. paratuberculosis
gaagaacgacuggcggcggc

SEQ ID NO: 2840048 - RNA, 22 nt, Mycobacterium avium subsp. paratuberculosis
gaagaacggugucacguccacg

SEQ ID NO: 2840049 - RNA, 18 nt, Mycobacterium avium subsp. paratuberculosis
gaagaacucagccgaaga

SEQ ID NO: 2840050 - RNA, 18 nt, Mycobacterium avium subsp. paratuberculosis
gaagaagagggcgugacg

SEQ ID NO: 2840051 - RNA, 17 nt, Mycobacterium avium subsp. paratuberculosis
gaagaagauguugcggc

SEQ ID NO: 2840052 - RNA, 20 nt, Mycobacterium avium subsp. paratuberculosis
gaagaagauguugcggcggc

SEQ ID NO: 2840053 - RNA, 18 nt, Mycobacterium avium subsp. paratuberculosis
gaagaaggcuccgccgau

SEQ ID NO: 2840054 - RNA, 16 nt, Mycobacterium avium subsp. paratuberculosis
gaagacccgccggaac

SEQ ID NO: 2840055 - RNA, 22 nt, Mycobacterium avium subsp. paratuberculosis
gaagaccggugcgcgcaccagg

SEQ ID NO: 2840056 - RNA, 16 nt, Mycobacterium avium subsp. paratuberculosis
gaagaccuggccggcc

SEQ ID NO: 2840057 - RNA, 21 nt, Mycobacterium avium subsp. paratuberculosis
gaagacgaugaaaccccagcc

SEQ ID NO: 2840058 - RNA, 23 nt, Mycobacterium avium subsp. paratuberculosis
gaagacgaugaaaccccagccgg

SEQ ID NO: 2840059 - RNA, 18 nt, Mycobacterium avium subsp. paratuberculosis
gaagacgcgaaagcagcg

SEQ ID NO: 2840060 - RNA, 16 nt, Mycobacterium avium subsp. paratuberculosis
gaagacguaggcggcc

SEQ ID NO: 2840061 - RNA, 16 nt, Mycobacterium avium subsp. paratuberculosis
gaagacgucgaacccg

SEQ ID NO: 2840062 - RNA, 13 nt, Mycobacterium avium subsp. paratuberculosis
gaagacgucggcg

SEQ ID NO: 2840063 - RNA, 13 nt, Mycobacterium avium subsp. paratuberculosis
gaagagcggcgug

SEQ ID NO: 2840064 - RNA, 14 nt, Mycobacterium avium subsp. paratuberculosis
gaagaggcgcgcua

SEQ ID NO: 2840065 - RNA, 21 nt, Mycobacterium avium subsp. paratuberculosis
gaagaggcgcgcuaacggcgc

SEQ ID NO: 2840066 - RNA, 16 nt, Mycobacterium avium subsp. paratuberculosis
gaagaggugcucgacg

SEQ ID NO: 2840067 - RNA, 19 nt, Mycobacterium avium subsp. paratuberculosis
gaagaguuuucacgaagaa

SEQ ID NO: 2840068 - RNA, 22 nt, Mycobacterium avium subsp. paratuberculosis
gaagaguuuucacgaagaacac

SEQ ID NO: 2840069 - RNA, 14 nt, Mycobacterium avium subsp. paratuberculosis
gaagaucaccgcga

SEQ ID NO: 2840070 - RNA, 16 nt, Mycobacterium avium subsp. paratuberculosis
gaagaucaccgcgacg

SEQ ID NO: 2840071 - RNA, 14 nt, Mycobacterium avium subsp. paratuberculosis
gaagaucagcaccg

SEQ ID NO: 2840072 - RNA, 12 nt, Mycobacterium avium subsp. paratuberculosis
gaagaucagcag

SEQ ID NO: 2840073 - RNA, 13 nt, Mycobacterium avium subsp. paratuberculosis
gaagaucagcgcg

SEQ ID NO: 2840074 - RNA, 21 nt, Mycobacterium avium subsp. paratuberculosis
gaagaucgaaaugaccgcgcc

SEQ ID NO: 2840075 - RNA, 14 nt, Mycobacterium avium subsp. paratuberculosis
gaagaucgacgcca

SEQ ID NO: 2840076 - RNA, 13 nt, Mycobacterium avium subsp. paratuberculosis
gaagaucgcccgc

SEQ ID NO: 2840077 - RNA, 18 nt, Mycobacterium avium subsp. paratuberculosis
gaagaucgcccgccgcga

SEQ ID NO: 2840078 - RNA, 14 nt, Mycobacterium avium subsp. paratuberculosis
gaagaucucggcca

SEQ ID NO: 2840079 - RNA, 22 nt, Mycobacterium avium subsp. paratuberculosis
gaagaucuucucggugucgucg

SEQ ID NO: 2840080 - RNA, 22 nt, Mycobacterium avium subsp. paratuberculosis
gaagaugaccugaucgaguucc

SEQ ID NO: 2840081 - RNA, 16 nt, Mycobacterium avium subsp. paratuberculosis
gaagaugaucagcgcg

SEQ ID NO: 2840082 - RNA, 16 nt, Mycobacterium avium subsp. paratuberculosis
gaagaugaucucgccg

SEQ ID NO: 2840083 - RNA, 21 nt, Mycobacterium avium subsp. paratuberculosis
gaagaugaucucgccgagcgg

SEQ ID NO: 2840084 - RNA, 22 nt, Mycobacterium avium subsp. paratuberculosis
gaagaugaucucgccgagcggg

SEQ ID NO: 2840085 - RNA, 23 nt, Mycobacterium avium subsp. paratuberculosis
gaagaugcgccggguccagccgc

SEQ ID NO: 2840086 - RNA, 13 nt, Mycobacterium avium subsp. paratuberculosis
gaagauggccagg

SEQ ID NO: 2840087 - RNA, 16 nt, Mycobacterium avium subsp. paratuberculosis
gaagauggccaggaac

SEQ ID NO: 2840088 - RNA, 14 nt, Mycobacterium avium subsp. paratuberculosis
gaagcgggacagca

SEQ ID NO: 2840089 - RNA, 14 nt, Mycobacterium avium subsp. paratuberculosis
gaagcgggcggcga

SEQ ID NO: 2840090 - RNA, 16 nt, Mycobacterium avium subsp. paratuberculosis
gaagcggucgcggaac

SEQ ID NO: 2840091 - RNA, 18 nt, Mycobacterium avium subsp. paratuberculosis
gaagcggucgcggaaccg

SEQ ID NO: 2840092 - RNA, 19 nt, Mycobacterium avium subsp. paratuberculosis
gaagcggugauggcgaugc

SEQ ID NO: 2840093 - RNA, 22 nt, Mycobacterium avium subsp. paratuberculosis
gaagcguacccaggucggcgug

SEQ ID NO: 2840094 - RNA, 15 nt, Mycobacterium avium subsp. paratuberculosis
gaagcguaugccggu

SEQ ID NO: 2840095 - RNA, 18 nt, Mycobacterium avium subsp. paratuberculosis
gaagcuaaaccccacggc

SEQ ID NO: 2840096 - RNA, 16 nt, Mycobacterium avium subsp. paratuberculosis
gaagcuaguuucacgc

SEQ ID NO: 2840097 - RNA, 20 nt, Mycobacterium avium subsp. paratuberculosis
gaagcuaguuucacgcucgg

SEQ ID NO: 2840098 - RNA, 14 nt, Mycobacterium avium subsp. paratuberculosis
gaagcuccacgccg

SEQ ID NO: 2840099 - RNA, 20 nt, Mycobacterium avium subsp. paratuberculosis
gaagcuccacgccgccggga

SEQ ID NO: 2840100 - RNA, 18 nt, Mycobacterium avium subsp. paratuberculosis
gaagcugaagcggcccug

SEQ ID NO: 2840101 - RNA, 12 nt, Mycobacterium avium subsp. paratuberculosis
gaagcugccgac

SEQ ID NO: 2840102 - RNA, 13 nt, Mycobacterium avium subsp. paratuberculosis
gaagcugccgacc

SEQ ID NO: 2840103 - RNA, 22 nt, Mycobacterium avium subsp. paratuberculosis
gaagcugccguugcgccagcgg

SEQ ID NO: 2840104 - RNA, 17 nt, Mycobacterium avium subsp. paratuberculosis
gaagcugcgcagccgug

SEQ ID NO: 2840105 - RNA, 18 nt, Mycobacterium avium subsp. paratuberculosis
gaagcuggccaccgcauc

SEQ ID NO: 2840106 - RNA, 22 nt, Mycobacterium avium subsp. paratuberculosis
gaagcugguggugaucggccag

SEQ ID NO: 2840107 - RNA, 23 nt, Mycobacterium avium subsp. paratuberculosis
gaagcugguggugaucggccagg

SEQ ID NO: 2840108 - RNA, 24 nt, Mycobacterium avium subsp. paratuberculosis
gaagcugguggugaucggccaggc

SEQ ID NO: 2840109 - RNA, 14 nt, Mycobacterium avium subsp. paratuberculosis
gaagcugucgccga

SEQ ID NO: 2840110 - RNA, 17 nt, Mycobacterium avium subsp. paratuberculosis
gaagcugucgccgaggu

SEQ ID NO: 2840111 - RNA, 13 nt, Mycobacterium avium subsp. paratuberculosis
gaaggacagccgg

SEQ ID NO: 2840112 - RNA, 18 nt, Mycobacterium avium subsp. paratuberculosis
gaaggacgucaggccggu

SEQ ID NO: 2840113 - RNA, 20 nt, Mycobacterium avium subsp. paratuberculosis
gaaggacucaaucggucagg

SEQ ID NO: 2840114 - RNA, 18 nt, Mycobacterium avium subsp. paratuberculosis
gaaggaggcggucgacug

SEQ ID NO: 2840115 - RNA, 12 nt, Mycobacterium avium subsp. paratuberculosis
gaaggcaacucg

SEQ ID NO: 2840116 - RNA, 17 nt, Mycobacterium avium subsp. paratuberculosis
gaaggccaaggccagca

SEQ ID NO: 2840117 - RNA, 18 nt, Mycobacterium avium subsp. paratuberculosis
gaaggccaaggccagcaa

SEQ ID NO: 2840118 - RNA, 23 nt, Mycobacterium avium subsp. paratuberculosis
gaaggccagcuccucggggauga

SEQ ID NO: 2840119 - RNA, 19 nt, Mycobacterium avium subsp. paratuberculosis
gaaggccaggugcacgccg

SEQ ID NO: 2840120 - RNA, 20 nt, Mycobacterium avium subsp. paratuberculosis
gaaggccagguugccacgcg

SEQ ID NO: 2840121 - RNA, 13 nt, Mycobacterium avium subsp. paratuberculosis
gaaggccgcgcug

SEQ ID NO: 2840122 - RNA, 19 nt, Mycobacterium avium subsp. paratuberculosis
gaaggccuggaacacccag

SEQ ID NO: 2840123 - RNA, 20 nt, Mycobacterium avium subsp. paratuberculosis
gaaggccuggaugccgcccu

SEQ ID NO: 2840124 - RNA, 15 nt, Mycobacterium avium subsp. paratuberculosis
gaaggcgaacaccag

SEQ ID NO: 2840125 - RNA, 17 nt, Mycobacterium avium subsp. paratuberculosis
gaaggcgacgucggucg

SEQ ID NO: 2840126 - RNA, 14 nt, Mycobacterium avium subsp. paratuberculosis
gaaggcgccgaugg

SEQ ID NO: 2840127 - RNA, 15 nt, Mycobacterium avium subsp. paratuberculosis
gaaggcgccggcgcg

SEQ ID NO: 2840128 - RNA, 18 nt, Mycobacterium avium subsp. paratuberculosis
gaaggcgcgcagggcgaa

SEQ ID NO: 2840129 - RNA, 22 nt, Mycobacterium avium subsp. paratuberculosis
gaaggcgcgggcagggggacga

SEQ ID NO: 2840130 - RNA, 15 nt, Mycobacterium avium subsp. paratuberculosis
gaaggcgcgggcguc

SEQ ID NO: 2840131 - RNA, 14 nt, Mycobacterium avium subsp. paratuberculosis
gaaggcggccaccg

SEQ ID NO: 2840132 - RNA, 15 nt, Mycobacterium avium subsp. paratuberculosis
gaaggcggccaccgc

SEQ ID NO: 2840133 - RNA, 14 nt, Mycobacterium avium subsp. paratuberculosis
gaaggcggccgcga

SEQ ID NO: 2840134 - RNA, 18 nt, Mycobacterium avium subsp. paratuberculosis
gaaggcggccgcgagccc

SEQ ID NO: 2840135 - RNA, 22 nt, Mycobacterium avium subsp. paratuberculosis
gaaggcggccgcgagcccggcg

SEQ ID NO: 2840136 - RNA, 16 nt, Mycobacterium avium subsp. paratuberculosis
gaaggcggcgccggcc

SEQ ID NO: 2840137 - RNA, 16 nt, Mycobacterium avium subsp. paratuberculosis
gaaggcgugcucgauc

SEQ ID NO: 2840138 - RNA, 22 nt, Mycobacterium avium subsp. paratuberculosis
gaaggcguuggacuccaccgcc

SEQ ID NO: 2840139 - RNA, 17 nt, Mycobacterium avium subsp. paratuberculosis
gaaggcuccgccgaugu

SEQ ID NO: 2840140 - RNA, 16 nt, Mycobacterium avium subsp. paratuberculosis
gaagggaaaggcagca

SEQ ID NO: 2840141 - RNA, 18 nt, Mycobacterium avium subsp. paratuberculosis
gaagggcccgccgguggc

SEQ ID NO: 2840142 - RNA, 14 nt, Mycobacterium avium subsp. paratuberculosis
gaagggcgccagcc

SEQ ID NO: 2840143 - RNA, 22 nt, Mycobacterium avium subsp. paratuberculosis
gaagggcgcgucguagccggca

SEQ ID NO: 2840144 - RNA, 21 nt, Mycobacterium avium subsp. paratuberculosis
gaagggcuuuagaaggccgcc

SEQ ID NO: 2840145 - RNA, 22 nt, Mycobacterium avium subsp. paratuberculosis
gaagggcuuuagaaggccgccu

SEQ ID NO: 2840146 - RNA, 17 nt, Mycobacterium avium subsp. paratuberculosis
gaagggguccggaagcc

SEQ ID NO: 2840147 - RNA, 10 nt, Mycobacterium avium subsp. paratuberculosis
gaaggggucg

SEQ ID NO: 2840148 - RNA, 15 nt, Mycobacterium avium subsp. paratuberculosis
gaaggucauagggcu

SEQ ID NO: 2840149 - RNA, 20 nt, Mycobacterium avium subsp. paratuberculosis
gaaggucauagggcucgucc

SEQ ID NO: 2840150 - RNA, 22 nt, Mycobacterium avium subsp. paratuberculosis
gaaggucccggucagguugacg

SEQ ID NO: 2840151 - RNA, 17 nt, Mycobacterium avium subsp. paratuberculosis
gaaggucugcagcagcc

SEQ ID NO: 2840152 - RNA, 22 nt, Mycobacterium avium subsp. paratuberculosis
gaaggugaagguccgguaggcg

SEQ ID NO: 2840153 - RNA, 22 nt, Mycobacterium avium subsp. paratuberculosis
gaaggugaccaucgggucgucg

SEQ ID NO: 2840154 - RNA, 20 nt, Mycobacterium avium subsp. paratuberculosis
gaaggugacgucgccgaugg

SEQ ID NO: 2840155 - RNA, 17 nt, Mycobacterium avium subsp. paratuberculosis
gaaggugccgcgaugcc

SEQ ID NO: 2840156 - RNA, 14 nt, Mycobacterium avium subsp. paratuberculosis
gaaggugcgcacga

SEQ ID NO: 2840157 - RNA, 15 nt, Mycobacterium avium subsp. paratuberculosis
gaaggugggcagcgc

SEQ ID NO: 2840158 - RNA, 19 nt, Mycobacterium avium subsp. paratuberculosis
gaaggugguccuggcggug

SEQ ID NO: 2840159 - RNA, 14 nt, Mycobacterium avium subsp. paratuberculosis
gaaggugucggccg

SEQ ID NO: 2840160 - RNA, 17 nt, Mycobacterium avium subsp. paratuberculosis
gaagguguuggugcggg

SEQ ID NO: 2840161 - RNA, 20 nt, Mycobacterium avium subsp. paratuberculosis
gaaguagagccgcugcacgc

SEQ ID NO: 2840162 - RNA, 13 nt, Mycobacterium avium subsp. paratuberculosis
gaaguagccggcg

SEQ ID NO: 2840163 - RNA, 14 nt, Mycobacterium avium subsp. paratuberculosis
gaaguauucgccgu

SEQ ID NO: 2840164 - RNA, 16 nt, Mycobacterium avium subsp. paratuberculosis
gaaguauucgccgucg

SEQ ID NO: 2840165 - RNA, 17 nt, Mycobacterium avium subsp. paratuberculosis
gaaguauucgccgucgu

SEQ ID NO: 2840166 - RNA, 16 nt, Mycobacterium avium subsp. paratuberculosis
gaagucagcgcgugac

SEQ ID NO: 2840167 - RNA, 14 nt, Mycobacterium avium subsp. paratuberculosis
gaaguccgccaggg

SEQ ID NO: 2840168 - RNA, 15 nt, Mycobacterium avium subsp. paratuberculosis
gaaguccgccagggu

SEQ ID NO: 2840169 - RNA, 16 nt, Mycobacterium avium subsp. paratuberculosis
gaaguccggcgcgccc

SEQ ID NO: 2840170 - RNA, 18 nt, Mycobacterium avium subsp. paratuberculosis
gaaguccggcgcgcccgg

SEQ ID NO: 2840171 - RNA, 19 nt, Mycobacterium avium subsp. paratuberculosis
gaaguccggcgcgcccgga

SEQ ID NO: 2840172 - RNA, 13 nt, Mycobacterium avium subsp. paratuberculosis
gaaguccugcgcc

SEQ ID NO: 2840173 - RNA, 15 nt, Mycobacterium avium subsp. paratuberculosis
gaaucgcggcaggcg

SEQ ID NO: 2840174 - RNA, 23 nt, Mycobacterium avium subsp. paratuberculosis
gaaucgcgggaucggccggcgag

SEQ ID NO: 2840175 - RNA, 14 nt, Mycobacterium avium subsp. paratuberculosis
gaaucgcuugacca

SEQ ID NO: 2840176 - RNA, 15 nt, Mycobacterium avium subsp. paratuberculosis
gaaucgguccggcga

SEQ ID NO: 2840177 - RNA, 15 nt, Mycobacterium avium subsp. paratuberculosis
gaaucggucgaccag

SEQ ID NO: 2840178 - RNA, 15 nt, Mycobacterium avium subsp. paratuberculosis
gaaucgucccgucga

SEQ ID NO: 2840179 - RNA, 22 nt, Mycobacterium avium subsp. paratuberculosis
gaaucgucggccacgcucgcca

SEQ ID NO: 2840180 - RNA, 18 nt, Mycobacterium avium subsp. paratuberculosis
gaaucuuggccagcagcg

SEQ ID NO: 2840181 - RNA, 22 nt, Mycobacterium avium subsp. paratuberculosis
gaaucuuggccagcagcguggg

SEQ ID NO: 2840182 - RNA, 20 nt, Mycobacterium avium subsp. paratuberculosis
gaaugcaucgcgaucgacag

SEQ ID NO: 2840183 - RNA, 14 nt, Mycobacterium avium subsp. paratuberculosis
gaaugcccagcggg

SEQ ID NO: 2840184 - RNA, 14 nt, Mycobacterium avium subsp. paratuberculosis
gaaugcgacgacgu

SEQ ID NO: 2840185 - RNA, 16 nt, Mycobacterium avium subsp. paratuberculosis
gaaugcggcugggugg

SEQ ID NO: 2840186 - RNA, 14 nt, Mycobacterium avium subsp. paratuberculosis
gaaugcucagcggg

SEQ ID NO: 2840187 - RNA, 17 nt, Mycobacterium avium subsp. paratuberculosis
gaauggcaaggccagca

SEQ ID NO: 2840188 - RNA, 18 nt, Mycobacterium avium subsp. paratuberculosis
gaauggcaaggccagcaa

SEQ ID NO: 2840189 - RNA, 14 nt, Mycobacterium avium subsp. paratuberculosis
gaauggcagcagcc

SEQ ID NO: 2840190 - RNA, 15 nt, Mycobacterium avium subsp. paratuberculosis
gaauggcagcagccg

SEQ ID NO: 2840191 - RNA, 22 nt, Mycobacterium avium subsp. paratuberculosis
gaaugucauuugagcggccgac

SEQ ID NO: 2840192 - RNA, 20 nt, Mycobacterium avium subsp. paratuberculosis
gaaugucgcgcagcauccgc

SEQ ID NO: 2840193 - RNA, 13 nt, Mycobacterium avium subsp. paratuberculosis
gaaugucggcguu

SEQ ID NO: 2840194 - RNA, 20 nt, Mycobacterium avium subsp. paratuberculosis
gaaugucguagaacucgccg

SEQ ID NO: 2840195 - RNA, 17 nt, Mycobacterium avium subsp. paratuberculosis
gaaugucguagcggucg

SEQ ID NO: 2840196 - RNA, 18 nt, Mycobacterium avium subsp. paratuberculosis
gaauucagugaggccagc

SEQ ID NO: 2840197 - RNA, 13 nt, Mycobacterium avium subsp. paratuberculosis
gaauuccggcgcg

SEQ ID NO: 2840198 - RNA, 16 nt, Mycobacterium avium subsp. paratuberculosis
gaauuccucagcgccc

SEQ ID NO: 2840199 - RNA, 16 nt, Mycobacterium avium subsp. paratuberculosis
gaauuccuggccggug

SEQ ID NO: 2840200 - RNA, 15 nt, Mycobacterium avium subsp. paratuberculosis
gaauucgaccacggc

SEQ ID NO: 2840201 - RNA, 14 nt, Mycobacterium avium subsp. paratuberculosis
gaauucgccgacgc

SEQ ID NO: 2840202 - RNA, 16 nt, Mycobacterium avium subsp. paratuberculosis
gaauucgccgacgcgc

SEQ ID NO: 2840203 - RNA, 21 nt, Mycobacterium avium subsp. paratuberculosis
gaauucggaacccugccccac

SEQ ID NO: 2840204 - RNA, 21 nt, Mycobacterium avium subsp. paratuberculosis
gaauucggccaccgacugcga

SEQ ID NO: 2840205 - RNA, 22 nt, Mycobacterium avium subsp. paratuberculosis
gaauucggccaccgacugcgac

SEQ ID NO: 2840206 - RNA, 23 nt, Mycobacterium avium subsp. paratuberculosis
gaauucgguggcgauggugcugc

SEQ ID NO: 2840207 - RNA, 16 nt, Mycobacterium avium subsp. paratuberculosis
gaauucuggccgaccg

SEQ ID NO: 2840208 - RNA, 17 nt, Mycobacterium avium subsp. paratuberculosis
gaauucuggccgaccgc

SEQ ID NO: 2840209 - RNA, 19 nt, Mycobacterium avium subsp. paratuberculosis
gaauugaagcccugcucgg

SEQ ID NO: 2840210 - RNA, 17 nt, Mycobacterium avium subsp. paratuberculosis
gaauugccgguggugcg

SEQ ID NO: 2840211 - RNA, 14 nt, Mycobacterium avium subsp. paratuberculosis
gaauugggcgagua

SEQ ID NO: 2840212 - RNA, 19 nt, Mycobacterium avium subsp. paratuberculosis
gaauugggcgaguacaccu

SEQ ID NO: 2840213 - RNA, 17 nt, Mycobacterium avium subsp. paratuberculosis
gaauuguccagcaguuu

SEQ ID NO: 2840214 - RNA, 15 nt, Mycobacterium avium subsp. paratuberculosis
gaauuguggcggccc

SEQ ID NO: 2840215 - RNA, 18 nt, Mycobacterium avium subsp. paratuberculosis
gacaaagaucacagcgcc

SEQ ID NO: 2840216 - RNA, 14 nt, Mycobacterium avium subsp. paratuberculosis
gacaaaggaggggc

SEQ ID NO: 2840217 - RNA, 23 nt, Mycobacterium avium subsp. paratuberculosis
gacaacagcacgaacagcagcgg

SEQ ID NO: 2840218 - RNA, 13 nt, Mycobacterium avium subsp. paratuberculosis
gacaacagcgccg

SEQ ID NO: 2840219 - RNA, 18 nt, Mycobacterium avium subsp. paratuberculosis
gacaacaggcgaccucgg

SEQ ID NO: 2840220 - RNA, 15 nt, Mycobacterium avium subsp. paratuberculosis
gacaacauccgcgac

SEQ ID NO: 2840221 - RNA, 22 nt, Mycobacterium avium subsp. paratuberculosis
gacaacauccgcgacgacacca

SEQ ID NO: 2840222 - RNA, 15 nt, Mycobacterium avium subsp. paratuberculosis
gacaacgacagcacc

SEQ ID NO: 2840223 - RNA, 21 nt, Mycobacterium avium subsp. paratuberculosis
gacaacgacagcacccaggug

SEQ ID NO: 2840224 - RNA, 17 nt, Mycobacterium avium subsp. paratuberculosis
gacaacgcagguuucuc

SEQ ID NO: 2840225 - RNA, 17 nt, Mycobacterium avium subsp. paratuberculosis
gacaacgcgugaugcag

SEQ ID NO: 2840226 - RNA, 17 nt, Mycobacterium avium subsp. paratuberculosis
gacaacggaucgagcgc

SEQ ID NO: 2840227 - RNA, 17 nt, Mycobacterium avium subsp. paratuberculosis
gacaacggcccccacga

SEQ ID NO: 2840228 - RNA, 24 nt, Mycobacterium avium subsp. paratuberculosis
gacaacgggauaugcgccugcacg

SEQ ID NO: 2840229 - RNA, 18 nt, Mycobacterium avium subsp. paratuberculosis
gacaacgggccgccucac

SEQ ID NO: 2840230 - RNA, 22 nt, Mycobacterium avium subsp. paratuberculosis
gacaacgggccgccucacgcag

SEQ ID NO: 2840231 - RNA, 16 nt, Mycobacterium avium subsp. paratuberculosis
gacaacggugguggcg

SEQ ID NO: 2840232 - RNA, 17 nt, Mycobacterium avium subsp. paratuberculosis
gacaacggugguggcga

SEQ ID NO: 2840233 - RNA, 22 nt, Mycobacterium avium subsp. paratuberculosis
gacaacguggugugcaccagcg

SEQ ID NO: 2840234 - RNA, 16 nt, Mycobacterium avium subsp. paratuberculosis
gacaagggccgggcgc

SEQ ID NO: 2840235 - RNA, 15 nt, Mycobacterium avium subsp. paratuberculosis
gacaaggucgaccgc

SEQ ID NO: 2840236 - RNA, 17 nt, Mycobacterium avium subsp. paratuberculosis
gacaaggucgaccgcgc

SEQ ID NO: 2840237 - RNA, 14 nt, Mycobacterium avium subsp. paratuberculosis
gacacaaaagcgcc

SEQ ID NO: 2840238 - RNA, 15 nt, Mycobacterium avium subsp. paratuberculosis
gacacaaaagcgccc

SEQ ID NO: 2840239 - RNA, 17 nt, Mycobacterium avium subsp. paratuberculosis
gacacaaaagcgcccga

SEQ ID NO: 2840240 - RNA, 14 nt, Mycobacterium avium subsp. paratuberculosis
gacacagcaccggc

SEQ ID NO: 2840241 - RNA, 18 nt, Mycobacterium avium subsp. paratuberculosis
gacacagcaccggcgucg

SEQ ID NO: 2840242 - RNA, 19 nt, Mycobacterium avium subsp. paratuberculosis
gacacagcaccggcgucga

SEQ ID NO: 2840243 - RNA, 13 nt, Mycobacterium avium subsp. paratuberculosis
gacacagcacgcc

SEQ ID NO: 2840244 - RNA, 14 nt, Mycobacterium avium subsp. paratuberculosis
gacaccaccacgaa

SEQ ID NO: 2840245 - RNA, 13 nt, Mycobacterium avium subsp. paratuberculosis
gacaccaccggcc

SEQ ID NO: 2840246 - RNA, 20 nt, Mycobacterium avium subsp. paratuberculosis
gacaccaccggccgcccggc

SEQ ID NO: 2840247 - RNA, 13 nt, Mycobacterium avium subsp. paratuberculosis
gacaccaccgugc

SEQ ID NO: 2840248 - RNA, 21 nt, Mycobacterium avium subsp. paratuberculosis
gacaccaccgugcuggccacc

SEQ ID NO: 2840249 - RNA, 16 nt, Mycobacterium avium subsp. paratuberculosis
gacaccaccugcacgg

SEQ ID NO: 2840250 - RNA, 18 nt, Mycobacterium avium subsp. paratuberculosis
gacaccacgaucagcgcg

SEQ ID NO: 2840251 - RNA, 15 nt, Mycobacterium avium subsp. paratuberculosis
gacaccacgucgucg

SEQ ID NO: 2840252 - RNA, 17 nt, Mycobacterium avium subsp. paratuberculosis
gacaccacgucgucggc

SEQ ID NO: 2840253 - RNA, 18 nt, Mycobacterium avium subsp. paratuberculosis
gacaccacgucgucggcc

SEQ ID NO: 2840254 - RNA, 21 nt, Mycobacterium avium subsp. paratuberculosis
gacaccacgucgucggccugc

SEQ ID NO: 2840255 - RNA, 13 nt, Mycobacterium avium subsp. paratuberculosis
gacaccagcgcgc

SEQ ID NO: 2840256 - RNA, 14 nt, Mycobacterium avium subsp. paratuberculosis
gacaccagcgucgc

SEQ ID NO: 2840257 - RNA, 16 nt, Mycobacterium avium subsp. paratuberculosis
gacaccagcgucgcga

SEQ ID NO: 2840258 - RNA, 20 nt, Mycobacterium avium subsp. paratuberculosis
gacacgcgccggcgcgggca

SEQ ID NO: 2840259 - RNA, 21 nt, Mycobacterium avium subsp. paratuberculosis
gacacgcgccggcgcgggcau

SEQ ID NO: 2840260 - RNA, 12 nt, Mycobacterium avium subsp. paratuberculosis
gacacggccagc

SEQ ID NO: 2840261 - RNA, 13 nt, Mycobacterium avium subsp. paratuberculosis
gacacggccagcg

SEQ ID NO: 2840262 - RNA, 19 nt, Mycobacterium avium subsp. paratuberculosis
gacacggccagcgccguca

SEQ ID NO: 2840263 - RNA, 22 nt, Mycobacterium avium subsp. paratuberculosis
gacacggcgccgugcgccucga

SEQ ID NO: 2840264 - RNA, 17 nt, Mycobacterium avium subsp. paratuberculosis
gacacggcggcgcgggc

SEQ ID NO: 2840265 - RNA, 19 nt, Mycobacterium avium subsp. paratuberculosis
gacacggcggcgcgggcgg

SEQ ID NO: 2840266 - RNA, 20 nt, Mycobacterium avium subsp. paratuberculosis
gacacggcggcgcgggcggc

SEQ ID NO: 2840267 - RNA, 22 nt, Mycobacterium avium subsp. paratuberculosis
gacacggcggcgcgggcggcgu

SEQ ID NO: 2840268 - RNA, 13 nt, Mycobacterium avium subsp. paratuberculosis
gacacgggccgcg

SEQ ID NO: 2840269 - RNA, 17 nt, Mycobacterium avium subsp. paratuberculosis
gacacggugaacgucga

SEQ ID NO: 2840270 - RNA, 21 nt, Mycobacterium avium subsp. paratuberculosis
gacacguaaagcauuggccca

SEQ ID NO: 2840271 - RNA, 14 nt, Mycobacterium avium subsp. paratuberculosis
gacacguaggccgc

SEQ ID NO: 2840272 - RNA, 13 nt, Mycobacterium avium subsp. paratuberculosis
gacacguccagcu

SEQ ID NO: 2840273 - RNA, 18 nt, Mycobacterium avium subsp. paratuberculosis
gacacguccagcucucga

SEQ ID NO: 2840274 - RNA, 12 nt, Mycobacterium avium subsp. paratuberculosis
gacacgucgaca

SEQ ID NO: 2840275 - RNA, 14 nt, Mycobacterium avium subsp. paratuberculosis
gacacgucgacacg

SEQ ID NO: 2840276 - RNA, 17 nt, Mycobacterium avium subsp. paratuberculosis
gacacgucgacacgccg

SEQ ID NO: 2840277 - RNA, 23 nt, Mycobacterium avium subsp. paratuberculosis
gacacguggaccgagcgcgcgau

SEQ ID NO: 2840278 - RNA, 15 nt, Mycobacterium avium subsp. paratuberculosis
gacacguuggccaga

SEQ ID NO: 2840279 - RNA, 22 nt, Mycobacterium avium subsp. paratuberculosis
gacacguuggccagaugcccgc

SEQ ID NO: 2840280 - RNA, 17 nt, Mycobacterium avium subsp. paratuberculosis
gacacucggucaccggu

SEQ ID NO: 2840281 - RNA, 19 nt, Mycobacterium avium subsp. paratuberculosis
gacagauacuucgucgaac

SEQ ID NO: 2840282 - RNA, 18 nt, Mycobacterium avium subsp. paratuberculosis
gacagaugcggcaccagc

SEQ ID NO: 2840283 - RNA, 19 nt, Mycobacterium avium subsp. paratuberculosis
gacagaugcggcaccagcc

SEQ ID NO: 2840284 - RNA, 24 nt, Mycobacterium avium subsp. paratuberculosis
gacagaugcggcaccagcccgccg

SEQ ID NO: 2840285 - RNA, 17 nt, Mycobacterium avium subsp. paratuberculosis
gacagcaaaccgaccgc

SEQ ID NO: 2840286 - RNA, 16 nt, Mycobacterium avium subsp. paratuberculosis
gacagcaacgccaggg

SEQ ID NO: 2840287 - RNA, 17 nt, Mycobacterium avium subsp. paratuberculosis
gacagcaacgccagggc

SEQ ID NO: 2840288 - RNA, 12 nt, Mycobacterium avium subsp. paratuberculosis
gacagcaccaca

SEQ ID NO: 2840289 - RNA, 14 nt, Mycobacterium avium subsp. paratuberculosis
gacagcacccgcug

SEQ ID NO: 2840290 - RNA, 15 nt, Mycobacterium avium subsp. paratuberculosis
gacagcacccgcugc

SEQ ID NO: 2840291 - RNA, 13 nt, Mycobacterium avium subsp. paratuberculosis
gacagcaccgcca

SEQ ID NO: 2840292 - RNA, 14 nt, Mycobacterium avium subsp. paratuberculosis
gacagcaccgccau

SEQ ID NO: 2840293 - RNA, 18 nt, Mycobacterium avium subsp. paratuberculosis
gacagcaccgccaucgcg

SEQ ID NO: 2840294 - RNA, 22 nt, Mycobacterium avium subsp. paratuberculosis
gacagcacguuguucaggucga

SEQ ID NO: 2840295 - RNA, 13 nt, Mycobacterium avium subsp. paratuberculosis
gacagcagcaccg

SEQ ID NO: 2840296 - RNA, 16 nt, Mycobacterium avium subsp. paratuberculosis
gacagcagcaccggca

SEQ ID NO: 2840297 - RNA, 13 nt, Mycobacterium avium subsp. paratuberculosis
gacagcagccgcu

SEQ ID NO: 2840298 - RNA, 20 nt, Mycobacterium avium subsp. paratuberculosis
gacagcaggaucuccggccg

SEQ ID NO: 2840299 - RNA, 23 nt, Mycobacterium avium subsp. paratuberculosis
gacagcaggaucuccggccggug

SEQ ID NO: 2840300 - RNA, 14 nt, Mycobacterium avium subsp. paratuberculosis
gacagccacagcuc

SEQ ID NO: 2840301 - RNA, 16 nt, Mycobacterium avium subsp. paratuberculosis
gacagccacagcucgg

SEQ ID NO: 2840302 - RNA, 18 nt, Mycobacterium avium subsp. paratuberculosis
gacagccacagcucgggc

SEQ ID NO: 2840303 - RNA, 21 nt, Mycobacterium avium subsp. paratuberculosis
gacagccacuccauccggaac

SEQ ID NO: 2840304 - RNA, 15 nt, Mycobacterium avium subsp. paratuberculosis
gacagcccccgcagc

SEQ ID NO: 2840305 - RNA, 18 nt, Mycobacterium avium subsp. paratuberculosis
gacagcccccgcagcccg

SEQ ID NO: 2840306 - RNA, 15 nt, Mycobacterium avium subsp. paratuberculosis
gacagccccgagccg

SEQ ID NO: 2840307 - RNA, 20 nt, Mycobacterium avium subsp. paratuberculosis
gacagccccgagccgcggau

SEQ ID NO: 2840308 - RNA, 16 nt, Mycobacterium avium subsp. paratuberculosis
gacagccgagauggca

SEQ ID NO: 2840309 - RNA, 18 nt, Mycobacterium avium subsp. paratuberculosis
gacagccgagauggcaac

SEQ ID NO: 2840310 - RNA, 13 nt, Mycobacterium avium subsp. paratuberculosis
gacagccgcacca

SEQ ID NO: 2840311 - RNA, 13 nt, Mycobacterium avium subsp. paratuberculosis
gacagccgcgccg

SEQ ID NO: 2840312 - RNA, 22 nt, Mycobacterium avium subsp. paratuberculosis
gacagccgggaaucgagggcgc

SEQ ID NO: 2840313 - RNA, 16 nt, Mycobacterium avium subsp. paratuberculosis
gacagccggucgacga

SEQ ID NO: 2840314 - RNA, 17 nt, Mycobacterium avium subsp. paratuberculosis
gacagccggucgacgaa

SEQ ID NO: 2840315 - RNA, 20 nt, Mycobacterium avium subsp. paratuberculosis
gacagccggucgacgaagaa

SEQ ID NO: 2840316 - RNA, 16 nt, Mycobacterium avium subsp. paratuberculosis
gacagccggucgcgca

SEQ ID NO: 2840317 - RNA, 17 nt, Mycobacterium avium subsp. paratuberculosis
gacagccggucgcgcau

SEQ ID NO: 2840318 - RNA, 19 nt, Mycobacterium avium subsp. paratuberculosis
gacagccggucgcgcaucg

SEQ ID NO: 2840319 - RNA, 15 nt, Mycobacterium avium subsp. paratuberculosis
gacagcgaaccgaca

SEQ ID NO: 2840320 - RNA, 16 nt, Mycobacterium avium subsp. paratuberculosis
gacagcgaaccgacau

SEQ ID NO: 2840321 - RNA, 22 nt, Mycobacterium avium subsp. paratuberculosis
gacagcgacaaucucgggcacc

SEQ ID NO: 2840322 - RNA, 17 nt, Mycobacterium avium subsp. paratuberculosis
gacagcgacgggccggg

SEQ ID NO: 2840323 - RNA, 18 nt, Mycobacterium avium subsp. paratuberculosis
gacagcgacgggccgggc

SEQ ID NO: 2840324 - RNA, 18 nt, Mycobacterium avium subsp. paratuberculosis
gacagcgauugcacaccg

SEQ ID NO: 2840325 - RNA, 16 nt, Mycobacterium avium subsp. paratuberculosis
gacagcgccugcccgg

SEQ ID NO: 2840326 - RNA, 17 nt, Mycobacterium avium subsp. paratuberculosis
gacagcgccugcccgga

SEQ ID NO: 2840327 - RNA, 11 nt, Mycobacterium avium subsp. paratuberculosis
gacagcgcgac

SEQ ID NO: 2840328 - RNA, 14 nt, Mycobacterium avium subsp. paratuberculosis
gacagcgcgacgca

SEQ ID NO: 2840329 - RNA, 21 nt, Mycobacterium avium subsp. paratuberculosis
gacagcgcgacgcacgccggc

SEQ ID NO: 2840330 - RNA, 21 nt, Mycobacterium avium subsp. paratuberculosis
gacagcgcgacgggcacccgc

SEQ ID NO: 2840331 - RNA, 22 nt, Mycobacterium avium subsp. paratuberculosis
gacagcgcguacaggucgcaca

SEQ ID NO: 2840332 - RNA, 16 nt, Mycobacterium avium subsp. paratuberculosis
gacagcgcgucggcca

SEQ ID NO: 2840333 - RNA, 19 nt, Mycobacterium avium subsp. paratuberculosis
gacagcgcgucggccagcg

SEQ ID NO: 2840334 - RNA, 20 nt, Mycobacterium avium subsp. paratuberculosis
gacagcgcgucggccagcgc

SEQ ID NO: 2840335 - RNA, 21 nt, Mycobacterium avium subsp. paratuberculosis
gacagcgcgucggccagcgcg

SEQ ID NO: 2840336 - RNA, 22 nt, Mycobacterium avium subsp. paratuberculosis
gacagcgcgucggccagcgcgc

SEQ ID NO: 2840337 - RNA, 19 nt, Mycobacterium avium subsp. paratuberculosis
gacagcgcgucggcgaugu

SEQ ID NO: 2840338 - RNA, 21 nt, Mycobacterium avium subsp. paratuberculosis
gacagcggccuaugcgcccgg

SEQ ID NO: 2840339 - RNA, 23 nt, Mycobacterium avium subsp. paratuberculosis
gacagcggccuaugcgcccggga

SEQ ID NO: 2840340 - RNA, 23 nt, Mycobacterium avium subsp. paratuberculosis
gacagcggcgcgguuucggcguc

SEQ ID NO: 2840341 - RNA, 20 nt, Mycobacterium avium subsp. paratuberculosis
gacagcgggccgacccggcc

SEQ ID NO: 2840342 - RNA, 22 nt, Mycobacterium avium subsp. paratuberculosis
gacagcgucaccaaugcgccgg

SEQ ID NO: 2840343 - RNA, 16 nt, Mycobacterium avium subsp. paratuberculosis
gacagcgucagccccg

SEQ ID NO: 2840344 - RNA, 16 nt, Mycobacterium avium subsp. paratuberculosis
gacagcgucguccaug

SEQ ID NO: 2840345 - RNA, 18 nt, Mycobacterium avium subsp. paratuberculosis
gacagcgucguccaugcc

SEQ ID NO: 2840346 - RNA, 23 nt, Mycobacterium avium subsp. paratuberculosis
gacagcgucguccaugcccgccc

SEQ ID NO: 2840347 - RNA, 22 nt, Mycobacterium avium subsp. paratuberculosis
gacagcguggucgcgcagcaug

SEQ ID NO: 2840348 - RNA, 24 nt, Mycobacterium avium subsp. paratuberculosis
gacagcguggucgcgcagcauggc

SEQ ID NO: 2840349 - RNA, 15 nt, Mycobacterium avium subsp. paratuberculosis
gacagcucaccgggc

SEQ ID NO: 2840350 - RNA, 14 nt, Mycobacterium avium subsp. paratuberculosis
gacagcuccaacag

SEQ ID NO: 2840351 - RNA, 16 nt, Mycobacterium avium subsp. paratuberculosis
gacagcuccaacagcc

SEQ ID NO: 2840352 - RNA, 18 nt, Mycobacterium avium subsp. paratuberculosis
gacagcuccaacagccgg

SEQ ID NO: 2840353 - RNA, 14 nt, Mycobacterium avium subsp. paratuberculosis
gacagcucgccggc

SEQ ID NO: 2840354 - RNA, 16 nt, Mycobacterium avium subsp. paratuberculosis
gacagcucgccggccg

SEQ ID NO: 2840355 - RNA, 14 nt, Mycobacterium avium subsp. paratuberculosis
gacagcugagcagc

SEQ ID NO: 2840356 - RNA, 16 nt, Mycobacterium avium subsp. paratuberculosis
gacagcugagcagccc

SEQ ID NO: 2840357 - RNA, 18 nt, Mycobacterium avium subsp. paratuberculosis
gacagcugagcagcccga

SEQ ID NO: 2840358 - RNA, 13 nt, Mycobacterium avium subsp. paratuberculosis
gacagcugcgcgg

SEQ ID NO: 2840359 - RNA, 21 nt, Mycobacterium avium subsp. paratuberculosis
gacagcugcgcgggcgcggcc

SEQ ID NO: 2840360 - RNA, 14 nt, Mycobacterium avium subsp. paratuberculosis
gacagcuggcgguc

SEQ ID NO: 2840361 - RNA, 22 nt, Mycobacterium avium subsp. paratuberculosis
gacagcugggcguacugcucgg

SEQ ID NO: 2840362 - RNA, 14 nt, Mycobacterium avium subsp. paratuberculosis
gacaggaaccuggu

SEQ ID NO: 2840363 - RNA, 22 nt, Mycobacterium avium subsp. paratuberculosis
gacaggaggguuuucggggcgu

SEQ ID NO: 2840364 - RNA, 23 nt, Mycobacterium avium subsp. paratuberculosis
gacaggaggguuuucggggcgug

SEQ ID NO: 2840365 - RNA, 16 nt, Mycobacterium avium subsp. paratuberculosis
gacaggaugcguucgg

SEQ ID NO: 2840366 - RNA, 15 nt, Mycobacterium avium subsp. paratuberculosis
gacaggaugcugggg

SEQ ID NO: 2840367 - RNA, 21 nt, Mycobacterium avium subsp. paratuberculosis
gacaggaugcuggggucggcc

SEQ ID NO: 2840368 - RNA, 16 nt, Mycobacterium avium subsp. paratuberculosis
gacaggcacucgccca

SEQ ID NO: 2840369 - RNA, 19 nt, Mycobacterium avium subsp. paratuberculosis
gacaggcacucgcccaggg

SEQ ID NO: 2840370 - RNA, 19 nt, Mycobacterium avium subsp. paratuberculosis
gacaggcagcccggcugcg

SEQ ID NO: 2840371 - RNA, 20 nt, Mycobacterium avium subsp. paratuberculosis
gacaggcagcccggcugcgc

SEQ ID NO: 2840372 - RNA, 17 nt, Mycobacterium avium subsp. paratuberculosis
gacaggcccagcggcug

SEQ ID NO: 2840373 - RNA, 14 nt, Mycobacterium avium subsp. paratuberculosis
gacaggccggccgc

SEQ ID NO: 2840374 - RNA, 15 nt, Mycobacterium avium subsp. paratuberculosis
gacaggccggccgcu

SEQ ID NO: 2840375 - RNA, 18 nt, Mycobacterium avium subsp. paratuberculosis
gacaggccggccgcuacc

SEQ ID NO: 2840376 - RNA, 23 nt, Mycobacterium avium subsp. paratuberculosis
gacaggccggccgcuacccggcg

SEQ ID NO: 2840377 - RNA, 12 nt, Mycobacterium avium subsp. paratuberculosis
gacaggccggcg

SEQ ID NO: 2840378 - RNA, 16 nt, Mycobacterium avium subsp. paratuberculosis
gacaggccggcgacgg

SEQ ID NO: 2840379 - RNA, 18 nt, Mycobacterium avium subsp. paratuberculosis
gacaggccggcgacggcg

SEQ ID NO: 2840380 - RNA, 19 nt, Mycobacterium avium subsp. paratuberculosis
gacaggcggucgugucagg

SEQ ID NO: 2840381 - RNA, 19 nt, Mycobacterium avium subsp. paratuberculosis
gacagggagccgacgaaga

SEQ ID NO: 2840382 - RNA, 19 nt, Mycobacterium avium subsp. paratuberculosis
gacagggaggacagcaccg

SEQ ID NO: 2840383 - RNA, 14 nt, Mycobacterium avium subsp. paratuberculosis
gacagggccagcgc

SEQ ID NO: 2840384 - RNA, 15 nt, Mycobacterium avium subsp. paratuberculosis
gacagggccagcgcc

SEQ ID NO: 2840385 - RNA, 15 nt, Mycobacterium avium subsp. paratuberculosis
gacagggcgacaucg

SEQ ID NO: 2840386 - RNA, 13 nt, Mycobacterium avium subsp. paratuberculosis
gacagggcggcga

SEQ ID NO: 2840387 - RNA, 15 nt, Mycobacterium avium subsp. paratuberculosis
gacaggggcagcagc

SEQ ID NO: 2840388 - RNA, 12 nt, Mycobacterium avium subsp. paratuberculosis
gacagggugcca

SEQ ID NO: 2840389 - RNA, 16 nt, Mycobacterium avium subsp. paratuberculosis
gacagggugccgaaca

SEQ ID NO: 2840390 - RNA, 23 nt, Mycobacterium avium subsp. paratuberculosis
gacagggugccgaacagcgacgu

SEQ ID NO: 2840391 - RNA, 13 nt, Mycobacterium avium subsp. paratuberculosis
gacagguagcagg

SEQ ID NO: 2840392 - RNA, 14 nt, Mycobacterium avium subsp. paratuberculosis
gacagguagcaggc

SEQ ID NO: 2840393 - RNA, 16 nt, Mycobacterium avium subsp. paratuberculosis
gacagguagcaggcgc

SEQ ID NO: 2840394 - RNA, 18 nt, Mycobacterium avium subsp. paratuberculosis
gacagguagcaggcgcgc

SEQ ID NO: 2840395 - RNA, 20 nt, Mycobacterium avium subsp. paratuberculosis
gacagguagcgcaucagcuc

SEQ ID NO: 2840396 - RNA, 19 nt, Mycobacterium avium subsp. paratuberculosis
gacagguagcggugcucga

SEQ ID NO: 2840397 - RNA, 16 nt, Mycobacterium avium subsp. paratuberculosis
gacaggucgaggguga

SEQ ID NO: 2840398 - RNA, 23 nt, Mycobacterium avium subsp. paratuberculosis
gacaggucgagggugacccgggc

SEQ ID NO: 2840399 - RNA, 13 nt, Mycobacterium avium subsp. paratuberculosis
gacaggucgauga

SEQ ID NO: 2840400 - RNA, 16 nt, Mycobacterium avium subsp. paratuberculosis
gacaggugcauccagu

SEQ ID NO: 2840401 - RNA, 21 nt, Mycobacterium avium subsp. paratuberculosis
gacagguggccgaucagcggc

SEQ ID NO: 2840402 - RNA, 23 nt, Mycobacterium avium subsp. paratuberculosis
gacagguggccgaucagcggcgg

SEQ ID NO: 2840403 - RNA, 15 nt, Mycobacterium avium subsp. paratuberculosis
gacagguggggcacc

SEQ ID NO: 2840404 - RNA, 19 nt, Mycobacterium avium subsp. paratuberculosis
gacagguucuuggcggccu

SEQ ID NO: 2840405 - RNA, 21 nt, Mycobacterium avium subsp. paratuberculosis
gacagguucuuggcggccugc

SEQ ID NO: 2840406 - RNA, 13 nt, Mycobacterium avium subsp. paratuberculosis
gacagucccgcgu

SEQ ID NO: 2840407 - RNA, 16 nt, Mycobacterium avium subsp. paratuberculosis
gacaguccgaccgcgu

SEQ ID NO: 2840408 - RNA, 18 nt, Mycobacterium avium subsp. paratuberculosis
gacagucgcgggcagccg

SEQ ID NO: 2840409 - RNA, 21 nt, Mycobacterium avium subsp. paratuberculosis
gacagucgcgggcagccggcg

SEQ ID NO: 2840410 - RNA, 22 nt, Mycobacterium avium subsp. paratuberculosis
gacagucgcgggcggggcgccg

SEQ ID NO: 2840411 - RNA, 16 nt, Mycobacterium avium subsp. paratuberculosis
gacaguucgguggggc

SEQ ID NO: 2840412 - RNA, 22 nt, Mycobacterium avium subsp. paratuberculosis
gacauaggucagguuggggccg

SEQ ID NO: 2840413 - RNA, 23 nt, Mycobacterium avium subsp. paratuberculosis
gacaucaagugcaagggcgacau

SEQ ID NO: 2840414 - RNA, 21 nt, Mycobacterium avium subsp. paratuberculosis
gacaucaccaaccgcucggcg

SEQ ID NO: 2840415 - RNA, 23 nt, Mycobacterium avium subsp. paratuberculosis
gacaucaccaaccgcucggcgau

SEQ ID NO: 2840416 - RNA, 17 nt, Mycobacterium avium subsp. paratuberculosis
gacaucaccaccgccgg

SEQ ID NO: 2840417 - RNA, 19 nt, Mycobacterium avium subsp. paratuberculosis
gacaucaccaccgccgggg

SEQ ID NO: 2840418 - RNA, 13 nt, Mycobacterium avium subsp. paratuberculosis
gacaucaccgcgg

SEQ ID NO: 2840419 - RNA, 21 nt, Mycobacterium avium subsp. paratuberculosis
gacaucaccgcgggcgcgccg

SEQ ID NO: 2840420 - RNA, 17 nt, Mycobacterium avium subsp. paratuberculosis
gacaucagaucgccgac

SEQ ID NO: 2840421 - RNA, 23 nt, Mycobacterium avium subsp. paratuberculosis
gacaucaggcccuugccccacca

SEQ ID NO: 2840422 - RNA, 17 nt, Mycobacterium avium subsp. paratuberculosis
gacaucagugcgggcau

SEQ ID NO: 2840423 - RNA, 19 nt, Mycobacterium avium subsp. paratuberculosis
gacauccagaugcccagca

SEQ ID NO: 2840424 - RNA, 21 nt, Mycobacterium avium subsp. paratuberculosis
gacauccagaugcccagcagg

SEQ ID NO: 2840425 - RNA, 17 nt, Mycobacterium avium subsp. paratuberculosis
gacauccaggaccgcgc

SEQ ID NO: 2840426 - RNA, 15 nt, Mycobacterium avium subsp. paratuberculosis
gaccacccgcagcga

SEQ ID NO: 2840427 - RNA, 17 nt, Mycobacterium avium subsp. paratuberculosis
gaccacccgcagcgagg

SEQ ID NO: 2840428 - RNA, 17 nt, Mycobacterium avium subsp. paratuberculosis
gaccacccgcagcgcgg

SEQ ID NO: 2840429 - RNA, 14 nt, Mycobacterium avium subsp. paratuberculosis
gaccacccgcagcu

SEQ ID NO: 2840430 - RNA, 15 nt, Mycobacterium avium subsp. paratuberculosis
gaccacccgcagcuc

SEQ ID NO: 2840431 - RNA, 17 nt, Mycobacterium avium subsp. paratuberculosis
gaccacccgcagcucgc

SEQ ID NO: 2840432 - RNA, 15 nt, Mycobacterium avium subsp. paratuberculosis
gaccacccggcgggc

SEQ ID NO: 2840433 - RNA, 16 nt, Mycobacterium avium subsp. paratuberculosis
gaccacccggcgggcc

SEQ ID NO: 2840434 - RNA, 14 nt, Mycobacterium avium subsp. paratuberculosis
gaccacccucaggg

SEQ ID NO: 2840435 - RNA, 20 nt, Mycobacterium avium subsp. paratuberculosis
gaccacccucagggagcugc

SEQ ID NO: 2840436 - RNA, 15 nt, Mycobacterium avium subsp. paratuberculosis
gaccaccgagccggg

SEQ ID NO: 2840437 - RNA, 18 nt, Mycobacterium avium subsp. paratuberculosis
gaccaccgagccgggcag

SEQ ID NO: 2840438 - RNA, 16 nt, Mycobacterium avium subsp. paratuberculosis
gaccaccgccggcccg

SEQ ID NO: 2840439 - RNA, 17 nt, Mycobacterium avium subsp. paratuberculosis
gaccaccgccggcccgg

SEQ ID NO: 2840440 - RNA, 11 nt, Mycobacterium avium subsp. paratuberculosis
gaccaccggca

SEQ ID NO: 2840441 - RNA, 17 nt, Mycobacterium avium subsp. paratuberculosis
gaccaccggcaccacga

SEQ ID NO: 2840442 - RNA, 15 nt, Mycobacterium avium subsp. paratuberculosis
gaccaccggccgacc

SEQ ID NO: 2840443 - RNA, 19 nt, Mycobacterium avium subsp. paratuberculosis
gaccaccggguagcccgcg

SEQ ID NO: 2840444 - RNA, 19 nt, Mycobacterium avium subsp. paratuberculosis
gaccaccuccccgcggugc

SEQ ID NO: 2840445 - RNA, 23 nt, Mycobacterium avium subsp. paratuberculosis
gaccaccuccccgcggugccgca

SEQ ID NO: 2840446 - RNA, 16 nt, Mycobacterium avium subsp. paratuberculosis
gaccaccucgaugacc

SEQ ID NO: 2840447 - RNA, 18 nt, Mycobacterium avium subsp. paratuberculosis
gaccaccucuucgcgguc

SEQ ID NO: 2840448 - RNA, 16 nt, Mycobacterium avium subsp. paratuberculosis
gaccaccugcaccugc

SEQ ID NO: 2840449 - RNA, 16 nt, Mycobacterium avium subsp. paratuberculosis
gaccaccuugcgcagc

SEQ ID NO: 2840450 - RNA, 17 nt, Mycobacterium avium subsp. paratuberculosis
gaccaccuuggccggug

SEQ ID NO: 2840451 - RNA, 19 nt, Mycobacterium avium subsp. paratuberculosis
gaccaccuuggccggugcg

SEQ ID NO: 2840452 - RNA, 20 nt, Mycobacterium avium subsp. paratuberculosis
gaccacgaacaccggcgcga

SEQ ID NO: 2840453 - RNA, 22 nt, Mycobacterium avium subsp. paratuberculosis
gaccacgaacaccggcgcgacc

SEQ ID NO: 2840454 - RNA, 17 nt, Mycobacterium avium subsp. paratuberculosis
gaccacgaagggcgcca

SEQ ID NO: 2840455 - RNA, 20 nt, Mycobacterium avium subsp. paratuberculosis
gaccacgaagggcgccagca

SEQ ID NO: 2840456 - RNA, 20 nt, Mycobacterium avium subsp. paratuberculosis
gaccacgaucgucuggccgu

SEQ ID NO: 2840457 - RNA, 12 nt, Mycobacterium avium subsp. paratuberculosis
gaccacgcacac

SEQ ID NO: 2840458 - RNA, 14 nt, Mycobacterium avium subsp. paratuberculosis
gaccacgccgcgcu

SEQ ID NO: 2840459 - RNA, 13 nt, Mycobacterium avium subsp. paratuberculosis
gaccacgccgcgg

SEQ ID NO: 2840460 - RNA, 20 nt, Mycobacterium avium subsp. paratuberculosis
gaccacgccgcggucgcuga

SEQ ID NO: 2840461 - RNA, 22 nt, Mycobacterium avium subsp. paratuberculosis
gaccacgccgcggucgcugacc

SEQ ID NO: 2840462 - RNA, 14 nt, Mycobacterium avium subsp. paratuberculosis
gaccacgcuccaga

SEQ ID NO: 2840463 - RNA, 21 nt, Mycobacterium avium subsp. paratuberculosis
gaccacgcuccagaugcggug

SEQ ID NO: 2840464 - RNA, 24 nt, Mycobacterium avium subsp. paratuberculosis
gaccacgcuccagaugcgguggug

SEQ ID NO: 2840465 - RNA, 19 nt, Mycobacterium avium subsp. paratuberculosis
gaccacgcugagcaaccgc

SEQ ID NO: 2840466 - RNA, 15 nt, Mycobacterium avium subsp. paratuberculosis
gaccacggccccagc

SEQ ID NO: 2840467 - RNA, 23 nt, Mycobacterium avium subsp. paratuberculosis
gaccacggccugguacagcaccg

SEQ ID NO: 2840468 - RNA, 14 nt, Mycobacterium avium subsp. paratuberculosis
gaccacggcgcgga

SEQ ID NO: 2840469 - RNA, 16 nt, Mycobacterium avium subsp. paratuberculosis
gaccacggucacagcc

SEQ ID NO: 2840470 - RNA, 19 nt, Mycobacterium avium subsp. paratuberculosis
gaccacggucacagccgcg

SEQ ID NO: 2840471 - RNA, 20 nt, Mycobacterium avium subsp. paratuberculosis
gaccacggucacagccgcga

SEQ ID NO: 2840472 - RNA, 14 nt, Mycobacterium avium subsp. paratuberculosis
gaccacggucggcg

SEQ ID NO: 2840473 - RNA, 17 nt, Mycobacterium avium subsp. paratuberculosis
gaccacguccccgggcg

SEQ ID NO: 2840474 - RNA, 21 nt, Mycobacterium avium subsp. paratuberculosis
gaccacuccuggguuccggug

SEQ ID NO: 2840475 - RNA, 23 nt, Mycobacterium avium subsp. paratuberculosis
gaccagaccgaagaucaccgcga

SEQ ID NO: 2840476 - RNA, 16 nt, Mycobacterium avium subsp. paratuberculosis
gaccagauaggccagc

SEQ ID NO: 2840477 - RNA, 17 nt, Mycobacterium avium subsp. paratuberculosis
gaccagauaggccagcg

SEQ ID NO: 2840478 - RNA, 18 nt, Mycobacterium avium subsp. paratuberculosis
gaccagauaggccagcgc

SEQ ID NO: 2840479 - RNA, 19 nt, Mycobacterium avium subsp. paratuberculosis
gaccagauaggccagcgcg

SEQ ID NO: 2840480 - RNA, 22 nt, Mycobacterium avium subsp. paratuberculosis
gaccagauccucgaauccgcgg

SEQ ID NO: 2840481 - RNA, 16 nt, Mycobacterium avium subsp. paratuberculosis
gaccagauugcggcac

SEQ ID NO: 2840482 - RNA, 18 nt, Mycobacterium avium subsp. paratuberculosis
gaccagauugcggcacca

SEQ ID NO: 2840483 - RNA, 17 nt, Mycobacterium avium subsp. paratuberculosis
gaccagcacccgggccu

SEQ ID NO: 2840484 - RNA, 13 nt, Mycobacterium avium subsp. paratuberculosis
gaccagcaccgca

SEQ ID NO: 2840485 - RNA, 15 nt, Mycobacterium avium subsp. paratuberculosis
gaccagcaccgcauc

SEQ ID NO: 2840486 - RNA, 14 nt, Mycobacterium avium subsp. paratuberculosis
gaccagcacguugu

SEQ ID NO: 2840487 - RNA, 14 nt, Mycobacterium avium subsp. paratuberculosis
gaccagcagcugga

SEQ ID NO: 2840488 - RNA, 20 nt, Mycobacterium avium subsp. paratuberculosis
gaccagcaggacgcgcccgg

SEQ ID NO: 2840489 - RNA, 20 nt, Mycobacterium avium subsp. paratuberculosis
gaccagcaggucgagcaugc

SEQ ID NO: 2840490 - RNA, 22 nt, Mycobacterium avium subsp. paratuberculosis
gaccagcccgcucagagcugca

SEQ ID NO: 2840491 - RNA, 16 nt, Mycobacterium avium subsp. paratuberculosis
gaccagcccggccgcc

SEQ ID NO: 2840492 - RNA, 20 nt, Mycobacterium avium subsp. paratuberculosis
gaccagccgaggcgcucgca

SEQ ID NO: 2840493 - RNA, 23 nt, Mycobacterium avium subsp. paratuberculosis
gaccagccgcaucaccuucugcg

SEQ ID NO: 2840494 - RNA, 15 nt, Mycobacterium avium subsp. paratuberculosis
gaccagccgguaggc

SEQ ID NO: 2840495 - RNA, 13 nt, Mycobacterium avium subsp. paratuberculosis
gaccagccggucu

SEQ ID NO: 2840496 - RNA, 21 nt, Mycobacterium avium subsp. paratuberculosis
gaccagccggucuuggacagc

SEQ ID NO: 2840497 - RNA, 13 nt, Mycobacterium avium subsp. paratuberculosis
gaccagcgacggc

SEQ ID NO: 2840498 - RNA, 16 nt, Mycobacterium avium subsp. paratuberculosis
gaccagcgagcccagc

SEQ ID NO: 2840499 - RNA, 20 nt, Mycobacterium avium subsp. paratuberculosis
gaccagcgagcccagcugcg

SEQ ID NO: 2840500 - RNA, 15 nt, Mycobacterium avium subsp. paratuberculosis
gaccagcgcaaccgc

SEQ ID NO: 2840501 - RNA, 20 nt, Mycobacterium avium subsp. paratuberculosis
gaccagcgcaaccgcggcgg

SEQ ID NO: 2840502 - RNA, 22 nt, Mycobacterium avium subsp. paratuberculosis
gaccagcgcaaccgcggcggcg

SEQ ID NO: 2840503 - RNA, 14 nt, Mycobacterium avium subsp. paratuberculosis
gaccagcgcccccg

SEQ ID NO: 2840504 - RNA, 18 nt, Mycobacterium avium subsp. paratuberculosis
gaccagcgcccccgacag

SEQ ID NO: 2840505 - RNA, 21 nt, Mycobacterium avium subsp. paratuberculosis
gaccagcgcccccgacaggcc

SEQ ID NO: 2840506 - RNA, 19 nt, Mycobacterium avium subsp. paratuberculosis
gaccagcgccgagaccagc

SEQ ID NO: 2840507 - RNA, 20 nt, Mycobacterium avium subsp. paratuberculosis
gaccagcgccgagaccagcc

SEQ ID NO: 2840508 - RNA, 14 nt, Mycobacterium avium subsp. paratuberculosis
gaccagcgccgagg

SEQ ID NO: 2840509 - RNA, 19 nt, Mycobacterium avium subsp. paratuberculosis
gaccagcgccgaggugcug

SEQ ID NO: 2840510 - RNA, 16 nt, Mycobacterium avium subsp. paratuberculosis
gaccagcgccucgcgg

SEQ ID NO: 2840511 - RNA, 19 nt, Mycobacterium avium subsp. paratuberculosis
gaccagugcaccucgacga

SEQ ID NO: 2840512 - RNA, 15 nt, Mycobacterium avium subsp. paratuberculosis
gaccagugcccggcc

SEQ ID NO: 2840513 - RNA, 15 nt, Mycobacterium avium subsp. paratuberculosis
gaccagugguggccg

SEQ ID NO: 2840514 - RNA, 17 nt, Mycobacterium avium subsp. paratuberculosis
gaccaguucgcccuggc

SEQ ID NO: 2840515 - RNA, 19 nt, Mycobacterium avium subsp. paratuberculosis
gaccaguucgcccuggccg

SEQ ID NO: 2840516 - RNA, 20 nt, Mycobacterium avium subsp. paratuberculosis
gaccaguucgcccuggccgc

SEQ ID NO: 2840517 - RNA, 20 nt, Mycobacterium avium subsp. paratuberculosis
gaccaguucggccaccgcgu

SEQ ID NO: 2840518 - RNA, 20 nt, Mycobacterium avium subsp. paratuberculosis
gaccaguucuucgaugacgg

SEQ ID NO: 2840519 - RNA, 23 nt, Mycobacterium avium subsp. paratuberculosis
gaccaguucuucgaugacggccg

SEQ ID NO: 2840520 - RNA, 19 nt, Mycobacterium avium subsp. paratuberculosis
gaccauaaucggcucgugg

SEQ ID NO: 2840521 - RNA, 15 nt, Mycobacterium avium subsp. paratuberculosis
gaccaucagccugcg

SEQ ID NO: 2840522 - RNA, 16 nt, Mycobacterium avium subsp. paratuberculosis
gaccaucagccugcgg

SEQ ID NO: 2840523 - RNA, 15 nt, Mycobacterium avium subsp. paratuberculosis
gaccaucauggccuc

SEQ ID NO: 2840524 - RNA, 21 nt, Mycobacterium avium subsp. paratuberculosis
gaccauccacucgggccagcc

SEQ ID NO: 2840525 - RNA, 21 nt, Mycobacterium avium subsp. paratuberculosis
gaccaucgggucgucggcguc

SEQ ID NO: 2840526 - RNA, 14 nt, Mycobacterium avium subsp. paratuberculosis
gaccaugcccagca

SEQ ID NO: 2840527 - RNA, 13 nt, Mycobacterium avium subsp. paratuberculosis
gaccaugccgcgg

SEQ ID NO: 2840528 - RNA, 21 nt, Mycobacterium avium subsp. paratuberculosis
gaccaugccgcgggccagcag

SEQ ID NO: 2840529 - RNA, 23 nt, Mycobacterium avium subsp. paratuberculosis
gaccaugccgcgggccagcagcc

SEQ ID NO: 2840530 - RNA, 23 nt, Mycobacterium avium subsp. paratuberculosis
gaccaugccguagcggucgcccc

SEQ ID NO: 2840531 - RNA, 16 nt, Mycobacterium avium subsp. paratuberculosis
gaccauggcgcggcgg

SEQ ID NO: 2840532 - RNA, 17 nt, Mycobacterium avium subsp. paratuberculosis
gaccauggcgcggcggc

SEQ ID NO: 2840533 - RNA, 22 nt, Mycobacterium avium subsp. paratuberculosis
gaccauggcgcggcggccggcc

SEQ ID NO: 2840534 - RNA, 21 nt, Mycobacterium avium subsp. paratuberculosis
gaccaugucggcgacccgcac

SEQ ID NO: 2840535 - RNA, 21 nt, Mycobacterium avium subsp. paratuberculosis
gacccaacucaugggcccggc

SEQ ID NO: 2840536 - RNA, 22 nt, Mycobacterium avium subsp. paratuberculosis
gacccaacucaugggcccggcc

SEQ ID NO: 2840537 - RNA, 19 nt, Mycobacterium avium subsp. paratuberculosis
gacccacagcugccggccg

SEQ ID NO: 2840538 - RNA, 21 nt, Mycobacterium avium subsp. paratuberculosis
gacccacagcugccggccguu

SEQ ID NO: 2840539 - RNA, 13 nt, Mycobacterium avium subsp. paratuberculosis
gacccaccagccg

SEQ ID NO: 2840540 - RNA, 23 nt, Mycobacterium avium subsp. paratuberculosis
gacccacggguuggggccgcgga

SEQ ID NO: 2840541 - RNA, 19 nt, Mycobacterium avium subsp. paratuberculosis
gacccagacuugggcagca

SEQ ID NO: 2840542 - RNA, 14 nt, Mycobacterium avium subsp. paratuberculosis
gacccagcagcggc

SEQ ID NO: 2840543 - RNA, 16 nt, Mycobacterium avium subsp. paratuberculosis
gacccagcagcggccg

SEQ ID NO: 2840544 - RNA, 16 nt, Mycobacterium avium subsp. paratuberculosis
gacccagcaucgccgc

SEQ ID NO: 2840545 - RNA, 17 nt, Mycobacterium avium subsp. paratuberculosis
gacccagcaucgccgcg

SEQ ID NO: 2840546 - RNA, 17 nt, Mycobacterium avium subsp. paratuberculosis
gacccagcccggcgacg

SEQ ID NO: 2840547 - RNA, 17 nt, Mycobacterium avium subsp. paratuberculosis
gacccagcuccucggcc

SEQ ID NO: 2840548 - RNA, 20 nt, Mycobacterium avium subsp. paratuberculosis
gacccagcuccucggccagc

SEQ ID NO: 2840549 - RNA, 21 nt, Mycobacterium avium subsp. paratuberculosis
gacccagcuccucggccagca

SEQ ID NO: 2840550 - RNA, 15 nt, Mycobacterium avium subsp. paratuberculosis
gacccaggccgccgc

SEQ ID NO: 2840551 - RNA, 16 nt, Mycobacterium avium subsp. paratuberculosis
gacccaggccgccgcc

SEQ ID NO: 2840552 - RNA, 17 nt, Mycobacterium avium subsp. paratuberculosis
gacccaggccgccgcca

SEQ ID NO: 2840553 - RNA, 17 nt, Mycobacterium avium subsp. paratuberculosis
gacccauucgucggcgg

SEQ ID NO: 2840554 - RNA, 18 nt, Mycobacterium avium subsp. paratuberculosis
gacccauucgucggcggu

SEQ ID NO: 2840555 - RNA, 16 nt, Mycobacterium avium subsp. paratuberculosis
gaccccacaccuucgc

SEQ ID NO: 2840556 - RNA, 13 nt, Mycobacterium avium subsp. paratuberculosis
gaccccacagcgc

SEQ ID NO: 2840557 - RNA, 16 nt, Mycobacterium avium subsp. paratuberculosis
gaccccacagcgcgcc

SEQ ID NO: 2840558 - RNA, 14 nt, Mycobacterium avium subsp. paratuberculosis
gaccccagcgugac

SEQ ID NO: 2840559 - RNA, 15 nt, Mycobacterium avium subsp. paratuberculosis
gaccccccgacgccg

SEQ ID NO: 2840560 - RNA, 18 nt, Mycobacterium avium subsp. paratuberculosis
gaccccccgacgccgacg

SEQ ID NO: 2840561 - RNA, 22 nt, Mycobacterium avium subsp. paratuberculosis
gacccccgccgcgucggucagc

SEQ ID NO: 2840562 - RNA, 21 nt, Mycobacterium avium subsp. paratuberculosis
gacccccggugucugaccucg

SEQ ID NO: 2840563 - RNA, 13 nt, Mycobacterium avium subsp. paratuberculosis
gacccccucgucg

SEQ ID NO: 2840564 - RNA, 20 nt, Mycobacterium avium subsp. paratuberculosis
gacccccucgucgaucgcgg

SEQ ID NO: 2840565 - RNA, 17 nt, Mycobacterium avium subsp. paratuberculosis
gaccccgaaggcguugg

SEQ ID NO: 2840566 - RNA, 19 nt, Mycobacterium avium subsp. paratuberculosis
gaccccgacggcgccgcgg

SEQ ID NO: 2840567 - RNA, 19 nt, Mycobacterium avium subsp. paratuberculosis
gaccccgaugcgcucaccc

SEQ ID NO: 2840568 - RNA, 17 nt, Mycobacterium avium subsp. paratuberculosis
gaccccgaugcgcucgc

SEQ ID NO: 2840569 - RNA, 15 nt, Mycobacterium avium subsp. paratuberculosis
gaccccgccagcacc

SEQ ID NO: 2840570 - RNA, 20 nt, Mycobacterium avium subsp. paratuberculosis
gaccccgccagcaccgacag

SEQ ID NO: 2840571 - RNA, 15 nt, Mycobacterium avium subsp. paratuberculosis
gaccccgcccagcga

SEQ ID NO: 2840572 - RNA, 19 nt, Mycobacterium avium subsp. paratuberculosis
gaccccggccccggccggc

SEQ ID NO: 2840573 - RNA, 20 nt, Mycobacterium avium subsp. paratuberculosis
gaccccggccccggccggcg

SEQ ID NO: 2840574 - RNA, 18 nt, Mycobacterium avium subsp. paratuberculosis
gaccccggcgaccagcag

SEQ ID NO: 2840575 - RNA, 20 nt, Mycobacterium avium subsp. paratuberculosis
gaccccggcgaccagcaggu

SEQ ID NO: 2840576 - RNA, 18 nt, Mycobacterium avium subsp. paratuberculosis
gaccccggcggcaccgcc

SEQ ID NO: 2840577 - RNA, 23 nt, Mycobacterium avium subsp. paratuberculosis
gaccccggcguccaguagccgcc

SEQ ID NO: 2840578 - RNA, 19 nt, Mycobacterium avium subsp. paratuberculosis
gaccccggcugcugcacga

SEQ ID NO: 2840579 - RNA, 23 nt, Mycobacterium avium subsp. paratuberculosis
gaccccgguuucguuguccacca

SEQ ID NO: 2840580 - RNA, 16 nt, Mycobacterium avium subsp. paratuberculosis
gaccccguaccagcgc

SEQ ID NO: 2840581 - RNA, 15 nt, Mycobacterium avium subsp. paratuberculosis
gaccccgucgaacga

SEQ ID NO: 2840582 - RNA, 17 nt, Mycobacterium avium subsp. paratuberculosis
gaccccguucgccgaca

SEQ ID NO: 2840583 - RNA, 19 nt, Mycobacterium avium subsp. paratuberculosis
gaccccguucgccgacagc

SEQ ID NO: 2840584 - RNA, 20 nt, Mycobacterium avium subsp. paratuberculosis
gaccccuacgggcgcaccgc

SEQ ID NO: 2840585 - RNA, 22 nt, Mycobacterium avium subsp. paratuberculosis
gaccccuacgggcgcaccgcgc

SEQ ID NO: 2840586 - RNA, 16 nt, Mycobacterium avium subsp. paratuberculosis
gaccccucggcggccg

SEQ ID NO: 2840587 - RNA, 17 nt, Mycobacterium avium subsp. paratuberculosis
gaccccucggcggccgu

SEQ ID NO: 2840588 - RNA, 19 nt, Mycobacterium avium subsp. paratuberculosis
gaccccucggcggccgucg

SEQ ID NO: 2840589 - RNA, 18 nt, Mycobacterium avium subsp. paratuberculosis
gacccgaacuucagcgcg

SEQ ID NO: 2840590 - RNA, 21 nt, Mycobacterium avium subsp. paratuberculosis
gacccgaacuucagcgcgucg

SEQ ID NO: 2840591 - RNA, 15 nt, Mycobacterium avium subsp. paratuberculosis
gacccgaagccaggu

SEQ ID NO: 2840592 - RNA, 14 nt, Mycobacterium avium subsp. paratuberculosis
gacccgaagcccau

SEQ ID NO: 2840593 - RNA, 17 nt, Mycobacterium avium subsp. paratuberculosis
gacccgaagucgacgca

SEQ ID NO: 2840594 - RNA, 20 nt, Mycobacterium avium subsp. paratuberculosis
gacccgaccuuuugcccggc

SEQ ID NO: 2840595 - RNA, 15 nt, Mycobacterium avium subsp. paratuberculosis
gacccgucggggugc

SEQ ID NO: 2840596 - RNA, 15 nt, Mycobacterium avium subsp. paratuberculosis
gacccguuccccggc

SEQ ID NO: 2840597 - RNA, 16 nt, Mycobacterium avium subsp. paratuberculosis
gacccguugggccaga

SEQ ID NO: 2840598 - RNA, 19 nt, Mycobacterium avium subsp. paratuberculosis
gacccucagcagggcggca

SEQ ID NO: 2840599 - RNA, 22 nt, Mycobacterium avium subsp. paratuberculosis
gacccucagcagggcggcaccg

SEQ ID NO: 2840600 - RNA, 21 nt, Mycobacterium avium subsp. paratuberculosis
gacccugccgucaccggccau

SEQ ID NO: 2840601 - RNA, 18 nt, Mycobacterium avium subsp. paratuberculosis
gacccugcguccggcccg

SEQ ID NO: 2840602 - RNA, 21 nt, Mycobacterium avium subsp. paratuberculosis
gacccugcguccggcccggcg

SEQ ID NO: 2840603 - RNA, 22 nt, Mycobacterium avium subsp. paratuberculosis
gacccuggaugaucucgaugca

SEQ ID NO: 2840604 - RNA, 14 nt, Mycobacterium avium subsp. paratuberculosis
gacccuggccagca

SEQ ID NO: 2840605 - RNA, 15 nt, Mycobacterium avium subsp. paratuberculosis
gacccuggccagcac

SEQ ID NO: 2840606 - RNA, 17 nt, Mycobacterium avium subsp. paratuberculosis
gacccuggccagcaccg

SEQ ID NO: 2840607 - RNA, 22 nt, Mycobacterium avium subsp. paratuberculosis
gacccuuccggaacgacgcguc

SEQ ID NO: 2840608 - RNA, 15 nt, Mycobacterium avium subsp. paratuberculosis
gacccuucgaacgcg

SEQ ID NO: 2840609 - RNA, 16 nt, Mycobacterium avium subsp. paratuberculosis
gaccgaacccgggcgc

SEQ ID NO: 2840610 - RNA, 18 nt, Mycobacterium avium subsp. paratuberculosis
gaccgaagaucaccgcga

SEQ ID NO: 2840611 - RNA, 16 nt, Mycobacterium avium subsp. paratuberculosis
gaccgacagcaaaccg

SEQ ID NO: 2840612 - RNA, 22 nt, Mycobacterium avium subsp. paratuberculosis
gaccgacagcaaaccgaccgcc

SEQ ID NO: 2840613 - RNA, 12 nt, Mycobacterium avium subsp. paratuberculosis
gaccgacagccg

SEQ ID NO: 2840614 - RNA, 15 nt, Mycobacterium avium subsp. paratuberculosis
gaccgacauggccag

SEQ ID NO: 2840615 - RNA, 17 nt, Mycobacterium avium subsp. paratuberculosis
gaccgacauggccagca

SEQ ID NO: 2840616 - RNA, 17 nt, Mycobacterium avium subsp. paratuberculosis
gaccgacccggccagcg

SEQ ID NO: 2840617 - RNA, 14 nt, Mycobacterium avium subsp. paratuberculosis
gaccgacgacguga

SEQ ID NO: 2840618 - RNA, 16 nt, Mycobacterium avium subsp. paratuberculosis
gaccgacgacgugacg

SEQ ID NO: 2840619 - RNA, 13 nt, Mycobacterium avium subsp. paratuberculosis
gaccgacgcgguc

SEQ ID NO: 2840620 - RNA, 15 nt, Mycobacterium avium subsp. paratuberculosis
gaccgacggcgacca

SEQ ID NO: 2840621 - RNA, 17 nt, Mycobacterium avium subsp. paratuberculosis
gaccgacggcgaccagu

SEQ ID NO: 2840622 - RNA, 22 nt, Mycobacterium avium subsp. paratuberculosis
gaccgagaugaagacccggccg

SEQ ID NO: 2840623 - RNA, 15 nt, Mycobacterium avium subsp. paratuberculosis
gaccgagcagcgggg

SEQ ID NO: 2840624 - RNA, 17 nt, Mycobacterium avium subsp. paratuberculosis
gaccgagcagcggggug

SEQ ID NO: 2840625 - RNA, 21 nt, Mycobacterium avium subsp. paratuberculosis
gaccgagcagcggggugagca

SEQ ID NO: 2840626 - RNA, 17 nt, Mycobacterium avium subsp. paratuberculosis
gaccgagccgcgcgccg

SEQ ID NO: 2840627 - RNA, 18 nt, Mycobacterium avium subsp. paratuberculosis
gaccgagcgcgcgaucuc

SEQ ID NO: 2840628 - RNA, 13 nt, Mycobacterium avium subsp. paratuberculosis
gaccgagcggcgc

SEQ ID NO: 2840629 - RNA, 15 nt, Mycobacterium avium subsp. paratuberculosis
gaccgaggcgaucgc

SEQ ID NO: 2840630 - RNA, 13 nt, Mycobacterium avium subsp. paratuberculosis
gaccgaggugccg

SEQ ID NO: 2840631 - RNA, 16 nt, Mycobacterium avium subsp. paratuberculosis
gaccgaggugccgcgg

SEQ ID NO: 2840632 - RNA, 19 nt, Mycobacterium avium subsp. paratuberculosis
gaccgaggugccgcggguc

SEQ ID NO: 2840633 - RNA, 15 nt, Mycobacterium avium subsp. paratuberculosis
gaccgagucgucgcg

SEQ ID NO: 2840634 - RNA, 12 nt, Mycobacterium avium subsp. paratuberculosis
gaccgaucagcg

SEQ ID NO: 2840635 - RNA, 14 nt, Mycobacterium avium subsp. paratuberculosis
gaccgauccgccgg

SEQ ID NO: 2840636 - RNA, 17 nt, Mycobacterium avium subsp. paratuberculosis
gaccgauccgccggcga

SEQ ID NO: 2840637 - RNA, 15 nt, Mycobacterium avium subsp. paratuberculosis
gaccgaucuggcgau

SEQ ID NO: 2840638 - RNA, 15 nt, Mycobacterium avium subsp. paratuberculosis
gaccgaugccgcuga

SEQ ID NO: 2840639 - RNA, 17 nt, Mycobacterium avium subsp. paratuberculosis
gaccgauggccgcccgc

SEQ ID NO: 2840640 - RNA, 17 nt, Mycobacterium avium subsp. paratuberculosis
gaccgauggcggcggcc

SEQ ID NO: 2840641 - RNA, 19 nt, Mycobacterium avium subsp. paratuberculosis
gaccgauggcggcggcccg

SEQ ID NO: 2840642 - RNA, 15 nt, Mycobacterium avium subsp. paratuberculosis
gaccgcaagugcggu

SEQ ID NO: 2840643 - RNA, 20 nt, Mycobacterium avium subsp. paratuberculosis
gaccgcaagugcggucagcu

SEQ ID NO: 2840644 - RNA, 18 nt, Mycobacterium avium subsp. paratuberculosis
gaccgcacaauccgguca

SEQ ID NO: 2840645 - RNA, 20 nt, Mycobacterium avium subsp. paratuberculosis
gaccgcacaauccggucagc

SEQ ID NO: 2840646 - RNA, 21 nt, Mycobacterium avium subsp. paratuberculosis
gaccgcacaauccggucagcg

SEQ ID NO: 2840647 - RNA, 23 nt, Mycobacterium avium subsp. paratuberculosis
gaccgcacaauccggucagcgug

SEQ ID NO: 2840648 - RNA, 21 nt, Mycobacterium avium subsp. paratuberculosis
gaccgcacccccagcucgacg

SEQ ID NO: 2840649 - RNA, 23 nt, Mycobacterium avium subsp. paratuberculosis
gaccgcacccccagcucgacgac

SEQ ID NO: 2840650 - RNA, 13 nt, Mycobacterium avium subsp. paratuberculosis
gaccgcaccgacc

SEQ ID NO: 2840651 - RNA, 17 nt, Mycobacterium avium subsp. paratuberculosis
gaccgcagcaggcggac

SEQ ID NO: 2840652 - RNA, 18 nt, Mycobacterium avium subsp. paratuberculosis
gaccgcagcaggcggacg

SEQ ID NO: 2840653 - RNA, 22 nt, Mycobacterium avium subsp. paratuberculosis
gaccgcagcaggcggacggcga

SEQ ID NO: 2840654 - RNA, 20 nt, Mycobacterium avium subsp. paratuberculosis
gaccgcagccuucuucgccg

SEQ ID NO: 2840655 - RNA, 23 nt, Mycobacterium avium subsp. paratuberculosis
gaccgcagccuucuucgccgggg

SEQ ID NO: 2840656 - RNA, 16 nt, Mycobacterium avium subsp. paratuberculosis
gaccgcaggucgaugg

SEQ ID NO: 2840657 - RNA, 18 nt, Mycobacterium avium subsp. paratuberculosis
gaccgcaggucgauggcg

SEQ ID NO: 2840658 - RNA, 14 nt, Mycobacterium avium subsp. paratuberculosis
gaccgccaccaccc

SEQ ID NO: 2840659 - RNA, 15 nt, Mycobacterium avium subsp. paratuberculosis
gaccgccaccacccg

SEQ ID NO: 2840660 - RNA, 17 nt, Mycobacterium avium subsp. paratuberculosis
gaccgccaccacccggc

SEQ ID NO: 2840661 - RNA, 18 nt, Mycobacterium avium subsp. paratuberculosis
gaccgccaccagaucgug

SEQ ID NO: 2840662 - RNA, 21 nt, Mycobacterium avium subsp. paratuberculosis
gaccgccaccagaucgugucc

SEQ ID NO: 2840663 - RNA, 21 nt, Mycobacterium avium subsp. paratuberculosis
gaccgccaccucgagcucacc

SEQ ID NO: 2840664 - RNA, 16 nt, Mycobacterium avium subsp. paratuberculosis
gaccgccagcaccgcg

SEQ ID NO: 2840665 - RNA, 13 nt, Mycobacterium avium subsp. paratuberculosis
gaccgccagcagc

SEQ ID NO: 2840666 - RNA, 20 nt, Mycobacterium avium subsp. paratuberculosis
gaccgccagcagcagccgcg

SEQ ID NO: 2840667 - RNA, 14 nt, Mycobacterium avium subsp. paratuberculosis
gaccgcccgcucga

SEQ ID NO: 2840668 - RNA, 16 nt, Mycobacterium avium subsp. paratuberculosis
gaccgcccgcuguucg

SEQ ID NO: 2840669 - RNA, 20 nt, Mycobacterium avium subsp. paratuberculosis
gaccgcccgggccaggcgcg

SEQ ID NO: 2840670 - RNA, 24 nt, Mycobacterium avium subsp. paratuberculosis
gaccgcccgggccaggcgcgcgua

SEQ ID NO: 2840671 - RNA, 13 nt, Mycobacterium avium subsp. paratuberculosis
gaccgcccggggc

SEQ ID NO: 2840672 - RNA, 15 nt, Mycobacterium avium subsp. paratuberculosis
gaccgcccggggcgc

SEQ ID NO: 2840673 - RNA, 20 nt, Mycobacterium avium subsp. paratuberculosis
gaccgcccggggcgcggacc

SEQ ID NO: 2840674 - RNA, 14 nt, Mycobacterium avium subsp. paratuberculosis
gaccgcccggguga

SEQ ID NO: 2840675 - RNA, 13 nt, Mycobacterium avium subsp. paratuberculosis
gaccgccgacacc

SEQ ID NO: 2840676 - RNA, 14 nt, Mycobacterium avium subsp. paratuberculosis
gaccgccgacacca

SEQ ID NO: 2840677 - RNA, 15 nt, Mycobacterium avium subsp. paratuberculosis
gaccgccgacaccac

SEQ ID NO: 2840678 - RNA, 19 nt, Mycobacterium avium subsp. paratuberculosis
gaccgccgacaccaccgcg

SEQ ID NO: 2840679 - RNA, 20 nt, Mycobacterium avium subsp. paratuberculosis
gaccgccgacaccaccgcgc

SEQ ID NO: 2840680 - RNA, 15 nt, Mycobacterium avium subsp. paratuberculosis
gaccgcgucgacggc

SEQ ID NO: 2840681 - RNA, 16 nt, Mycobacterium avium subsp. paratuberculosis
gaccgcgucgacggcg

SEQ ID NO: 2840682 - RNA, 17 nt, Mycobacterium avium subsp. paratuberculosis
gaccgcgucgacggcgu

SEQ ID NO: 2840683 - RNA, 13 nt, Mycobacterium avium subsp. paratuberculosis
gaccgcgucggcg

SEQ ID NO: 2840684 - RNA, 16 nt, Mycobacterium avium subsp. paratuberculosis
gaccgcgugucggcac

SEQ ID NO: 2840685 - RNA, 13 nt, Mycobacterium avium subsp. paratuberculosis
gaccgcgugugcc

SEQ ID NO: 2840686 - RNA, 23 nt, Mycobacterium avium subsp. paratuberculosis
gaccgcgugugcccgccucgcag

SEQ ID NO: 2840687 - RNA, 16 nt, Mycobacterium avium subsp. paratuberculosis
gaccgcguuggcgccg

SEQ ID NO: 2840688 - RNA, 17 nt, Mycobacterium avium subsp. paratuberculosis
gaccgcguuggcgccga

SEQ ID NO: 2840689 - RNA, 18 nt, Mycobacterium avium subsp. paratuberculosis
gaccgcuugacgccgccg

SEQ ID NO: 2840690 - RNA, 19 nt, Mycobacterium avium subsp. paratuberculosis
gaccgcuugacgccgccga

SEQ ID NO: 2840691 - RNA, 20 nt, Mycobacterium avium subsp. paratuberculosis
gaccggaagccuguuggcca

SEQ ID NO: 2840692 - RNA, 15 nt, Mycobacterium avium subsp. paratuberculosis
gaccggacagcuggg

SEQ ID NO: 2840693 - RNA, 16 nt, Mycobacterium avium subsp. paratuberculosis
gaccggagccgucucg

SEQ ID NO: 2840694 - RNA, 14 nt, Mycobacterium avium subsp. paratuberculosis
gaccggaucggcca

SEQ ID NO: 2840695 - RNA, 15 nt, Mycobacterium avium subsp. paratuberculosis
gaccggaucggccag

SEQ ID NO: 2840696 - RNA, 21 nt, Mycobacterium avium subsp. paratuberculosis
gaccggaucggccagcagguc

SEQ ID NO: 2840697 - RNA, 22 nt, Mycobacterium avium subsp. paratuberculosis
gaccggaugaaggacuggccca

SEQ ID NO: 2840698 - RNA, 17 nt, Mycobacterium avium subsp. paratuberculosis
gaccggaugaugccggu

SEQ ID NO: 2840699 - RNA, 14 nt, Mycobacterium avium subsp. paratuberculosis
gaccggcaccagca

SEQ ID NO: 2840700 - RNA, 15 nt, Mycobacterium avium subsp. paratuberculosis
gaccggcaccagcag

SEQ ID NO: 2840701 - RNA, 17 nt, Mycobacterium avium subsp. paratuberculosis
gaccggcaccagcagcc

SEQ ID NO: 2840702 - RNA, 14 nt, Mycobacterium avium subsp. paratuberculosis
gaccggcagcaccg

SEQ ID NO: 2840703 - RNA, 12 nt, Mycobacterium avium subsp. paratuberculosis
gaccggccaccu

SEQ ID NO: 2840704 - RNA, 20 nt, Mycobacterium avium subsp. paratuberculosis
gaccggccaccucgucggcg

SEQ ID NO: 2840705 - RNA, 12 nt, Mycobacterium avium subsp. paratuberculosis
gaccggccagca

SEQ ID NO: 2840706 - RNA, 14 nt, Mycobacterium avium subsp. paratuberculosis
gaccggccagcagc

SEQ ID NO: 2840707 - RNA, 15 nt, Mycobacterium avium subsp. paratuberculosis
gaccggccagcagcc

SEQ ID NO: 2840708 - RNA, 20 nt, Mycobacterium avium subsp. paratuberculosis
gaccggccagcauggucucg

SEQ ID NO: 2840709 - RNA, 18 nt, Mycobacterium avium subsp. paratuberculosis
gaccggccaucuccugca

SEQ ID NO: 2840710 - RNA, 21 nt, Mycobacterium avium subsp. paratuberculosis
gaccggccaucuccugcacgc

SEQ ID NO: 2840711 - RNA, 20 nt, Mycobacterium avium subsp. paratuberculosis
gaccggccccaacggcgugc

SEQ ID NO: 2840712 - RNA, 13 nt, Mycobacterium avium subsp. paratuberculosis
gaccggcccggcg

SEQ ID NO: 2840713 - RNA, 14 nt, Mycobacterium avium subsp. paratuberculosis
gaccggcccggcgg

SEQ ID NO: 2840714 - RNA, 16 nt, Mycobacterium avium subsp. paratuberculosis
gaccggcccggcggcc

SEQ ID NO: 2840715 - RNA, 19 nt, Mycobacterium avium subsp. paratuberculosis
gaccggcccggcggccggc

SEQ ID NO: 2840716 - RNA, 20 nt, Mycobacterium avium subsp. paratuberculosis
gaccggcccggcggccggcc

SEQ ID NO: 2840717 - RNA, 21 nt, Mycobacterium avium subsp. paratuberculosis
gaccggcccggcggccggccg

SEQ ID NO: 2840718 - RNA, 13 nt, Mycobacterium avium subsp. paratuberculosis
gaccggccggggc

SEQ ID NO: 2840719 - RNA, 14 nt, Mycobacterium avium subsp. paratuberculosis
gaccggccggggcg

SEQ ID NO: 2840720 - RNA, 16 nt, Mycobacterium avium subsp. paratuberculosis
gaccggccgugcgcgu

SEQ ID NO: 2840721 - RNA, 17 nt, Mycobacterium avium subsp. paratuberculosis
gaccggccugcagcgcg

SEQ ID NO: 2840722 - RNA, 18 nt, Mycobacterium avium subsp. paratuberculosis
gaccggccugcagcgcgg

SEQ ID NO: 2840723 - RNA, 13 nt, Mycobacterium avium subsp. paratuberculosis
gaccggcgaggug

SEQ ID NO: 2840724 - RNA, 17 nt, Mycobacterium avium subsp. paratuberculosis
gaccggcgaggugcgcc

SEQ ID NO: 2840725 - RNA, 12 nt, Mycobacterium avium subsp. paratuberculosis
gaccggcgaucc

SEQ ID NO: 2840726 - RNA, 13 nt, Mycobacterium avium subsp. paratuberculosis
gaccggcgaucgu

SEQ ID NO: 2840727 - RNA, 15 nt, Mycobacterium avium subsp. paratuberculosis
gaccggcgaucguca

SEQ ID NO: 2840728 - RNA, 13 nt, Mycobacterium avium subsp. paratuberculosis
gaccggcgccggc

SEQ ID NO: 2840729 - RNA, 15 nt, Mycobacterium avium subsp. paratuberculosis
gaccggcgccggccg

SEQ ID NO: 2840730 - RNA, 16 nt, Mycobacterium avium subsp. paratuberculosis
gaccggcgccggccgc

SEQ ID NO: 2840731 - RNA, 23 nt, Mycobacterium avium subsp. paratuberculosis
gaccggcgccggccgccggaucg

SEQ ID NO: 2840732 - RNA, 20 nt, Mycobacterium avium subsp. paratuberculosis
gaccggcgccgggcagcccg

SEQ ID NO: 2840733 - RNA, 17 nt, Mycobacterium avium subsp. paratuberculosis
gaccggcgcgcagcauc

SEQ ID NO: 2840734 - RNA, 15 nt, Mycobacterium avium subsp. paratuberculosis
gaccggcgcgcccga

SEQ ID NO: 2840735 - RNA, 13 nt, Mycobacterium avium subsp. paratuberculosis
gaccggcggccag

SEQ ID NO: 2840736 - RNA, 16 nt, Mycobacterium avium subsp. paratuberculosis
gaccggcggccagcga

SEQ ID NO: 2840737 - RNA, 21 nt, Mycobacterium avium subsp. paratuberculosis
gaccggcggccgccaucaucc

SEQ ID NO: 2840738 - RNA, 17 nt, Mycobacterium avium subsp. paratuberculosis
gaccggcggcgaucggc

SEQ ID NO: 2840739 - RNA, 19 nt, Mycobacterium avium subsp. paratuberculosis
gaccggcggcgaucggcgc

SEQ ID NO: 2840740 - RNA, 22 nt, Mycobacterium avium subsp. paratuberculosis
gaccggcggcgaucggcgcggc

SEQ ID NO: 2840741 - RNA, 15 nt, Mycobacterium avium subsp. paratuberculosis
gaccggcggugccgg

SEQ ID NO: 2840742 - RNA, 16 nt, Mycobacterium avium subsp. paratuberculosis
gaccggcggugccggc

SEQ ID NO: 2840743 - RNA, 17 nt, Mycobacterium avium subsp. paratuberculosis
gaccggcggugccggcc

SEQ ID NO: 2840744 - RNA, 12 nt, Mycobacterium avium subsp. paratuberculosis
gaccggcggugu

SEQ ID NO: 2840745 - RNA, 15 nt, Mycobacterium avium subsp. paratuberculosis
gaccggcucgccggc

SEQ ID NO: 2840746 - RNA, 16 nt, Mycobacterium avium subsp. paratuberculosis
gaccggcucgccggcg

SEQ ID NO: 2840747 - RNA, 14 nt, Mycobacterium avium subsp. paratuberculosis
gaccggcucgccgu

SEQ ID NO: 2840748 - RNA, 20 nt, Mycobacterium avium subsp. paratuberculosis
gaccggcucguagcuggugc

SEQ ID NO: 2840749 - RNA, 17 nt, Mycobacterium avium subsp. paratuberculosis
gaccggcugcucgcgcu

SEQ ID NO: 2840750 - RNA, 21 nt, Mycobacterium avium subsp. paratuberculosis
gaccggcugcucgcgcugccg

SEQ ID NO: 2840751 - RNA, 14 nt, Mycobacterium avium subsp. paratuberculosis
gaccgggaagccga

SEQ ID NO: 2840752 - RNA, 20 nt, Mycobacterium avium subsp. paratuberculosis
gaccgggaagccgagcuugg

SEQ ID NO: 2840753 - RNA, 15 nt, Mycobacterium avium subsp. paratuberculosis
gaccgggacgacggc

SEQ ID NO: 2840754 - RNA, 16 nt, Mycobacterium avium subsp. paratuberculosis
gaccgggacgacggcg

SEQ ID NO: 2840755 - RNA, 18 nt, Mycobacterium avium subsp. paratuberculosis
gaccgggacgacggcgcc

SEQ ID NO: 2840756 - RNA, 20 nt, Mycobacterium avium subsp. paratuberculosis
gaccgggacgacggcgccgc

SEQ ID NO: 2840757 - RNA, 16 nt, Mycobacterium avium subsp. paratuberculosis
gaccgggcccggcgcc

SEQ ID NO: 2840758 - RNA, 14 nt, Mycobacterium avium subsp. paratuberculosis
gaccgggcgcuccg

SEQ ID NO: 2840759 - RNA, 14 nt, Mycobacterium avium subsp. paratuberculosis
gaccgggcgggcug

SEQ ID NO: 2840760 - RNA, 23 nt, Mycobacterium avium subsp. paratuberculosis
gaccgggcgggcugcgggcaucg

SEQ ID NO: 2840761 - RNA, 14 nt, Mycobacterium avium subsp. paratuberculosis
gaccgggcuccagc

SEQ ID NO: 2840762 - RNA, 20 nt, Mycobacterium avium subsp. paratuberculosis
gaccgggcuccagcgggucc

SEQ ID NO: 2840763 - RNA, 14 nt, Mycobacterium avium subsp. paratuberculosis
gaccggggacuuga

SEQ ID NO: 2840764 - RNA, 17 nt, Mycobacterium avium subsp. paratuberculosis
gaccggggacuugacga

SEQ ID NO: 2840765 - RNA, 23 nt, Mycobacterium avium subsp. paratuberculosis
gaccucgcgcccggcgccggccc

SEQ ID NO: 2840766 - RNA, 14 nt, Mycobacterium avium subsp. paratuberculosis
gaccucgcgccgcg

SEQ ID NO: 2840767 - RNA, 16 nt, Mycobacterium avium subsp. paratuberculosis
gaccucgcgccgcgau

SEQ ID NO: 2840768 - RNA, 18 nt, Mycobacterium avium subsp. paratuberculosis
gaccucgcgcgucacgcu

SEQ ID NO: 2840769 - RNA, 19 nt, Mycobacterium avium subsp. paratuberculosis
gaccucgcgcgucacgcug

SEQ ID NO: 2840770 - RNA, 14 nt, Mycobacterium avium subsp. paratuberculosis
gaccucggccacca

SEQ ID NO: 2840771 - RNA, 16 nt, Mycobacterium avium subsp. paratuberculosis
gaccucggccaccacc

SEQ ID NO: 2840772 - RNA, 23 nt, Mycobacterium avium subsp. paratuberculosis
gaccucggccaccaccucgcggg

SEQ ID NO: 2840773 - RNA, 15 nt, Mycobacterium avium subsp. paratuberculosis
gaccucggccagcgu

SEQ ID NO: 2840774 - RNA, 18 nt, Mycobacterium avium subsp. paratuberculosis
gaccucggcgaccagcga

SEQ ID NO: 2840775 - RNA, 18 nt, Mycobacterium avium subsp. paratuberculosis
gaccucggcggccagcgc

SEQ ID NO: 2840776 - RNA, 23 nt, Mycobacterium avium subsp. paratuberculosis
gaccucggguguaggcccgauca

SEQ ID NO: 2840777 - RNA, 19 nt, Mycobacterium avium subsp. paratuberculosis
gaccucggugucgaggucg

SEQ ID NO: 2840778 - RNA, 15 nt, Mycobacterium avium subsp. paratuberculosis
gaccucgucgacggc

SEQ ID NO: 2840779 - RNA, 19 nt, Mycobacterium avium subsp. paratuberculosis
gaccucgucgacggcggcg

SEQ ID NO: 2840780 - RNA, 11 nt, Mycobacterium avium subsp. paratuberculosis
gaccucgucgg

SEQ ID NO: 2840781 - RNA, 15 nt, Mycobacterium avium subsp. paratuberculosis
gaccucgucggcggc

SEQ ID NO: 2840782 - RNA, 16 nt, Mycobacterium avium subsp. paratuberculosis
gaccucgucggcggcg

SEQ ID NO: 2840783 - RNA, 17 nt, Mycobacterium avium subsp. paratuberculosis
gaccucgucggcggcga

SEQ ID NO: 2840784 - RNA, 23 nt, Mycobacterium avium subsp. paratuberculosis
gaccucgucggcggcgacggcga

SEQ ID NO: 2840785 - RNA, 18 nt, Mycobacterium avium subsp. paratuberculosis
gaccucgucggcggugcc

SEQ ID NO: 2840786 - RNA, 20 nt, Mycobacterium avium subsp. paratuberculosis
gaccucgucgggcgccagcc

SEQ ID NO: 2840787 - RNA, 21 nt, Mycobacterium avium subsp. paratuberculosis
gaccucgucgggcgccagccc

SEQ ID NO: 2840788 - RNA, 23 nt, Mycobacterium avium subsp. paratuberculosis
gaccucgucgggcgccagcccgc

SEQ ID NO: 2840789 - RNA, 19 nt, Mycobacterium avium subsp. paratuberculosis
gaccucuucggcgccggca

SEQ ID NO: 2840790 - RNA, 23 nt, Mycobacterium avium subsp. paratuberculosis
gaccucuugggacuggauggcga

SEQ ID NO: 2840791 - RNA, 14 nt, Mycobacterium avium subsp. paratuberculosis
gaccugaucuucga

SEQ ID NO: 2840792 - RNA, 13 nt, Mycobacterium avium subsp. paratuberculosis
gaccugcagcgcc

SEQ ID NO: 2840793 - RNA, 16 nt, Mycobacterium avium subsp. paratuberculosis
gaccugcaucucgacc

SEQ ID NO: 2840794 - RNA, 15 nt, Mycobacterium avium subsp. paratuberculosis
gaccugcccgggccc

SEQ ID NO: 2840795 - RNA, 18 nt, Mycobacterium avium subsp. paratuberculosis
gaccugcccgggcccgau

SEQ ID NO: 2840796 - RNA, 13 nt, Mycobacterium avium subsp. paratuberculosis
gaccugccggcga

SEQ ID NO: 2840797 - RNA, 22 nt, Mycobacterium avium subsp. paratuberculosis
gaccugcgagauggggugaugc

SEQ ID NO: 2840798 - RNA, 14 nt, Mycobacterium avium subsp. paratuberculosis
gaccugcgggccca

SEQ ID NO: 2840799 - RNA, 20 nt, Mycobacterium avium subsp. paratuberculosis
gaccugcgggcccaccgcgc

SEQ ID NO: 2840800 - RNA, 17 nt, Mycobacterium avium subsp. paratuberculosis
gaccugcucgucgguga

SEQ ID NO: 2840801 - RNA, 21 nt, Mycobacterium avium subsp. paratuberculosis
gaccugcugcucgucgcgggc

SEQ ID NO: 2840802 - RNA, 18 nt, Mycobacterium avium subsp. paratuberculosis
gaccugcugggcgggcag

SEQ ID NO: 2840803 - RNA, 22 nt, Mycobacterium avium subsp. paratuberculosis
gaccugcugggcgggcagccgc

SEQ ID NO: 2840804 - RNA, 23 nt, Mycobacterium avium subsp. paratuberculosis
gaccugcuugagcccgucgacgu

SEQ ID NO: 2840805 - RNA, 16 nt, Mycobacterium avium subsp. paratuberculosis
gaccugcuuggcggcc

SEQ ID NO: 2840806 - RNA, 18 nt, Mycobacterium avium subsp. paratuberculosis
gaccugcuuggcggccug

SEQ ID NO: 2840807 - RNA, 20 nt, Mycobacterium avium subsp. paratuberculosis
gaccugcuuggcggccugcg

SEQ ID NO: 2840808 - RNA, 21 nt, Mycobacterium avium subsp. paratuberculosis
gaccugcuuggcggccugcgc

SEQ ID NO: 2840809 - RNA, 15 nt, Mycobacterium avium subsp. paratuberculosis
gaccuggacgccgca

SEQ ID NO: 2840810 - RNA, 18 nt, Mycobacterium avium subsp. paratuberculosis
gaccuggacgccgcacgc

SEQ ID NO: 2840811 - RNA, 20 nt, Mycobacterium avium subsp. paratuberculosis
gaccuggacgccgcacgcga

SEQ ID NO: 2840812 - RNA, 13 nt, Mycobacterium avium subsp. paratuberculosis
gaccuggccggcc

SEQ ID NO: 2840813 - RNA, 14 nt, Mycobacterium avium subsp. paratuberculosis
gaccuggccggccu

SEQ ID NO: 2840814 - RNA, 15 nt, Mycobacterium avium subsp. paratuberculosis
gaccuggcggccgga

SEQ ID NO: 2840815 - RNA, 17 nt, Mycobacterium avium subsp. paratuberculosis
gaccuggcgggccagcu

SEQ ID NO: 2840816 - RNA, 14 nt, Mycobacterium avium subsp. paratuberculosis
gaccugggcggcca

SEQ ID NO: 2840817 - RNA, 16 nt, Mycobacterium avium subsp. paratuberculosis
gaccugggcggccacc

SEQ ID NO: 2840818 - RNA, 22 nt, Mycobacterium avium subsp. paratuberculosis
gaccugggucugcggccggggc

SEQ ID NO: 2840819 - RNA, 14 nt, Mycobacterium avium subsp. paratuberculosis
gaccugggugcgcc

SEQ ID NO: 2840820 - RNA, 16 nt, Mycobacterium avium subsp. paratuberculosis
gaccugggugcgccac

SEQ ID NO: 2840821 - RNA, 20 nt, Mycobacterium avium subsp. paratuberculosis
gaccugguccaccgcggcgg

SEQ ID NO: 2840822 - RNA, 22 nt, Mycobacterium avium subsp. paratuberculosis
gaccugguccaccgcggcggcc

SEQ ID NO: 2840823 - RNA, 15 nt, Mycobacterium avium subsp. paratuberculosis
gaccuggucgccgaa

SEQ ID NO: 2840824 - RNA, 18 nt, Mycobacterium avium subsp. paratuberculosis
gaccuggucgccgaacgu

SEQ ID NO: 2840825 - RNA, 14 nt, Mycobacterium avium subsp. paratuberculosis
gaccuggucgccgc

SEQ ID NO: 2840826 - RNA, 17 nt, Mycobacterium avium subsp. paratuberculosis
gaccuggucgccgccgu

SEQ ID NO: 2840827 - RNA, 22 nt, Mycobacterium avium subsp. paratuberculosis
gaccuggugcucgaugcgacgc

SEQ ID NO: 2840828 - RNA, 20 nt, Mycobacterium avium subsp. paratuberculosis
gaccugguugacaccaccga

SEQ ID NO: 2840829 - RNA, 15 nt, Mycobacterium avium subsp. paratuberculosis
gaccugguugccgcc

SEQ ID NO: 2840830 - RNA, 17 nt, Mycobacterium avium subsp. paratuberculosis
gaccugguugccgcccu

SEQ ID NO: 2840831 - RNA, 20 nt, Mycobacterium avium subsp. paratuberculosis
gaccugguugccgcccucgg

SEQ ID NO: 2840832 - RNA, 23 nt, Mycobacterium avium subsp. paratuberculosis
gaccugguugccgcccucggccg

SEQ ID NO: 2840833 - RNA, 21 nt, Mycobacterium avium subsp. paratuberculosis
gaccugugcgccccacggcgc

SEQ ID NO: 2840834 - RNA, 24 nt, Mycobacterium avium subsp. paratuberculosis
gaccuguuugaacaccucgaagcc

SEQ ID NO: 2840835 - RNA, 17 nt, Mycobacterium avium subsp. paratuberculosis
gaccuguuuggccagcc

SEQ ID NO: 2840836 - RNA, 14 nt, Mycobacterium avium subsp. paratuberculosis
gaccuucgagccgc

SEQ ID NO: 2840837 - RNA, 19 nt, Mycobacterium avium subsp. paratuberculosis
gaccuucucccgcggcagc

SEQ ID NO: 2840838 - RNA, 13 nt, Mycobacterium avium subsp. paratuberculosis
gaccuucugcugc

SEQ ID NO: 2840839 - RNA, 22 nt, Mycobacterium avium subsp. paratuberculosis
gaccuucugcugcacguccgcc

SEQ ID NO: 2840840 - RNA, 23 nt, Mycobacterium avium subsp. paratuberculosis
gaccuucuggccuugcagcccgc

SEQ ID NO: 2840841 - RNA, 16 nt, Mycobacterium avium subsp. paratuberculosis
gaccuucuuggucagc

SEQ ID NO: 2840842 - RNA, 18 nt, Mycobacterium avium subsp. paratuberculosis
gaccuugaccaccgagcc

SEQ ID NO: 2840843 - RNA, 16 nt, Mycobacterium avium subsp. paratuberculosis
gaccuugcgcagccgg

SEQ ID NO: 2840844 - RNA, 17 nt, Mycobacterium avium subsp. paratuberculosis
gaccuugcgcagccggc

SEQ ID NO: 2840845 - RNA, 21 nt, Mycobacterium avium subsp. paratuberculosis
gaccuugcgcagccggcagca

SEQ ID NO: 2840846 - RNA, 18 nt, Mycobacterium avium subsp. paratuberculosis
gaccuuggcgcugaucga

SEQ ID NO: 2840847 - RNA, 18 nt, Mycobacterium avium subsp. paratuberculosis
gaccuuggugucggcgag

SEQ ID NO: 2840848 - RNA, 23 nt, Mycobacterium avium subsp. paratuberculosis
gaccuuggugucggcgagcuugg

SEQ ID NO: 2840849 - RNA, 17 nt, Mycobacterium avium subsp. paratuberculosis
gacgaccuugucgcgca

SEQ ID NO: 2840850 - RNA, 18 nt, Mycobacterium avium subsp. paratuberculosis
gacgaccuugucgcgcac

SEQ ID NO: 2840851 - RNA, 22 nt, Mycobacterium avium subsp. paratuberculosis
gacgaccuugucgcgcacccgc

SEQ ID NO: 2840852 - RNA, 23 nt, Mycobacterium avium subsp. paratuberculosis
gacgacgaacggguaggugcccg

SEQ ID NO: 2840853 - RNA, 16 nt, Mycobacterium avium subsp. paratuberculosis
gacgacgaaucccgcc

SEQ ID NO: 2840854 - RNA, 21 nt, Mycobacterium avium subsp. paratuberculosis
gacgacgaaucccgccucggu

SEQ ID NO: 2840855 - RNA, 13 nt, Mycobacterium avium subsp. paratuberculosis
gacgacgccacca

SEQ ID NO: 2840856 - RNA, 17 nt, Mycobacterium avium subsp. paratuberculosis
gacgacgccaccaucga

SEQ ID NO: 2840857 - RNA, 17 nt, Mycobacterium avium subsp. paratuberculosis
gacgacgccagcugccg

SEQ ID NO: 2840858 - RNA, 19 nt, Mycobacterium avium subsp. paratuberculosis
gacgacgccagcugccgcg

SEQ ID NO: 2840859 - RNA, 20 nt, Mycobacterium avium subsp. paratuberculosis
gacgacgccagcugccgcga

SEQ ID NO: 2840860 - RNA, 20 nt, Mycobacterium avium subsp. paratuberculosis
gacgacgccgauccgcagcc

SEQ ID NO: 2840861 - RNA, 22 nt, Mycobacterium avium subsp. paratuberculosis
gacgacgccgucacggaucgcc

SEQ ID NO: 2840862 - RNA, 19 nt, Mycobacterium avium subsp. paratuberculosis
gacgacgcggucgucgucg

SEQ ID NO: 2840863 - RNA, 17 nt, Mycobacterium avium subsp. paratuberculosis
gacgacggccaccgcga

SEQ ID NO: 2840864 - RNA, 20 nt, Mycobacterium avium subsp. paratuberculosis
gacgacggccaccgcgacgc

SEQ ID NO: 2840865 - RNA, 13 nt, Mycobacterium avium subsp. paratuberculosis
gacgacggccagc

SEQ ID NO: 2840866 - RNA, 20 nt, Mycobacterium avium subsp. paratuberculosis
gacgacggcgaacgucgaug

SEQ ID NO: 2840867 - RNA, 14 nt, Mycobacterium avium subsp. paratuberculosis
gacgacggcgccgc

SEQ ID NO: 2840868 - RNA, 16 nt, Mycobacterium avium subsp. paratuberculosis
gacgacggcgccgccc

SEQ ID NO: 2840869 - RNA, 20 nt, Mycobacterium avium subsp. paratuberculosis
gacgacggcgccgcccgggc

SEQ ID NO: 2840870 - RNA, 15 nt, Mycobacterium avium subsp. paratuberculosis
gacgacggcgccgcg

SEQ ID NO: 2840871 - RNA, 17 nt, Mycobacterium avium subsp. paratuberculosis
gacgacggcgccgcguc

SEQ ID NO: 2840872 - RNA, 14 nt, Mycobacterium avium subsp. paratuberculosis
gacgacggcggagu

SEQ ID NO: 2840873 - RNA, 22 nt, Mycobacterium avium subsp. paratuberculosis
gacgacggcggggaugcccggg

SEQ ID NO: 2840874 - RNA, 15 nt, Mycobacterium avium subsp. paratuberculosis
gacgacgggcagggu

SEQ ID NO: 2840875 - RNA, 13 nt, Mycobacterium avium subsp. paratuberculosis
gacgacggguggg

SEQ ID NO: 2840876 - RNA, 15 nt, Mycobacterium avium subsp. paratuberculosis
gacgacgggugggug

SEQ ID NO: 2840877 - RNA, 16 nt, Mycobacterium avium subsp. paratuberculosis
gacgacggucaccggc

SEQ ID NO: 2840878 - RNA, 21 nt, Mycobacterium avium subsp. paratuberculosis
gacgacggucaccggcaggcg

SEQ ID NO: 2840879 - RNA, 16 nt, Mycobacterium avium subsp. paratuberculosis
gacgacggucuucccg

SEQ ID NO: 2840880 - RNA, 20 nt, Mycobacterium avium subsp. paratuberculosis
gacgacggucuucccgccgc

SEQ ID NO: 2840881 - RNA, 23 nt, Mycobacterium avium subsp. paratuberculosis
gacgacggucuucccgccgccgu

SEQ ID NO: 2840882 - RNA, 13 nt, Mycobacterium avium subsp. paratuberculosis
gacgacgucgacc

SEQ ID NO: 2840883 - RNA, 14 nt, Mycobacterium avium subsp. paratuberculosis
gacgacgucgaccg

SEQ ID NO: 2840884 - RNA, 15 nt, Mycobacterium avium subsp. paratuberculosis
gacgacgucgaccgc

SEQ ID NO: 2840885 - RNA, 15 nt, Mycobacterium avium subsp. paratuberculosis
gacgacgucgacgac

SEQ ID NO: 2840886 - RNA, 18 nt, Mycobacterium avium subsp. paratuberculosis
gacgacgucgacgacccg

SEQ ID NO: 2840887 - RNA, 14 nt, Mycobacterium avium subsp. paratuberculosis
gacgacgucgaugu

SEQ ID NO: 2840888 - RNA, 14 nt, Mycobacterium avium subsp. paratuberculosis
gacgacgucgcgca

SEQ ID NO: 2840889 - RNA, 23 nt, Mycobacterium avium subsp. paratuberculosis
gacgacgugacgaccuggucgcc

SEQ ID NO: 2840890 - RNA, 21 nt, Mycobacterium avium subsp. paratuberculosis
gacgacgugcccuuccccggc

SEQ ID NO: 2840891 - RNA, 22 nt, Mycobacterium avium subsp. paratuberculosis
gacgacgugcccuuccccggcg

SEQ ID NO: 2840892 - RNA, 23 nt, Mycobacterium avium subsp. paratuberculosis
gacgacgugcccuuccccggcgg

SEQ ID NO: 2840893 - RNA, 21 nt, Mycobacterium avium subsp. paratuberculosis
gacgacgugguggaugaugcc

SEQ ID NO: 2840894 - RNA, 16 nt, Mycobacterium avium subsp. paratuberculosis
gacgacguugcgggcc

SEQ ID NO: 2840895 - RNA, 17 nt, Mycobacterium avium subsp. paratuberculosis
gacgacguuggccagca

SEQ ID NO: 2840896 - RNA, 21 nt, Mycobacterium avium subsp. paratuberculosis
gacgacguuggccagcaccgc

SEQ ID NO: 2840897 - RNA, 18 nt, Mycobacterium avium subsp. paratuberculosis
gacgacucguucgacgcc

SEQ ID NO: 2840898 - RNA, 22 nt, Mycobacterium avium subsp. paratuberculosis
gacgacugggugcgcgggcgcc

SEQ ID NO: 2840899 - RNA, 17 nt, Mycobacterium avium subsp. paratuberculosis
gacgacuucggccucgg

SEQ ID NO: 2840900 - RNA, 19 nt, Mycobacterium avium subsp. paratuberculosis
gacgacuucggccucgguu

SEQ ID NO: 2840901 - RNA, 14 nt, Mycobacterium avium subsp. paratuberculosis
gacgagcagccgca

SEQ ID NO: 2840902 - RNA, 22 nt, Mycobacterium avium subsp. paratuberculosis
gacgagcaggcugaucucggcg

SEQ ID NO: 2840903 - RNA, 15 nt, Mycobacterium avium subsp. paratuberculosis
gacgagcccgccggc

SEQ ID NO: 2840904 - RNA, 16 nt, Mycobacterium avium subsp. paratuberculosis
gacgagcccgccggcg

SEQ ID NO: 2840905 - RNA, 13 nt, Mycobacterium avium subsp. paratuberculosis
gacgagccgccgc

SEQ ID NO: 2840906 - RNA, 14 nt, Mycobacterium avium subsp. paratuberculosis
gacgagccgggcca

SEQ ID NO: 2840907 - RNA, 16 nt, Mycobacterium avium subsp. paratuberculosis
gacgagcgggccgauc

SEQ ID NO: 2840908 - RNA, 14 nt, Mycobacterium avium subsp. paratuberculosis
gacgagcucaccgc

SEQ ID NO: 2840909 - RNA, 15 nt, Mycobacterium avium subsp. paratuberculosis
gacgagcucaccgcc

SEQ ID NO: 2840910 - RNA, 16 nt, Mycobacterium avium subsp. paratuberculosis
gacgagcucaccgccg

SEQ ID NO: 2840911 - RNA, 17 nt, Mycobacterium avium subsp. paratuberculosis
gacgagcucaccgccga

SEQ ID NO: 2840912 - RNA, 21 nt, Mycobacterium avium subsp. paratuberculosis
gacgaggagaccuccugcugg

SEQ ID NO: 2840913 - RNA, 13 nt, Mycobacterium avium subsp. paratuberculosis
gacgaggcccacg

SEQ ID NO: 2840914 - RNA, 14 nt, Mycobacterium avium subsp. paratuberculosis
gacgaggcccacga

SEQ ID NO: 2840915 - RNA, 16 nt, Mycobacterium avium subsp. paratuberculosis
gacgaggcccgcaaga

SEQ ID NO: 2840916 - RNA, 15 nt, Mycobacterium avium subsp. paratuberculosis
gacgaggcgggcgau

SEQ ID NO: 2840917 - RNA, 18 nt, Mycobacterium avium subsp. paratuberculosis
gacgaggcgggcgaucuc

SEQ ID NO: 2840918 - RNA, 14 nt, Mycobacterium avium subsp. paratuberculosis
gacgaggggcagca

SEQ ID NO: 2840919 - RNA, 22 nt, Mycobacterium avium subsp. paratuberculosis
gacgaggggcagcagcgcccac

SEQ ID NO: 2840920 - RNA, 21 nt, Mycobacterium avium subsp. paratuberculosis
gacgagucccaugggcugcaa

SEQ ID NO: 2840921 - RNA, 14 nt, Mycobacterium avium subsp. paratuberculosis
gacgagucgacgcu

SEQ ID NO: 2840922 - RNA, 21 nt, Mycobacterium avium subsp. paratuberculosis
gacgagucgacgcugugcgcc

SEQ ID NO: 2840923 - RNA, 15 nt, Mycobacterium avium subsp. paratuberculosis
gacgagucgccguug

SEQ ID NO: 2840924 - RNA, 17 nt, Mycobacterium avium subsp. paratuberculosis
gacgaguggucggccgc

SEQ ID NO: 2840925 - RNA, 21 nt, Mycobacterium avium subsp. paratuberculosis
gacgaucaccggcuugccgau

SEQ ID NO: 2840926 - RNA, 16 nt, Mycobacterium avium subsp. paratuberculosis
gacgaucacgacgcga

SEQ ID NO: 2840927 - RNA, 12 nt, Mycobacterium avium subsp. paratuberculosis
gacgaucagcag

SEQ ID NO: 2840928 - RNA, 13 nt, Mycobacterium avium subsp. paratuberculosis
gacgaucagcagc

SEQ ID NO: 2840929 - RNA, 22 nt, Mycobacterium avium subsp. paratuberculosis
gacgaucagcagccgggccugc

SEQ ID NO: 2840930 - RNA, 15 nt, Mycobacterium avium subsp. paratuberculosis
gacgauccacagcgc

SEQ ID NO: 2840931 - RNA, 18 nt, Mycobacterium avium subsp. paratuberculosis
gacgaucccggcgagcac

SEQ ID NO: 2840932 - RNA, 18 nt, Mycobacterium avium subsp. paratuberculosis
gacgauccgcgcccuggu

SEQ ID NO: 2840933 - RNA, 14 nt, Mycobacterium avium subsp. paratuberculosis
gacgauccgggccg

SEQ ID NO: 2840934 - RNA, 23 nt, Mycobacterium avium subsp. paratuberculosis
gacgccaugucgaugucgacgcc

SEQ ID NO: 2840935 - RNA, 14 nt, Mycobacterium avium subsp. paratuberculosis
gacgcccaacuacc

SEQ ID NO: 2840936 - RNA, 21 nt, Mycobacterium avium subsp. paratuberculosis
gacgcccaacuacccgccgac

SEQ ID NO: 2840937 - RNA, 14 nt, Mycobacterium avium subsp. paratuberculosis
gacgcccacagcgc

SEQ ID NO: 2840938 - RNA, 17 nt, Mycobacterium avium subsp. paratuberculosis
gacgcccacagcgccag

SEQ ID NO: 2840939 - RNA, 18 nt, Mycobacterium avium subsp. paratuberculosis
gacgcccacagcgccagc

SEQ ID NO: 2840940 - RNA, 19 nt, Mycobacterium avium subsp. paratuberculosis
gacgcccacagcgccagca

SEQ ID NO: 2840941 - RNA, 21 nt, Mycobacterium avium subsp. paratuberculosis
gacgcccacagcgccagcacg

SEQ ID NO: 2840942 - RNA, 22 nt, Mycobacterium avium subsp. paratuberculosis
gacgcccacugguaaccgcccg

SEQ ID NO: 2840943 - RNA, 19 nt, Mycobacterium avium subsp. paratuberculosis
gacgcccagaacugggccg

SEQ ID NO: 2840944 - RNA, 23 nt, Mycobacterium avium subsp. paratuberculosis
gacgcccagaacugggccgccgu

SEQ ID NO: 2840945 - RNA, 16 nt, Mycobacterium avium subsp. paratuberculosis
gacgcccaggcucagg

SEQ ID NO: 2840946 - RNA, 23 nt, Mycobacterium avium subsp. paratuberculosis
gacgcccaggugcacccgaugcu

SEQ ID NO: 2840947 - RNA, 14 nt, Mycobacterium avium subsp. paratuberculosis
gacgcccccgguga

SEQ ID NO: 2840948 - RNA, 22 nt, Mycobacterium avium subsp. paratuberculosis
gacgcccccggugacgauccgg

SEQ ID NO: 2840949 - RNA, 11 nt, Mycobacterium avium subsp. paratuberculosis
gacgcccgcga

SEQ ID NO: 2840950 - RNA, 15 nt, Mycobacterium avium subsp. paratuberculosis
gacgcccgcgacccg

SEQ ID NO: 2840951 - RNA, 16 nt, Mycobacterium avium subsp. paratuberculosis
gacgcccgcgacccga

SEQ ID NO: 2840952 - RNA, 11 nt, Mycobacterium avium subsp. paratuberculosis
gacgcccggcg

SEQ ID NO: 2840953 - RNA, 13 nt, Mycobacterium avium subsp. paratuberculosis
gacgcccggcgag

SEQ ID NO: 2840954 - RNA, 14 nt, Mycobacterium avium subsp. paratuberculosis
gacgcccggcgagu

SEQ ID NO: 2840955 - RNA, 16 nt, Mycobacterium avium subsp. paratuberculosis
gacgcccggcgccggc

SEQ ID NO: 2840956 - RNA, 17 nt, Mycobacterium avium subsp. paratuberculosis
gacgcccggcgccggcg

SEQ ID NO: 2840957 - RNA, 19 nt, Mycobacterium avium subsp. paratuberculosis
gacgcccggcuucgccgcc

SEQ ID NO: 2840958 - RNA, 16 nt, Mycobacterium avium subsp. paratuberculosis
gacgcccggucgacca

SEQ ID NO: 2840959 - RNA, 14 nt, Mycobacterium avium subsp. paratuberculosis
gacgcccgucccgc

SEQ ID NO: 2840960 - RNA, 15 nt, Mycobacterium avium subsp. paratuberculosis
gacgcccgucccgcc

SEQ ID NO: 2840961 - RNA, 16 nt, Mycobacterium avium subsp. paratuberculosis
gacgcccuccuggcgg

SEQ ID NO: 2840962 - RNA, 22 nt, Mycobacterium avium subsp. paratuberculosis
gacgcccuccuggcggguggcg

SEQ ID NO: 2840963 - RNA, 19 nt, Mycobacterium avium subsp. paratuberculosis
gacgcccugccacagcgac

SEQ ID NO: 2840964 - RNA, 19 nt, Mycobacterium avium subsp. paratuberculosis
gacgcccuuggcgcccagc

SEQ ID NO: 2840965 - RNA, 20 nt, Mycobacterium avium subsp. paratuberculosis
gacgcccuuggcgcccagcg

SEQ ID NO: 2840966 - RNA, 16 nt, Mycobacterium avium subsp. paratuberculosis
gacgccgaacugccgg

SEQ ID NO: 2840967 - RNA, 21 nt, Mycobacterium avium subsp. paratuberculosis
gacgccgaacugccggaccag

SEQ ID NO: 2840968 - RNA, 18 nt, Mycobacterium avium subsp. paratuberculosis
gacgccgaagaucagcgc

SEQ ID NO: 2840969 - RNA, 17 nt, Mycobacterium avium subsp. paratuberculosis
gacgccgaauccgggca

SEQ ID NO: 2840970 - RNA, 21 nt, Mycobacterium avium subsp. paratuberculosis
gacgccgaauccgggcaugcu

SEQ ID NO: 2840971 - RNA, 16 nt, Mycobacterium avium subsp. paratuberculosis
gacgccgacaccagcg

SEQ ID NO: 2840972 - RNA, 17 nt, Mycobacterium avium subsp. paratuberculosis
gacgccgacaccagcgc

SEQ ID NO: 2840973 - RNA, 18 nt, Mycobacterium avium subsp. paratuberculosis
gacgccgacaccagcgcg

SEQ ID NO: 2840974 - RNA, 18 nt, Mycobacterium avium subsp. paratuberculosis
gacgccgacaucgcggcg

SEQ ID NO: 2840975 - RNA, 15 nt, Mycobacterium avium subsp. paratuberculosis
gacgccgaccgcggu

SEQ ID NO: 2840976 - RNA, 23 nt, Mycobacterium avium subsp. paratuberculosis
gacgccgaccgcggucgcggcgc

SEQ ID NO: 2840977 - RNA, 11 nt, Mycobacterium avium subsp. paratuberculosis
gacgccgacgc

SEQ ID NO: 2840978 - RNA, 14 nt, Mycobacterium avium subsp. paratuberculosis
gacgccgacgccca

SEQ ID NO: 2840979 - RNA, 16 nt, Mycobacterium avium subsp. paratuberculosis
gacgccgacgcccagc

SEQ ID NO: 2840980 - RNA, 13 nt, Mycobacterium avium subsp. paratuberculosis
gacgccgacggca

SEQ ID NO: 2840981 - RNA, 15 nt, Mycobacterium avium subsp. paratuberculosis
gacgccgagcagcuc

SEQ ID NO: 2840982 - RNA, 24 nt, Mycobacterium avium subsp. paratuberculosis
gacgccgagcagcucagccgccug

SEQ ID NO: 2840983 - RNA, 19 nt, Mycobacterium avium subsp. paratuberculosis
gacgccgaguaacucggcc

SEQ ID NO: 2840984 - RNA, 20 nt, Mycobacterium avium subsp. paratuberculosis
gacgccgaguaacucggccu

SEQ ID NO: 2840985 - RNA, 15 nt, Mycobacterium avium subsp. paratuberculosis
gacgccgauccgcag

SEQ ID NO: 2840986 - RNA, 16 nt, Mycobacterium avium subsp. paratuberculosis
gacgccgauccgcagc

SEQ ID NO: 2840987 - RNA, 20 nt, Mycobacterium avium subsp. paratuberculosis
gacgccgauccgcagccgcu

SEQ ID NO: 2840988 - RNA, 23 nt, Mycobacterium avium subsp. paratuberculosis
gacgccgauccgcugcggauccg

SEQ ID NO: 2840989 - RNA, 13 nt, Mycobacterium avium subsp. paratuberculosis
gacgccgaugauc

SEQ ID NO: 2840990 - RNA, 18 nt, Mycobacterium avium subsp. paratuberculosis
gacgccgaugaucugguu

SEQ ID NO: 2840991 - RNA, 17 nt, Mycobacterium avium subsp. paratuberculosis
gacgccgauggugaccu

SEQ ID NO: 2840992 - RNA, 20 nt, Mycobacterium avium subsp. paratuberculosis
gacgccgauggugaccucgg

SEQ ID NO: 2840993 - RNA, 24 nt, Mycobacterium avium subsp. paratuberculosis
gacgccgauggugaccucggucga

SEQ ID NO: 2840994 - RNA, 14 nt, Mycobacterium avium subsp. paratuberculosis
gacgccgcaccgca

SEQ ID NO: 2840995 - RNA, 21 nt, Mycobacterium avium subsp. paratuberculosis
gacgccgcacgaauugccggu

SEQ ID NO: 2840996 - RNA, 13 nt, Mycobacterium avium subsp. paratuberculosis
gacgccgcacgcg

SEQ ID NO: 2840997 - RNA, 19 nt, Mycobacterium avium subsp. paratuberculosis
gacgccgcccucucacggc

SEQ ID NO: 2840998 - RNA, 21 nt, Mycobacterium avium subsp. paratuberculosis
gacgccgcccucucacggcgg

SEQ ID NO: 2840999 - RNA, 15 nt, Mycobacterium avium subsp. paratuberculosis
gacgccgccgccgag

SEQ ID NO: 2841000 - RNA, 12 nt, Mycobacterium avium subsp. paratuberculosis
gacgccgccgug

SEQ ID NO: 2841001 - RNA, 13 nt, Mycobacterium avium subsp. paratuberculosis
gacgccgccgugg

SEQ ID NO: 2841002 - RNA, 14 nt, Mycobacterium avium subsp. paratuberculosis
gacgccgcgcacga

SEQ ID NO: 2841003 - RNA, 18 nt, Mycobacterium avium subsp. paratuberculosis
gacgccgcgcagcggggc

SEQ ID NO: 2841004 - RNA, 19 nt, Mycobacterium avium subsp. paratuberculosis
gacgccgcgccgcccggcg

SEQ ID NO: 2841005 - RNA, 14 nt, Mycobacterium avium subsp. paratuberculosis
gacgccgcgcuggc

SEQ ID NO: 2841006 - RNA, 16 nt, Mycobacterium avium subsp. paratuberculosis
gacgccgcgcuggccg

SEQ ID NO: 2841007 - RNA, 18 nt, Mycobacterium avium subsp. paratuberculosis
gacgccgcggaagcccca

SEQ ID NO: 2841008 - RNA, 15 nt, Mycobacterium avium subsp. paratuberculosis
gacgccgcucggcca

SEQ ID NO: 2841009 - RNA, 18 nt, Mycobacterium avium subsp. paratuberculosis
gacgccgcucggccagcg

SEQ ID NO: 2841010 - RNA, 19 nt, Mycobacterium avium subsp. paratuberculosis
gacgccgcucggccagcgc

SEQ ID NO: 2841011 - RNA, 20 nt, Mycobacterium avium subsp. paratuberculosis
gacgccgcucggccagcgca

SEQ ID NO: 2841012 - RNA, 22 nt, Mycobacterium avium subsp. paratuberculosis
gacgccgcucggccagcgcagc

SEQ ID NO: 2841013 - RNA, 14 nt, Mycobacterium avium subsp. paratuberculosis
gacgccgcugccgg

SEQ ID NO: 2841014 - RNA, 14 nt, Mycobacterium avium subsp. paratuberculosis
gacgccgcugcgug

SEQ ID NO: 2841015 - RNA, 17 nt, Mycobacterium avium subsp. paratuberculosis
gacgccgcugcgugccc

SEQ ID NO: 2841016 - RNA, 16 nt, Mycobacterium avium subsp. paratuberculosis
gacgccggacagcugg

SEQ ID NO: 2841017 - RNA, 13 nt, Mycobacterium avium subsp. paratuberculosis
gacgccggacccc

SEQ ID NO: 2841018 - RNA, 21 nt, Mycobacterium avium subsp. paratuberculosis
gacgccggaccccacagcgcg

SEQ ID NO: 2841019 - RNA, 21 nt, Mycobacterium avium subsp. paratuberculosis
gacgcggcgucgggcgggugg

SEQ ID NO: 2841020 - RNA, 14 nt, Mycobacterium avium subsp. paratuberculosis
gacgcggcucgcgc

SEQ ID NO: 2841021 - RNA, 16 nt, Mycobacterium avium subsp. paratuberculosis
gacgcggcucgcgcgg

SEQ ID NO: 2841022 - RNA, 17 nt, Mycobacterium avium subsp. paratuberculosis
gacgcggcucgcgcggu

SEQ ID NO: 2841023 - RNA, 20 nt, Mycobacterium avium subsp. paratuberculosis
gacgcggcucgcgcgguguu

SEQ ID NO: 2841024 - RNA, 15 nt, Mycobacterium avium subsp. paratuberculosis
gacgcgggaccgggc

SEQ ID NO: 2841025 - RNA, 13 nt, Mycobacterium avium subsp. paratuberculosis
gacgcgggccggc

SEQ ID NO: 2841026 - RNA, 22 nt, Mycobacterium avium subsp. paratuberculosis
gacgcgggccggcacccgggcc

SEQ ID NO: 2841027 - RNA, 16 nt, Mycobacterium avium subsp. paratuberculosis
gacgcgggccugggca

SEQ ID NO: 2841028 - RNA, 14 nt, Mycobacterium avium subsp. paratuberculosis
gacgcgggcgccca

SEQ ID NO: 2841029 - RNA, 15 nt, Mycobacterium avium subsp. paratuberculosis
gacgcgggcgcccag

SEQ ID NO: 2841030 - RNA, 16 nt, Mycobacterium avium subsp. paratuberculosis
gacgcgggcgcccagc

SEQ ID NO: 2841031 - RNA, 17 nt, Mycobacterium avium subsp. paratuberculosis
gacgcgggcgcccagca

SEQ ID NO: 2841032 - RNA, 14 nt, Mycobacterium avium subsp. paratuberculosis
gacgcggggcggcg

SEQ ID NO: 2841033 - RNA, 17 nt, Mycobacterium avium subsp. paratuberculosis
gacgcggggcggcggcg

SEQ ID NO: 2841034 - RNA, 20 nt, Mycobacterium avium subsp. paratuberculosis
gacgcggggcggcggcgccg

SEQ ID NO: 2841035 - RNA, 14 nt, Mycobacterium avium subsp. paratuberculosis
gacgcggucaccgg

SEQ ID NO: 2841036 - RNA, 14 nt, Mycobacterium avium subsp. paratuberculosis
gacgcggucgaaca

SEQ ID NO: 2841037 - RNA, 22 nt, Mycobacterium avium subsp. paratuberculosis
gacgcggucgucgucgucggug

SEQ ID NO: 2841038 - RNA, 16 nt, Mycobacterium avium subsp. paratuberculosis
gacgcggucugcggug

SEQ ID NO: 2841039 - RNA, 16 nt, Mycobacterium avium subsp. paratuberculosis
gacgcggugacaugcc

SEQ ID NO: 2841040 - RNA, 17 nt, Mycobacterium avium subsp. paratuberculosis
gacgcggugacggugaa

SEQ ID NO: 2841041 - RNA, 16 nt, Mycobacterium avium subsp. paratuberculosis
gacgcggugagcgcgc

SEQ ID NO: 2841042 - RNA, 16 nt, Mycobacterium avium subsp. paratuberculosis
gacgcgguggcgugcu

SEQ ID NO: 2841043 - RNA, 14 nt, Mycobacterium avium subsp. paratuberculosis
gacgcgguggugcu

SEQ ID NO: 2841044 - RNA, 18 nt, Mycobacterium avium subsp. paratuberculosis
gacgcgguggugcucgcc

SEQ ID NO: 2841045 - RNA, 22 nt, Mycobacterium avium subsp. paratuberculosis
gacgcguccguagugcucggcg

SEQ ID NO: 2841046 - RNA, 23 nt, Mycobacterium avium subsp. paratuberculosis
gacgcguccguagugcucggcgu

SEQ ID NO: 2841047 - RNA, 14 nt, Mycobacterium avium subsp. paratuberculosis
gacgcgucgcggcg

SEQ ID NO: 2841048 - RNA, 17 nt, Mycobacterium avium subsp. paratuberculosis
gacgcgugcgucaucgc

SEQ ID NO: 2841049 - RNA, 19 nt, Mycobacterium avium subsp. paratuberculosis
gacgcgugcgucaucgcgc

SEQ ID NO: 2841050 - RNA, 22 nt, Mycobacterium avium subsp. paratuberculosis
gacgcgugcgucaucgcgcugg

SEQ ID NO: 2841051 - RNA, 18 nt, Mycobacterium avium subsp. paratuberculosis
gacgcguugaaaguccuu

SEQ ID NO: 2841052 - RNA, 20 nt, Mycobacterium avium subsp. paratuberculosis
gacgcguuguugcucggcgg

SEQ ID NO: 2841053 - RNA, 21 nt, Mycobacterium avium subsp. paratuberculosis
gacgcguuguugcucggcggc

SEQ ID NO: 2841054 - RNA, 22 nt, Mycobacterium avium subsp. paratuberculosis
gacgcguuguugcucggcggcc

SEQ ID NO: 2841055 - RNA, 22 nt, Mycobacterium avium subsp. paratuberculosis
gacgcuaagcgcugaaccggua

SEQ ID NO: 2841056 - RNA, 14 nt, Mycobacterium avium subsp. paratuberculosis
gacgcucacccggc

SEQ ID NO: 2841057 - RNA, 17 nt, Mycobacterium avium subsp. paratuberculosis
gacgcucacccggccca

SEQ ID NO: 2841058 - RNA, 18 nt, Mycobacterium avium subsp. paratuberculosis
gacgcucacccggcccac

SEQ ID NO: 2841059 - RNA, 19 nt, Mycobacterium avium subsp. paratuberculosis
gacgcucacccggcccacc

SEQ ID NO: 2841060 - RNA, 20 nt, Mycobacterium avium subsp. paratuberculosis
gacgcucacccggcccaccg

SEQ ID NO: 2841061 - RNA, 22 nt, Mycobacterium avium subsp. paratuberculosis
gacgcucacccggcccaccggc

SEQ ID NO: 2841062 - RNA, 23 nt, Mycobacterium avium subsp. paratuberculosis
gacgcucacccggcccaccggcc

SEQ ID NO: 2841063 - RNA, 16 nt, Mycobacterium avium subsp. paratuberculosis
gacgcucaggcgucca

SEQ ID NO: 2841064 - RNA, 21 nt, Mycobacterium avium subsp. paratuberculosis
gacgcucaggcguccagccag

SEQ ID NO: 2841065 - RNA, 23 nt, Mycobacterium avium subsp. paratuberculosis
gacgcucaggcguccagccagcg

SEQ ID NO: 2841066 - RNA, 24 nt, Mycobacterium avium subsp. paratuberculosis
gacgcucaggcguccagccagcgu

SEQ ID NO: 2841067 - RNA, 17 nt, Mycobacterium avium subsp. paratuberculosis
gacgcucgacggccggc

SEQ ID NO: 2841068 - RNA, 17 nt, Mycobacterium avium subsp. paratuberculosis
gacgcucgaggccccgc

SEQ ID NO: 2841069 - RNA, 17 nt, Mycobacterium avium subsp. paratuberculosis
gacgcucgccaccccgc

SEQ ID NO: 2841070 - RNA, 13 nt, Mycobacterium avium subsp. paratuberculosis
gacgcucgccggc

SEQ ID NO: 2841071 - RNA, 17 nt, Mycobacterium avium subsp. paratuberculosis
gacgcucgccggcggcc

SEQ ID NO: 2841072 - RNA, 22 nt, Mycobacterium avium subsp. paratuberculosis
gacgcucgcgguugggccgccg

SEQ ID NO: 2841073 - RNA, 14 nt, Mycobacterium avium subsp. paratuberculosis
gacgcucgcguggc

SEQ ID NO: 2841074 - RNA, 18 nt, Mycobacterium avium subsp. paratuberculosis
gacgcucggccguggccg

SEQ ID NO: 2841075 - RNA, 12 nt, Mycobacterium avium subsp. paratuberculosis
gacgcucggcgc

SEQ ID NO: 2841076 - RNA, 16 nt, Mycobacterium avium subsp. paratuberculosis
gacgcucggcgccgcg

SEQ ID NO: 2841077 - RNA, 16 nt, Mycobacterium avium subsp. paratuberculosis
gacgcucggcgccggc

SEQ ID NO: 2841078 - RNA, 17 nt, Mycobacterium avium subsp. paratuberculosis
gacgcucggcgccggcc

SEQ ID NO: 2841079 - RNA, 18 nt, Mycobacterium avium subsp. paratuberculosis
gacgcucggcgccggccg

SEQ ID NO: 2841080 - RNA, 13 nt, Mycobacterium avium subsp. paratuberculosis
gacgcucggcgcg

SEQ ID NO: 2841081 - RNA, 13 nt, Mycobacterium avium subsp. paratuberculosis
gacgcucggcggc

SEQ ID NO: 2841082 - RNA, 14 nt, Mycobacterium avium subsp. paratuberculosis
gacgcucggcggcc

SEQ ID NO: 2841083 - RNA, 19 nt, Mycobacterium avium subsp. paratuberculosis
gacgcucggggccgguugg

SEQ ID NO: 2841084 - RNA, 14 nt, Mycobacterium avium subsp. paratuberculosis
gacgcucggucgcc

SEQ ID NO: 2841085 - RNA, 16 nt, Mycobacterium avium subsp. paratuberculosis
gacgcucggucgccac

SEQ ID NO: 2841086 - RNA, 19 nt, Mycobacterium avium subsp. paratuberculosis
gacgcugaacagcagcagc

SEQ ID NO: 2841087 - RNA, 14 nt, Mycobacterium avium subsp. paratuberculosis
gacgcugaacagcc

SEQ ID NO: 2841088 - RNA, 16 nt, Mycobacterium avium subsp. paratuberculosis
gacgcugaacagcccg

SEQ ID NO: 2841089 - RNA, 19 nt, Mycobacterium avium subsp. paratuberculosis
gacgcugaacagcccgagc

SEQ ID NO: 2841090 - RNA, 20 nt, Mycobacterium avium subsp. paratuberculosis
gacgcugaacagcccgagca

SEQ ID NO: 2841091 - RNA, 22 nt, Mycobacterium avium subsp. paratuberculosis
gacgcugaagaagaugggcgcc

SEQ ID NO: 2841092 - RNA, 16 nt, Mycobacterium avium subsp. paratuberculosis
gacgcugacgaugcgg

SEQ ID NO: 2841093 - RNA, 22 nt, Mycobacterium avium subsp. paratuberculosis
gacgcugacgaugcggccggcg

SEQ ID NO: 2841094 - RNA, 17 nt, Mycobacterium avium subsp. paratuberculosis
gacgcugagcacccgcc

SEQ ID NO: 2841095 - RNA, 15 nt, Mycobacterium avium subsp. paratuberculosis
gacgcugagccgcuc

SEQ ID NO: 2841096 - RNA, 12 nt, Mycobacterium avium subsp. paratuberculosis
gacgcugagcgc

SEQ ID NO: 2841097 - RNA, 15 nt, Mycobacterium avium subsp. paratuberculosis
gacgcugagcgccag

SEQ ID NO: 2841098 - RNA, 18 nt, Mycobacterium avium subsp. paratuberculosis
gacgcugagcgccaggcc

SEQ ID NO: 2841099 - RNA, 20 nt, Mycobacterium avium subsp. paratuberculosis
gacgcugagcgccaggccau

SEQ ID NO: 2841100 - RNA, 19 nt, Mycobacterium avium subsp. paratuberculosis
gacgcugaucuacgucggc

SEQ ID NO: 2841101 - RNA, 12 nt, Mycobacterium avium subsp. paratuberculosis
gacgcugcaggu

SEQ ID NO: 2841102 - RNA, 17 nt, Mycobacterium avium subsp. paratuberculosis
gacgcugcagguggccc

SEQ ID NO: 2841103 - RNA, 14 nt, Mycobacterium avium subsp. paratuberculosis
gacgcugccgcgcc

SEQ ID NO: 2841104 - RNA, 21 nt, Mycobacterium avium subsp. paratuberculosis
gacggccucccacucgucgau

SEQ ID NO: 2841105 - RNA, 14 nt, Mycobacterium avium subsp. paratuberculosis
gacggccucgccgu

SEQ ID NO: 2841106 - RNA, 22 nt, Mycobacterium avium subsp. paratuberculosis
gacggccucgccgucgcgaucg

SEQ ID NO: 2841107 - RNA, 22 nt, Mycobacterium avium subsp. paratuberculosis
gacggccugcaccaccacaccc

SEQ ID NO: 2841108 - RNA, 12 nt, Mycobacterium avium subsp. paratuberculosis
gacggccugggc

SEQ ID NO: 2841109 - RNA, 18 nt, Mycobacterium avium subsp. paratuberculosis
gacggccugggcgaccac

SEQ ID NO: 2841110 - RNA, 15 nt, Mycobacterium avium subsp. paratuberculosis
gacggcgaacgucga

SEQ ID NO: 2841111 - RNA, 20 nt, Mycobacterium avium subsp. paratuberculosis
gacggcgaacuuggccgaca

SEQ ID NO: 2841112 - RNA, 16 nt, Mycobacterium avium subsp. paratuberculosis
gacggcgaagccggcg

SEQ ID NO: 2841113 - RNA, 17 nt, Mycobacterium avium subsp. paratuberculosis
gacggcgaagccggcgu

SEQ ID NO: 2841114 - RNA, 20 nt, Mycobacterium avium subsp. paratuberculosis
gacggcgaccacaccgucga

SEQ ID NO: 2841115 - RNA, 22 nt, Mycobacterium avium subsp. paratuberculosis
gacggcgaccacaccgucgacg

SEQ ID NO: 2841116 - RNA, 23 nt, Mycobacterium avium subsp. paratuberculosis
gacggcgaccucuaacgucucgg

SEQ ID NO: 2841117 - RNA, 18 nt, Mycobacterium avium subsp. paratuberculosis
gacggcgacgaccgucau

SEQ ID NO: 2841118 - RNA, 17 nt, Mycobacterium avium subsp. paratuberculosis
gacggcgacggcagcgc

SEQ ID NO: 2841119 - RNA, 14 nt, Mycobacterium avium subsp. paratuberculosis
gacggcgacggcca

SEQ ID NO: 2841120 - RNA, 21 nt, Mycobacterium avium subsp. paratuberculosis
gacggcgacggcguccgggcg

SEQ ID NO: 2841121 - RNA, 16 nt, Mycobacterium avium subsp. paratuberculosis
gacggcgagccgggcc

SEQ ID NO: 2841122 - RNA, 17 nt, Mycobacterium avium subsp. paratuberculosis
gacggcgagccgggccg

SEQ ID NO: 2841123 - RNA, 19 nt, Mycobacterium avium subsp. paratuberculosis
gacggcgagccgggccggg

SEQ ID NO: 2841124 - RNA, 15 nt, Mycobacterium avium subsp. paratuberculosis
gacggcgcccgcccc

SEQ ID NO: 2841125 - RNA, 16 nt, Mycobacterium avium subsp. paratuberculosis
gacggcgccgcccggg

SEQ ID NO: 2841126 - RNA, 21 nt, Mycobacterium avium subsp. paratuberculosis
gacggcgccgcggccguugcu

SEQ ID NO: 2841127 - RNA, 15 nt, Mycobacterium avium subsp. paratuberculosis
gacggcgccgcgucg

SEQ ID NO: 2841128 - RNA, 16 nt, Mycobacterium avium subsp. paratuberculosis
gacggcgccgcgucgg

SEQ ID NO: 2841129 - RNA, 20 nt, Mycobacterium avium subsp. paratuberculosis
gacggcgccugauccgcggu

SEQ ID NO: 2841130 - RNA, 15 nt, Mycobacterium avium subsp. paratuberculosis
gacggcgcgaacgca

SEQ ID NO: 2841131 - RNA, 14 nt, Mycobacterium avium subsp. paratuberculosis
gacggcgcgcccga

SEQ ID NO: 2841132 - RNA, 21 nt, Mycobacterium avium subsp. paratuberculosis
gacggcgcgguggcgugcagc

SEQ ID NO: 2841133 - RNA, 16 nt, Mycobacterium avium subsp. paratuberculosis
gacggcgcucaccggc

SEQ ID NO: 2841134 - RNA, 18 nt, Mycobacterium avium subsp. paratuberculosis
gacggcgcucaccggcgu

SEQ ID NO: 2841135 - RNA, 14 nt, Mycobacterium avium subsp. paratuberculosis
gacggcgcuggccg

SEQ ID NO: 2841136 - RNA, 15 nt, Mycobacterium avium subsp. paratuberculosis
gacggcgcuggccgc

SEQ ID NO: 2841137 - RNA, 23 nt, Mycobacterium avium subsp. paratuberculosis
gacggcgcuggccgcggccagcu

SEQ ID NO: 2841138 - RNA, 16 nt, Mycobacterium avium subsp. paratuberculosis
gacggcgcuguggccg

SEQ ID NO: 2841139 - RNA, 23 nt, Mycobacterium avium subsp. paratuberculosis
gacggcggccgucuugcccggcg

SEQ ID NO: 2841140 - RNA, 15 nt, Mycobacterium avium subsp. paratuberculosis
gacggcggcgaagac

SEQ ID NO: 2841141 - RNA, 21 nt, Mycobacterium avium subsp. paratuberculosis
gacggcggcgaguucggcggc

SEQ ID NO: 2841142 - RNA, 22 nt, Mycobacterium avium subsp. paratuberculosis
gacggcggcgaguucggcggcc

SEQ ID NO: 2841143 - RNA, 13 nt, Mycobacterium avium subsp. paratuberculosis
gacggcggcgccc

SEQ ID NO: 2841144 - RNA, 15 nt, Mycobacterium avium subsp. paratuberculosis
gacggcggcgcccug

SEQ ID NO: 2841145 - RNA, 12 nt, Mycobacterium avium subsp. paratuberculosis
gacggcggcggu

SEQ ID NO: 2841146 - RNA, 13 nt, Mycobacterium avium subsp. paratuberculosis
gacggcggcggug

SEQ ID NO: 2841147 - RNA, 16 nt, Mycobacterium avium subsp. paratuberculosis
gacggcggcggugccg

SEQ ID NO: 2841148 - RNA, 17 nt, Mycobacterium avium subsp. paratuberculosis
gacggcggcggugccgc

SEQ ID NO: 2841149 - RNA, 18 nt, Mycobacterium avium subsp. paratuberculosis
gacggcggcggugccgca

SEQ ID NO: 2841150 - RNA, 21 nt, Mycobacterium avium subsp. paratuberculosis
gacggcggcggugccgcaggc

SEQ ID NO: 2841151 - RNA, 21 nt, Mycobacterium avium subsp. paratuberculosis
gacggcggggaugcccggggg

SEQ ID NO: 2841152 - RNA, 19 nt, Mycobacterium avium subsp. paratuberculosis
gacggcggggcggaugcgc

SEQ ID NO: 2841153 - RNA, 23 nt, Mycobacterium avium subsp. paratuberculosis
gacggcggggcggaugcgcuggu

SEQ ID NO: 2841154 - RNA, 19 nt, Mycobacterium avium subsp. paratuberculosis
gacggcggggugcgcggcg

SEQ ID NO: 2841155 - RNA, 19 nt, Mycobacterium avium subsp. paratuberculosis
gacggcggugggcucggcc

SEQ ID NO: 2841156 - RNA, 20 nt, Mycobacterium avium subsp. paratuberculosis
gacggcggugggcucggcca

SEQ ID NO: 2841157 - RNA, 17 nt, Mycobacterium avium subsp. paratuberculosis
gacggcgguucgaagcg

SEQ ID NO: 2841158 - RNA, 21 nt, Mycobacterium avium subsp. paratuberculosis
gacggcgguucgaagcgcagc

SEQ ID NO: 2841159 - RNA, 10 nt, Mycobacterium avium subsp. paratuberculosis
gacggcgucc

SEQ ID NO: 2841160 - RNA, 14 nt, Mycobacterium avium subsp. paratuberculosis
gacggcguccagcu

SEQ ID NO: 2841161 - RNA, 23 nt, Mycobacterium avium subsp. paratuberculosis
gacggcguccagcugcgcgccgg

SEQ ID NO: 2841162 - RNA, 15 nt, Mycobacterium avium subsp. paratuberculosis
gacggcguccgggcg

SEQ ID NO: 2841163 - RNA, 16 nt, Mycobacterium avium subsp. paratuberculosis
gacggcguccgggcgc

SEQ ID NO: 2841164 - RNA, 14 nt, Mycobacterium avium subsp. paratuberculosis
gacggcgucggcga

SEQ ID NO: 2841165 - RNA, 15 nt, Mycobacterium avium subsp. paratuberculosis
gacggcgucggcgag

SEQ ID NO: 2841166 - RNA, 15 nt, Mycobacterium avium subsp. paratuberculosis
gacggcgucggcggc

SEQ ID NO: 2841167 - RNA, 18 nt, Mycobacterium avium subsp. paratuberculosis
gacggcgucggcggccug

SEQ ID NO: 2841168 - RNA, 19 nt, Mycobacterium avium subsp. paratuberculosis
gacggcgucggcggccugc

SEQ ID NO: 2841169 - RNA, 23 nt, Mycobacterium avium subsp. paratuberculosis
gacggcgucggcggccugcucca

SEQ ID NO: 2841170 - RNA, 21 nt, Mycobacterium avium subsp. paratuberculosis
gacggcguggcugaggccgcc

SEQ ID NO: 2841171 - RNA, 18 nt, Mycobacterium avium subsp. paratuberculosis
gacggcguggucggcgaa

SEQ ID NO: 2841172 - RNA, 14 nt, Mycobacterium avium subsp. paratuberculosis
gacggcguugcugg

SEQ ID NO: 2841173 - RNA, 15 nt, Mycobacterium avium subsp. paratuberculosis
gacggcguugcuggc

SEQ ID NO: 2841174 - RNA, 19 nt, Mycobacterium avium subsp. paratuberculosis
gacggcguugcuggcgcga

SEQ ID NO: 2841175 - RNA, 20 nt, Mycobacterium avium subsp. paratuberculosis
gacggcguugcuggcgcgau

SEQ ID NO: 2841176 - RNA, 16 nt, Mycobacterium avium subsp. paratuberculosis
gacggcuaccugacca

SEQ ID NO: 2841177 - RNA, 20 nt, Mycobacterium avium subsp. paratuberculosis
gacggcuccuaugucggugc

SEQ ID NO: 2841178 - RNA, 18 nt, Mycobacterium avium subsp. paratuberculosis
gacggcucuucggcgccg

SEQ ID NO: 2841179 - RNA, 19 nt, Mycobacterium avium subsp. paratuberculosis
gacggcucuucggcgccga

SEQ ID NO: 2841180 - RNA, 22 nt, Mycobacterium avium subsp. paratuberculosis
gacggcucuucggcgccgagcg

SEQ ID NO: 2841181 - RNA, 13 nt, Mycobacterium avium subsp. paratuberculosis
gacggcugcccgg

SEQ ID NO: 2841182 - RNA, 16 nt, Mycobacterium avium subsp. paratuberculosis
gacggcugcccggccc

SEQ ID NO: 2841183 - RNA, 18 nt, Mycobacterium avium subsp. paratuberculosis
gacggcugcccggcccgc

SEQ ID NO: 2841184 - RNA, 21 nt, Mycobacterium avium subsp. paratuberculosis
gacggcugcgguuggccggcc

SEQ ID NO: 2841185 - RNA, 20 nt, Mycobacterium avium subsp. paratuberculosis
gacggcuggguggcgaaacc

SEQ ID NO: 2841186 - RNA, 15 nt, Mycobacterium avium subsp. paratuberculosis
gacggcuuccgcgga

SEQ ID NO: 2841187 - RNA, 19 nt, Mycobacterium avium subsp. paratuberculosis
gacgggaacucggccagcu

SEQ ID NO: 2841188 - RNA, 20 nt, Mycobacterium avium subsp. paratuberculosis
gacgucaggccggucagcga

SEQ ID NO: 2841189 - RNA, 23 nt, Mycobacterium avium subsp. paratuberculosis
gacgucaggccggucagcgacga

SEQ ID NO: 2841190 - RNA, 21 nt, Mycobacterium avium subsp. paratuberculosis
gacgucaggccguagcggcuc

SEQ ID NO: 2841191 - RNA, 21 nt, Mycobacterium avium subsp. paratuberculosis
gacgucaggggugccggaggc

SEQ ID NO: 2841192 - RNA, 21 nt, Mycobacterium avium subsp. paratuberculosis
gacguccaccaggguggccgc

SEQ ID NO: 2841193 - RNA, 22 nt, Mycobacterium avium subsp. paratuberculosis
gacguccaccaggguggccgcc

SEQ ID NO: 2841194 - RNA, 22 nt, Mycobacterium avium subsp. paratuberculosis
gacguccacguugaugccgccc

SEQ ID NO: 2841195 - RNA, 14 nt, Mycobacterium avium subsp. paratuberculosis
gacguccagcgccg

SEQ ID NO: 2841196 - RNA, 16 nt, Mycobacterium avium subsp. paratuberculosis
gacguccagcgccgcc

SEQ ID NO: 2841197 - RNA, 20 nt, Mycobacterium avium subsp. paratuberculosis
gacguccaucgggaccgcgg

SEQ ID NO: 2841198 - RNA, 13 nt, Mycobacterium avium subsp. paratuberculosis
gacguccgagguc

SEQ ID NO: 2841199 - RNA, 14 nt, Mycobacterium avium subsp. paratuberculosis
gacguccgggccgc

SEQ ID NO: 2841200 - RNA, 16 nt, Mycobacterium avium subsp. paratuberculosis
gacguccgggccgccu

SEQ ID NO: 2841201 - RNA, 17 nt, Mycobacterium avium subsp. paratuberculosis
gacguccucgaugccga

SEQ ID NO: 2841202 - RNA, 22 nt, Mycobacterium avium subsp. paratuberculosis
gacguccucgcccgggugcugc

SEQ ID NO: 2841203 - RNA, 20 nt, Mycobacterium avium subsp. paratuberculosis
gacguccuggaucgcgcagg

SEQ ID NO: 2841204 - RNA, 23 nt, Mycobacterium avium subsp. paratuberculosis
gacguccuggaucgcgcagguga

SEQ ID NO: 2841205 - RNA, 20 nt, Mycobacterium avium subsp. paratuberculosis
gacguccugguugaggaucu

SEQ ID NO: 2841206 - RNA, 18 nt, Mycobacterium avium subsp. paratuberculosis
gacguccuugacccggcc

SEQ ID NO: 2841207 - RNA, 20 nt, Mycobacterium avium subsp. paratuberculosis
gacguccuugacccggccgc

SEQ ID NO: 2841208 - RNA, 21 nt, Mycobacterium avium subsp. paratuberculosis
gacguccuugacccggccgca

SEQ ID NO: 2841209 - RNA, 22 nt, Mycobacterium avium subsp. paratuberculosis
gacguccuugacccggccgcac

SEQ ID NO: 2841210 - RNA, 14 nt, Mycobacterium avium subsp. paratuberculosis
gacguccuugauca

SEQ ID NO: 2841211 - RNA, 13 nt, Mycobacterium avium subsp. paratuberculosis
gacgucgaacccg

SEQ ID NO: 2841212 - RNA, 23 nt, Mycobacterium avium subsp. paratuberculosis
gacgucgaacccgaaaagcacca

SEQ ID NO: 2841213 - RNA, 19 nt, Mycobacterium avium subsp. paratuberculosis
gacgucgaagggucggucg

SEQ ID NO: 2841214 - RNA, 14 nt, Mycobacterium avium subsp. paratuberculosis
gacgucgaccgcga

SEQ ID NO: 2841215 - RNA, 15 nt, Mycobacterium avium subsp. paratuberculosis
gacgucgaccgcgac

SEQ ID NO: 2841216 - RNA, 20 nt, Mycobacterium avium subsp. paratuberculosis
gacgucgaccgcgacgaccu

SEQ ID NO: 2841217 - RNA, 15 nt, Mycobacterium avium subsp. paratuberculosis
gacgucgaccgcgcc

SEQ ID NO: 2841218 - RNA, 16 nt, Mycobacterium avium subsp. paratuberculosis
gacgucgaccgcgccg

SEQ ID NO: 2841219 - RNA, 19 nt, Mycobacterium avium subsp. paratuberculosis
gacgucgaccuugcagccc

SEQ ID NO: 2841220 - RNA, 20 nt, Mycobacterium avium subsp. paratuberculosis
gacgucgaccuugcagcccg

SEQ ID NO: 2841221 - RNA, 12 nt, Mycobacterium avium subsp. paratuberculosis
gacgucgacgac

SEQ ID NO: 2841222 - RNA, 14 nt, Mycobacterium avium subsp. paratuberculosis
gacgucgacgaccc

SEQ ID NO: 2841223 - RNA, 20 nt, Mycobacterium avium subsp. paratuberculosis
gacgucgacgcgggcgacgu

SEQ ID NO: 2841224 - RNA, 13 nt, Mycobacterium avium subsp. paratuberculosis
gacgucgacggca

SEQ ID NO: 2841225 - RNA, 15 nt, Mycobacterium avium subsp. paratuberculosis
gacgucgacggcagc

SEQ ID NO: 2841226 - RNA, 17 nt, Mycobacterium avium subsp. paratuberculosis
gacgucgacggcagcgc

SEQ ID NO: 2841227 - RNA, 19 nt, Mycobacterium avium subsp. paratuberculosis
gacgucgacgugggcggcc

SEQ ID NO: 2841228 - RNA, 23 nt, Mycobacterium avium subsp. paratuberculosis
gacgucgacgugggcggccacca

SEQ ID NO: 2841229 - RNA, 23 nt, Mycobacterium avium subsp. paratuberculosis
gacgucgagaaaggccagcacgc

SEQ ID NO: 2841230 - RNA, 23 nt, Mycobacterium avium subsp. paratuberculosis
gacgucgagccagcgggccgagc

SEQ ID NO: 2841231 - RNA, 13 nt, Mycobacterium avium subsp. paratuberculosis
gacgucgagcggc

SEQ ID NO: 2841232 - RNA, 16 nt, Mycobacterium avium subsp. paratuberculosis
gacgucgagggcgccg

SEQ ID NO: 2841233 - RNA, 19 nt, Mycobacterium avium subsp. paratuberculosis
gacgucgaugccggccagc

SEQ ID NO: 2841234 - RNA, 20 nt, Mycobacterium avium subsp. paratuberculosis
gacgucgaugccggccagcg

SEQ ID NO: 2841235 - RNA, 19 nt, Mycobacterium avium subsp. paratuberculosis
gacgucgaugugcucgggg

SEQ ID NO: 2841236 - RNA, 12 nt, Mycobacterium avium subsp. paratuberculosis
gacgucgccacc

SEQ ID NO: 2841237 - RNA, 21 nt, Mycobacterium avium subsp. paratuberculosis
gacgucgccaccagaccggcg

SEQ ID NO: 2841238 - RNA, 22 nt, Mycobacterium avium subsp. paratuberculosis
gacgucgccaccagaccggcga

SEQ ID NO: 2841239 - RNA, 20 nt, Mycobacterium avium subsp. paratuberculosis
gacgucgccgauggcguuca

SEQ ID NO: 2841240 - RNA, 13 nt, Mycobacterium avium subsp. paratuberculosis
gacgucgccggcc

SEQ ID NO: 2841241 - RNA, 15 nt, Mycobacterium avium subsp. paratuberculosis
gacgucgccggccug

SEQ ID NO: 2841242 - RNA, 20 nt, Mycobacterium avium subsp. paratuberculosis
gacgucgccggccugcccgc

SEQ ID NO: 2841243 - RNA, 13 nt, Mycobacterium avium subsp. paratuberculosis
gacgucgcgcagg

SEQ ID NO: 2841244 - RNA, 18 nt, Mycobacterium avium subsp. paratuberculosis
gacgucgcgccgcucggc

SEQ ID NO: 2841245 - RNA, 20 nt, Mycobacterium avium subsp. paratuberculosis
gacgucgcgccgcucggcca

SEQ ID NO: 2841246 - RNA, 22 nt, Mycobacterium avium subsp. paratuberculosis
gacgucgcgccgcucggccagc

SEQ ID NO: 2841247 - RNA, 23 nt, Mycobacterium avium subsp. paratuberculosis
gacgucgcgccgcucggccagca

SEQ ID NO: 2841248 - RNA, 13 nt, Mycobacterium avium subsp. paratuberculosis
gacgucgcgcugc

SEQ ID NO: 2841249 - RNA, 16 nt, Mycobacterium avium subsp. paratuberculosis
gacgucgcgcugccgg

SEQ ID NO: 2841250 - RNA, 18 nt, Mycobacterium avium subsp. paratuberculosis
gacgucgcgcugccggcc

SEQ ID NO: 2841251 - RNA, 17 nt, Mycobacterium avium subsp. paratuberculosis
gacgucggacgcggccg

SEQ ID NO: 2841252 - RNA, 13 nt, Mycobacterium avium subsp. paratuberculosis
gacgucggccggc

SEQ ID NO: 2841253 - RNA, 14 nt, Mycobacterium avium subsp. paratuberculosis
gacgucggccggcu

SEQ ID NO: 2841254 - RNA, 12 nt, Mycobacterium avium subsp. paratuberculosis
gacgucggcgcg

SEQ ID NO: 2841255 - RNA, 17 nt, Mycobacterium avium subsp. paratuberculosis
gacgucggcgcgcucgg

SEQ ID NO: 2841256 - RNA, 18 nt, Mycobacterium avium subsp. paratuberculosis
gacgucggcgcgcucggu

SEQ ID NO: 2841257 - RNA, 22 nt, Mycobacterium avium subsp. paratuberculosis
gacgucggcgcggucgcaggcg

SEQ ID NO: 2841258 - RNA, 18 nt, Mycobacterium avium subsp. paratuberculosis
gacgucggcguacugcgc

SEQ ID NO: 2841259 - RNA, 22 nt, Mycobacterium avium subsp. paratuberculosis
gacgucggcguacugcgcgacc

SEQ ID NO: 2841260 - RNA, 12 nt, Mycobacterium avium subsp. paratuberculosis
gacgucggcguc

SEQ ID NO: 2841261 - RNA, 17 nt, Mycobacterium avium subsp. paratuberculosis
gacgucggcgucaucga

SEQ ID NO: 2841262 - RNA, 23 nt, Mycobacterium avium subsp. paratuberculosis
gacgucgggcacggucaggugga

SEQ ID NO: 2841263 - RNA, 20 nt, Mycobacterium avium subsp. paratuberculosis
gacgucgggcugggcggggu

SEQ ID NO: 2841264 - RNA, 21 nt, Mycobacterium avium subsp. paratuberculosis
gacgucggguccgaccagcac

SEQ ID NO: 2841265 - RNA, 19 nt, Mycobacterium avium subsp. paratuberculosis
gacgucggucagcaucggg

SEQ ID NO: 2841266 - RNA, 14 nt, Mycobacterium avium subsp. paratuberculosis
gacgucgguguagc

SEQ ID NO: 2841267 - RNA, 21 nt, Mycobacterium avium subsp. paratuberculosis
gacgucgguguagucggcgau

SEQ ID NO: 2841268 - RNA, 22 nt, Mycobacterium avium subsp. paratuberculosis
gacgucgguguagucggcgauc

SEQ ID NO: 2841269 - RNA, 15 nt, Mycobacterium avium subsp. paratuberculosis
gacgucgucgacccg

SEQ ID NO: 2841270 - RNA, 14 nt, Mycobacterium avium subsp. paratuberculosis
gacgucgucgacgu

SEQ ID NO: 2841271 - RNA, 16 nt, Mycobacterium avium subsp. paratuberculosis
gacgucgucgacgucc

SEQ ID NO: 2841272 - RNA, 17 nt, Mycobacterium avium subsp. paratuberculosis
gacguuggccagcaccg

SEQ ID NO: 2841273 - RNA, 20 nt, Mycobacterium avium subsp. paratuberculosis
gacguuggccagcaccgcgg

SEQ ID NO: 2841274 - RNA, 12 nt, Mycobacterium avium subsp. paratuberculosis
gacguuggugau

SEQ ID NO: 2841275 - RNA, 15 nt, Mycobacterium avium subsp. paratuberculosis
gacguuggugaucgc

SEQ ID NO: 2841276 - RNA, 20 nt, Mycobacterium avium subsp. paratuberculosis
gacguuguugucgaugaugu

SEQ ID NO: 2841277 - RNA, 13 nt, Mycobacterium avium subsp. paratuberculosis
gacuaagucacca

SEQ ID NO: 2841278 - RNA, 12 nt, Mycobacterium avium subsp. paratuberculosis
gacuaccgcgcc

SEQ ID NO: 2841279 - RNA, 14 nt, Mycobacterium avium subsp. paratuberculosis
gacuaccgcgccca

SEQ ID NO: 2841280 - RNA, 13 nt, Mycobacterium avium subsp. paratuberculosis
gacuauacacgcc

SEQ ID NO: 2841281 - RNA, 20 nt, Mycobacterium avium subsp. paratuberculosis
gacucaaucggucagggugu

SEQ ID NO: 2841282 - RNA, 13 nt, Mycobacterium avium subsp. paratuberculosis
gacucacggcggc

SEQ ID NO: 2841283 - RNA, 16 nt, Mycobacterium avium subsp. paratuberculosis
gacucacggcggcagc

SEQ ID NO: 2841284 - RNA, 13 nt, Mycobacterium avium subsp. paratuberculosis
gacucagcccggc

SEQ ID NO: 2841285 - RNA, 14 nt, Mycobacterium avium subsp. paratuberculosis
gacucagcccggcc

SEQ ID NO: 2841286 - RNA, 19 nt, Mycobacterium avium subsp. paratuberculosis
gacuccaccaccuggccgg

SEQ ID NO: 2841287 - RNA, 20 nt, Mycobacterium avium subsp. paratuberculosis
gacuccaccaccuggccggc

SEQ ID NO: 2841288 - RNA, 21 nt, Mycobacterium avium subsp. paratuberculosis
gacuccaccaccuggccggcc

SEQ ID NO: 2841289 - RNA, 16 nt, Mycobacterium avium subsp. paratuberculosis
gacuccaccgccaccg

SEQ ID NO: 2841290 - RNA, 17 nt, Mycobacterium avium subsp. paratuberculosis
gacuccaccgccaccgc

SEQ ID NO: 2841291 - RNA, 11 nt, Mycobacterium avium subsp. paratuberculosis
gacuccagcac

SEQ ID NO: 2841292 - RNA, 16 nt, Mycobacterium avium subsp. paratuberculosis
gacuccagcaccagca

SEQ ID NO: 2841293 - RNA, 23 nt, Mycobacterium avium subsp. paratuberculosis
gacuccagcaccagcacggcgac

SEQ ID NO: 2841294 - RNA, 15 nt, Mycobacterium avium subsp. paratuberculosis
gacuccagcaccggc

SEQ ID NO: 2841295 - RNA, 18 nt, Mycobacterium avium subsp. paratuberculosis
gacuccagcaccggcgcc

SEQ ID NO: 2841296 - RNA, 17 nt, Mycobacterium avium subsp. paratuberculosis
gacuccagcagcgccag

SEQ ID NO: 2841297 - RNA, 18 nt, Mycobacterium avium subsp. paratuberculosis
gacuccagcagcgccagc

SEQ ID NO: 2841298 - RNA, 16 nt, Mycobacterium avium subsp. paratuberculosis
gacuccagcagcgccu

SEQ ID NO: 2841299 - RNA, 23 nt, Mycobacterium avium subsp. paratuberculosis
gacuccaucccgugcggagaucg

SEQ ID NO: 2841300 - RNA, 15 nt, Mycobacterium avium subsp. paratuberculosis
gacucccccaccacg

SEQ ID NO: 2841301 - RNA, 19 nt, Mycobacterium avium subsp. paratuberculosis
gacucccgagcgugggggc

SEQ ID NO: 2841302 - RNA, 14 nt, Mycobacterium avium subsp. paratuberculosis
gacuccggcgacac

SEQ ID NO: 2841303 - RNA, 16 nt, Mycobacterium avium subsp. paratuberculosis
gacuccggcgacacgu

SEQ ID NO: 2841304 - RNA, 15 nt, Mycobacterium avium subsp. paratuberculosis
gacuccggcgccggu

SEQ ID NO: 2841305 - RNA, 16 nt, Mycobacterium avium subsp. paratuberculosis
gacuccggcgccgguc

SEQ ID NO: 2841306 - RNA, 19 nt, Mycobacterium avium subsp. paratuberculosis
gacuccggcgccggucagc

SEQ ID NO: 2841307 - RNA, 16 nt, Mycobacterium avium subsp. paratuberculosis
gacuccucacaccucg

SEQ ID NO: 2841308 - RNA, 17 nt, Mycobacterium avium subsp. paratuberculosis
gacuccucacaccucgc

SEQ ID NO: 2841309 - RNA, 21 nt, Mycobacterium avium subsp. paratuberculosis
gacuccucacaccucgcuacg

SEQ ID NO: 2841310 - RNA, 19 nt, Mycobacterium avium subsp. paratuberculosis
gacuccuccucggccagcc

SEQ ID NO: 2841311 - RNA, 20 nt, Mycobacterium avium subsp. paratuberculosis
gacuccuccucggccagccc

SEQ ID NO: 2841312 - RNA, 23 nt, Mycobacterium avium subsp. paratuberculosis
gacuccuccucggccagccccac

SEQ ID NO: 2841313 - RNA, 15 nt, Mycobacterium avium subsp. paratuberculosis
gacuccuccugcgac

SEQ ID NO: 2841314 - RNA, 15 nt, Mycobacterium avium subsp. paratuberculosis
gacuccucgguggcc

SEQ ID NO: 2841315 - RNA, 22 nt, Mycobacterium avium subsp. paratuberculosis
gacuccucgguggccucgcgca

SEQ ID NO: 2841316 - RNA, 21 nt, Mycobacterium avium subsp. paratuberculosis
gacuccuugggagacugcgac

SEQ ID NO: 2841317 - RNA, 23 nt, Mycobacterium avium subsp. paratuberculosis
gacuccuugggcauggugaagcc

SEQ ID NO: 2841318 - RNA, 20 nt, Mycobacterium avium subsp. paratuberculosis
gacucgaagaaccgcaacac

SEQ ID NO: 2841319 - RNA, 16 nt, Mycobacterium avium subsp. paratuberculosis
gacucgaagaucgccu

SEQ ID NO: 2841320 - RNA, 15 nt, Mycobacterium avium subsp. paratuberculosis
gacucgaucgccacc

SEQ ID NO: 2841321 - RNA, 17 nt, Mycobacterium avium subsp. paratuberculosis
gacucgaucgccaccga

SEQ ID NO: 2841322 - RNA, 18 nt, Mycobacterium avium subsp. paratuberculosis
gacucgauguagccgggc

SEQ ID NO: 2841323 - RNA, 15 nt, Mycobacterium avium subsp. paratuberculosis
gacucggcggugccg

SEQ ID NO: 2841324 - RNA, 17 nt, Mycobacterium avium subsp. paratuberculosis
gacucgggguugacccg

SEQ ID NO: 2841325 - RNA, 13 nt, Mycobacterium avium subsp. paratuberculosis
gacucgucgcuga

SEQ ID NO: 2841326 - RNA, 19 nt, Mycobacterium avium subsp. paratuberculosis
gacucgucgcugaucgcga

SEQ ID NO: 2841327 - RNA, 15 nt, Mycobacterium avium subsp. paratuberculosis
gacucguucgacgcc

SEQ ID NO: 2841328 - RNA, 16 nt, Mycobacterium avium subsp. paratuberculosis
gacucguuggccggcu

SEQ ID NO: 2841329 - RNA, 17 nt, Mycobacterium avium subsp. paratuberculosis
gacucguuggccggcuc

SEQ ID NO: 2841330 - RNA, 16 nt, Mycobacterium avium subsp. paratuberculosis
gacucugcacucagag

SEQ ID NO: 2841331 - RNA, 21 nt, Mycobacterium avium subsp. paratuberculosis
gacucugcacucagagcagcg

SEQ ID NO: 2841332 - RNA, 20 nt, Mycobacterium avium subsp. paratuberculosis
gacucuuccaggacaacgca

SEQ ID NO: 2841333 - RNA, 21 nt, Mycobacterium avium subsp. paratuberculosis
gacugaaguaguacgaccgcg

SEQ ID NO: 2841334 - RNA, 16 nt, Mycobacterium avium subsp. paratuberculosis
gacugauccaccaucu

SEQ ID NO: 2841335 - RNA, 16 nt, Mycobacterium avium subsp. paratuberculosis
gacugaugaagccgcc

SEQ ID NO: 2841336 - RNA, 17 nt, Mycobacterium avium subsp. paratuberculosis
gacugaugaagccgccg

SEQ ID NO: 2841337 - RNA, 17 nt, Mycobacterium avium subsp. paratuberculosis
gacugaugcccucgccg

SEQ ID NO: 2841338 - RNA, 18 nt, Mycobacterium avium subsp. paratuberculosis
gacugaugcccucgccgg

SEQ ID NO: 2841339 - RNA, 21 nt, Mycobacterium avium subsp. paratuberculosis
gacugaugguggcgcgcaucg

SEQ ID NO: 2841340 - RNA, 18 nt, Mycobacterium avium subsp. paratuberculosis
gacugcacagugcgucgc

SEQ ID NO: 2841341 - RNA, 22 nt, Mycobacterium avium subsp. paratuberculosis
gacugcacagugcgucgcccau

SEQ ID NO: 2841342 - RNA, 12 nt, Mycobacterium avium subsp. paratuberculosis
gacugcagcgcg

SEQ ID NO: 2841343 - RNA, 15 nt, Mycobacterium avium subsp. paratuberculosis
gacugcccgaccgcg

SEQ ID NO: 2841344 - RNA, 16 nt, Mycobacterium avium subsp. paratuberculosis
gacugcccgaccgcgc

SEQ ID NO: 2841345 - RNA, 20 nt, Mycobacterium avium subsp. paratuberculosis
gacugcccgaccgcgccgaa

SEQ ID NO: 2841346 - RNA, 14 nt, Mycobacterium avium subsp. paratuberculosis
gacugccgagcauc

SEQ ID NO: 2841347 - RNA, 17 nt, Mycobacterium avium subsp. paratuberculosis
gacugccgagcaucagc

SEQ ID NO: 2841348 - RNA, 22 nt, Mycobacterium avium subsp. paratuberculosis
gacugccgagcaucagcugccg

SEQ ID NO: 2841349 - RNA, 12 nt, Mycobacterium avium subsp. paratuberculosis
gacugccggcga

SEQ ID NO: 2841350 - RNA, 13 nt, Mycobacterium avium subsp. paratuberculosis
gacugcgacaccc

SEQ ID NO: 2841351 - RNA, 15 nt, Mycobacterium avium subsp. paratuberculosis
gacugcgacacccgc

SEQ ID NO: 2841352 - RNA, 16 nt, Mycobacterium avium subsp. paratuberculosis
gacugcgaucgccgac

SEQ ID NO: 2841353 - RNA, 17 nt, Mycobacterium avium subsp. paratuberculosis
gacugcgaucgccgacg

SEQ ID NO: 2841354 - RNA, 22 nt, Mycobacterium avium subsp. paratuberculosis
gacugcgaucgccgacgccagc

SEQ ID NO: 2841355 - RNA, 16 nt, Mycobacterium avium subsp. paratuberculosis
gacugcgaugcuuccc

SEQ ID NO: 2841356 - RNA, 15 nt, Mycobacterium avium subsp. paratuberculosis
gacugcgcaccgcca

SEQ ID NO: 2841357 - RNA, 17 nt, Mycobacterium avium subsp. paratuberculosis
gagacguaccagcugcc

SEQ ID NO: 2841358 - RNA, 18 nt, Mycobacterium avium subsp. paratuberculosis
gagacguccgaggucuug

SEQ ID NO: 2841359 - RNA, 13 nt, Mycobacterium avium subsp. paratuberculosis
gagacguccucgg

SEQ ID NO: 2841360 - RNA, 15 nt, Mycobacterium avium subsp. paratuberculosis
gagacguggucgggc

SEQ ID NO: 2841361 - RNA, 16 nt, Mycobacterium avium subsp. paratuberculosis
gagacgugguggugcg

SEQ ID NO: 2841362 - RNA, 16 nt, Mycobacterium avium subsp. paratuberculosis
gagacguugccgcaca

SEQ ID NO: 2841363 - RNA, 18 nt, Mycobacterium avium subsp. paratuberculosis
gagacguugccgcacacc

SEQ ID NO: 2841364 - RNA, 17 nt, Mycobacterium avium subsp. paratuberculosis
gagacugcgacccaccg

SEQ ID NO: 2841365 - RNA, 19 nt, Mycobacterium avium subsp. paratuberculosis
gagacugcgacccaccguc

SEQ ID NO: 2841366 - RNA, 12 nt, Mycobacterium avium subsp. paratuberculosis
gagagcaacacc

SEQ ID NO: 2841367 - RNA, 16 nt, Mycobacterium avium subsp. paratuberculosis
gagagcaacaccucgg

SEQ ID NO: 2841368 - RNA, 21 nt, Mycobacterium avium subsp. paratuberculosis
gagagccgguagaucagcgcc

SEQ ID NO: 2841369 - RNA, 22 nt, Mycobacterium avium subsp. paratuberculosis
gagagcgcgggcaccgucgucg

SEQ ID NO: 2841370 - RNA, 17 nt, Mycobacterium avium subsp. paratuberculosis
gagagcucuugcgcccc

SEQ ID NO: 2841371 - RNA, 14 nt, Mycobacterium avium subsp. paratuberculosis
gagagcuucaugcc

SEQ ID NO: 2841372 - RNA, 15 nt, Mycobacterium avium subsp. paratuberculosis
gagagcuugccgcgg

SEQ ID NO: 2841373 - RNA, 22 nt, Mycobacterium avium subsp. paratuberculosis
gagaguaucgccacgccgacca

SEQ ID NO: 2841374 - RNA, 17 nt, Mycobacterium avium subsp. paratuberculosis
gagagucgcuggcgcgc

SEQ ID NO: 2841375 - RNA, 12 nt, Mycobacterium avium subsp. paratuberculosis
gagauaggggca

SEQ ID NO: 2841376 - RNA, 15 nt, Mycobacterium avium subsp. paratuberculosis
gagauaggggcaggg

SEQ ID NO: 2841377 - RNA, 17 nt, Mycobacterium avium subsp. paratuberculosis
gagaucaacaccgcgca

SEQ ID NO: 2841378 - RNA, 22 nt, Mycobacterium avium subsp. paratuberculosis
gagaucaccgcguagcgccgcc

SEQ ID NO: 2841379 - RNA, 12 nt, Mycobacterium avium subsp. paratuberculosis
gagaucaccggc

SEQ ID NO: 2841380 - RNA, 13 nt, Mycobacterium avium subsp. paratuberculosis
gagaucaccggca

SEQ ID NO: 2841381 - RNA, 19 nt, Mycobacterium avium subsp. paratuberculosis
gagaucaccggcaccccca

SEQ ID NO: 2841382 - RNA, 14 nt, Mycobacterium avium subsp. paratuberculosis
gagaucaccggcuu

SEQ ID NO: 2841383 - RNA, 22 nt, Mycobacterium avium subsp. paratuberculosis
gagaucaccggcuuggcgguga

SEQ ID NO: 2841384 - RNA, 15 nt, Mycobacterium avium subsp. paratuberculosis
gagaucagcaccagg

SEQ ID NO: 2841385 - RNA, 19 nt, Mycobacterium avium subsp. paratuberculosis
gagaucagcaccagguggc

SEQ ID NO: 2841386 - RNA, 17 nt, Mycobacterium avium subsp. paratuberculosis
gagaucagcaccgggug

SEQ ID NO: 2841387 - RNA, 16 nt, Mycobacterium avium subsp. paratuberculosis
gagaucagcgccaugc

SEQ ID NO: 2841388 - RNA, 15 nt, Mycobacterium avium subsp. paratuberculosis
gagaucagggcgcgc

SEQ ID NO: 2841389 - RNA, 15 nt, Mycobacterium avium subsp. paratuberculosis
gagaucagggugcuc

SEQ ID NO: 2841390 - RNA, 20 nt, Mycobacterium avium subsp. paratuberculosis
gagaucagggugcucagccg

SEQ ID NO: 2841391 - RNA, 16 nt, Mycobacterium avium subsp. paratuberculosis
gagauccaccgcgcgg

SEQ ID NO: 2841392 - RNA, 18 nt, Mycobacterium avium subsp. paratuberculosis
gagauccaccgcgcggcc

SEQ ID NO: 2841393 - RNA, 14 nt, Mycobacterium avium subsp. paratuberculosis
gagauccagcagcc

SEQ ID NO: 2841394 - RNA, 23 nt, Mycobacterium avium subsp. paratuberculosis
gagauccagcagccaggauccga

SEQ ID NO: 2841395 - RNA, 19 nt, Mycobacterium avium subsp. paratuberculosis
gagaucccagcgggacagc

SEQ ID NO: 2841396 - RNA, 19 nt, Mycobacterium avium subsp. paratuberculosis
gagaucccugcgcucagca

SEQ ID NO: 2841397 - RNA, 20 nt, Mycobacterium avium subsp. paratuberculosis
gagaucccugcgcucagcac

SEQ ID NO: 2841398 - RNA, 22 nt, Mycobacterium avium subsp. paratuberculosis
gagaucgacccgcuccgacgcg

SEQ ID NO: 2841399 - RNA, 18 nt, Mycobacterium avium subsp. paratuberculosis
gagaucgccccgccguug

SEQ ID NO: 2841400 - RNA, 18 nt, Mycobacterium avium subsp. paratuberculosis
gagaucgcgggcugcggc

SEQ ID NO: 2841401 - RNA, 14 nt, Mycobacterium avium subsp. paratuberculosis
gagaucgcgguggc

SEQ ID NO: 2841402 - RNA, 16 nt, Mycobacterium avium subsp. paratuberculosis
gagaucgcgguggcgc

SEQ ID NO: 2841403 - RNA, 19 nt, Mycobacterium avium subsp. paratuberculosis
gagaucgcgguggcgcccg

SEQ ID NO: 2841404 - RNA, 22 nt, Mycobacterium avium subsp. paratuberculosis
gagaucgcgguggcgcccgcgg

SEQ ID NO: 2841405 - RNA, 23 nt, Mycobacterium avium subsp. paratuberculosis
gagaucgcgguggcgcccgcggu

SEQ ID NO: 2841406 - RNA, 15 nt, Mycobacterium avium subsp. paratuberculosis
gagaucggcagaccg

SEQ ID NO: 2841407 - RNA, 16 nt, Mycobacterium avium subsp. paratuberculosis
gagaucggcgcggagc

SEQ ID NO: 2841408 - RNA, 17 nt, Mycobacterium avium subsp. paratuberculosis
gagaugaagacccggcc

SEQ ID NO: 2841409 - RNA, 18 nt, Mycobacterium avium subsp. paratuberculosis
gagaugaagacccggccg

SEQ ID NO: 2841410 - RNA, 22 nt, Mycobacterium avium subsp. paratuberculosis
gagaugaagacccggccgugga

SEQ ID NO: 2841411 - RNA, 19 nt, Mycobacterium avium subsp. paratuberculosis
gagaugaucagccgcccga

SEQ ID NO: 2841412 - RNA, 16 nt, Mycobacterium avium subsp. paratuberculosis
gagaugcccacccgcu

SEQ ID NO: 2841413 - RNA, 16 nt, Mycobacterium avium subsp. paratuberculosis
gagaugccccaggcga

SEQ ID NO: 2841414 - RNA, 14 nt, Mycobacterium avium subsp. paratuberculosis
gagaugcguucggc

SEQ ID NO: 2841415 - RNA, 20 nt, Mycobacterium avium subsp. paratuberculosis
gagaugcguucggccgcagc

SEQ ID NO: 2841416 - RNA, 21 nt, Mycobacterium avium subsp. paratuberculosis
gagauggccagcaccaccgcg

SEQ ID NO: 2841417 - RNA, 19 nt, Mycobacterium avium subsp. paratuberculosis
gagaugguggucaccacca

SEQ ID NO: 2841418 - RNA, 14 nt, Mycobacterium avium subsp. paratuberculosis
gagauucugcagcc

SEQ ID NO: 2841419 - RNA, 17 nt, Mycobacterium avium subsp. paratuberculosis
gagauucugcagccgca

SEQ ID NO: 2841420 - RNA, 17 nt, Mycobacterium avium subsp. paratuberculosis
gagauuggauuccagau

SEQ ID NO: 2841421 - RNA, 14 nt, Mycobacterium avium subsp. paratuberculosis
gagcaaauccggca

SEQ ID NO: 2841422 - RNA, 21 nt, Mycobacterium avium subsp. paratuberculosis
gagcaaauccggcagcgcucg

SEQ ID NO: 2841423 - RNA, 20 nt, Mycobacterium avium subsp. paratuberculosis
gagcaacaccggcacgaucg

SEQ ID NO: 2841424 - RNA, 14 nt, Mycobacterium avium subsp. paratuberculosis
gagcaacaccucgg

SEQ ID NO: 2841425 - RNA, 16 nt, Mycobacterium avium subsp. paratuberculosis
gagcaacaccucgggc

SEQ ID NO: 2841426 - RNA, 15 nt, Mycobacterium avium subsp. paratuberculosis
gagcaacagcccgac

SEQ ID NO: 2841427 - RNA, 21 nt, Mycobacterium avium subsp. paratuberculosis
gagcaacagcgcuucgcgcug

SEQ ID NO: 2841428 - RNA, 22 nt, Mycobacterium avium subsp. paratuberculosis
gagcaacagcgcuucgcgcugu

SEQ ID NO: 2841429 - RNA, 22 nt, Mycobacterium avium subsp. paratuberculosis
gagcaaccgguucggacacggc

SEQ ID NO: 2841430 - RNA, 14 nt, Mycobacterium avium subsp. paratuberculosis
gagcaacuggguga

SEQ ID NO: 2841431 - RNA, 17 nt, Mycobacterium avium subsp. paratuberculosis
gagcaacugggugagca

SEQ ID NO: 2841432 - RNA, 20 nt, Mycobacterium avium subsp. paratuberculosis
gagcaauuaaccggcaggcc

SEQ ID NO: 2841433 - RNA, 15 nt, Mycobacterium avium subsp. paratuberculosis
gagcaauucggugac

SEQ ID NO: 2841434 - RNA, 17 nt, Mycobacterium avium subsp. paratuberculosis
gagcacacacaggucgc

SEQ ID NO: 2841435 - RNA, 22 nt, Mycobacterium avium subsp. paratuberculosis
gagcacacacaggucgcccggc

SEQ ID NO: 2841436 - RNA, 17 nt, Mycobacterium avium subsp. paratuberculosis
gagcacacccagcgagc

SEQ ID NO: 2841437 - RNA, 18 nt, Mycobacterium avium subsp. paratuberculosis
gagcacacccagcgagcc

SEQ ID NO: 2841438 - RNA, 18 nt, Mycobacterium avium subsp. paratuberculosis
gagcacacccucaccccg

SEQ ID NO: 2841439 - RNA, 14 nt, Mycobacterium avium subsp. paratuberculosis
gagcacagcacggc

SEQ ID NO: 2841440 - RNA, 15 nt, Mycobacterium avium subsp. paratuberculosis
gagcacagcacggca

SEQ ID NO: 2841441 - RNA, 18 nt, Mycobacterium avium subsp. paratuberculosis
gagcacagcacggcaucg

SEQ ID NO: 2841442 - RNA, 18 nt, Mycobacterium avium subsp. paratuberculosis
gagcagcacccgacuucg

SEQ ID NO: 2841443 - RNA, 22 nt, Mycobacterium avium subsp. paratuberculosis
gagcagcacccgacuucggcuc

SEQ ID NO: 2841444 - RNA, 13 nt, Mycobacterium avium subsp. paratuberculosis
gagcagcaccgcg

SEQ ID NO: 2841445 - RNA, 14 nt, Mycobacterium avium subsp. paratuberculosis
gagcagcaccgcga

SEQ ID NO: 2841446 - RNA, 17 nt, Mycobacterium avium subsp. paratuberculosis
gagcagcaccgcgaccc

SEQ ID NO: 2841447 - RNA, 13 nt, Mycobacterium avium subsp. paratuberculosis
gagcagcaccggc

SEQ ID NO: 2841448 - RNA, 14 nt, Mycobacterium avium subsp. paratuberculosis
gagcagcaccggca

SEQ ID NO: 2841449 - RNA, 14 nt, Mycobacterium avium subsp. paratuberculosis
gagcagcagccgca

SEQ ID NO: 2841450 - RNA, 13 nt, Mycobacterium avium subsp. paratuberculosis
gagcagcagcgcg

SEQ ID NO: 2841451 - RNA, 18 nt, Mycobacterium avium subsp. paratuberculosis
gagcagcaggucggcgug

SEQ ID NO: 2841452 - RNA, 14 nt, Mycobacterium avium subsp. paratuberculosis
gagcagcaugccga

SEQ ID NO: 2841453 - RNA, 19 nt, Mycobacterium avium subsp. paratuberculosis
gagcagcaugccgagcacc

SEQ ID NO: 2841454 - RNA, 20 nt, Mycobacterium avium subsp. paratuberculosis
gagcagcaugccgagcaccu

SEQ ID NO: 2841455 - RNA, 22 nt, Mycobacterium avium subsp. paratuberculosis
gagcagcaugccgagcaccucc

SEQ ID NO: 2841456 - RNA, 13 nt, Mycobacterium avium subsp. paratuberculosis
gagcagcccgacc

SEQ ID NO: 2841457 - RNA, 15 nt, Mycobacterium avium subsp. paratuberculosis
gagcagcccgaccac

SEQ ID NO: 2841458 - RNA, 13 nt, Mycobacterium avium subsp. paratuberculosis
gagcagcccggcg

SEQ ID NO: 2841459 - RNA, 14 nt, Mycobacterium avium subsp. paratuberculosis
gagcagcccggcga

SEQ ID NO: 2841460 - RNA, 19 nt, Mycobacterium avium subsp. paratuberculosis
gagcagccgcaacacggcc

SEQ ID NO: 2841461 - RNA, 16 nt, Mycobacterium avium subsp. paratuberculosis
gagcagccgggccagc

SEQ ID NO: 2841462 - RNA, 14 nt, Mycobacterium avium subsp. paratuberculosis
gagcagcgcccggc

SEQ ID NO: 2841463 - RNA, 15 nt, Mycobacterium avium subsp. paratuberculosis
gagcagcgcccgggu

SEQ ID NO: 2841464 - RNA, 14 nt, Mycobacterium avium subsp. paratuberculosis
gagcagcgccugcu

SEQ ID NO: 2841465 - RNA, 15 nt, Mycobacterium avium subsp. paratuberculosis
gagcagcgcgaugcc

SEQ ID NO: 2841466 - RNA, 22 nt, Mycobacterium avium subsp. paratuberculosis
gagcagcgcgaugccggccagg

SEQ ID NO: 2841467 - RNA, 17 nt, Mycobacterium avium subsp. paratuberculosis
gagcagcggggugagca

SEQ ID NO: 2841468 - RNA, 21 nt, Mycobacterium avium subsp. paratuberculosis
gagcagcggggugagcaccgc

SEQ ID NO: 2841469 - RNA, 22 nt, Mycobacterium avium subsp. paratuberculosis
gagcagcggggugagcaccgcg

SEQ ID NO: 2841470 - RNA, 23 nt, Mycobacterium avium subsp. paratuberculosis
gagcagcgggucgucgggccggg

SEQ ID NO: 2841471 - RNA, 14 nt, Mycobacterium avium subsp. paratuberculosis
gagcagcgguuggc

SEQ ID NO: 2841472 - RNA, 14 nt, Mycobacterium avium subsp. paratuberculosis
gagcagcgugcuga

SEQ ID NO: 2841473 - RNA, 17 nt, Mycobacterium avium subsp. paratuberculosis
gagcagcucagccgccu

SEQ ID NO: 2841474 - RNA, 13 nt, Mycobacterium avium subsp. paratuberculosis
gagcagcucgcgg

SEQ ID NO: 2841475 - RNA, 14 nt, Mycobacterium avium subsp. paratuberculosis
gagcagcucggcgg

SEQ ID NO: 2841476 - RNA, 16 nt, Mycobacterium avium subsp. paratuberculosis
gagcagcucggcggcc

SEQ ID NO: 2841477 - RNA, 19 nt, Mycobacterium avium subsp. paratuberculosis
gagcagcucggcggccugc

SEQ ID NO: 2841478 - RNA, 20 nt, Mycobacterium avium subsp. paratuberculosis
gagcagcucggucaccagcg

SEQ ID NO: 2841479 - RNA, 21 nt, Mycobacterium avium subsp. paratuberculosis
gagcagcucggucaccagcgg

SEQ ID NO: 2841480 - RNA, 18 nt, Mycobacterium avium subsp. paratuberculosis
gagcagcugcagcgucgg

SEQ ID NO: 2841481 - RNA, 21 nt, Mycobacterium avium subsp. paratuberculosis
gagcagcugcagcgucgggua

SEQ ID NO: 2841482 - RNA, 20 nt, Mycobacterium avium subsp. paratuberculosis
gagcagcugggacagcguca

SEQ ID NO: 2841483 - RNA, 15 nt, Mycobacterium avium subsp. paratuberculosis
gagcaggaccgagcc

SEQ ID NO: 2841484 - RNA, 18 nt, Mycobacterium avium subsp. paratuberculosis
gagcaggaccgagccgcg

SEQ ID NO: 2841485 - RNA, 17 nt, Mycobacterium avium subsp. paratuberculosis
gagcaggacgguggccg

SEQ ID NO: 2841486 - RNA, 17 nt, Mycobacterium avium subsp. paratuberculosis
gagcaggcuucgcagca

SEQ ID NO: 2841487 - RNA, 18 nt, Mycobacterium avium subsp. paratuberculosis
gagcaggcuucgcagcag

SEQ ID NO: 2841488 - RNA, 17 nt, Mycobacterium avium subsp. paratuberculosis
gagcagggccagcggca

SEQ ID NO: 2841489 - RNA, 15 nt, Mycobacterium avium subsp. paratuberculosis
gagcagggcgggcag

SEQ ID NO: 2841490 - RNA, 12 nt, Mycobacterium avium subsp. paratuberculosis
gagcagggugac

SEQ ID NO: 2841491 - RNA, 21 nt, Mycobacterium avium subsp. paratuberculosis
gagcaggucaccggaugcacg

SEQ ID NO: 2841492 - RNA, 17 nt, Mycobacterium avium subsp. paratuberculosis
gagcaguagacgccgcc

SEQ ID NO: 2841493 - RNA, 18 nt, Mycobacterium avium subsp. paratuberculosis
gagcagugcaucgcugcc

SEQ ID NO: 2841494 - RNA, 22 nt, Mycobacterium avium subsp. paratuberculosis
gagcaguucgaugcgcucggcg

SEQ ID NO: 2841495 - RNA, 14 nt, Mycobacterium avium subsp. paratuberculosis
gagcaucagcugcc

SEQ ID NO: 2841496 - RNA, 14 nt, Mycobacterium avium subsp. paratuberculosis
gagcauccggcgca

SEQ ID NO: 2841497 - RNA, 19 nt, Mycobacterium avium subsp. paratuberculosis
gagcaucgaggaucgccaa

SEQ ID NO: 2841498 - RNA, 14 nt, Mycobacterium avium subsp. paratuberculosis
gagcaucgccgagc

SEQ ID NO: 2841499 - RNA, 20 nt, Mycobacterium avium subsp. paratuberculosis
gagcaucgccgagcgcaucg

SEQ ID NO: 2841500 - RNA, 21 nt, Mycobacterium avium subsp. paratuberculosis
gagcaucgccgagcgcaucga

SEQ ID NO: 2841501 - RNA, 14 nt, Mycobacterium avium subsp. paratuberculosis
gagcaucgggcgca

SEQ ID NO: 2841502 - RNA, 20 nt, Mycobacterium avium subsp. paratuberculosis
gagcaucggguugccggcgg

SEQ ID NO: 2841503 - RNA, 16 nt, Mycobacterium avium subsp. paratuberculosis
gagcaucuccagccgg

SEQ ID NO: 2841504 - RNA, 17 nt, Mycobacterium avium subsp. paratuberculosis
gagcaucuccagccggc

SEQ ID NO: 2841505 - RNA, 18 nt, Mycobacterium avium subsp. paratuberculosis
gagcaucuccagccggcg

SEQ ID NO: 2841506 - RNA, 16 nt, Mycobacterium avium subsp. paratuberculosis
gagcauuucgcgcacg

SEQ ID NO: 2841507 - RNA, 22 nt, Mycobacterium avium subsp. paratuberculosis
gagcauuucgcgcacgucgagg

SEQ ID NO: 2841508 - RNA, 22 nt, Mycobacterium avium subsp. paratuberculosis
gagccaccucgaucagcggcau

SEQ ID NO: 2841509 - RNA, 23 nt, Mycobacterium avium subsp. paratuberculosis
gagccaccucgaucagcggcauc

SEQ ID NO: 2841510 - RNA, 14 nt, Mycobacterium avium subsp. paratuberculosis
gagccagcugcgcg

SEQ ID NO: 2841511 - RNA, 17 nt, Mycobacterium avium subsp. paratuberculosis
gagccagcugcgcgucg

SEQ ID NO: 2841512 - RNA, 19 nt, Mycobacterium avium subsp. paratuberculosis
gagccagcugcgcgucggc

SEQ ID NO: 2841513 - RNA, 23 nt, Mycobacterium avium subsp. paratuberculosis
gagccagcugcgcgucggccgca

SEQ ID NO: 2841514 - RNA, 19 nt, Mycobacterium avium subsp. paratuberculosis
gagccaguucgccagcaug

SEQ ID NO: 2841515 - RNA, 21 nt, Mycobacterium avium subsp. paratuberculosis
gagccaguucgccagcaugcg

SEQ ID NO: 2841516 - RNA, 22 nt, Mycobacterium avium subsp. paratuberculosis
gagccauaaaccggccggcgcg

SEQ ID NO: 2841517 - RNA, 23 nt, Mycobacterium avium subsp. paratuberculosis
gagccauaaaccggccggcgcgc

SEQ ID NO: 2841518 - RNA, 15 nt, Mycobacterium avium subsp. paratuberculosis
gagcccaccgcgccc

SEQ ID NO: 2841519 - RNA, 21 nt, Mycobacterium avium subsp. paratuberculosis
gagcccagccgucgcaccgcc

SEQ ID NO: 2841520 - RNA, 16 nt, Mycobacterium avium subsp. paratuberculosis
gagcccagcugcgcgg

SEQ ID NO: 2841521 - RNA, 21 nt, Mycobacterium avium subsp. paratuberculosis
gagcccagcuuggcgcccuug

SEQ ID NO: 2841522 - RNA, 13 nt, Mycobacterium avium subsp. paratuberculosis
gagcccccaccug

SEQ ID NO: 2841523 - RNA, 14 nt, Mycobacterium avium subsp. paratuberculosis
gagcccccaccuga

SEQ ID NO: 2841524 - RNA, 17 nt, Mycobacterium avium subsp. paratuberculosis
gagcccccaccugaucg

SEQ ID NO: 2841525 - RNA, 16 nt, Mycobacterium avium subsp. paratuberculosis
gagcccgaacacgggc

SEQ ID NO: 2841526 - RNA, 19 nt, Mycobacterium avium subsp. paratuberculosis
gagcccgaacacgggcggc

SEQ ID NO: 2841527 - RNA, 17 nt, Mycobacterium avium subsp. paratuberculosis
gagccggccucgccggc

SEQ ID NO: 2841528 - RNA, 22 nt, Mycobacterium avium subsp. paratuberculosis
gagccggccucgccggcgccgg

SEQ ID NO: 2841529 - RNA, 15 nt, Mycobacterium avium subsp. paratuberculosis
gagccggcgcaccgc

SEQ ID NO: 2841530 - RNA, 14 nt, Mycobacterium avium subsp. paratuberculosis
gagccggcggcggu

SEQ ID NO: 2841531 - RNA, 18 nt, Mycobacterium avium subsp. paratuberculosis
gagccggcggcggugcgu

SEQ ID NO: 2841532 - RNA, 15 nt, Mycobacterium avium subsp. paratuberculosis
gagccggcggcguug

SEQ ID NO: 2841533 - RNA, 22 nt, Mycobacterium avium subsp. paratuberculosis
gagccggcguacccgcccaugc

SEQ ID NO: 2841534 - RNA, 16 nt, Mycobacterium avium subsp. paratuberculosis
gagccggcgucgccgc

SEQ ID NO: 2841535 - RNA, 19 nt, Mycobacterium avium subsp. paratuberculosis
gagccggcgucgccgcugg

SEQ ID NO: 2841536 - RNA, 22 nt, Mycobacterium avium subsp. paratuberculosis
gagccggcguuauuugugcgcu

SEQ ID NO: 2841537 - RNA, 24 nt, Mycobacterium avium subsp. paratuberculosis
gagccggcguuauuugugcgcugg

SEQ ID NO: 2841538 - RNA, 17 nt, Mycobacterium avium subsp. paratuberculosis
gagccgggcagcgcgac

SEQ ID NO: 2841539 - RNA, 19 nt, Mycobacterium avium subsp. paratuberculosis
gagccgggcagcgcgacac

SEQ ID NO: 2841540 - RNA, 14 nt, Mycobacterium avium subsp. paratuberculosis
gagccgggccgggu

SEQ ID NO: 2841541 - RNA, 16 nt, Mycobacterium avium subsp. paratuberculosis
gagccgggcggccagc

SEQ ID NO: 2841542 - RNA, 17 nt, Mycobacterium avium subsp. paratuberculosis
gagccgggcggccagcg

SEQ ID NO: 2841543 - RNA, 18 nt, Mycobacterium avium subsp. paratuberculosis
gagccgggcggccagcgu

SEQ ID NO: 2841544 - RNA, 20 nt, Mycobacterium avium subsp. paratuberculosis
gagccgggcggccagcgugg

SEQ ID NO: 2841545 - RNA, 14 nt, Mycobacterium avium subsp. paratuberculosis
gagccgggugcccg

SEQ ID NO: 2841546 - RNA, 20 nt, Mycobacterium avium subsp. paratuberculosis
gagccgggugcccgcguaca

SEQ ID NO: 2841547 - RNA, 16 nt, Mycobacterium avium subsp. paratuberculosis
gagccgguacggcucg

SEQ ID NO: 2841548 - RNA, 23 nt, Mycobacterium avium subsp. paratuberculosis
gagccgguacggcucgugggugg

SEQ ID NO: 2841549 - RNA, 18 nt, Mycobacterium avium subsp. paratuberculosis
gagccgguagaucagcgc

SEQ ID NO: 2841550 - RNA, 19 nt, Mycobacterium avium subsp. paratuberculosis
gagccgguagaucagcgcc

SEQ ID NO: 2841551 - RNA, 20 nt, Mycobacterium avium subsp. paratuberculosis
gagccgguagaucagcgccu

SEQ ID NO: 2841552 - RNA, 17 nt, Mycobacterium avium subsp. paratuberculosis
gagccgguccgaccagc

SEQ ID NO: 2841553 - RNA, 19 nt, Mycobacterium avium subsp. paratuberculosis
gagccgguccgaccagcgg

SEQ ID NO: 2841554 - RNA, 21 nt, Mycobacterium avium subsp. paratuberculosis
gagccgguccgaccagcggcc

SEQ ID NO: 2841555 - RNA, 14 nt, Mycobacterium avium subsp. paratuberculosis
gagccgguccgacg

SEQ ID NO: 2841556 - RNA, 16 nt, Mycobacterium avium subsp. paratuberculosis
gagccgguccgacggc

SEQ ID NO: 2841557 - RNA, 19 nt, Mycobacterium avium subsp. paratuberculosis
gagccggucgaacgccagc

SEQ ID NO: 2841558 - RNA, 21 nt, Mycobacterium avium subsp. paratuberculosis
gagccggucgaacgccagcgc

SEQ ID NO: 2841559 - RNA, 16 nt, Mycobacterium avium subsp. paratuberculosis
gagccggucugggcga

SEQ ID NO: 2841560 - RNA, 19 nt, Mycobacterium avium subsp. paratuberculosis
gagccggucugggcgacca

SEQ ID NO: 2841561 - RNA, 22 nt, Mycobacterium avium subsp. paratuberculosis
gagccggucugggcgaccaugc

SEQ ID NO: 2841562 - RNA, 16 nt, Mycobacterium avium subsp. paratuberculosis
gagccggugccgaggc

SEQ ID NO: 2841563 - RNA, 23 nt, Mycobacterium avium subsp. paratuberculosis
gagccggugccgaggcaguucca

SEQ ID NO: 2841564 - RNA, 22 nt, Mycobacterium avium subsp. paratuberculosis
gagccggugguuuugcggcccu

SEQ ID NO: 2841565 - RNA, 23 nt, Mycobacterium avium subsp. paratuberculosis
gagccggugguuuugcggcccug

SEQ ID NO: 2841566 - RNA, 21 nt, Mycobacterium avium subsp. paratuberculosis
gagccguccggguucgacgcc

SEQ ID NO: 2841567 - RNA, 22 nt, Mycobacterium avium subsp. paratuberculosis
gagccguccggguucgacgccu

SEQ ID NO: 2841568 - RNA, 23 nt, Mycobacterium avium subsp. paratuberculosis
gagccguccggguucgacgccuc

SEQ ID NO: 2841569 - RNA, 23 nt, Mycobacterium avium subsp. paratuberculosis
gagccgucggcuuccuccucggc

SEQ ID NO: 2841570 - RNA, 17 nt, Mycobacterium avium subsp. paratuberculosis
gagccgucgucgcugca

SEQ ID NO: 2841571 - RNA, 20 nt, Mycobacterium avium subsp. paratuberculosis
gagccgucucggagcggugu

SEQ ID NO: 2841572 - RNA, 21 nt, Mycobacterium avium subsp. paratuberculosis
gagccgucucggagcgguguc

SEQ ID NO: 2841573 - RNA, 22 nt, Mycobacterium avium subsp. paratuberculosis
gagccgucucggagcggugucg

SEQ ID NO: 2841574 - RNA, 13 nt, Mycobacterium avium subsp. paratuberculosis
gagccgugcagcg

SEQ ID NO: 2841575 - RNA, 15 nt, Mycobacterium avium subsp. paratuberculosis
gagccgugcagcgcc

SEQ ID NO: 2841576 - RNA, 15 nt, Mycobacterium avium subsp. paratuberculosis
gagccgugcccgagg

SEQ ID NO: 2841577 - RNA, 16 nt, Mycobacterium avium subsp. paratuberculosis
gagccgugcccgaggu

SEQ ID NO: 2841578 - RNA, 23 nt, Mycobacterium avium subsp. paratuberculosis
gagccguuuggcgccgcccacca

SEQ ID NO: 2841579 - RNA, 13 nt, Mycobacterium avium subsp. paratuberculosis
gagccuaugaggc

SEQ ID NO: 2841580 - RNA, 14 nt, Mycobacterium avium subsp. paratuberculosis
gagccucagcgcgc

SEQ ID NO: 2841581 - RNA, 18 nt, Mycobacterium avium subsp. paratuberculosis
gagccucagggcgcgcug

SEQ ID NO: 2841582 - RNA, 21 nt, Mycobacterium avium subsp. paratuberculosis
gagccucagggcgcgcugucg

SEQ ID NO: 2841583 - RNA, 20 nt, Mycobacterium avium subsp. paratuberculosis
gagccugggauugccgggca

SEQ ID NO: 2841584 - RNA, 11 nt, Mycobacterium avium subsp. paratuberculosis
gagccuucuuc

SEQ ID NO: 2841585 - RNA, 17 nt, Mycobacterium avium subsp. paratuberculosis
gagccuucuucgccgca

SEQ ID NO: 2841586 - RNA, 18 nt, Mycobacterium avium subsp. paratuberculosis
gagccuucuucgccgcaa

SEQ ID NO: 2841587 - RNA, 20 nt, Mycobacterium avium subsp. paratuberculosis
gagccuucuucgccgcaacc

SEQ ID NO: 2841588 - RNA, 21 nt, Mycobacterium avium subsp. paratuberculosis
gagccuucuucgccgcaaccu

SEQ ID NO: 2841589 - RNA, 22 nt, Mycobacterium avium subsp. paratuberculosis
gagccuucuucgccgcaaccuu

SEQ ID NO: 2841590 - RNA, 18 nt, Mycobacterium avium subsp. paratuberculosis
gagccuucuucgccgcag

SEQ ID NO: 2841591 - RNA, 19 nt, Mycobacterium avium subsp. paratuberculosis
gagccuucuucgccgcagc

SEQ ID NO: 2841592 - RNA, 20 nt, Mycobacterium avium subsp. paratuberculosis
gagccuucuucgccgcagcc

SEQ ID NO: 2841593 - RNA, 21 nt, Mycobacterium avium subsp. paratuberculosis
gagccuucuucgccgcagccu

SEQ ID NO: 2841594 - RNA, 22 nt, Mycobacterium avium subsp. paratuberculosis
gagccuucuucgccgcagccuu

SEQ ID NO: 2841595 - RNA, 23 nt, Mycobacterium avium subsp. paratuberculosis
gagccuucuucgccgcagccuuc

SEQ ID NO: 2841596 - RNA, 18 nt, Mycobacterium avium subsp. paratuberculosis
gagccuucuugaccgcag

SEQ ID NO: 2841597 - RNA, 22 nt, Mycobacterium avium subsp. paratuberculosis
gagccuucuugaccgcagccuu

SEQ ID NO: 2841598 - RNA, 15 nt, Mycobacterium avium subsp. paratuberculosis
gagccuugcuggcgg

SEQ ID NO: 2841599 - RNA, 19 nt, Mycobacterium avium subsp. paratuberculosis
gagccuugcuggcggccuu

SEQ ID NO: 2841600 - RNA, 10 nt, Mycobacterium avium subsp. paratuberculosis
gagccuuggu

SEQ ID NO: 2841601 - RNA, 19 nt, Mycobacterium avium subsp. paratuberculosis
gagccuuggucgcggccuu

SEQ ID NO: 2841602 - RNA, 21 nt, Mycobacterium avium subsp. paratuberculosis
gagcgaacacgugcagcucgg

SEQ ID NO: 2841603 - RNA, 14 nt, Mycobacterium avium subsp. paratuberculosis
gagcgacaccaggu

SEQ ID NO: 2841604 - RNA, 23 nt, Mycobacterium avium subsp. paratuberculosis
gagcgagaugaucagccgcccga

SEQ ID NO: 2841605 - RNA, 15 nt, Mycobacterium avium subsp. paratuberculosis
gagcgagccggcacg

SEQ ID NO: 2841606 - RNA, 14 nt, Mycobacterium avium subsp. paratuberculosis
gagcgagcgcacca

SEQ ID NO: 2841607 - RNA, 21 nt, Mycobacterium avium subsp. paratuberculosis
gagcgaggacgucgagcggcg

SEQ ID NO: 2841608 - RNA, 14 nt, Mycobacterium avium subsp. paratuberculosis
gagcgaggccauca

SEQ ID NO: 2841609 - RNA, 18 nt, Mycobacterium avium subsp. paratuberculosis
gagcgaugggcgcgauca

SEQ ID NO: 2841610 - RNA, 14 nt, Mycobacterium avium subsp. paratuberculosis
gagcgcaccagauu

SEQ ID NO: 2841611 - RNA, 17 nt, Mycobacterium avium subsp. paratuberculosis
gagcgggaagcugcugg

SEQ ID NO: 2841612 - RNA, 21 nt, Mycobacterium avium subsp. paratuberculosis
gagcgggaccgaggugccgcg

SEQ ID NO: 2841613 - RNA, 20 nt, Mycobacterium avium subsp. paratuberculosis
gagcgggauccccaccguga

SEQ ID NO: 2841614 - RNA, 22 nt, Mycobacterium avium subsp. paratuberculosis
gagcgggauccccaccgugacg

SEQ ID NO: 2841615 - RNA, 19 nt, Mycobacterium avium subsp. paratuberculosis
gagcgggaucugcgccgcc

SEQ ID NO: 2841616 - RNA, 19 nt, Mycobacterium avium subsp. paratuberculosis
gagcgggcacgccgccgcg

SEQ ID NO: 2841617 - RNA, 21 nt, Mycobacterium avium subsp. paratuberculosis
gagcgggcacgccgccgcgaa

SEQ ID NO: 2841618 - RNA, 14 nt, Mycobacterium avium subsp. paratuberculosis
gagcgggccacgca

SEQ ID NO: 2841619 - RNA, 13 nt, Mycobacterium avium subsp. paratuberculosis
gagcgggccgacc

SEQ ID NO: 2841620 - RNA, 17 nt, Mycobacterium avium subsp. paratuberculosis
gagcgggccgaccguca

SEQ ID NO: 2841621 - RNA, 23 nt, Mycobacterium avium subsp. paratuberculosis
gagcgggccgaucagugccgcgc

SEQ ID NO: 2841622 - RNA, 16 nt, Mycobacterium avium subsp. paratuberculosis
gagcgggccuucacgc

SEQ ID NO: 2841623 - RNA, 22 nt, Mycobacterium avium subsp. paratuberculosis
gagcgggcgaucucgauggcca

SEQ ID NO: 2841624 - RNA, 13 nt, Mycobacterium avium subsp. paratuberculosis
gagcgggcgggcu

SEQ ID NO: 2841625 - RNA, 14 nt, Mycobacterium avium subsp. paratuberculosis
gagcgggcgggcuc

SEQ ID NO: 2841626 - RNA, 18 nt, Mycobacterium avium subsp. paratuberculosis
gagcggguaaccgcagcc

SEQ ID NO: 2841627 - RNA, 20 nt, Mycobacterium avium subsp. paratuberculosis
gagcggguaaccgcagccgg

SEQ ID NO: 2841628 - RNA, 21 nt, Mycobacterium avium subsp. paratuberculosis
gagcggguccgccccgagauc

SEQ ID NO: 2841629 - RNA, 16 nt, Mycobacterium avium subsp. paratuberculosis
gagcgggucggccggc

SEQ ID NO: 2841630 - RNA, 17 nt, Mycobacterium avium subsp. paratuberculosis
gagcgggucggccggcg

SEQ ID NO: 2841631 - RNA, 15 nt, Mycobacterium avium subsp. paratuberculosis
gagcgggucgucguu

SEQ ID NO: 2841632 - RNA, 22 nt, Mycobacterium avium subsp. paratuberculosis
gagcgggugaaucgacaccgca

SEQ ID NO: 2841633 - RNA, 23 nt, Mycobacterium avium subsp. paratuberculosis
gagcgggugaaucgacaccgcac

SEQ ID NO: 2841634 - RNA, 22 nt, Mycobacterium avium subsp. paratuberculosis
gagcgguccaacgggcucagca

SEQ ID NO: 2841635 - RNA, 19 nt, Mycobacterium avium subsp. paratuberculosis
gagcggugacaucgccacc

SEQ ID NO: 2841636 - RNA, 11 nt, Mycobacterium avium subsp. paratuberculosis
gagcggugacc

SEQ ID NO: 2841637 - RNA, 12 nt, Mycobacterium avium subsp. paratuberculosis
gagcgguggcca

SEQ ID NO: 2841638 - RNA, 15 nt, Mycobacterium avium subsp. paratuberculosis
gagcgguggccacgc

SEQ ID NO: 2841639 - RNA, 24 nt, Mycobacterium avium subsp. paratuberculosis
gagcggugucgcuuugcggcgaac

SEQ ID NO: 2841640 - RNA, 20 nt, Mycobacterium avium subsp. paratuberculosis
gagcgguucgaucucgucgg

SEQ ID NO: 2841641 - RNA, 19 nt, Mycobacterium avium subsp. paratuberculosis
gagcgguuggcgacgcuga

SEQ ID NO: 2841642 - RNA, 16 nt, Mycobacterium avium subsp. paratuberculosis
gagcgguuugcggguc

SEQ ID NO: 2841643 - RNA, 15 nt, Mycobacterium avium subsp. paratuberculosis
gagcgucacgccagc

SEQ ID NO: 2841644 - RNA, 17 nt, Mycobacterium avium subsp. paratuberculosis
gagcgucacgccagcgu

SEQ ID NO: 2841645 - RNA, 20 nt, Mycobacterium avium subsp. paratuberculosis
gagcgucacgccagcgugac

SEQ ID NO: 2841646 - RNA, 21 nt, Mycobacterium avium subsp. paratuberculosis
gagcgucacgccagcgugacg

SEQ ID NO: 2841647 - RNA, 14 nt, Mycobacterium avium subsp. paratuberculosis
gagcgucacgccgc

SEQ ID NO: 2841648 - RNA, 23 nt, Mycobacterium avium subsp. paratuberculosis
gagcgucacgccgcgcccgucga

SEQ ID NO: 2841649 - RNA, 20 nt, Mycobacterium avium subsp. paratuberculosis
gagcgucacgcuggcguggc

SEQ ID NO: 2841650 - RNA, 21 nt, Mycobacterium avium subsp. paratuberculosis
gagcgucacgcuggcguggcg

SEQ ID NO: 2841651 - RNA, 14 nt, Mycobacterium avium subsp. paratuberculosis
gagcgucauuccgc

SEQ ID NO: 2841652 - RNA, 21 nt, Mycobacterium avium subsp. paratuberculosis
gagcgucauuccgccgcgccc

SEQ ID NO: 2841653 - RNA, 14 nt, Mycobacterium avium subsp. paratuberculosis
gagcgucgccacca

SEQ ID NO: 2841654 - RNA, 17 nt, Mycobacterium avium subsp. paratuberculosis
gagcgucgccaccaccu

SEQ ID NO: 2841655 - RNA, 17 nt, Mycobacterium avium subsp. paratuberculosis
gagcgucggucucgacg

SEQ ID NO: 2841656 - RNA, 22 nt, Mycobacterium avium subsp. paratuberculosis
gagcgucggucucgacguugga

SEQ ID NO: 2841657 - RNA, 20 nt, Mycobacterium avium subsp. paratuberculosis
gagcgugaaacuagcuucac

SEQ ID NO: 2841658 - RNA, 15 nt, Mycobacterium avium subsp. paratuberculosis
gagcgugaacuuaac

SEQ ID NO: 2841659 - RNA, 22 nt, Mycobacterium avium subsp. paratuberculosis
gagcgugaacuuaacuucacgc

SEQ ID NO: 2841660 - RNA, 20 nt, Mycobacterium avium subsp. paratuberculosis
gagcgugaaguuaacuucac

SEQ ID NO: 2841661 - RNA, 22 nt, Mycobacterium avium subsp. paratuberculosis
gagcgugaaguuaguuucacgc

SEQ ID NO: 2841662 - RNA, 14 nt, Mycobacterium avium subsp. paratuberculosis
gagcgugcccgcgc

SEQ ID NO: 2841663 - RNA, 18 nt, Mycobacterium avium subsp. paratuberculosis
gagcgugcccgcgcccac

SEQ ID NO: 2841664 - RNA, 14 nt, Mycobacterium avium subsp. paratuberculosis
gagcgugccgccgg

SEQ ID NO: 2841665 - RNA, 19 nt, Mycobacterium avium subsp. paratuberculosis
gagcguggacaccgcaccc

SEQ ID NO: 2841666 - RNA, 17 nt, Mycobacterium avium subsp. paratuberculosis
gagcgugggggccaugu

SEQ ID NO: 2841667 - RNA, 12 nt, Mycobacterium avium subsp. paratuberculosis
gagcguguggga

SEQ ID NO: 2841668 - RNA, 16 nt, Mycobacterium avium subsp. paratuberculosis
gagcguucggcgcgga

SEQ ID NO: 2841669 - RNA, 17 nt, Mycobacterium avium subsp. paratuberculosis
gagcguucggcgcggau

SEQ ID NO: 2841670 - RNA, 18 nt, Mycobacterium avium subsp. paratuberculosis
gagcguucuccacccgcc

SEQ ID NO: 2841671 - RNA, 12 nt, Mycobacterium avium subsp. paratuberculosis
gagcuaggcggc

SEQ ID NO: 2841672 - RNA, 14 nt, Mycobacterium avium subsp. paratuberculosis
gagcucaggccggc

SEQ ID NO: 2841673 - RNA, 23 nt, Mycobacterium avium subsp. paratuberculosis
gagcucaugguguuccaccagcg

SEQ ID NO: 2841674 - RNA, 20 nt, Mycobacterium avium subsp. paratuberculosis
gagcuccagcuaggagccug

SEQ ID NO: 2841675 - RNA, 14 nt, Mycobacterium avium subsp. paratuberculosis
gagcuccucggcca

SEQ ID NO: 2841676 - RNA, 24 nt, Mycobacterium avium subsp. paratuberculosis
gagcucgcagucgaucagcgacgg

SEQ ID NO: 2841677 - RNA, 19 nt, Mycobacterium avium subsp. paratuberculosis
gagcucgccgcugucgucg

SEQ ID NO: 2841678 - RNA, 20 nt, Mycobacterium avium subsp. paratuberculosis
gagcucgccgcugucgucga

SEQ ID NO: 2841679 - RNA, 19 nt, Mycobacterium avium subsp. paratuberculosis
gagcucgcggcgcagcucg

SEQ ID NO: 2841680 - RNA, 17 nt, Mycobacterium avium subsp. paratuberculosis
gagcucggccaccagcg

SEQ ID NO: 2841681 - RNA, 22 nt, Mycobacterium avium subsp. paratuberculosis
gagcucggccuuacgcugcgcg

SEQ ID NO: 2841682 - RNA, 22 nt, Mycobacterium avium subsp. paratuberculosis
gagcucggccuugagccggucg

SEQ ID NO: 2841683 - RNA, 14 nt, Mycobacterium avium subsp. paratuberculosis
gagcucgggcgcga

SEQ ID NO: 2841684 - RNA, 16 nt, Mycobacterium avium subsp. paratuberculosis
gagcucgucgggugug

SEQ ID NO: 2841685 - RNA, 18 nt, Mycobacterium avium subsp. paratuberculosis
gagcucgucggguguggc

SEQ ID NO: 2841686 - RNA, 21 nt, Mycobacterium avium subsp. paratuberculosis
gagcucgugaugguccagcac

SEQ ID NO: 2841687 - RNA, 17 nt, Mycobacterium avium subsp. paratuberculosis
gagcucguucucggcga

SEQ ID NO: 2841688 - RNA, 20 nt, Mycobacterium avium subsp. paratuberculosis
gagcucguucucggcgaaca

SEQ ID NO: 2841689 - RNA, 13 nt, Mycobacterium avium subsp. paratuberculosis
gagcucuugcgcc

SEQ ID NO: 2841690 - RNA, 19 nt, Mycobacterium avium subsp. paratuberculosis
gagcugaaguucaccaccg

SEQ ID NO: 2841691 - RNA, 21 nt, Mycobacterium avium subsp. paratuberculosis
gagcugaaguucaccaccgcg

SEQ ID NO: 2841692 - RNA, 19 nt, Mycobacterium avium subsp. paratuberculosis
gagcugaccuggcugacgg

SEQ ID NO: 2841693 - RNA, 21 nt, Mycobacterium avium subsp. paratuberculosis
gagcugaccuggcugacggcg

SEQ ID NO: 2841694 - RNA, 22 nt, Mycobacterium avium subsp. paratuberculosis
gagcugaccuggcugacggcgu

SEQ ID NO: 2841695 - RNA, 18 nt, Mycobacterium avium subsp. paratuberculosis
gaggcaccgaacgccagc

SEQ ID NO: 2841696 - RNA, 14 nt, Mycobacterium avium subsp. paratuberculosis
gaggcacggcccgc

SEQ ID NO: 2841697 - RNA, 14 nt, Mycobacterium avium subsp. paratuberculosis
gaggccaccgcgcc

SEQ ID NO: 2841698 - RNA, 15 nt, Mycobacterium avium subsp. paratuberculosis
gaggccaccgcgccg

SEQ ID NO: 2841699 - RNA, 13 nt, Mycobacterium avium subsp. paratuberculosis
gaggccagcaccu

SEQ ID NO: 2841700 - RNA, 13 nt, Mycobacterium avium subsp. paratuberculosis
gaggccagcacgc

SEQ ID NO: 2841701 - RNA, 15 nt, Mycobacterium avium subsp. paratuberculosis
gaggccagcacgccg

SEQ ID NO: 2841702 - RNA, 19 nt, Mycobacterium avium subsp. paratuberculosis
gaggccagcacgccgguca

SEQ ID NO: 2841703 - RNA, 22 nt, Mycobacterium avium subsp. paratuberculosis
gaggccagcacgccggucagca

SEQ ID NO: 2841704 - RNA, 14 nt, Mycobacterium avium subsp. paratuberculosis
gaggccagcgcgau

SEQ ID NO: 2841705 - RNA, 15 nt, Mycobacterium avium subsp. paratuberculosis
gaggccagcgcgauc

SEQ ID NO: 2841706 - RNA, 22 nt, Mycobacterium avium subsp. paratuberculosis
gaggccagcgcgaucgccggga

SEQ ID NO: 2841707 - RNA, 17 nt, Mycobacterium avium subsp. paratuberculosis
gaggccagcugcaccgg

SEQ ID NO: 2841708 - RNA, 21 nt, Mycobacterium avium subsp. paratuberculosis
gaggccagcugcaccggggcc

SEQ ID NO: 2841709 - RNA, 18 nt, Mycobacterium avium subsp. paratuberculosis
gaggcccacguugagcac

SEQ ID NO: 2841710 - RNA, 17 nt, Mycobacterium avium subsp. paratuberculosis
gaggcccagcccgccgc

SEQ ID NO: 2841711 - RNA, 16 nt, Mycobacterium avium subsp. paratuberculosis
gaggccccgcgugacg

SEQ ID NO: 2841712 - RNA, 18 nt, Mycobacterium avium subsp. paratuberculosis
gaggcccggacggccacc

SEQ ID NO: 2841713 - RNA, 21 nt, Mycobacterium avium subsp. paratuberculosis
gaggcccggcagccggggugc

SEQ ID NO: 2841714 - RNA, 20 nt, Mycobacterium avium subsp. paratuberculosis
gaggcccggcgugggccgca

SEQ ID NO: 2841715 - RNA, 22 nt, Mycobacterium avium subsp. paratuberculosis
gaggcccggcgugggccgcagc

SEQ ID NO: 2841716 - RNA, 19 nt, Mycobacterium avium subsp. paratuberculosis
gaggcccucgacaccggug

SEQ ID NO: 2841717 - RNA, 21 nt, Mycobacterium avium subsp. paratuberculosis
gaggcccucgacaccgguggc

SEQ ID NO: 2841718 - RNA, 17 nt, Mycobacterium avium subsp. paratuberculosis
gaggccgaaccgcagcc

SEQ ID NO: 2841719 - RNA, 19 nt, Mycobacterium avium subsp. paratuberculosis
gaggccgaaccgcagccgg

SEQ ID NO: 2841720 - RNA, 22 nt, Mycobacterium avium subsp. paratuberculosis
gaggccgacgugcuuggccagc

SEQ ID NO: 2841721 - RNA, 19 nt, Mycobacterium avium subsp. paratuberculosis
gaggccgacguggagcuga

SEQ ID NO: 2841722 - RNA, 13 nt, Mycobacterium avium subsp. paratuberculosis
gaggccgaggcga

SEQ ID NO: 2841723 - RNA, 14 nt, Mycobacterium avium subsp. paratuberculosis
gaggccgaggcgag

SEQ ID NO: 2841724 - RNA, 15 nt, Mycobacterium avium subsp. paratuberculosis
gaggccgaggcgagu

SEQ ID NO: 2841725 - RNA, 22 nt, Mycobacterium avium subsp. paratuberculosis
gaggccgaggcgagugaggacg

SEQ ID NO: 2841726 - RNA, 16 nt, Mycobacterium avium subsp. paratuberculosis
gaggccgaggucgguc

SEQ ID NO: 2841727 - RNA, 17 nt, Mycobacterium avium subsp. paratuberculosis
gaggccgauggcgccca

SEQ ID NO: 2841728 - RNA, 18 nt, Mycobacterium avium subsp. paratuberculosis
gaggccgauggcgcccag

SEQ ID NO: 2841729 - RNA, 19 nt, Mycobacterium avium subsp. paratuberculosis
gaggccgauggcgcccagc

SEQ ID NO: 2841730 - RNA, 19 nt, Mycobacterium avium subsp. paratuberculosis
gaggccgccccggccgcgc

SEQ ID NO: 2841731 - RNA, 20 nt, Mycobacterium avium subsp. paratuberculosis
gaggccgccccggccgcgca

SEQ ID NO: 2841732 - RNA, 22 nt, Mycobacterium avium subsp. paratuberculosis
gaggccgccccggccgcgcacc

SEQ ID NO: 2841733 - RNA, 21 nt, Mycobacterium avium subsp. paratuberculosis
gaggccgcgccgugcgccagc

SEQ ID NO: 2841734 - RNA, 17 nt, Mycobacterium avium subsp. paratuberculosis
gaggccgcggcgacacc

SEQ ID NO: 2841735 - RNA, 13 nt, Mycobacterium avium subsp. paratuberculosis
gaggccgcgggcg

SEQ ID NO: 2841736 - RNA, 16 nt, Mycobacterium avium subsp. paratuberculosis
gaggccgcgggcguuc

SEQ ID NO: 2841737 - RNA, 19 nt, Mycobacterium avium subsp. paratuberculosis
gaggccguaucccaccacg

SEQ ID NO: 2841738 - RNA, 23 nt, Mycobacterium avium subsp. paratuberculosis
gaggccguucagguaaucgauga

SEQ ID NO: 2841739 - RNA, 23 nt, Mycobacterium avium subsp. paratuberculosis
gaggccuccagguagacgaugcc

SEQ ID NO: 2841740 - RNA, 12 nt, Mycobacterium avium subsp. paratuberculosis
gaggccucgccg

SEQ ID NO: 2841741 - RNA, 18 nt, Mycobacterium avium subsp. paratuberculosis
gaggccucgccgcuggga

SEQ ID NO: 2841742 - RNA, 18 nt, Mycobacterium avium subsp. paratuberculosis
gaggccugcgcggccgcg

SEQ ID NO: 2841743 - RNA, 23 nt, Mycobacterium avium subsp. paratuberculosis
gaggccuucuuucguucgauguc

SEQ ID NO: 2841744 - RNA, 22 nt, Mycobacterium avium subsp. paratuberculosis
gaggccuuggugaugggcagcg

SEQ ID NO: 2841745 - RNA, 17 nt, Mycobacterium avium subsp. paratuberculosis
gaggcgaaugcggccau

SEQ ID NO: 2841746 - RNA, 18 nt, Mycobacterium avium subsp. paratuberculosis
gaggcgaaugcggccaug

SEQ ID NO: 2841747 - RNA, 22 nt, Mycobacterium avium subsp. paratuberculosis
gaggcgaucagguggggcagga

SEQ ID NO: 2841748 - RNA, 18 nt, Mycobacterium avium subsp. paratuberculosis
gaggcgaucgcggccacc

SEQ ID NO: 2841749 - RNA, 16 nt, Mycobacterium avium subsp. paratuberculosis
gaggcgauggugcccu

SEQ ID NO: 2841750 - RNA, 16 nt, Mycobacterium avium subsp. paratuberculosis
gaggcgcaacaccgga

SEQ ID NO: 2841751 - RNA, 17 nt, Mycobacterium avium subsp. paratuberculosis
gaggcgcacaacgaggc

SEQ ID NO: 2841752 - RNA, 23 nt, Mycobacterium avium subsp. paratuberculosis
gaggcgccguauuggcaggcgau

SEQ ID NO: 2841753 - RNA, 14 nt, Mycobacterium avium subsp. paratuberculosis
gaggcgcgcaggua

SEQ ID NO: 2841754 - RNA, 18 nt, Mycobacterium avium subsp. paratuberculosis
gaggcgcuccugaaucgg

SEQ ID NO: 2841755 - RNA, 15 nt, Mycobacterium avium subsp. paratuberculosis
gaggcgcucggcccg

SEQ ID NO: 2841756 - RNA, 16 nt, Mycobacterium avium subsp. paratuberculosis
gaggcgcugcagcaug

SEQ ID NO: 2841757 - RNA, 21 nt, Mycobacterium avium subsp. paratuberculosis
gaggcggaucuucucgcugcu

SEQ ID NO: 2841758 - RNA, 13 nt, Mycobacterium avium subsp. paratuberculosis
gaggcggccagcg

SEQ ID NO: 2841759 - RNA, 14 nt, Mycobacterium avium subsp. paratuberculosis
gaggcggcgaccgc

SEQ ID NO: 2841760 - RNA, 13 nt, Mycobacterium avium subsp. paratuberculosis
gaggcggcggcgg

SEQ ID NO: 2841761 - RNA, 17 nt, Mycobacterium avium subsp. paratuberculosis
gaggcggcggcgggcca

SEQ ID NO: 2841762 - RNA, 14 nt, Mycobacterium avium subsp. paratuberculosis
gaggcggcgggggc

SEQ ID NO: 2841763 - RNA, 14 nt, Mycobacterium avium subsp. paratuberculosis
gaggcggguaggcg

SEQ ID NO: 2841764 - RNA, 16 nt, Mycobacterium avium subsp. paratuberculosis
gaggcggguaggcguc

SEQ ID NO: 2841765 - RNA, 21 nt, Mycobacterium avium subsp. paratuberculosis
gaggcggguaggcgucgcgca

SEQ ID NO: 2841766 - RNA, 21 nt, Mycobacterium avium subsp. paratuberculosis
gaggcggguguauucgcccac

SEQ ID NO: 2841767 - RNA, 13 nt, Mycobacterium avium subsp. paratuberculosis
gaggcggucgacu

SEQ ID NO: 2841768 - RNA, 13 nt, Mycobacterium avium subsp. paratuberculosis
gaggcggucggcg

SEQ ID NO: 2841769 - RNA, 15 nt, Mycobacterium avium subsp. paratuberculosis
gaggcggucggcgga

SEQ ID NO: 2841770 - RNA, 20 nt, Mycobacterium avium subsp. paratuberculosis
gaggcggucggcggaggcga

SEQ ID NO: 2841771 - RNA, 18 nt, Mycobacterium avium subsp. paratuberculosis
gaggcgguuccgguggcg

SEQ ID NO: 2841772 - RNA, 19 nt, Mycobacterium avium subsp. paratuberculosis
gaggcgucagggguuggcg

SEQ ID NO: 2841773 - RNA, 22 nt, Mycobacterium avium subsp. paratuberculosis
gaggcgucagggguuggcgcgc

SEQ ID NO: 2841774 - RNA, 15 nt, Mycobacterium avium subsp. paratuberculosis
gaggcguccagcgcg

SEQ ID NO: 2841775 - RNA, 20 nt, Mycobacterium avium subsp. paratuberculosis
gaggcguccagcgcgucgcu

SEQ ID NO: 2841776 - RNA, 18 nt, Mycobacterium avium subsp. paratuberculosis
gaggcguccuccucgucc

SEQ ID NO: 2841777 - RNA, 15 nt, Mycobacterium avium subsp. paratuberculosis
gaggcgucgacgcgc

SEQ ID NO: 2841778 - RNA, 19 nt, Mycobacterium avium subsp. paratuberculosis
gaggcgucgacgcgcugcu

SEQ ID NO: 2841779 - RNA, 20 nt, Mycobacterium avium subsp. paratuberculosis
gaggugaauaccacugcgcg

SEQ ID NO: 2841780 - RNA, 21 nt, Mycobacterium avium subsp. paratuberculosis
gaggugaauaccacugcgcgc

SEQ ID NO: 2841781 - RNA, 13 nt, Mycobacterium avium subsp. paratuberculosis
gaggugaccggcg

SEQ ID NO: 2841782 - RNA, 16 nt, Mycobacterium avium subsp. paratuberculosis
gaggugacgucgcgcc

SEQ ID NO: 2841783 - RNA, 18 nt, Mycobacterium avium subsp. paratuberculosis
gaggugacgucgcgccgc

SEQ ID NO: 2841784 - RNA, 13 nt, Mycobacterium avium subsp. paratuberculosis
gaggugaucgcca

SEQ ID NO: 2841785 - RNA, 15 nt, Mycobacterium avium subsp. paratuberculosis
gaggugaucgccagc

SEQ ID NO: 2841786 - RNA, 19 nt, Mycobacterium avium subsp. paratuberculosis
gaggugaucgcgaacgcgc

SEQ ID NO: 2841787 - RNA, 22 nt, Mycobacterium avium subsp. paratuberculosis
gaggugaucgcgaacgcgccgg

SEQ ID NO: 2841788 - RNA, 18 nt, Mycobacterium avium subsp. paratuberculosis
gaggugaugccguccagc

SEQ ID NO: 2841789 - RNA, 16 nt, Mycobacterium avium subsp. paratuberculosis
gaggugauguuggccg

SEQ ID NO: 2841790 - RNA, 19 nt, Mycobacterium avium subsp. paratuberculosis
gaggugauguuggccgcga

SEQ ID NO: 2841791 - RNA, 21 nt, Mycobacterium avium subsp. paratuberculosis
gaggugauguuggccgcgacg

SEQ ID NO: 2841792 - RNA, 22 nt, Mycobacterium avium subsp. paratuberculosis
gaggugauguuggccgcgacgc

SEQ ID NO: 2841793 - RNA, 16 nt, Mycobacterium avium subsp. paratuberculosis
gaggugcaacacucga

SEQ ID NO: 2841794 - RNA, 22 nt, Mycobacterium avium subsp. paratuberculosis
gaggugcaacacucgagcgcgc

SEQ ID NO: 2841795 - RNA, 17 nt, Mycobacterium avium subsp. paratuberculosis
gaggugcagcgggcugg

SEQ ID NO: 2841796 - RNA, 17 nt, Mycobacterium avium subsp. paratuberculosis
gaggugccgcgcagcac

SEQ ID NO: 2841797 - RNA, 14 nt, Mycobacterium avium subsp. paratuberculosis
gaggugccggccgg

SEQ ID NO: 2841798 - RNA, 13 nt, Mycobacterium avium subsp. paratuberculosis
gaggugcucgacg

SEQ ID NO: 2841799 - RNA, 13 nt, Mycobacterium avium subsp. paratuberculosis
gaggugcucgcgc

SEQ ID NO: 2841800 - RNA, 16 nt, Mycobacterium avium subsp. paratuberculosis
gaggugcucgcgcagg

SEQ ID NO: 2841801 - RNA, 16 nt, Mycobacterium avium subsp. paratuberculosis
gagguggcccagccgc

SEQ ID NO: 2841802 - RNA, 15 nt, Mycobacterium avium subsp. paratuberculosis
gagguggcccgccac

SEQ ID NO: 2841803 - RNA, 12 nt, Mycobacterium avium subsp. paratuberculosis
gagguggccgcc

SEQ ID NO: 2841804 - RNA, 19 nt, Mycobacterium avium subsp. paratuberculosis
gagguggcguagucgucga

SEQ ID NO: 2841805 - RNA, 13 nt, Mycobacterium avium subsp. paratuberculosis
gaggugguccgcg

SEQ ID NO: 2841806 - RNA, 22 nt, Mycobacterium avium subsp. paratuberculosis
gaggugguuucggggucgccgu

SEQ ID NO: 2841807 - RNA, 15 nt, Mycobacterium avium subsp. paratuberculosis
gaggugugaggaguc

SEQ ID NO: 2841808 - RNA, 22 nt, Mycobacterium avium subsp. paratuberculosis
gagguuagguacgcggcuggcg

SEQ ID NO: 2841809 - RNA, 15 nt, Mycobacterium avium subsp. paratuberculosis
gaguaacacgugggc

SEQ ID NO: 2841810 - RNA, 14 nt, Mycobacterium avium subsp. paratuberculosis
gaguaaccggugcg

SEQ ID NO: 2841811 - RNA, 16 nt, Mycobacterium avium subsp. paratuberculosis
gaguaaccggugcgcu

SEQ ID NO: 2841812 - RNA, 23 nt, Mycobacterium avium subsp. paratuberculosis
gaguaaccggugcgcuccaaggu

SEQ ID NO: 2841813 - RNA, 15 nt, Mycobacterium avium subsp. paratuberculosis
gaguacccgccgcac

SEQ ID NO: 2841814 - RNA, 18 nt, Mycobacterium avium subsp. paratuberculosis
gaguaccgacgagaucag

SEQ ID NO: 2841815 - RNA, 21 nt, Mycobacterium avium subsp. paratuberculosis
gaguaccgacgagaucagcac

SEQ ID NO: 2841816 - RNA, 22 nt, Mycobacterium avium subsp. paratuberculosis
gaguacucgguguagagcaccu

SEQ ID NO: 2841817 - RNA, 19 nt, Mycobacterium avium subsp. paratuberculosis
gaguagaacuucgccagcg

SEQ ID NO: 2841818 - RNA, 20 nt, Mycobacterium avium subsp. paratuberculosis
gaguagaccuuguccggcgu

SEQ ID NO: 2841819 - RNA, 21 nt, Mycobacterium avium subsp. paratuberculosis
gaguagaccuuguccggcguc

SEQ ID NO: 2841820 - RNA, 22 nt, Mycobacterium avium subsp. paratuberculosis
gaguaggcgccgccgcgcaggc

SEQ ID NO: 2841821 - RNA, 16 nt, Mycobacterium avium subsp. paratuberculosis
gagucaagccggcaug

SEQ ID NO: 2841822 - RNA, 18 nt, Mycobacterium avium subsp. paratuberculosis
gagucacccggcuggccg

SEQ ID NO: 2841823 - RNA, 19 nt, Mycobacterium avium subsp. paratuberculosis
gagucacccggcuggccgc

SEQ ID NO: 2841824 - RNA, 20 nt, Mycobacterium avium subsp. paratuberculosis
gagucacccggcuggccgca

SEQ ID NO: 2841825 - RNA, 14 nt, Mycobacterium avium subsp. paratuberculosis
gagucaucgccacc

SEQ ID NO: 2841826 - RNA, 22 nt, Mycobacterium avium subsp. paratuberculosis
gagucauucugaauucggccac

SEQ ID NO: 2841827 - RNA, 23 nt, Mycobacterium avium subsp. paratuberculosis
gagucauucugaauucggccacc

SEQ ID NO: 2841828 - RNA, 16 nt, Mycobacterium avium subsp. paratuberculosis
gaguccaccggcggau

SEQ ID NO: 2841829 - RNA, 22 nt, Mycobacterium avium subsp. paratuberculosis
gaguccacgacguccucgacga

SEQ ID NO: 2841830 - RNA, 14 nt, Mycobacterium avium subsp. paratuberculosis
gaguccacgccgug

SEQ ID NO: 2841831 - RNA, 13 nt, Mycobacterium avium subsp. paratuberculosis
gaguccagcacgc

SEQ ID NO: 2841832 - RNA, 15 nt, Mycobacterium avium subsp. paratuberculosis
gaguccagcacgccc

SEQ ID NO: 2841833 - RNA, 21 nt, Mycobacterium avium subsp. paratuberculosis
gaguccagccagccgcgccgc

SEQ ID NO: 2841834 - RNA, 14 nt, Mycobacterium avium subsp. paratuberculosis
gagucccgcgcggc

SEQ ID NO: 2841835 - RNA, 14 nt, Mycobacterium avium subsp. paratuberculosis
gagucccucggcga

SEQ ID NO: 2841836 - RNA, 18 nt, Mycobacterium avium subsp. paratuberculosis
gaguccggcucggugccg

SEQ ID NO: 2841837 - RNA, 18 nt, Mycobacterium avium subsp. paratuberculosis
gaguccgggccgccggcc

SEQ ID NO: 2841838 - RNA, 22 nt, Mycobacterium avium subsp. paratuberculosis
gaguccgggccgccggccgcgg

SEQ ID NO: 2841839 - RNA, 16 nt, Mycobacterium avium subsp. paratuberculosis
gaguccucgcgguugc

SEQ ID NO: 2841840 - RNA, 15 nt, Mycobacterium avium subsp. paratuberculosis
gaguccuugaccuug

SEQ ID NO: 2841841 - RNA, 19 nt, Mycobacterium avium subsp. paratuberculosis
gagucgaagcggugcacca

SEQ ID NO: 2841842 - RNA, 20 nt, Mycobacterium avium subsp. paratuberculosis
gagucgacgcugugcgccuu

SEQ ID NO: 2841843 - RNA, 15 nt, Mycobacterium avium subsp. paratuberculosis
gagucgagcaccgcg

SEQ ID NO: 2841844 - RNA, 18 nt, Mycobacterium avium subsp. paratuberculosis
gagucgagcaccgcgacc

SEQ ID NO: 2841845 - RNA, 22 nt, Mycobacterium avium subsp. paratuberculosis
gagucgagcaccgcgaccacgc

SEQ ID NO: 2841846 - RNA, 23 nt, Mycobacterium avium subsp. paratuberculosis
gagucgagcaccgcgaccacgcc

SEQ ID NO: 2841847 - RNA, 22 nt, Mycobacterium avium subsp. paratuberculosis
gagucgagguugaugccgacgu

SEQ ID NO: 2841848 - RNA, 13 nt, Mycobacterium avium subsp. paratuberculosis
gagucgaucgcca

SEQ ID NO: 2841849 - RNA, 17 nt, Mycobacterium avium subsp. paratuberculosis
gagucgaucgccagcgc

SEQ ID NO: 2841850 - RNA, 18 nt, Mycobacterium avium subsp. paratuberculosis
gagucgaucgccagcgcg

SEQ ID NO: 2841851 - RNA, 14 nt, Mycobacterium avium subsp. paratuberculosis
gagucgcgcgacca

SEQ ID NO: 2841852 - RNA, 18 nt, Mycobacterium avium subsp. paratuberculosis
gagucgcuguuggcgacg

SEQ ID NO: 2841853 - RNA, 22 nt, Mycobacterium avium subsp. paratuberculosis
gagucggccaccgcggucgacg

SEQ ID NO: 2841854 - RNA, 14 nt, Mycobacterium avium subsp. paratuberculosis
gagucggcgucgga

SEQ ID NO: 2841855 - RNA, 19 nt, Mycobacterium avium subsp. paratuberculosis
gagucggcgucggagaugc

SEQ ID NO: 2841856 - RNA, 21 nt, Mycobacterium avium subsp. paratuberculosis
gagucgggaaaucggacccag

SEQ ID NO: 2841857 - RNA, 21 nt, Mycobacterium avium subsp. paratuberculosis
gagucgggcaaucggacccag

SEQ ID NO: 2841858 - RNA, 19 nt, Mycobacterium avium subsp. paratuberculosis
gagucggggugcucgaucg

SEQ ID NO: 2841859 - RNA, 16 nt, Mycobacterium avium subsp. paratuberculosis
gagucggugaccaccu

SEQ ID NO: 2841860 - RNA, 21 nt, Mycobacterium avium subsp. paratuberculosis
gagucggugaccaccugcacc

SEQ ID NO: 2841861 - RNA, 20 nt, Mycobacterium avium subsp. paratuberculosis
gagucgguuucgaccugcgg

SEQ ID NO: 2841862 - RNA, 22 nt, Mycobacterium avium subsp. paratuberculosis
gagucgguuucgaccugcgggu

SEQ ID NO: 2841863 - RNA, 14 nt, Mycobacterium avium subsp. paratuberculosis
gauaggcggccagc

SEQ ID NO: 2841864 - RNA, 14 nt, Mycobacterium avium subsp. paratuberculosis
gauagggccggccg

SEQ ID NO: 2841865 - RNA, 17 nt, Mycobacterium avium subsp. paratuberculosis
gauagggcgcgucgauc

SEQ ID NO: 2841866 - RNA, 13 nt, Mycobacterium avium subsp. paratuberculosis
gauagggcgugau

SEQ ID NO: 2841867 - RNA, 13 nt, Mycobacterium avium subsp. paratuberculosis
gauaggucacgcc

SEQ ID NO: 2841868 - RNA, 15 nt, Mycobacterium avium subsp. paratuberculosis
gauaggucagcucga

SEQ ID NO: 2841869 - RNA, 18 nt, Mycobacterium avium subsp. paratuberculosis
gauagguggucucccaga

SEQ ID NO: 2841870 - RNA, 18 nt, Mycobacterium avium subsp. paratuberculosis
gauagugaacgccucggg

SEQ ID NO: 2841871 - RNA, 14 nt, Mycobacterium avium subsp. paratuberculosis
gauaguucgccgcc

SEQ ID NO: 2841872 - RNA, 19 nt, Mycobacterium avium subsp. paratuberculosis
gauaguucgccgccgccag

SEQ ID NO: 2841873 - RNA, 14 nt, Mycobacterium avium subsp. paratuberculosis
gauauccagccuug

SEQ ID NO: 2841874 - RNA, 15 nt, Mycobacterium avium subsp. paratuberculosis
gauauccagccuugc

SEQ ID NO: 2841875 - RNA, 21 nt, Mycobacterium avium subsp. paratuberculosis
gauaucggccgcggggccggc

SEQ ID NO: 2841876 - RNA, 22 nt, Mycobacterium avium subsp. paratuberculosis
gauaugcgccugcacggugccg

SEQ ID NO: 2841877 - RNA, 20 nt, Mycobacterium avium subsp. paratuberculosis
gauaugcugcaacggcuggc

SEQ ID NO: 2841878 - RNA, 22 nt, Mycobacterium avium subsp. paratuberculosis
gauaugcugcaacggcuggcgc

SEQ ID NO: 2841879 - RNA, 21 nt, Mycobacterium avium subsp. paratuberculosis
gauauugaucgagagcuucau

SEQ ID NO: 2841880 - RNA, 13 nt, Mycobacterium avium subsp. paratuberculosis
gaucaaagccggu

SEQ ID NO: 2841881 - RNA, 23 nt, Mycobacterium avium subsp. paratuberculosis
gaucaacaccaacgacagcgacg

SEQ ID NO: 2841882 - RNA, 16 nt, Mycobacterium avium subsp. paratuberculosis
gaucaacaccgccagc

SEQ ID NO: 2841883 - RNA, 17 nt, Mycobacterium avium subsp. paratuberculosis
gaucaacaccgccagca

SEQ ID NO: 2841884 - RNA, 18 nt, Mycobacterium avium subsp. paratuberculosis
gaucaacaccgccagcac

SEQ ID NO: 2841885 - RNA, 21 nt, Mycobacterium avium subsp. paratuberculosis
gaucaacaccgccagcaccgc

SEQ ID NO: 2841886 - RNA, 22 nt, Mycobacterium avium subsp. paratuberculosis
gaucaacaccgccagcaccgcc

SEQ ID NO: 2841887 - RNA, 14 nt, Mycobacterium avium subsp. paratuberculosis
gaucaacagccgcc

SEQ ID NO: 2841888 - RNA, 18 nt, Mycobacterium avium subsp. paratuberculosis
gaucaacaggcccagcag

SEQ ID NO: 2841889 - RNA, 14 nt, Mycobacterium avium subsp. paratuberculosis
gaucaaccacacca

SEQ ID NO: 2841890 - RNA, 17 nt, Mycobacterium avium subsp. paratuberculosis
gaucaaccacaccagca

SEQ ID NO: 2841891 - RNA, 21 nt, Mycobacterium avium subsp. paratuberculosis
gaucaacgccgggucgacgcc

SEQ ID NO: 2841892 - RNA, 18 nt, Mycobacterium avium subsp. paratuberculosis
gaucaacugaucgagcuc

SEQ ID NO: 2841893 - RNA, 15 nt, Mycobacterium avium subsp. paratuberculosis
gaucaaggaaccggc

SEQ ID NO: 2841894 - RNA, 14 nt, Mycobacterium avium subsp. paratuberculosis
gaucacacccacga

SEQ ID NO: 2841895 - RNA, 18 nt, Mycobacterium avium subsp. paratuberculosis
gaucacaccgucggcgau

SEQ ID NO: 2841896 - RNA, 16 nt, Mycobacterium avium subsp. paratuberculosis
gaucaccaccaccgcc

SEQ ID NO: 2841897 - RNA, 21 nt, Mycobacterium avium subsp. paratuberculosis
gaucaccaccccggugccgca

SEQ ID NO: 2841898 - RNA, 21 nt, Mycobacterium avium subsp. paratuberculosis
gaucaccaccugguccugccc

SEQ ID NO: 2841899 - RNA, 17 nt, Mycobacterium avium subsp. paratuberculosis
gaucaccacggucaggg

SEQ ID NO: 2841900 - RNA, 15 nt, Mycobacterium avium subsp. paratuberculosis
gaucaccaggcccag

SEQ ID NO: 2841901 - RNA, 20 nt, Mycobacterium avium subsp. paratuberculosis
gaucaccaggcccaggccga

SEQ ID NO: 2841902 - RNA, 16 nt, Mycobacterium avium subsp. paratuberculosis
gaucaccaugaucagc

SEQ ID NO: 2841903 - RNA, 20 nt, Mycobacterium avium subsp. paratuberculosis
gaucaccaugaucagcgccg

SEQ ID NO: 2841904 - RNA, 13 nt, Mycobacterium avium subsp. paratuberculosis
gaucacccagccg

SEQ ID NO: 2841905 - RNA, 15 nt, Mycobacterium avium subsp. paratuberculosis
gaucacccccgacac

SEQ ID NO: 2841906 - RNA, 15 nt, Mycobacterium avium subsp. paratuberculosis
gaucaccccuggcgg

SEQ ID NO: 2841907 - RNA, 17 nt, Mycobacterium avium subsp. paratuberculosis
gaucacccgccgggugg

SEQ ID NO: 2841908 - RNA, 23 nt, Mycobacterium avium subsp. paratuberculosis
gaucacccgccggguggccgcca

SEQ ID NO: 2841909 - RNA, 22 nt, Mycobacterium avium subsp. paratuberculosis
gaucacccgggucgagcggccc

SEQ ID NO: 2841910 - RNA, 16 nt, Mycobacterium avium subsp. paratuberculosis
gaucacccucggcguc

SEQ ID NO: 2841911 - RNA, 18 nt, Mycobacterium avium subsp. paratuberculosis
gaucacccucggcguccc

SEQ ID NO: 2841912 - RNA, 15 nt, Mycobacterium avium subsp. paratuberculosis
gaucaccgccagcgc

SEQ ID NO: 2841913 - RNA, 17 nt, Mycobacterium avium subsp. paratuberculosis
gaucaccgccagcgcgc

SEQ ID NO: 2841914 - RNA, 20 nt, Mycobacterium avium subsp. paratuberculosis
gaucaccgccagcgcgccga

SEQ ID NO: 2841915 - RNA, 14 nt, Mycobacterium avium subsp. paratuberculosis
gaucaccgccgcgg

SEQ ID NO: 2841916 - RNA, 13 nt, Mycobacterium avium subsp. paratuberculosis
gaucaccgcgcuc

SEQ ID NO: 2841917 - RNA, 16 nt, Mycobacterium avium subsp. paratuberculosis
gaucaccgcgcucggc

SEQ ID NO: 2841918 - RNA, 18 nt, Mycobacterium avium subsp. paratuberculosis
gaucaccgcgcucggcga

SEQ ID NO: 2841919 - RNA, 13 nt, Mycobacterium avium subsp. paratuberculosis
gaucaccgcggcc

SEQ ID NO: 2841920 - RNA, 14 nt, Mycobacterium avium subsp. paratuberculosis
gaucaccgcggcca

SEQ ID NO: 2841921 - RNA, 23 nt, Mycobacterium avium subsp. paratuberculosis
gaucaccgcggccaccugggcgg

SEQ ID NO: 2841922 - RNA, 23 nt, Mycobacterium avium subsp. paratuberculosis
gaucaccgcggcgagcgcuucgg

SEQ ID NO: 2841923 - RNA, 20 nt, Mycobacterium avium subsp. paratuberculosis
gaucaccgcguagcgccgcc

SEQ ID NO: 2841924 - RNA, 15 nt, Mycobacterium avium subsp. paratuberculosis
gaucaccgcgucggc

SEQ ID NO: 2841925 - RNA, 21 nt, Mycobacterium avium subsp. paratuberculosis
gaucaccgcguucucggcgga

SEQ ID NO: 2841926 - RNA, 19 nt, Mycobacterium avium subsp. paratuberculosis
gaucaccgcguugucggcg

SEQ ID NO: 2841927 - RNA, 16 nt, Mycobacterium avium subsp. paratuberculosis
gaucaccgcugccacg

SEQ ID NO: 2841928 - RNA, 18 nt, Mycobacterium avium subsp. paratuberculosis
gaucaccggcagcagcgc

SEQ ID NO: 2841929 - RNA, 22 nt, Mycobacterium avium subsp. paratuberculosis
gaucaccggcgcguuggcccgu

SEQ ID NO: 2841930 - RNA, 22 nt, Mycobacterium avium subsp. paratuberculosis
gaucaccgggacaccgcuggcc

SEQ ID NO: 2841931 - RNA, 19 nt, Mycobacterium avium subsp. paratuberculosis
gaucaccgggacgggggug

SEQ ID NO: 2841932 - RNA, 15 nt, Mycobacterium avium subsp. paratuberculosis
gaucaccgggcggcc

SEQ ID NO: 2841933 - RNA, 16 nt, Mycobacterium avium subsp. paratuberculosis
gaucaccgggcggccg

SEQ ID NO: 2841934 - RNA, 23 nt, Mycobacterium avium subsp. paratuberculosis
gaucaccgugaguucgcugaccg

SEQ ID NO: 2841935 - RNA, 19 nt, Mycobacterium avium subsp. paratuberculosis
gaucaccgugaucgccacc

SEQ ID NO: 2841936 - RNA, 20 nt, Mycobacterium avium subsp. paratuberculosis
gaucaccgugaucgccacca

SEQ ID NO: 2841937 - RNA, 23 nt, Mycobacterium avium subsp. paratuberculosis
gaucaccgugaucgccaccacca

SEQ ID NO: 2841938 - RNA, 22 nt, Mycobacterium avium subsp. paratuberculosis
gaucaccucgaccgugaggccc

SEQ ID NO: 2841939 - RNA, 20 nt, Mycobacterium avium subsp. paratuberculosis
gaucaccucgauggccggga

SEQ ID NO: 2841940 - RNA, 14 nt, Mycobacterium avium subsp. paratuberculosis
gaucaccucgccgg

SEQ ID NO: 2841941 - RNA, 19 nt, Mycobacterium avium subsp. paratuberculosis
gaucaccucgcugacgucg

SEQ ID NO: 2841942 - RNA, 13 nt, Mycobacterium avium subsp. paratuberculosis
gaucaccucggug

SEQ ID NO: 2841943 - RNA, 17 nt, Mycobacterium avium subsp. paratuberculosis
gaucaccuggugcucgc

SEQ ID NO: 2841944 - RNA, 23 nt, Mycobacterium avium subsp. paratuberculosis
gaucaccuggugcucgcgcucgu

SEQ ID NO: 2841945 - RNA, 16 nt, Mycobacterium avium subsp. paratuberculosis
gaucaccuugcggccg

SEQ ID NO: 2841946 - RNA, 17 nt, Mycobacterium avium subsp. paratuberculosis
gaucacgaacagguccg

SEQ ID NO: 2841947 - RNA, 19 nt, Mycobacterium avium subsp. paratuberculosis
gaucagcucuucgauggcc

SEQ ID NO: 2841948 - RNA, 15 nt, Mycobacterium avium subsp. paratuberculosis
gaucagcugcccgga

SEQ ID NO: 2841949 - RNA, 19 nt, Mycobacterium avium subsp. paratuberculosis
gaucagcugcucggccacc

SEQ ID NO: 2841950 - RNA, 22 nt, Mycobacterium avium subsp. paratuberculosis
gaucagcugcucggccaccgcg

SEQ ID NO: 2841951 - RNA, 23 nt, Mycobacterium avium subsp. paratuberculosis
gaucagcugcucggccaccgcgc

SEQ ID NO: 2841952 - RNA, 17 nt, Mycobacterium avium subsp. paratuberculosis
gaucaggaucggcgggc

SEQ ID NO: 2841953 - RNA, 18 nt, Mycobacterium avium subsp. paratuberculosis
gaucaggaucggcgggcg

SEQ ID NO: 2841954 - RNA, 14 nt, Mycobacterium avium subsp. paratuberculosis
gaucaggaugacgc

SEQ ID NO: 2841955 - RNA, 17 nt, Mycobacterium avium subsp. paratuberculosis
gaucaggaugacgccgc

SEQ ID NO: 2841956 - RNA, 18 nt, Mycobacterium avium subsp. paratuberculosis
gaucaggaugacgccgcg

SEQ ID NO: 2841957 - RNA, 15 nt, Mycobacterium avium subsp. paratuberculosis
gaucaggccccaccc

SEQ ID NO: 2841958 - RNA, 16 nt, Mycobacterium avium subsp. paratuberculosis
gaucaggccccacccg

SEQ ID NO: 2841959 - RNA, 18 nt, Mycobacterium avium subsp. paratuberculosis
gaucaggcccucgucggc

SEQ ID NO: 2841960 - RNA, 13 nt, Mycobacterium avium subsp. paratuberculosis
gaucaggccggcc

SEQ ID NO: 2841961 - RNA, 14 nt, Mycobacterium avium subsp. paratuberculosis
gaucaggcgcagcc

SEQ ID NO: 2841962 - RNA, 13 nt, Mycobacterium avium subsp. paratuberculosis
gaucaggcugccg

SEQ ID NO: 2841963 - RNA, 14 nt, Mycobacterium avium subsp. paratuberculosis
gaucaggcugccgc

SEQ ID NO: 2841964 - RNA, 22 nt, Mycobacterium avium subsp. paratuberculosis
gaucaggcugccgcugcgccgg

SEQ ID NO: 2841965 - RNA, 21 nt, Mycobacterium avium subsp. paratuberculosis
gaucaggcuggacaccacguc

SEQ ID NO: 2841966 - RNA, 14 nt, Mycobacterium avium subsp. paratuberculosis
gaucagggcccaca

SEQ ID NO: 2841967 - RNA, 23 nt, Mycobacterium avium subsp. paratuberculosis
gaucagggcccacagcagccgca

SEQ ID NO: 2841968 - RNA, 16 nt, Mycobacterium avium subsp. paratuberculosis
gaucagggccgcggcc

SEQ ID NO: 2841969 - RNA, 18 nt, Mycobacterium avium subsp. paratuberculosis
gaucagggccgcggccgc

SEQ ID NO: 2841970 - RNA, 18 nt, Mycobacterium avium subsp. paratuberculosis
gaucagggcggcgccgcg

SEQ ID NO: 2841971 - RNA, 23 nt, Mycobacterium avium subsp. paratuberculosis
gaucagggcggcgccgcggcccu

SEQ ID NO: 2841972 - RNA, 15 nt, Mycobacterium avium subsp. paratuberculosis
gaucagggcggcgcg

SEQ ID NO: 2841973 - RNA, 22 nt, Mycobacterium avium subsp. paratuberculosis
gaucagggugcucagccgcacg

SEQ ID NO: 2841974 - RNA, 22 nt, Mycobacterium avium subsp. paratuberculosis
gaucagguauugcgaaccucga

SEQ ID NO: 2841975 - RNA, 14 nt, Mycobacterium avium subsp. paratuberculosis
gaucagguccuugc

SEQ ID NO: 2841976 - RNA, 22 nt, Mycobacterium avium subsp. paratuberculosis
gaucagguccuugcgcgccgcg

SEQ ID NO: 2841977 - RNA, 16 nt, Mycobacterium avium subsp. paratuberculosis
gaucaggugcagcgug

SEQ ID NO: 2841978 - RNA, 14 nt, Mycobacterium avium subsp. paratuberculosis
gaucagguggggca

SEQ ID NO: 2841979 - RNA, 23 nt, Mycobacterium avium subsp. paratuberculosis
gaucagucgaagaugucgcggcg

SEQ ID NO: 2841980 - RNA, 13 nt, Mycobacterium avium subsp. paratuberculosis
gaucagugccgcg

SEQ ID NO: 2841981 - RNA, 21 nt, Mycobacterium avium subsp. paratuberculosis
gaucaucaccaccgccgccga

SEQ ID NO: 2841982 - RNA, 13 nt, Mycobacterium avium subsp. paratuberculosis
gaucaucagggca

SEQ ID NO: 2841983 - RNA, 13 nt, Mycobacterium avium subsp. paratuberculosis
gaucauccaggug

SEQ ID NO: 2841984 - RNA, 16 nt, Mycobacterium avium subsp. paratuberculosis
gaucaucccggccacc

SEQ ID NO: 2841985 - RNA, 17 nt, Mycobacterium avium subsp. paratuberculosis
gaucaucccggccaccc

SEQ ID NO: 2841986 - RNA, 20 nt, Mycobacterium avium subsp. paratuberculosis
gaucaucccggccaccccgc

SEQ ID NO: 2841987 - RNA, 21 nt, Mycobacterium avium subsp. paratuberculosis
gaucaucccggccaccccgca

SEQ ID NO: 2841988 - RNA, 18 nt, Mycobacterium avium subsp. paratuberculosis
gaucaucuccacccggca

SEQ ID NO: 2841989 - RNA, 17 nt, Mycobacterium avium subsp. paratuberculosis
gaucaugaagucgcgga

SEQ ID NO: 2841990 - RNA, 20 nt, Mycobacterium avium subsp. paratuberculosis
gaucaugauccggaagccgu

SEQ ID NO: 2841991 - RNA, 23 nt, Mycobacterium avium subsp. paratuberculosis
gaucaugauccggaagccgucgg

SEQ ID NO: 2841992 - RNA, 18 nt, Mycobacterium avium subsp. paratuberculosis
gaucauggucggcgacgc

SEQ ID NO: 2841993 - RNA, 21 nt, Mycobacterium avium subsp. paratuberculosis
gaucaugucguccucccggcc

SEQ ID NO: 2841994 - RNA, 18 nt, Mycobacterium avium subsp. paratuberculosis
gauccaaccgagucgcug

SEQ ID NO: 2841995 - RNA, 16 nt, Mycobacterium avium subsp. paratuberculosis
gauccaccaucuucca

SEQ ID NO: 2841996 - RNA, 15 nt, Mycobacterium avium subsp. paratuberculosis
gauccacccaccggc

SEQ ID NO: 2841997 - RNA, 19 nt, Mycobacterium avium subsp. paratuberculosis
gauccaccgcgcggccagc

SEQ ID NO: 2841998 - RNA, 22 nt, Mycobacterium avium subsp. paratuberculosis
gauccaccgcgcggccagcggc

SEQ ID NO: 2841999 - RNA, 16 nt, Mycobacterium avium subsp. paratuberculosis
gauccacgcccggacc

SEQ ID NO: 2842000 - RNA, 17 nt, Mycobacterium avium subsp. paratuberculosis
gauccacgccuccggca

SEQ ID NO: 2842001 - RNA, 11 nt, Mycobacterium avium subsp. paratuberculosis
gauccacggcg

SEQ ID NO: 2842002 - RNA, 14 nt, Mycobacterium avium subsp. paratuberculosis
gauccacuccagca

SEQ ID NO: 2842003 - RNA, 16 nt, Mycobacterium avium subsp. paratuberculosis
gauccacuccagcacc

SEQ ID NO: 2842004 - RNA, 20 nt, Mycobacterium avium subsp. paratuberculosis
gauccacuccgaggucagcg

SEQ ID NO: 2842005 - RNA, 14 nt, Mycobacterium avium subsp. paratuberculosis
gauccagaugccgg

SEQ ID NO: 2842006 - RNA, 19 nt, Mycobacterium avium subsp. paratuberculosis
gauccagaugccggguggg

SEQ ID NO: 2842007 - RNA, 19 nt, Mycobacterium avium subsp. paratuberculosis
gauccagcccugcucggcc

SEQ ID NO: 2842008 - RNA, 20 nt, Mycobacterium avium subsp. paratuberculosis
gauccagcccugcucggcca

SEQ ID NO: 2842009 - RNA, 22 nt, Mycobacterium avium subsp. paratuberculosis
gauccagccgucguugcgggcg

SEQ ID NO: 2842010 - RNA, 18 nt, Mycobacterium avium subsp. paratuberculosis
gauccagcgcuggccggc

SEQ ID NO: 2842011 - RNA, 12 nt, Mycobacterium avium subsp. paratuberculosis
gauccagcggcg

SEQ ID NO: 2842012 - RNA, 17 nt, Mycobacterium avium subsp. paratuberculosis
gauccagcggcggccuu

SEQ ID NO: 2842013 - RNA, 19 nt, Mycobacterium avium subsp. paratuberculosis
gauccaggaacggcacccg

SEQ ID NO: 2842014 - RNA, 20 nt, Mycobacterium avium subsp. paratuberculosis
gauccaggaacggcacccgc

SEQ ID NO: 2842015 - RNA, 21 nt, Mycobacterium avium subsp. paratuberculosis
gauccaggaacggcacccgca

SEQ ID NO: 2842016 - RNA, 23 nt, Mycobacterium avium subsp. paratuberculosis
gauccaggaacggcacccgcagc

SEQ ID NO: 2842017 - RNA, 21 nt, Mycobacterium avium subsp. paratuberculosis
gaucccaggaacgcgcccggc

SEQ ID NO: 2842018 - RNA, 22 nt, Mycobacterium avium subsp. paratuberculosis
gauccccguccagcccagcgcc

SEQ ID NO: 2842019 - RNA, 21 nt, Mycobacterium avium subsp. paratuberculosis
gauccccucacuccagcggcg

SEQ ID NO: 2842020 - RNA, 23 nt, Mycobacterium avium subsp. paratuberculosis
gaucccgaaaccgucgaccaggg

SEQ ID NO: 2842021 - RNA, 19 nt, Mycobacterium avium subsp. paratuberculosis
gaucccgaacugccgcgca

SEQ ID NO: 2842022 - RNA, 20 nt, Mycobacterium avium subsp. paratuberculosis
gaucccgaggaugccgccca

SEQ ID NO: 2842023 - RNA, 17 nt, Mycobacterium avium subsp. paratuberculosis
gaucccgauccucgccu

SEQ ID NO: 2842024 - RNA, 16 nt, Mycobacterium avium subsp. paratuberculosis
gaucccgaugccgcgc

SEQ ID NO: 2842025 - RNA, 11 nt, Mycobacterium avium subsp. paratuberculosis
gaucccgccgc

SEQ ID NO: 2842026 - RNA, 13 nt, Mycobacterium avium subsp. paratuberculosis
gaucccgccggcg

SEQ ID NO: 2842027 - RNA, 15 nt, Mycobacterium avium subsp. paratuberculosis
gaucccgccggcgau

SEQ ID NO: 2842028 - RNA, 14 nt, Mycobacterium avium subsp. paratuberculosis
gaucccgccggcgg

SEQ ID NO: 2842029 - RNA, 20 nt, Mycobacterium avium subsp. paratuberculosis
gaucccggacuccucggugg

SEQ ID NO: 2842030 - RNA, 17 nt, Mycobacterium avium subsp. paratuberculosis
gaucccggccacgucga

SEQ ID NO: 2842031 - RNA, 22 nt, Mycobacterium avium subsp. paratuberculosis
gauccuggccuggucggccggc

SEQ ID NO: 2842032 - RNA, 16 nt, Mycobacterium avium subsp. paratuberculosis
gaucgaaacgccgcgc

SEQ ID NO: 2842033 - RNA, 18 nt, Mycobacterium avium subsp. paratuberculosis
gaucgaacggcaccucga

SEQ ID NO: 2842034 - RNA, 22 nt, Mycobacterium avium subsp. paratuberculosis
gaucgaacggcggaaccgggcc

SEQ ID NO: 2842035 - RNA, 21 nt, Mycobacterium avium subsp. paratuberculosis
gaucgaacuugaucaccgcgu

SEQ ID NO: 2842036 - RNA, 16 nt, Mycobacterium avium subsp. paratuberculosis
gaucgaaggcgugcuc

SEQ ID NO: 2842037 - RNA, 20 nt, Mycobacterium avium subsp. paratuberculosis
gaucgaaggcgugcucgauc

SEQ ID NO: 2842038 - RNA, 21 nt, Mycobacterium avium subsp. paratuberculosis
gaucgaauacaccugccgcac

SEQ ID NO: 2842039 - RNA, 22 nt, Mycobacterium avium subsp. paratuberculosis
gaucgaauacaccugccgcaca

SEQ ID NO: 2842040 - RNA, 17 nt, Mycobacterium avium subsp. paratuberculosis
gaucgaauccggcggcg

SEQ ID NO: 2842041 - RNA, 16 nt, Mycobacterium avium subsp. paratuberculosis
gaucgacaacgcguga

SEQ ID NO: 2842042 - RNA, 19 nt, Mycobacterium avium subsp. paratuberculosis
gaucgacaacgcgugaugc

SEQ ID NO: 2842043 - RNA, 14 nt, Mycobacterium avium subsp. paratuberculosis
gaucgacagcucca

SEQ ID NO: 2842044 - RNA, 17 nt, Mycobacterium avium subsp. paratuberculosis
gaucgacccccaccgcg

SEQ ID NO: 2842045 - RNA, 20 nt, Mycobacterium avium subsp. paratuberculosis
gaucgacccccaccgcgaca

SEQ ID NO: 2842046 - RNA, 15 nt, Mycobacterium avium subsp. paratuberculosis
gaucgacccgcuccg

SEQ ID NO: 2842047 - RNA, 14 nt, Mycobacterium avium subsp. paratuberculosis
gaucgacgacgcca

SEQ ID NO: 2842048 - RNA, 22 nt, Mycobacterium avium subsp. paratuberculosis
gaucgacgccaugggcccagca

SEQ ID NO: 2842049 - RNA, 22 nt, Mycobacterium avium subsp. paratuberculosis
gaucgacgccgacaucgcggcg

SEQ ID NO: 2842050 - RNA, 14 nt, Mycobacterium avium subsp. paratuberculosis
gaucgacgccgacc

SEQ ID NO: 2842051 - RNA, 18 nt, Mycobacterium avium subsp. paratuberculosis
gaucgacgccgaccgcgg

SEQ ID NO: 2842052 - RNA, 20 nt, Mycobacterium avium subsp. paratuberculosis
gaucgacgccgaccgcgguc

SEQ ID NO: 2842053 - RNA, 13 nt, Mycobacterium avium subsp. paratuberculosis
gaucgacgccgcg

SEQ ID NO: 2842054 - RNA, 15 nt, Mycobacterium avium subsp. paratuberculosis
gaucgacgccgcggu

SEQ ID NO: 2842055 - RNA, 18 nt, Mycobacterium avium subsp. paratuberculosis
gaucgacgccgcgguggc

SEQ ID NO: 2842056 - RNA, 20 nt, Mycobacterium avium subsp. paratuberculosis
gaucgacgccgcgguggccg

SEQ ID NO: 2842057 - RNA, 16 nt, Mycobacterium avium subsp. paratuberculosis
gaucgacgucgacuga

SEQ ID NO: 2842058 - RNA, 16 nt, Mycobacterium avium subsp. paratuberculosis
gaucgacuccgggugg

SEQ ID NO: 2842059 - RNA, 17 nt, Mycobacterium avium subsp. paratuberculosis
gaucgacuccgggugga

SEQ ID NO: 2842060 - RNA, 22 nt, Mycobacterium avium subsp. paratuberculosis
gaucgagaccaugucggccagg

SEQ ID NO: 2842061 - RNA, 16 nt, Mycobacterium avium subsp. paratuberculosis
gaucgagaucagggcg

SEQ ID NO: 2842062 - RNA, 18 nt, Mycobacterium avium subsp. paratuberculosis
gaucgagaucagggcgcg

SEQ ID NO: 2842063 - RNA, 14 nt, Mycobacterium avium subsp. paratuberculosis
gaucgagcaccggg

SEQ ID NO: 2842064 - RNA, 18 nt, Mycobacterium avium subsp. paratuberculosis
gaucgagccgcggcccgc

SEQ ID NO: 2842065 - RNA, 16 nt, Mycobacterium avium subsp. paratuberculosis
gaucgagccggccguc

SEQ ID NO: 2842066 - RNA, 17 nt, Mycobacterium avium subsp. paratuberculosis
gaucgagcgcaccgccc

SEQ ID NO: 2842067 - RNA, 23 nt, Mycobacterium avium subsp. paratuberculosis
gaucgagcucgcagucgaucagc

SEQ ID NO: 2842068 - RNA, 15 nt, Mycobacterium avium subsp. paratuberculosis
gaucgagcucggccu

SEQ ID NO: 2842069 - RNA, 13 nt, Mycobacterium avium subsp. paratuberculosis
gaucgagcugggc

SEQ ID NO: 2842070 - RNA, 16 nt, Mycobacterium avium subsp. paratuberculosis
gaucgaggacaccgcg

SEQ ID NO: 2842071 - RNA, 16 nt, Mycobacterium avium subsp. paratuberculosis
gaucgaggaucucccg

SEQ ID NO: 2842072 - RNA, 13 nt, Mycobacterium avium subsp. paratuberculosis
gaucgaggccagc

SEQ ID NO: 2842073 - RNA, 14 nt, Mycobacterium avium subsp. paratuberculosis
gaucgaggccagcg

SEQ ID NO: 2842074 - RNA, 15 nt, Mycobacterium avium subsp. paratuberculosis
gaucgaggccagcgc

SEQ ID NO: 2842075 - RNA, 17 nt, Mycobacterium avium subsp. paratuberculosis
gaucgaggccagcgcga

SEQ ID NO: 2842076 - RNA, 17 nt, Mycobacterium avium subsp. paratuberculosis
gaucgagggggucauca

SEQ ID NO: 2842077 - RNA, 22 nt, Mycobacterium avium subsp. paratuberculosis
gaucgaggugauguuggccgcg

SEQ ID NO: 2842078 - RNA, 23 nt, Mycobacterium avium subsp. paratuberculosis
gaucgaggugauguuggccgcga

SEQ ID NO: 2842079 - RNA, 15 nt, Mycobacterium avium subsp. paratuberculosis
gaucgaguccucgcg

SEQ ID NO: 2842080 - RNA, 21 nt, Mycobacterium avium subsp. paratuberculosis
gaucgaguucacccgaauucc

SEQ ID NO: 2842081 - RNA, 17 nt, Mycobacterium avium subsp. paratuberculosis
gaucgaguucagcgucg

SEQ ID NO: 2842082 - RNA, 21 nt, Mycobacterium avium subsp. paratuberculosis
gaucgaguucagcgucgaugu

SEQ ID NO: 2842083 - RNA, 19 nt, Mycobacterium avium subsp. paratuberculosis
gaucgaguuccgcgucggc

SEQ ID NO: 2842084 - RNA, 20 nt, Mycobacterium avium subsp. paratuberculosis
gaucgaguuccgcgucggcc

SEQ ID NO: 2842085 - RNA, 15 nt, Mycobacterium avium subsp. paratuberculosis
gaucgaucagccgcg

SEQ ID NO: 2842086 - RNA, 13 nt, Mycobacterium avium subsp. paratuberculosis
gaucgaucaucgc

SEQ ID NO: 2842087 - RNA, 19 nt, Mycobacterium avium subsp. paratuberculosis
gaucgaucccuuggcggcg

SEQ ID NO: 2842088 - RNA, 21 nt, Mycobacterium avium subsp. paratuberculosis
gaucgaucccuuggcggcggc

SEQ ID NO: 2842089 - RNA, 18 nt, Mycobacterium avium subsp. paratuberculosis
gaucgaugaauccgcgca

SEQ ID NO: 2842090 - RNA, 21 nt, Mycobacterium avium subsp. paratuberculosis
gaucgaugaauccgcgcagca

SEQ ID NO: 2842091 - RNA, 17 nt, Mycobacterium avium subsp. paratuberculosis
gaucgaugcccagcgcg

SEQ ID NO: 2842092 - RNA, 22 nt, Mycobacterium avium subsp. paratuberculosis
gaucgaugcccagcgcgcggug

SEQ ID NO: 2842093 - RNA, 21 nt, Mycobacterium avium subsp. paratuberculosis
gaucgauggggauggugcgcc

SEQ ID NO: 2842094 - RNA, 18 nt, Mycobacterium avium subsp. paratuberculosis
gaucgcaaaccgcgucuu

SEQ ID NO: 2842095 - RNA, 14 nt, Mycobacterium avium subsp. paratuberculosis
gaucgcagcgguga

SEQ ID NO: 2842096 - RNA, 19 nt, Mycobacterium avium subsp. paratuberculosis
gaucgcaggauggccugca

SEQ ID NO: 2842097 - RNA, 22 nt, Mycobacterium avium subsp. paratuberculosis
gaucgcaggauggccugcacgg

SEQ ID NO: 2842098 - RNA, 21 nt, Mycobacterium avium subsp. paratuberculosis
gaucgccaacgcgcucaagau

SEQ ID NO: 2842099 - RNA, 20 nt, Mycobacterium avium subsp. paratuberculosis
gaucgccaacucgcugcgau

SEQ ID NO: 2842100 - RNA, 20 nt, Mycobacterium avium subsp. paratuberculosis
gaucgccacggcggugucgg

SEQ ID NO: 2842101 - RNA, 16 nt, Mycobacterium avium subsp. paratuberculosis
gaucgccagcaccggc

SEQ ID NO: 2842102 - RNA, 18 nt, Mycobacterium avium subsp. paratuberculosis
gaucgccagcaccggcgc

SEQ ID NO: 2842103 - RNA, 22 nt, Mycobacterium avium subsp. paratuberculosis
gaucgccagcaccggcgcgccg

SEQ ID NO: 2842104 - RNA, 13 nt, Mycobacterium avium subsp. paratuberculosis
gaucgccagcacg

SEQ ID NO: 2842105 - RNA, 22 nt, Mycobacterium avium subsp. paratuberculosis
gaucgccagcccggcguacagc

SEQ ID NO: 2842106 - RNA, 14 nt, Mycobacterium avium subsp. paratuberculosis
gaucgccagcgccc

SEQ ID NO: 2842107 - RNA, 17 nt, Mycobacterium avium subsp. paratuberculosis
gaucgccagcgccccca

SEQ ID NO: 2842108 - RNA, 18 nt, Mycobacterium avium subsp. paratuberculosis
gaucgccagcgcccccag

SEQ ID NO: 2842109 - RNA, 17 nt, Mycobacterium avium subsp. paratuberculosis
gaucgccagcgcccgau

SEQ ID NO: 2842110 - RNA, 13 nt, Mycobacterium avium subsp. paratuberculosis
gaucgccagcgcg

SEQ ID NO: 2842111 - RNA, 15 nt, Mycobacterium avium subsp. paratuberculosis
gaucgccagcgcggu

SEQ ID NO: 2842112 - RNA, 17 nt, Mycobacterium avium subsp. paratuberculosis
gaucgccagcgcggugu

SEQ ID NO: 2842113 - RNA, 22 nt, Mycobacterium avium subsp. paratuberculosis
gaucgccaggcguugcaccgcg

SEQ ID NO: 2842114 - RNA, 19 nt, Mycobacterium avium subsp. paratuberculosis
gaucgccaguccggcgccg

SEQ ID NO: 2842115 - RNA, 22 nt, Mycobacterium avium subsp. paratuberculosis
gaucgcgccuugggccaucccg

SEQ ID NO: 2842116 - RNA, 17 nt, Mycobacterium avium subsp. paratuberculosis
gaucgcgcugaccaggc

SEQ ID NO: 2842117 - RNA, 14 nt, Mycobacterium avium subsp. paratuberculosis
gaucgcggccacca

SEQ ID NO: 2842118 - RNA, 14 nt, Mycobacterium avium subsp. paratuberculosis
gaucgcggccagcg

SEQ ID NO: 2842119 - RNA, 20 nt, Mycobacterium avium subsp. paratuberculosis
gaucgcggccagcgugaaca

SEQ ID NO: 2842120 - RNA, 17 nt, Mycobacterium avium subsp. paratuberculosis
gaucgcggcccacccgc

SEQ ID NO: 2842121 - RNA, 19 nt, Mycobacterium avium subsp. paratuberculosis
gaucgcggcccccugaucg

SEQ ID NO: 2842122 - RNA, 20 nt, Mycobacterium avium subsp. paratuberculosis
gaucgcggcccccugaucgg

SEQ ID NO: 2842123 - RNA, 21 nt, Mycobacterium avium subsp. paratuberculosis
gaucgcggcccccugaucggc

SEQ ID NO: 2842124 - RNA, 23 nt, Mycobacterium avium subsp. paratuberculosis
gaucgcggcccccugaucggccg

SEQ ID NO: 2842125 - RNA, 12 nt, Mycobacterium avium subsp. paratuberculosis
gaucgcggcccg

SEQ ID NO: 2842126 - RNA, 13 nt, Mycobacterium avium subsp. paratuberculosis
gaucgcggcccgc

SEQ ID NO: 2842127 - RNA, 14 nt, Mycobacterium avium subsp. paratuberculosis
gaucgcggcccgcc

SEQ ID NO: 2842128 - RNA, 16 nt, Mycobacterium avium subsp. paratuberculosis
gaucgcggcccgccgc

SEQ ID NO: 2842129 - RNA, 15 nt, Mycobacterium avium subsp. paratuberculosis
gaucgcggcccgcgg

SEQ ID NO: 2842130 - RNA, 22 nt, Mycobacterium avium subsp. paratuberculosis
gaucgcggcccgcggggcguac

SEQ ID NO: 2842131 - RNA, 14 nt, Mycobacterium avium subsp. paratuberculosis
gaucgcggccggcg

SEQ ID NO: 2842132 - RNA, 16 nt, Mycobacterium avium subsp. paratuberculosis
gaucgcggccggcgag

SEQ ID NO: 2842133 - RNA, 23 nt, Mycobacterium avium subsp. paratuberculosis
gaucgcggccggcgagucgcgga

SEQ ID NO: 2842134 - RNA, 18 nt, Mycobacterium avium subsp. paratuberculosis
gaucgcggcgaucagccc

SEQ ID NO: 2842135 - RNA, 22 nt, Mycobacterium avium subsp. paratuberculosis
gaucgcggcgaucagcccggcc

SEQ ID NO: 2842136 - RNA, 15 nt, Mycobacterium avium subsp. paratuberculosis
gaucgcggcgaugga

SEQ ID NO: 2842137 - RNA, 18 nt, Mycobacterium avium subsp. paratuberculosis
gaucgcggcgcugccgcc

SEQ ID NO: 2842138 - RNA, 21 nt, Mycobacterium avium subsp. paratuberculosis
gaucgcggcgcugccgccggc

SEQ ID NO: 2842139 - RNA, 12 nt, Mycobacterium avium subsp. paratuberculosis
gaucgcggcggc

SEQ ID NO: 2842140 - RNA, 12 nt, Mycobacterium avium subsp. paratuberculosis
gaucgcggcggu

SEQ ID NO: 2842141 - RNA, 13 nt, Mycobacterium avium subsp. paratuberculosis
gaucgcggcgguc

SEQ ID NO: 2842142 - RNA, 20 nt, Mycobacterium avium subsp. paratuberculosis
gaucgcgggcgacccgcugg

SEQ ID NO: 2842143 - RNA, 17 nt, Mycobacterium avium subsp. paratuberculosis
gaucgcgggcugcggcg

SEQ ID NO: 2842144 - RNA, 19 nt, Mycobacterium avium subsp. paratuberculosis
gaucgcgggcugcggcgag

SEQ ID NO: 2842145 - RNA, 14 nt, Mycobacterium avium subsp. paratuberculosis
gaucgcggucaccu

SEQ ID NO: 2842146 - RNA, 16 nt, Mycobacterium avium subsp. paratuberculosis
gaucgcgguccaggau

SEQ ID NO: 2842147 - RNA, 20 nt, Mycobacterium avium subsp. paratuberculosis
gaucgcggugaccgccgcca

SEQ ID NO: 2842148 - RNA, 20 nt, Mycobacterium avium subsp. paratuberculosis
gaucgcggugacgcgccggc

SEQ ID NO: 2842149 - RNA, 21 nt, Mycobacterium avium subsp. paratuberculosis
gaucgcggugacgcgccggcc

SEQ ID NO: 2842150 - RNA, 12 nt, Mycobacterium avium subsp. paratuberculosis
gaucgcgguggc

SEQ ID NO: 2842151 - RNA, 18 nt, Mycobacterium avium subsp. paratuberculosis
gaucgcgguggcgcccgc

SEQ ID NO: 2842152 - RNA, 23 nt, Mycobacterium avium subsp. paratuberculosis
gaucgcgguggcgcccgcggugg

SEQ ID NO: 2842153 - RNA, 22 nt, Mycobacterium avium subsp. paratuberculosis
gaucgcgguggcuuccagcccg

SEQ ID NO: 2842154 - RNA, 19 nt, Mycobacterium avium subsp. paratuberculosis
gaucgcgucaaccaccggc

SEQ ID NO: 2842155 - RNA, 12 nt, Mycobacterium avium subsp. paratuberculosis
gaucgcgucgac

SEQ ID NO: 2842156 - RNA, 14 nt, Mycobacterium avium subsp. paratuberculosis
gaucgcgucgacga

SEQ ID NO: 2842157 - RNA, 16 nt, Mycobacterium avium subsp. paratuberculosis
gaucgcgucgacgaug

SEQ ID NO: 2842158 - RNA, 16 nt, Mycobacterium avium subsp. paratuberculosis
gaucgcgucgacggcg

SEQ ID NO: 2842159 - RNA, 18 nt, Mycobacterium avium subsp. paratuberculosis
gaucgcgucgacggcgcc

SEQ ID NO: 2842160 - RNA, 18 nt, Mycobacterium avium subsp. paratuberculosis
gaucgcgucgaugccggc

SEQ ID NO: 2842161 - RNA, 15 nt, Mycobacterium avium subsp. paratuberculosis
gaucgcguucugcac

SEQ ID NO: 2842162 - RNA, 20 nt, Mycobacterium avium subsp. paratuberculosis
gaucgcguucugcaccagcu

SEQ ID NO: 2842163 - RNA, 22 nt, Mycobacterium avium subsp. paratuberculosis
gaucgcguucugcaccagcucg

SEQ ID NO: 2842164 - RNA, 23 nt, Mycobacterium avium subsp. paratuberculosis
gaucgcguucugcaccagcucgg

SEQ ID NO: 2842165 - RNA, 14 nt, Mycobacterium avium subsp. paratuberculosis
gaucgcugacgccg

SEQ ID NO: 2842166 - RNA, 16 nt, Mycobacterium avium subsp. paratuberculosis
gaucgcuucggccagc

SEQ ID NO: 2842167 - RNA, 17 nt, Mycobacterium avium subsp. paratuberculosis
gaucgcuucggccagcg

SEQ ID NO: 2842168 - RNA, 20 nt, Mycobacterium avium subsp. paratuberculosis
gaucgcuucggccagcgcgu

SEQ ID NO: 2842169 - RNA, 15 nt, Mycobacterium avium subsp. paratuberculosis
gaucggaccgcacca

SEQ ID NO: 2842170 - RNA, 17 nt, Mycobacterium avium subsp. paratuberculosis
gaucggaccgcaccacc

SEQ ID NO: 2842171 - RNA, 17 nt, Mycobacterium avium subsp. paratuberculosis
gaucggauccgccugcc

SEQ ID NO: 2842172 - RNA, 20 nt, Mycobacterium avium subsp. paratuberculosis
gaucggauccgccugcccuu

SEQ ID NO: 2842173 - RNA, 15 nt, Mycobacterium avium subsp. paratuberculosis
gaucggcacgucgag

SEQ ID NO: 2842174 - RNA, 23 nt, Mycobacterium avium subsp. paratuberculosis
gaucggcagcgccaacauggcgc

SEQ ID NO: 2842175 - RNA, 14 nt, Mycobacterium avium subsp. paratuberculosis
gaucggcagcgcgc

SEQ ID NO: 2842176 - RNA, 15 nt, Mycobacterium avium subsp. paratuberculosis
gaucggcagcgcgcc

SEQ ID NO: 2842177 - RNA, 19 nt, Mycobacterium avium subsp. paratuberculosis
gaucggcaggauccggucg

SEQ ID NO: 2842178 - RNA, 18 nt, Mycobacterium avium subsp. paratuberculosis
gaucggcaggucgucgac

SEQ ID NO: 2842179 - RNA, 22 nt, Mycobacterium avium subsp. paratuberculosis
gaucggcaggucgucgacgucg

SEQ ID NO: 2842180 - RNA, 17 nt, Mycobacterium avium subsp. paratuberculosis
gaucggcaugacgccca

SEQ ID NO: 2842181 - RNA, 13 nt, Mycobacterium avium subsp. paratuberculosis
gaucggccagcag

SEQ ID NO: 2842182 - RNA, 15 nt, Mycobacterium avium subsp. paratuberculosis
gaucggccagccacg

SEQ ID NO: 2842183 - RNA, 12 nt, Mycobacterium avium subsp. paratuberculosis
gaucggccagcg

SEQ ID NO: 2842184 - RNA, 13 nt, Mycobacterium avium subsp. paratuberculosis
gaucggccagcgc

SEQ ID NO: 2842185 - RNA, 14 nt, Mycobacterium avium subsp. paratuberculosis
gaucggccagcgcg

SEQ ID NO: 2842186 - RNA, 15 nt, Mycobacterium avium subsp. paratuberculosis
gaucggccagcgcgg

SEQ ID NO: 2842187 - RNA, 17 nt, Mycobacterium avium subsp. paratuberculosis
gaucggccagcgcggcc

SEQ ID NO: 2842188 - RNA, 18 nt, Mycobacterium avium subsp. paratuberculosis
gaucggccagcgcggccg

SEQ ID NO: 2842189 - RNA, 22 nt, Mycobacterium avium subsp. paratuberculosis
gaucggccagcgcggccgggcg

SEQ ID NO: 2842190 - RNA, 20 nt, Mycobacterium avium subsp. paratuberculosis
gaucggccaggcgcccagca

SEQ ID NO: 2842191 - RNA, 21 nt, Mycobacterium avium subsp. paratuberculosis
gaucggccagguugucgucgg

SEQ ID NO: 2842192 - RNA, 22 nt, Mycobacterium avium subsp. paratuberculosis
gaucggccauggugccgccguu

SEQ ID NO: 2842193 - RNA, 19 nt, Mycobacterium avium subsp. paratuberculosis
gaucggcccccgggcccga

SEQ ID NO: 2842194 - RNA, 16 nt, Mycobacterium avium subsp. paratuberculosis
gaucggcccgacgggu

SEQ ID NO: 2842195 - RNA, 13 nt, Mycobacterium avium subsp. paratuberculosis
gaucggcccggcc

SEQ ID NO: 2842196 - RNA, 22 nt, Mycobacterium avium subsp. paratuberculosis
gaucggccgcugcgggcgggcc

SEQ ID NO: 2842197 - RNA, 23 nt, Mycobacterium avium subsp. paratuberculosis
gaucggccgcugcgggcgggccg

SEQ ID NO: 2842198 - RNA, 13 nt, Mycobacterium avium subsp. paratuberculosis
gaucggccugggg

SEQ ID NO: 2842199 - RNA, 18 nt, Mycobacterium avium subsp. paratuberculosis
gaucggccuggggggcgc

SEQ ID NO: 2842200 - RNA, 13 nt, Mycobacterium avium subsp. paratuberculosis
gaucgucgccgcc

SEQ ID NO: 2842201 - RNA, 17 nt, Mycobacterium avium subsp. paratuberculosis
gaucgucgccgccaacg

SEQ ID NO: 2842202 - RNA, 20 nt, Mycobacterium avium subsp. paratuberculosis
gaucgucgccgucaccucga

SEQ ID NO: 2842203 - RNA, 20 nt, Mycobacterium avium subsp. paratuberculosis
gaucgucggcacugcccgca

SEQ ID NO: 2842204 - RNA, 23 nt, Mycobacterium avium subsp. paratuberculosis
gaucgucggcacugcccgcaucg

SEQ ID NO: 2842205 - RNA, 14 nt, Mycobacterium avium subsp. paratuberculosis
gaucgucucggcca

SEQ ID NO: 2842206 - RNA, 17 nt, Mycobacterium avium subsp. paratuberculosis
gaucgucucggccagcc

SEQ ID NO: 2842207 - RNA, 19 nt, Mycobacterium avium subsp. paratuberculosis
gaucgucucggccagccgg

SEQ ID NO: 2842208 - RNA, 16 nt, Mycobacterium avium subsp. paratuberculosis
gaucgucucggccgcg

SEQ ID NO: 2842209 - RNA, 17 nt, Mycobacterium avium subsp. paratuberculosis
gaucgucucggccgcgg

SEQ ID NO: 2842210 - RNA, 18 nt, Mycobacterium avium subsp. paratuberculosis
gaucgucucggccgcggu

SEQ ID NO: 2842211 - RNA, 22 nt, Mycobacterium avium subsp. paratuberculosis
gaucgucucggccgcggugcgu

SEQ ID NO: 2842212 - RNA, 20 nt, Mycobacterium avium subsp. paratuberculosis
gaucgucuggccguugauga

SEQ ID NO: 2842213 - RNA, 17 nt, Mycobacterium avium subsp. paratuberculosis
gaucgucuugaccgccc

SEQ ID NO: 2842214 - RNA, 20 nt, Mycobacterium avium subsp. paratuberculosis
gaucgucuugaccgcccggg

SEQ ID NO: 2842215 - RNA, 23 nt, Mycobacterium avium subsp. paratuberculosis
gaucgucuugccgaagaugucgg

SEQ ID NO: 2842216 - RNA, 23 nt, Mycobacterium avium subsp. paratuberculosis
gaucgugacgccguccgacgugc

SEQ ID NO: 2842217 - RNA, 21 nt, Mycobacterium avium subsp. paratuberculosis
gaucgugcgcccauccggcgc

SEQ ID NO: 2842218 - RNA, 16 nt, Mycobacterium avium subsp. paratuberculosis
gaucgugucccggcgc

SEQ ID NO: 2842219 - RNA, 18 nt, Mycobacterium avium subsp. paratuberculosis
gaucguguccgcgccggc

SEQ ID NO: 2842220 - RNA, 13 nt, Mycobacterium avium subsp. paratuberculosis
gaucgugucgauc

SEQ ID NO: 2842221 - RNA, 15 nt, Mycobacterium avium subsp. paratuberculosis
gaucgugucgaucgu

SEQ ID NO: 2842222 - RNA, 20 nt, Mycobacterium avium subsp. paratuberculosis
gaucgugucuggccccgucg

SEQ ID NO: 2842223 - RNA, 21 nt, Mycobacterium avium subsp. paratuberculosis
gaucgugucuggccccgucgu

SEQ ID NO: 2842224 - RNA, 19 nt, Mycobacterium avium subsp. paratuberculosis
gaucguugaugucgguggu

SEQ ID NO: 2842225 - RNA, 21 nt, Mycobacterium avium subsp. paratuberculosis
gaucguugggcaugucgccga

SEQ ID NO: 2842226 - RNA, 17 nt, Mycobacterium avium subsp. paratuberculosis
gaucuacgucggcuggc

SEQ ID NO: 2842227 - RNA, 17 nt, Mycobacterium avium subsp. paratuberculosis
gaucucaccggcggcgg

SEQ ID NO: 2842228 - RNA, 18 nt, Mycobacterium avium subsp. paratuberculosis
gaucucaccggcggcggc

SEQ ID NO: 2842229 - RNA, 19 nt, Mycobacterium avium subsp. paratuberculosis
gaucucaccggcggcggcc

SEQ ID NO: 2842230 - RNA, 21 nt, Mycobacterium avium subsp. paratuberculosis
gaucuccaccgagugcggcgc

SEQ ID NO: 2842231 - RNA, 23 nt, Mycobacterium avium subsp. paratuberculosis
gaucuccaccguguucaccagcg

SEQ ID NO: 2842232 - RNA, 11 nt, Mycobacterium avium subsp. paratuberculosis
gaucuccagca

SEQ ID NO: 2842233 - RNA, 12 nt, Mycobacterium avium subsp. paratuberculosis
gaucuccagcag

SEQ ID NO: 2842234 - RNA, 14 nt, Mycobacterium avium subsp. paratuberculosis
gaucuccagcagcu

SEQ ID NO: 2842235 - RNA, 21 nt, Mycobacterium avium subsp. paratuberculosis
gaucuccagcagcuucaugcc

SEQ ID NO: 2842236 - RNA, 17 nt, Mycobacterium avium subsp. paratuberculosis
gaucuccagcggccggg

SEQ ID NO: 2842237 - RNA, 21 nt, Mycobacterium avium subsp. paratuberculosis
gaucuccaucccgcugaagcc

SEQ ID NO: 2842238 - RNA, 19 nt, Mycobacterium avium subsp. paratuberculosis
gaucucccggguggccucc

SEQ ID NO: 2842239 - RNA, 17 nt, Mycobacterium avium subsp. paratuberculosis
gaucuccgccuucgacg

SEQ ID NO: 2842240 - RNA, 16 nt, Mycobacterium avium subsp. paratuberculosis
gaucuccgcggcgaug

SEQ ID NO: 2842241 - RNA, 17 nt, Mycobacterium avium subsp. paratuberculosis
gaucuccgcggcgauga

SEQ ID NO: 2842242 - RNA, 18 nt, Mycobacterium avium subsp. paratuberculosis
gaucuccgcggcgaugac

SEQ ID NO: 2842243 - RNA, 16 nt, Mycobacterium avium subsp. paratuberculosis
gaucuccggccgguga

SEQ ID NO: 2842244 - RNA, 17 nt, Mycobacterium avium subsp. paratuberculosis
gaucuccgucaccgugg

SEQ ID NO: 2842245 - RNA, 14 nt, Mycobacterium avium subsp. paratuberculosis
gaucuccucggcgu

SEQ ID NO: 2842246 - RNA, 19 nt, Mycobacterium avium subsp. paratuberculosis
gaucuccuuguugacgaug

SEQ ID NO: 2842247 - RNA, 16 nt, Mycobacterium avium subsp. paratuberculosis
gaucucgaccagcgcc

SEQ ID NO: 2842248 - RNA, 17 nt, Mycobacterium avium subsp. paratuberculosis
gaucucgaccagcgccg

SEQ ID NO: 2842249 - RNA, 15 nt, Mycobacterium avium subsp. paratuberculosis
gaucucgaccaggcc

SEQ ID NO: 2842250 - RNA, 16 nt, Mycobacterium avium subsp. paratuberculosis
gaucucgaccaggccg

SEQ ID NO: 2842251 - RNA, 22 nt, Mycobacterium avium subsp. paratuberculosis
gaucucgaccaggccguugucc

SEQ ID NO: 2842252 - RNA, 20 nt, Mycobacterium avium subsp. paratuberculosis
gaucucgaccucgucggcgg

SEQ ID NO: 2842253 - RNA, 24 nt, Mycobacterium avium subsp. paratuberculosis
gaucucgaccuucuuguccaggau

SEQ ID NO: 2842254 - RNA, 20 nt, Mycobacterium avium subsp. paratuberculosis
gaucucgacgguggccucgg

SEQ ID NO: 2842255 - RNA, 21 nt, Mycobacterium avium subsp. paratuberculosis
gaucucgacgguggccucggc

SEQ ID NO: 2842256 - RNA, 23 nt, Mycobacterium avium subsp. paratuberculosis
gaucucgacgguggccucggcgc

SEQ ID NO: 2842257 - RNA, 23 nt, Mycobacterium avium subsp. paratuberculosis
gaucucgauggacgcgguggugc

SEQ ID NO: 2842258 - RNA, 22 nt, Mycobacterium avium subsp. paratuberculosis
gaucucgccgaaggccgggucg

SEQ ID NO: 2842259 - RNA, 14 nt, Mycobacterium avium subsp. paratuberculosis
gaucucgccgagca

SEQ ID NO: 2842260 - RNA, 15 nt, Mycobacterium avium subsp. paratuberculosis
gaucucgccgagcac

SEQ ID NO: 2842261 - RNA, 17 nt, Mycobacterium avium subsp. paratuberculosis
gaucucgccgcgguggu

SEQ ID NO: 2842262 - RNA, 20 nt, Mycobacterium avium subsp. paratuberculosis
gaucucgccgcggugguggg

SEQ ID NO: 2842263 - RNA, 13 nt, Mycobacterium avium subsp. paratuberculosis
gaucucgcgcagg

SEQ ID NO: 2842264 - RNA, 17 nt, Mycobacterium avium subsp. paratuberculosis
gaucucgcgcagguccg

SEQ ID NO: 2842265 - RNA, 14 nt, Mycobacterium avium subsp. paratuberculosis
gaucucgcgccgcg

SEQ ID NO: 2842266 - RNA, 16 nt, Mycobacterium avium subsp. paratuberculosis
gaucucgcgggcccgc

SEQ ID NO: 2842267 - RNA, 17 nt, Mycobacterium avium subsp. paratuberculosis
gaucucgcgggcccgcg

SEQ ID NO: 2842268 - RNA, 18 nt, Mycobacterium avium subsp. paratuberculosis
gaucucgcgggcccgcgc

SEQ ID NO: 2842269 - RNA, 14 nt, Mycobacterium avium subsp. paratuberculosis
gaucucggccaccg

SEQ ID NO: 2842270 - RNA, 18 nt, Mycobacterium avium subsp. paratuberculosis
gaucucggccagcgggcg

SEQ ID NO: 2842271 - RNA, 16 nt, Mycobacterium avium subsp. paratuberculosis
gaucucggcggacucg

SEQ ID NO: 2842272 - RNA, 14 nt, Mycobacterium avium subsp. paratuberculosis
gaucucggcggccg

SEQ ID NO: 2842273 - RNA, 15 nt, Mycobacterium avium subsp. paratuberculosis
gaucucggcggccgc

SEQ ID NO: 2842274 - RNA, 19 nt, Mycobacterium avium subsp. paratuberculosis
gaucucggcguacagcccg

SEQ ID NO: 2842275 - RNA, 16 nt, Mycobacterium avium subsp. paratuberculosis
gaucucggggaucagc

SEQ ID NO: 2842276 - RNA, 20 nt, Mycobacterium avium subsp. paratuberculosis
gaucucggucaccgagcggc

SEQ ID NO: 2842277 - RNA, 16 nt, Mycobacterium avium subsp. paratuberculosis
gaucucggucgccagc

SEQ ID NO: 2842278 - RNA, 16 nt, Mycobacterium avium subsp. paratuberculosis
gaucucggugagccgc

SEQ ID NO: 2842279 - RNA, 16 nt, Mycobacterium avium subsp. paratuberculosis
gaucucguagguggcc

SEQ ID NO: 2842280 - RNA, 21 nt, Mycobacterium avium subsp. paratuberculosis
gaucucgucccacggcggggu

SEQ ID NO: 2842281 - RNA, 14 nt, Mycobacterium avium subsp. paratuberculosis
gaucucgucgauga

SEQ ID NO: 2842282 - RNA, 16 nt, Mycobacterium avium subsp. paratuberculosis
gaucucgucgaugacg

SEQ ID NO: 2842283 - RNA, 22 nt, Mycobacterium avium subsp. paratuberculosis
gaucucgucgcacaaccgggcc

SEQ ID NO: 2842284 - RNA, 23 nt, Mycobacterium avium subsp. paratuberculosis
gaugaccagcgcgaacagcgcgg

SEQ ID NO: 2842285 - RNA, 22 nt, Mycobacterium avium subsp. paratuberculosis
gaugaccagggccucgucgucg

SEQ ID NO: 2842286 - RNA, 15 nt, Mycobacterium avium subsp. paratuberculosis
gaugaccaggguggu

SEQ ID NO: 2842287 - RNA, 18 nt, Mycobacterium avium subsp. paratuberculosis
gaugaccaggucgccggc

SEQ ID NO: 2842288 - RNA, 16 nt, Mycobacterium avium subsp. paratuberculosis
gaugacccaccagccg

SEQ ID NO: 2842289 - RNA, 22 nt, Mycobacterium avium subsp. paratuberculosis
gaugacccaccagccgagaucg

SEQ ID NO: 2842290 - RNA, 21 nt, Mycobacterium avium subsp. paratuberculosis
gaugaccgacauggccagcac

SEQ ID NO: 2842291 - RNA, 22 nt, Mycobacterium avium subsp. paratuberculosis
gaugaccgacauggccagcacc

SEQ ID NO: 2842292 - RNA, 23 nt, Mycobacterium avium subsp. paratuberculosis
gaugaccgacauggccagcacca

SEQ ID NO: 2842293 - RNA, 18 nt, Mycobacterium avium subsp. paratuberculosis
gaugaccgcccaggaccc

SEQ ID NO: 2842294 - RNA, 15 nt, Mycobacterium avium subsp. paratuberculosis
gaugaccgccugcgg

SEQ ID NO: 2842295 - RNA, 13 nt, Mycobacterium avium subsp. paratuberculosis
gaugaccgcggcg

SEQ ID NO: 2842296 - RNA, 14 nt, Mycobacterium avium subsp. paratuberculosis
gaugaccgcggcga

SEQ ID NO: 2842297 - RNA, 15 nt, Mycobacterium avium subsp. paratuberculosis
gaugaccgcggcggg

SEQ ID NO: 2842298 - RNA, 16 nt, Mycobacterium avium subsp. paratuberculosis
gaugaccgcggcgggc

SEQ ID NO: 2842299 - RNA, 12 nt, Mycobacterium avium subsp. paratuberculosis
gaugaccgcguc

SEQ ID NO: 2842300 - RNA, 22 nt, Mycobacterium avium subsp. paratuberculosis
gaugaccgcgucggcgccguag

SEQ ID NO: 2842301 - RNA, 14 nt, Mycobacterium avium subsp. paratuberculosis
gaugaccggcccgg

SEQ ID NO: 2842302 - RNA, 17 nt, Mycobacterium avium subsp. paratuberculosis
gaugaccggcccggcgg

SEQ ID NO: 2842303 - RNA, 19 nt, Mycobacterium avium subsp. paratuberculosis
gaugaccggcccggcggcc

SEQ ID NO: 2842304 - RNA, 14 nt, Mycobacterium avium subsp. paratuberculosis
gaugaccggccugc

SEQ ID NO: 2842305 - RNA, 21 nt, Mycobacterium avium subsp. paratuberculosis
gaugaccuccuugcccagcgc

SEQ ID NO: 2842306 - RNA, 13 nt, Mycobacterium avium subsp. paratuberculosis
gaugaccucgcgc

SEQ ID NO: 2842307 - RNA, 18 nt, Mycobacterium avium subsp. paratuberculosis
gaugaccucgcgcccggc

SEQ ID NO: 2842308 - RNA, 20 nt, Mycobacterium avium subsp. paratuberculosis
gaugacgacggucaccggca

SEQ ID NO: 2842309 - RNA, 15 nt, Mycobacterium avium subsp. paratuberculosis
gaugacgagcagcgu

SEQ ID NO: 2842310 - RNA, 20 nt, Mycobacterium avium subsp. paratuberculosis
gaugacgagcagcgugcuga

SEQ ID NO: 2842311 - RNA, 22 nt, Mycobacterium avium subsp. paratuberculosis
gaugacgaugaugucgcccggc

SEQ ID NO: 2842312 - RNA, 24 nt, Mycobacterium avium subsp. paratuberculosis
gaugacgaugaugucgcccggcgg

SEQ ID NO: 2842313 - RNA, 18 nt, Mycobacterium avium subsp. paratuberculosis
gaugacgaugcccggggu

SEQ ID NO: 2842314 - RNA, 14 nt, Mycobacterium avium subsp. paratuberculosis
gaugacgcagccga

SEQ ID NO: 2842315 - RNA, 13 nt, Mycobacterium avium subsp. paratuberculosis
gaugacgccgcgc

SEQ ID NO: 2842316 - RNA, 14 nt, Mycobacterium avium subsp. paratuberculosis
gaugacgccgcgcc

SEQ ID NO: 2842317 - RNA, 15 nt, Mycobacterium avium subsp. paratuberculosis
gaugacgccgcgccg

SEQ ID NO: 2842318 - RNA, 19 nt, Mycobacterium avium subsp. paratuberculosis
gaugacgccgcgccgcccg

SEQ ID NO: 2842319 - RNA, 22 nt, Mycobacterium avium subsp. paratuberculosis
gaugacgccgcgccgcccggcg

SEQ ID NO: 2842320 - RNA, 13 nt, Mycobacterium avium subsp. paratuberculosis
gaugacgccggac

SEQ ID NO: 2842321 - RNA, 14 nt, Mycobacterium avium subsp. paratuberculosis
gaugacgcugccgc

SEQ ID NO: 2842322 - RNA, 17 nt, Mycobacterium avium subsp. paratuberculosis
gaugacgcugccgcgcc

SEQ ID NO: 2842323 - RNA, 14 nt, Mycobacterium avium subsp. paratuberculosis
gaugacggcggcgg

SEQ ID NO: 2842324 - RNA, 15 nt, Mycobacterium avium subsp. paratuberculosis
gaugacggcggcggu

SEQ ID NO: 2842325 - RNA, 22 nt, Mycobacterium avium subsp. paratuberculosis
gaugacguccaccaggguggcc

SEQ ID NO: 2842326 - RNA, 21 nt, Mycobacterium avium subsp. paratuberculosis
gaugacguccuugacccggcc

SEQ ID NO: 2842327 - RNA, 15 nt, Mycobacterium avium subsp. paratuberculosis
gaugacgucgcgcug

SEQ ID NO: 2842328 - RNA, 16 nt, Mycobacterium avium subsp. paratuberculosis
gaugacgucgcgcugc

SEQ ID NO: 2842329 - RNA, 14 nt, Mycobacterium avium subsp. paratuberculosis
gaugacgucgucgc

SEQ ID NO: 2842330 - RNA, 19 nt, Mycobacterium avium subsp. paratuberculosis
gaugacgucgucgcggcgc

SEQ ID NO: 2842331 - RNA, 19 nt, Mycobacterium avium subsp. paratuberculosis
gaugacgugcaccaccgcg

SEQ ID NO: 2842332 - RNA, 15 nt, Mycobacterium avium subsp. paratuberculosis
gaugacgugguugcg

SEQ ID NO: 2842333 - RNA, 15 nt, Mycobacterium avium subsp. paratuberculosis
gaugacguugcgcgc

SEQ ID NO: 2842334 - RNA, 23 nt, Mycobacterium avium subsp. paratuberculosis
gaugacguuggugaucgccgacg

SEQ ID NO: 2842335 - RNA, 19 nt, Mycobacterium avium subsp. paratuberculosis
gaugagauccuuugcggcc

SEQ ID NO: 2842336 - RNA, 19 nt, Mycobacterium avium subsp. paratuberculosis
gaugagcaagucggcggug

SEQ ID NO: 2842337 - RNA, 14 nt, Mycobacterium avium subsp. paratuberculosis
gaugagccgcagcc

SEQ ID NO: 2842338 - RNA, 15 nt, Mycobacterium avium subsp. paratuberculosis
gaugagccgcagccg

SEQ ID NO: 2842339 - RNA, 17 nt, Mycobacterium avium subsp. paratuberculosis
gaugagccucagcgcgc

SEQ ID NO: 2842340 - RNA, 16 nt, Mycobacterium avium subsp. paratuberculosis
gaugagcugggcggcg

SEQ ID NO: 2842341 - RNA, 19 nt, Mycobacterium avium subsp. paratuberculosis
gaugagcugggcggcgcgc

SEQ ID NO: 2842342 - RNA, 14 nt, Mycobacterium avium subsp. paratuberculosis
gaugagcuggugca

SEQ ID NO: 2842343 - RNA, 17 nt, Mycobacterium avium subsp. paratuberculosis
gaugaggucgcgaccgc

SEQ ID NO: 2842344 - RNA, 23 nt, Mycobacterium avium subsp. paratuberculosis
gaugaggucgcgaccgccggaca

SEQ ID NO: 2842345 - RNA, 23 nt, Mycobacterium avium subsp. paratuberculosis
gaugaucaacacgucgucgugcg

SEQ ID NO: 2842346 - RNA, 17 nt, Mycobacterium avium subsp. paratuberculosis
gaugaucaccucgguga

SEQ ID NO: 2842347 - RNA, 18 nt, Mycobacterium avium subsp. paratuberculosis
gaugaucaccucggugau

SEQ ID NO: 2842348 - RNA, 17 nt, Mycobacterium avium subsp. paratuberculosis
gaugaucagccgcccga

SEQ ID NO: 2842349 - RNA, 20 nt, Mycobacterium avium subsp. paratuberculosis
gaugaucagcgcgcccaggc

SEQ ID NO: 2842350 - RNA, 14 nt, Mycobacterium avium subsp. paratuberculosis
gaugaucagcucgc

SEQ ID NO: 2842351 - RNA, 18 nt, Mycobacterium avium subsp. paratuberculosis
gaugaucaggccggaccg

SEQ ID NO: 2842352 - RNA, 19 nt, Mycobacterium avium subsp. paratuberculosis
gaugaucccgaggaugccg

SEQ ID NO: 2842353 - RNA, 19 nt, Mycobacterium avium subsp. paratuberculosis
gaugaucccggugaugccg

SEQ ID NO: 2842354 - RNA, 17 nt, Mycobacterium avium subsp. paratuberculosis
gaugauccuggccuggu

SEQ ID NO: 2842355 - RNA, 23 nt, Mycobacterium avium subsp. paratuberculosis
gaugauccuggccuggucggccg

SEQ ID NO: 2842356 - RNA, 16 nt, Mycobacterium avium subsp. paratuberculosis
gaugaucgagccgcgg

SEQ ID NO: 2842357 - RNA, 13 nt, Mycobacterium avium subsp. paratuberculosis
gaugaucgccgau

SEQ ID NO: 2842358 - RNA, 21 nt, Mycobacterium avium subsp. paratuberculosis
gaugaucgccgauccgggcgg

SEQ ID NO: 2842359 - RNA, 13 nt, Mycobacterium avium subsp. paratuberculosis
gaugaucgccggc

SEQ ID NO: 2842360 - RNA, 16 nt, Mycobacterium avium subsp. paratuberculosis
gaugaucgccggcgcc

SEQ ID NO: 2842361 - RNA, 16 nt, Mycobacterium avium subsp. paratuberculosis
gaugaucgucggcagc

SEQ ID NO: 2842362 - RNA, 17 nt, Mycobacterium avium subsp. paratuberculosis
gaugaucgucucggccg

SEQ ID NO: 2842363 - RNA, 14 nt, Mycobacterium avium subsp. paratuberculosis
gaugaucucgaugc

SEQ ID NO: 2842364 - RNA, 15 nt, Mycobacterium avium subsp. paratuberculosis
gaugaucuucuccag

SEQ ID NO: 2842365 - RNA, 21 nt, Mycobacterium avium subsp. paratuberculosis
gaugaugaaaccggccagcag

SEQ ID NO: 2842366 - RNA, 23 nt, Mycobacterium avium subsp. paratuberculosis
gaugaugccgcccaucagcagga

SEQ ID NO: 2842367 - RNA, 17 nt, Mycobacterium avium subsp. paratuberculosis
gaugaugccggccgcgu

SEQ ID NO: 2842368 - RNA, 14 nt, Mycobacterium avium subsp. paratuberculosis
gaugaugccggcgg

SEQ ID NO: 2842369 - RNA, 12 nt, Mycobacterium avium subsp. paratuberculosis
gaugccgccggu

SEQ ID NO: 2842370 - RNA, 13 nt, Mycobacterium avium subsp. paratuberculosis
gaugccgcgcagg

SEQ ID NO: 2842371 - RNA, 21 nt, Mycobacterium avium subsp. paratuberculosis
gaugccgcgcggcgccagcgg

SEQ ID NO: 2842372 - RNA, 14 nt, Mycobacterium avium subsp. paratuberculosis
gaugccgcgcucga

SEQ ID NO: 2842373 - RNA, 18 nt, Mycobacterium avium subsp. paratuberculosis
gaugccgcgcugcgccgg

SEQ ID NO: 2842374 - RNA, 21 nt, Mycobacterium avium subsp. paratuberculosis
gaugccgcgcugcgccgggug

SEQ ID NO: 2842375 - RNA, 14 nt, Mycobacterium avium subsp. paratuberculosis
gaugccgcucggcg

SEQ ID NO: 2842376 - RNA, 19 nt, Mycobacterium avium subsp. paratuberculosis
gaugccgcucggcgcucca

SEQ ID NO: 2842377 - RNA, 23 nt, Mycobacterium avium subsp. paratuberculosis
gaugccgcuuuccaaccaggcgc

SEQ ID NO: 2842378 - RNA, 19 nt, Mycobacterium avium subsp. paratuberculosis
gaugccggacucugacuca

SEQ ID NO: 2842379 - RNA, 17 nt, Mycobacterium avium subsp. paratuberculosis
gaugccggcaaccgcug

SEQ ID NO: 2842380 - RNA, 15 nt, Mycobacterium avium subsp. paratuberculosis
gaugccggccagccg

SEQ ID NO: 2842381 - RNA, 18 nt, Mycobacterium avium subsp. paratuberculosis
gaugccggccagcggcca

SEQ ID NO: 2842382 - RNA, 14 nt, Mycobacterium avium subsp. paratuberculosis
gaugccggccaggc

SEQ ID NO: 2842383 - RNA, 21 nt, Mycobacterium avium subsp. paratuberculosis
gaugccggccaggcacagcag

SEQ ID NO: 2842384 - RNA, 13 nt, Mycobacterium avium subsp. paratuberculosis
gaugccggccggg

SEQ ID NO: 2842385 - RNA, 14 nt, Mycobacterium avium subsp. paratuberculosis
gaugccggccggga

SEQ ID NO: 2842386 - RNA, 16 nt, Mycobacterium avium subsp. paratuberculosis
gaugccggccgggacg

SEQ ID NO: 2842387 - RNA, 17 nt, Mycobacterium avium subsp. paratuberculosis
gaugccggccgggacgc

SEQ ID NO: 2842388 - RNA, 23 nt, Mycobacterium avium subsp. paratuberculosis
gaugccggccgggacgcggucca

SEQ ID NO: 2842389 - RNA, 14 nt, Mycobacterium avium subsp. paratuberculosis
gaugccggccuggc

SEQ ID NO: 2842390 - RNA, 21 nt, Mycobacterium avium subsp. paratuberculosis
gaugccggccuggcccagccg

SEQ ID NO: 2842391 - RNA, 16 nt, Mycobacterium avium subsp. paratuberculosis
gaugccggcgacgaac

SEQ ID NO: 2842392 - RNA, 22 nt, Mycobacterium avium subsp. paratuberculosis
gaugccggcgacgaacgcuucc

SEQ ID NO: 2842393 - RNA, 19 nt, Mycobacterium avium subsp. paratuberculosis
gaugccggcgauccgcgcg

SEQ ID NO: 2842394 - RNA, 18 nt, Mycobacterium avium subsp. paratuberculosis
gaugccggcgcccagcgg

SEQ ID NO: 2842395 - RNA, 20 nt, Mycobacterium avium subsp. paratuberculosis
gaugccggcgcccagcggcg

SEQ ID NO: 2842396 - RNA, 22 nt, Mycobacterium avium subsp. paratuberculosis
gaugccggcgguaccgccgauc

SEQ ID NO: 2842397 - RNA, 20 nt, Mycobacterium avium subsp. paratuberculosis
gaugccggcguagcagucgg

SEQ ID NO: 2842398 - RNA, 12 nt, Mycobacterium avium subsp. paratuberculosis
gaugccggcguu

SEQ ID NO: 2842399 - RNA, 19 nt, Mycobacterium avium subsp. paratuberculosis
gaugccggcguugacgaug

SEQ ID NO: 2842400 - RNA, 16 nt, Mycobacterium avium subsp. paratuberculosis
gaugccgggcauggcu

SEQ ID NO: 2842401 - RNA, 13 nt, Mycobacterium avium subsp. paratuberculosis
gaugccgggcucc

SEQ ID NO: 2842402 - RNA, 13 nt, Mycobacterium avium subsp. paratuberculosis
gaugccggggcag

SEQ ID NO: 2842403 - RNA, 20 nt, Mycobacterium avium subsp. paratuberculosis
gaugccggggcagcacccgc

SEQ ID NO: 2842404 - RNA, 13 nt, Mycobacterium avium subsp. paratuberculosis
gaugccggugcag

SEQ ID NO: 2842405 - RNA, 22 nt, Mycobacterium avium subsp. paratuberculosis
gaugccgguguucaagccggcg

SEQ ID NO: 2842406 - RNA, 17 nt, Mycobacterium avium subsp. paratuberculosis
gaugccguagaccagca

SEQ ID NO: 2842407 - RNA, 23 nt, Mycobacterium avium subsp. paratuberculosis
gaugccguagcgcaugaugccca

SEQ ID NO: 2842408 - RNA, 17 nt, Mycobacterium avium subsp. paratuberculosis
gaugccguaggacagga

SEQ ID NO: 2842409 - RNA, 20 nt, Mycobacterium avium subsp. paratuberculosis
gaugccgucacugucggcgc

SEQ ID NO: 2842410 - RNA, 20 nt, Mycobacterium avium subsp. paratuberculosis
gaugccguccuugucgcgca

SEQ ID NO: 2842411 - RNA, 16 nt, Mycobacterium avium subsp. paratuberculosis
gaugccgugccggugg

SEQ ID NO: 2842412 - RNA, 17 nt, Mycobacterium avium subsp. paratuberculosis
gaugccgugccggugga

SEQ ID NO: 2842413 - RNA, 16 nt, Mycobacterium avium subsp. paratuberculosis
gaugccgugcgcgcug

SEQ ID NO: 2842414 - RNA, 18 nt, Mycobacterium avium subsp. paratuberculosis
gaugccgugcgcgcuggu

SEQ ID NO: 2842415 - RNA, 15 nt, Mycobacterium avium subsp. paratuberculosis
gaugccguggucggc

SEQ ID NO: 2842416 - RNA, 18 nt, Mycobacterium avium subsp. paratuberculosis
gaugccguggucggcgaa

SEQ ID NO: 2842417 - RNA, 22 nt, Mycobacterium avium subsp. paratuberculosis
gaugccguggucggcgaacgcc

SEQ ID NO: 2842418 - RNA, 20 nt, Mycobacterium avium subsp. paratuberculosis
gaugccuacaggugccggcg

SEQ ID NO: 2842419 - RNA, 22 nt, Mycobacterium avium subsp. paratuberculosis
gaugccuacaggugccggcggc

SEQ ID NO: 2842420 - RNA, 15 nt, Mycobacterium avium subsp. paratuberculosis
gaugccugcccgcgc

SEQ ID NO: 2842421 - RNA, 16 nt, Mycobacterium avium subsp. paratuberculosis
gaugccugcccgcgca

SEQ ID NO: 2842422 - RNA, 17 nt, Mycobacterium avium subsp. paratuberculosis
gaugccuuccucggcgc

SEQ ID NO: 2842423 - RNA, 13 nt, Mycobacterium avium subsp. paratuberculosis
gaugcgacaccgc

SEQ ID NO: 2842424 - RNA, 14 nt, Mycobacterium avium subsp. paratuberculosis
gaugcgagccagcu

SEQ ID NO: 2842425 - RNA, 23 nt, Mycobacterium avium subsp. paratuberculosis
gaugcgaucgaugaauccgcgca

SEQ ID NO: 2842426 - RNA, 16 nt, Mycobacterium avium subsp. paratuberculosis
gaugcgaugggugauc

SEQ ID NO: 2842427 - RNA, 19 nt, Mycobacterium avium subsp. paratuberculosis
gaugcgaugggugaucgcg

SEQ ID NO: 2842428 - RNA, 15 nt, Mycobacterium avium subsp. paratuberculosis
gaugcgcaacagcau

SEQ ID NO: 2842429 - RNA, 20 nt, Mycobacterium avium subsp. paratuberculosis
gaugcgcaagcaccggcugg

SEQ ID NO: 2842430 - RNA, 17 nt, Mycobacterium avium subsp. paratuberculosis
gaugcgcaccacgcccg

SEQ ID NO: 2842431 - RNA, 19 nt, Mycobacterium avium subsp. paratuberculosis
gaugcgcaccacgcccgac

SEQ ID NO: 2842432 - RNA, 22 nt, Mycobacterium avium subsp. paratuberculosis
gaugcgcaccacgcccgacgac

SEQ ID NO: 2842433 - RNA, 19 nt, Mycobacterium avium subsp. paratuberculosis
gaugcgcaccaucaccugu

SEQ ID NO: 2842434 - RNA, 17 nt, Mycobacterium avium subsp. paratuberculosis
gaugcgcaccgcggcgu

SEQ ID NO: 2842435 - RNA, 20 nt, Mycobacterium avium subsp. paratuberculosis
gaugcgcaccgcggcgugcg

SEQ ID NO: 2842436 - RNA, 22 nt, Mycobacterium avium subsp. paratuberculosis
gaugcgcaccgcggcgugcgcc

SEQ ID NO: 2842437 - RNA, 18 nt, Mycobacterium avium subsp. paratuberculosis
gaugcgcaccgugccgcc

SEQ ID NO: 2842438 - RNA, 19 nt, Mycobacterium avium subsp. paratuberculosis
gaugcgcaccugcggcccc

SEQ ID NO: 2842439 - RNA, 19 nt, Mycobacterium avium subsp. paratuberculosis
gaugcgcacgucggccgcc

SEQ ID NO: 2842440 - RNA, 15 nt, Mycobacterium avium subsp. paratuberculosis
gaugcgccaccgaca

SEQ ID NO: 2842441 - RNA, 17 nt, Mycobacterium avium subsp. paratuberculosis
gaugcgccaccgacacc

SEQ ID NO: 2842442 - RNA, 18 nt, Mycobacterium avium subsp. paratuberculosis
gaugcgccaccgacacca

SEQ ID NO: 2842443 - RNA, 21 nt, Mycobacterium avium subsp. paratuberculosis
gaugcgccaccgacaccaccg

SEQ ID NO: 2842444 - RNA, 11 nt, Mycobacterium avium subsp. paratuberculosis
gaugcgcccgc

SEQ ID NO: 2842445 - RNA, 13 nt, Mycobacterium avium subsp. paratuberculosis
gaugcgcccgcgc

SEQ ID NO: 2842446 - RNA, 14 nt, Mycobacterium avium subsp. paratuberculosis
gaugcgcccgcgcc

SEQ ID NO: 2842447 - RNA, 17 nt, Mycobacterium avium subsp. paratuberculosis
gaugcgcccgcgccacc

SEQ ID NO: 2842448 - RNA, 13 nt, Mycobacterium avium subsp. paratuberculosis
gaugcgccgcgga

SEQ ID NO: 2842449 - RNA, 19 nt, Mycobacterium avium subsp. paratuberculosis
gaugcgccggguccagccg

SEQ ID NO: 2842450 - RNA, 20 nt, Mycobacterium avium subsp. paratuberculosis
gaugcgccggguccagccgc

SEQ ID NO: 2842451 - RNA, 15 nt, Mycobacterium avium subsp. paratuberculosis
gaugcgccgucucag

SEQ ID NO: 2842452 - RNA, 18 nt, Mycobacterium avium subsp. paratuberculosis
gaugcgccgugcccaaca

SEQ ID NO: 2842453 - RNA, 13 nt, Mycobacterium avium subsp. paratuberculosis
gaugcgcgacggc

SEQ ID NO: 2842454 - RNA, 13 nt, Mycobacterium avium subsp. paratuberculosis
gauggagcugacc

SEQ ID NO: 2842455 - RNA, 14 nt, Mycobacterium avium subsp. paratuberculosis
gauggaggucccga

SEQ ID NO: 2842456 - RNA, 20 nt, Mycobacterium avium subsp. paratuberculosis
gauggaggugccgcgcagca

SEQ ID NO: 2842457 - RNA, 22 nt, Mycobacterium avium subsp. paratuberculosis
gauggccaccaucaggccggcc

SEQ ID NO: 2842458 - RNA, 13 nt, Mycobacterium avium subsp. paratuberculosis
gauggccaccggg

SEQ ID NO: 2842459 - RNA, 23 nt, Mycobacterium avium subsp. paratuberculosis
gauggccacgcucucgccgguca

SEQ ID NO: 2842460 - RNA, 12 nt, Mycobacterium avium subsp. paratuberculosis
gauggccagcac

SEQ ID NO: 2842461 - RNA, 16 nt, Mycobacterium avium subsp. paratuberculosis
gauggccagcaccacc

SEQ ID NO: 2842462 - RNA, 16 nt, Mycobacterium avium subsp. paratuberculosis
gauggccagcgcggcg

SEQ ID NO: 2842463 - RNA, 14 nt, Mycobacterium avium subsp. paratuberculosis
gauggccagcgcgu

SEQ ID NO: 2842464 - RNA, 20 nt, Mycobacterium avium subsp. paratuberculosis
gauggccagcgcgucgcaca

SEQ ID NO: 2842465 - RNA, 17 nt, Mycobacterium avium subsp. paratuberculosis
gauggccagguaguggu

SEQ ID NO: 2842466 - RNA, 20 nt, Mycobacterium avium subsp. paratuberculosis
gauggccagguagugguggg

SEQ ID NO: 2842467 - RNA, 14 nt, Mycobacterium avium subsp. paratuberculosis
gauggccaucgucg

SEQ ID NO: 2842468 - RNA, 17 nt, Mycobacterium avium subsp. paratuberculosis
gauggccauggccagga

SEQ ID NO: 2842469 - RNA, 18 nt, Mycobacterium avium subsp. paratuberculosis
gauggccccggcgagucu

SEQ ID NO: 2842470 - RNA, 20 nt, Mycobacterium avium subsp. paratuberculosis
gauggcccgccagaucgcca

SEQ ID NO: 2842471 - RNA, 15 nt, Mycobacterium avium subsp. paratuberculosis
gauggcccgcugcgc

SEQ ID NO: 2842472 - RNA, 19 nt, Mycobacterium avium subsp. paratuberculosis
gauggcccggaccgccgcg

SEQ ID NO: 2842473 - RNA, 20 nt, Mycobacterium avium subsp. paratuberculosis
gauggcccgggccacacccg

SEQ ID NO: 2842474 - RNA, 14 nt, Mycobacterium avium subsp. paratuberculosis
gauggccgacaaca

SEQ ID NO: 2842475 - RNA, 12 nt, Mycobacterium avium subsp. paratuberculosis
gauggccgcccg

SEQ ID NO: 2842476 - RNA, 14 nt, Mycobacterium avium subsp. paratuberculosis
gauggccgcccgca

SEQ ID NO: 2842477 - RNA, 13 nt, Mycobacterium avium subsp. paratuberculosis
gauggccgcgccg

SEQ ID NO: 2842478 - RNA, 15 nt, Mycobacterium avium subsp. paratuberculosis
gauggccgcgccgcc

SEQ ID NO: 2842479 - RNA, 13 nt, Mycobacterium avium subsp. paratuberculosis
gauggccggccgg

SEQ ID NO: 2842480 - RNA, 14 nt, Mycobacterium avium subsp. paratuberculosis
gauggccggccggg

SEQ ID NO: 2842481 - RNA, 17 nt, Mycobacterium avium subsp. paratuberculosis
gauggccggccggguca

SEQ ID NO: 2842482 - RNA, 14 nt, Mycobacterium avium subsp. paratuberculosis
gauggccgggcagg

SEQ ID NO: 2842483 - RNA, 19 nt, Mycobacterium avium subsp. paratuberculosis
gauggccgggcaggccggg

SEQ ID NO: 2842484 - RNA, 17 nt, Mycobacterium avium subsp. paratuberculosis
gauggccuccgacccgu

SEQ ID NO: 2842485 - RNA, 20 nt, Mycobacterium avium subsp. paratuberculosis
gauggccuccgacccgucca

SEQ ID NO: 2842486 - RNA, 19 nt, Mycobacterium avium subsp. paratuberculosis
gauggccucggcgaugccg

SEQ ID NO: 2842487 - RNA, 14 nt, Mycobacterium avium subsp. paratuberculosis
gauggccucgucga

SEQ ID NO: 2842488 - RNA, 22 nt, Mycobacterium avium subsp. paratuberculosis
gauggccucgucgaugucggcg

SEQ ID NO: 2842489 - RNA, 15 nt, Mycobacterium avium subsp. paratuberculosis
gauggccucgucgcg

SEQ ID NO: 2842490 - RNA, 17 nt, Mycobacterium avium subsp. paratuberculosis
gauggccucgucgcgga

SEQ ID NO: 2842491 - RNA, 14 nt, Mycobacterium avium subsp. paratuberculosis
gauggccugcucgc

SEQ ID NO: 2842492 - RNA, 16 nt, Mycobacterium avium subsp. paratuberculosis
gauggccugguggccc

SEQ ID NO: 2842493 - RNA, 23 nt, Mycobacterium avium subsp. paratuberculosis
gauggccugguggcccaggcaga

SEQ ID NO: 2842494 - RNA, 15 nt, Mycobacterium avium subsp. paratuberculosis
gauggcgaaccagcg

SEQ ID NO: 2842495 - RNA, 16 nt, Mycobacterium avium subsp. paratuberculosis
gauggcgaaccagcgc

SEQ ID NO: 2842496 - RNA, 20 nt, Mycobacterium avium subsp. paratuberculosis
gauggcgaaccagcgcccgc

SEQ ID NO: 2842497 - RNA, 21 nt, Mycobacterium avium subsp. paratuberculosis
gauggcgaaccagcgcccgcu

SEQ ID NO: 2842498 - RNA, 14 nt, Mycobacterium avium subsp. paratuberculosis
gauggcgaagccca

SEQ ID NO: 2842499 - RNA, 16 nt, Mycobacterium avium subsp. paratuberculosis
gauggcgaaguucggc

SEQ ID NO: 2842500 - RNA, 15 nt, Mycobacterium avium subsp. paratuberculosis
gauggcgaccgcgca

SEQ ID NO: 2842501 - RNA, 19 nt, Mycobacterium avium subsp. paratuberculosis
gauggcgaccgcgcaggcg

SEQ ID NO: 2842502 - RNA, 19 nt, Mycobacterium avium subsp. paratuberculosis
gauggcgacggcgacgacc

SEQ ID NO: 2842503 - RNA, 20 nt, Mycobacterium avium subsp. paratuberculosis
gauggcgaggaaguccggcg

SEQ ID NO: 2842504 - RNA, 23 nt, Mycobacterium avium subsp. paratuberculosis
gauggcgaggaaguccggcgcgc

SEQ ID NO: 2842505 - RNA, 13 nt, Mycobacterium avium subsp. paratuberculosis
gauggcgaugccg

SEQ ID NO: 2842506 - RNA, 14 nt, Mycobacterium avium subsp. paratuberculosis
gauggcgaugccgg

SEQ ID NO: 2842507 - RNA, 15 nt, Mycobacterium avium subsp. paratuberculosis
gauggcgauggccug

SEQ ID NO: 2842508 - RNA, 16 nt, Mycobacterium avium subsp. paratuberculosis
gauggcgauggccugc

SEQ ID NO: 2842509 - RNA, 17 nt, Mycobacterium avium subsp. paratuberculosis
gauggcgcccagcccga

SEQ ID NO: 2842510 - RNA, 20 nt, Mycobacterium avium subsp. paratuberculosis
gauggcgcccagcccgagca

SEQ ID NO: 2842511 - RNA, 13 nt, Mycobacterium avium subsp. paratuberculosis
gauggcgcccggc

SEQ ID NO: 2842512 - RNA, 19 nt, Mycobacterium avium subsp. paratuberculosis
gauggcgcccggcagccgc

SEQ ID NO: 2842513 - RNA, 21 nt, Mycobacterium avium subsp. paratuberculosis
gauggcgcccggcagccgcuc

SEQ ID NO: 2842514 - RNA, 19 nt, Mycobacterium avium subsp. paratuberculosis
gauggcgccgaucgcgcgc

SEQ ID NO: 2842515 - RNA, 14 nt, Mycobacterium avium subsp. paratuberculosis
gauggcgcggccca

SEQ ID NO: 2842516 - RNA, 22 nt, Mycobacterium avium subsp. paratuberculosis
gauggcgcggccggccgacacc

SEQ ID NO: 2842517 - RNA, 20 nt, Mycobacterium avium subsp. paratuberculosis
gauggcgcggcgcaccgccc

SEQ ID NO: 2842518 - RNA, 21 nt, Mycobacterium avium subsp. paratuberculosis
gauggcgcggcgcaccgcccg

SEQ ID NO: 2842519 - RNA, 22 nt, Mycobacterium avium subsp. paratuberculosis
gauggcgcggcgcaccgcccgc

SEQ ID NO: 2842520 - RNA, 17 nt, Mycobacterium avium subsp. paratuberculosis
gauggcggccugcagga

SEQ ID NO: 2842521 - RNA, 23 nt, Mycobacterium avium subsp. paratuberculosis
gauggcggcgcgcucgucgucgg

SEQ ID NO: 2842522 - RNA, 13 nt, Mycobacterium avium subsp. paratuberculosis
gauggcggcggcc

SEQ ID NO: 2842523 - RNA, 16 nt, Mycobacterium avium subsp. paratuberculosis
gauggcggcggcccgc

SEQ ID NO: 2842524 - RNA, 19 nt, Mycobacterium avium subsp. paratuberculosis
gauggcggcggcccgccgc

SEQ ID NO: 2842525 - RNA, 20 nt, Mycobacterium avium subsp. paratuberculosis
gauggcggcggcccgccgcg

SEQ ID NO: 2842526 - RNA, 21 nt, Mycobacterium avium subsp. paratuberculosis
gauggcggcggcccgccgcgc

SEQ ID NO: 2842527 - RNA, 18 nt, Mycobacterium avium subsp. paratuberculosis
gauggcggcgucgaguuc

SEQ ID NO: 2842528 - RNA, 15 nt, Mycobacterium avium subsp. paratuberculosis
gauggcgggcgcgcc

SEQ ID NO: 2842529 - RNA, 16 nt, Mycobacterium avium subsp. paratuberculosis
gauggcgggcgcgccg

SEQ ID NO: 2842530 - RNA, 22 nt, Mycobacterium avium subsp. paratuberculosis
gauggcggguuggugucgaaca

SEQ ID NO: 2842531 - RNA, 17 nt, Mycobacterium avium subsp. paratuberculosis
gauggcgguccaccacc

SEQ ID NO: 2842532 - RNA, 14 nt, Mycobacterium avium subsp. paratuberculosis
gauggcggucgcgc

SEQ ID NO: 2842533 - RNA, 14 nt, Mycobacterium avium subsp. paratuberculosis
gauggcggugugga

SEQ ID NO: 2842534 - RNA, 18 nt, Mycobacterium avium subsp. paratuberculosis
gauggcguccaccgacau

SEQ ID NO: 2842535 - RNA, 16 nt, Mycobacterium avium subsp. paratuberculosis
gauggcgucgacgugc

SEQ ID NO: 2842536 - RNA, 16 nt, Mycobacterium avium subsp. paratuberculosis
gauggcgucggccagc

SEQ ID NO: 2842537 - RNA, 18 nt, Mycobacterium avium subsp. paratuberculosis
gauggcgucggccagcgg

SEQ ID NO: 2842538 - RNA, 20 nt, Mycobacterium avium subsp. paratuberculosis
gauggcgugccacagcauga

SEQ ID NO: 2842539 - RNA, 22 nt, Mycobacterium avium subsp. paratuberculosis
gaugucgccgcagaucagggcg

SEQ ID NO: 2842540 - RNA, 13 nt, Mycobacterium avium subsp. paratuberculosis
gaugucgccggcg

SEQ ID NO: 2842541 - RNA, 18 nt, Mycobacterium avium subsp. paratuberculosis
gaugucgccggcgaccgc

SEQ ID NO: 2842542 - RNA, 20 nt, Mycobacterium avium subsp. paratuberculosis
gaugucgccggcgaccgccu

SEQ ID NO: 2842543 - RNA, 21 nt, Mycobacterium avium subsp. paratuberculosis
gaugucgcgaaaaucgguggu

SEQ ID NO: 2842544 - RNA, 14 nt, Mycobacterium avium subsp. paratuberculosis
gaugucgcgcggcu

SEQ ID NO: 2842545 - RNA, 14 nt, Mycobacterium avium subsp. paratuberculosis
gaugucgcugccgc

SEQ ID NO: 2842546 - RNA, 18 nt, Mycobacterium avium subsp. paratuberculosis
gaugucgcugccgccgcc

SEQ ID NO: 2842547 - RNA, 20 nt, Mycobacterium avium subsp. paratuberculosis
gaugucggacuucugguuga

SEQ ID NO: 2842548 - RNA, 12 nt, Mycobacterium avium subsp. paratuberculosis
gaugucggccag

SEQ ID NO: 2842549 - RNA, 14 nt, Mycobacterium avium subsp. paratuberculosis
gaugucggccagcg

SEQ ID NO: 2842550 - RNA, 15 nt, Mycobacterium avium subsp. paratuberculosis
gaugucggccagcgc

SEQ ID NO: 2842551 - RNA, 22 nt, Mycobacterium avium subsp. paratuberculosis
gaugucggccagcgcggcggcc

SEQ ID NO: 2842552 - RNA, 14 nt, Mycobacterium avium subsp. paratuberculosis
gaugucggccggca

SEQ ID NO: 2842553 - RNA, 14 nt, Mycobacterium avium subsp. paratuberculosis
gaugucggcgaacc

SEQ ID NO: 2842554 - RNA, 17 nt, Mycobacterium avium subsp. paratuberculosis
gaugucggcgaaccagg

SEQ ID NO: 2842555 - RNA, 21 nt, Mycobacterium avium subsp. paratuberculosis
gaugucggcgaaccagggcag

SEQ ID NO: 2842556 - RNA, 23 nt, Mycobacterium avium subsp. paratuberculosis
gaugucggcgaaccagggcagcc

SEQ ID NO: 2842557 - RNA, 16 nt, Mycobacterium avium subsp. paratuberculosis
gaugucggcggccggg

SEQ ID NO: 2842558 - RNA, 19 nt, Mycobacterium avium subsp. paratuberculosis
gaugucggcgggccggucc

SEQ ID NO: 2842559 - RNA, 20 nt, Mycobacterium avium subsp. paratuberculosis
gaugucggcuucguacggcc

SEQ ID NO: 2842560 - RNA, 16 nt, Mycobacterium avium subsp. paratuberculosis
gaugucggugagcgcc

SEQ ID NO: 2842561 - RNA, 18 nt, Mycobacterium avium subsp. paratuberculosis
gaugucggugagcgccac

SEQ ID NO: 2842562 - RNA, 19 nt, Mycobacterium avium subsp. paratuberculosis
gaugucggugagcgccacc

SEQ ID NO: 2842563 - RNA, 17 nt, Mycobacterium avium subsp. paratuberculosis
gaugucggugcggccgc

SEQ ID NO: 2842564 - RNA, 22 nt, Mycobacterium avium subsp. paratuberculosis
gaugucggugguggggccggcg

SEQ ID NO: 2842565 - RNA, 17 nt, Mycobacterium avium subsp. paratuberculosis
gaugucggugguguggc

SEQ ID NO: 2842566 - RNA, 14 nt, Mycobacterium avium subsp. paratuberculosis
gaugucggugugca

SEQ ID NO: 2842567 - RNA, 17 nt, Mycobacterium avium subsp. paratuberculosis
gaugucggugugcagca

SEQ ID NO: 2842568 - RNA, 20 nt, Mycobacterium avium subsp. paratuberculosis
gaugucgguguggaccgcgc

SEQ ID NO: 2842569 - RNA, 22 nt, Mycobacterium avium subsp. paratuberculosis
gaugucgguguggaccgcgcag

SEQ ID NO: 2842570 - RNA, 23 nt, Mycobacterium avium subsp. paratuberculosis
gaugucgguguggaccgcgcagu

SEQ ID NO: 2842571 - RNA, 23 nt, Mycobacterium avium subsp. paratuberculosis
gaugucgucgaacgcggcgaagc

SEQ ID NO: 2842572 - RNA, 13 nt, Mycobacterium avium subsp. paratuberculosis
gaugucgucgacg

SEQ ID NO: 2842573 - RNA, 16 nt, Mycobacterium avium subsp. paratuberculosis
gaugucgucgccggug

SEQ ID NO: 2842574 - RNA, 14 nt, Mycobacterium avium subsp. paratuberculosis
gaugucgugcgguc

SEQ ID NO: 2842575 - RNA, 16 nt, Mycobacterium avium subsp. paratuberculosis
gaugucgugggcgugc

SEQ ID NO: 2842576 - RNA, 17 nt, Mycobacterium avium subsp. paratuberculosis
gaugucguuggugucga

SEQ ID NO: 2842577 - RNA, 16 nt, Mycobacterium avium subsp. paratuberculosis
gaugucuccgcgcagc

SEQ ID NO: 2842578 - RNA, 17 nt, Mycobacterium avium subsp. paratuberculosis
gaugucuccgcgcagcc

SEQ ID NO: 2842579 - RNA, 12 nt, Mycobacterium avium subsp. paratuberculosis
gaugugaucggc

SEQ ID NO: 2842580 - RNA, 17 nt, Mycobacterium avium subsp. paratuberculosis
gaugugaucggcggcca

SEQ ID NO: 2842581 - RNA, 16 nt, Mycobacterium avium subsp. paratuberculosis
gaugugaugggucugc

SEQ ID NO: 2842582 - RNA, 19 nt, Mycobacterium avium subsp. paratuberculosis
gaugugccuggcccagaca

SEQ ID NO: 2842583 - RNA, 20 nt, Mycobacterium avium subsp. paratuberculosis
gaugugcgcgcuggccgcgu

SEQ ID NO: 2842584 - RNA, 17 nt, Mycobacterium avium subsp. paratuberculosis
gaugugcucgaucugcu

SEQ ID NO: 2842585 - RNA, 14 nt, Mycobacterium avium subsp. paratuberculosis
gaugugcugcaggu

SEQ ID NO: 2842586 - RNA, 14 nt, Mycobacterium avium subsp. paratuberculosis
gauguggccggcga

SEQ ID NO: 2842587 - RNA, 18 nt, Mycobacterium avium subsp. paratuberculosis
gauguggcgggcguccug

SEQ ID NO: 2842588 - RNA, 13 nt, Mycobacterium avium subsp. paratuberculosis
gaugugggccgca

SEQ ID NO: 2842589 - RNA, 18 nt, Mycobacterium avium subsp. paratuberculosis
gauguggguggucagcgc

SEQ ID NO: 2842590 - RNA, 16 nt, Mycobacterium avium subsp. paratuberculosis
gauguggucggccacg

SEQ ID NO: 2842591 - RNA, 17 nt, Mycobacterium avium subsp. paratuberculosis
gauguggucggccacga

SEQ ID NO: 2842592 - RNA, 20 nt, Mycobacterium avium subsp. paratuberculosis
gauguguaacaacucgccgg

SEQ ID NO: 2842593 - RNA, 23 nt, Mycobacterium avium subsp. paratuberculosis
gauguucaccccguugagcagcg

SEQ ID NO: 2842594 - RNA, 17 nt, Mycobacterium avium subsp. paratuberculosis
gauguugaccacccgca

SEQ ID NO: 2842595 - RNA, 19 nt, Mycobacterium avium subsp. paratuberculosis
gauguugaccacccgcagc

SEQ ID NO: 2842596 - RNA, 18 nt, Mycobacterium avium subsp. paratuberculosis
gauguugaucacgugucc

SEQ ID NO: 2842597 - RNA, 20 nt, Mycobacterium avium subsp. paratuberculosis
gauguugccccgcgagagaa

SEQ ID NO: 2842598 - RNA, 16 nt, Mycobacterium avium subsp. paratuberculosis
gauguugcggccggcc

SEQ ID NO: 2842599 - RNA, 14 nt, Mycobacterium avium subsp. paratuberculosis
gauguugcggcggc

SEQ ID NO: 2842600 - RNA, 16 nt, Mycobacterium avium subsp. paratuberculosis
gauguuggccgcgacg

SEQ ID NO: 2842601 - RNA, 17 nt, Mycobacterium avium subsp. paratuberculosis
gauguuggccgcgacgc

SEQ ID NO: 2842602 - RNA, 14 nt, Mycobacterium avium subsp. paratuberculosis
gauuacucgccggc

SEQ ID NO: 2842603 - RNA, 15 nt, Mycobacterium avium subsp. paratuberculosis
gauuacucgccggcg

SEQ ID NO: 2842604 - RNA, 15 nt, Mycobacterium avium subsp. paratuberculosis
gauuaggucgguggc

SEQ ID NO: 2842605 - RNA, 14 nt, Mycobacterium avium subsp. paratuberculosis
gauucaccagcgcc

SEQ ID NO: 2842606 - RNA, 18 nt, Mycobacterium avium subsp. paratuberculosis
gauucagccggcgggcgc

SEQ ID NO: 2842607 - RNA, 14 nt, Mycobacterium avium subsp. paratuberculosis
gauucaucgccgaa

SEQ ID NO: 2842608 - RNA, 18 nt, Mycobacterium avium subsp. paratuberculosis
gauuccagaucugucuuc

SEQ ID NO: 2842609 - RNA, 17 nt, Mycobacterium avium subsp. paratuberculosis
gauuccagcgcgaccgc

SEQ ID NO: 2842610 - RNA, 13 nt, Mycobacterium avium subsp. paratuberculosis
gauuccagcgcgu

SEQ ID NO: 2842611 - RNA, 14 nt, Mycobacterium avium subsp. paratuberculosis
gauuccauccggga

SEQ ID NO: 2842612 - RNA, 14 nt, Mycobacterium avium subsp. paratuberculosis
gauucccgaccccg

SEQ ID NO: 2842613 - RNA, 20 nt, Mycobacterium avium subsp. paratuberculosis
gauucccgaccccgccagca

SEQ ID NO: 2842614 - RNA, 21 nt, Mycobacterium avium subsp. paratuberculosis
gauucccgaccccgccagcac

SEQ ID NO: 2842615 - RNA, 14 nt, Mycobacterium avium subsp. paratuberculosis
gauucccgccggau

SEQ ID NO: 2842616 - RNA, 23 nt, Mycobacterium avium subsp. paratuberculosis
gauucccggaugcugcgggucag

SEQ ID NO: 2842617 - RNA, 16 nt, Mycobacterium avium subsp. paratuberculosis
gauuccggcacccgcc

SEQ ID NO: 2842618 - RNA, 17 nt, Mycobacterium avium subsp. paratuberculosis
gauuccggcacccgcca

SEQ ID NO: 2842619 - RNA, 20 nt, Mycobacterium avium subsp. paratuberculosis
gauuccggcacccgccagcc

SEQ ID NO: 2842620 - RNA, 16 nt, Mycobacterium avium subsp. paratuberculosis
gauuccgucggcggcc

SEQ ID NO: 2842621 - RNA, 17 nt, Mycobacterium avium subsp. paratuberculosis
gauuccgucggcggccg

SEQ ID NO: 2842622 - RNA, 19 nt, Mycobacterium avium subsp. paratuberculosis
gauucgaucaaaucccgca

SEQ ID NO: 2842623 - RNA, 17 nt, Mycobacterium avium subsp. paratuberculosis
gauucgcggccaccacc

SEQ ID NO: 2842624 - RNA, 18 nt, Mycobacterium avium subsp. paratuberculosis
gcaacagcgcgccggccg

SEQ ID NO: 2842625 - RNA, 21 nt, Mycobacterium avium subsp. paratuberculosis
gcaacagcgcgccggccggca

SEQ ID NO: 2842626 - RNA, 18 nt, Mycobacterium avium subsp. paratuberculosis
gcaacagcgucucgacgg

SEQ ID NO: 2842627 - RNA, 21 nt, Mycobacterium avium subsp. paratuberculosis
gcaacagcgugcacacccgca

SEQ ID NO: 2842628 - RNA, 23 nt, Mycobacterium avium subsp. paratuberculosis
gcaacagcgugcacacccgcagc

SEQ ID NO: 2842629 - RNA, 20 nt, Mycobacterium avium subsp. paratuberculosis
gcaacagggccaccgcguag

SEQ ID NO: 2842630 - RNA, 19 nt, Mycobacterium avium subsp. paratuberculosis
gcaacagguuucgcucguc

SEQ ID NO: 2842631 - RNA, 21 nt, Mycobacterium avium subsp. paratuberculosis
gcaacagguuucgcucgucgg

SEQ ID NO: 2842632 - RNA, 22 nt, Mycobacterium avium subsp. paratuberculosis
gcaacagguuucgcucgucggc

SEQ ID NO: 2842633 - RNA, 23 nt, Mycobacterium avium subsp. paratuberculosis
gcaacagguuucgcucgucggcg

SEQ ID NO: 2842634 - RNA, 19 nt, Mycobacterium avium subsp. paratuberculosis
gcaacaucgucaacaugcu

SEQ ID NO: 2842635 - RNA, 18 nt, Mycobacterium avium subsp. paratuberculosis
gcaacaugauuccgccgg

SEQ ID NO: 2842636 - RNA, 21 nt, Mycobacterium avium subsp. paratuberculosis
gcaacaugauuccgccgggcg

SEQ ID NO: 2842637 - RNA, 22 nt, Mycobacterium avium subsp. paratuberculosis
gcaacaugauuccgccgggcgg

SEQ ID NO: 2842638 - RNA, 14 nt, Mycobacterium avium subsp. paratuberculosis
gcaaccacagcggc

SEQ ID NO: 2842639 - RNA, 16 nt, Mycobacterium avium subsp. paratuberculosis
gcaaccacagcggcgc

SEQ ID NO: 2842640 - RNA, 18 nt, Mycobacterium avium subsp. paratuberculosis
gcaaccacuuucgcgagc

SEQ ID NO: 2842641 - RNA, 21 nt, Mycobacterium avium subsp. paratuberculosis
gcaaccagugcacgcucggcg

SEQ ID NO: 2842642 - RNA, 20 nt, Mycobacterium avium subsp. paratuberculosis
gcaacccgaccucgucgacg

SEQ ID NO: 2842643 - RNA, 14 nt, Mycobacterium avium subsp. paratuberculosis
gcaacccgccgagc

SEQ ID NO: 2842644 - RNA, 22 nt, Mycobacterium avium subsp. paratuberculosis
gcaacccgccgagcgugaaacu

SEQ ID NO: 2842645 - RNA, 16 nt, Mycobacterium avium subsp. paratuberculosis
gcaaccgaaucgagcc

SEQ ID NO: 2842646 - RNA, 18 nt, Mycobacterium avium subsp. paratuberculosis
gcaaccgcagcaucuugg

SEQ ID NO: 2842647 - RNA, 16 nt, Mycobacterium avium subsp. paratuberculosis
gcaaccgccacgacgc

SEQ ID NO: 2842648 - RNA, 14 nt, Mycobacterium avium subsp. paratuberculosis
gcaaccgccggcag

SEQ ID NO: 2842649 - RNA, 18 nt, Mycobacterium avium subsp. paratuberculosis
gcaaccgccggcagcggc

SEQ ID NO: 2842650 - RNA, 19 nt, Mycobacterium avium subsp. paratuberculosis
gcaaccgccggcagcggcu

SEQ ID NO: 2842651 - RNA, 18 nt, Mycobacterium avium subsp. paratuberculosis
gcaaccgcggcggcggcc

SEQ ID NO: 2842652 - RNA, 21 nt, Mycobacterium avium subsp. paratuberculosis
gcaaccgcggcggcggcccgu

SEQ ID NO: 2842653 - RNA, 21 nt, Mycobacterium avium subsp. paratuberculosis
gcaaccggaauggcagcagcc

SEQ ID NO: 2842654 - RNA, 23 nt, Mycobacterium avium subsp. paratuberculosis
gcaaccggaauggcagcagccgg

SEQ ID NO: 2842655 - RNA, 14 nt, Mycobacterium avium subsp. paratuberculosis
gcaaccggcggcug

SEQ ID NO: 2842656 - RNA, 19 nt, Mycobacterium avium subsp. paratuberculosis
gcaaccgggauaccgcgac

SEQ ID NO: 2842657 - RNA, 21 nt, Mycobacterium avium subsp. paratuberculosis
gcaaccgggauaccgcgaccg

SEQ ID NO: 2842658 - RNA, 16 nt, Mycobacterium avium subsp. paratuberculosis
gcaaccgggccgcacc

SEQ ID NO: 2842659 - RNA, 15 nt, Mycobacterium avium subsp. paratuberculosis
gcaaccgguccaguc

SEQ ID NO: 2842660 - RNA, 13 nt, Mycobacterium avium subsp. paratuberculosis
gcaaccgguucgg

SEQ ID NO: 2842661 - RNA, 21 nt, Mycobacterium avium subsp. paratuberculosis
gcaaccgguucggacacggcg

SEQ ID NO: 2842662 - RNA, 22 nt, Mycobacterium avium subsp. paratuberculosis
gcaaccgguucggacacggcgc

SEQ ID NO: 2842663 - RNA, 18 nt, Mycobacterium avium subsp. paratuberculosis
gcaaccugggcggcggcg

SEQ ID NO: 2842664 - RNA, 19 nt, Mycobacterium avium subsp. paratuberculosis
gcaaccuucuuggccggag

SEQ ID NO: 2842665 - RNA, 20 nt, Mycobacterium avium subsp. paratuberculosis
gcaaccuucuuggccggagc

SEQ ID NO: 2842666 - RNA, 21 nt, Mycobacterium avium subsp. paratuberculosis
gcaaccuucuuggccggagcc

SEQ ID NO: 2842667 - RNA, 23 nt, Mycobacterium avium subsp. paratuberculosis
gcaaccuucuuggccggagccuu

SEQ ID NO: 2842668 - RNA, 15 nt, Mycobacterium avium subsp. paratuberculosis
gcaacgaacgcggcg

SEQ ID NO: 2842669 - RNA, 14 nt, Mycobacterium avium subsp. paratuberculosis
gcaacgacccggcc

SEQ ID NO: 2842670 - RNA, 23 nt, Mycobacterium avium subsp. paratuberculosis
gcaacgacccggccaccgccgcc

SEQ ID NO: 2842671 - RNA, 14 nt, Mycobacterium avium subsp. paratuberculosis
gcaacgacgaaguc

SEQ ID NO: 2842672 - RNA, 16 nt, Mycobacterium avium subsp. paratuberculosis
gcaacgacgaagucgg

SEQ ID NO: 2842673 - RNA, 23 nt, Mycobacterium avium subsp. paratuberculosis
gcaacgaggcgguggugauggac

SEQ ID NO: 2842674 - RNA, 16 nt, Mycobacterium avium subsp. paratuberculosis
gcaacgauucacccag

SEQ ID NO: 2842675 - RNA, 20 nt, Mycobacterium avium subsp. paratuberculosis
gcaacgauucacccagcgag

SEQ ID NO: 2842676 - RNA, 14 nt, Mycobacterium avium subsp. paratuberculosis
gcaacgccagccag

SEQ ID NO: 2842677 - RNA, 19 nt, Mycobacterium avium subsp. paratuberculosis
gcaacgccagcgcgacccg

SEQ ID NO: 2842678 - RNA, 22 nt, Mycobacterium avium subsp. paratuberculosis
gcaacgccagggccccguuggu

SEQ ID NO: 2842679 - RNA, 14 nt, Mycobacterium avium subsp. paratuberculosis
gcaacgccgccgac

SEQ ID NO: 2842680 - RNA, 12 nt, Mycobacterium avium subsp. paratuberculosis
gcaacgccggcg

SEQ ID NO: 2842681 - RNA, 13 nt, Mycobacterium avium subsp. paratuberculosis
gcaacgccggcgu

SEQ ID NO: 2842682 - RNA, 13 nt, Mycobacterium avium subsp. paratuberculosis
gcaacgccggucu

SEQ ID NO: 2842683 - RNA, 13 nt, Mycobacterium avium subsp. paratuberculosis
gcaacgcgccggc

SEQ ID NO: 2842684 - RNA, 14 nt, Mycobacterium avium subsp. paratuberculosis
gcaacgcgccggcg

SEQ ID NO: 2842685 - RNA, 17 nt, Mycobacterium avium subsp. paratuberculosis
gcaacgcgccggcgguc

SEQ ID NO: 2842686 - RNA, 18 nt, Mycobacterium avium subsp. paratuberculosis
gcaacgcgccggcggucg

SEQ ID NO: 2842687 - RNA, 19 nt, Mycobacterium avium subsp. paratuberculosis
gcaacgcgccggcggucga

SEQ ID NO: 2842688 - RNA, 16 nt, Mycobacterium avium subsp. paratuberculosis
gcaacgcgcgcgacgg

SEQ ID NO: 2842689 - RNA, 21 nt, Mycobacterium avium subsp. paratuberculosis
gcaacgcgcgcgacggcgcgu

SEQ ID NO: 2842690 - RNA, 22 nt, Mycobacterium avium subsp. paratuberculosis
gcaacgcgcgcgacggcgcgug

SEQ ID NO: 2842691 - RNA, 23 nt, Mycobacterium avium subsp. paratuberculosis
gcaacgcggcggugacgaacccg

SEQ ID NO: 2842692 - RNA, 14 nt, Mycobacterium avium subsp. paratuberculosis
gcaacgcugaccgc

SEQ ID NO: 2842693 - RNA, 18 nt, Mycobacterium avium subsp. paratuberculosis
gcaacgcugaccgcagga

SEQ ID NO: 2842694 - RNA, 21 nt, Mycobacterium avium subsp. paratuberculosis
gcaacgcuuucgggucgacga

SEQ ID NO: 2842695 - RNA, 23 nt, Mycobacterium avium subsp. paratuberculosis
gcaacgcuuucgggucgacgagc

SEQ ID NO: 2842696 - RNA, 13 nt, Mycobacterium avium subsp. paratuberculosis
gcaacggccauga

SEQ ID NO: 2842697 - RNA, 14 nt, Mycobacterium avium subsp. paratuberculosis
gcaacggcggcggc

SEQ ID NO: 2842698 - RNA, 16 nt, Mycobacterium avium subsp. paratuberculosis
gcaacggcggcggcac

SEQ ID NO: 2842699 - RNA, 16 nt, Mycobacterium avium subsp. paratuberculosis
gcaacggcggucgugc

SEQ ID NO: 2842700 - RNA, 13 nt, Mycobacterium avium subsp. paratuberculosis
gcaacggcuggcg

SEQ ID NO: 2842701 - RNA, 15 nt, Mycobacterium avium subsp. paratuberculosis
gcaacggcuggcgca

SEQ ID NO: 2842702 - RNA, 16 nt, Mycobacterium avium subsp. paratuberculosis
gcaacggcuggcgcag

SEQ ID NO: 2842703 - RNA, 17 nt, Mycobacterium avium subsp. paratuberculosis
gcaacggcuggcgcagg

SEQ ID NO: 2842704 - RNA, 21 nt, Mycobacterium avium subsp. paratuberculosis
gcaacgggccgcagccgcgcg

SEQ ID NO: 2842705 - RNA, 16 nt, Mycobacterium avium subsp. paratuberculosis
gcaacgguacgugcgc

SEQ ID NO: 2842706 - RNA, 19 nt, Mycobacterium avium subsp. paratuberculosis
gcaacgguacgugcgccgg

SEQ ID NO: 2842707 - RNA, 20 nt, Mycobacterium avium subsp. paratuberculosis
gcaacgguacgugcgccggc

SEQ ID NO: 2842708 - RNA, 21 nt, Mycobacterium avium subsp. paratuberculosis
gcaauucggugacggcgucgg

SEQ ID NO: 2842709 - RNA, 13 nt, Mycobacterium avium subsp. paratuberculosis
gcacaacagccau

SEQ ID NO: 2842710 - RNA, 20 nt, Mycobacterium avium subsp. paratuberculosis
gcacaacccgcccgggucgu

SEQ ID NO: 2842711 - RNA, 22 nt, Mycobacterium avium subsp. paratuberculosis
gcacaacgaggcccggacggcc

SEQ ID NO: 2842712 - RNA, 16 nt, Mycobacterium avium subsp. paratuberculosis
gcacaacgccuccgaa

SEQ ID NO: 2842713 - RNA, 16 nt, Mycobacterium avium subsp. paratuberculosis
gcacaauccggucagc

SEQ ID NO: 2842714 - RNA, 17 nt, Mycobacterium avium subsp. paratuberculosis
gcacaauccggucagcg

SEQ ID NO: 2842715 - RNA, 20 nt, Mycobacterium avium subsp. paratuberculosis
gcacaauccggucagcgugg

SEQ ID NO: 2842716 - RNA, 16 nt, Mycobacterium avium subsp. paratuberculosis
gcacacacaggucgcc

SEQ ID NO: 2842717 - RNA, 21 nt, Mycobacterium avium subsp. paratuberculosis
gcacacacaggucgcccggcu

SEQ ID NO: 2842718 - RNA, 18 nt, Mycobacterium avium subsp. paratuberculosis
gcacacaccguaccgagg

SEQ ID NO: 2842719 - RNA, 19 nt, Mycobacterium avium subsp. paratuberculosis
gcacacagcagcagcacca

SEQ ID NO: 2842720 - RNA, 16 nt, Mycobacterium avium subsp. paratuberculosis
gcacacagcgugaccc

SEQ ID NO: 2842721 - RNA, 19 nt, Mycobacterium avium subsp. paratuberculosis
gcacacagcgugacccugc

SEQ ID NO: 2842722 - RNA, 14 nt, Mycobacterium avium subsp. paratuberculosis
gcacaccaccagcg

SEQ ID NO: 2842723 - RNA, 20 nt, Mycobacterium avium subsp. paratuberculosis
gcacaccaccgacgcgucgc

SEQ ID NO: 2842724 - RNA, 13 nt, Mycobacterium avium subsp. paratuberculosis
gcacaccagcacg

SEQ ID NO: 2842725 - RNA, 16 nt, Mycobacterium avium subsp. paratuberculosis
gcacaccagcacggcg

SEQ ID NO: 2842726 - RNA, 17 nt, Mycobacterium avium subsp. paratuberculosis
gcacaccagcacggcgg

SEQ ID NO: 2842727 - RNA, 17 nt, Mycobacterium avium subsp. paratuberculosis
gcacaccagcguucguc

SEQ ID NO: 2842728 - RNA, 23 nt, Mycobacterium avium subsp. paratuberculosis
gcacaccagcguucgucgccggu

SEQ ID NO: 2842729 - RNA, 15 nt, Mycobacterium avium subsp. paratuberculosis
gcacaccagguaggc

SEQ ID NO: 2842730 - RNA, 14 nt, Mycobacterium avium subsp. paratuberculosis
gcacacccagcgag

SEQ ID NO: 2842731 - RNA, 15 nt, Mycobacterium avium subsp. paratuberculosis
gcacacccagcgagc

SEQ ID NO: 2842732 - RNA, 11 nt, Mycobacterium avium subsp. paratuberculosis
gcacacccggu

SEQ ID NO: 2842733 - RNA, 14 nt, Mycobacterium avium subsp. paratuberculosis
gcacacccggugcg

SEQ ID NO: 2842734 - RNA, 18 nt, Mycobacterium avium subsp. paratuberculosis
gcacacccggugcgccgg

SEQ ID NO: 2842735 - RNA, 23 nt, Mycobacterium avium subsp. paratuberculosis
gcacacccucaccccgcccagcg

SEQ ID NO: 2842736 - RNA, 13 nt, Mycobacterium avium subsp. paratuberculosis
gcacaccgcgcag

SEQ ID NO: 2842737 - RNA, 18 nt, Mycobacterium avium subsp. paratuberculosis
gcacaccgcgcagaaccg

SEQ ID NO: 2842738 - RNA, 13 nt, Mycobacterium avium subsp. paratuberculosis
gcacaccgcgcga

SEQ ID NO: 2842739 - RNA, 13 nt, Mycobacterium avium subsp. paratuberculosis
gcacaccgcgcgc

SEQ ID NO: 2842740 - RNA, 15 nt, Mycobacterium avium subsp. paratuberculosis
gcacaccgcggcggc

SEQ ID NO: 2842741 - RNA, 16 nt, Mycobacterium avium subsp. paratuberculosis
gcacaccgcggcggcg

SEQ ID NO: 2842742 - RNA, 16 nt, Mycobacterium avium subsp. paratuberculosis
gcacaccggaucggcu

SEQ ID NO: 2842743 - RNA, 13 nt, Mycobacterium avium subsp. paratuberculosis
gcacaccggugcu

SEQ ID NO: 2842744 - RNA, 15 nt, Mycobacterium avium subsp. paratuberculosis
gcacaccgucgcccg

SEQ ID NO: 2842745 - RNA, 18 nt, Mycobacterium avium subsp. paratuberculosis
gcacaccgucgcccgccc

SEQ ID NO: 2842746 - RNA, 17 nt, Mycobacterium avium subsp. paratuberculosis
gcacaccgucucccacg

SEQ ID NO: 2842747 - RNA, 19 nt, Mycobacterium avium subsp. paratuberculosis
gcacaccguucccaccggc

SEQ ID NO: 2842748 - RNA, 18 nt, Mycobacterium avium subsp. paratuberculosis
gcacaccuuccaccaccg

SEQ ID NO: 2842749 - RNA, 22 nt, Mycobacterium avium subsp. paratuberculosis
gcacaccuuccaccaccgcggc

SEQ ID NO: 2842750 - RNA, 23 nt, Mycobacterium avium subsp. paratuberculosis
gcacaccuuccaccaccgcggcg

SEQ ID NO: 2842751 - RNA, 18 nt, Mycobacterium avium subsp. paratuberculosis
gcacacgaacaccggcgg

SEQ ID NO: 2842752 - RNA, 17 nt, Mycobacterium avium subsp. paratuberculosis
gcacacgaucucguagg

SEQ ID NO: 2842753 - RNA, 18 nt, Mycobacterium avium subsp. paratuberculosis
gcacacgcggacagggcg

SEQ ID NO: 2842754 - RNA, 20 nt, Mycobacterium avium subsp. paratuberculosis
gcacacgcggacagggcggc

SEQ ID NO: 2842755 - RNA, 19 nt, Mycobacterium avium subsp. paratuberculosis
gcacacggccucgcccagc

SEQ ID NO: 2842756 - RNA, 23 nt, Mycobacterium avium subsp. paratuberculosis
gcacacggccucgcccagcgccg

SEQ ID NO: 2842757 - RNA, 23 nt, Mycobacterium avium subsp. paratuberculosis
gcacacuuccgggaagucgucgu

SEQ ID NO: 2842758 - RNA, 16 nt, Mycobacterium avium subsp. paratuberculosis
gcacagauacgcgacg

SEQ ID NO: 2842759 - RNA, 21 nt, Mycobacterium avium subsp. paratuberculosis
gcacagaucgucucggccagc

SEQ ID NO: 2842760 - RNA, 22 nt, Mycobacterium avium subsp. paratuberculosis
gcacagaucgucucggccagcc

SEQ ID NO: 2842761 - RNA, 13 nt, Mycobacterium avium subsp. paratuberculosis
gcacagcaccagu

SEQ ID NO: 2842762 - RNA, 18 nt, Mycobacterium avium subsp. paratuberculosis
gcacagcaccaguugcac

SEQ ID NO: 2842763 - RNA, 22 nt, Mycobacterium avium subsp. paratuberculosis
gcacagcaccaguugcaccggc

SEQ ID NO: 2842764 - RNA, 19 nt, Mycobacterium avium subsp. paratuberculosis
gcacagcagcacguugucg

SEQ ID NO: 2842765 - RNA, 18 nt, Mycobacterium avium subsp. paratuberculosis
gcacagcagggcaccgac

SEQ ID NO: 2842766 - RNA, 21 nt, Mycobacterium avium subsp. paratuberculosis
gcacagcagggcaccgacggc

SEQ ID NO: 2842767 - RNA, 22 nt, Mycobacterium avium subsp. paratuberculosis
gcacagcauguccucggggugg

SEQ ID NO: 2842768 - RNA, 13 nt, Mycobacterium avium subsp. paratuberculosis
gcacagccagcgc

SEQ ID NO: 2842769 - RNA, 14 nt, Mycobacterium avium subsp. paratuberculosis
gcacagccagcgcc

SEQ ID NO: 2842770 - RNA, 15 nt, Mycobacterium avium subsp. paratuberculosis
gcacagccagcgccc

SEQ ID NO: 2842771 - RNA, 22 nt, Mycobacterium avium subsp. paratuberculosis
gcacagccagcgcccggcgacc

SEQ ID NO: 2842772 - RNA, 16 nt, Mycobacterium avium subsp. paratuberculosis
gcacagccgcagcagc

SEQ ID NO: 2842773 - RNA, 18 nt, Mycobacterium avium subsp. paratuberculosis
gcacagccgcagcagccg

SEQ ID NO: 2842774 - RNA, 21 nt, Mycobacterium avium subsp. paratuberculosis
gcacagccggcgcgcgguggu

SEQ ID NO: 2842775 - RNA, 13 nt, Mycobacterium avium subsp. paratuberculosis
gcacagccggcgg

SEQ ID NO: 2842776 - RNA, 14 nt, Mycobacterium avium subsp. paratuberculosis
gcacagccggcggc

SEQ ID NO: 2842777 - RNA, 15 nt, Mycobacterium avium subsp. paratuberculosis
gcacagccggcggcg

SEQ ID NO: 2842778 - RNA, 23 nt, Mycobacterium avium subsp. paratuberculosis
gcacagccggcggcggcggucgg

SEQ ID NO: 2842779 - RNA, 11 nt, Mycobacterium avium subsp. paratuberculosis
gcacagccguc

SEQ ID NO: 2842780 - RNA, 19 nt, Mycobacterium avium subsp. paratuberculosis
gcacagcgaaagcgcuugg

SEQ ID NO: 2842781 - RNA, 21 nt, Mycobacterium avium subsp. paratuberculosis
gcacagcgaaagcgcuuggcg

SEQ ID NO: 2842782 - RNA, 17 nt, Mycobacterium avium subsp. paratuberculosis
gcacagcgaggcgacgu

SEQ ID NO: 2842783 - RNA, 20 nt, Mycobacterium avium subsp. paratuberculosis
gcacagcgaggcgacgucga

SEQ ID NO: 2842784 - RNA, 12 nt, Mycobacterium avium subsp. paratuberculosis
gcacagcgccac

SEQ ID NO: 2842785 - RNA, 13 nt, Mycobacterium avium subsp. paratuberculosis
gcacagcgccaca

SEQ ID NO: 2842786 - RNA, 14 nt, Mycobacterium avium subsp. paratuberculosis
gcacagcgccgcgu

SEQ ID NO: 2842787 - RNA, 19 nt, Mycobacterium avium subsp. paratuberculosis
gcacagcgccgcguugucg

SEQ ID NO: 2842788 - RNA, 23 nt, Mycobacterium avium subsp. paratuberculosis
gcacagcgccgcguugucggcgu

SEQ ID NO: 2842789 - RNA, 12 nt, Mycobacterium avium subsp. paratuberculosis
gcacagcggcgg

SEQ ID NO: 2842790 - RNA, 15 nt, Mycobacterium avium subsp. paratuberculosis
gcacagcggcggaug

SEQ ID NO: 2842791 - RNA, 18 nt, Mycobacterium avium subsp. paratuberculosis
gcacagcgggaucccagu

SEQ ID NO: 2842792 - RNA, 23 nt, Mycobacterium avium subsp. paratuberculosis
gcacagcuaggucguggcgccga

SEQ ID NO: 2842793 - RNA, 13 nt, Mycobacterium avium subsp. paratuberculosis
gcaccacggcccg

SEQ ID NO: 2842794 - RNA, 14 nt, Mycobacterium avium subsp. paratuberculosis
gcaccacggcccgc

SEQ ID NO: 2842795 - RNA, 18 nt, Mycobacterium avium subsp. paratuberculosis
gcaccacggcccgcgccc

SEQ ID NO: 2842796 - RNA, 13 nt, Mycobacterium avium subsp. paratuberculosis
gcaccacggcggc

SEQ ID NO: 2842797 - RNA, 15 nt, Mycobacterium avium subsp. paratuberculosis
gcaccacggcggcau

SEQ ID NO: 2842798 - RNA, 16 nt, Mycobacterium avium subsp. paratuberculosis
gcaccacggcggcaug

SEQ ID NO: 2842799 - RNA, 20 nt, Mycobacterium avium subsp. paratuberculosis
gcaccacggcggcauguucg

SEQ ID NO: 2842800 - RNA, 21 nt, Mycobacterium avium subsp. paratuberculosis
gcaccacggugaucucgccga

SEQ ID NO: 2842801 - RNA, 23 nt, Mycobacterium avium subsp. paratuberculosis
gcaccacggugaucucgccgagc

SEQ ID NO: 2842802 - RNA, 16 nt, Mycobacterium avium subsp. paratuberculosis
gcaccacgguggcgcc

SEQ ID NO: 2842803 - RNA, 17 nt, Mycobacterium avium subsp. paratuberculosis
gcaccacgguggcgccg

SEQ ID NO: 2842804 - RNA, 15 nt, Mycobacterium avium subsp. paratuberculosis
gcaccacguccacca

SEQ ID NO: 2842805 - RNA, 17 nt, Mycobacterium avium subsp. paratuberculosis
gcaccacguccaccagc

SEQ ID NO: 2842806 - RNA, 21 nt, Mycobacterium avium subsp. paratuberculosis
gcaccacguccgcggugagca

SEQ ID NO: 2842807 - RNA, 23 nt, Mycobacterium avium subsp. paratuberculosis
gcaccacgucggguucgccggug

SEQ ID NO: 2842808 - RNA, 18 nt, Mycobacterium avium subsp. paratuberculosis
gcaccacgugcgcgaagc

SEQ ID NO: 2842809 - RNA, 20 nt, Mycobacterium avium subsp. paratuberculosis
gcaccacguugcgcccggcc

SEQ ID NO: 2842810 - RNA, 14 nt, Mycobacterium avium subsp. paratuberculosis
gcaccacuuccagc

SEQ ID NO: 2842811 - RNA, 18 nt, Mycobacterium avium subsp. paratuberculosis
gcaccacuuccagcaccg

SEQ ID NO: 2842812 - RNA, 20 nt, Mycobacterium avium subsp. paratuberculosis
gcaccagaacacguuucggc

SEQ ID NO: 2842813 - RNA, 17 nt, Mycobacterium avium subsp. paratuberculosis
gcaccagagcgccggac

SEQ ID NO: 2842814 - RNA, 17 nt, Mycobacterium avium subsp. paratuberculosis
gcaccagauucaccagc

SEQ ID NO: 2842815 - RNA, 19 nt, Mycobacterium avium subsp. paratuberculosis
gcaccagauucaccagcgc

SEQ ID NO: 2842816 - RNA, 20 nt, Mycobacterium avium subsp. paratuberculosis
gcaccagauucaccagcgcc

SEQ ID NO: 2842817 - RNA, 19 nt, Mycobacterium avium subsp. paratuberculosis
gcaccagcaacaccagggu

SEQ ID NO: 2842818 - RNA, 14 nt, Mycobacterium avium subsp. paratuberculosis
gcaccagcaccacc

SEQ ID NO: 2842819 - RNA, 18 nt, Mycobacterium avium subsp. paratuberculosis
gcaccagcaccaccgugg

SEQ ID NO: 2842820 - RNA, 22 nt, Mycobacterium avium subsp. paratuberculosis
gcaccagcaccccgccgcagcc

SEQ ID NO: 2842821 - RNA, 18 nt, Mycobacterium avium subsp. paratuberculosis
gcaccagcacgacaccga

SEQ ID NO: 2842822 - RNA, 20 nt, Mycobacterium avium subsp. paratuberculosis
gcaccagcacgacaccgacg

SEQ ID NO: 2842823 - RNA, 10 nt, Mycobacterium avium subsp. paratuberculosis
gcaccagcag

SEQ ID NO: 2842824 - RNA, 11 nt, Mycobacterium avium subsp. paratuberculosis
gcaccagcagc

SEQ ID NO: 2842825 - RNA, 13 nt, Mycobacterium avium subsp. paratuberculosis
gcaccagcagcca

SEQ ID NO: 2842826 - RNA, 17 nt, Mycobacterium avium subsp. paratuberculosis
gcaccagcagccgcagc

SEQ ID NO: 2842827 - RNA, 18 nt, Mycobacterium avium subsp. paratuberculosis
gcaccagcagccgcagcg

SEQ ID NO: 2842828 - RNA, 21 nt, Mycobacterium avium subsp. paratuberculosis
gcaccagcagccgcagcgcgc

SEQ ID NO: 2842829 - RNA, 15 nt, Mycobacterium avium subsp. paratuberculosis
gcaccagcagccggu

SEQ ID NO: 2842830 - RNA, 22 nt, Mycobacterium avium subsp. paratuberculosis
gcaccagcagccggucgagguc

SEQ ID NO: 2842831 - RNA, 14 nt, Mycobacterium avium subsp. paratuberculosis
gcaccagcagcgcg

SEQ ID NO: 2842832 - RNA, 16 nt, Mycobacterium avium subsp. paratuberculosis
gcaccagcagcgcgac

SEQ ID NO: 2842833 - RNA, 17 nt, Mycobacterium avium subsp. paratuberculosis
gcaccagcagcgcgacg

SEQ ID NO: 2842834 - RNA, 22 nt, Mycobacterium avium subsp. paratuberculosis
gcaccagcagcgcgacgccgac

SEQ ID NO: 2842835 - RNA, 21 nt, Mycobacterium avium subsp. paratuberculosis
gcaccagcaggccccguucgg

SEQ ID NO: 2842836 - RNA, 22 nt, Mycobacterium avium subsp. paratuberculosis
gcaccagcaggccccguucggu

SEQ ID NO: 2842837 - RNA, 13 nt, Mycobacterium avium subsp. paratuberculosis
gcaccagcagguc

SEQ ID NO: 2842838 - RNA, 19 nt, Mycobacterium avium subsp. paratuberculosis
gcaccagcccgaugccgcc

SEQ ID NO: 2842839 - RNA, 13 nt, Mycobacterium avium subsp. paratuberculosis
gcaccagcccgcc

SEQ ID NO: 2842840 - RNA, 16 nt, Mycobacterium avium subsp. paratuberculosis
gcaccagcccgccguc

SEQ ID NO: 2842841 - RNA, 17 nt, Mycobacterium avium subsp. paratuberculosis
gcaccagcccgccgucg

SEQ ID NO: 2842842 - RNA, 21 nt, Mycobacterium avium subsp. paratuberculosis
gcaccagcccgccgucggcau

SEQ ID NO: 2842843 - RNA, 17 nt, Mycobacterium avium subsp. paratuberculosis
gcaccagcccggccagc

SEQ ID NO: 2842844 - RNA, 18 nt, Mycobacterium avium subsp. paratuberculosis
gcaccagcccgucggccu

SEQ ID NO: 2842845 - RNA, 17 nt, Mycobacterium avium subsp. paratuberculosis
gcaccagcgacagcacc

SEQ ID NO: 2842846 - RNA, 19 nt, Mycobacterium avium subsp. paratuberculosis
gcaccagcgacagcacccg

SEQ ID NO: 2842847 - RNA, 16 nt, Mycobacterium avium subsp. paratuberculosis
gcaccagcgauccggc

SEQ ID NO: 2842848 - RNA, 19 nt, Mycobacterium avium subsp. paratuberculosis
gcaccagcgauccggcgcg

SEQ ID NO: 2842849 - RNA, 12 nt, Mycobacterium avium subsp. paratuberculosis
gcaccagcgccg

SEQ ID NO: 2842850 - RNA, 13 nt, Mycobacterium avium subsp. paratuberculosis
gcaccagcgccgc

SEQ ID NO: 2842851 - RNA, 14 nt, Mycobacterium avium subsp. paratuberculosis
gcaccagcgccgcg

SEQ ID NO: 2842852 - RNA, 16 nt, Mycobacterium avium subsp. paratuberculosis
gcaccagcgccgcgau

SEQ ID NO: 2842853 - RNA, 17 nt, Mycobacterium avium subsp. paratuberculosis
gcaccagcgccgcgaug

SEQ ID NO: 2842854 - RNA, 19 nt, Mycobacterium avium subsp. paratuberculosis
gcaccagcgccgcgaugau

SEQ ID NO: 2842855 - RNA, 13 nt, Mycobacterium avium subsp. paratuberculosis
gcaccagcgcgac

SEQ ID NO: 2842856 - RNA, 16 nt, Mycobacterium avium subsp. paratuberculosis
gcaccagcgcgacggu

SEQ ID NO: 2842857 - RNA, 24 nt, Mycobacterium avium subsp. paratuberculosis
gcaccagcgcuuucgcgcacgcca

SEQ ID NO: 2842858 - RNA, 15 nt, Mycobacterium avium subsp. paratuberculosis
gcaccagcggacccu

SEQ ID NO: 2842859 - RNA, 21 nt, Mycobacterium avium subsp. paratuberculosis
gcaccagcggacccuucagcc

SEQ ID NO: 2842860 - RNA, 12 nt, Mycobacterium avium subsp. paratuberculosis
gcaccagcggca

SEQ ID NO: 2842861 - RNA, 19 nt, Mycobacterium avium subsp. paratuberculosis
gcaccagcggcaccaggua

SEQ ID NO: 2842862 - RNA, 15 nt, Mycobacterium avium subsp. paratuberculosis
gcaccagcggcaucg

SEQ ID NO: 2842863 - RNA, 18 nt, Mycobacterium avium subsp. paratuberculosis
gcaccagcggcaucgccg

SEQ ID NO: 2842864 - RNA, 20 nt, Mycobacterium avium subsp. paratuberculosis
gcaccagcggcaucgccgcc

SEQ ID NO: 2842865 - RNA, 13 nt, Mycobacterium avium subsp. paratuberculosis
gcaccagcggcgc

SEQ ID NO: 2842866 - RNA, 15 nt, Mycobacterium avium subsp. paratuberculosis
gcaccagcggcgccc

SEQ ID NO: 2842867 - RNA, 16 nt, Mycobacterium avium subsp. paratuberculosis
gcaccagcggcgccca

SEQ ID NO: 2842868 - RNA, 17 nt, Mycobacterium avium subsp. paratuberculosis
gcaccagcggcgcccac

SEQ ID NO: 2842869 - RNA, 20 nt, Mycobacterium avium subsp. paratuberculosis
gcaccagcggcgcccacggc

SEQ ID NO: 2842870 - RNA, 19 nt, Mycobacterium avium subsp. paratuberculosis
gcaccagcguggccggcag

SEQ ID NO: 2842871 - RNA, 13 nt, Mycobacterium avium subsp. paratuberculosis
gcaccagcguggu

SEQ ID NO: 2842872 - RNA, 20 nt, Mycobacterium avium subsp. paratuberculosis
gcaccagcguggugcgcccg

SEQ ID NO: 2842873 - RNA, 21 nt, Mycobacterium avium subsp. paratuberculosis
gcaccagcguggugcgcccgu

SEQ ID NO: 2842874 - RNA, 16 nt, Mycobacterium avium subsp. paratuberculosis
gcaccagcucgaggcc

SEQ ID NO: 2842875 - RNA, 22 nt, Mycobacterium avium subsp. paratuberculosis
gcaccagcucgaggccgcgggc

SEQ ID NO: 2842876 - RNA, 15 nt, Mycobacterium avium subsp. paratuberculosis
gcaccagcucggcgc

SEQ ID NO: 2842877 - RNA, 20 nt, Mycobacterium avium subsp. paratuberculosis
gcaccagcugauucgcggug

SEQ ID NO: 2842878 - RNA, 19 nt, Mycobacterium avium subsp. paratuberculosis
gcacccccagcucgacgac

SEQ ID NO: 2842879 - RNA, 20 nt, Mycobacterium avium subsp. paratuberculosis
gcacccccggggccuccagc

SEQ ID NO: 2842880 - RNA, 22 nt, Mycobacterium avium subsp. paratuberculosis
gcacccccggggccuccagcca

SEQ ID NO: 2842881 - RNA, 14 nt, Mycobacterium avium subsp. paratuberculosis
gcacccccuccaca

SEQ ID NO: 2842882 - RNA, 15 nt, Mycobacterium avium subsp. paratuberculosis
gcacccccuccacac

SEQ ID NO: 2842883 - RNA, 17 nt, Mycobacterium avium subsp. paratuberculosis
gcacccccuucuccacg

SEQ ID NO: 2842884 - RNA, 14 nt, Mycobacterium avium subsp. paratuberculosis
gcaccccgaaccgc

SEQ ID NO: 2842885 - RNA, 21 nt, Mycobacterium avium subsp. paratuberculosis
gcaccccgaucgcgaucaccg

SEQ ID NO: 2842886 - RNA, 13 nt, Mycobacterium avium subsp. paratuberculosis
gcaccccgccgca

SEQ ID NO: 2842887 - RNA, 21 nt, Mycobacterium avium subsp. paratuberculosis
gcaccccgccgcagcccaggc

SEQ ID NO: 2842888 - RNA, 16 nt, Mycobacterium avium subsp. paratuberculosis
gcaccccgcgccgggc

SEQ ID NO: 2842889 - RNA, 12 nt, Mycobacterium avium subsp. paratuberculosis
gcaccccgcggu

SEQ ID NO: 2842890 - RNA, 13 nt, Mycobacterium avium subsp. paratuberculosis
gcaccccggcaua

SEQ ID NO: 2842891 - RNA, 14 nt, Mycobacterium avium subsp. paratuberculosis
gcaccccggcggcc

SEQ ID NO: 2842892 - RNA, 16 nt, Mycobacterium avium subsp. paratuberculosis
gcaccccggcggccgc

SEQ ID NO: 2842893 - RNA, 18 nt, Mycobacterium avium subsp. paratuberculosis
gcaccccggcggccgcgu

SEQ ID NO: 2842894 - RNA, 21 nt, Mycobacterium avium subsp. paratuberculosis
gcaccccggcggccgcgucgg

SEQ ID NO: 2842895 - RNA, 14 nt, Mycobacterium avium subsp. paratuberculosis
gcaccccggucacc

SEQ ID NO: 2842896 - RNA, 21 nt, Mycobacterium avium subsp. paratuberculosis
gcaccccgguccaggcgaccg

SEQ ID NO: 2842897 - RNA, 23 nt, Mycobacterium avium subsp. paratuberculosis
gcaccccgguccaggcgaccggc

SEQ ID NO: 2842898 - RNA, 19 nt, Mycobacterium avium subsp. paratuberculosis
gcaccccgucgagcagccg

SEQ ID NO: 2842899 - RNA, 14 nt, Mycobacterium avium subsp. paratuberculosis
gcaccccgucgagg

SEQ ID NO: 2842900 - RNA, 12 nt, Mycobacterium avium subsp. paratuberculosis
gcaccccguggu

SEQ ID NO: 2842901 - RNA, 19 nt, Mycobacterium avium subsp. paratuberculosis
gcaccccgugguagacgcc

SEQ ID NO: 2842902 - RNA, 23 nt, Mycobacterium avium subsp. paratuberculosis
gcaccccgugguagacgccggac

SEQ ID NO: 2842903 - RNA, 24 nt, Mycobacterium avium subsp. paratuberculosis
gcaccccgugguagacgccggacg

SEQ ID NO: 2842904 - RNA, 13 nt, Mycobacterium avium subsp. paratuberculosis
gcaccccguugcc

SEQ ID NO: 2842905 - RNA, 20 nt, Mycobacterium avium subsp. paratuberculosis
gcaccccguugccgccggcg

SEQ ID NO: 2842906 - RNA, 16 nt, Mycobacterium avium subsp. paratuberculosis
gcaccccugccgccac

SEQ ID NO: 2842907 - RNA, 17 nt, Mycobacterium avium subsp. paratuberculosis
gcaccccugccgccacc

SEQ ID NO: 2842908 - RNA, 12 nt, Mycobacterium avium subsp. paratuberculosis
gcacccgacacg

SEQ ID NO: 2842909 - RNA, 15 nt, Mycobacterium avium subsp. paratuberculosis
gcacccgacacgccg

SEQ ID NO: 2842910 - RNA, 16 nt, Mycobacterium avium subsp. paratuberculosis
gcacccgacacgccga

SEQ ID NO: 2842911 - RNA, 19 nt, Mycobacterium avium subsp. paratuberculosis
gcacccgacacgccgaugu

SEQ ID NO: 2842912 - RNA, 17 nt, Mycobacterium avium subsp. paratuberculosis
gcacccgaccgacgccc

SEQ ID NO: 2842913 - RNA, 20 nt, Mycobacterium avium subsp. paratuberculosis
gcacccgaccgacgcccggc

SEQ ID NO: 2842914 - RNA, 21 nt, Mycobacterium avium subsp. paratuberculosis
gcacccgaccgacgcccggcu

SEQ ID NO: 2842915 - RNA, 14 nt, Mycobacterium avium subsp. paratuberculosis
gcacccgacuucgg

SEQ ID NO: 2842916 - RNA, 15 nt, Mycobacterium avium subsp. paratuberculosis
gcacccgacuucggc

SEQ ID NO: 2842917 - RNA, 18 nt, Mycobacterium avium subsp. paratuberculosis
gcacccgacuucggcucg

SEQ ID NO: 2842918 - RNA, 21 nt, Mycobacterium avium subsp. paratuberculosis
gcacccgacuucggcucggcg

SEQ ID NO: 2842919 - RNA, 22 nt, Mycobacterium avium subsp. paratuberculosis
gcacccgacuucggcucggcga

SEQ ID NO: 2842920 - RNA, 22 nt, Mycobacterium avium subsp. paratuberculosis
gcacccgcaacaccacgucggu

SEQ ID NO: 2842921 - RNA, 17 nt, Mycobacterium avium subsp. paratuberculosis
gcacccgcaacgcgcgc

SEQ ID NO: 2842922 - RNA, 18 nt, Mycobacterium avium subsp. paratuberculosis
gcacccgcacgugcgcgc

SEQ ID NO: 2842923 - RNA, 23 nt, Mycobacterium avium subsp. paratuberculosis
gcacccgcacgugcgcgccgacc

SEQ ID NO: 2842924 - RNA, 14 nt, Mycobacterium avium subsp. paratuberculosis
gcacccgcagccgc

SEQ ID NO: 2842925 - RNA, 20 nt, Mycobacterium avium subsp. paratuberculosis
gcacccgcagcuccagcgag

SEQ ID NO: 2842926 - RNA, 18 nt, Mycobacterium avium subsp. paratuberculosis
gcacccgcagcucgccga

SEQ ID NO: 2842927 - RNA, 21 nt, Mycobacterium avium subsp. paratuberculosis
gcacccgcagcucgccgagcg

SEQ ID NO: 2842928 - RNA, 21 nt, Mycobacterium avium subsp. paratuberculosis
gcacccgcaucaacugcacca

SEQ ID NO: 2842929 - RNA, 13 nt, Mycobacterium avium subsp. paratuberculosis
gcacccgccagcc

SEQ ID NO: 2842930 - RNA, 14 nt, Mycobacterium avium subsp. paratuberculosis
gcacccgccagccc

SEQ ID NO: 2842931 - RNA, 19 nt, Mycobacterium avium subsp. paratuberculosis
gcacccgcgcgucgcgcag

SEQ ID NO: 2842932 - RNA, 20 nt, Mycobacterium avium subsp. paratuberculosis
gcacccgcgcgucgcgcagc

SEQ ID NO: 2842933 - RNA, 12 nt, Mycobacterium avium subsp. paratuberculosis
gcacccgcggcg

SEQ ID NO: 2842934 - RNA, 14 nt, Mycobacterium avium subsp. paratuberculosis
gcacccgcucgccg

SEQ ID NO: 2842935 - RNA, 20 nt, Mycobacterium avium subsp. paratuberculosis
gcacccgcucgccgaugacg

SEQ ID NO: 2842936 - RNA, 16 nt, Mycobacterium avium subsp. paratuberculosis
gcacccgcucgcgggc

SEQ ID NO: 2842937 - RNA, 17 nt, Mycobacterium avium subsp. paratuberculosis
gcacccgcucgcgggcc

SEQ ID NO: 2842938 - RNA, 18 nt, Mycobacterium avium subsp. paratuberculosis
gcacccgcucgcgggccc

SEQ ID NO: 2842939 - RNA, 19 nt, Mycobacterium avium subsp. paratuberculosis
gcacccgcucgcgggcccg

SEQ ID NO: 2842940 - RNA, 21 nt, Mycobacterium avium subsp. paratuberculosis
gcacccgcugauccagcagcg

SEQ ID NO: 2842941 - RNA, 14 nt, Mycobacterium avium subsp. paratuberculosis
gcacccgcugcagc

SEQ ID NO: 2842942 - RNA, 17 nt, Mycobacterium avium subsp. paratuberculosis
gcacccgcugcagccgg

SEQ ID NO: 2842943 - RNA, 18 nt, Mycobacterium avium subsp. paratuberculosis
gcacccgcugcagccggu

SEQ ID NO: 2842944 - RNA, 21 nt, Mycobacterium avium subsp. paratuberculosis
gcacccgcuuuugccgucggu

SEQ ID NO: 2842945 - RNA, 21 nt, Mycobacterium avium subsp. paratuberculosis
gcacccggacgugaucgcggu

SEQ ID NO: 2842946 - RNA, 12 nt, Mycobacterium avium subsp. paratuberculosis
gcacccggccca

SEQ ID NO: 2842947 - RNA, 15 nt, Mycobacterium avium subsp. paratuberculosis
gcacccggcccacgc

SEQ ID NO: 2842948 - RNA, 18 nt, Mycobacterium avium subsp. paratuberculosis
gcacccggcccacgccgu

SEQ ID NO: 2842949 - RNA, 16 nt, Mycobacterium avium subsp. paratuberculosis
gcacccggcgcggccg

SEQ ID NO: 2842950 - RNA, 13 nt, Mycobacterium avium subsp. paratuberculosis
gcacccgggcagc

SEQ ID NO: 2842951 - RNA, 14 nt, Mycobacterium avium subsp. paratuberculosis
gcacccgggcagcu

SEQ ID NO: 2842952 - RNA, 13 nt, Mycobacterium avium subsp. paratuberculosis
gcacccgggccug

SEQ ID NO: 2842953 - RNA, 14 nt, Mycobacterium avium subsp. paratuberculosis
gcacccgggccugc

SEQ ID NO: 2842954 - RNA, 20 nt, Mycobacterium avium subsp. paratuberculosis
gcacccgggccugcggcggc

SEQ ID NO: 2842955 - RNA, 23 nt, Mycobacterium avium subsp. paratuberculosis
gcacccgggcgacaugcccgcgg

SEQ ID NO: 2842956 - RNA, 13 nt, Mycobacterium avium subsp. paratuberculosis
gcacccgggcgcg

SEQ ID NO: 2842957 - RNA, 18 nt, Mycobacterium avium subsp. paratuberculosis
gcacccgggcgcgacggu

SEQ ID NO: 2842958 - RNA, 13 nt, Mycobacterium avium subsp. paratuberculosis
gcacccgggucag

SEQ ID NO: 2842959 - RNA, 13 nt, Mycobacterium avium subsp. paratuberculosis
gcacccgggugcc

SEQ ID NO: 2842960 - RNA, 16 nt, Mycobacterium avium subsp. paratuberculosis
gcacccgggugcccgg

SEQ ID NO: 2842961 - RNA, 18 nt, Mycobacterium avium subsp. paratuberculosis
gcacccgggugcccggcu

SEQ ID NO: 2842962 - RNA, 23 nt, Mycobacterium avium subsp. paratuberculosis
gcacccgggugcccggcugggcg

SEQ ID NO: 2842963 - RNA, 18 nt, Mycobacterium avium subsp. paratuberculosis
gcaccgccagcgcggcgg

SEQ ID NO: 2842964 - RNA, 17 nt, Mycobacterium avium subsp. paratuberculosis
gcaccgccaggcuggcc

SEQ ID NO: 2842965 - RNA, 22 nt, Mycobacterium avium subsp. paratuberculosis
gcaccgccaggcuggccaggcu

SEQ ID NO: 2842966 - RNA, 14 nt, Mycobacterium avium subsp. paratuberculosis
gcaccgccagucug

SEQ ID NO: 2842967 - RNA, 16 nt, Mycobacterium avium subsp. paratuberculosis
gcaccgcccccgcggc

SEQ ID NO: 2842968 - RNA, 18 nt, Mycobacterium avium subsp. paratuberculosis
gcaccgcccccgcggcgg

SEQ ID NO: 2842969 - RNA, 20 nt, Mycobacterium avium subsp. paratuberculosis
gcaccgcccccgcggcggcc

SEQ ID NO: 2842970 - RNA, 16 nt, Mycobacterium avium subsp. paratuberculosis
gcaccgccccgcaacc

SEQ ID NO: 2842971 - RNA, 14 nt, Mycobacterium avium subsp. paratuberculosis
gcaccgccccgguc

SEQ ID NO: 2842972 - RNA, 22 nt, Mycobacterium avium subsp. paratuberculosis
gcaccgccccggucaccccggc

SEQ ID NO: 2842973 - RNA, 23 nt, Mycobacterium avium subsp. paratuberculosis
gcaccgccccggucaccccggcc

SEQ ID NO: 2842974 - RNA, 15 nt, Mycobacterium avium subsp. paratuberculosis
gcaccgcccgcgcga

SEQ ID NO: 2842975 - RNA, 22 nt, Mycobacterium avium subsp. paratuberculosis
gcaccgcccgcgcgaugcgggc

SEQ ID NO: 2842976 - RNA, 17 nt, Mycobacterium avium subsp. paratuberculosis
gcaccgcccgcggugug

SEQ ID NO: 2842977 - RNA, 23 nt, Mycobacterium avium subsp. paratuberculosis
gcaccgcccgcggugugcuggcc

SEQ ID NO: 2842978 - RNA, 15 nt, Mycobacterium avium subsp. paratuberculosis
gcaccgcccggguug

SEQ ID NO: 2842979 - RNA, 19 nt, Mycobacterium avium subsp. paratuberculosis
gcaccgccgacaucgcccg

SEQ ID NO: 2842980 - RNA, 21 nt, Mycobacterium avium subsp. paratuberculosis
gcaccgccgacaucgcccggu

SEQ ID NO: 2842981 - RNA, 14 nt, Mycobacterium avium subsp. paratuberculosis
gcaccgccgagccg

SEQ ID NO: 2842982 - RNA, 15 nt, Mycobacterium avium subsp. paratuberculosis
gcaccgccgcgcggc

SEQ ID NO: 2842983 - RNA, 17 nt, Mycobacterium avium subsp. paratuberculosis
gcaccgccgcgcggccg

SEQ ID NO: 2842984 - RNA, 14 nt, Mycobacterium avium subsp. paratuberculosis
gcaccgccgcggcc

SEQ ID NO: 2842985 - RNA, 16 nt, Mycobacterium avium subsp. paratuberculosis
gcaccgccgcggccgc

SEQ ID NO: 2842986 - RNA, 17 nt, Mycobacterium avium subsp. paratuberculosis
gcaccgccgcggccgcg

SEQ ID NO: 2842987 - RNA, 19 nt, Mycobacterium avium subsp. paratuberculosis
gcaccgccgcggccgcgau

SEQ ID NO: 2842988 - RNA, 20 nt, Mycobacterium avium subsp. paratuberculosis
gcaccgccggcgccgucgau

SEQ ID NO: 2842989 - RNA, 16 nt, Mycobacterium avium subsp. paratuberculosis
gcaccgccggcggccu

SEQ ID NO: 2842990 - RNA, 13 nt, Mycobacterium avium subsp. paratuberculosis
gcaccgccgggca

SEQ ID NO: 2842991 - RNA, 18 nt, Mycobacterium avium subsp. paratuberculosis
gcaccgccgggcauccgg

SEQ ID NO: 2842992 - RNA, 15 nt, Mycobacterium avium subsp. paratuberculosis
gcaccgccgucccgu

SEQ ID NO: 2842993 - RNA, 16 nt, Mycobacterium avium subsp. paratuberculosis
gcaccgccgucccguc

SEQ ID NO: 2842994 - RNA, 23 nt, Mycobacterium avium subsp. paratuberculosis
gcaccgccgucggggcgucggcg

SEQ ID NO: 2842995 - RNA, 16 nt, Mycobacterium avium subsp. paratuberculosis
gcaccgccucaugcca

SEQ ID NO: 2842996 - RNA, 23 nt, Mycobacterium avium subsp. paratuberculosis
gcaccgccuccucgaugucggug

SEQ ID NO: 2842997 - RNA, 18 nt, Mycobacterium avium subsp. paratuberculosis
gcaccgccucggccaccu

SEQ ID NO: 2842998 - RNA, 21 nt, Mycobacterium avium subsp. paratuberculosis
gcaccgccugugcgacggcgu

SEQ ID NO: 2842999 - RNA, 23 nt, Mycobacterium avium subsp. paratuberculosis
gcaccgcgaaacgcaacagcgag

SEQ ID NO: 2843000 - RNA, 16 nt, Mycobacterium avium subsp. paratuberculosis
gcaccgcgaacaucgc

SEQ ID NO: 2843001 - RNA, 19 nt, Mycobacterium avium subsp. paratuberculosis
gcaccgcgaacaucgccag

SEQ ID NO: 2843002 - RNA, 20 nt, Mycobacterium avium subsp. paratuberculosis
gcaccgcgaacaucgccagc

SEQ ID NO: 2843003 - RNA, 22 nt, Mycobacterium avium subsp. paratuberculosis
gcaccgcgaacaucgccagcaa

SEQ ID NO: 2843004 - RNA, 21 nt, Mycobacterium avium subsp. paratuberculosis
gcaccgcgaccacgccgcggu

SEQ ID NO: 2843005 - RNA, 21 nt, Mycobacterium avium subsp. paratuberculosis
gcaccgcgacccaggccgccg

SEQ ID NO: 2843006 - RNA, 12 nt, Mycobacterium avium subsp. paratuberculosis
gcaccgcgaccg

SEQ ID NO: 2843007 - RNA, 14 nt, Mycobacterium avium subsp. paratuberculosis
gcaccgcgaccggu

SEQ ID NO: 2843008 - RNA, 15 nt, Mycobacterium avium subsp. paratuberculosis
gcaccgcgacgagau

SEQ ID NO: 2843009 - RNA, 24 nt, Mycobacterium avium subsp. paratuberculosis
gcaccgcgacgaucgcgacggccg

SEQ ID NO: 2843010 - RNA, 19 nt, Mycobacterium avium subsp. paratuberculosis
gcaccgcgagcaccgcgau

SEQ ID NO: 2843011 - RNA, 15 nt, Mycobacterium avium subsp. paratuberculosis
gcaccgcgaucaccg

SEQ ID NO: 2843012 - RNA, 23 nt, Mycobacterium avium subsp. paratuberculosis
gcaccgcgaucaccgagauggcc

SEQ ID NO: 2843013 - RNA, 17 nt, Mycobacterium avium subsp. paratuberculosis
gcaccgcgaucgccgac

SEQ ID NO: 2843014 - RNA, 18 nt, Mycobacterium avium subsp. paratuberculosis
gcaccgcgaucgccgacg

SEQ ID NO: 2843015 - RNA, 20 nt, Mycobacterium avium subsp. paratuberculosis
gcaccgcgaucgccgacguc

SEQ ID NO: 2843016 - RNA, 13 nt, Mycobacterium avium subsp. paratuberculosis
gcaccgcgauggc

SEQ ID NO: 2843017 - RNA, 15 nt, Mycobacterium avium subsp. paratuberculosis
gcaccgcgauggccc

SEQ ID NO: 2843018 - RNA, 16 nt, Mycobacterium avium subsp. paratuberculosis
gcaccgcgauggcccg

SEQ ID NO: 2843019 - RNA, 14 nt, Mycobacterium avium subsp. paratuberculosis
gcaccgcgcccgcc

SEQ ID NO: 2843020 - RNA, 15 nt, Mycobacterium avium subsp. paratuberculosis
gcaccgcgcccgccc

SEQ ID NO: 2843021 - RNA, 16 nt, Mycobacterium avium subsp. paratuberculosis
gcaccgcgcgcaccac

SEQ ID NO: 2843022 - RNA, 18 nt, Mycobacterium avium subsp. paratuberculosis
gcaccgcgcgcaccacgu

SEQ ID NO: 2843023 - RNA, 14 nt, Mycobacterium avium subsp. paratuberculosis
gcaccgcgcggcgg

SEQ ID NO: 2843024 - RNA, 15 nt, Mycobacterium avium subsp. paratuberculosis
gcaccgcgcggcggu

SEQ ID NO: 2843025 - RNA, 20 nt, Mycobacterium avium subsp. paratuberculosis
gcaccgcgcggcggugcucg

SEQ ID NO: 2843026 - RNA, 17 nt, Mycobacterium avium subsp. paratuberculosis
gcaccgcgcucaccgcg

SEQ ID NO: 2843027 - RNA, 19 nt, Mycobacterium avium subsp. paratuberculosis
gcaccgcggauuccagcgc

SEQ ID NO: 2843028 - RNA, 12 nt, Mycobacterium avium subsp. paratuberculosis
gcaccgcggcca

SEQ ID NO: 2843029 - RNA, 17 nt, Mycobacterium avium subsp. paratuberculosis
gcaccgcggccaacccg

SEQ ID NO: 2843030 - RNA, 22 nt, Mycobacterium avium subsp. paratuberculosis
gcaccgcggccaacccgggcgc

SEQ ID NO: 2843031 - RNA, 16 nt, Mycobacterium avium subsp. paratuberculosis
gcaccgcggccgucgc

SEQ ID NO: 2843032 - RNA, 22 nt, Mycobacterium avium subsp. paratuberculosis
gcaccgcggccgucgcggcgau

SEQ ID NO: 2843033 - RNA, 24 nt, Mycobacterium avium subsp. paratuberculosis
gcaccgcggccgucgcggcgaucg

SEQ ID NO: 2843034 - RNA, 11 nt, Mycobacterium avium subsp. paratuberculosis
gcaccgcggcg

SEQ ID NO: 2843035 - RNA, 15 nt, Mycobacterium avium subsp. paratuberculosis
gcaccgcggcgaucg

SEQ ID NO: 2843036 - RNA, 18 nt, Mycobacterium avium subsp. paratuberculosis
gcaccgcggcgaucgccg

SEQ ID NO: 2843037 - RNA, 20 nt, Mycobacterium avium subsp. paratuberculosis
gcaccgcggcgaucgccgug

SEQ ID NO: 2843038 - RNA, 16 nt, Mycobacterium avium subsp. paratuberculosis
gcaccgcggcgaugau

SEQ ID NO: 2843039 - RNA, 15 nt, Mycobacterium avium subsp. paratuberculosis
gcaccgcggcgcgca

SEQ ID NO: 2843040 - RNA, 17 nt, Mycobacterium avium subsp. paratuberculosis
gcaccgcggcgcgcauc

SEQ ID NO: 2843041 - RNA, 18 nt, Mycobacterium avium subsp. paratuberculosis
gcaccgcggcgcgcaucg

SEQ ID NO: 2843042 - RNA, 23 nt, Mycobacterium avium subsp. paratuberculosis
gcaccgcggcgcgcaucgccguc

SEQ ID NO: 2843043 - RNA, 22 nt, Mycobacterium avium subsp. paratuberculosis
gcaccgcggcgggguccacgca

SEQ ID NO: 2843044 - RNA, 13 nt, Mycobacterium avium subsp. paratuberculosis
gcaccgcggcggu

SEQ ID NO: 2843045 - RNA, 15 nt, Mycobacterium avium subsp. paratuberculosis
gcaccgcggcguagc

SEQ ID NO: 2843046 - RNA, 16 nt, Mycobacterium avium subsp. paratuberculosis
gcaccgcggcguagcg

SEQ ID NO: 2843047 - RNA, 19 nt, Mycobacterium avium subsp. paratuberculosis
gcaccgcggcguagcgcca

SEQ ID NO: 2843048 - RNA, 21 nt, Mycobacterium avium subsp. paratuberculosis
gcaccgcggcguagcgccagu

SEQ ID NO: 2843049 - RNA, 18 nt, Mycobacterium avium subsp. paratuberculosis
gcaccgcggcgugcgcca

SEQ ID NO: 2843050 - RNA, 15 nt, Mycobacterium avium subsp. paratuberculosis
gcaccgcggcgugga

SEQ ID NO: 2843051 - RNA, 20 nt, Mycobacterium avium subsp. paratuberculosis
gcaccgcggcguggacgucg

SEQ ID NO: 2843052 - RNA, 13 nt, Mycobacterium avium subsp. paratuberculosis
gcaccgcggcucg

SEQ ID NO: 2843053 - RNA, 14 nt, Mycobacterium avium subsp. paratuberculosis
gcaccgcggcucgg

SEQ ID NO: 2843054 - RNA, 22 nt, Mycobacterium avium subsp. paratuberculosis
gcaccgcggcucggucgcgaag

SEQ ID NO: 2843055 - RNA, 17 nt, Mycobacterium avium subsp. paratuberculosis
gcaccgcgggcacggcg

SEQ ID NO: 2843056 - RNA, 19 nt, Mycobacterium avium subsp. paratuberculosis
gcaccgcgggcacggcgau

SEQ ID NO: 2843057 - RNA, 17 nt, Mycobacterium avium subsp. paratuberculosis
gcaccgcgggcagcagc

SEQ ID NO: 2843058 - RNA, 21 nt, Mycobacterium avium subsp. paratuberculosis
gcaccgcgggcagcagcuugg

SEQ ID NO: 2843059 - RNA, 17 nt, Mycobacterium avium subsp. paratuberculosis
gcaccgcgggggcggcc

SEQ ID NO: 2843060 - RNA, 16 nt, Mycobacterium avium subsp. paratuberculosis
gcaccgcggucugcgc

SEQ ID NO: 2843061 - RNA, 17 nt, Mycobacterium avium subsp. paratuberculosis
gcaccgcggucugcgcc

SEQ ID NO: 2843062 - RNA, 20 nt, Mycobacterium avium subsp. paratuberculosis
gcaccgcggucugcgccagc

SEQ ID NO: 2843063 - RNA, 22 nt, Mycobacterium avium subsp. paratuberculosis
gcaccgcggucugcgccagcuc

SEQ ID NO: 2843064 - RNA, 21 nt, Mycobacterium avium subsp. paratuberculosis
gcaccgcguccgcgucgucga

SEQ ID NO: 2843065 - RNA, 18 nt, Mycobacterium avium subsp. paratuberculosis
gcaccgcgucgaccaccg

SEQ ID NO: 2843066 - RNA, 22 nt, Mycobacterium avium subsp. paratuberculosis
gcaccgcgucgaugcgggcccg

SEQ ID NO: 2843067 - RNA, 16 nt, Mycobacterium avium subsp. paratuberculosis
gcaccgcgucgauguc

SEQ ID NO: 2843068 - RNA, 18 nt, Mycobacterium avium subsp. paratuberculosis
gcaccgcgucggcgcugg

SEQ ID NO: 2843069 - RNA, 15 nt, Mycobacterium avium subsp. paratuberculosis
gcaccgcugccggcc

SEQ ID NO: 2843070 - RNA, 16 nt, Mycobacterium avium subsp. paratuberculosis
gcaccgcugccggccg

SEQ ID NO: 2843071 - RNA, 16 nt, Mycobacterium avium subsp. paratuberculosis
gcaccggacgcagcga

SEQ ID NO: 2843072 - RNA, 15 nt, Mycobacterium avium subsp. paratuberculosis
gcaccggagccuugg

SEQ ID NO: 2843073 - RNA, 15 nt, Mycobacterium avium subsp. paratuberculosis
gcaccggaucgacca

SEQ ID NO: 2843074 - RNA, 17 nt, Mycobacterium avium subsp. paratuberculosis
gcaccggaugcucaccg

SEQ ID NO: 2843075 - RNA, 12 nt, Mycobacterium avium subsp. paratuberculosis
gcaccggcaccg

SEQ ID NO: 2843076 - RNA, 16 nt, Mycobacterium avium subsp. paratuberculosis
gcaccggcaccgccag

SEQ ID NO: 2843077 - RNA, 17 nt, Mycobacterium avium subsp. paratuberculosis
gcaccggcaccgccagc

SEQ ID NO: 2843078 - RNA, 17 nt, Mycobacterium avium subsp. paratuberculosis
gcaccggcaccgccccc

SEQ ID NO: 2843079 - RNA, 19 nt, Mycobacterium avium subsp. paratuberculosis
gcaccggcaccgcggcgau

SEQ ID NO: 2843080 - RNA, 20 nt, Mycobacterium avium subsp. paratuberculosis
gcaccggcaccgcggcgaug

SEQ ID NO: 2843081 - RNA, 16 nt, Mycobacterium avium subsp. paratuberculosis
gcaccggcacgucgag

SEQ ID NO: 2843082 - RNA, 19 nt, Mycobacterium avium subsp. paratuberculosis
gcaccggcacgucgagcuc

SEQ ID NO: 2843083 - RNA, 15 nt, Mycobacterium avium subsp. paratuberculosis
gcaccggcagcaacc

SEQ ID NO: 2843084 - RNA, 13 nt, Mycobacterium avium subsp. paratuberculosis
gcaccggcagcca

SEQ ID NO: 2843085 - RNA, 17 nt, Mycobacterium avium subsp. paratuberculosis
gcaccggcagccagaug

SEQ ID NO: 2843086 - RNA, 15 nt, Mycobacterium avium subsp. paratuberculosis
gcaccggcagccgca

SEQ ID NO: 2843087 - RNA, 19 nt, Mycobacterium avium subsp. paratuberculosis
gcaccggcagugaucggcg

SEQ ID NO: 2843088 - RNA, 13 nt, Mycobacterium avium subsp. paratuberculosis
gcaccggccggau

SEQ ID NO: 2843089 - RNA, 22 nt, Mycobacterium avium subsp. paratuberculosis
gcaccggccggauguuguccgg

SEQ ID NO: 2843090 - RNA, 13 nt, Mycobacterium avium subsp. paratuberculosis
gcaccggccggcc

SEQ ID NO: 2843091 - RNA, 19 nt, Mycobacterium avium subsp. paratuberculosis
gcaccggcgacggcgguuc

SEQ ID NO: 2843092 - RNA, 18 nt, Mycobacterium avium subsp. paratuberculosis
gcaccggcgaguccgcgg

SEQ ID NO: 2843093 - RNA, 21 nt, Mycobacterium avium subsp. paratuberculosis
gcaccggcgaguccgcggagg

SEQ ID NO: 2843094 - RNA, 22 nt, Mycobacterium avium subsp. paratuberculosis
gcaccggcgaugcagaucacca

SEQ ID NO: 2843095 - RNA, 23 nt, Mycobacterium avium subsp. paratuberculosis
gcaccggcgaugcagaucaccac

SEQ ID NO: 2843096 - RNA, 17 nt, Mycobacterium avium subsp. paratuberculosis
gcaccggcgccccgggc

SEQ ID NO: 2843097 - RNA, 19 nt, Mycobacterium avium subsp. paratuberculosis
gcaccggcgccccgggcag

SEQ ID NO: 2843098 - RNA, 20 nt, Mycobacterium avium subsp. paratuberculosis
gcaccggcgccccgggcagc

SEQ ID NO: 2843099 - RNA, 14 nt, Mycobacterium avium subsp. paratuberculosis
gcaccggcgccgcc

SEQ ID NO: 2843100 - RNA, 17 nt, Mycobacterium avium subsp. paratuberculosis
gcaccggcgccgccacc

SEQ ID NO: 2843101 - RNA, 13 nt, Mycobacterium avium subsp. paratuberculosis
gcaccggcgccuc

SEQ ID NO: 2843102 - RNA, 16 nt, Mycobacterium avium subsp. paratuberculosis
gcaccggcgccucgau

SEQ ID NO: 2843103 - RNA, 22 nt, Mycobacterium avium subsp. paratuberculosis
gcaccggcgccucgaugcgggu

SEQ ID NO: 2843104 - RNA, 16 nt, Mycobacterium avium subsp. paratuberculosis
gcaccggcgcgccgcg

SEQ ID NO: 2843105 - RNA, 17 nt, Mycobacterium avium subsp. paratuberculosis
gcaccggcgcgccgcgu

SEQ ID NO: 2843106 - RNA, 12 nt, Mycobacterium avium subsp. paratuberculosis
gcaccggcggca

SEQ ID NO: 2843107 - RNA, 14 nt, Mycobacterium avium subsp. paratuberculosis
gcaccggcggcagc

SEQ ID NO: 2843108 - RNA, 21 nt, Mycobacterium avium subsp. paratuberculosis
gcaccggcggcagcgacucgg

SEQ ID NO: 2843109 - RNA, 17 nt, Mycobacterium avium subsp. paratuberculosis
gcaccggcgucgacagc

SEQ ID NO: 2843110 - RNA, 19 nt, Mycobacterium avium subsp. paratuberculosis
gcaccggcgucgacagccg

SEQ ID NO: 2843111 - RNA, 20 nt, Mycobacterium avium subsp. paratuberculosis
gcaccggcgucgacagccgg

SEQ ID NO: 2843112 - RNA, 22 nt, Mycobacterium avium subsp. paratuberculosis
gcaccggcguggggacccccuc

SEQ ID NO: 2843113 - RNA, 13 nt, Mycobacterium avium subsp. paratuberculosis
gcaccggcugccc

SEQ ID NO: 2843114 - RNA, 12 nt, Mycobacterium avium subsp. paratuberculosis
gcaccggcuggc

SEQ ID NO: 2843115 - RNA, 14 nt, Mycobacterium avium subsp. paratuberculosis
gcaccggcuggccg

SEQ ID NO: 2843116 - RNA, 18 nt, Mycobacterium avium subsp. paratuberculosis
gcaccggcuggccgagcg

SEQ ID NO: 2843117 - RNA, 19 nt, Mycobacterium avium subsp. paratuberculosis
gcaccggcuggccgagcgg

SEQ ID NO: 2843118 - RNA, 16 nt, Mycobacterium avium subsp. paratuberculosis
gcaccggcuggucggc

SEQ ID NO: 2843119 - RNA, 18 nt, Mycobacterium avium subsp. paratuberculosis
gcaccggcuggucggcgg

SEQ ID NO: 2843120 - RNA, 15 nt, Mycobacterium avium subsp. paratuberculosis
gcaccggcuggugca

SEQ ID NO: 2843121 - RNA, 20 nt, Mycobacterium avium subsp. paratuberculosis
gcaccggcuggugcagcagc

SEQ ID NO: 2843122 - RNA, 16 nt, Mycobacterium avium subsp. paratuberculosis
gcaccgggaacagcca

SEQ ID NO: 2843123 - RNA, 19 nt, Mycobacterium avium subsp. paratuberculosis
gcaccgggaacagccaggc

SEQ ID NO: 2843124 - RNA, 22 nt, Mycobacterium avium subsp. paratuberculosis
gcaccgggaacagccaggcgaa

SEQ ID NO: 2843125 - RNA, 20 nt, Mycobacterium avium subsp. paratuberculosis
gcaccgggaaggugucggcc

SEQ ID NO: 2843126 - RNA, 16 nt, Mycobacterium avium subsp. paratuberculosis
gcaccgggaccagcgc

SEQ ID NO: 2843127 - RNA, 17 nt, Mycobacterium avium subsp. paratuberculosis
gcaccgggaccagcgcg

SEQ ID NO: 2843128 - RNA, 22 nt, Mycobacterium avium subsp. paratuberculosis
gcaccgggaccagcgcggugcc

SEQ ID NO: 2843129 - RNA, 12 nt, Mycobacterium avium subsp. paratuberculosis
gcaccgggauga

SEQ ID NO: 2843130 - RNA, 15 nt, Mycobacterium avium subsp. paratuberculosis
gcaccgggcccagcu

SEQ ID NO: 2843131 - RNA, 17 nt, Mycobacterium avium subsp. paratuberculosis
gcaccgggcccagcucg

SEQ ID NO: 2843132 - RNA, 12 nt, Mycobacterium avium subsp. paratuberculosis
gcaccucgcccg

SEQ ID NO: 2843133 - RNA, 15 nt, Mycobacterium avium subsp. paratuberculosis
gcaccucgcccggcu

SEQ ID NO: 2843134 - RNA, 20 nt, Mycobacterium avium subsp. paratuberculosis
gcaccucgcccugcagccgg

SEQ ID NO: 2843135 - RNA, 20 nt, Mycobacterium avium subsp. paratuberculosis
gcaccucgcccugcagcgcg

SEQ ID NO: 2843136 - RNA, 14 nt, Mycobacterium avium subsp. paratuberculosis
gcaccucgccggcc

SEQ ID NO: 2843137 - RNA, 15 nt, Mycobacterium avium subsp. paratuberculosis
gcaccucgccggccg

SEQ ID NO: 2843138 - RNA, 19 nt, Mycobacterium avium subsp. paratuberculosis
gcaccucgccggccgccgu

SEQ ID NO: 2843139 - RNA, 15 nt, Mycobacterium avium subsp. paratuberculosis
gcaccucgcgcagca

SEQ ID NO: 2843140 - RNA, 18 nt, Mycobacterium avium subsp. paratuberculosis
gcaccucgcgcagcaccg

SEQ ID NO: 2843141 - RNA, 23 nt, Mycobacterium avium subsp. paratuberculosis
gcaccucgcgcucuugggcggcc

SEQ ID NO: 2843142 - RNA, 14 nt, Mycobacterium avium subsp. paratuberculosis
gcaccucgcggcag

SEQ ID NO: 2843143 - RNA, 13 nt, Mycobacterium avium subsp. paratuberculosis
gcaccucgcucag

SEQ ID NO: 2843144 - RNA, 14 nt, Mycobacterium avium subsp. paratuberculosis
gcaccucgcucagc

SEQ ID NO: 2843145 - RNA, 17 nt, Mycobacterium avium subsp. paratuberculosis
gcaccucgcucagcccg

SEQ ID NO: 2843146 - RNA, 13 nt, Mycobacterium avium subsp. paratuberculosis
gcaccucggccag

SEQ ID NO: 2843147 - RNA, 14 nt, Mycobacterium avium subsp. paratuberculosis
gcaccucggccggg

SEQ ID NO: 2843148 - RNA, 15 nt, Mycobacterium avium subsp. paratuberculosis
gcaccucggccgggu

SEQ ID NO: 2843149 - RNA, 12 nt, Mycobacterium avium subsp. paratuberculosis
gcaccucggcgu

SEQ ID NO: 2843150 - RNA, 16 nt, Mycobacterium avium subsp. paratuberculosis
gcaccucggcgucggc

SEQ ID NO: 2843151 - RNA, 17 nt, Mycobacterium avium subsp. paratuberculosis
gcaccucggcgucggcg

SEQ ID NO: 2843152 - RNA, 19 nt, Mycobacterium avium subsp. paratuberculosis
gcaccucggcgucggcgcg

SEQ ID NO: 2843153 - RNA, 13 nt, Mycobacterium avium subsp. paratuberculosis
gcaccucggggcg

SEQ ID NO: 2843154 - RNA, 14 nt, Mycobacterium avium subsp. paratuberculosis
gcaccucgucgccc

SEQ ID NO: 2843155 - RNA, 17 nt, Mycobacterium avium subsp. paratuberculosis
gcaccucgucgcccggc

SEQ ID NO: 2843156 - RNA, 16 nt, Mycobacterium avium subsp. paratuberculosis
gcaccucgucgccguc

SEQ ID NO: 2843157 - RNA, 18 nt, Mycobacterium avium subsp. paratuberculosis
gcaccucgucgccgucgg

SEQ ID NO: 2843158 - RNA, 22 nt, Mycobacterium avium subsp. paratuberculosis
gcaccucuucgaaagccacccg

SEQ ID NO: 2843159 - RNA, 14 nt, Mycobacterium avium subsp. paratuberculosis
gcaccugaacggcc

SEQ ID NO: 2843160 - RNA, 17 nt, Mycobacterium avium subsp. paratuberculosis
gcaccugaacggccgcg

SEQ ID NO: 2843161 - RNA, 18 nt, Mycobacterium avium subsp. paratuberculosis
gcaccugaacggccgcgc

SEQ ID NO: 2843162 - RNA, 19 nt, Mycobacterium avium subsp. paratuberculosis
gcaccugaacggccgcgca

SEQ ID NO: 2843163 - RNA, 20 nt, Mycobacterium avium subsp. paratuberculosis
gcaccugaacggccgcgcag

SEQ ID NO: 2843164 - RNA, 16 nt, Mycobacterium avium subsp. paratuberculosis
gcaccugaccgucggc

SEQ ID NO: 2843165 - RNA, 21 nt, Mycobacterium avium subsp. paratuberculosis
gcaccugaccgucggccagau

SEQ ID NO: 2843166 - RNA, 22 nt, Mycobacterium avium subsp. paratuberculosis
gcaccugaccgucggccagaua

SEQ ID NO: 2843167 - RNA, 15 nt, Mycobacterium avium subsp. paratuberculosis
gcaccugagucuggg

SEQ ID NO: 2843168 - RNA, 22 nt, Mycobacterium avium subsp. paratuberculosis
gcaccugagucugggucacgcu

SEQ ID NO: 2843169 - RNA, 15 nt, Mycobacterium avium subsp. paratuberculosis
gcaccugaucgaugc

SEQ ID NO: 2843170 - RNA, 17 nt, Mycobacterium avium subsp. paratuberculosis
gcaccugaucgaugccg

SEQ ID NO: 2843171 - RNA, 17 nt, Mycobacterium avium subsp. paratuberculosis
gcaccugccgucgacga

SEQ ID NO: 2843172 - RNA, 18 nt, Mycobacterium avium subsp. paratuberculosis
gcaccugccgucgacgac

SEQ ID NO: 2843173 - RNA, 12 nt, Mycobacterium avium subsp. paratuberculosis
gcaccugcgcgc

SEQ ID NO: 2843174 - RNA, 20 nt, Mycobacterium avium subsp. paratuberculosis
gcaccugcuccucgaaccuc

SEQ ID NO: 2843175 - RNA, 15 nt, Mycobacterium avium subsp. paratuberculosis
gcaccugcucgaugc

SEQ ID NO: 2843176 - RNA, 20 nt, Mycobacterium avium subsp. paratuberculosis
gcaccugcucgaugcgcgcc

SEQ ID NO: 2843177 - RNA, 20 nt, Mycobacterium avium subsp. paratuberculosis
gcaccugcuuggucuccggc

SEQ ID NO: 2843178 - RNA, 18 nt, Mycobacterium avium subsp. paratuberculosis
gcaccuggagcggguccg

SEQ ID NO: 2843179 - RNA, 15 nt, Mycobacterium avium subsp. paratuberculosis
gcaccuggauccagu

SEQ ID NO: 2843180 - RNA, 16 nt, Mycobacterium avium subsp. paratuberculosis
gcaccuggcagcaucc

SEQ ID NO: 2843181 - RNA, 23 nt, Mycobacterium avium subsp. paratuberculosis
gcaccuggcagcauccgccgacg

SEQ ID NO: 2843182 - RNA, 15 nt, Mycobacterium avium subsp. paratuberculosis
gcaccuggccgucgg

SEQ ID NO: 2843183 - RNA, 18 nt, Mycobacterium avium subsp. paratuberculosis
gcaccuggccgucggugg

SEQ ID NO: 2843184 - RNA, 15 nt, Mycobacterium avium subsp. paratuberculosis
gcaccuggcgcaccg

SEQ ID NO: 2843185 - RNA, 19 nt, Mycobacterium avium subsp. paratuberculosis
gcaccuggcgcaccgccgc

SEQ ID NO: 2843186 - RNA, 20 nt, Mycobacterium avium subsp. paratuberculosis
gcaccuggcgcaccgccgcg

SEQ ID NO: 2843187 - RNA, 21 nt, Mycobacterium avium subsp. paratuberculosis
gcaccuggcgcaccgccgcgg

SEQ ID NO: 2843188 - RNA, 18 nt, Mycobacterium avium subsp. paratuberculosis
gcaccuggcgcagcaccg

SEQ ID NO: 2843189 - RNA, 15 nt, Mycobacterium avium subsp. paratuberculosis
gcaccugggugaucu

SEQ ID NO: 2843190 - RNA, 18 nt, Mycobacterium avium subsp. paratuberculosis
gcaccuggucggucagcu

SEQ ID NO: 2843191 - RNA, 23 nt, Mycobacterium avium subsp. paratuberculosis
gcaccugguugaacggcaccccg

SEQ ID NO: 2843192 - RNA, 19 nt, Mycobacterium avium subsp. paratuberculosis
gcaccugugaggcaccgaa

SEQ ID NO: 2843193 - RNA, 19 nt, Mycobacterium avium subsp. paratuberculosis
gcaccuucaccgaccagcu

SEQ ID NO: 2843194 - RNA, 21 nt, Mycobacterium avium subsp. paratuberculosis
gcaccuucagcgggcgcagcu

SEQ ID NO: 2843195 - RNA, 15 nt, Mycobacterium avium subsp. paratuberculosis
gcaccuucgggccga

SEQ ID NO: 2843196 - RNA, 13 nt, Mycobacterium avium subsp. paratuberculosis
gcaccuugaucuc

SEQ ID NO: 2843197 - RNA, 18 nt, Mycobacterium avium subsp. paratuberculosis
gcaccuugaucucgucgc

SEQ ID NO: 2843198 - RNA, 18 nt, Mycobacterium avium subsp. paratuberculosis
gcaccuugcccgucgcgu

SEQ ID NO: 2843199 - RNA, 14 nt, Mycobacterium avium subsp. paratuberculosis
gcaccuugccgguc

SEQ ID NO: 2843200 - RNA, 23 nt, Mycobacterium avium subsp. paratuberculosis
gcaccuuggacgaaacccggcgg

SEQ ID NO: 2843201 - RNA, 20 nt, Mycobacterium avium subsp. paratuberculosis
gcaccuuggucagcucccgg

SEQ ID NO: 2843202 - RNA, 18 nt, Mycobacterium avium subsp. paratuberculosis
gcaccuuggugagcaccg

SEQ ID NO: 2843203 - RNA, 20 nt, Mycobacterium avium subsp. paratuberculosis
gcaccuuggugagcaccgcg

SEQ ID NO: 2843204 - RNA, 18 nt, Mycobacterium avium subsp. paratuberculosis
gcacgaaaccgcguggcg

SEQ ID NO: 2843205 - RNA, 16 nt, Mycobacterium avium subsp. paratuberculosis
gcacgaaacugccgua

SEQ ID NO: 2843206 - RNA, 19 nt, Mycobacterium avium subsp. paratuberculosis
gcacgaaauaaccgcgcgg

SEQ ID NO: 2843207 - RNA, 20 nt, Mycobacterium avium subsp. paratuberculosis
gcacgaaauaaccgcgcggc

SEQ ID NO: 2843208 - RNA, 21 nt, Mycobacterium avium subsp. paratuberculosis
gcacgaaauaaccgcgcggcg

SEQ ID NO: 2843209 - RNA, 16 nt, Mycobacterium avium subsp. paratuberculosis
gcacgaaaugcgggcg

SEQ ID NO: 2843210 - RNA, 14 nt, Mycobacterium avium subsp. paratuberculosis
gcacgaacagcagc

SEQ ID NO: 2843211 - RNA, 16 nt, Mycobacterium avium subsp. paratuberculosis
gcacgaacagcagcgg

SEQ ID NO: 2843212 - RNA, 15 nt, Mycobacterium avium subsp. paratuberculosis
gcacgaacgcgacga

SEQ ID NO: 2843213 - RNA, 14 nt, Mycobacterium avium subsp. paratuberculosis
gcacgaacgcggcc

SEQ ID NO: 2843214 - RNA, 15 nt, Mycobacterium avium subsp. paratuberculosis
gcacgaacgcggcca

SEQ ID NO: 2843215 - RNA, 16 nt, Mycobacterium avium subsp. paratuberculosis
gcacgaacgcggccag

SEQ ID NO: 2843216 - RNA, 18 nt, Mycobacterium avium subsp. paratuberculosis
gcacgaacgcggccagcg

SEQ ID NO: 2843217 - RNA, 21 nt, Mycobacterium avium subsp. paratuberculosis
gcacgcccguucgagcgccgg

SEQ ID NO: 2843218 - RNA, 22 nt, Mycobacterium avium subsp. paratuberculosis
gcacgcccguucgagcgccgga

SEQ ID NO: 2843219 - RNA, 15 nt, Mycobacterium avium subsp. paratuberculosis
gcacgcccugcggcu

SEQ ID NO: 2843220 - RNA, 17 nt, Mycobacterium avium subsp. paratuberculosis
gcacgccgagcagcacc

SEQ ID NO: 2843221 - RNA, 21 nt, Mycobacterium avium subsp. paratuberculosis
gcacgccgagcagcaccggca

SEQ ID NO: 2843222 - RNA, 11 nt, Mycobacterium avium subsp. paratuberculosis
gcacgccgagg

SEQ ID NO: 2843223 - RNA, 14 nt, Mycobacterium avium subsp. paratuberculosis
gcacgccgaggcgu

SEQ ID NO: 2843224 - RNA, 21 nt, Mycobacterium avium subsp. paratuberculosis
gcacgccgaggcgugccgcug

SEQ ID NO: 2843225 - RNA, 13 nt, Mycobacterium avium subsp. paratuberculosis
gcacgccgccgcg

SEQ ID NO: 2843226 - RNA, 15 nt, Mycobacterium avium subsp. paratuberculosis
gcacgccgccgcgaa

SEQ ID NO: 2843227 - RNA, 18 nt, Mycobacterium avium subsp. paratuberculosis
gcacgccgcucgucgggc

SEQ ID NO: 2843228 - RNA, 13 nt, Mycobacterium avium subsp. paratuberculosis
gcacgccggccgg

SEQ ID NO: 2843229 - RNA, 18 nt, Mycobacterium avium subsp. paratuberculosis
gcacgccggccggcgugg

SEQ ID NO: 2843230 - RNA, 15 nt, Mycobacterium avium subsp. paratuberculosis
gcacgccgggcaugc

SEQ ID NO: 2843231 - RNA, 13 nt, Mycobacterium avium subsp. paratuberculosis
gcacgccggggcc

SEQ ID NO: 2843232 - RNA, 20 nt, Mycobacterium avium subsp. paratuberculosis
gcacgccggguugggcggcg

SEQ ID NO: 2843233 - RNA, 22 nt, Mycobacterium avium subsp. paratuberculosis
gcacgccggguugggcggcggc

SEQ ID NO: 2843234 - RNA, 13 nt, Mycobacterium avium subsp. paratuberculosis
gcacgccggucag

SEQ ID NO: 2843235 - RNA, 15 nt, Mycobacterium avium subsp. paratuberculosis
gcacgccggucagca

SEQ ID NO: 2843236 - RNA, 18 nt, Mycobacterium avium subsp. paratuberculosis
gcacgccggucagcacca

SEQ ID NO: 2843237 - RNA, 14 nt, Mycobacterium avium subsp. paratuberculosis
gcacgccguacccg

SEQ ID NO: 2843238 - RNA, 21 nt, Mycobacterium avium subsp. paratuberculosis
gcacgccguccuuggccgcca

SEQ ID NO: 2843239 - RNA, 22 nt, Mycobacterium avium subsp. paratuberculosis
gcacgccguccuuggccgccag

SEQ ID NO: 2843240 - RNA, 12 nt, Mycobacterium avium subsp. paratuberculosis
gcacgccgucgu

SEQ ID NO: 2843241 - RNA, 22 nt, Mycobacterium avium subsp. paratuberculosis
gcacgccgucgugcucggcgag

SEQ ID NO: 2843242 - RNA, 16 nt, Mycobacterium avium subsp. paratuberculosis
gcacgccguggcggcg

SEQ ID NO: 2843243 - RNA, 17 nt, Mycobacterium avium subsp. paratuberculosis
gcacgccguggcggcgg

SEQ ID NO: 2843244 - RNA, 19 nt, Mycobacterium avium subsp. paratuberculosis
gcacgccguugaccccgac

SEQ ID NO: 2843245 - RNA, 22 nt, Mycobacterium avium subsp. paratuberculosis
gcacgccguugaccccgacggc

SEQ ID NO: 2843246 - RNA, 23 nt, Mycobacterium avium subsp. paratuberculosis
gcacgccuuccacgaccuggcgg

SEQ ID NO: 2843247 - RNA, 22 nt, Mycobacterium avium subsp. paratuberculosis
gcacgcgaacaccagaugccgc

SEQ ID NO: 2843248 - RNA, 22 nt, Mycobacterium avium subsp. paratuberculosis
gcacgcgaccgcgucgacggcg

SEQ ID NO: 2843249 - RNA, 19 nt, Mycobacterium avium subsp. paratuberculosis
gcacgcgagacgagccgcc

SEQ ID NO: 2843250 - RNA, 20 nt, Mycobacterium avium subsp. paratuberculosis
gcacgcgagacgagccgccg

SEQ ID NO: 2843251 - RNA, 21 nt, Mycobacterium avium subsp. paratuberculosis
gcacgcgagacgagccgccgc

SEQ ID NO: 2843252 - RNA, 15 nt, Mycobacterium avium subsp. paratuberculosis
gcacgcgcgcccggc

SEQ ID NO: 2843253 - RNA, 19 nt, Mycobacterium avium subsp. paratuberculosis
gcacgcgcgcccggcaccg

SEQ ID NO: 2843254 - RNA, 21 nt, Mycobacterium avium subsp. paratuberculosis
gcacgcgcgcccggcaccgcg

SEQ ID NO: 2843255 - RNA, 12 nt, Mycobacterium avium subsp. paratuberculosis
gcacgcgcgccg

SEQ ID NO: 2843256 - RNA, 15 nt, Mycobacterium avium subsp. paratuberculosis
gcacgcgcgggucgu

SEQ ID NO: 2843257 - RNA, 22 nt, Mycobacterium avium subsp. paratuberculosis
gcacgcgcgggucgucggccug

SEQ ID NO: 2843258 - RNA, 13 nt, Mycobacterium avium subsp. paratuberculosis
gcacgcggacacg

SEQ ID NO: 2843259 - RNA, 22 nt, Mycobacterium avium subsp. paratuberculosis
gcacgcggacacgaacgacgcg

SEQ ID NO: 2843260 - RNA, 15 nt, Mycobacterium avium subsp. paratuberculosis
gcacgcggaucgcgc

SEQ ID NO: 2843261 - RNA, 20 nt, Mycobacterium avium subsp. paratuberculosis
gcacgcggaucgcgcugacc

SEQ ID NO: 2843262 - RNA, 14 nt, Mycobacterium avium subsp. paratuberculosis
gcacgcggccgcgc

SEQ ID NO: 2843263 - RNA, 15 nt, Mycobacterium avium subsp. paratuberculosis
gcacgcggccgcgcc

SEQ ID NO: 2843264 - RNA, 16 nt, Mycobacterium avium subsp. paratuberculosis
gcacgcggccgcgccg

SEQ ID NO: 2843265 - RNA, 20 nt, Mycobacterium avium subsp. paratuberculosis
gcacgcggccgcgccggccg

SEQ ID NO: 2843266 - RNA, 17 nt, Mycobacterium avium subsp. paratuberculosis
gcacgcguugcagcgcc

SEQ ID NO: 2843267 - RNA, 18 nt, Mycobacterium avium subsp. paratuberculosis
gcacgcguugcagcgccg

SEQ ID NO: 2843268 - RNA, 19 nt, Mycobacterium avium subsp. paratuberculosis
gcacgcguugcagcgccgc

SEQ ID NO: 2843269 - RNA, 20 nt, Mycobacterium avium subsp. paratuberculosis
gcacgcguugcagcgccgcg

SEQ ID NO: 2843270 - RNA, 22 nt, Mycobacterium avium subsp. paratuberculosis
gcacgcguugcagcgccgcggc

SEQ ID NO: 2843271 - RNA, 13 nt, Mycobacterium avium subsp. paratuberculosis
gcacgcucgcggu

SEQ ID NO: 2843272 - RNA, 21 nt, Mycobacterium avium subsp. paratuberculosis
gcacgcucgcggugcgcgcgc

SEQ ID NO: 2843273 - RNA, 13 nt, Mycobacterium avium subsp. paratuberculosis
gcacgcucggcgc

SEQ ID NO: 2843274 - RNA, 18 nt, Mycobacterium avium subsp. paratuberculosis
gcacgcucggcgcgacgu

SEQ ID NO: 2843275 - RNA, 16 nt, Mycobacterium avium subsp. paratuberculosis
gcacgcugaagcccac

SEQ ID NO: 2843276 - RNA, 19 nt, Mycobacterium avium subsp. paratuberculosis
gcacgcugaagcccaccgc

SEQ ID NO: 2843277 - RNA, 20 nt, Mycobacterium avium subsp. paratuberculosis
gcacgcugaagcccaccgcc

SEQ ID NO: 2843278 - RNA, 21 nt, Mycobacterium avium subsp. paratuberculosis
gcacgcugaagcccaccgccg

SEQ ID NO: 2843279 - RNA, 22 nt, Mycobacterium avium subsp. paratuberculosis
gcacgcugaagcccaccgccgu

SEQ ID NO: 2843280 - RNA, 14 nt, Mycobacterium avium subsp. paratuberculosis
gcacgcugaucacc

SEQ ID NO: 2843281 - RNA, 16 nt, Mycobacterium avium subsp. paratuberculosis
gcacgcugaucaccac

SEQ ID NO: 2843282 - RNA, 22 nt, Mycobacterium avium subsp. paratuberculosis
gcacgcugaucaccacggucag

SEQ ID NO: 2843283 - RNA, 21 nt, Mycobacterium avium subsp. paratuberculosis
gcacgcugcgcacccgguccg

SEQ ID NO: 2843284 - RNA, 15 nt, Mycobacterium avium subsp. paratuberculosis
gcacgcugcgccagc

SEQ ID NO: 2843285 - RNA, 16 nt, Mycobacterium avium subsp. paratuberculosis
gcacgcugcgccagcc

SEQ ID NO: 2843286 - RNA, 19 nt, Mycobacterium avium subsp. paratuberculosis
gcacgcugcgccagccguc

SEQ ID NO: 2843287 - RNA, 17 nt, Mycobacterium avium subsp. paratuberculosis
gcacgcuggccggcagc

SEQ ID NO: 2843288 - RNA, 17 nt, Mycobacterium avium subsp. paratuberculosis
gcacgcuguccgcguga

SEQ ID NO: 2843289 - RNA, 16 nt, Mycobacterium avium subsp. paratuberculosis
gcacgcugucgggguc

SEQ ID NO: 2843290 - RNA, 19 nt, Mycobacterium avium subsp. paratuberculosis
gcacgcugucggggucgcg

SEQ ID NO: 2843291 - RNA, 22 nt, Mycobacterium avium subsp. paratuberculosis
gcacgcuguuggaaccggccac

SEQ ID NO: 2843292 - RNA, 23 nt, Mycobacterium avium subsp. paratuberculosis
gcacgcuguuggaaccggccacc

SEQ ID NO: 2843293 - RNA, 21 nt, Mycobacterium avium subsp. paratuberculosis
gcacggcaaugguugcggcgg

SEQ ID NO: 2843294 - RNA, 15 nt, Mycobacterium avium subsp. paratuberculosis
gcacggcaccgcgag

SEQ ID NO: 2843295 - RNA, 16 nt, Mycobacterium avium subsp. paratuberculosis
gcacggcaccgcgagc

SEQ ID NO: 2843296 - RNA, 15 nt, Mycobacterium avium subsp. paratuberculosis
gcacggcacgcccgu

SEQ ID NO: 2843297 - RNA, 16 nt, Mycobacterium avium subsp. paratuberculosis
gcacggcaucgauggc

SEQ ID NO: 2843298 - RNA, 23 nt, Mycobacterium avium subsp. paratuberculosis
gcacggcauggcgaacacgucgg

SEQ ID NO: 2843299 - RNA, 18 nt, Mycobacterium avium subsp. paratuberculosis
gcacggccaccagcagcg

SEQ ID NO: 2843300 - RNA, 19 nt, Mycobacterium avium subsp. paratuberculosis
gcacggccaccagcagcga

SEQ ID NO: 2843301 - RNA, 15 nt, Mycobacterium avium subsp. paratuberculosis
gcacggugcgggugc

SEQ ID NO: 2843302 - RNA, 18 nt, Mycobacterium avium subsp. paratuberculosis
gcacggugcgggugccga

SEQ ID NO: 2843303 - RNA, 15 nt, Mycobacterium avium subsp. paratuberculosis
gcacggugcguucgc

SEQ ID NO: 2843304 - RNA, 13 nt, Mycobacterium avium subsp. paratuberculosis
gcacggugggacg

SEQ ID NO: 2843305 - RNA, 19 nt, Mycobacterium avium subsp. paratuberculosis
gcacggugggacggcgggu

SEQ ID NO: 2843306 - RNA, 20 nt, Mycobacterium avium subsp. paratuberculosis
gcacggugggacggcgggug

SEQ ID NO: 2843307 - RNA, 21 nt, Mycobacterium avium subsp. paratuberculosis
gcacgguguagacgcgggccg

SEQ ID NO: 2843308 - RNA, 23 nt, Mycobacterium avium subsp. paratuberculosis
gcacgguguagacgcgggccggc

SEQ ID NO: 2843309 - RNA, 21 nt, Mycobacterium avium subsp. paratuberculosis
gcacgguguugcgcacccgcg

SEQ ID NO: 2843310 - RNA, 18 nt, Mycobacterium avium subsp. paratuberculosis
gcacgguuggccggcccg

SEQ ID NO: 2843311 - RNA, 22 nt, Mycobacterium avium subsp. paratuberculosis
gcacgguuggccggcccgcccg

SEQ ID NO: 2843312 - RNA, 15 nt, Mycobacterium avium subsp. paratuberculosis
gcacguagcccagcg

SEQ ID NO: 2843313 - RNA, 16 nt, Mycobacterium avium subsp. paratuberculosis
gcacguaggcggcgag

SEQ ID NO: 2843314 - RNA, 15 nt, Mycobacterium avium subsp. paratuberculosis
gcacguauccgcggu

SEQ ID NO: 2843315 - RNA, 13 nt, Mycobacterium avium subsp. paratuberculosis
gcacgucaccgcg

SEQ ID NO: 2843316 - RNA, 14 nt, Mycobacterium avium subsp. paratuberculosis
gcacgucaccgcgc

SEQ ID NO: 2843317 - RNA, 23 nt, Mycobacterium avium subsp. paratuberculosis
gcacgucaccgcgcuugccgcga

SEQ ID NO: 2843318 - RNA, 16 nt, Mycobacterium avium subsp. paratuberculosis
gcacgucacgggccag

SEQ ID NO: 2843319 - RNA, 18 nt, Mycobacterium avium subsp. paratuberculosis
gcacgucacgggccaggc

SEQ ID NO: 2843320 - RNA, 21 nt, Mycobacterium avium subsp. paratuberculosis
gcacgucacgggccaggcgcg

SEQ ID NO: 2843321 - RNA, 22 nt, Mycobacterium avium subsp. paratuberculosis
gcacgucacgggccaggcgcgc

SEQ ID NO: 2843322 - RNA, 12 nt, Mycobacterium avium subsp. paratuberculosis
gcacguccagcc

SEQ ID NO: 2843323 - RNA, 14 nt, Mycobacterium avium subsp. paratuberculosis
gcacguccagcccg

SEQ ID NO: 2843324 - RNA, 15 nt, Mycobacterium avium subsp. paratuberculosis
gcacguccagcccgc

SEQ ID NO: 2843325 - RNA, 19 nt, Mycobacterium avium subsp. paratuberculosis
gcacguccagcccgcgcca

SEQ ID NO: 2843326 - RNA, 20 nt, Mycobacterium avium subsp. paratuberculosis
gcacguccagcccgcgccag

SEQ ID NO: 2843327 - RNA, 21 nt, Mycobacterium avium subsp. paratuberculosis
gcacguccagcccgcgccagc

SEQ ID NO: 2843328 - RNA, 22 nt, Mycobacterium avium subsp. paratuberculosis
gcacguccccgggcaccccggu

SEQ ID NO: 2843329 - RNA, 15 nt, Mycobacterium avium subsp. paratuberculosis
gcacgucccgcccgg

SEQ ID NO: 2843330 - RNA, 17 nt, Mycobacterium avium subsp. paratuberculosis
gcacgucccgcccggcg

SEQ ID NO: 2843331 - RNA, 19 nt, Mycobacterium avium subsp. paratuberculosis
gcacgucccgcccggcgcc

SEQ ID NO: 2843332 - RNA, 20 nt, Mycobacterium avium subsp. paratuberculosis
gcacgucccgcccggcgccg

SEQ ID NO: 2843333 - RNA, 21 nt, Mycobacterium avium subsp. paratuberculosis
gcacgucccgcccggcgccgg

SEQ ID NO: 2843334 - RNA, 22 nt, Mycobacterium avium subsp. paratuberculosis
gcacgucccgcccggcgccggc

SEQ ID NO: 2843335 - RNA, 15 nt, Mycobacterium avium subsp. paratuberculosis
gcacguccgccuccg

SEQ ID NO: 2843336 - RNA, 21 nt, Mycobacterium avium subsp. paratuberculosis
gcacguccuagacacgaauac

SEQ ID NO: 2843337 - RNA, 14 nt, Mycobacterium avium subsp. paratuberculosis
gcacguccucgucg

SEQ ID NO: 2843338 - RNA, 17 nt, Mycobacterium avium subsp. paratuberculosis
gcacguccuugggcucc

SEQ ID NO: 2843339 - RNA, 13 nt, Mycobacterium avium subsp. paratuberculosis
gcacgucgacgcc

SEQ ID NO: 2843340 - RNA, 16 nt, Mycobacterium avium subsp. paratuberculosis
gcacgucgacgcccug

SEQ ID NO: 2843341 - RNA, 17 nt, Mycobacterium avium subsp. paratuberculosis
gcacgucgacgcccugc

SEQ ID NO: 2843342 - RNA, 14 nt, Mycobacterium avium subsp. paratuberculosis
gcacgucgacgccg

SEQ ID NO: 2843343 - RNA, 15 nt, Mycobacterium avium subsp. paratuberculosis
gcacgucgacgccgg

SEQ ID NO: 2843344 - RNA, 17 nt, Mycobacterium avium subsp. paratuberculosis
gcacgucgacgccgguc

SEQ ID NO: 2843345 - RNA, 16 nt, Mycobacterium avium subsp. paratuberculosis
gcacgucgagcaccgc

SEQ ID NO: 2843346 - RNA, 18 nt, Mycobacterium avium subsp. paratuberculosis
gcacgucgagcuccucgg

SEQ ID NO: 2843347 - RNA, 23 nt, Mycobacterium avium subsp. paratuberculosis
gcacgucgagcuccucggccagc

SEQ ID NO: 2843348 - RNA, 15 nt, Mycobacterium avium subsp. paratuberculosis
gcacgucgaggucgg

SEQ ID NO: 2843349 - RNA, 20 nt, Mycobacterium avium subsp. paratuberculosis
gcacgucgaggucggacgcc

SEQ ID NO: 2843350 - RNA, 16 nt, Mycobacterium avium subsp. paratuberculosis
gcacgucgccgccgca

SEQ ID NO: 2843351 - RNA, 13 nt, Mycobacterium avium subsp. paratuberculosis
gcacgucgccggc

SEQ ID NO: 2843352 - RNA, 14 nt, Mycobacterium avium subsp. paratuberculosis
gcacgucgccggcg

SEQ ID NO: 2843353 - RNA, 18 nt, Mycobacterium avium subsp. paratuberculosis
gcacgucgccggcgaccg

SEQ ID NO: 2843354 - RNA, 14 nt, Mycobacterium avium subsp. paratuberculosis
gcacgucgccguuc

SEQ ID NO: 2843355 - RNA, 17 nt, Mycobacterium avium subsp. paratuberculosis
gcacgucgcgcgggguc

SEQ ID NO: 2843356 - RNA, 21 nt, Mycobacterium avium subsp. paratuberculosis
gcacgucggcagguugucgcu

SEQ ID NO: 2843357 - RNA, 13 nt, Mycobacterium avium subsp. paratuberculosis
gcacgucggccac

SEQ ID NO: 2843358 - RNA, 21 nt, Mycobacterium avium subsp. paratuberculosis
gcacgucggccacgccgggca

SEQ ID NO: 2843359 - RNA, 15 nt, Mycobacterium avium subsp. paratuberculosis
gcacgucggccgcca

SEQ ID NO: 2843360 - RNA, 17 nt, Mycobacterium avium subsp. paratuberculosis
gcacgucggcgcgcagg

SEQ ID NO: 2843361 - RNA, 21 nt, Mycobacterium avium subsp. paratuberculosis
gcacgucggcgcgcaggcugg

SEQ ID NO: 2843362 - RNA, 14 nt, Mycobacterium avium subsp. paratuberculosis
gcacgucggcggcc

SEQ ID NO: 2843363 - RNA, 15 nt, Mycobacterium avium subsp. paratuberculosis
gcacgucggcggccg

SEQ ID NO: 2843364 - RNA, 16 nt, Mycobacterium avium subsp. paratuberculosis
gcacgucgggguggcc

SEQ ID NO: 2843365 - RNA, 17 nt, Mycobacterium avium subsp. paratuberculosis
gcacgucgggguggccg

SEQ ID NO: 2843366 - RNA, 20 nt, Mycobacterium avium subsp. paratuberculosis
gcacgucgggguggccggcc

SEQ ID NO: 2843367 - RNA, 23 nt, Mycobacterium avium subsp. paratuberculosis
gcacgugaugagcgaggacgucg

SEQ ID NO: 2843368 - RNA, 14 nt, Mycobacterium avium subsp. paratuberculosis
gcacgugaugcagc

SEQ ID NO: 2843369 - RNA, 17 nt, Mycobacterium avium subsp. paratuberculosis
gcacgugaugcagcuga

SEQ ID NO: 2843370 - RNA, 14 nt, Mycobacterium avium subsp. paratuberculosis
gcacgugcaccgcg

SEQ ID NO: 2843371 - RNA, 20 nt, Mycobacterium avium subsp. paratuberculosis
gcacgugcaccgcggccaac

SEQ ID NO: 2843372 - RNA, 12 nt, Mycobacterium avium subsp. paratuberculosis
gcacgugcaggu

SEQ ID NO: 2843373 - RNA, 17 nt, Mycobacterium avium subsp. paratuberculosis
gcacgugcaggugcggc

SEQ ID NO: 2843374 - RNA, 14 nt, Mycobacterium avium subsp. paratuberculosis
gcacgugcccagcc

SEQ ID NO: 2843375 - RNA, 16 nt, Mycobacterium avium subsp. paratuberculosis
gcacgugcccagcccg

SEQ ID NO: 2843376 - RNA, 23 nt, Mycobacterium avium subsp. paratuberculosis
gcacgugcccagcccgcgcgagc

SEQ ID NO: 2843377 - RNA, 13 nt, Mycobacterium avium subsp. paratuberculosis
gcacgugcccgcc

SEQ ID NO: 2843378 - RNA, 17 nt, Mycobacterium avium subsp. paratuberculosis
gcacgugcgcgccgacc

SEQ ID NO: 2843379 - RNA, 19 nt, Mycobacterium avium subsp. paratuberculosis
gcacgugcgcgccgaccgc

SEQ ID NO: 2843380 - RNA, 20 nt, Mycobacterium avium subsp. paratuberculosis
gcacgugcgcgccgaccgcg

SEQ ID NO: 2843381 - RNA, 16 nt, Mycobacterium avium subsp. paratuberculosis
gcacgugcgcgggaac

SEQ ID NO: 2843382 - RNA, 17 nt, Mycobacterium avium subsp. paratuberculosis
gcacgugcggguuggcg

SEQ ID NO: 2843383 - RNA, 22 nt, Mycobacterium avium subsp. paratuberculosis
gcacgugcggguuggcgccggu

SEQ ID NO: 2843384 - RNA, 15 nt, Mycobacterium avium subsp. paratuberculosis
gcacguggccgggcu

SEQ ID NO: 2843385 - RNA, 17 nt, Mycobacterium avium subsp. paratuberculosis
gcacguggccgggcucg

SEQ ID NO: 2843386 - RNA, 15 nt, Mycobacterium avium subsp. paratuberculosis
gcagaccagcccguc

SEQ ID NO: 2843387 - RNA, 19 nt, Mycobacterium avium subsp. paratuberculosis
gcagaccagcccgucgucc

SEQ ID NO: 2843388 - RNA, 13 nt, Mycobacterium avium subsp. paratuberculosis
gcagacccagcag

SEQ ID NO: 2843389 - RNA, 14 nt, Mycobacterium avium subsp. paratuberculosis
gcagacccagcagc

SEQ ID NO: 2843390 - RNA, 15 nt, Mycobacterium avium subsp. paratuberculosis
gcagacccagcagcg

SEQ ID NO: 2843391 - RNA, 17 nt, Mycobacterium avium subsp. paratuberculosis
gcagacccagcagcggc

SEQ ID NO: 2843392 - RNA, 18 nt, Mycobacterium avium subsp. paratuberculosis
gcagacccagcagcggcc

SEQ ID NO: 2843393 - RNA, 17 nt, Mycobacterium avium subsp. paratuberculosis
gcagacccccagcagcg

SEQ ID NO: 2843394 - RNA, 16 nt, Mycobacterium avium subsp. paratuberculosis
gcagaccccggcgucc

SEQ ID NO: 2843395 - RNA, 17 nt, Mycobacterium avium subsp. paratuberculosis
gcagaccccggcgucca

SEQ ID NO: 2843396 - RNA, 23 nt, Mycobacterium avium subsp. paratuberculosis
gcagaccccggcguccaguagcc

SEQ ID NO: 2843397 - RNA, 18 nt, Mycobacterium avium subsp. paratuberculosis
gcagacccgacgggaacu

SEQ ID NO: 2843398 - RNA, 20 nt, Mycobacterium avium subsp. paratuberculosis
gcagacccgacgggaacucg

SEQ ID NO: 2843399 - RNA, 15 nt, Mycobacterium avium subsp. paratuberculosis
gcagacccgccgcgg

SEQ ID NO: 2843400 - RNA, 16 nt, Mycobacterium avium subsp. paratuberculosis
gcagacccgccgcggc

SEQ ID NO: 2843401 - RNA, 18 nt, Mycobacterium avium subsp. paratuberculosis
gcagacccgccgcggcaa

SEQ ID NO: 2843402 - RNA, 21 nt, Mycobacterium avium subsp. paratuberculosis
gcagacccgccgcggcaacgc

SEQ ID NO: 2843403 - RNA, 22 nt, Mycobacterium avium subsp. paratuberculosis
gcagacccgccgcggcaacgcc

SEQ ID NO: 2843404 - RNA, 15 nt, Mycobacterium avium subsp. paratuberculosis
gcagacccgcgucga

SEQ ID NO: 2843405 - RNA, 15 nt, Mycobacterium avium subsp. paratuberculosis
gcagacccgguggcc

SEQ ID NO: 2843406 - RNA, 16 nt, Mycobacterium avium subsp. paratuberculosis
gcagacccgguggccg

SEQ ID NO: 2843407 - RNA, 17 nt, Mycobacterium avium subsp. paratuberculosis
gcagaccgaacccgggc

SEQ ID NO: 2843408 - RNA, 20 nt, Mycobacterium avium subsp. paratuberculosis
gcagaccgaacccgggcgcg

SEQ ID NO: 2843409 - RNA, 17 nt, Mycobacterium avium subsp. paratuberculosis
gcagaccgaacgucacg

SEQ ID NO: 2843410 - RNA, 20 nt, Mycobacterium avium subsp. paratuberculosis
gcagaccgaacgucacggcg

SEQ ID NO: 2843411 - RNA, 18 nt, Mycobacterium avium subsp. paratuberculosis
gcagaccgccggugcgca

SEQ ID NO: 2843412 - RNA, 18 nt, Mycobacterium avium subsp. paratuberculosis
gcagaccggugagcaccg

SEQ ID NO: 2843413 - RNA, 14 nt, Mycobacterium avium subsp. paratuberculosis
gcagaccgguggcg

SEQ ID NO: 2843414 - RNA, 19 nt, Mycobacterium avium subsp. paratuberculosis
gcagaccguccgguucggc

SEQ ID NO: 2843415 - RNA, 23 nt, Mycobacterium avium subsp. paratuberculosis
gcagaccguccgguucggcggca

SEQ ID NO: 2843416 - RNA, 14 nt, Mycobacterium avium subsp. paratuberculosis
gcagacgaauucgg

SEQ ID NO: 2843417 - RNA, 17 nt, Mycobacterium avium subsp. paratuberculosis
gcagacgcaaaagcccc

SEQ ID NO: 2843418 - RNA, 18 nt, Mycobacterium avium subsp. paratuberculosis
gcagacgcaaaagccccg

SEQ ID NO: 2843419 - RNA, 20 nt, Mycobacterium avium subsp. paratuberculosis
gcagacgcaaaagccccgcg

SEQ ID NO: 2843420 - RNA, 21 nt, Mycobacterium avium subsp. paratuberculosis
gcagacgcaaaagccccgcga

SEQ ID NO: 2843421 - RNA, 20 nt, Mycobacterium avium subsp. paratuberculosis
gcagacgcgaaagcacccga

SEQ ID NO: 2843422 - RNA, 18 nt, Mycobacterium avium subsp. paratuberculosis
gcagacggacacccgcgc

SEQ ID NO: 2843423 - RNA, 20 nt, Mycobacterium avium subsp. paratuberculosis
gcagacggacacccgcgcgg

SEQ ID NO: 2843424 - RNA, 22 nt, Mycobacterium avium subsp. paratuberculosis
gcagacggacacccgcgcggug

SEQ ID NO: 2843425 - RNA, 23 nt, Mycobacterium avium subsp. paratuberculosis
gcagacggacacccgcgcggugc

SEQ ID NO: 2843426 - RNA, 21 nt, Mycobacterium avium subsp. paratuberculosis
gcagacgguaugcccgccgcg

SEQ ID NO: 2843427 - RNA, 22 nt, Mycobacterium avium subsp. paratuberculosis
gcagacgugacgugccccucga

SEQ ID NO: 2843428 - RNA, 15 nt, Mycobacterium avium subsp. paratuberculosis
gcagagcgaugggcg

SEQ ID NO: 2843429 - RNA, 12 nt, Mycobacterium avium subsp. paratuberculosis
gcagagcgguga

SEQ ID NO: 2843430 - RNA, 23 nt, Mycobacterium avium subsp. paratuberculosis
gcagagcggugacaucgccaccu

SEQ ID NO: 2843431 - RNA, 18 nt, Mycobacterium avium subsp. paratuberculosis
gcagauagaucagcaggc

SEQ ID NO: 2843432 - RNA, 15 nt, Mycobacterium avium subsp. paratuberculosis
gcagauagcccagcc

SEQ ID NO: 2843433 - RNA, 18 nt, Mycobacterium avium subsp. paratuberculosis
gcagauagcccagccagc

SEQ ID NO: 2843434 - RNA, 19 nt, Mycobacterium avium subsp. paratuberculosis
gcagauagcccagccagcc

SEQ ID NO: 2843435 - RNA, 20 nt, Mycobacterium avium subsp. paratuberculosis
gcagauagccguacacggcg

SEQ ID NO: 2843436 - RNA, 21 nt, Mycobacterium avium subsp. paratuberculosis
gcagauagccguacacggcgg

SEQ ID NO: 2843437 - RNA, 15 nt, Mycobacterium avium subsp. paratuberculosis
gcagauaggacccgg

SEQ ID NO: 2843438 - RNA, 16 nt, Mycobacterium avium subsp. paratuberculosis
gcagauaggacccggc

SEQ ID NO: 2843439 - RNA, 12 nt, Mycobacterium avium subsp. paratuberculosis
gcagaucaccac

SEQ ID NO: 2843440 - RNA, 17 nt, Mycobacterium avium subsp. paratuberculosis
gcagaucaccacggugg

SEQ ID NO: 2843441 - RNA, 23 nt, Mycobacterium avium subsp. paratuberculosis
gcagaucaccacgguggccgcga

SEQ ID NO: 2843442 - RNA, 17 nt, Mycobacterium avium subsp. paratuberculosis
gcagaucaucgagggcg

SEQ ID NO: 2843443 - RNA, 14 nt, Mycobacterium avium subsp. paratuberculosis
gcagaucccgccgg

SEQ ID NO: 2843444 - RNA, 17 nt, Mycobacterium avium subsp. paratuberculosis
gcagaucccgccggcgg

SEQ ID NO: 2843445 - RNA, 19 nt, Mycobacterium avium subsp. paratuberculosis
gcagaucccgccggcggcc

SEQ ID NO: 2843446 - RNA, 21 nt, Mycobacterium avium subsp. paratuberculosis
gcagaucccgccggcggccac

SEQ ID NO: 2843447 - RNA, 20 nt, Mycobacterium avium subsp. paratuberculosis
gcagauccgcucgccgucgg

SEQ ID NO: 2843448 - RNA, 16 nt, Mycobacterium avium subsp. paratuberculosis
gcagauccucagcagc

SEQ ID NO: 2843449 - RNA, 16 nt, Mycobacterium avium subsp. paratuberculosis
gcagaucgagaucagg

SEQ ID NO: 2843450 - RNA, 18 nt, Mycobacterium avium subsp. paratuberculosis
gcagaucgagaucagggc

SEQ ID NO: 2843451 - RNA, 18 nt, Mycobacterium avium subsp. paratuberculosis
gcagaucgauggggaugg

SEQ ID NO: 2843452 - RNA, 12 nt, Mycobacterium avium subsp. paratuberculosis
gcagaucgccag

SEQ ID NO: 2843453 - RNA, 16 nt, Mycobacterium avium subsp. paratuberculosis
gcagaucgccagcacc

SEQ ID NO: 2843454 - RNA, 19 nt, Mycobacterium avium subsp. paratuberculosis
gcagaucgccagcaccggc

SEQ ID NO: 2843455 - RNA, 20 nt, Mycobacterium avium subsp. paratuberculosis
gcagaucgccagcaccggcg

SEQ ID NO: 2843456 - RNA, 19 nt, Mycobacterium avium subsp. paratuberculosis
gcagaucgcgcaucacccg

SEQ ID NO: 2843457 - RNA, 19 nt, Mycobacterium avium subsp. paratuberculosis
gcagaucgcggcccgccgc

SEQ ID NO: 2843458 - RNA, 17 nt, Mycobacterium avium subsp. paratuberculosis
gcagaucgucgaacucg

SEQ ID NO: 2843459 - RNA, 12 nt, Mycobacterium avium subsp. paratuberculosis
gcagaucgucgg

SEQ ID NO: 2843460 - RNA, 19 nt, Mycobacterium avium subsp. paratuberculosis
gcagaucugcaggguuucc

SEQ ID NO: 2843461 - RNA, 19 nt, Mycobacterium avium subsp. paratuberculosis
gcagaugaugccgucacug

SEQ ID NO: 2843462 - RNA, 15 nt, Mycobacterium avium subsp. paratuberculosis
gcagaugcgcgucgc

SEQ ID NO: 2843463 - RNA, 20 nt, Mycobacterium avium subsp. paratuberculosis
gcagaugcgcgucgcggcgc

SEQ ID NO: 2843464 - RNA, 18 nt, Mycobacterium avium subsp. paratuberculosis
gcagaugcgugcgguggu

SEQ ID NO: 2843465 - RNA, 20 nt, Mycobacterium avium subsp. paratuberculosis
gcagauggggaucgaacggc

SEQ ID NO: 2843466 - RNA, 14 nt, Mycobacterium avium subsp. paratuberculosis
gcagauggucgccg

SEQ ID NO: 2843467 - RNA, 13 nt, Mycobacterium avium subsp. paratuberculosis
gcagauggucggg

SEQ ID NO: 2843468 - RNA, 21 nt, Mycobacterium avium subsp. paratuberculosis
gcagauggucgggacgucggc

SEQ ID NO: 2843469 - RNA, 18 nt, Mycobacterium avium subsp. paratuberculosis
gcagauggugaaguugcc

SEQ ID NO: 2843470 - RNA, 20 nt, Mycobacterium avium subsp. paratuberculosis
gcagcacgcccagcccgcgg

SEQ ID NO: 2843471 - RNA, 17 nt, Mycobacterium avium subsp. paratuberculosis
gcagcacgcccucggcu

SEQ ID NO: 2843472 - RNA, 20 nt, Mycobacterium avium subsp. paratuberculosis
gcagcacgcccucggcuucc

SEQ ID NO: 2843473 - RNA, 14 nt, Mycobacterium avium subsp. paratuberculosis
gcagcacgccgcgg

SEQ ID NO: 2843474 - RNA, 16 nt, Mycobacterium avium subsp. paratuberculosis
gcagcacgccgcggaa

SEQ ID NO: 2843475 - RNA, 23 nt, Mycobacterium avium subsp. paratuberculosis
gcagcacgccgcggaaggccagc

SEQ ID NO: 2843476 - RNA, 20 nt, Mycobacterium avium subsp. paratuberculosis
gcagcacgcugaagcccacc

SEQ ID NO: 2843477 - RNA, 22 nt, Mycobacterium avium subsp. paratuberculosis
gcagcacgcugaagcccaccgc

SEQ ID NO: 2843478 - RNA, 20 nt, Mycobacterium avium subsp. paratuberculosis
gcagcacggcaaugguugcg

SEQ ID NO: 2843479 - RNA, 15 nt, Mycobacterium avium subsp. paratuberculosis
gcagcacugagcggc

SEQ ID NO: 2843480 - RNA, 14 nt, Mycobacterium avium subsp. paratuberculosis
gcagcagaaccagc

SEQ ID NO: 2843481 - RNA, 15 nt, Mycobacterium avium subsp. paratuberculosis
gcagcagaaccagca

SEQ ID NO: 2843482 - RNA, 16 nt, Mycobacterium avium subsp. paratuberculosis
gcagcagaaccagcac

SEQ ID NO: 2843483 - RNA, 14 nt, Mycobacterium avium subsp. paratuberculosis
gcagcagaccgccg

SEQ ID NO: 2843484 - RNA, 19 nt, Mycobacterium avium subsp. paratuberculosis
gcagcagaccgccggugcg

SEQ ID NO: 2843485 - RNA, 23 nt, Mycobacterium avium subsp. paratuberculosis
gcagcagaccgccggugcgcagc

SEQ ID NO: 2843486 - RNA, 15 nt, Mycobacterium avium subsp. paratuberculosis
gcagcagaccgcgau

SEQ ID NO: 2843487 - RNA, 22 nt, Mycobacterium avium subsp. paratuberculosis
gcagcagaccgcgaucagcccc

SEQ ID NO: 2843488 - RNA, 19 nt, Mycobacterium avium subsp. paratuberculosis
gcagcagaugcgccucgau

SEQ ID NO: 2843489 - RNA, 14 nt, Mycobacterium avium subsp. paratuberculosis
gcagcagcaccagc

SEQ ID NO: 2843490 - RNA, 15 nt, Mycobacterium avium subsp. paratuberculosis
gcagcagcaccagcg

SEQ ID NO: 2843491 - RNA, 16 nt, Mycobacterium avium subsp. paratuberculosis
gcagcagcaccagcgc

SEQ ID NO: 2843492 - RNA, 19 nt, Mycobacterium avium subsp. paratuberculosis
gcagcagcaccagcgccgc

SEQ ID NO: 2843493 - RNA, 22 nt, Mycobacterium avium subsp. paratuberculosis
gcagcagcaccagcguggccgg

SEQ ID NO: 2843494 - RNA, 14 nt, Mycobacterium avium subsp. paratuberculosis
gcagcagcaccccg

SEQ ID NO: 2843495 - RNA, 18 nt, Mycobacterium avium subsp. paratuberculosis
gcagcagcaccccgaucg

SEQ ID NO: 2843496 - RNA, 12 nt, Mycobacterium avium subsp. paratuberculosis
gcagcagcagau

SEQ ID NO: 2843497 - RNA, 16 nt, Mycobacterium avium subsp. paratuberculosis
gcagcagcagccacgc

SEQ ID NO: 2843498 - RNA, 14 nt, Mycobacterium avium subsp. paratuberculosis
gcagcagcagcccg

SEQ ID NO: 2843499 - RNA, 12 nt, Mycobacterium avium subsp. paratuberculosis
gcagcagcaggu

SEQ ID NO: 2843500 - RNA, 14 nt, Mycobacterium avium subsp. paratuberculosis
gcagcagcaggucg

SEQ ID NO: 2843501 - RNA, 19 nt, Mycobacterium avium subsp. paratuberculosis
gcagcagcaggucggccag

SEQ ID NO: 2843502 - RNA, 18 nt, Mycobacterium avium subsp. paratuberculosis
gcagcagcaucgguccca

SEQ ID NO: 2843503 - RNA, 17 nt, Mycobacterium avium subsp. paratuberculosis
gcagcagccacgccagc

SEQ ID NO: 2843504 - RNA, 23 nt, Mycobacterium avium subsp. paratuberculosis
gcagcagccacgccagccaggcg

SEQ ID NO: 2843505 - RNA, 14 nt, Mycobacterium avium subsp. paratuberculosis
gcagcagccaugac

SEQ ID NO: 2843506 - RNA, 22 nt, Mycobacterium avium subsp. paratuberculosis
gcagcagcccgaucacccccga

SEQ ID NO: 2843507 - RNA, 12 nt, Mycobacterium avium subsp. paratuberculosis
gcagcagcccgc

SEQ ID NO: 2843508 - RNA, 14 nt, Mycobacterium avium subsp. paratuberculosis
gcagcagcccgccg

SEQ ID NO: 2843509 - RNA, 15 nt, Mycobacterium avium subsp. paratuberculosis
gcagcagcccgccga

SEQ ID NO: 2843510 - RNA, 17 nt, Mycobacterium avium subsp. paratuberculosis
gcagcagccgcagcggc

SEQ ID NO: 2843511 - RNA, 19 nt, Mycobacterium avium subsp. paratuberculosis
gcagcagccgcagcggcgg

SEQ ID NO: 2843512 - RNA, 21 nt, Mycobacterium avium subsp. paratuberculosis
gcagcagccgcagcggcggcu

SEQ ID NO: 2843513 - RNA, 23 nt, Mycobacterium avium subsp. paratuberculosis
gcagcagccgcagcggcggcucg

SEQ ID NO: 2843514 - RNA, 16 nt, Mycobacterium avium subsp. paratuberculosis
gcagcagccgccgggc

SEQ ID NO: 2843515 - RNA, 13 nt, Mycobacterium avium subsp. paratuberculosis
gcagcagccgcgc

SEQ ID NO: 2843516 - RNA, 14 nt, Mycobacterium avium subsp. paratuberculosis
gcagcagccgcgcc

SEQ ID NO: 2843517 - RNA, 16 nt, Mycobacterium avium subsp. paratuberculosis
gcagcagccgcgccac

SEQ ID NO: 2843518 - RNA, 21 nt, Mycobacterium avium subsp. paratuberculosis
gcagcagccgcgccaccgcgg

SEQ ID NO: 2843519 - RNA, 17 nt, Mycobacterium avium subsp. paratuberculosis
gcagcagccgcgccgcc

SEQ ID NO: 2843520 - RNA, 18 nt, Mycobacterium avium subsp. paratuberculosis
gcagcagccgcgccgccg

SEQ ID NO: 2843521 - RNA, 20 nt, Mycobacterium avium subsp. paratuberculosis
gcagcagccgcugcugggug

SEQ ID NO: 2843522 - RNA, 13 nt, Mycobacterium avium subsp. paratuberculosis
gcagcagccggaa

SEQ ID NO: 2843523 - RNA, 21 nt, Mycobacterium avium subsp. paratuberculosis
gcagcagcgaggccucgccgc

SEQ ID NO: 2843524 - RNA, 14 nt, Mycobacterium avium subsp. paratuberculosis
gcagcagcgccagc

SEQ ID NO: 2843525 - RNA, 12 nt, Mycobacterium avium subsp. paratuberculosis
gcagcagcgccc

SEQ ID NO: 2843526 - RNA, 15 nt, Mycobacterium avium subsp. paratuberculosis
gcagcagcgcccacc

SEQ ID NO: 2843527 - RNA, 14 nt, Mycobacterium avium subsp. paratuberculosis
gcagcagcgccgcc

SEQ ID NO: 2843528 - RNA, 16 nt, Mycobacterium avium subsp. paratuberculosis
gcagcagcgccgccac

SEQ ID NO: 2843529 - RNA, 18 nt, Mycobacterium avium subsp. paratuberculosis
gcagcagcgccgcgacga

SEQ ID NO: 2843530 - RNA, 21 nt, Mycobacterium avium subsp. paratuberculosis
gcagcagcgccgcgacgaacu

SEQ ID NO: 2843531 - RNA, 12 nt, Mycobacterium avium subsp. paratuberculosis
gcagcagcgcgg

SEQ ID NO: 2843532 - RNA, 13 nt, Mycobacterium avium subsp. paratuberculosis
gcagcagcgcggc

SEQ ID NO: 2843533 - RNA, 16 nt, Mycobacterium avium subsp. paratuberculosis
gcagcagcgcggcaug

SEQ ID NO: 2843534 - RNA, 16 nt, Mycobacterium avium subsp. paratuberculosis
gcagcagcgcggugcc

SEQ ID NO: 2843535 - RNA, 12 nt, Mycobacterium avium subsp. paratuberculosis
gcagcagcgcgu

SEQ ID NO: 2843536 - RNA, 14 nt, Mycobacterium avium subsp. paratuberculosis
gcagcagcggcagc

SEQ ID NO: 2843537 - RNA, 14 nt, Mycobacterium avium subsp. paratuberculosis
gcagcagcggcuug

SEQ ID NO: 2843538 - RNA, 22 nt, Mycobacterium avium subsp. paratuberculosis
gcagcagcggcuugagcgccag

SEQ ID NO: 2843539 - RNA, 14 nt, Mycobacterium avium subsp. paratuberculosis
gcagcagcgggauc

SEQ ID NO: 2843540 - RNA, 14 nt, Mycobacterium avium subsp. paratuberculosis
gcagcagcucggcg

SEQ ID NO: 2843541 - RNA, 15 nt, Mycobacterium avium subsp. paratuberculosis
gcagcagcucggcga

SEQ ID NO: 2843542 - RNA, 16 nt, Mycobacterium avium subsp. paratuberculosis
gcagcagcucggcgau

SEQ ID NO: 2843543 - RNA, 17 nt, Mycobacterium avium subsp. paratuberculosis
gcagcagcugcgucggc

SEQ ID NO: 2843544 - RNA, 13 nt, Mycobacterium avium subsp. paratuberculosis
gcagcagcuuggc

SEQ ID NO: 2843545 - RNA, 19 nt, Mycobacterium avium subsp. paratuberculosis
gcagcaggaacucccgcgc

SEQ ID NO: 2843546 - RNA, 23 nt, Mycobacterium avium subsp. paratuberculosis
gcagcaggaacucccgcgccgca

SEQ ID NO: 2843547 - RNA, 13 nt, Mycobacterium avium subsp. paratuberculosis
gcagcaggcgccg

SEQ ID NO: 2843548 - RNA, 14 nt, Mycobacterium avium subsp. paratuberculosis
gcagcaggcggacg

SEQ ID NO: 2843549 - RNA, 16 nt, Mycobacterium avium subsp. paratuberculosis
gcagcaggcggacggc

SEQ ID NO: 2843550 - RNA, 15 nt, Mycobacterium avium subsp. paratuberculosis
gcagcagggcgcgca

SEQ ID NO: 2843551 - RNA, 17 nt, Mycobacterium avium subsp. paratuberculosis
gcagcagggcgcgcauc

SEQ ID NO: 2843552 - RNA, 21 nt, Mycobacterium avium subsp. paratuberculosis
gcagcagggcgcgcaucugcu

SEQ ID NO: 2843553 - RNA, 18 nt, Mycobacterium avium subsp. paratuberculosis
gcagcagggugccgccgc

SEQ ID NO: 2843554 - RNA, 18 nt, Mycobacterium avium subsp. paratuberculosis
gcagcagguaaaccagca

SEQ ID NO: 2843555 - RNA, 18 nt, Mycobacterium avium subsp. paratuberculosis
gcagccccugcaccacga

SEQ ID NO: 2843556 - RNA, 19 nt, Mycobacterium avium subsp. paratuberculosis
gcagcccgaacagccgggc

SEQ ID NO: 2843557 - RNA, 23 nt, Mycobacterium avium subsp. paratuberculosis
gcagcccgaacagccgggccagc

SEQ ID NO: 2843558 - RNA, 20 nt, Mycobacterium avium subsp. paratuberculosis
gcagcccgaacagccgggcg

SEQ ID NO: 2843559 - RNA, 23 nt, Mycobacterium avium subsp. paratuberculosis
gcagcccgaacagccgggcggcc

SEQ ID NO: 2843560 - RNA, 17 nt, Mycobacterium avium subsp. paratuberculosis
gcagcccgaccaccucc

SEQ ID NO: 2843561 - RNA, 21 nt, Mycobacterium avium subsp. paratuberculosis
gcagcccgaccuucugcugca

SEQ ID NO: 2843562 - RNA, 18 nt, Mycobacterium avium subsp. paratuberculosis
gcagcccgacguccuuga

SEQ ID NO: 2843563 - RNA, 14 nt, Mycobacterium avium subsp. paratuberculosis
gcagcccgagcggc

SEQ ID NO: 2843564 - RNA, 16 nt, Mycobacterium avium subsp. paratuberculosis
gcagcccgaucgccag

SEQ ID NO: 2843565 - RNA, 21 nt, Mycobacterium avium subsp. paratuberculosis
gcagcccgaucgccagcgccc

SEQ ID NO: 2843566 - RNA, 14 nt, Mycobacterium avium subsp. paratuberculosis
gcagcccgccgacc

SEQ ID NO: 2843567 - RNA, 18 nt, Mycobacterium avium subsp. paratuberculosis
gcagcccgccgaccaccu

SEQ ID NO: 2843568 - RNA, 14 nt, Mycobacterium avium subsp. paratuberculosis
gcagcccgccgaug

SEQ ID NO: 2843569 - RNA, 15 nt, Mycobacterium avium subsp. paratuberculosis
gcagcccgccgaugg

SEQ ID NO: 2843570 - RNA, 14 nt, Mycobacterium avium subsp. paratuberculosis
gcagcccgccgcgg

SEQ ID NO: 2843571 - RNA, 14 nt, Mycobacterium avium subsp. paratuberculosis
gcagcccgccggga

SEQ ID NO: 2843572 - RNA, 15 nt, Mycobacterium avium subsp. paratuberculosis
gcagcccgccgggau

SEQ ID NO: 2843573 - RNA, 18 nt, Mycobacterium avium subsp. paratuberculosis
gcagcccgccgggaugcg

SEQ ID NO: 2843574 - RNA, 15 nt, Mycobacterium avium subsp. paratuberculosis
gcagcccgcguccag

SEQ ID NO: 2843575 - RNA, 17 nt, Mycobacterium avium subsp. paratuberculosis
gcagcccgcguccagca

SEQ ID NO: 2843576 - RNA, 19 nt, Mycobacterium avium subsp. paratuberculosis
gcagcccgcguccagcagc

SEQ ID NO: 2843577 - RNA, 20 nt, Mycobacterium avium subsp. paratuberculosis
gcagcccgcguccagcagca

SEQ ID NO: 2843578 - RNA, 14 nt, Mycobacterium avium subsp. paratuberculosis
gcagcccgcugacc

SEQ ID NO: 2843579 - RNA, 18 nt, Mycobacterium avium subsp. paratuberculosis
gcagcccgcugaccaggc

SEQ ID NO: 2843580 - RNA, 19 nt, Mycobacterium avium subsp. paratuberculosis
gcagcccgcugaccaggcc

SEQ ID NO: 2843581 - RNA, 18 nt, Mycobacterium avium subsp. paratuberculosis
gcagcccggccagccggg

SEQ ID NO: 2843582 - RNA, 12 nt, Mycobacterium avium subsp. paratuberculosis
gcagcccggcgg

SEQ ID NO: 2843583 - RNA, 11 nt, Mycobacterium avium subsp. paratuberculosis
gcagcccggcu

SEQ ID NO: 2843584 - RNA, 22 nt, Mycobacterium avium subsp. paratuberculosis
gcagcccggcuaauucgggccg

SEQ ID NO: 2843585 - RNA, 16 nt, Mycobacterium avium subsp. paratuberculosis
gcagcccggcugcgca

SEQ ID NO: 2843586 - RNA, 18 nt, Mycobacterium avium subsp. paratuberculosis
gcagcccggcugcgcagc

SEQ ID NO: 2843587 - RNA, 21 nt, Mycobacterium avium subsp. paratuberculosis
gcagcccgggcugcagcagcg

SEQ ID NO: 2843588 - RNA, 17 nt, Mycobacterium avium subsp. paratuberculosis
gcagcccgucccggccc

SEQ ID NO: 2843589 - RNA, 15 nt, Mycobacterium avium subsp. paratuberculosis
gcagccgaucuggcg

SEQ ID NO: 2843590 - RNA, 17 nt, Mycobacterium avium subsp. paratuberculosis
gcagccgaugucgucga

SEQ ID NO: 2843591 - RNA, 21 nt, Mycobacterium avium subsp. paratuberculosis
gcagccgaugucgucgaacgc

SEQ ID NO: 2843592 - RNA, 23 nt, Mycobacterium avium subsp. paratuberculosis
gcagccgaugucgucgaacgcgg

SEQ ID NO: 2843593 - RNA, 13 nt, Mycobacterium avium subsp. paratuberculosis
gcagccgcaacac

SEQ ID NO: 2843594 - RNA, 14 nt, Mycobacterium avium subsp. paratuberculosis
gcagccgcaacacg

SEQ ID NO: 2843595 - RNA, 22 nt, Mycobacterium avium subsp. paratuberculosis
gcagccgcaacacggccucgau

SEQ ID NO: 2843596 - RNA, 12 nt, Mycobacterium avium subsp. paratuberculosis
gcagccgcaagg

SEQ ID NO: 2843597 - RNA, 22 nt, Mycobacterium avium subsp. paratuberculosis
gcagccgcaaggugauucgcgc

SEQ ID NO: 2843598 - RNA, 12 nt, Mycobacterium avium subsp. paratuberculosis
gcagccgcacac

SEQ ID NO: 2843599 - RNA, 14 nt, Mycobacterium avium subsp. paratuberculosis
gcagccgcacaccg

SEQ ID NO: 2843600 - RNA, 16 nt, Mycobacterium avium subsp. paratuberculosis
gcagccgcacaccgcg

SEQ ID NO: 2843601 - RNA, 17 nt, Mycobacterium avium subsp. paratuberculosis
gcagccgcacaccgcgg

SEQ ID NO: 2843602 - RNA, 20 nt, Mycobacterium avium subsp. paratuberculosis
gcagccgcacaccgcggcgg

SEQ ID NO: 2843603 - RNA, 21 nt, Mycobacterium avium subsp. paratuberculosis
gcagccgcaccucggggcgug

SEQ ID NO: 2843604 - RNA, 13 nt, Mycobacterium avium subsp. paratuberculosis
gcagccgcagcga

SEQ ID NO: 2843605 - RNA, 15 nt, Mycobacterium avium subsp. paratuberculosis
gcagccgcagcgcgc

SEQ ID NO: 2843606 - RNA, 14 nt, Mycobacterium avium subsp. paratuberculosis
gcagccgcagcggc

SEQ ID NO: 2843607 - RNA, 15 nt, Mycobacterium avium subsp. paratuberculosis
gcagccgcagcggcg

SEQ ID NO: 2843608 - RNA, 14 nt, Mycobacterium avium subsp. paratuberculosis
gcagccgccgcgcc

SEQ ID NO: 2843609 - RNA, 16 nt, Mycobacterium avium subsp. paratuberculosis
gcagccgccgcgccac

SEQ ID NO: 2843610 - RNA, 18 nt, Mycobacterium avium subsp. paratuberculosis
gcagccgccgcggagcgg

SEQ ID NO: 2843611 - RNA, 19 nt, Mycobacterium avium subsp. paratuberculosis
gcagccgccgcggagcggc

SEQ ID NO: 2843612 - RNA, 22 nt, Mycobacterium avium subsp. paratuberculosis
gcagccgccgcggagcggcggu

SEQ ID NO: 2843613 - RNA, 13 nt, Mycobacterium avium subsp. paratuberculosis
gcagccgcgacac

SEQ ID NO: 2843614 - RNA, 15 nt, Mycobacterium avium subsp. paratuberculosis
gcagccgcgcccacc

SEQ ID NO: 2843615 - RNA, 17 nt, Mycobacterium avium subsp. paratuberculosis
gcagccgcgcccacccg

SEQ ID NO: 2843616 - RNA, 18 nt, Mycobacterium avium subsp. paratuberculosis
gcagccgcgcccacccgc

SEQ ID NO: 2843617 - RNA, 14 nt, Mycobacterium avium subsp. paratuberculosis
gcagccgcgccgac

SEQ ID NO: 2843618 - RNA, 15 nt, Mycobacterium avium subsp. paratuberculosis
gcagccgcgccgacg

SEQ ID NO: 2843619 - RNA, 16 nt, Mycobacterium avium subsp. paratuberculosis
gcagccgcgccgacgc

SEQ ID NO: 2843620 - RNA, 17 nt, Mycobacterium avium subsp. paratuberculosis
gcagccgcgccgacgcc

SEQ ID NO: 2843621 - RNA, 14 nt, Mycobacterium avium subsp. paratuberculosis
gcagccgcgccgcc

SEQ ID NO: 2843622 - RNA, 15 nt, Mycobacterium avium subsp. paratuberculosis
gcagccgcgccgccg

SEQ ID NO: 2843623 - RNA, 14 nt, Mycobacterium avium subsp. paratuberculosis
gcagccgcgccggg

SEQ ID NO: 2843624 - RNA, 15 nt, Mycobacterium avium subsp. paratuberculosis
gcagccgcgcgagca

SEQ ID NO: 2843625 - RNA, 18 nt, Mycobacterium avium subsp. paratuberculosis
gcagccgcgcgagcauca

SEQ ID NO: 2843626 - RNA, 13 nt, Mycobacterium avium subsp. paratuberculosis
gcagccgcgcggc

SEQ ID NO: 2843627 - RNA, 15 nt, Mycobacterium avium subsp. paratuberculosis
gcagccgcgcggccg

SEQ ID NO: 2843628 - RNA, 17 nt, Mycobacterium avium subsp. paratuberculosis
gcagccgcgcggccggc

SEQ ID NO: 2843629 - RNA, 18 nt, Mycobacterium avium subsp. paratuberculosis
gcagccgcgcggccggcc

SEQ ID NO: 2843630 - RNA, 14 nt, Mycobacterium avium subsp. paratuberculosis
gcagccgcgcgugc

SEQ ID NO: 2843631 - RNA, 16 nt, Mycobacterium avium subsp. paratuberculosis
gcagccgcgcgugcag

SEQ ID NO: 2843632 - RNA, 18 nt, Mycobacterium avium subsp. paratuberculosis
gcagccgcgcgugcagcc

SEQ ID NO: 2843633 - RNA, 15 nt, Mycobacterium avium subsp. paratuberculosis
gcagccgcgguggcg

SEQ ID NO: 2843634 - RNA, 14 nt, Mycobacterium avium subsp. paratuberculosis
gcagccgcucacac

SEQ ID NO: 2843635 - RNA, 22 nt, Mycobacterium avium subsp. paratuberculosis
gcagccgcucacacagccgcuu

SEQ ID NO: 2843636 - RNA, 17 nt, Mycobacterium avium subsp. paratuberculosis
gcagccgcuccggcccg

SEQ ID NO: 2843637 - RNA, 18 nt, Mycobacterium avium subsp. paratuberculosis
gcagccgcuccggcccga

SEQ ID NO: 2843638 - RNA, 21 nt, Mycobacterium avium subsp. paratuberculosis
gcagccgcucguaguuggggc

SEQ ID NO: 2843639 - RNA, 18 nt, Mycobacterium avium subsp. paratuberculosis
gcagccgcugcagcgccg

SEQ ID NO: 2843640 - RNA, 16 nt, Mycobacterium avium subsp. paratuberculosis
gcagcgaacugccggc

SEQ ID NO: 2843641 - RNA, 17 nt, Mycobacterium avium subsp. paratuberculosis
gcagcgaagcgaggcgc

SEQ ID NO: 2843642 - RNA, 18 nt, Mycobacterium avium subsp. paratuberculosis
gcagcgaagcgaggcgcc

SEQ ID NO: 2843643 - RNA, 22 nt, Mycobacterium avium subsp. paratuberculosis
gcagcgaauacaccguccagcu

SEQ ID NO: 2843644 - RNA, 18 nt, Mycobacterium avium subsp. paratuberculosis
gcagcgaaucggggucga

SEQ ID NO: 2843645 - RNA, 21 nt, Mycobacterium avium subsp. paratuberculosis
gcagcgacaaucggcucgccu

SEQ ID NO: 2843646 - RNA, 23 nt, Mycobacterium avium subsp. paratuberculosis
gcagcgacaaucggcucgccuca

SEQ ID NO: 2843647 - RNA, 14 nt, Mycobacterium avium subsp. paratuberculosis
gcagcgacagcgcg

SEQ ID NO: 2843648 - RNA, 18 nt, Mycobacterium avium subsp. paratuberculosis
gcagcgacagcgcgucgg

SEQ ID NO: 2843649 - RNA, 19 nt, Mycobacterium avium subsp. paratuberculosis
gcagcgacagcgcgucggc

SEQ ID NO: 2843650 - RNA, 17 nt, Mycobacterium avium subsp. paratuberculosis
gcagcgacaugaccacc

SEQ ID NO: 2843651 - RNA, 19 nt, Mycobacterium avium subsp. paratuberculosis
gcagcgacaugaccaccgc

SEQ ID NO: 2843652 - RNA, 17 nt, Mycobacterium avium subsp. paratuberculosis
gcagcgaccgcggauga

SEQ ID NO: 2843653 - RNA, 20 nt, Mycobacterium avium subsp. paratuberculosis
gcagcgaccugguccaccgc

SEQ ID NO: 2843654 - RNA, 21 nt, Mycobacterium avium subsp. paratuberculosis
gcagcgaccugguccaccgcg

SEQ ID NO: 2843655 - RNA, 14 nt, Mycobacterium avium subsp. paratuberculosis
gcagcgacgcggug

SEQ ID NO: 2843656 - RNA, 17 nt, Mycobacterium avium subsp. paratuberculosis
gcagcgacggaucggcc

SEQ ID NO: 2843657 - RNA, 19 nt, Mycobacterium avium subsp. paratuberculosis
gcagcgacggaucggccgc

SEQ ID NO: 2843658 - RNA, 20 nt, Mycobacterium avium subsp. paratuberculosis
gcagcgacggaucggccgcg

SEQ ID NO: 2843659 - RNA, 21 nt, Mycobacterium avium subsp. paratuberculosis
gcagcgacggaucggccgcgu

SEQ ID NO: 2843660 - RNA, 16 nt, Mycobacterium avium subsp. paratuberculosis
gcagcgacucguuggc

SEQ ID NO: 2843661 - RNA, 18 nt, Mycobacterium avium subsp. paratuberculosis
gcagcgacucguuggccg

SEQ ID NO: 2843662 - RNA, 20 nt, Mycobacterium avium subsp. paratuberculosis
gcagcgacucguuggccggc

SEQ ID NO: 2843663 - RNA, 16 nt, Mycobacterium avium subsp. paratuberculosis
gcagcgacuggcccuc

SEQ ID NO: 2843664 - RNA, 21 nt, Mycobacterium avium subsp. paratuberculosis
gcagcgacuggcccucggagg

SEQ ID NO: 2843665 - RNA, 19 nt, Mycobacterium avium subsp. paratuberculosis
gcagcgacuugaccagcag

SEQ ID NO: 2843666 - RNA, 20 nt, Mycobacterium avium subsp. paratuberculosis
gcagcgacuugaccagcagc

SEQ ID NO: 2843667 - RNA, 16 nt, Mycobacterium avium subsp. paratuberculosis
gcagcgagaaccggcg

SEQ ID NO: 2843668 - RNA, 19 nt, Mycobacterium avium subsp. paratuberculosis
gcagcgagaaccggcgcag

SEQ ID NO: 2843669 - RNA, 20 nt, Mycobacterium avium subsp. paratuberculosis
gcagcgagaaccggcgcaga

SEQ ID NO: 2843670 - RNA, 17 nt, Mycobacterium avium subsp. paratuberculosis
gcagcgagaccggcacg

SEQ ID NO: 2843671 - RNA, 22 nt, Mycobacterium avium subsp. paratuberculosis
gcagcgagaccggcacggugca

SEQ ID NO: 2843672 - RNA, 13 nt, Mycobacterium avium subsp. paratuberculosis
gcagcgagaccuc

SEQ ID NO: 2843673 - RNA, 19 nt, Mycobacterium avium subsp. paratuberculosis
gcagcgagaccucccggcg

SEQ ID NO: 2843674 - RNA, 16 nt, Mycobacterium avium subsp. paratuberculosis
gcagcgagaucccggu

SEQ ID NO: 2843675 - RNA, 17 nt, Mycobacterium avium subsp. paratuberculosis
gcagcgagcacagcggc

SEQ ID NO: 2843676 - RNA, 19 nt, Mycobacterium avium subsp. paratuberculosis
gcagcgagcacagcggcgg

SEQ ID NO: 2843677 - RNA, 20 nt, Mycobacterium avium subsp. paratuberculosis
gcagcgagcacagcggcgga

SEQ ID NO: 2843678 - RNA, 16 nt, Mycobacterium avium subsp. paratuberculosis
gcagcgaggccucgcc

SEQ ID NO: 2843679 - RNA, 21 nt, Mycobacterium avium subsp. paratuberculosis
gcagcgaggccucgccgcugg

SEQ ID NO: 2843680 - RNA, 16 nt, Mycobacterium avium subsp. paratuberculosis
gcagcgaggcgauggu

SEQ ID NO: 2843681 - RNA, 16 nt, Mycobacterium avium subsp. paratuberculosis
gcagcgaggcgcgcag

SEQ ID NO: 2843682 - RNA, 16 nt, Mycobacterium avium subsp. paratuberculosis
gcagcgaggcguccag

SEQ ID NO: 2843683 - RNA, 17 nt, Mycobacterium avium subsp. paratuberculosis
gcagcgaggcguccagc

SEQ ID NO: 2843684 - RNA, 21 nt, Mycobacterium avium subsp. paratuberculosis
gcagcgagucgaagccguggc

SEQ ID NO: 2843685 - RNA, 22 nt, Mycobacterium avium subsp. paratuberculosis
gcagcgagucgaaggcgcgggc

SEQ ID NO: 2843686 - RNA, 13 nt, Mycobacterium avium subsp. paratuberculosis
gcagcgaucggcg

SEQ ID NO: 2843687 - RNA, 14 nt, Mycobacterium avium subsp. paratuberculosis
gcagcgaucggcgg

SEQ ID NO: 2843688 - RNA, 18 nt, Mycobacterium avium subsp. paratuberculosis
gcagcgaucggcggcucg

SEQ ID NO: 2843689 - RNA, 13 nt, Mycobacterium avium subsp. paratuberculosis
gcagcgcaccggc

SEQ ID NO: 2843690 - RNA, 13 nt, Mycobacterium avium subsp. paratuberculosis
gcagcgcagcacc

SEQ ID NO: 2843691 - RNA, 14 nt, Mycobacterium avium subsp. paratuberculosis
gcagcgcagcacca

SEQ ID NO: 2843692 - RNA, 17 nt, Mycobacterium avium subsp. paratuberculosis
gcagcgcagcaccaucc

SEQ ID NO: 2843693 - RNA, 15 nt, Mycobacterium avium subsp. paratuberculosis
gcagcgcagcgucgg

SEQ ID NO: 2843694 - RNA, 16 nt, Mycobacterium avium subsp. paratuberculosis
gcagcgcagcgucggc

SEQ ID NO: 2843695 - RNA, 17 nt, Mycobacterium avium subsp. paratuberculosis
gcagcgcagcgucggcg

SEQ ID NO: 2843696 - RNA, 17 nt, Mycobacterium avium subsp. paratuberculosis
gcagcgcauccgacacc

SEQ ID NO: 2843697 - RNA, 20 nt, Mycobacterium avium subsp. paratuberculosis
gcagcgcauccgacaccgcc

SEQ ID NO: 2843698 - RNA, 15 nt, Mycobacterium avium subsp. paratuberculosis
gcagcgcaucgccgg

SEQ ID NO: 2843699 - RNA, 16 nt, Mycobacterium avium subsp. paratuberculosis
gcagcgcaucgccggc

SEQ ID NO: 2843700 - RNA, 16 nt, Mycobacterium avium subsp. paratuberculosis
gcagcgcaucguugcc

SEQ ID NO: 2843701 - RNA, 14 nt, Mycobacterium avium subsp. paratuberculosis
gcagcgcauggaga

SEQ ID NO: 2843702 - RNA, 21 nt, Mycobacterium avium subsp. paratuberculosis
gcagcgccaacauggcgcaga

SEQ ID NO: 2843703 - RNA, 18 nt, Mycobacterium avium subsp. paratuberculosis
gcagcgccacaauggauc

SEQ ID NO: 2843704 - RNA, 12 nt, Mycobacterium avium subsp. paratuberculosis
gcagcgccacca

SEQ ID NO: 2843705 - RNA, 14 nt, Mycobacterium avium subsp. paratuberculosis
gcagcgccagcacc

SEQ ID NO: 2843706 - RNA, 17 nt, Mycobacterium avium subsp. paratuberculosis
gcagcgccagcaccgcc

SEQ ID NO: 2843707 - RNA, 19 nt, Mycobacterium avium subsp. paratuberculosis
gcagcgccagcaccgccug

SEQ ID NO: 2843708 - RNA, 17 nt, Mycobacterium avium subsp. paratuberculosis
gcagcgccagcaccggg

SEQ ID NO: 2843709 - RNA, 21 nt, Mycobacterium avium subsp. paratuberculosis
gcagcgccagcaccgggccca

SEQ ID NO: 2843710 - RNA, 23 nt, Mycobacterium avium subsp. paratuberculosis
gcagcgccagcaccgggcccagc

SEQ ID NO: 2843711 - RNA, 18 nt, Mycobacterium avium subsp. paratuberculosis
gcagcgccagcagcggca

SEQ ID NO: 2843712 - RNA, 22 nt, Mycobacterium avium subsp. paratuberculosis
gcagcgccagcagcggcacccg

SEQ ID NO: 2843713 - RNA, 12 nt, Mycobacterium avium subsp. paratuberculosis
gcagcgccagcg

SEQ ID NO: 2843714 - RNA, 14 nt, Mycobacterium avium subsp. paratuberculosis
gcagcgccagcgcg

SEQ ID NO: 2843715 - RNA, 13 nt, Mycobacterium avium subsp. paratuberculosis
gcagcgccagcgg

SEQ ID NO: 2843716 - RNA, 15 nt, Mycobacterium avium subsp. paratuberculosis
gcagcgccagcggga

SEQ ID NO: 2843717 - RNA, 14 nt, Mycobacterium avium subsp. paratuberculosis
gcagcgccaggcag

SEQ ID NO: 2843718 - RNA, 15 nt, Mycobacterium avium subsp. paratuberculosis
gcagcgccaggcaga

SEQ ID NO: 2843719 - RNA, 20 nt, Mycobacterium avium subsp. paratuberculosis
gcagcgccaggcagaagcuc

SEQ ID NO: 2843720 - RNA, 16 nt, Mycobacterium avium subsp. paratuberculosis
gcagcgcccaccgcuc

SEQ ID NO: 2843721 - RNA, 15 nt, Mycobacterium avium subsp. paratuberculosis
gcagcgcccagccga

SEQ ID NO: 2843722 - RNA, 23 nt, Mycobacterium avium subsp. paratuberculosis
gcagcgcccagccgagccgggcc

SEQ ID NO: 2843723 - RNA, 15 nt, Mycobacterium avium subsp. paratuberculosis
gcagcgccccggucc

SEQ ID NO: 2843724 - RNA, 18 nt, Mycobacterium avium subsp. paratuberculosis
gcagcgccccgguccggc

SEQ ID NO: 2843725 - RNA, 21 nt, Mycobacterium avium subsp. paratuberculosis
gcagcgcuccugcagcgcggc

SEQ ID NO: 2843726 - RNA, 17 nt, Mycobacterium avium subsp. paratuberculosis
gcagcgcucgucgucgg

SEQ ID NO: 2843727 - RNA, 15 nt, Mycobacterium avium subsp. paratuberculosis
gcagcgcuuccaagu

SEQ ID NO: 2843728 - RNA, 17 nt, Mycobacterium avium subsp. paratuberculosis
gcagcgcuuccaagucc

SEQ ID NO: 2843729 - RNA, 14 nt, Mycobacterium avium subsp. paratuberculosis
gcagcggacccggu

SEQ ID NO: 2843730 - RNA, 20 nt, Mycobacterium avium subsp. paratuberculosis
gcagcggacccggucggccg

SEQ ID NO: 2843731 - RNA, 19 nt, Mycobacterium avium subsp. paratuberculosis
gcagcggaugccggaggcg

SEQ ID NO: 2843732 - RNA, 21 nt, Mycobacterium avium subsp. paratuberculosis
gcagcggaugccggaggcgcc

SEQ ID NO: 2843733 - RNA, 22 nt, Mycobacterium avium subsp. paratuberculosis
gcagcggaugccggaggcgccg

SEQ ID NO: 2843734 - RNA, 21 nt, Mycobacterium avium subsp. paratuberculosis
gcagcggcacccgguccggcc

SEQ ID NO: 2843735 - RNA, 23 nt, Mycobacterium avium subsp. paratuberculosis
gcagcggcacccgguccggcccg

SEQ ID NO: 2843736 - RNA, 15 nt, Mycobacterium avium subsp. paratuberculosis
gcagcggcagccacg

SEQ ID NO: 2843737 - RNA, 16 nt, Mycobacterium avium subsp. paratuberculosis
gcagcggcagccacgg

SEQ ID NO: 2843738 - RNA, 18 nt, Mycobacterium avium subsp. paratuberculosis
gcagcggcagccacggca

SEQ ID NO: 2843739 - RNA, 17 nt, Mycobacterium avium subsp. paratuberculosis
gcagcggcagcgaacug

SEQ ID NO: 2843740 - RNA, 18 nt, Mycobacterium avium subsp. paratuberculosis
gcagcggcaggucgucgu

SEQ ID NO: 2843741 - RNA, 16 nt, Mycobacterium avium subsp. paratuberculosis
gcagcggcaguagcgc

SEQ ID NO: 2843742 - RNA, 18 nt, Mycobacterium avium subsp. paratuberculosis
gcagcggcaugcccccga

SEQ ID NO: 2843743 - RNA, 22 nt, Mycobacterium avium subsp. paratuberculosis
gcagcggccgcaaucggcgccg

SEQ ID NO: 2843744 - RNA, 13 nt, Mycobacterium avium subsp. paratuberculosis
gcagcggccggcg

SEQ ID NO: 2843745 - RNA, 14 nt, Mycobacterium avium subsp. paratuberculosis
gcagcggccggcgc

SEQ ID NO: 2843746 - RNA, 16 nt, Mycobacterium avium subsp. paratuberculosis
gcagcggccggcgcag

SEQ ID NO: 2843747 - RNA, 17 nt, Mycobacterium avium subsp. paratuberculosis
gcagcggccggcgcagc

SEQ ID NO: 2843748 - RNA, 16 nt, Mycobacterium avium subsp. paratuberculosis
gcagcggcgccgcagc

SEQ ID NO: 2843749 - RNA, 16 nt, Mycobacterium avium subsp. paratuberculosis
gcagcggcgccgggau

SEQ ID NO: 2843750 - RNA, 15 nt, Mycobacterium avium subsp. paratuberculosis
gcagcggcggcacgg

SEQ ID NO: 2843751 - RNA, 12 nt, Mycobacterium avium subsp. paratuberculosis
gcagcggcggcc

SEQ ID NO: 2843752 - RNA, 15 nt, Mycobacterium avium subsp. paratuberculosis
gcagcggcggccagu

SEQ ID NO: 2843753 - RNA, 15 nt, Mycobacterium avium subsp. paratuberculosis
gcagcggcgguugcu

SEQ ID NO: 2843754 - RNA, 12 nt, Mycobacterium avium subsp. paratuberculosis
gcagcggcguca

SEQ ID NO: 2843755 - RNA, 16 nt, Mycobacterium avium subsp. paratuberculosis
gcagcggcuccgagcg

SEQ ID NO: 2843756 - RNA, 17 nt, Mycobacterium avium subsp. paratuberculosis
gcagcggcucggccuuc

SEQ ID NO: 2843757 - RNA, 20 nt, Mycobacterium avium subsp. paratuberculosis
gcagcggcugcugcagcgcc

SEQ ID NO: 2843758 - RNA, 23 nt, Mycobacterium avium subsp. paratuberculosis
gcagcggcugcugcagcgcccgg

SEQ ID NO: 2843759 - RNA, 19 nt, Mycobacterium avium subsp. paratuberculosis
gcagcggcuugagcgccag

SEQ ID NO: 2843760 - RNA, 20 nt, Mycobacterium avium subsp. paratuberculosis
gcagcggcuugagcgccagc

SEQ ID NO: 2843761 - RNA, 21 nt, Mycobacterium avium subsp. paratuberculosis
gcagcggcuuggucaccagcu

SEQ ID NO: 2843762 - RNA, 22 nt, Mycobacterium avium subsp. paratuberculosis
gcagcggcuuggucaccagcuc

SEQ ID NO: 2843763 - RNA, 15 nt, Mycobacterium avium subsp. paratuberculosis
gcagcgggauuggcg

SEQ ID NO: 2843764 - RNA, 15 nt, Mycobacterium avium subsp. paratuberculosis
gcagcgggcccgggc

SEQ ID NO: 2843765 - RNA, 16 nt, Mycobacterium avium subsp. paratuberculosis
gcagcgggcuggcgua

SEQ ID NO: 2843766 - RNA, 18 nt, Mycobacterium avium subsp. paratuberculosis
gcagcggggaggcccagc

SEQ ID NO: 2843767 - RNA, 20 nt, Mycobacterium avium subsp. paratuberculosis
gcagcggggaggcccagccc

SEQ ID NO: 2843768 - RNA, 21 nt, Mycobacterium avium subsp. paratuberculosis
gcagcggggaggcccagcccg

SEQ ID NO: 2843769 - RNA, 23 nt, Mycobacterium avium subsp. paratuberculosis
gcagcggggaggcccagcccgcc

SEQ ID NO: 2843770 - RNA, 14 nt, Mycobacterium avium subsp. paratuberculosis
gcagcggggcgaac

SEQ ID NO: 2843771 - RNA, 19 nt, Mycobacterium avium subsp. paratuberculosis
gcagcggggcgaacccggc

SEQ ID NO: 2843772 - RNA, 21 nt, Mycobacterium avium subsp. paratuberculosis
gcagcggggcgaacccggcgc

SEQ ID NO: 2843773 - RNA, 22 nt, Mycobacterium avium subsp. paratuberculosis
gcagcggggcgaacccggcgcc

SEQ ID NO: 2843774 - RNA, 18 nt, Mycobacterium avium subsp. paratuberculosis
gcagcggggugagcaccg

SEQ ID NO: 2843775 - RNA, 14 nt, Mycobacterium avium subsp. paratuberculosis
gcagcggggugugc

SEQ ID NO: 2843776 - RNA, 21 nt, Mycobacterium avium subsp. paratuberculosis
gcagcggggugugcucggcgg

SEQ ID NO: 2843777 - RNA, 15 nt, Mycobacterium avium subsp. paratuberculosis
gcagcgggucgucgg

SEQ ID NO: 2843778 - RNA, 17 nt, Mycobacterium avium subsp. paratuberculosis
gcagcgggucgucgggc

SEQ ID NO: 2843779 - RNA, 19 nt, Mycobacterium avium subsp. paratuberculosis
gcagcgggucgucgggccg

SEQ ID NO: 2843780 - RNA, 14 nt, Mycobacterium avium subsp. paratuberculosis
gcagcggguugcgg

SEQ ID NO: 2843781 - RNA, 22 nt, Mycobacterium avium subsp. paratuberculosis
gcagcggguugcgguccccgga

SEQ ID NO: 2843782 - RNA, 13 nt, Mycobacterium avium subsp. paratuberculosis
gcagcggucggcg

SEQ ID NO: 2843783 - RNA, 18 nt, Mycobacterium avium subsp. paratuberculosis
gcagcggugacacccagg

SEQ ID NO: 2843784 - RNA, 15 nt, Mycobacterium avium subsp. paratuberculosis
gcagcggugaucgcg

SEQ ID NO: 2843785 - RNA, 18 nt, Mycobacterium avium subsp. paratuberculosis
gcagcggugaucgcguca

SEQ ID NO: 2843786 - RNA, 16 nt, Mycobacterium avium subsp. paratuberculosis
gcagcggugcagcccc

SEQ ID NO: 2843787 - RNA, 17 nt, Mycobacterium avium subsp. paratuberculosis
gcagcggugcagccccg

SEQ ID NO: 2843788 - RNA, 13 nt, Mycobacterium avium subsp. paratuberculosis
gcagcgguuggcc

SEQ ID NO: 2843789 - RNA, 22 nt, Mycobacterium avium subsp. paratuberculosis
gcagcgguuggcccuucgaccu

SEQ ID NO: 2843790 - RNA, 15 nt, Mycobacterium avium subsp. paratuberculosis
gcagcgucaucgcgu

SEQ ID NO: 2843791 - RNA, 15 nt, Mycobacterium avium subsp. paratuberculosis
gcagcgucccgucgg

SEQ ID NO: 2843792 - RNA, 14 nt, Mycobacterium avium subsp. paratuberculosis
gcagcgucgccagc

SEQ ID NO: 2843793 - RNA, 17 nt, Mycobacterium avium subsp. paratuberculosis
gcagcgucgccagccgc

SEQ ID NO: 2843794 - RNA, 18 nt, Mycobacterium avium subsp. paratuberculosis
gcagcgucgccagccgcc

SEQ ID NO: 2843795 - RNA, 19 nt, Mycobacterium avium subsp. paratuberculosis
gcagcgucggguacaccga

SEQ ID NO: 2843796 - RNA, 21 nt, Mycobacterium avium subsp. paratuberculosis
gcagcgucggguacaccgagc

SEQ ID NO: 2843797 - RNA, 14 nt, Mycobacterium avium subsp. paratuberculosis
gcagcgucucccgg

SEQ ID NO: 2843798 - RNA, 18 nt, Mycobacterium avium subsp. paratuberculosis
gcagcgucucccgggugc

SEQ ID NO: 2843799 - RNA, 19 nt, Mycobacterium avium subsp. paratuberculosis
gcagcgucugcgccagcug

SEQ ID NO: 2843800 - RNA, 22 nt, Mycobacterium avium subsp. paratuberculosis
gcagcgucugcgccagcugggu

SEQ ID NO: 2843801 - RNA, 23 nt, Mycobacterium avium subsp. paratuberculosis
gcagcgucugcgccagcugggug

SEQ ID NO: 2843802 - RNA, 16 nt, Mycobacterium avium subsp. paratuberculosis
gcagcgucugcgcccc

SEQ ID NO: 2843803 - RNA, 19 nt, Mycobacterium avium subsp. paratuberculosis
gcagcgucugcgccccggc

SEQ ID NO: 2843804 - RNA, 17 nt, Mycobacterium avium subsp. paratuberculosis
gcagcgucuugcccagc

SEQ ID NO: 2843805 - RNA, 19 nt, Mycobacterium avium subsp. paratuberculosis
gcagcgucuugcccagcgg

SEQ ID NO: 2843806 - RNA, 21 nt, Mycobacterium avium subsp. paratuberculosis
gcagcgucuugcccagcgggg

SEQ ID NO: 2843807 - RNA, 17 nt, Mycobacterium avium subsp. paratuberculosis
gcagcgugcugacgucg

SEQ ID NO: 2843808 - RNA, 15 nt, Mycobacterium avium subsp. paratuberculosis
gcagcgugggcaccg

SEQ ID NO: 2843809 - RNA, 21 nt, Mycobacterium avium subsp. paratuberculosis
gcagcugggacagcgucacca

SEQ ID NO: 2843810 - RNA, 17 nt, Mycobacterium avium subsp. paratuberculosis
gcagcugggagauguug

SEQ ID NO: 2843811 - RNA, 13 nt, Mycobacterium avium subsp. paratuberculosis
gcagcuguuccug

SEQ ID NO: 2843812 - RNA, 19 nt, Mycobacterium avium subsp. paratuberculosis
gcagcuguucgggcagaug

SEQ ID NO: 2843813 - RNA, 18 nt, Mycobacterium avium subsp. paratuberculosis
gcagcuguugcggcguca

SEQ ID NO: 2843814 - RNA, 19 nt, Mycobacterium avium subsp. paratuberculosis
gcagcuguugcggcgucag

SEQ ID NO: 2843815 - RNA, 17 nt, Mycobacterium avium subsp. paratuberculosis
gcagcuucaugcccgcg

SEQ ID NO: 2843816 - RNA, 16 nt, Mycobacterium avium subsp. paratuberculosis
gcagcuuccgccucgg

SEQ ID NO: 2843817 - RNA, 19 nt, Mycobacterium avium subsp. paratuberculosis
gcagcuuccgccucggcga

SEQ ID NO: 2843818 - RNA, 20 nt, Mycobacterium avium subsp. paratuberculosis
gcagcuuccgccucggcgag

SEQ ID NO: 2843819 - RNA, 15 nt, Mycobacterium avium subsp. paratuberculosis
gcagcuucuggucau

SEQ ID NO: 2843820 - RNA, 21 nt, Mycobacterium avium subsp. paratuberculosis
gcagcuugacgucggucagca

SEQ ID NO: 2843821 - RNA, 15 nt, Mycobacterium avium subsp. paratuberculosis
gcagcuugaucgccg

SEQ ID NO: 2843822 - RNA, 18 nt, Mycobacterium avium subsp. paratuberculosis
gcagcuugaucgccgggg

SEQ ID NO: 2843823 - RNA, 14 nt, Mycobacterium avium subsp. paratuberculosis
gcagcuuggcggug

SEQ ID NO: 2843824 - RNA, 15 nt, Mycobacterium avium subsp. paratuberculosis
gcagcuuggcggugg

SEQ ID NO: 2843825 - RNA, 18 nt, Mycobacterium avium subsp. paratuberculosis
gcagcuugggggccgacg

SEQ ID NO: 2843826 - RNA, 20 nt, Mycobacterium avium subsp. paratuberculosis
gcagcuugggggccgacgcu

SEQ ID NO: 2843827 - RNA, 20 nt, Mycobacterium avium subsp. paratuberculosis
gcaggaacaaccgcagcggc

SEQ ID NO: 2843828 - RNA, 17 nt, Mycobacterium avium subsp. paratuberculosis
gcaggaacagcgacccg

SEQ ID NO: 2843829 - RNA, 15 nt, Mycobacterium avium subsp. paratuberculosis
gcaggaacgccuugg

SEQ ID NO: 2843830 - RNA, 17 nt, Mycobacterium avium subsp. paratuberculosis
gcaggaacuccagcagc

SEQ ID NO: 2843831 - RNA, 18 nt, Mycobacterium avium subsp. paratuberculosis
gcaggaacuccagcagcu

SEQ ID NO: 2843832 - RNA, 19 nt, Mycobacterium avium subsp. paratuberculosis
gcaggaacuccagcagcug

SEQ ID NO: 2843833 - RNA, 16 nt, Mycobacterium avium subsp. paratuberculosis
gcaggaaguucuucgc

SEQ ID NO: 2843834 - RNA, 18 nt, Mycobacterium avium subsp. paratuberculosis
gcaggaauuccagcgaca

SEQ ID NO: 2843835 - RNA, 13 nt, Mycobacterium avium subsp. paratuberculosis
gcaggaccaggcc

SEQ ID NO: 2843836 - RNA, 22 nt, Mycobacterium avium subsp. paratuberculosis
gcaggacccggugcccaccguc

SEQ ID NO: 2843837 - RNA, 16 nt, Mycobacterium avium subsp. paratuberculosis
gcaggaccgagccgcg

SEQ ID NO: 2843838 - RNA, 15 nt, Mycobacterium avium subsp. paratuberculosis
gcaggaccuugucgg

SEQ ID NO: 2843839 - RNA, 15 nt, Mycobacterium avium subsp. paratuberculosis
gcaggacgcgcccgg

SEQ ID NO: 2843840 - RNA, 16 nt, Mycobacterium avium subsp. paratuberculosis
gcaggacgcgcccggc

SEQ ID NO: 2843841 - RNA, 17 nt, Mycobacterium avium subsp. paratuberculosis
gcaggacgcgcccggcg

SEQ ID NO: 2843842 - RNA, 18 nt, Mycobacterium avium subsp. paratuberculosis
gcaggacgcgcccggcga

SEQ ID NO: 2843843 - RNA, 16 nt, Mycobacterium avium subsp. paratuberculosis
gcaggacgggggccgg

SEQ ID NO: 2843844 - RNA, 17 nt, Mycobacterium avium subsp. paratuberculosis
gcaggacgggggccggu

SEQ ID NO: 2843845 - RNA, 13 nt, Mycobacterium avium subsp. paratuberculosis
gcaggacgguggc

SEQ ID NO: 2843846 - RNA, 15 nt, Mycobacterium avium subsp. paratuberculosis
gcaggacgguggccg

SEQ ID NO: 2843847 - RNA, 14 nt, Mycobacterium avium subsp. paratuberculosis
gcaggagaucggcg

SEQ ID NO: 2843848 - RNA, 22 nt, Mycobacterium avium subsp. paratuberculosis
gcaggagaucggcgcggagcgu

SEQ ID NO: 2843849 - RNA, 15 nt, Mycobacterium avium subsp. paratuberculosis
gcaggauccgcucga

SEQ ID NO: 2843850 - RNA, 17 nt, Mycobacterium avium subsp. paratuberculosis
gcaggauccgcucgacg

SEQ ID NO: 2843851 - RNA, 15 nt, Mycobacterium avium subsp. paratuberculosis
gcaggauccggacga

SEQ ID NO: 2843852 - RNA, 16 nt, Mycobacterium avium subsp. paratuberculosis
gcaggaucgagccggc

SEQ ID NO: 2843853 - RNA, 23 nt, Mycobacterium avium subsp. paratuberculosis
gcaggaucgagccggccgucagg

SEQ ID NO: 2843854 - RNA, 15 nt, Mycobacterium avium subsp. paratuberculosis
gcaggaucgcgguga

SEQ ID NO: 2843855 - RNA, 18 nt, Mycobacterium avium subsp. paratuberculosis
gcaggaucuccggccggu

SEQ ID NO: 2843856 - RNA, 18 nt, Mycobacterium avium subsp. paratuberculosis
gcaggaucuggugcgcgc

SEQ ID NO: 2843857 - RNA, 20 nt, Mycobacterium avium subsp. paratuberculosis
gcaggaucuggugcgcgcgc

SEQ ID NO: 2843858 - RNA, 19 nt, Mycobacterium avium subsp. paratuberculosis
gcaggaugaccgcgucggc

SEQ ID NO: 2843859 - RNA, 16 nt, Mycobacterium avium subsp. paratuberculosis
gcaggaugcccagcac

SEQ ID NO: 2843860 - RNA, 23 nt, Mycobacterium avium subsp. paratuberculosis
gcaggaugccgcguuccacgcag

SEQ ID NO: 2843861 - RNA, 17 nt, Mycobacterium avium subsp. paratuberculosis
gcaggaugcguuggccg

SEQ ID NO: 2843862 - RNA, 12 nt, Mycobacterium avium subsp. paratuberculosis
gcaggauggccu

SEQ ID NO: 2843863 - RNA, 21 nt, Mycobacterium avium subsp. paratuberculosis
gcaggauggccugcacggugc

SEQ ID NO: 2843864 - RNA, 15 nt, Mycobacterium avium subsp. paratuberculosis
gcaggauggucagcg

SEQ ID NO: 2843865 - RNA, 18 nt, Mycobacterium avium subsp. paratuberculosis
gcaggauggucagcgagu

SEQ ID NO: 2843866 - RNA, 15 nt, Mycobacterium avium subsp. paratuberculosis
gcaggaugucguagg

SEQ ID NO: 2843867 - RNA, 15 nt, Mycobacterium avium subsp. paratuberculosis
gcaggcacuccuggu

SEQ ID NO: 2843868 - RNA, 12 nt, Mycobacterium avium subsp. paratuberculosis
gcaggcagcagc

SEQ ID NO: 2843869 - RNA, 15 nt, Mycobacterium avium subsp. paratuberculosis
gcaggcagcagcacc

SEQ ID NO: 2843870 - RNA, 16 nt, Mycobacterium avium subsp. paratuberculosis
gcaggcagcagcaccc

SEQ ID NO: 2843871 - RNA, 13 nt, Mycobacterium avium subsp. paratuberculosis
gcaggcagccguu

SEQ ID NO: 2843872 - RNA, 15 nt, Mycobacterium avium subsp. paratuberculosis
gcaggcaggccggca

SEQ ID NO: 2843873 - RNA, 17 nt, Mycobacterium avium subsp. paratuberculosis
gcaggcaggccggcagc

SEQ ID NO: 2843874 - RNA, 19 nt, Mycobacterium avium subsp. paratuberculosis
gcaggcaggccggcagccg

SEQ ID NO: 2843875 - RNA, 17 nt, Mycobacterium avium subsp. paratuberculosis
gcaggcaucgcgugccg

SEQ ID NO: 2843876 - RNA, 21 nt, Mycobacterium avium subsp. paratuberculosis
gcaggcauuuccagguccggg

SEQ ID NO: 2843877 - RNA, 18 nt, Mycobacterium avium subsp. paratuberculosis
gcaggccacgcccacgcc

SEQ ID NO: 2843878 - RNA, 16 nt, Mycobacterium avium subsp. paratuberculosis
gcaggccaggugcagc

SEQ ID NO: 2843879 - RNA, 17 nt, Mycobacterium avium subsp. paratuberculosis
gcaggccaggugcagcu

SEQ ID NO: 2843880 - RNA, 20 nt, Mycobacterium avium subsp. paratuberculosis
gcaggccaggugcagcugca

SEQ ID NO: 2843881 - RNA, 15 nt, Mycobacterium avium subsp. paratuberculosis
gcaggcccaacguga

SEQ ID NO: 2843882 - RNA, 21 nt, Mycobacterium avium subsp. paratuberculosis
gcaggccccggauccgucgcc

SEQ ID NO: 2843883 - RNA, 23 nt, Mycobacterium avium subsp. paratuberculosis
gcaggccccggauccgucgcccc

SEQ ID NO: 2843884 - RNA, 24 nt, Mycobacterium avium subsp. paratuberculosis
gcaggccccggauccgucgccccg

SEQ ID NO: 2843885 - RNA, 13 nt, Mycobacterium avium subsp. paratuberculosis
gcaggccccgggg

SEQ ID NO: 2843886 - RNA, 20 nt, Mycobacterium avium subsp. paratuberculosis
gcaggccccuccagcuggag

SEQ ID NO: 2843887 - RNA, 18 nt, Mycobacterium avium subsp. paratuberculosis
gcaggcccgagcccgacg

SEQ ID NO: 2843888 - RNA, 14 nt, Mycobacterium avium subsp. paratuberculosis
gcaggcccgggcgg

SEQ ID NO: 2843889 - RNA, 15 nt, Mycobacterium avium subsp. paratuberculosis
gcaggcccgggcggc

SEQ ID NO: 2843890 - RNA, 21 nt, Mycobacterium avium subsp. paratuberculosis
gcaggcccgguagauauggcc

SEQ ID NO: 2843891 - RNA, 14 nt, Mycobacterium avium subsp. paratuberculosis
gcaggcccucgacg

SEQ ID NO: 2843892 - RNA, 14 nt, Mycobacterium avium subsp. paratuberculosis
gcaggcccucggcc

SEQ ID NO: 2843893 - RNA, 17 nt, Mycobacterium avium subsp. paratuberculosis
gcaggcccucggccagc

SEQ ID NO: 2843894 - RNA, 18 nt, Mycobacterium avium subsp. paratuberculosis
gcaggcugacgcgaccgc

SEQ ID NO: 2843895 - RNA, 20 nt, Mycobacterium avium subsp. paratuberculosis
gcaggcugacgcgaccgcgc

SEQ ID NO: 2843896 - RNA, 17 nt, Mycobacterium avium subsp. paratuberculosis
gcaggcugaucucggcg

SEQ ID NO: 2843897 - RNA, 19 nt, Mycobacterium avium subsp. paratuberculosis
gcaggcuggcaucgucggc

SEQ ID NO: 2843898 - RNA, 13 nt, Mycobacterium avium subsp. paratuberculosis
gcaggcuggucug

SEQ ID NO: 2843899 - RNA, 16 nt, Mycobacterium avium subsp. paratuberculosis
gcaggcuggucuggug

SEQ ID NO: 2843900 - RNA, 16 nt, Mycobacterium avium subsp. paratuberculosis
gcaggcuguccugcgg

SEQ ID NO: 2843901 - RNA, 15 nt, Mycobacterium avium subsp. paratuberculosis
gcaggcuucgcagca

SEQ ID NO: 2843902 - RNA, 14 nt, Mycobacterium avium subsp. paratuberculosis
gcagggaauucagc

SEQ ID NO: 2843903 - RNA, 13 nt, Mycobacterium avium subsp. paratuberculosis
gcagggacgggcg

SEQ ID NO: 2843904 - RNA, 16 nt, Mycobacterium avium subsp. paratuberculosis
gcagggauucggccau

SEQ ID NO: 2843905 - RNA, 23 nt, Mycobacterium avium subsp. paratuberculosis
gcagggauucggccaugccgcgc

SEQ ID NO: 2843906 - RNA, 14 nt, Mycobacterium avium subsp. paratuberculosis
gcagggcaccgacg

SEQ ID NO: 2843907 - RNA, 17 nt, Mycobacterium avium subsp. paratuberculosis
gcagggcaucucccgcg

SEQ ID NO: 2843908 - RNA, 12 nt, Mycobacterium avium subsp. paratuberculosis
gcagggccaccg

SEQ ID NO: 2843909 - RNA, 19 nt, Mycobacterium avium subsp. paratuberculosis
gcagggccaccgucagggu

SEQ ID NO: 2843910 - RNA, 14 nt, Mycobacterium avium subsp. paratuberculosis
gcagggccagcagc

SEQ ID NO: 2843911 - RNA, 15 nt, Mycobacterium avium subsp. paratuberculosis
gcagggccagcagcc

SEQ ID NO: 2843912 - RNA, 18 nt, Mycobacterium avium subsp. paratuberculosis
gcagggccagcgccucgg

SEQ ID NO: 2843913 - RNA, 19 nt, Mycobacterium avium subsp. paratuberculosis
gcagggccagcgccucggc

SEQ ID NO: 2843914 - RNA, 15 nt, Mycobacterium avium subsp. paratuberculosis
gcagggccagcggca

SEQ ID NO: 2843915 - RNA, 17 nt, Mycobacterium avium subsp. paratuberculosis
gcagggccagcggcaac

SEQ ID NO: 2843916 - RNA, 19 nt, Mycobacterium avium subsp. paratuberculosis
gcagggccagcggcaacug

SEQ ID NO: 2843917 - RNA, 17 nt, Mycobacterium avium subsp. paratuberculosis
gcagggccgcuacgccg

SEQ ID NO: 2843918 - RNA, 15 nt, Mycobacterium avium subsp. paratuberculosis
gcagggccgggucga

SEQ ID NO: 2843919 - RNA, 16 nt, Mycobacterium avium subsp. paratuberculosis
gcagggcgaacggcgg

SEQ ID NO: 2843920 - RNA, 14 nt, Mycobacterium avium subsp. paratuberculosis
gcagggcgccggug

SEQ ID NO: 2843921 - RNA, 15 nt, Mycobacterium avium subsp. paratuberculosis
gcagggcgccgguga

SEQ ID NO: 2843922 - RNA, 12 nt, Mycobacterium avium subsp. paratuberculosis
gcagggcggcac

SEQ ID NO: 2843923 - RNA, 20 nt, Mycobacterium avium subsp. paratuberculosis
gcagggcggcaccgaucggc

SEQ ID NO: 2843924 - RNA, 21 nt, Mycobacterium avium subsp. paratuberculosis
gcagggcggcaccgaucggca

SEQ ID NO: 2843925 - RNA, 15 nt, Mycobacterium avium subsp. paratuberculosis
gcagggcggccggcc

SEQ ID NO: 2843926 - RNA, 18 nt, Mycobacterium avium subsp. paratuberculosis
gcagggggacgaaccagu

SEQ ID NO: 2843927 - RNA, 23 nt, Mycobacterium avium subsp. paratuberculosis
gcagggggcgcagccgaucgacg

SEQ ID NO: 2843928 - RNA, 17 nt, Mycobacterium avium subsp. paratuberculosis
gcaggguccgccgucga

SEQ ID NO: 2843929 - RNA, 19 nt, Mycobacterium avium subsp. paratuberculosis
gcaggguccgccgucgagu

SEQ ID NO: 2843930 - RNA, 18 nt, Mycobacterium avium subsp. paratuberculosis
gcagggucgagaucagca

SEQ ID NO: 2843931 - RNA, 23 nt, Mycobacterium avium subsp. paratuberculosis
gcagggucgagaucagcaccggg

SEQ ID NO: 2843932 - RNA, 22 nt, Mycobacterium avium subsp. paratuberculosis
gcagggugaccgaggccgcccg

SEQ ID NO: 2843933 - RNA, 15 nt, Mycobacterium avium subsp. paratuberculosis
gcagggugccgccgc

SEQ ID NO: 2843934 - RNA, 12 nt, Mycobacterium avium subsp. paratuberculosis
gcaggguggcca

SEQ ID NO: 2843935 - RNA, 14 nt, Mycobacterium avium subsp. paratuberculosis
gcaggguggccagc

SEQ ID NO: 2843936 - RNA, 23 nt, Mycobacterium avium subsp. paratuberculosis
gcaggguuuccucgagcaucucg

SEQ ID NO: 2843937 - RNA, 17 nt, Mycobacterium avium subsp. paratuberculosis
gcaggguuuucacgucg

SEQ ID NO: 2843938 - RNA, 19 nt, Mycobacterium avium subsp. paratuberculosis
gcagguagaagccgcgacg

SEQ ID NO: 2843939 - RNA, 17 nt, Mycobacterium avium subsp. paratuberculosis
gcagguagaucgccagc

SEQ ID NO: 2843940 - RNA, 23 nt, Mycobacterium avium subsp. paratuberculosis
gcagguagccgccguagccggcg

SEQ ID NO: 2843941 - RNA, 17 nt, Mycobacterium avium subsp. paratuberculosis
gcagguaggcgccgcuc

SEQ ID NO: 2843942 - RNA, 20 nt, Mycobacterium avium subsp. paratuberculosis
gcagguagguggccagccgg

SEQ ID NO: 2843943 - RNA, 21 nt, Mycobacterium avium subsp. paratuberculosis
gcagguagguggccagccggg

SEQ ID NO: 2843944 - RNA, 20 nt, Mycobacterium avium subsp. paratuberculosis
gcagguauuuggugaccugc

SEQ ID NO: 2843945 - RNA, 16 nt, Mycobacterium avium subsp. paratuberculosis
gcaggucacccuccuc

SEQ ID NO: 2843946 - RNA, 14 nt, Mycobacterium avium subsp. paratuberculosis
gcaggucaccggau

SEQ ID NO: 2843947 - RNA, 23 nt, Mycobacterium avium subsp. paratuberculosis
gcaggucaccggaugcacgugca

SEQ ID NO: 2843948 - RNA, 15 nt, Mycobacterium avium subsp. paratuberculosis
gcaggucagccaggu

SEQ ID NO: 2843949 - RNA, 19 nt, Mycobacterium avium subsp. paratuberculosis
gcagguccacccgccccgc

SEQ ID NO: 2843950 - RNA, 23 nt, Mycobacterium avium subsp. paratuberculosis
gcagguccacccgccccgccgcg

SEQ ID NO: 2843951 - RNA, 18 nt, Mycobacterium avium subsp. paratuberculosis
gcagguccauggccuuga

SEQ ID NO: 2843952 - RNA, 20 nt, Mycobacterium avium subsp. paratuberculosis
gcagguccauggccuugacg

SEQ ID NO: 2843953 - RNA, 20 nt, Mycobacterium avium subsp. paratuberculosis
gcagguccgccggugccagc

SEQ ID NO: 2843954 - RNA, 13 nt, Mycobacterium avium subsp. paratuberculosis
gcagguccguggu

SEQ ID NO: 2843955 - RNA, 14 nt, Mycobacterium avium subsp. paratuberculosis
gcagguccguggug

SEQ ID NO: 2843956 - RNA, 15 nt, Mycobacterium avium subsp. paratuberculosis
gcagguccucgaucg

SEQ ID NO: 2843957 - RNA, 17 nt, Mycobacterium avium subsp. paratuberculosis
gcagguccuguccgguc

SEQ ID NO: 2843958 - RNA, 15 nt, Mycobacterium avium subsp. paratuberculosis
gcaggucgagcaugc

SEQ ID NO: 2843959 - RNA, 21 nt, Mycobacterium avium subsp. paratuberculosis
gcaggucgagcaugcguccgg

SEQ ID NO: 2843960 - RNA, 22 nt, Mycobacterium avium subsp. paratuberculosis
gcaggucgaggccggccagcgg

SEQ ID NO: 2843961 - RNA, 12 nt, Mycobacterium avium subsp. paratuberculosis
gcaggucgcggu

SEQ ID NO: 2843962 - RNA, 17 nt, Mycobacterium avium subsp. paratuberculosis
gcaggucgcggugggcg

SEQ ID NO: 2843963 - RNA, 14 nt, Mycobacterium avium subsp. paratuberculosis
gcaggucggccagc

SEQ ID NO: 2843964 - RNA, 16 nt, Mycobacterium avium subsp. paratuberculosis
gcaggucggccagcgc

SEQ ID NO: 2843965 - RNA, 17 nt, Mycobacterium avium subsp. paratuberculosis
gcaggucggccagcgcc

SEQ ID NO: 2843966 - RNA, 22 nt, Mycobacterium avium subsp. paratuberculosis
gcaggucggccagcgccgcccg

SEQ ID NO: 2843967 - RNA, 23 nt, Mycobacterium avium subsp. paratuberculosis
gcaggucggccagcgccgcccgg

SEQ ID NO: 2843968 - RNA, 18 nt, Mycobacterium avium subsp. paratuberculosis
gcaggucggccagcugcg

SEQ ID NO: 2843969 - RNA, 22 nt, Mycobacterium avium subsp. paratuberculosis
gcaggucggccagcugcggguu

SEQ ID NO: 2843970 - RNA, 16 nt, Mycobacterium avium subsp. paratuberculosis
gcaggucggcgggagc

SEQ ID NO: 2843971 - RNA, 21 nt, Mycobacterium avium subsp. paratuberculosis
gcaggucggcgggagccggcg

SEQ ID NO: 2843972 - RNA, 21 nt, Mycobacterium avium subsp. paratuberculosis
gcaggucggcgugcucgucgc

SEQ ID NO: 2843973 - RNA, 18 nt, Mycobacterium avium subsp. paratuberculosis
gcaggucgggcucgcgca

SEQ ID NO: 2843974 - RNA, 23 nt, Mycobacterium avium subsp. paratuberculosis
gcaggucggugcgcgggguggcg

SEQ ID NO: 2843975 - RNA, 21 nt, Mycobacterium avium subsp. paratuberculosis
gcaggucguaguaggcgccga

SEQ ID NO: 2843976 - RNA, 19 nt, Mycobacterium avium subsp. paratuberculosis
gcaggucguccgacaggau

SEQ ID NO: 2843977 - RNA, 12 nt, Mycobacterium avium subsp. paratuberculosis
gcaggucgucga

SEQ ID NO: 2843978 - RNA, 14 nt, Mycobacterium avium subsp. paratuberculosis
gcagucgcuggucg

SEQ ID NO: 2843979 - RNA, 17 nt, Mycobacterium avium subsp. paratuberculosis
gcagucggccugcagcu

SEQ ID NO: 2843980 - RNA, 15 nt, Mycobacterium avium subsp. paratuberculosis
gcagucggcgucgcg

SEQ ID NO: 2843981 - RNA, 15 nt, Mycobacterium avium subsp. paratuberculosis
gcagucgugacgcgg

SEQ ID NO: 2843982 - RNA, 21 nt, Mycobacterium avium subsp. paratuberculosis
gcagucgugacgcggcgucgg

SEQ ID NO: 2843983 - RNA, 16 nt, Mycobacterium avium subsp. paratuberculosis
gcagucguucggccag

SEQ ID NO: 2843984 - RNA, 22 nt, Mycobacterium avium subsp. paratuberculosis
gcagucguucggccagcaccag

SEQ ID NO: 2843985 - RNA, 16 nt, Mycobacterium avium subsp. paratuberculosis
gcagucugccgguggc

SEQ ID NO: 2843986 - RNA, 21 nt, Mycobacterium avium subsp. paratuberculosis
gcagucuuaucuaucuucggc

SEQ ID NO: 2843987 - RNA, 22 nt, Mycobacterium avium subsp. paratuberculosis
gcagucuuaucuaucuucggcg

SEQ ID NO: 2843988 - RNA, 18 nt, Mycobacterium avium subsp. paratuberculosis
gcagucuuguugaccuuc

SEQ ID NO: 2843989 - RNA, 20 nt, Mycobacterium avium subsp. paratuberculosis
gcagucuuguugaccuucuc

SEQ ID NO: 2843990 - RNA, 22 nt, Mycobacterium avium subsp. paratuberculosis
gcagugaaauucgcgccucggu

SEQ ID NO: 2843991 - RNA, 17 nt, Mycobacterium avium subsp. paratuberculosis
gcagugagggaacgccg

SEQ ID NO: 2843992 - RNA, 20 nt, Mycobacterium avium subsp. paratuberculosis
gcagugagggaacgccgauc

SEQ ID NO: 2843993 - RNA, 13 nt, Mycobacterium avium subsp. paratuberculosis
gcagugaucggcg

SEQ ID NO: 2843994 - RNA, 17 nt, Mycobacterium avium subsp. paratuberculosis
gcagugaucggcggaac

SEQ ID NO: 2843995 - RNA, 20 nt, Mycobacterium avium subsp. paratuberculosis
gcagugaucggcggaacccg

SEQ ID NO: 2843996 - RNA, 21 nt, Mycobacterium avium subsp. paratuberculosis
gcagugaucggcggaacccgg

SEQ ID NO: 2843997 - RNA, 23 nt, Mycobacterium avium subsp. paratuberculosis
gcagugaucggcggaacccgggu

SEQ ID NO: 2843998 - RNA, 16 nt, Mycobacterium avium subsp. paratuberculosis
gcagugcacgacgacc

SEQ ID NO: 2843999 - RNA, 18 nt, Mycobacterium avium subsp. paratuberculosis
gcagugcacgacgaccgc

SEQ ID NO: 2844000 - RNA, 21 nt, Mycobacterium avium subsp. paratuberculosis
gcagugcacgacgaccgcguc

SEQ ID NO: 2844001 - RNA, 12 nt, Mycobacterium avium subsp. paratuberculosis
gcagugcaucgc

SEQ ID NO: 2844002 - RNA, 17 nt, Mycobacterium avium subsp. paratuberculosis
gcagugccaacacggcg

SEQ ID NO: 2844003 - RNA, 19 nt, Mycobacterium avium subsp. paratuberculosis
gcagugccaacacggcggc

SEQ ID NO: 2844004 - RNA, 20 nt, Mycobacterium avium subsp. paratuberculosis
gcagugccaacacggcggcg

SEQ ID NO: 2844005 - RNA, 21 nt, Mycobacterium avium subsp. paratuberculosis
gcagugccaacacggcggcgc

SEQ ID NO: 2844006 - RNA, 17 nt, Mycobacterium avium subsp. paratuberculosis
gcagugccaccaccacg

SEQ ID NO: 2844007 - RNA, 22 nt, Mycobacterium avium subsp. paratuberculosis
gcagugccaccaccacggccag

SEQ ID NO: 2844008 - RNA, 18 nt, Mycobacterium avium subsp. paratuberculosis
gcagugccccguccggcg

SEQ ID NO: 2844009 - RNA, 20 nt, Mycobacterium avium subsp. paratuberculosis
gcagugccccguccggcgcc

SEQ ID NO: 2844010 - RNA, 16 nt, Mycobacterium avium subsp. paratuberculosis
gcagugcccgcccagc

SEQ ID NO: 2844011 - RNA, 12 nt, Mycobacterium avium subsp. paratuberculosis
gcagugccgcac

SEQ ID NO: 2844012 - RNA, 13 nt, Mycobacterium avium subsp. paratuberculosis
gcagugccgcacc

SEQ ID NO: 2844013 - RNA, 16 nt, Mycobacterium avium subsp. paratuberculosis
gcagugccgcaccagc

SEQ ID NO: 2844014 - RNA, 19 nt, Mycobacterium avium subsp. paratuberculosis
gcagugccgcaccagcacc

SEQ ID NO: 2844015 - RNA, 13 nt, Mycobacterium avium subsp. paratuberculosis
gcagugccggcgc

SEQ ID NO: 2844016 - RNA, 15 nt, Mycobacterium avium subsp. paratuberculosis
gcagugccggcgcac

SEQ ID NO: 2844017 - RNA, 16 nt, Mycobacterium avium subsp. paratuberculosis
gcagugccggcgcacc

SEQ ID NO: 2844018 - RNA, 18 nt, Mycobacterium avium subsp. paratuberculosis
gcagugccggcgcaccgc

SEQ ID NO: 2844019 - RNA, 21 nt, Mycobacterium avium subsp. paratuberculosis
gcagugccggcgcaccgcguc

SEQ ID NO: 2844020 - RNA, 20 nt, Mycobacterium avium subsp. paratuberculosis
gcagugccggugcagcaccu

SEQ ID NO: 2844021 - RNA, 23 nt, Mycobacterium avium subsp. paratuberculosis
gcagugccggugcagcaccucga

SEQ ID NO: 2844022 - RNA, 15 nt, Mycobacterium avium subsp. paratuberculosis
gcagugcgaucgccg

SEQ ID NO: 2844023 - RNA, 18 nt, Mycobacterium avium subsp. paratuberculosis
gcagugcgaucgccguga

SEQ ID NO: 2844024 - RNA, 16 nt, Mycobacterium avium subsp. paratuberculosis
gcagugcgcggcgucc

SEQ ID NO: 2844025 - RNA, 16 nt, Mycobacterium avium subsp. paratuberculosis
gcaguguccagucggc

SEQ ID NO: 2844026 - RNA, 17 nt, Mycobacterium avium subsp. paratuberculosis
gcaguguccagucggcc

SEQ ID NO: 2844027 - RNA, 20 nt, Mycobacterium avium subsp. paratuberculosis
gcaguguccgaucgccuccu

SEQ ID NO: 2844028 - RNA, 17 nt, Mycobacterium avium subsp. paratuberculosis
gcagugucggaaucggc

SEQ ID NO: 2844029 - RNA, 17 nt, Mycobacterium avium subsp. paratuberculosis
gcaguuccggagcgcgg

SEQ ID NO: 2844030 - RNA, 16 nt, Mycobacterium avium subsp. paratuberculosis
gcaguuccucgccgga

SEQ ID NO: 2844031 - RNA, 13 nt, Mycobacterium avium subsp. paratuberculosis
gcaguucgaccgg

SEQ ID NO: 2844032 - RNA, 13 nt, Mycobacterium avium subsp. paratuberculosis
gcaguucgaucac

SEQ ID NO: 2844033 - RNA, 13 nt, Mycobacterium avium subsp. paratuberculosis
gcaguucgaugcc

SEQ ID NO: 2844034 - RNA, 18 nt, Mycobacterium avium subsp. paratuberculosis
gcaguucgaugccgggca

SEQ ID NO: 2844035 - RNA, 20 nt, Mycobacterium avium subsp. paratuberculosis
gcaguucgaugcgcucggcg

SEQ ID NO: 2844036 - RNA, 20 nt, Mycobacterium avium subsp. paratuberculosis
gcaguucgggaucgucgccg

SEQ ID NO: 2844037 - RNA, 21 nt, Mycobacterium avium subsp. paratuberculosis
gcaguucguccacgcuggcgg

SEQ ID NO: 2844038 - RNA, 22 nt, Mycobacterium avium subsp. paratuberculosis
gcaguucguccacgcuggcggu

SEQ ID NO: 2844039 - RNA, 22 nt, Mycobacterium avium subsp. paratuberculosis
gcaguuuggucauguaccaggc

SEQ ID NO: 2844040 - RNA, 15 nt, Mycobacterium avium subsp. paratuberculosis
gcaguuuguccugcu

SEQ ID NO: 2844041 - RNA, 18 nt, Mycobacterium avium subsp. paratuberculosis
gcauacaccuugucggcg

SEQ ID NO: 2844042 - RNA, 21 nt, Mycobacterium avium subsp. paratuberculosis
gcauacaccuugucggcgagc

SEQ ID NO: 2844043 - RNA, 15 nt, Mycobacterium avium subsp. paratuberculosis
gcauaccgcccgcgc

SEQ ID NO: 2844044 - RNA, 21 nt, Mycobacterium avium subsp. paratuberculosis
gcauacugcuugccgucgacg

SEQ ID NO: 2844045 - RNA, 17 nt, Mycobacterium avium subsp. paratuberculosis
gcauagcgccgcucggc

SEQ ID NO: 2844046 - RNA, 18 nt, Mycobacterium avium subsp. paratuberculosis
gcauagcgggagccggcc

SEQ ID NO: 2844047 - RNA, 15 nt, Mycobacterium avium subsp. paratuberculosis
gcauagcuggcgccg

SEQ ID NO: 2844048 - RNA, 16 nt, Mycobacterium avium subsp. paratuberculosis
gcauagcuggcgccga

SEQ ID NO: 2844049 - RNA, 15 nt, Mycobacterium avium subsp. paratuberculosis
gcauaggccagcacc

SEQ ID NO: 2844050 - RNA, 21 nt, Mycobacterium avium subsp. paratuberculosis
gcauaguccagcucgcgaagc

SEQ ID NO: 2844051 - RNA, 14 nt, Mycobacterium avium subsp. paratuberculosis
gcauagucggcccg

SEQ ID NO: 2844052 - RNA, 15 nt, Mycobacterium avium subsp. paratuberculosis
gcaucaaauucagga

SEQ ID NO: 2844053 - RNA, 14 nt, Mycobacterium avium subsp. paratuberculosis
gcaucaacugcacc

SEQ ID NO: 2844054 - RNA, 17 nt, Mycobacterium avium subsp. paratuberculosis
gcaucaacugcaccagc

SEQ ID NO: 2844055 - RNA, 21 nt, Mycobacterium avium subsp. paratuberculosis
gcaucaacugcaccagcggcg

SEQ ID NO: 2844056 - RNA, 22 nt, Mycobacterium avium subsp. paratuberculosis
gcaucaacugcaccagcggcgc

SEQ ID NO: 2844057 - RNA, 16 nt, Mycobacterium avium subsp. paratuberculosis
gcaucaauuacaacug

SEQ ID NO: 2844058 - RNA, 14 nt, Mycobacterium avium subsp. paratuberculosis
gcaucacccggcgc

SEQ ID NO: 2844059 - RNA, 18 nt, Mycobacterium avium subsp. paratuberculosis
gcaucacccggcgcgcgg

SEQ ID NO: 2844060 - RNA, 23 nt, Mycobacterium avium subsp. paratuberculosis
gcaucaccgaggucaccgcgacc

SEQ ID NO: 2844061 - RNA, 22 nt, Mycobacterium avium subsp. paratuberculosis
gcaucaccgccuuccgccacgc

SEQ ID NO: 2844062 - RNA, 20 nt, Mycobacterium avium subsp. paratuberculosis
gcaucgacaugcccggcgac

SEQ ID NO: 2844063 - RNA, 20 nt, Mycobacterium avium subsp. paratuberculosis
gcaucgacugcgacacccgc

SEQ ID NO: 2844064 - RNA, 18 nt, Mycobacterium avium subsp. paratuberculosis
gcaucgagaugcugugga

SEQ ID NO: 2844065 - RNA, 18 nt, Mycobacterium avium subsp. paratuberculosis
gcaucgagcugcaacgcg

SEQ ID NO: 2844066 - RNA, 19 nt, Mycobacterium avium subsp. paratuberculosis
gcaucgagcugcaacgcgu

SEQ ID NO: 2844067 - RNA, 22 nt, Mycobacterium avium subsp. paratuberculosis
gcaucgagcugcaacgcgucgg

SEQ ID NO: 2844068 - RNA, 15 nt, Mycobacterium avium subsp. paratuberculosis
gcaucgaggaccggc

SEQ ID NO: 2844069 - RNA, 16 nt, Mycobacterium avium subsp. paratuberculosis
gcaucgaggaccggcg

SEQ ID NO: 2844070 - RNA, 17 nt, Mycobacterium avium subsp. paratuberculosis
gcaucgaggaccggcgc

SEQ ID NO: 2844071 - RNA, 21 nt, Mycobacterium avium subsp. paratuberculosis
gcaucgaggaccggcgccggc

SEQ ID NO: 2844072 - RNA, 16 nt, Mycobacterium avium subsp. paratuberculosis
gcaucgaggaucgcca

SEQ ID NO: 2844073 - RNA, 17 nt, Mycobacterium avium subsp. paratuberculosis
gcaucgaugccggcaac

SEQ ID NO: 2844074 - RNA, 20 nt, Mycobacterium avium subsp. paratuberculosis
gcaucgaugccggcaaccgc

SEQ ID NO: 2844075 - RNA, 18 nt, Mycobacterium avium subsp. paratuberculosis
gcaucgauggcgggcgcg

SEQ ID NO: 2844076 - RNA, 21 nt, Mycobacterium avium subsp. paratuberculosis
gcaucgauggcgggcgcgccg

SEQ ID NO: 2844077 - RNA, 20 nt, Mycobacterium avium subsp. paratuberculosis
gcaucgcacagauacgcgac

SEQ ID NO: 2844078 - RNA, 15 nt, Mycobacterium avium subsp. paratuberculosis
gcaucgccaaggcgc

SEQ ID NO: 2844079 - RNA, 17 nt, Mycobacterium avium subsp. paratuberculosis
gcaucgccaaggcgcug

SEQ ID NO: 2844080 - RNA, 19 nt, Mycobacterium avium subsp. paratuberculosis
gcaucgccaaggcgcugug

SEQ ID NO: 2844081 - RNA, 16 nt, Mycobacterium avium subsp. paratuberculosis
gcaucgccaccgucgu

SEQ ID NO: 2844082 - RNA, 19 nt, Mycobacterium avium subsp. paratuberculosis
gcaucgccaccgucgucga

SEQ ID NO: 2844083 - RNA, 13 nt, Mycobacterium avium subsp. paratuberculosis
gcaucgccagcac

SEQ ID NO: 2844084 - RNA, 13 nt, Mycobacterium avium subsp. paratuberculosis
gcaucgccgaacc

SEQ ID NO: 2844085 - RNA, 23 nt, Mycobacterium avium subsp. paratuberculosis
gcaucgccgaaccgggcgcgcag

SEQ ID NO: 2844086 - RNA, 12 nt, Mycobacterium avium subsp. paratuberculosis
gcaucgccgaga

SEQ ID NO: 2844087 - RNA, 12 nt, Mycobacterium avium subsp. paratuberculosis
gcaucgccgagc

SEQ ID NO: 2844088 - RNA, 17 nt, Mycobacterium avium subsp. paratuberculosis
gcaucgccgagggcgac

SEQ ID NO: 2844089 - RNA, 13 nt, Mycobacterium avium subsp. paratuberculosis
gcaucgccgccaa

SEQ ID NO: 2844090 - RNA, 13 nt, Mycobacterium avium subsp. paratuberculosis
gcaucgccgcgac

SEQ ID NO: 2844091 - RNA, 16 nt, Mycobacterium avium subsp. paratuberculosis
gcaucgccgcgacccg

SEQ ID NO: 2844092 - RNA, 14 nt, Mycobacterium avium subsp. paratuberculosis
gcaucgccggcgau

SEQ ID NO: 2844093 - RNA, 20 nt, Mycobacterium avium subsp. paratuberculosis
gcaucgccggcgaugcgcgc

SEQ ID NO: 2844094 - RNA, 15 nt, Mycobacterium avium subsp. paratuberculosis
gcaucgccggcgcgc

SEQ ID NO: 2844095 - RNA, 18 nt, Mycobacterium avium subsp. paratuberculosis
gcaucgccgucauggugu

SEQ ID NO: 2844096 - RNA, 18 nt, Mycobacterium avium subsp. paratuberculosis
gcaucgccguccacgggu

SEQ ID NO: 2844097 - RNA, 13 nt, Mycobacterium avium subsp. paratuberculosis
gcaucgccgucgu

SEQ ID NO: 2844098 - RNA, 17 nt, Mycobacterium avium subsp. paratuberculosis
gcaucgccgucgucagc

SEQ ID NO: 2844099 - RNA, 13 nt, Mycobacterium avium subsp. paratuberculosis
gcaucgccucggc

SEQ ID NO: 2844100 - RNA, 23 nt, Mycobacterium avium subsp. paratuberculosis
gcaucgccucggcggccgcccgg

SEQ ID NO: 2844101 - RNA, 14 nt, Mycobacterium avium subsp. paratuberculosis
gcaucgcgccgcau

SEQ ID NO: 2844102 - RNA, 20 nt, Mycobacterium avium subsp. paratuberculosis
gcaucgcgccgcaugaugcg

SEQ ID NO: 2844103 - RNA, 13 nt, Mycobacterium avium subsp. paratuberculosis
gcaucgcgcgcgg

SEQ ID NO: 2844104 - RNA, 14 nt, Mycobacterium avium subsp. paratuberculosis
gcaucgcgcgcggc

SEQ ID NO: 2844105 - RNA, 20 nt, Mycobacterium avium subsp. paratuberculosis
gcaucgcgcgcggcgacggu

SEQ ID NO: 2844106 - RNA, 16 nt, Mycobacterium avium subsp. paratuberculosis
gcaucgcgcgcggcgg

SEQ ID NO: 2844107 - RNA, 17 nt, Mycobacterium avium subsp. paratuberculosis
gcaucgcgcgcggcggc

SEQ ID NO: 2844108 - RNA, 18 nt, Mycobacterium avium subsp. paratuberculosis
gcaucgcgcgcggcggcc

SEQ ID NO: 2844109 - RNA, 14 nt, Mycobacterium avium subsp. paratuberculosis
gcaucgcggcgaug

SEQ ID NO: 2844110 - RNA, 14 nt, Mycobacterium avium subsp. paratuberculosis
gcaucgcgggccac

SEQ ID NO: 2844111 - RNA, 16 nt, Mycobacterium avium subsp. paratuberculosis
gcaucgcgggccaccg

SEQ ID NO: 2844112 - RNA, 19 nt, Mycobacterium avium subsp. paratuberculosis
gcaucgcgggccaccggcg

SEQ ID NO: 2844113 - RNA, 20 nt, Mycobacterium avium subsp. paratuberculosis
gcaucgcgggccaccggcgc

SEQ ID NO: 2844114 - RNA, 21 nt, Mycobacterium avium subsp. paratuberculosis
gcaucgcgggccaccggcgcc

SEQ ID NO: 2844115 - RNA, 15 nt, Mycobacterium avium subsp. paratuberculosis
gcaucgcgugccgac

SEQ ID NO: 2844116 - RNA, 14 nt, Mycobacterium avium subsp. paratuberculosis
gcaucgcugccguc

SEQ ID NO: 2844117 - RNA, 16 nt, Mycobacterium avium subsp. paratuberculosis
gcaucgcugguggccg

SEQ ID NO: 2844118 - RNA, 22 nt, Mycobacterium avium subsp. paratuberculosis
gcaucgcugguggccgacgugc

SEQ ID NO: 2844119 - RNA, 19 nt, Mycobacterium avium subsp. paratuberculosis
gcaucggaugccggggcag

SEQ ID NO: 2844120 - RNA, 20 nt, Mycobacterium avium subsp. paratuberculosis
gcaucggaugccggggcagc

SEQ ID NO: 2844121 - RNA, 16 nt, Mycobacterium avium subsp. paratuberculosis
gcaucggcaguccgcg

SEQ ID NO: 2844122 - RNA, 18 nt, Mycobacterium avium subsp. paratuberculosis
gcaucggcaguccgcgcc

SEQ ID NO: 2844123 - RNA, 19 nt, Mycobacterium avium subsp. paratuberculosis
gcaucggcaguccgcgccg

SEQ ID NO: 2844124 - RNA, 13 nt, Mycobacterium avium subsp. paratuberculosis
gcaucggcgacgc

SEQ ID NO: 2844125 - RNA, 13 nt, Mycobacterium avium subsp. paratuberculosis
gcaucggcgcccu

SEQ ID NO: 2844126 - RNA, 12 nt, Mycobacterium avium subsp. paratuberculosis
gcaucggcgccg

SEQ ID NO: 2844127 - RNA, 14 nt, Mycobacterium avium subsp. paratuberculosis
gcaucggcgccgga

SEQ ID NO: 2844128 - RNA, 17 nt, Mycobacterium avium subsp. paratuberculosis
gcaucggcgccugcgag

SEQ ID NO: 2844129 - RNA, 15 nt, Mycobacterium avium subsp. paratuberculosis
gcaucggcucguagc

SEQ ID NO: 2844130 - RNA, 20 nt, Mycobacterium avium subsp. paratuberculosis
gcaucggcucguagcgggcg

SEQ ID NO: 2844131 - RNA, 20 nt, Mycobacterium avium subsp. paratuberculosis
gcaucggcuggucggcggcc

SEQ ID NO: 2844132 - RNA, 22 nt, Mycobacterium avium subsp. paratuberculosis
gcaucgggcgacaucucgguga

SEQ ID NO: 2844133 - RNA, 16 nt, Mycobacterium avium subsp. paratuberculosis
gcaucgggcgcucggc

SEQ ID NO: 2844134 - RNA, 19 nt, Mycobacterium avium subsp. paratuberculosis
gcaucgggcgcucggccag

SEQ ID NO: 2844135 - RNA, 21 nt, Mycobacterium avium subsp. paratuberculosis
gcaucgggcgcucggccagca

SEQ ID NO: 2844136 - RNA, 23 nt, Mycobacterium avium subsp. paratuberculosis
gcaucgggguuccaccguucggg

SEQ ID NO: 2844137 - RNA, 15 nt, Mycobacterium avium subsp. paratuberculosis
gcaucgggucguaga

SEQ ID NO: 2844138 - RNA, 17 nt, Mycobacterium avium subsp. paratuberculosis
gcaucggguugccggcg

SEQ ID NO: 2844139 - RNA, 18 nt, Mycobacterium avium subsp. paratuberculosis
gcaucggguugccggcgg

SEQ ID NO: 2844140 - RNA, 19 nt, Mycobacterium avium subsp. paratuberculosis
gcaucggguugccggcggc

SEQ ID NO: 2844141 - RNA, 18 nt, Mycobacterium avium subsp. paratuberculosis
gcaucggucaccagcucc

SEQ ID NO: 2844142 - RNA, 16 nt, Mycobacterium avium subsp. paratuberculosis
gcaucggugagacgac

SEQ ID NO: 2844143 - RNA, 22 nt, Mycobacterium avium subsp. paratuberculosis
gcaucgguggcaccccgcgccg

SEQ ID NO: 2844144 - RNA, 16 nt, Mycobacterium avium subsp. paratuberculosis
gcaucgucgcggcgcu

SEQ ID NO: 2844145 - RNA, 13 nt, Mycobacterium avium subsp. paratuberculosis
gcaucgucggcgc

SEQ ID NO: 2844146 - RNA, 14 nt, Mycobacterium avium subsp. paratuberculosis
gcaucgucggcgcc

SEQ ID NO: 2844147 - RNA, 17 nt, Mycobacterium avium subsp. paratuberculosis
gcauguccucggggugg

SEQ ID NO: 2844148 - RNA, 15 nt, Mycobacterium avium subsp. paratuberculosis
gcaugucgaccucgg

SEQ ID NO: 2844149 - RNA, 23 nt, Mycobacterium avium subsp. paratuberculosis
gcaugucgaccucggccaccacc

SEQ ID NO: 2844150 - RNA, 12 nt, Mycobacterium avium subsp. paratuberculosis
gcaugucgcccg

SEQ ID NO: 2844151 - RNA, 18 nt, Mycobacterium avium subsp. paratuberculosis
gcaugucgcccgcgucgu

SEQ ID NO: 2844152 - RNA, 19 nt, Mycobacterium avium subsp. paratuberculosis
gcaugucgcccgcgucgug

SEQ ID NO: 2844153 - RNA, 22 nt, Mycobacterium avium subsp. paratuberculosis
gcaugucgcccgcgucguggcc

SEQ ID NO: 2844154 - RNA, 15 nt, Mycobacterium avium subsp. paratuberculosis
gcaugucgccgaacg

SEQ ID NO: 2844155 - RNA, 20 nt, Mycobacterium avium subsp. paratuberculosis
gcaugucgccgaacgccacc

SEQ ID NO: 2844156 - RNA, 22 nt, Mycobacterium avium subsp. paratuberculosis
gcaugucgccgaacgccaccac

SEQ ID NO: 2844157 - RNA, 23 nt, Mycobacterium avium subsp. paratuberculosis
gcaugucgccgaacgccaccacc

SEQ ID NO: 2844158 - RNA, 20 nt, Mycobacterium avium subsp. paratuberculosis
gcaugucgguggacagcgcg

SEQ ID NO: 2844159 - RNA, 14 nt, Mycobacterium avium subsp. paratuberculosis
gcaugugcucggcg

SEQ ID NO: 2844160 - RNA, 22 nt, Mycobacterium avium subsp. paratuberculosis
gcauguucaaucccguugcggu

SEQ ID NO: 2844161 - RNA, 13 nt, Mycobacterium avium subsp. paratuberculosis
gcauuagcgcgug

SEQ ID NO: 2844162 - RNA, 16 nt, Mycobacterium avium subsp. paratuberculosis
gcauucaggucaccgc

SEQ ID NO: 2844163 - RNA, 18 nt, Mycobacterium avium subsp. paratuberculosis
gcauucaggucaccgcgc

SEQ ID NO: 2844164 - RNA, 15 nt, Mycobacterium avium subsp. paratuberculosis
gcauuccaccgcgcg

SEQ ID NO: 2844165 - RNA, 21 nt, Mycobacterium avium subsp. paratuberculosis
gcauuccaccgcgcggcgcag

SEQ ID NO: 2844166 - RNA, 20 nt, Mycobacterium avium subsp. paratuberculosis
gcauuccgucuuggccaggc

SEQ ID NO: 2844167 - RNA, 21 nt, Mycobacterium avium subsp. paratuberculosis
gcauuccgucuuggccaggcc

SEQ ID NO: 2844168 - RNA, 22 nt, Mycobacterium avium subsp. paratuberculosis
gcauuccgucuuggccaggccc

SEQ ID NO: 2844169 - RNA, 14 nt, Mycobacterium avium subsp. paratuberculosis
gcauuccucggcca

SEQ ID NO: 2844170 - RNA, 17 nt, Mycobacterium avium subsp. paratuberculosis
gcauucggccgccaccg

SEQ ID NO: 2844171 - RNA, 14 nt, Mycobacterium avium subsp. paratuberculosis
gcauucggcgacgc

SEQ ID NO: 2844172 - RNA, 12 nt, Mycobacterium avium subsp. paratuberculosis
gcauugcagcgg

SEQ ID NO: 2844173 - RNA, 20 nt, Mycobacterium avium subsp. paratuberculosis
gcauugcagcggaugccgga

SEQ ID NO: 2844174 - RNA, 18 nt, Mycobacterium avium subsp. paratuberculosis
gcauugcccaucgccacg

SEQ ID NO: 2844175 - RNA, 16 nt, Mycobacterium avium subsp. paratuberculosis
gcauuggcagcucggg

SEQ ID NO: 2844176 - RNA, 13 nt, Mycobacterium avium subsp. paratuberculosis
gcauuggcgaugg

SEQ ID NO: 2844177 - RNA, 22 nt, Mycobacterium avium subsp. paratuberculosis
gcauuggcgauggccuuucugg

SEQ ID NO: 2844178 - RNA, 15 nt, Mycobacterium avium subsp. paratuberculosis
gcauuggugccggcc

SEQ ID NO: 2844179 - RNA, 17 nt, Mycobacterium avium subsp. paratuberculosis
gcauuuccagguccggg

SEQ ID NO: 2844180 - RNA, 16 nt, Mycobacterium avium subsp. paratuberculosis
gcauuucgcgcacguc

SEQ ID NO: 2844181 - RNA, 21 nt, Mycobacterium avium subsp. paratuberculosis
gcauuucggacggcgacggca

SEQ ID NO: 2844182 - RNA, 22 nt, Mycobacterium avium subsp. paratuberculosis
gcauuucggcguccucgacgcc

SEQ ID NO: 2844183 - RNA, 20 nt, Mycobacterium avium subsp. paratuberculosis
gcauuucggcuuccaccugc

SEQ ID NO: 2844184 - RNA, 22 nt, Mycobacterium avium subsp. paratuberculosis
gccaaacugcgcaaccacugau

SEQ ID NO: 2844185 - RNA, 17 nt, Mycobacterium avium subsp. paratuberculosis
gccaaagccuacggcgc

SEQ ID NO: 2844186 - RNA, 21 nt, Mycobacterium avium subsp. paratuberculosis
gccaaagccuacggcgccggu

SEQ ID NO: 2844187 - RNA, 19 nt, Mycobacterium avium subsp. paratuberculosis
gccaaaucgcuugcgccgc

SEQ ID NO: 2844188 - RNA, 22 nt, Mycobacterium avium subsp. paratuberculosis
gccaaaucgcuugcgccgcagc

SEQ ID NO: 2844189 - RNA, 14 nt, Mycobacterium avium subsp. paratuberculosis
gccaacacggcggc

SEQ ID NO: 2844190 - RNA, 15 nt, Mycobacterium avium subsp. paratuberculosis
gccaacacggcggcg

SEQ ID NO: 2844191 - RNA, 19 nt, Mycobacterium avium subsp. paratuberculosis
gccaacacggcggcgcgca

SEQ ID NO: 2844192 - RNA, 20 nt, Mycobacterium avium subsp. paratuberculosis
gccaacacggcggcgcgcac

SEQ ID NO: 2844193 - RNA, 21 nt, Mycobacterium avium subsp. paratuberculosis
gccaacagcagcagaaccagc

SEQ ID NO: 2844194 - RNA, 22 nt, Mycobacterium avium subsp. paratuberculosis
gccaacagcagcagaaccagca

SEQ ID NO: 2844195 - RNA, 22 nt, Mycobacterium avium subsp. paratuberculosis
gccaacagcagcgccgcggccg

SEQ ID NO: 2844196 - RNA, 14 nt, Mycobacterium avium subsp. paratuberculosis
gccaacagugcgca

SEQ ID NO: 2844197 - RNA, 16 nt, Mycobacterium avium subsp. paratuberculosis
gccaacagugcgcagg

SEQ ID NO: 2844198 - RNA, 18 nt, Mycobacterium avium subsp. paratuberculosis
gccaacagugcgcaggcg

SEQ ID NO: 2844199 - RNA, 12 nt, Mycobacterium avium subsp. paratuberculosis
gccaaccagguc

SEQ ID NO: 2844200 - RNA, 18 nt, Mycobacterium avium subsp. paratuberculosis
gccaaccaggucgcggcg

SEQ ID NO: 2844201 - RNA, 20 nt, Mycobacterium avium subsp. paratuberculosis
gccaaccaggucgcggcgcu

SEQ ID NO: 2844202 - RNA, 22 nt, Mycobacterium avium subsp. paratuberculosis
gccaaccaggucgcggcgcugc

SEQ ID NO: 2844203 - RNA, 23 nt, Mycobacterium avium subsp. paratuberculosis
gccaaccgaggcaaucgagcggg

SEQ ID NO: 2844204 - RNA, 14 nt, Mycobacterium avium subsp. paratuberculosis
gccaaccgcccggc

SEQ ID NO: 2844205 - RNA, 13 nt, Mycobacterium avium subsp. paratuberculosis
gccaaccgccggg

SEQ ID NO: 2844206 - RNA, 17 nt, Mycobacterium avium subsp. paratuberculosis
gccaaccgccggggaag

SEQ ID NO: 2844207 - RNA, 18 nt, Mycobacterium avium subsp. paratuberculosis
gccaaccgggcaggcacg

SEQ ID NO: 2844208 - RNA, 23 nt, Mycobacterium avium subsp. paratuberculosis
gccaaccuguuuggcugucgcgc

SEQ ID NO: 2844209 - RNA, 14 nt, Mycobacterium avium subsp. paratuberculosis
gccaacgagcgcgc

SEQ ID NO: 2844210 - RNA, 16 nt, Mycobacterium avium subsp. paratuberculosis
gccaacgagcgcgccg

SEQ ID NO: 2844211 - RNA, 17 nt, Mycobacterium avium subsp. paratuberculosis
gccaacgagcgcgccga

SEQ ID NO: 2844212 - RNA, 19 nt, Mycobacterium avium subsp. paratuberculosis
gccaacgaggcacggcccg

SEQ ID NO: 2844213 - RNA, 21 nt, Mycobacterium avium subsp. paratuberculosis
gccaacgaggcacggcccgcu

SEQ ID NO: 2844214 - RNA, 23 nt, Mycobacterium avium subsp. paratuberculosis
gccaacgaggcacggcccgcucg

SEQ ID NO: 2844215 - RNA, 14 nt, Mycobacterium avium subsp. paratuberculosis
gccaacgccucguc

SEQ ID NO: 2844216 - RNA, 16 nt, Mycobacterium avium subsp. paratuberculosis
gccaacgccucgucga

SEQ ID NO: 2844217 - RNA, 18 nt, Mycobacterium avium subsp. paratuberculosis
gccaacgccucgucgacc

SEQ ID NO: 2844218 - RNA, 21 nt, Mycobacterium avium subsp. paratuberculosis
gccaacgccucgucgaccgcg

SEQ ID NO: 2844219 - RNA, 23 nt, Mycobacterium avium subsp. paratuberculosis
gccaacgcgacgaagccggugcc

SEQ ID NO: 2844220 - RNA, 18 nt, Mycobacterium avium subsp. paratuberculosis
gccaacggauucagcguc

SEQ ID NO: 2844221 - RNA, 17 nt, Mycobacterium avium subsp. paratuberculosis
gccaacgggaagagcgg

SEQ ID NO: 2844222 - RNA, 22 nt, Mycobacterium avium subsp. paratuberculosis
gccaacgggaagagcggcguga

SEQ ID NO: 2844223 - RNA, 16 nt, Mycobacterium avium subsp. paratuberculosis
gccaacgguucggccg

SEQ ID NO: 2844224 - RNA, 23 nt, Mycobacterium avium subsp. paratuberculosis
gccaacgguucggccgcucgggu

SEQ ID NO: 2844225 - RNA, 23 nt, Mycobacterium avium subsp. paratuberculosis
gccaacgguuuccaccaccaccc

SEQ ID NO: 2844226 - RNA, 15 nt, Mycobacterium avium subsp. paratuberculosis
gccaacuccggcggc

SEQ ID NO: 2844227 - RNA, 16 nt, Mycobacterium avium subsp. paratuberculosis
gccaacuccggcggca

SEQ ID NO: 2844228 - RNA, 17 nt, Mycobacterium avium subsp. paratuberculosis
gccaacuccggcggcag

SEQ ID NO: 2844229 - RNA, 19 nt, Mycobacterium avium subsp. paratuberculosis
gccaacuccggcggcagcc

SEQ ID NO: 2844230 - RNA, 19 nt, Mycobacterium avium subsp. paratuberculosis
gccaacugaauuccuggcc

SEQ ID NO: 2844231 - RNA, 21 nt, Mycobacterium avium subsp. paratuberculosis
gccaccaccacggagcgcccg

SEQ ID NO: 2844232 - RNA, 15 nt, Mycobacterium avium subsp. paratuberculosis
gccaccaccacggcc

SEQ ID NO: 2844233 - RNA, 17 nt, Mycobacterium avium subsp. paratuberculosis
gccaccaccacggccgc

SEQ ID NO: 2844234 - RNA, 18 nt, Mycobacterium avium subsp. paratuberculosis
gccaccaccacggccgcc

SEQ ID NO: 2844235 - RNA, 21 nt, Mycobacterium avium subsp. paratuberculosis
gccaccaccacggccgccgag

SEQ ID NO: 2844236 - RNA, 17 nt, Mycobacterium avium subsp. paratuberculosis
gccaccaccacggggcg

SEQ ID NO: 2844237 - RNA, 23 nt, Mycobacterium avium subsp. paratuberculosis
gccaccaccacggggcgggucgu

SEQ ID NO: 2844238 - RNA, 12 nt, Mycobacterium avium subsp. paratuberculosis
gccaccaccagc

SEQ ID NO: 2844239 - RNA, 13 nt, Mycobacterium avium subsp. paratuberculosis
gccaccaccagcg

SEQ ID NO: 2844240 - RNA, 16 nt, Mycobacterium avium subsp. paratuberculosis
gccaccaccagcgggc

SEQ ID NO: 2844241 - RNA, 17 nt, Mycobacterium avium subsp. paratuberculosis
gccaccaccagcgggcu

SEQ ID NO: 2844242 - RNA, 14 nt, Mycobacterium avium subsp. paratuberculosis
gccaccacccggcg

SEQ ID NO: 2844243 - RNA, 16 nt, Mycobacterium avium subsp. paratuberculosis
gccaccacccggcgau

SEQ ID NO: 2844244 - RNA, 21 nt, Mycobacterium avium subsp. paratuberculosis
gccaccaccgagguggcccag

SEQ ID NO: 2844245 - RNA, 22 nt, Mycobacterium avium subsp. paratuberculosis
gccaccaccgagguggcccagc

SEQ ID NO: 2844246 - RNA, 13 nt, Mycobacterium avium subsp. paratuberculosis
gccaccaccgcgc

SEQ ID NO: 2844247 - RNA, 14 nt, Mycobacterium avium subsp. paratuberculosis
gccaccaccgcgcc

SEQ ID NO: 2844248 - RNA, 15 nt, Mycobacterium avium subsp. paratuberculosis
gccaccaccgcgccg

SEQ ID NO: 2844249 - RNA, 16 nt, Mycobacterium avium subsp. paratuberculosis
gccaccaccgcgccgu

SEQ ID NO: 2844250 - RNA, 21 nt, Mycobacterium avium subsp. paratuberculosis
gccaccaccgcgccgucgucg

SEQ ID NO: 2844251 - RNA, 16 nt, Mycobacterium avium subsp. paratuberculosis
gccaccaccuccucgc

SEQ ID NO: 2844252 - RNA, 21 nt, Mycobacterium avium subsp. paratuberculosis
gccaccaccuccucgcgggcg

SEQ ID NO: 2844253 - RNA, 22 nt, Mycobacterium avium subsp. paratuberculosis
gccaccaccuccucgcgggcga

SEQ ID NO: 2844254 - RNA, 13 nt, Mycobacterium avium subsp. paratuberculosis
gccaccaccucgc

SEQ ID NO: 2844255 - RNA, 17 nt, Mycobacterium avium subsp. paratuberculosis
gccaccaccucgcgggc

SEQ ID NO: 2844256 - RNA, 19 nt, Mycobacterium avium subsp. paratuberculosis
gccaccaccuucaucgccg

SEQ ID NO: 2844257 - RNA, 17 nt, Mycobacterium avium subsp. paratuberculosis
gccaccacgacgccggg

SEQ ID NO: 2844258 - RNA, 20 nt, Mycobacterium avium subsp. paratuberculosis
gccaccacgacgccgggcgc

SEQ ID NO: 2844259 - RNA, 15 nt, Mycobacterium avium subsp. paratuberculosis
gccaccacgauguug

SEQ ID NO: 2844260 - RNA, 12 nt, Mycobacterium avium subsp. paratuberculosis
gccaccacgcca

SEQ ID NO: 2844261 - RNA, 15 nt, Mycobacterium avium subsp. paratuberculosis
gccaccacgccagcc

SEQ ID NO: 2844262 - RNA, 21 nt, Mycobacterium avium subsp. paratuberculosis
gccaccacgcccuuguuguuc

SEQ ID NO: 2844263 - RNA, 22 nt, Mycobacterium avium subsp. paratuberculosis
gccaccacgcccuuguuguucc

SEQ ID NO: 2844264 - RNA, 15 nt, Mycobacterium avium subsp. paratuberculosis
gccaccacggcaccg

SEQ ID NO: 2844265 - RNA, 16 nt, Mycobacterium avium subsp. paratuberculosis
gccaccacggcaccgc

SEQ ID NO: 2844266 - RNA, 15 nt, Mycobacterium avium subsp. paratuberculosis
gccaccacggcgccc

SEQ ID NO: 2844267 - RNA, 15 nt, Mycobacterium avium subsp. paratuberculosis
gccaccacggcgucg

SEQ ID NO: 2844268 - RNA, 16 nt, Mycobacterium avium subsp. paratuberculosis
gccaccacggcgucgc

SEQ ID NO: 2844269 - RNA, 19 nt, Mycobacterium avium subsp. paratuberculosis
gccaccacggcgucgcuga

SEQ ID NO: 2844270 - RNA, 20 nt, Mycobacterium avium subsp. paratuberculosis
gccaccacguacuccugcgc

SEQ ID NO: 2844271 - RNA, 22 nt, Mycobacterium avium subsp. paratuberculosis
gccaccacguacuccugcgcga

SEQ ID NO: 2844272 - RNA, 15 nt, Mycobacterium avium subsp. paratuberculosis
gccaccacugcgccg

SEQ ID NO: 2844273 - RNA, 17 nt, Mycobacterium avium subsp. paratuberculosis
gccaccagaccggcgaa

SEQ ID NO: 2844274 - RNA, 19 nt, Mycobacterium avium subsp. paratuberculosis
gccaccagaccggcgaagc

SEQ ID NO: 2844275 - RNA, 22 nt, Mycobacterium avium subsp. paratuberculosis
gccaccagaucguguccgcgcc

SEQ ID NO: 2844276 - RNA, 21 nt, Mycobacterium avium subsp. paratuberculosis
gccaccagaugccgggcuccg

SEQ ID NO: 2844277 - RNA, 12 nt, Mycobacterium avium subsp. paratuberculosis
gccaccagcagc

SEQ ID NO: 2844278 - RNA, 17 nt, Mycobacterium avium subsp. paratuberculosis
gccaccagcagcagguu

SEQ ID NO: 2844279 - RNA, 13 nt, Mycobacterium avium subsp. paratuberculosis
gccaccagcagcg

SEQ ID NO: 2844280 - RNA, 16 nt, Mycobacterium avium subsp. paratuberculosis
gccaccagcagcgaga

SEQ ID NO: 2844281 - RNA, 19 nt, Mycobacterium avium subsp. paratuberculosis
gccaccagcagcgagaccg

SEQ ID NO: 2844282 - RNA, 13 nt, Mycobacterium avium subsp. paratuberculosis
gccaccagcaggc

SEQ ID NO: 2844283 - RNA, 19 nt, Mycobacterium avium subsp. paratuberculosis
gccaccagccacaccgccg

SEQ ID NO: 2844284 - RNA, 17 nt, Mycobacterium avium subsp. paratuberculosis
gccaccagccggccggc

SEQ ID NO: 2844285 - RNA, 18 nt, Mycobacterium avium subsp. paratuberculosis
gccaccagccggccggcc

SEQ ID NO: 2844286 - RNA, 12 nt, Mycobacterium avium subsp. paratuberculosis
gccaccagcgca

SEQ ID NO: 2844287 - RNA, 19 nt, Mycobacterium avium subsp. paratuberculosis
gccaccagcgcacacagca

SEQ ID NO: 2844288 - RNA, 23 nt, Mycobacterium avium subsp. paratuberculosis
gccaccagcgcacacagcagcag

SEQ ID NO: 2844289 - RNA, 12 nt, Mycobacterium avium subsp. paratuberculosis
gccaccagcgcc

SEQ ID NO: 2844290 - RNA, 16 nt, Mycobacterium avium subsp. paratuberculosis
gccaccagcgcccgcc

SEQ ID NO: 2844291 - RNA, 18 nt, Mycobacterium avium subsp. paratuberculosis
gccaccagcgcggccacc

SEQ ID NO: 2844292 - RNA, 22 nt, Mycobacterium avium subsp. paratuberculosis
gccaccagcgcggccaccacca

SEQ ID NO: 2844293 - RNA, 13 nt, Mycobacterium avium subsp. paratuberculosis
gccaccagcggcc

SEQ ID NO: 2844294 - RNA, 16 nt, Mycobacterium avium subsp. paratuberculosis
gccaccagcggccgga

SEQ ID NO: 2844295 - RNA, 23 nt, Mycobacterium avium subsp. paratuberculosis
gccaccagcguuccagcacccgg

SEQ ID NO: 2844296 - RNA, 13 nt, Mycobacterium avium subsp. paratuberculosis
gccaccagcuccu

SEQ ID NO: 2844297 - RNA, 15 nt, Mycobacterium avium subsp. paratuberculosis
gccaccaggcgccgu

SEQ ID NO: 2844298 - RNA, 18 nt, Mycobacterium avium subsp. paratuberculosis
gccaccaggcgccgucga

SEQ ID NO: 2844299 - RNA, 20 nt, Mycobacterium avium subsp. paratuberculosis
gccaccaggcgccgucgaug

SEQ ID NO: 2844300 - RNA, 12 nt, Mycobacterium avium subsp. paratuberculosis
gccaccaggcgg

SEQ ID NO: 2844301 - RNA, 16 nt, Mycobacterium avium subsp. paratuberculosis
gccaccaggcgguccg

SEQ ID NO: 2844302 - RNA, 18 nt, Mycobacterium avium subsp. paratuberculosis
gccaccaggcugaacguc

SEQ ID NO: 2844303 - RNA, 17 nt, Mycobacterium avium subsp. paratuberculosis
gccaccagggcgaccgc

SEQ ID NO: 2844304 - RNA, 20 nt, Mycobacterium avium subsp. paratuberculosis
gccaccagggcgaccgccgc

SEQ ID NO: 2844305 - RNA, 21 nt, Mycobacterium avium subsp. paratuberculosis
gccaccagggcgaccgccgcg

SEQ ID NO: 2844306 - RNA, 20 nt, Mycobacterium avium subsp. paratuberculosis
gccaccagggucucgcgcag

SEQ ID NO: 2844307 - RNA, 14 nt, Mycobacterium avium subsp. paratuberculosis
gccaccaggucgca

SEQ ID NO: 2844308 - RNA, 16 nt, Mycobacterium avium subsp. paratuberculosis
gccaccaggucgcaca

SEQ ID NO: 2844309 - RNA, 20 nt, Mycobacterium avium subsp. paratuberculosis
gccaccaggucgcacaccag

SEQ ID NO: 2844310 - RNA, 17 nt, Mycobacterium avium subsp. paratuberculosis
gccaccaucaggccggc

SEQ ID NO: 2844311 - RNA, 18 nt, Mycobacterium avium subsp. paratuberculosis
gccaccaucaggccggcc

SEQ ID NO: 2844312 - RNA, 23 nt, Mycobacterium avium subsp. paratuberculosis
gccaccaucgaguaggcccaguc

SEQ ID NO: 2844313 - RNA, 18 nt, Mycobacterium avium subsp. paratuberculosis
gccaccaucuccgcggcg

SEQ ID NO: 2844314 - RNA, 19 nt, Mycobacterium avium subsp. paratuberculosis
gccaccaugggcgggacga

SEQ ID NO: 2844315 - RNA, 16 nt, Mycobacterium avium subsp. paratuberculosis
gccaccaugucggcgu

SEQ ID NO: 2844316 - RNA, 22 nt, Mycobacterium avium subsp. paratuberculosis
gccaccgcugggcggcgcggcg

SEQ ID NO: 2844317 - RNA, 15 nt, Mycobacterium avium subsp. paratuberculosis
gccaccggcccggcc

SEQ ID NO: 2844318 - RNA, 12 nt, Mycobacterium avium subsp. paratuberculosis
gccaccggccgg

SEQ ID NO: 2844319 - RNA, 13 nt, Mycobacterium avium subsp. paratuberculosis
gccaccggccggu

SEQ ID NO: 2844320 - RNA, 16 nt, Mycobacterium avium subsp. paratuberculosis
gccaccggccgguccg

SEQ ID NO: 2844321 - RNA, 18 nt, Mycobacterium avium subsp. paratuberculosis
gccaccggccgguccgcc

SEQ ID NO: 2844322 - RNA, 22 nt, Mycobacterium avium subsp. paratuberculosis
gccaccggccgguccgcccaga

SEQ ID NO: 2844323 - RNA, 23 nt, Mycobacterium avium subsp. paratuberculosis
gccaccggccgguccgcccagac

SEQ ID NO: 2844324 - RNA, 12 nt, Mycobacterium avium subsp. paratuberculosis
gccaccggcgcc

SEQ ID NO: 2844325 - RNA, 13 nt, Mycobacterium avium subsp. paratuberculosis
gccaccggcgcca

SEQ ID NO: 2844326 - RNA, 16 nt, Mycobacterium avium subsp. paratuberculosis
gccaccggcgcgacgg

SEQ ID NO: 2844327 - RNA, 18 nt, Mycobacterium avium subsp. paratuberculosis
gccaccggcgcgacggcg

SEQ ID NO: 2844328 - RNA, 19 nt, Mycobacterium avium subsp. paratuberculosis
gccaccggcgcgacggcgg

SEQ ID NO: 2844329 - RNA, 21 nt, Mycobacterium avium subsp. paratuberculosis
gccaccggcuccuugcgccgc

SEQ ID NO: 2844330 - RNA, 23 nt, Mycobacterium avium subsp. paratuberculosis
gccaccggcuccuugcgccgcaa

SEQ ID NO: 2844331 - RNA, 15 nt, Mycobacterium avium subsp. paratuberculosis
gccaccggcuggccg

SEQ ID NO: 2844332 - RNA, 24 nt, Mycobacterium avium subsp. paratuberculosis
gccaccgggaccugcugcucgucg

SEQ ID NO: 2844333 - RNA, 14 nt, Mycobacterium avium subsp. paratuberculosis
gccaccgggcgugg

SEQ ID NO: 2844334 - RNA, 16 nt, Mycobacterium avium subsp. paratuberculosis
gccaccgggcguggcu

SEQ ID NO: 2844335 - RNA, 19 nt, Mycobacterium avium subsp. paratuberculosis
gccaccggguaagugucgu

SEQ ID NO: 2844336 - RNA, 20 nt, Mycobacterium avium subsp. paratuberculosis
gccaccggguaagugucgug

SEQ ID NO: 2844337 - RNA, 21 nt, Mycobacterium avium subsp. paratuberculosis
gccaccgggucguccgcgacg

SEQ ID NO: 2844338 - RNA, 18 nt, Mycobacterium avium subsp. paratuberculosis
gccaccgucagcgucagc

SEQ ID NO: 2844339 - RNA, 20 nt, Mycobacterium avium subsp. paratuberculosis
gccaccgucagcgucagcac

SEQ ID NO: 2844340 - RNA, 22 nt, Mycobacterium avium subsp. paratuberculosis
gccaccgucagcgucagcacgu

SEQ ID NO: 2844341 - RNA, 23 nt, Mycobacterium avium subsp. paratuberculosis
gccaccgucccggugucgccguc

SEQ ID NO: 2844342 - RNA, 14 nt, Mycobacterium avium subsp. paratuberculosis
gccaccgucgccgg

SEQ ID NO: 2844343 - RNA, 13 nt, Mycobacterium avium subsp. paratuberculosis
gccaccgucgucg

SEQ ID NO: 2844344 - RNA, 18 nt, Mycobacterium avium subsp. paratuberculosis
gccaccgucgucgagcgc

SEQ ID NO: 2844345 - RNA, 19 nt, Mycobacterium avium subsp. paratuberculosis
gccaccgucgucgagcgcu

SEQ ID NO: 2844346 - RNA, 22 nt, Mycobacterium avium subsp. paratuberculosis
gccaccgucgucgagcgcucgc

SEQ ID NO: 2844347 - RNA, 23 nt, Mycobacterium avium subsp. paratuberculosis
gccaccgucuucggggccgccgu

SEQ ID NO: 2844348 - RNA, 21 nt, Mycobacterium avium subsp. paratuberculosis
gccaccgugccuuacgccggg

SEQ ID NO: 2844349 - RNA, 18 nt, Mycobacterium avium subsp. paratuberculosis
gccaccuccuccgguccg

SEQ ID NO: 2844350 - RNA, 20 nt, Mycobacterium avium subsp. paratuberculosis
gccaccuccuccgguccggg

SEQ ID NO: 2844351 - RNA, 22 nt, Mycobacterium avium subsp. paratuberculosis
gccaccuccuccgguccgggcu

SEQ ID NO: 2844352 - RNA, 19 nt, Mycobacterium avium subsp. paratuberculosis
gccaccucgagcucaccga

SEQ ID NO: 2844353 - RNA, 14 nt, Mycobacterium avium subsp. paratuberculosis
gccaccucgaucag

SEQ ID NO: 2844354 - RNA, 14 nt, Mycobacterium avium subsp. paratuberculosis
gccaccucgccgca

SEQ ID NO: 2844355 - RNA, 22 nt, Mycobacterium avium subsp. paratuberculosis
gccaccucggagaugauggccg

SEQ ID NO: 2844356 - RNA, 17 nt, Mycobacterium avium subsp. paratuberculosis
gccaccucggcggcacc

SEQ ID NO: 2844357 - RNA, 18 nt, Mycobacterium avium subsp. paratuberculosis
gccaccucggcggcaccg

SEQ ID NO: 2844358 - RNA, 19 nt, Mycobacterium avium subsp. paratuberculosis
gccaccucggcggcaccgc

SEQ ID NO: 2844359 - RNA, 20 nt, Mycobacterium avium subsp. paratuberculosis
gccaccucggcggcaccgcc

SEQ ID NO: 2844360 - RNA, 22 nt, Mycobacterium avium subsp. paratuberculosis
gccaccucggcggcaccgcccg

SEQ ID NO: 2844361 - RNA, 17 nt, Mycobacterium avium subsp. paratuberculosis
gccaccucgucccagcg

SEQ ID NO: 2844362 - RNA, 19 nt, Mycobacterium avium subsp. paratuberculosis
gccaccucgucccagcgca

SEQ ID NO: 2844363 - RNA, 15 nt, Mycobacterium avium subsp. paratuberculosis
gccaccucgucggcg

SEQ ID NO: 2844364 - RNA, 13 nt, Mycobacterium avium subsp. paratuberculosis
gccaccuggccgg

SEQ ID NO: 2844365 - RNA, 17 nt, Mycobacterium avium subsp. paratuberculosis
gccaccugggcggggcu

SEQ ID NO: 2844366 - RNA, 17 nt, Mycobacterium avium subsp. paratuberculosis
gccaccuucaccgcgcc

SEQ ID NO: 2844367 - RNA, 18 nt, Mycobacterium avium subsp. paratuberculosis
gccaccuucaccgcgccg

SEQ ID NO: 2844368 - RNA, 20 nt, Mycobacterium avium subsp. paratuberculosis
gccaccuucaccgcgccggu

SEQ ID NO: 2844369 - RNA, 22 nt, Mycobacterium avium subsp. paratuberculosis
gccaccuugcgcgggucgccgg

SEQ ID NO: 2844370 - RNA, 22 nt, Mycobacterium avium subsp. paratuberculosis
gccacgacaccagcgucgcgau

SEQ ID NO: 2844371 - RNA, 16 nt, Mycobacterium avium subsp. paratuberculosis
gccacgacauccccgc

SEQ ID NO: 2844372 - RNA, 18 nt, Mycobacterium avium subsp. paratuberculosis
gccacgacauccccgcaa

SEQ ID NO: 2844373 - RNA, 20 nt, Mycobacterium avium subsp. paratuberculosis
gccacgacauccccgcaaac

SEQ ID NO: 2844374 - RNA, 15 nt, Mycobacterium avium subsp. paratuberculosis
gccacgaccagcggc

SEQ ID NO: 2844375 - RNA, 13 nt, Mycobacterium avium subsp. paratuberculosis
gccacgaccucgg

SEQ ID NO: 2844376 - RNA, 18 nt, Mycobacterium avium subsp. paratuberculosis
gccacgaccucggggucg

SEQ ID NO: 2844377 - RNA, 20 nt, Mycobacterium avium subsp. paratuberculosis
gccacgaccucggggucggc

SEQ ID NO: 2844378 - RNA, 22 nt, Mycobacterium avium subsp. paratuberculosis
gccacgaccucggggucggccg

SEQ ID NO: 2844379 - RNA, 17 nt, Mycobacterium avium subsp. paratuberculosis
gccacgacgcgccacgc

SEQ ID NO: 2844380 - RNA, 18 nt, Mycobacterium avium subsp. paratuberculosis
gccacgacgcgccacgcc

SEQ ID NO: 2844381 - RNA, 14 nt, Mycobacterium avium subsp. paratuberculosis
gccacgacgcggcg

SEQ ID NO: 2844382 - RNA, 16 nt, Mycobacterium avium subsp. paratuberculosis
gccacgacgcggcgau

SEQ ID NO: 2844383 - RNA, 15 nt, Mycobacterium avium subsp. paratuberculosis
gccacgacgcggcgc

SEQ ID NO: 2844384 - RNA, 17 nt, Mycobacterium avium subsp. paratuberculosis
gccacgacgcggcgcgc

SEQ ID NO: 2844385 - RNA, 19 nt, Mycobacterium avium subsp. paratuberculosis
gccacgacgcggcgcgcga

SEQ ID NO: 2844386 - RNA, 23 nt, Mycobacterium avium subsp. paratuberculosis
gccacgacgcggcgcgcgaugga

SEQ ID NO: 2844387 - RNA, 15 nt, Mycobacterium avium subsp. paratuberculosis
gccacgacggcgcug

SEQ ID NO: 2844388 - RNA, 19 nt, Mycobacterium avium subsp. paratuberculosis
gccacgacggcgcuggccg

SEQ ID NO: 2844389 - RNA, 23 nt, Mycobacterium avium subsp. paratuberculosis
gccacgacggcgcuggccgcggc

SEQ ID NO: 2844390 - RNA, 17 nt, Mycobacterium avium subsp. paratuberculosis
gccacgacguacccccg

SEQ ID NO: 2844391 - RNA, 20 nt, Mycobacterium avium subsp. paratuberculosis
gccacgacguacccccgcac

SEQ ID NO: 2844392 - RNA, 22 nt, Mycobacterium avium subsp. paratuberculosis
gccacgacguacccccgcacgc

SEQ ID NO: 2844393 - RNA, 17 nt, Mycobacterium avium subsp. paratuberculosis
gccacgacugcgcggcc

SEQ ID NO: 2844394 - RNA, 18 nt, Mycobacterium avium subsp. paratuberculosis
gccacgacugcgcggccg

SEQ ID NO: 2844395 - RNA, 23 nt, Mycobacterium avium subsp. paratuberculosis
gccacgacugcgcggccggcgug

SEQ ID NO: 2844396 - RNA, 17 nt, Mycobacterium avium subsp. paratuberculosis
gccacgagcccagccgu

SEQ ID NO: 2844397 - RNA, 19 nt, Mycobacterium avium subsp. paratuberculosis
gccacgagcccagccgucg

SEQ ID NO: 2844398 - RNA, 16 nt, Mycobacterium avium subsp. paratuberculosis
gccacgaucaccacca

SEQ ID NO: 2844399 - RNA, 22 nt, Mycobacterium avium subsp. paratuberculosis
gccacgaucaccaccaccgccg

SEQ ID NO: 2844400 - RNA, 21 nt, Mycobacterium avium subsp. paratuberculosis
gccacggcgccaugcgccgcg

SEQ ID NO: 2844401 - RNA, 12 nt, Mycobacterium avium subsp. paratuberculosis
gccacggcggau

SEQ ID NO: 2844402 - RNA, 20 nt, Mycobacterium avium subsp. paratuberculosis
gccacggcggaucaguaccg

SEQ ID NO: 2844403 - RNA, 13 nt, Mycobacterium avium subsp. paratuberculosis
gccacggcggccg

SEQ ID NO: 2844404 - RNA, 14 nt, Mycobacterium avium subsp. paratuberculosis
gccacggcgggguc

SEQ ID NO: 2844405 - RNA, 21 nt, Mycobacterium avium subsp. paratuberculosis
gccacggcggggucaagcggc

SEQ ID NO: 2844406 - RNA, 20 nt, Mycobacterium avium subsp. paratuberculosis
gccacggcggugucggcggc

SEQ ID NO: 2844407 - RNA, 18 nt, Mycobacterium avium subsp. paratuberculosis
gccacggcguugaccaac

SEQ ID NO: 2844408 - RNA, 14 nt, Mycobacterium avium subsp. paratuberculosis
gccacgggcggucg

SEQ ID NO: 2844409 - RNA, 15 nt, Mycobacterium avium subsp. paratuberculosis
gccacgggcggucgg

SEQ ID NO: 2844410 - RNA, 19 nt, Mycobacterium avium subsp. paratuberculosis
gccacgggcggucggacgc

SEQ ID NO: 2844411 - RNA, 16 nt, Mycobacterium avium subsp. paratuberculosis
gccacggggcccgcga

SEQ ID NO: 2844412 - RNA, 18 nt, Mycobacterium avium subsp. paratuberculosis
gccacggggcccgcgacc

SEQ ID NO: 2844413 - RNA, 14 nt, Mycobacterium avium subsp. paratuberculosis
gccacggggcgccg

SEQ ID NO: 2844414 - RNA, 15 nt, Mycobacterium avium subsp. paratuberculosis
gccacggggcgccgc

SEQ ID NO: 2844415 - RNA, 16 nt, Mycobacterium avium subsp. paratuberculosis
gccacggggcgccgcu

SEQ ID NO: 2844416 - RNA, 18 nt, Mycobacterium avium subsp. paratuberculosis
gccacggggcgccgcugc

SEQ ID NO: 2844417 - RNA, 18 nt, Mycobacterium avium subsp. paratuberculosis
gccacggggcugcgggcc

SEQ ID NO: 2844418 - RNA, 20 nt, Mycobacterium avium subsp. paratuberculosis
gccacggggcugcgggccag

SEQ ID NO: 2844419 - RNA, 24 nt, Mycobacterium avium subsp. paratuberculosis
gccacggggucgagaagcccgugc

SEQ ID NO: 2844420 - RNA, 16 nt, Mycobacterium avium subsp. paratuberculosis
gccacggucaggcgca

SEQ ID NO: 2844421 - RNA, 17 nt, Mycobacterium avium subsp. paratuberculosis
gccacggucaggcgcag

SEQ ID NO: 2844422 - RNA, 18 nt, Mycobacterium avium subsp. paratuberculosis
gccacggucaggcgcagc

SEQ ID NO: 2844423 - RNA, 17 nt, Mycobacterium avium subsp. paratuberculosis
gccacgguuucgccgua

SEQ ID NO: 2844424 - RNA, 18 nt, Mycobacterium avium subsp. paratuberculosis
gccacgguuucgccguac

SEQ ID NO: 2844425 - RNA, 22 nt, Mycobacterium avium subsp. paratuberculosis
gccacgguuucgccguacagcu

SEQ ID NO: 2844426 - RNA, 16 nt, Mycobacterium avium subsp. paratuberculosis
gccacguacaccggga

SEQ ID NO: 2844427 - RNA, 19 nt, Mycobacterium avium subsp. paratuberculosis
gccacguacaccgggaucg

SEQ ID NO: 2844428 - RNA, 21 nt, Mycobacterium avium subsp. paratuberculosis
gccacguacaccgggaucggg

SEQ ID NO: 2844429 - RNA, 17 nt, Mycobacterium avium subsp. paratuberculosis
gccacguaguccgacga

SEQ ID NO: 2844430 - RNA, 22 nt, Mycobacterium avium subsp. paratuberculosis
gccacguaguccgacgauccgg

SEQ ID NO: 2844431 - RNA, 16 nt, Mycobacterium avium subsp. paratuberculosis
gccacguaucgcgccu

SEQ ID NO: 2844432 - RNA, 19 nt, Mycobacterium avium subsp. paratuberculosis
gccacguaucgcgccugca

SEQ ID NO: 2844433 - RNA, 21 nt, Mycobacterium avium subsp. paratuberculosis
gccacguccggaugcggcgcc

SEQ ID NO: 2844434 - RNA, 23 nt, Mycobacterium avium subsp. paratuberculosis
gccacguccggaugcggcgccca

SEQ ID NO: 2844435 - RNA, 21 nt, Mycobacterium avium subsp. paratuberculosis
gccacgucgaacccgaccccg

SEQ ID NO: 2844436 - RNA, 22 nt, Mycobacterium avium subsp. paratuberculosis
gccacgucgaacccgaccccgg

SEQ ID NO: 2844437 - RNA, 23 nt, Mycobacterium avium subsp. paratuberculosis
gccacgucgaacccgaccccggc

SEQ ID NO: 2844438 - RNA, 19 nt, Mycobacterium avium subsp. paratuberculosis
gccacgucgaagcccgggu

SEQ ID NO: 2844439 - RNA, 20 nt, Mycobacterium avium subsp. paratuberculosis
gccacgucgaagcccgggua

SEQ ID NO: 2844440 - RNA, 17 nt, Mycobacterium avium subsp. paratuberculosis
gccacgucgaugccgaa

SEQ ID NO: 2844441 - RNA, 19 nt, Mycobacterium avium subsp. paratuberculosis
gccacgucgaugccgaacc

SEQ ID NO: 2844442 - RNA, 21 nt, Mycobacterium avium subsp. paratuberculosis
gccacgucguucaugaucggc

SEQ ID NO: 2844443 - RNA, 13 nt, Mycobacterium avium subsp. paratuberculosis
gccacguggucga

SEQ ID NO: 2844444 - RNA, 22 nt, Mycobacterium avium subsp. paratuberculosis
gccacguggucgagcaugcggg

SEQ ID NO: 2844445 - RNA, 13 nt, Mycobacterium avium subsp. paratuberculosis
gccacguggucgc

SEQ ID NO: 2844446 - RNA, 21 nt, Mycobacterium avium subsp. paratuberculosis
gccacguggucgcugaccuuc

SEQ ID NO: 2844447 - RNA, 17 nt, Mycobacterium avium subsp. paratuberculosis
gccacuccaccaccggc

SEQ ID NO: 2844448 - RNA, 23 nt, Mycobacterium avium subsp. paratuberculosis
gccacuccaggguucucgcggcg

SEQ ID NO: 2844449 - RNA, 14 nt, Mycobacterium avium subsp. paratuberculosis
gccacucgccgcga

SEQ ID NO: 2844450 - RNA, 15 nt, Mycobacterium avium subsp. paratuberculosis
gccacucgccgcgaa

SEQ ID NO: 2844451 - RNA, 19 nt, Mycobacterium avium subsp. paratuberculosis
gccacucgccgcgaacgac

SEQ ID NO: 2844452 - RNA, 14 nt, Mycobacterium avium subsp. paratuberculosis
gccacucgccguga

SEQ ID NO: 2844453 - RNA, 15 nt, Mycobacterium avium subsp. paratuberculosis
gccacucgcgucccc

SEQ ID NO: 2844454 - RNA, 16 nt, Mycobacterium avium subsp. paratuberculosis
gccacucgggcggccg

SEQ ID NO: 2844455 - RNA, 20 nt, Mycobacterium avium subsp. paratuberculosis
gccacucgggcggccgcgga

SEQ ID NO: 2844456 - RNA, 18 nt, Mycobacterium avium subsp. paratuberculosis
gccacucgucgacguucg

SEQ ID NO: 2844457 - RNA, 14 nt, Mycobacterium avium subsp. paratuberculosis
gccacugccccggc

SEQ ID NO: 2844458 - RNA, 20 nt, Mycobacterium avium subsp. paratuberculosis
gccacugccccggcgaacgc

SEQ ID NO: 2844459 - RNA, 17 nt, Mycobacterium avium subsp. paratuberculosis
gccacugccgccgccca

SEQ ID NO: 2844460 - RNA, 21 nt, Mycobacterium avium subsp. paratuberculosis
gccacugccgccgcccaggcc

SEQ ID NO: 2844461 - RNA, 17 nt, Mycobacterium avium subsp. paratuberculosis
gccacugcgggaacguc

SEQ ID NO: 2844462 - RNA, 15 nt, Mycobacterium avium subsp. paratuberculosis
gccacuggcgccacc

SEQ ID NO: 2844463 - RNA, 16 nt, Mycobacterium avium subsp. paratuberculosis
gccacuggcgccaccu

SEQ ID NO: 2844464 - RNA, 19 nt, Mycobacterium avium subsp. paratuberculosis
gccacuggcuggucaccca

SEQ ID NO: 2844465 - RNA, 17 nt, Mycobacterium avium subsp. paratuberculosis
gccacugggcgucggcg

SEQ ID NO: 2844466 - RNA, 18 nt, Mycobacterium avium subsp. paratuberculosis
gccacugggcgucggcgc

SEQ ID NO: 2844467 - RNA, 19 nt, Mycobacterium avium subsp. paratuberculosis
gccacugggcgucggcgcc

SEQ ID NO: 2844468 - RNA, 16 nt, Mycobacterium avium subsp. paratuberculosis
gccacuucuccacgcc

SEQ ID NO: 2844469 - RNA, 20 nt, Mycobacterium avium subsp. paratuberculosis
gccacuucuccacgccgacg

SEQ ID NO: 2844470 - RNA, 21 nt, Mycobacterium avium subsp. paratuberculosis
gccacuucuccacgccgacga

SEQ ID NO: 2844471 - RNA, 18 nt, Mycobacterium avium subsp. paratuberculosis
gccagaaaucgccgggau

SEQ ID NO: 2844472 - RNA, 14 nt, Mycobacterium avium subsp. paratuberculosis
gccagaacacgccc

SEQ ID NO: 2844473 - RNA, 21 nt, Mycobacterium avium subsp. paratuberculosis
gccagaaccggcaacacagcc

SEQ ID NO: 2844474 - RNA, 22 nt, Mycobacterium avium subsp. paratuberculosis
gccagaacgaacagauggugaa

SEQ ID NO: 2844475 - RNA, 20 nt, Mycobacterium avium subsp. paratuberculosis
gccagaacgcuacucgcgca

SEQ ID NO: 2844476 - RNA, 13 nt, Mycobacterium avium subsp. paratuberculosis
gccagaacggcgg

SEQ ID NO: 2844477 - RNA, 14 nt, Mycobacterium avium subsp. paratuberculosis
gccagaacggcggc

SEQ ID NO: 2844478 - RNA, 16 nt, Mycobacterium avium subsp. paratuberculosis
gccagaacggcggcag

SEQ ID NO: 2844479 - RNA, 17 nt, Mycobacterium avium subsp. paratuberculosis
gccagaacggcggcagc

SEQ ID NO: 2844480 - RNA, 21 nt, Mycobacterium avium subsp. paratuberculosis
gccagaagaucugccggugcc

SEQ ID NO: 2844481 - RNA, 22 nt, Mycobacterium avium subsp. paratuberculosis
gccagaagaucugccggugccg

SEQ ID NO: 2844482 - RNA, 22 nt, Mycobacterium avium subsp. paratuberculosis
gccagaccacaagggccaccgg

SEQ ID NO: 2844483 - RNA, 18 nt, Mycobacterium avium subsp. paratuberculosis
gccagaccgguugcggcg

SEQ ID NO: 2844484 - RNA, 18 nt, Mycobacterium avium subsp. paratuberculosis
gccagcacccggucggug

SEQ ID NO: 2844485 - RNA, 19 nt, Mycobacterium avium subsp. paratuberculosis
gccagcacccggucgguga

SEQ ID NO: 2844486 - RNA, 19 nt, Mycobacterium avium subsp. paratuberculosis
gccagcaccgacagcuuga

SEQ ID NO: 2844487 - RNA, 21 nt, Mycobacterium avium subsp. paratuberculosis
gccagcaccgacagucccacc

SEQ ID NO: 2844488 - RNA, 22 nt, Mycobacterium avium subsp. paratuberculosis
gccagcaccgacagucccacca

SEQ ID NO: 2844489 - RNA, 18 nt, Mycobacterium avium subsp. paratuberculosis
gccagcaccgacgcgccg

SEQ ID NO: 2844490 - RNA, 12 nt, Mycobacterium avium subsp. paratuberculosis
gccagcaccgcc

SEQ ID NO: 2844491 - RNA, 13 nt, Mycobacterium avium subsp. paratuberculosis
gccagcaccgcca

SEQ ID NO: 2844492 - RNA, 14 nt, Mycobacterium avium subsp. paratuberculosis
gccagcaccgccac

SEQ ID NO: 2844493 - RNA, 16 nt, Mycobacterium avium subsp. paratuberculosis
gccagcaccgccaccg

SEQ ID NO: 2844494 - RNA, 18 nt, Mycobacterium avium subsp. paratuberculosis
gccagcaccgccaccggc

SEQ ID NO: 2844495 - RNA, 19 nt, Mycobacterium avium subsp. paratuberculosis
gccagcaccgccaccggcc

SEQ ID NO: 2844496 - RNA, 23 nt, Mycobacterium avium subsp. paratuberculosis
gccagcaccgccaccggcccggc

SEQ ID NO: 2844497 - RNA, 20 nt, Mycobacterium avium subsp. paratuberculosis
gccagcaccgccagcgccgg

SEQ ID NO: 2844498 - RNA, 17 nt, Mycobacterium avium subsp. paratuberculosis
gccagcaccgccccggu

SEQ ID NO: 2844499 - RNA, 20 nt, Mycobacterium avium subsp. paratuberculosis
gccagcaccgccccggucac

SEQ ID NO: 2844500 - RNA, 13 nt, Mycobacterium avium subsp. paratuberculosis
gccagcaccgccu

SEQ ID NO: 2844501 - RNA, 14 nt, Mycobacterium avium subsp. paratuberculosis
gccagcaccgccug

SEQ ID NO: 2844502 - RNA, 13 nt, Mycobacterium avium subsp. paratuberculosis
gccagcaccgcgg

SEQ ID NO: 2844503 - RNA, 14 nt, Mycobacterium avium subsp. paratuberculosis
gccagcaccgcggc

SEQ ID NO: 2844504 - RNA, 19 nt, Mycobacterium avium subsp. paratuberculosis
gccagcaccgcggccgucg

SEQ ID NO: 2844505 - RNA, 15 nt, Mycobacterium avium subsp. paratuberculosis
gccagcaccgcggcg

SEQ ID NO: 2844506 - RNA, 16 nt, Mycobacterium avium subsp. paratuberculosis
gccagcaccgcggcga

SEQ ID NO: 2844507 - RNA, 15 nt, Mycobacterium avium subsp. paratuberculosis
gccagcaccgcgggg

SEQ ID NO: 2844508 - RNA, 18 nt, Mycobacterium avium subsp. paratuberculosis
gccagcaccgcgggggcg

SEQ ID NO: 2844509 - RNA, 21 nt, Mycobacterium avium subsp. paratuberculosis
gccagcaccgcgggggcggcc

SEQ ID NO: 2844510 - RNA, 22 nt, Mycobacterium avium subsp. paratuberculosis
gccagcaccgcgggggcggccg

SEQ ID NO: 2844511 - RNA, 14 nt, Mycobacterium avium subsp. paratuberculosis
gccagcaccgcguc

SEQ ID NO: 2844512 - RNA, 15 nt, Mycobacterium avium subsp. paratuberculosis
gccagcaccgcgucg

SEQ ID NO: 2844513 - RNA, 16 nt, Mycobacterium avium subsp. paratuberculosis
gccagcaccgcgucga

SEQ ID NO: 2844514 - RNA, 18 nt, Mycobacterium avium subsp. paratuberculosis
gccagcaccgcgucgaug

SEQ ID NO: 2844515 - RNA, 12 nt, Mycobacterium avium subsp. paratuberculosis
gccagcaccggc

SEQ ID NO: 2844516 - RNA, 15 nt, Mycobacterium avium subsp. paratuberculosis
gccagcaccggcgcg

SEQ ID NO: 2844517 - RNA, 16 nt, Mycobacterium avium subsp. paratuberculosis
gccagcaccggcgcgc

SEQ ID NO: 2844518 - RNA, 13 nt, Mycobacterium avium subsp. paratuberculosis
gccagcaccgggc

SEQ ID NO: 2844519 - RNA, 16 nt, Mycobacterium avium subsp. paratuberculosis
gccagcaccgggccca

SEQ ID NO: 2844520 - RNA, 23 nt, Mycobacterium avium subsp. paratuberculosis
gccagcaccgggcccagcucggu

SEQ ID NO: 2844521 - RNA, 16 nt, Mycobacterium avium subsp. paratuberculosis
gccagcaccgucagcc

SEQ ID NO: 2844522 - RNA, 19 nt, Mycobacterium avium subsp. paratuberculosis
gccagcaccgucagccagg

SEQ ID NO: 2844523 - RNA, 15 nt, Mycobacterium avium subsp. paratuberculosis
gccagcaccucgcgg

SEQ ID NO: 2844524 - RNA, 15 nt, Mycobacterium avium subsp. paratuberculosis
gccagcaccucggcg

SEQ ID NO: 2844525 - RNA, 17 nt, Mycobacterium avium subsp. paratuberculosis
gccagcaccuucagcgg

SEQ ID NO: 2844526 - RNA, 20 nt, Mycobacterium avium subsp. paratuberculosis
gccagcaccuucagcgggcg

SEQ ID NO: 2844527 - RNA, 19 nt, Mycobacterium avium subsp. paratuberculosis
gccagcaccuucgggccga

SEQ ID NO: 2844528 - RNA, 18 nt, Mycobacterium avium subsp. paratuberculosis
gccagcacgaacaccacg

SEQ ID NO: 2844529 - RNA, 15 nt, Mycobacterium avium subsp. paratuberculosis
gccagcacgaccccg

SEQ ID NO: 2844530 - RNA, 17 nt, Mycobacterium avium subsp. paratuberculosis
gccagcacgaccccgcc

SEQ ID NO: 2844531 - RNA, 18 nt, Mycobacterium avium subsp. paratuberculosis
gccagcacgaccccgccc

SEQ ID NO: 2844532 - RNA, 21 nt, Mycobacterium avium subsp. paratuberculosis
gccagcacgaccccgcccacg

SEQ ID NO: 2844533 - RNA, 22 nt, Mycobacterium avium subsp. paratuberculosis
gccagcacgaccccgcccacga

SEQ ID NO: 2844534 - RNA, 14 nt, Mycobacterium avium subsp. paratuberculosis
gccagcacgaucgg

SEQ ID NO: 2844535 - RNA, 15 nt, Mycobacterium avium subsp. paratuberculosis
gccagcacgaucggg

SEQ ID NO: 2844536 - RNA, 16 nt, Mycobacterium avium subsp. paratuberculosis
gccagcacgcccccgc

SEQ ID NO: 2844537 - RNA, 18 nt, Mycobacterium avium subsp. paratuberculosis
gccagcacgcccccgcug

SEQ ID NO: 2844538 - RNA, 19 nt, Mycobacterium avium subsp. paratuberculosis
gccagcacgcccccgcugg

SEQ ID NO: 2844539 - RNA, 21 nt, Mycobacterium avium subsp. paratuberculosis
gccagcacgcccccgcuggcc

SEQ ID NO: 2844540 - RNA, 15 nt, Mycobacterium avium subsp. paratuberculosis
gccagcacgccgguc

SEQ ID NO: 2844541 - RNA, 18 nt, Mycobacterium avium subsp. paratuberculosis
gccagcacgccggucagc

SEQ ID NO: 2844542 - RNA, 20 nt, Mycobacterium avium subsp. paratuberculosis
gccagcacgccggucagcac

SEQ ID NO: 2844543 - RNA, 22 nt, Mycobacterium avium subsp. paratuberculosis
gccagcacgccggucagcacca

SEQ ID NO: 2844544 - RNA, 15 nt, Mycobacterium avium subsp. paratuberculosis
gccagcacgccgucc

SEQ ID NO: 2844545 - RNA, 16 nt, Mycobacterium avium subsp. paratuberculosis
gccagcacgcugcgga

SEQ ID NO: 2844546 - RNA, 15 nt, Mycobacterium avium subsp. paratuberculosis
gccagcacggccacc

SEQ ID NO: 2844547 - RNA, 15 nt, Mycobacterium avium subsp. paratuberculosis
gccagcacggccagc

SEQ ID NO: 2844548 - RNA, 19 nt, Mycobacterium avium subsp. paratuberculosis
gccagcacggccagccagc

SEQ ID NO: 2844549 - RNA, 16 nt, Mycobacterium avium subsp. paratuberculosis
gccagcacggcggcgu

SEQ ID NO: 2844550 - RNA, 16 nt, Mycobacterium avium subsp. paratuberculosis
gccagcacggucagcg

SEQ ID NO: 2844551 - RNA, 17 nt, Mycobacterium avium subsp. paratuberculosis
gccagcacggucagcgg

SEQ ID NO: 2844552 - RNA, 18 nt, Mycobacterium avium subsp. paratuberculosis
gccagcacggucagcggc

SEQ ID NO: 2844553 - RNA, 21 nt, Mycobacterium avium subsp. paratuberculosis
gccagcacggucagcggccag

SEQ ID NO: 2844554 - RNA, 23 nt, Mycobacterium avium subsp. paratuberculosis
gccagcacggucagcggccagcc

SEQ ID NO: 2844555 - RNA, 22 nt, Mycobacterium avium subsp. paratuberculosis
gccagcacgguguugcgcaccc

SEQ ID NO: 2844556 - RNA, 18 nt, Mycobacterium avium subsp. paratuberculosis
gccagcacgugaugcagc

SEQ ID NO: 2844557 - RNA, 19 nt, Mycobacterium avium subsp. paratuberculosis
gccagcacguggccgggcu

SEQ ID NO: 2844558 - RNA, 23 nt, Mycobacterium avium subsp. paratuberculosis
gccagcagauacuccucgcgguc

SEQ ID NO: 2844559 - RNA, 17 nt, Mycobacterium avium subsp. paratuberculosis
gccagcagaugccgccc

SEQ ID NO: 2844560 - RNA, 16 nt, Mycobacterium avium subsp. paratuberculosis
gccagcagcaacgcgg

SEQ ID NO: 2844561 - RNA, 18 nt, Mycobacterium avium subsp. paratuberculosis
gccagcagcaacgcggug

SEQ ID NO: 2844562 - RNA, 12 nt, Mycobacterium avium subsp. paratuberculosis
gccagcagcacc

SEQ ID NO: 2844563 - RNA, 20 nt, Mycobacterium avium subsp. paratuberculosis
gccagcagcaccagggcgug

SEQ ID NO: 2844564 - RNA, 13 nt, Mycobacterium avium subsp. paratuberculosis
gccagcagcaccg

SEQ ID NO: 2844565 - RNA, 14 nt, Mycobacterium avium subsp. paratuberculosis
gccagcagcaccgc

SEQ ID NO: 2844566 - RNA, 16 nt, Mycobacterium avium subsp. paratuberculosis
gccagcagcaccgcgu

SEQ ID NO: 2844567 - RNA, 20 nt, Mycobacterium avium subsp. paratuberculosis
gccagcagcaccgcguuguc

SEQ ID NO: 2844568 - RNA, 21 nt, Mycobacterium avium subsp. paratuberculosis
gccagcagcagcaggucgucg

SEQ ID NO: 2844569 - RNA, 17 nt, Mycobacterium avium subsp. paratuberculosis
gccagcauggucucgcu

SEQ ID NO: 2844570 - RNA, 21 nt, Mycobacterium avium subsp. paratuberculosis
gccagcauggucucgcugauc

SEQ ID NO: 2844571 - RNA, 19 nt, Mycobacterium avium subsp. paratuberculosis
gccagcaugguucgugggg

SEQ ID NO: 2844572 - RNA, 18 nt, Mycobacterium avium subsp. paratuberculosis
gccagccacgccgacacc

SEQ ID NO: 2844573 - RNA, 17 nt, Mycobacterium avium subsp. paratuberculosis
gccagccagccggugcg

SEQ ID NO: 2844574 - RNA, 16 nt, Mycobacterium avium subsp. paratuberculosis
gccagccaggccgucg

SEQ ID NO: 2844575 - RNA, 18 nt, Mycobacterium avium subsp. paratuberculosis
gccagccaggccgucggc

SEQ ID NO: 2844576 - RNA, 14 nt, Mycobacterium avium subsp. paratuberculosis
gccagccaggcgau

SEQ ID NO: 2844577 - RNA, 16 nt, Mycobacterium avium subsp. paratuberculosis
gccagccaggcgauga

SEQ ID NO: 2844578 - RNA, 23 nt, Mycobacterium avium subsp. paratuberculosis
gccagccaggcgaugaagccggc

SEQ ID NO: 2844579 - RNA, 15 nt, Mycobacterium avium subsp. paratuberculosis
gccagcccagccgcc

SEQ ID NO: 2844580 - RNA, 19 nt, Mycobacterium avium subsp. paratuberculosis
gccagccccaccaccgcca

SEQ ID NO: 2844581 - RNA, 15 nt, Mycobacterium avium subsp. paratuberculosis
gccagccccaccggc

SEQ ID NO: 2844582 - RNA, 16 nt, Mycobacterium avium subsp. paratuberculosis
gccagccccaccggcc

SEQ ID NO: 2844583 - RNA, 17 nt, Mycobacterium avium subsp. paratuberculosis
gccagccccaccggcca

SEQ ID NO: 2844584 - RNA, 20 nt, Mycobacterium avium subsp. paratuberculosis
gccagccccgggaaccagcc

SEQ ID NO: 2844585 - RNA, 15 nt, Mycobacterium avium subsp. paratuberculosis
gccagcccgaaaguc

SEQ ID NO: 2844586 - RNA, 15 nt, Mycobacterium avium subsp. paratuberculosis
gccagcccgcccagc

SEQ ID NO: 2844587 - RNA, 16 nt, Mycobacterium avium subsp. paratuberculosis
gccagcccgcccagcg

SEQ ID NO: 2844588 - RNA, 22 nt, Mycobacterium avium subsp. paratuberculosis
gccagcccgcccagcgccacgg

SEQ ID NO: 2844589 - RNA, 12 nt, Mycobacterium avium subsp. paratuberculosis
gccagcccgccg

SEQ ID NO: 2844590 - RNA, 15 nt, Mycobacterium avium subsp. paratuberculosis
gccagcccgccgaac

SEQ ID NO: 2844591 - RNA, 16 nt, Mycobacterium avium subsp. paratuberculosis
gccagcccgccgaacc

SEQ ID NO: 2844592 - RNA, 12 nt, Mycobacterium avium subsp. paratuberculosis
gccagcccgcgc

SEQ ID NO: 2844593 - RNA, 18 nt, Mycobacterium avium subsp. paratuberculosis
gccagcccgcgcaauacc

SEQ ID NO: 2844594 - RNA, 20 nt, Mycobacterium avium subsp. paratuberculosis
gccagcccgcggcagccagc

SEQ ID NO: 2844595 - RNA, 12 nt, Mycobacterium avium subsp. paratuberculosis
gccagcccgcgu

SEQ ID NO: 2844596 - RNA, 14 nt, Mycobacterium avium subsp. paratuberculosis
gccagcccgcgucg

SEQ ID NO: 2844597 - RNA, 19 nt, Mycobacterium avium subsp. paratuberculosis
gccagcccggcguacagca

SEQ ID NO: 2844598 - RNA, 18 nt, Mycobacterium avium subsp. paratuberculosis
gccagcccgggaaagcgg

SEQ ID NO: 2844599 - RNA, 21 nt, Mycobacterium avium subsp. paratuberculosis
gccagcccgggaaagcgggug

SEQ ID NO: 2844600 - RNA, 22 nt, Mycobacterium avium subsp. paratuberculosis
gccagcccgggaaagcggguga

SEQ ID NO: 2844601 - RNA, 12 nt, Mycobacterium avium subsp. paratuberculosis
gccagcccgucg

SEQ ID NO: 2844602 - RNA, 14 nt, Mycobacterium avium subsp. paratuberculosis
gccagcccgucggg

SEQ ID NO: 2844603 - RNA, 15 nt, Mycobacterium avium subsp. paratuberculosis
gccagcccguggcca

SEQ ID NO: 2844604 - RNA, 18 nt, Mycobacterium avium subsp. paratuberculosis
gccagcccguggccagcg

SEQ ID NO: 2844605 - RNA, 20 nt, Mycobacterium avium subsp. paratuberculosis
gccagcccguggccagcgcc

SEQ ID NO: 2844606 - RNA, 16 nt, Mycobacterium avium subsp. paratuberculosis
gccagcccguuguggc

SEQ ID NO: 2844607 - RNA, 21 nt, Mycobacterium avium subsp. paratuberculosis
gccagcccguuguggcggcca

SEQ ID NO: 2844608 - RNA, 23 nt, Mycobacterium avium subsp. paratuberculosis
gccagcccguuguggcggccagc

SEQ ID NO: 2844609 - RNA, 18 nt, Mycobacterium avium subsp. paratuberculosis
gccagccgaugcgcccgc

SEQ ID NO: 2844610 - RNA, 19 nt, Mycobacterium avium subsp. paratuberculosis
gccagccgaugcgcccgcg

SEQ ID NO: 2844611 - RNA, 20 nt, Mycobacterium avium subsp. paratuberculosis
gccagccgaugcgcccgcgc

SEQ ID NO: 2844612 - RNA, 22 nt, Mycobacterium avium subsp. paratuberculosis
gccagccgaugcgcccgcgcca

SEQ ID NO: 2844613 - RNA, 14 nt, Mycobacterium avium subsp. paratuberculosis
gccagccgcaccgc

SEQ ID NO: 2844614 - RNA, 15 nt, Mycobacterium avium subsp. paratuberculosis
gccagccgccgccga

SEQ ID NO: 2844615 - RNA, 16 nt, Mycobacterium avium subsp. paratuberculosis
gccagccgccgccgac

SEQ ID NO: 2844616 - RNA, 14 nt, Mycobacterium avium subsp. paratuberculosis
gccagccgccggcu

SEQ ID NO: 2844617 - RNA, 16 nt, Mycobacterium avium subsp. paratuberculosis
gccagccgccggcuca

SEQ ID NO: 2844618 - RNA, 17 nt, Mycobacterium avium subsp. paratuberculosis
gccagccgccggcucag

SEQ ID NO: 2844619 - RNA, 16 nt, Mycobacterium avium subsp. paratuberculosis
gccagccgcgccgcgc

SEQ ID NO: 2844620 - RNA, 21 nt, Mycobacterium avium subsp. paratuberculosis
gccagccgcgccgcgccgccu

SEQ ID NO: 2844621 - RNA, 13 nt, Mycobacterium avium subsp. paratuberculosis
gccagccgcgcga

SEQ ID NO: 2844622 - RNA, 16 nt, Mycobacterium avium subsp. paratuberculosis
gccagccgcgcggcgu

SEQ ID NO: 2844623 - RNA, 17 nt, Mycobacterium avium subsp. paratuberculosis
gccagccgcucccggcg

SEQ ID NO: 2844624 - RNA, 19 nt, Mycobacterium avium subsp. paratuberculosis
gccagccgcucccggcgca

SEQ ID NO: 2844625 - RNA, 20 nt, Mycobacterium avium subsp. paratuberculosis
gccagccgcucccggcgcag

SEQ ID NO: 2844626 - RNA, 22 nt, Mycobacterium avium subsp. paratuberculosis
gccagccgcucccggcgcagca

SEQ ID NO: 2844627 - RNA, 13 nt, Mycobacterium avium subsp. paratuberculosis
gccagccggcccu

SEQ ID NO: 2844628 - RNA, 16 nt, Mycobacterium avium subsp. paratuberculosis
gccagccggcccucca

SEQ ID NO: 2844629 - RNA, 17 nt, Mycobacterium avium subsp. paratuberculosis
gccagccggcccuccag

SEQ ID NO: 2844630 - RNA, 22 nt, Mycobacterium avium subsp. paratuberculosis
gccagccggccgcugaggaugg

SEQ ID NO: 2844631 - RNA, 12 nt, Mycobacterium avium subsp. paratuberculosis
gccagccgggcc

SEQ ID NO: 2844632 - RNA, 13 nt, Mycobacterium avium subsp. paratuberculosis
gccagccgggcga

SEQ ID NO: 2844633 - RNA, 14 nt, Mycobacterium avium subsp. paratuberculosis
gccagccgggcgac

SEQ ID NO: 2844634 - RNA, 16 nt, Mycobacterium avium subsp. paratuberculosis
gccagccgggcgaccg

SEQ ID NO: 2844635 - RNA, 14 nt, Mycobacterium avium subsp. paratuberculosis
gccagccggguggc

SEQ ID NO: 2844636 - RNA, 22 nt, Mycobacterium avium subsp. paratuberculosis
gccagccgguacggaucgccgg

SEQ ID NO: 2844637 - RNA, 18 nt, Mycobacterium avium subsp. paratuberculosis
gccagccggucgucgggg

SEQ ID NO: 2844638 - RNA, 19 nt, Mycobacterium avium subsp. paratuberculosis
gccagccggugcggucggc

SEQ ID NO: 2844639 - RNA, 21 nt, Mycobacterium avium subsp. paratuberculosis
gccagccggugcggucggcgu

SEQ ID NO: 2844640 - RNA, 13 nt, Mycobacterium avium subsp. paratuberculosis
gccagccggugcu

SEQ ID NO: 2844641 - RNA, 19 nt, Mycobacterium avium subsp. paratuberculosis
gccagccggugcugacccg

SEQ ID NO: 2844642 - RNA, 14 nt, Mycobacterium avium subsp. paratuberculosis
gccagccgguggcg

SEQ ID NO: 2844643 - RNA, 20 nt, Mycobacterium avium subsp. paratuberculosis
gccagccgguggcggccacg

SEQ ID NO: 2844644 - RNA, 15 nt, Mycobacterium avium subsp. paratuberculosis
gccagccgucccgcc

SEQ ID NO: 2844645 - RNA, 17 nt, Mycobacterium avium subsp. paratuberculosis
gccagccgucccgccgu

SEQ ID NO: 2844646 - RNA, 14 nt, Mycobacterium avium subsp. paratuberculosis
gccagccgucgccg

SEQ ID NO: 2844647 - RNA, 15 nt, Mycobacterium avium subsp. paratuberculosis
gccagccgucgccgc

SEQ ID NO: 2844648 - RNA, 16 nt, Mycobacterium avium subsp. paratuberculosis
gccagccgucgccgcg

SEQ ID NO: 2844649 - RNA, 21 nt, Mycobacterium avium subsp. paratuberculosis
gccagccgucgccgcgcccgc

SEQ ID NO: 2844650 - RNA, 14 nt, Mycobacterium avium subsp. paratuberculosis
gccagccgugcggc

SEQ ID NO: 2844651 - RNA, 16 nt, Mycobacterium avium subsp. paratuberculosis
gccagccgugcggcgg

SEQ ID NO: 2844652 - RNA, 17 nt, Mycobacterium avium subsp. paratuberculosis
gccagccgugcggcggc

SEQ ID NO: 2844653 - RNA, 18 nt, Mycobacterium avium subsp. paratuberculosis
gccagccgugcggcggcg

SEQ ID NO: 2844654 - RNA, 16 nt, Mycobacterium avium subsp. paratuberculosis
gccagcgcgccgaucg

SEQ ID NO: 2844655 - RNA, 14 nt, Mycobacterium avium subsp. paratuberculosis
gccagcgcgccgca

SEQ ID NO: 2844656 - RNA, 16 nt, Mycobacterium avium subsp. paratuberculosis
gccagcgcgccgcaca

SEQ ID NO: 2844657 - RNA, 21 nt, Mycobacterium avium subsp. paratuberculosis
gccagcgcgccgcacagccgg

SEQ ID NO: 2844658 - RNA, 14 nt, Mycobacterium avium subsp. paratuberculosis
gccagcgcgccgcc

SEQ ID NO: 2844659 - RNA, 15 nt, Mycobacterium avium subsp. paratuberculosis
gccagcgcgccgccg

SEQ ID NO: 2844660 - RNA, 16 nt, Mycobacterium avium subsp. paratuberculosis
gccagcgcgccgccga

SEQ ID NO: 2844661 - RNA, 20 nt, Mycobacterium avium subsp. paratuberculosis
gccagcgcgcgaucagcgcc

SEQ ID NO: 2844662 - RNA, 22 nt, Mycobacterium avium subsp. paratuberculosis
gccagcgcgcgaucagcgccgu

SEQ ID NO: 2844663 - RNA, 12 nt, Mycobacterium avium subsp. paratuberculosis
gccagcgcgcgc

SEQ ID NO: 2844664 - RNA, 13 nt, Mycobacterium avium subsp. paratuberculosis
gccagcgcgcgca

SEQ ID NO: 2844665 - RNA, 13 nt, Mycobacterium avium subsp. paratuberculosis
gccagcgcgcggg

SEQ ID NO: 2844666 - RNA, 21 nt, Mycobacterium avium subsp. paratuberculosis
gccagcgcgcgggcguccucg

SEQ ID NO: 2844667 - RNA, 12 nt, Mycobacterium avium subsp. paratuberculosis
gccagcgcggcc

SEQ ID NO: 2844668 - RNA, 13 nt, Mycobacterium avium subsp. paratuberculosis
gccagcgcggccg

SEQ ID NO: 2844669 - RNA, 16 nt, Mycobacterium avium subsp. paratuberculosis
gccagcgcggccgggc

SEQ ID NO: 2844670 - RNA, 17 nt, Mycobacterium avium subsp. paratuberculosis
gccagcgcggccgggcg

SEQ ID NO: 2844671 - RNA, 18 nt, Mycobacterium avium subsp. paratuberculosis
gccagcgcggccgggcgc

SEQ ID NO: 2844672 - RNA, 22 nt, Mycobacterium avium subsp. paratuberculosis
gccagcgcggccgggcgccccg

SEQ ID NO: 2844673 - RNA, 23 nt, Mycobacterium avium subsp. paratuberculosis
gccagcgcggccgggcgccccga

SEQ ID NO: 2844674 - RNA, 18 nt, Mycobacterium avium subsp. paratuberculosis
gccagcgcggcggccagc

SEQ ID NO: 2844675 - RNA, 15 nt, Mycobacterium avium subsp. paratuberculosis
gccagcgcggcggcg

SEQ ID NO: 2844676 - RNA, 18 nt, Mycobacterium avium subsp. paratuberculosis
gccagcgcggcggcgccg

SEQ ID NO: 2844677 - RNA, 20 nt, Mycobacterium avium subsp. paratuberculosis
gccagcgcggcggucgcgcg

SEQ ID NO: 2844678 - RNA, 23 nt, Mycobacterium avium subsp. paratuberculosis
gccagcgcggcggucgcgcgccg

SEQ ID NO: 2844679 - RNA, 21 nt, Mycobacterium avium subsp. paratuberculosis
gccagcgcggcgucacccugg

SEQ ID NO: 2844680 - RNA, 12 nt, Mycobacterium avium subsp. paratuberculosis
gccagcgcgggg

SEQ ID NO: 2844681 - RNA, 21 nt, Mycobacterium avium subsp. paratuberculosis
gccagcgcggggucggccagu

SEQ ID NO: 2844682 - RNA, 12 nt, Mycobacterium avium subsp. paratuberculosis
gccagcgcggug

SEQ ID NO: 2844683 - RNA, 19 nt, Mycobacterium avium subsp. paratuberculosis
gccagcgcggugaagucgg

SEQ ID NO: 2844684 - RNA, 23 nt, Mycobacterium avium subsp. paratuberculosis
gccagcgcggugaagucggugcc

SEQ ID NO: 2844685 - RNA, 13 nt, Mycobacterium avium subsp. paratuberculosis
gccagcgcggugc

SEQ ID NO: 2844686 - RNA, 15 nt, Mycobacterium avium subsp. paratuberculosis
gccagcgcggugccc

SEQ ID NO: 2844687 - RNA, 17 nt, Mycobacterium avium subsp. paratuberculosis
gccagcgcggugcccag

SEQ ID NO: 2844688 - RNA, 20 nt, Mycobacterium avium subsp. paratuberculosis
gccagcgcggugcccagcca

SEQ ID NO: 2844689 - RNA, 23 nt, Mycobacterium avium subsp. paratuberculosis
gccagcgcggugcccagccaggc

SEQ ID NO: 2844690 - RNA, 15 nt, Mycobacterium avium subsp. paratuberculosis
gccagcgcggugucg

SEQ ID NO: 2844691 - RNA, 22 nt, Mycobacterium avium subsp. paratuberculosis
gccagcgcggugucgacgucgg

SEQ ID NO: 2844692 - RNA, 14 nt, Mycobacterium avium subsp. paratuberculosis
gccagcgcggugug

SEQ ID NO: 2844693 - RNA, 15 nt, Mycobacterium avium subsp. paratuberculosis
gccagcgcggugugc

SEQ ID NO: 2844694 - RNA, 21 nt, Mycobacterium avium subsp. paratuberculosis
gccagcgcggugugcggcggc

SEQ ID NO: 2844695 - RNA, 22 nt, Mycobacterium avium subsp. paratuberculosis
gccagcgcggugugcggcggcu

SEQ ID NO: 2844696 - RNA, 23 nt, Mycobacterium avium subsp. paratuberculosis
gccagcgcggugugcggcggcuc

SEQ ID NO: 2844697 - RNA, 24 nt, Mycobacterium avium subsp. paratuberculosis
gccagcgcggugugcggcggcucg

SEQ ID NO: 2844698 - RNA, 12 nt, Mycobacterium avium subsp. paratuberculosis
gccagcgcgucg

SEQ ID NO: 2844699 - RNA, 13 nt, Mycobacterium avium subsp. paratuberculosis
gccagcgcgucgg

SEQ ID NO: 2844700 - RNA, 14 nt, Mycobacterium avium subsp. paratuberculosis
gccagcgcgucggc

SEQ ID NO: 2844701 - RNA, 17 nt, Mycobacterium avium subsp. paratuberculosis
gccagcgcgucggccag

SEQ ID NO: 2844702 - RNA, 22 nt, Mycobacterium avium subsp. paratuberculosis
gccagcgcgucggccagcacca

SEQ ID NO: 2844703 - RNA, 16 nt, Mycobacterium avium subsp. paratuberculosis
gccagcgcgugaucgg

SEQ ID NO: 2844704 - RNA, 18 nt, Mycobacterium avium subsp. paratuberculosis
gccagcgcgugaucggug

SEQ ID NO: 2844705 - RNA, 22 nt, Mycobacterium avium subsp. paratuberculosis
gccagcgcgugaugggugggca

SEQ ID NO: 2844706 - RNA, 15 nt, Mycobacterium avium subsp. paratuberculosis
gccagcgcgugcggg

SEQ ID NO: 2844707 - RNA, 18 nt, Mycobacterium avium subsp. paratuberculosis
gccagcgcgugcggggug

SEQ ID NO: 2844708 - RNA, 19 nt, Mycobacterium avium subsp. paratuberculosis
gccagcgcgugcggggugu

SEQ ID NO: 2844709 - RNA, 21 nt, Mycobacterium avium subsp. paratuberculosis
gccagcgcgugcggggugugc

SEQ ID NO: 2844710 - RNA, 21 nt, Mycobacterium avium subsp. paratuberculosis
gccagcggcaacugggcggcc

SEQ ID NO: 2844711 - RNA, 13 nt, Mycobacterium avium subsp. paratuberculosis
gccagcggcagcg

SEQ ID NO: 2844712 - RNA, 14 nt, Mycobacterium avium subsp. paratuberculosis
gccagcggcagcga

SEQ ID NO: 2844713 - RNA, 17 nt, Mycobacterium avium subsp. paratuberculosis
gccagcggcagcgacag

SEQ ID NO: 2844714 - RNA, 21 nt, Mycobacterium avium subsp. paratuberculosis
gccagcggcagcgacagcgcg

SEQ ID NO: 2844715 - RNA, 18 nt, Mycobacterium avium subsp. paratuberculosis
gccagcggcagcgccagc

SEQ ID NO: 2844716 - RNA, 15 nt, Mycobacterium avium subsp. paratuberculosis
gccagcggcagcggc

SEQ ID NO: 2844717 - RNA, 20 nt, Mycobacterium avium subsp. paratuberculosis
gccagcggcagcggcgucgu

SEQ ID NO: 2844718 - RNA, 22 nt, Mycobacterium avium subsp. paratuberculosis
gccagcggcagcggcgucgucg

SEQ ID NO: 2844719 - RNA, 13 nt, Mycobacterium avium subsp. paratuberculosis
gccagcggccagc

SEQ ID NO: 2844720 - RNA, 19 nt, Mycobacterium avium subsp. paratuberculosis
gccagcggccagcccgcgg

SEQ ID NO: 2844721 - RNA, 20 nt, Mycobacterium avium subsp. paratuberculosis
gccagcggccagcccgcggc

SEQ ID NO: 2844722 - RNA, 15 nt, Mycobacterium avium subsp. paratuberculosis
gccagcggccgauca

SEQ ID NO: 2844723 - RNA, 16 nt, Mycobacterium avium subsp. paratuberculosis
gccagcggcgcaacca

SEQ ID NO: 2844724 - RNA, 13 nt, Mycobacterium avium subsp. paratuberculosis
gccagcggcgccg

SEQ ID NO: 2844725 - RNA, 16 nt, Mycobacterium avium subsp. paratuberculosis
gccagcggcgccgggu

SEQ ID NO: 2844726 - RNA, 23 nt, Mycobacterium avium subsp. paratuberculosis
gccagcggcgccgggucaccgga

SEQ ID NO: 2844727 - RNA, 21 nt, Mycobacterium avium subsp. paratuberculosis
gccagcgggauacccaugauc

SEQ ID NO: 2844728 - RNA, 12 nt, Mycobacterium avium subsp. paratuberculosis
gccagcgggccg

SEQ ID NO: 2844729 - RNA, 17 nt, Mycobacterium avium subsp. paratuberculosis
gccagcgggccgaccug

SEQ ID NO: 2844730 - RNA, 17 nt, Mycobacterium avium subsp. paratuberculosis
gccagcgggccgagcgu

SEQ ID NO: 2844731 - RNA, 21 nt, Mycobacterium avium subsp. paratuberculosis
gccagcgggccgagcguucgg

SEQ ID NO: 2844732 - RNA, 18 nt, Mycobacterium avium subsp. paratuberculosis
gccagcgggccgugccgc

SEQ ID NO: 2844733 - RNA, 16 nt, Mycobacterium avium subsp. paratuberculosis
gccagcgggccguugc

SEQ ID NO: 2844734 - RNA, 17 nt, Mycobacterium avium subsp. paratuberculosis
gccagcgggcggccccg

SEQ ID NO: 2844735 - RNA, 15 nt, Mycobacterium avium subsp. paratuberculosis
gccagcgggucgugc

SEQ ID NO: 2844736 - RNA, 20 nt, Mycobacterium avium subsp. paratuberculosis
gccagcgggucgugcaucgg

SEQ ID NO: 2844737 - RNA, 23 nt, Mycobacterium avium subsp. paratuberculosis
gccagcgggucgugcaucggcgc

SEQ ID NO: 2844738 - RNA, 19 nt, Mycobacterium avium subsp. paratuberculosis
gccagcugcgacagcacgg

SEQ ID NO: 2844739 - RNA, 21 nt, Mycobacterium avium subsp. paratuberculosis
gccagcugcgcgucggccgca

SEQ ID NO: 2844740 - RNA, 12 nt, Mycobacterium avium subsp. paratuberculosis
gccagcugcggg

SEQ ID NO: 2844741 - RNA, 22 nt, Mycobacterium avium subsp. paratuberculosis
gccagcugcggguugcgggcca

SEQ ID NO: 2844742 - RNA, 14 nt, Mycobacterium avium subsp. paratuberculosis
gccagcugcgugaa

SEQ ID NO: 2844743 - RNA, 14 nt, Mycobacterium avium subsp. paratuberculosis
gccagcugggcagc

SEQ ID NO: 2844744 - RNA, 15 nt, Mycobacterium avium subsp. paratuberculosis
gccagcugggcagcc

SEQ ID NO: 2844745 - RNA, 22 nt, Mycobacterium avium subsp. paratuberculosis
gccagcuggguggucaccagcg

SEQ ID NO: 2844746 - RNA, 23 nt, Mycobacterium avium subsp. paratuberculosis
gccagcuggguggucaccagcgc

SEQ ID NO: 2844747 - RNA, 17 nt, Mycobacterium avium subsp. paratuberculosis
gccagcuggucguagcg

SEQ ID NO: 2844748 - RNA, 20 nt, Mycobacterium avium subsp. paratuberculosis
gccagcuggugaagcugccg

SEQ ID NO: 2844749 - RNA, 21 nt, Mycobacterium avium subsp. paratuberculosis
gccagcuggugaagcugccga

SEQ ID NO: 2844750 - RNA, 15 nt, Mycobacterium avium subsp. paratuberculosis
gccagcuucaccggu

SEQ ID NO: 2844751 - RNA, 18 nt, Mycobacterium avium subsp. paratuberculosis
gccagcuucaccggucgg

SEQ ID NO: 2844752 - RNA, 22 nt, Mycobacterium avium subsp. paratuberculosis
gccagcuucaccggucgggcca

SEQ ID NO: 2844753 - RNA, 15 nt, Mycobacterium avium subsp. paratuberculosis
gccagcuucgggcgc

SEQ ID NO: 2844754 - RNA, 17 nt, Mycobacterium avium subsp. paratuberculosis
gccagcuucgggcgcgc

SEQ ID NO: 2844755 - RNA, 15 nt, Mycobacterium avium subsp. paratuberculosis
gccagcuugcagcug

SEQ ID NO: 2844756 - RNA, 17 nt, Mycobacterium avium subsp. paratuberculosis
gccagcuuuccggccgc

SEQ ID NO: 2844757 - RNA, 18 nt, Mycobacterium avium subsp. paratuberculosis
gccaggaaccacaccccg

SEQ ID NO: 2844758 - RNA, 20 nt, Mycobacterium avium subsp. paratuberculosis
gccaggaaccacaccccggc

SEQ ID NO: 2844759 - RNA, 15 nt, Mycobacterium avium subsp. paratuberculosis
gccaggaaccaccgg

SEQ ID NO: 2844760 - RNA, 17 nt, Mycobacterium avium subsp. paratuberculosis
gccaggaaccaccggaa

SEQ ID NO: 2844761 - RNA, 16 nt, Mycobacterium avium subsp. paratuberculosis
gccaggaacggcgcca

SEQ ID NO: 2844762 - RNA, 17 nt, Mycobacterium avium subsp. paratuberculosis
gccaggaacggcgccau

SEQ ID NO: 2844763 - RNA, 18 nt, Mycobacterium avium subsp. paratuberculosis
gccaggaacggcgccauc

SEQ ID NO: 2844764 - RNA, 20 nt, Mycobacterium avium subsp. paratuberculosis
gccaggaagacguaggcggc

SEQ ID NO: 2844765 - RNA, 15 nt, Mycobacterium avium subsp. paratuberculosis
gccaggaagccggcg

SEQ ID NO: 2844766 - RNA, 17 nt, Mycobacterium avium subsp. paratuberculosis
gccaggaagccggcgac

SEQ ID NO: 2844767 - RNA, 16 nt, Mycobacterium avium subsp. paratuberculosis
gccaggaauaacgccg

SEQ ID NO: 2844768 - RNA, 18 nt, Mycobacterium avium subsp. paratuberculosis
gccaggaauaacgccggc

SEQ ID NO: 2844769 - RNA, 12 nt, Mycobacterium avium subsp. paratuberculosis
gccaggaccagc

SEQ ID NO: 2844770 - RNA, 14 nt, Mycobacterium avium subsp. paratuberculosis
gccaggaccagcgg

SEQ ID NO: 2844771 - RNA, 16 nt, Mycobacterium avium subsp. paratuberculosis
gccaggaccagcgggu

SEQ ID NO: 2844772 - RNA, 19 nt, Mycobacterium avium subsp. paratuberculosis
gccaggaccagcgggucga

SEQ ID NO: 2844773 - RNA, 19 nt, Mycobacterium avium subsp. paratuberculosis
gccaggaccgggacgacgg

SEQ ID NO: 2844774 - RNA, 17 nt, Mycobacterium avium subsp. paratuberculosis
gccaggauccgcccgcc

SEQ ID NO: 2844775 - RNA, 18 nt, Mycobacterium avium subsp. paratuberculosis
gccaggauccgcccgccg

SEQ ID NO: 2844776 - RNA, 16 nt, Mycobacterium avium subsp. paratuberculosis
gccaggaucgcguuga

SEQ ID NO: 2844777 - RNA, 21 nt, Mycobacterium avium subsp. paratuberculosis
gccaggaucucgcgggcccgc

SEQ ID NO: 2844778 - RNA, 17 nt, Mycobacterium avium subsp. paratuberculosis
gccaggaucugcucggc

SEQ ID NO: 2844779 - RNA, 15 nt, Mycobacterium avium subsp. paratuberculosis
gccaggaucuugucg

SEQ ID NO: 2844780 - RNA, 21 nt, Mycobacterium avium subsp. paratuberculosis
gccaggaucuugucggcggcc

SEQ ID NO: 2844781 - RNA, 22 nt, Mycobacterium avium subsp. paratuberculosis
gccaggaucuugucggcggccu

SEQ ID NO: 2844782 - RNA, 15 nt, Mycobacterium avium subsp. paratuberculosis
gccaggaugaaccgg

SEQ ID NO: 2844783 - RNA, 11 nt, Mycobacterium avium subsp. paratuberculosis
gccaggaugac

SEQ ID NO: 2844784 - RNA, 19 nt, Mycobacterium avium subsp. paratuberculosis
gccaggaugaccgcccagg

SEQ ID NO: 2844785 - RNA, 21 nt, Mycobacterium avium subsp. paratuberculosis
gccaggaugaccgcccaggac

SEQ ID NO: 2844786 - RNA, 17 nt, Mycobacterium avium subsp. paratuberculosis
gccaggaugccgaacgc

SEQ ID NO: 2844787 - RNA, 12 nt, Mycobacterium avium subsp. paratuberculosis
gccaggauggag

SEQ ID NO: 2844788 - RNA, 17 nt, Mycobacterium avium subsp. paratuberculosis
gccaggauggagcugac

SEQ ID NO: 2844789 - RNA, 17 nt, Mycobacterium avium subsp. paratuberculosis
gccaggauguacccgca

SEQ ID NO: 2844790 - RNA, 22 nt, Mycobacterium avium subsp. paratuberculosis
gccaggauguacccgcaggcca

SEQ ID NO: 2844791 - RNA, 18 nt, Mycobacterium avium subsp. paratuberculosis
gccaggaugucggacucg

SEQ ID NO: 2844792 - RNA, 23 nt, Mycobacterium avium subsp. paratuberculosis
gccaggaugucggacucgcgccg

SEQ ID NO: 2844793 - RNA, 20 nt, Mycobacterium avium subsp. paratuberculosis
gccaggaugucguccucggu

SEQ ID NO: 2844794 - RNA, 21 nt, Mycobacterium avium subsp. paratuberculosis
gccaggaugucguccucgguc

SEQ ID NO: 2844795 - RNA, 18 nt, Mycobacterium avium subsp. paratuberculosis
gccaggauguucaccccg

SEQ ID NO: 2844796 - RNA, 20 nt, Mycobacterium avium subsp. paratuberculosis
gccaggauguucaccccggc

SEQ ID NO: 2844797 - RNA, 16 nt, Mycobacterium avium subsp. paratuberculosis
gccaggcacagcaggg

SEQ ID NO: 2844798 - RNA, 17 nt, Mycobacterium avium subsp. paratuberculosis
gccaggcacagcagggc

SEQ ID NO: 2844799 - RNA, 18 nt, Mycobacterium avium subsp. paratuberculosis
gccaggcacagcagggca

SEQ ID NO: 2844800 - RNA, 15 nt, Mycobacterium avium subsp. paratuberculosis
gccaggcacggcccg

SEQ ID NO: 2844801 - RNA, 14 nt, Mycobacterium avium subsp. paratuberculosis
gccaggccaccgca

SEQ ID NO: 2844802 - RNA, 16 nt, Mycobacterium avium subsp. paratuberculosis
gccaggccaccgcacg

SEQ ID NO: 2844803 - RNA, 12 nt, Mycobacterium avium subsp. paratuberculosis
gccaggccaugg

SEQ ID NO: 2844804 - RNA, 20 nt, Mycobacterium avium subsp. paratuberculosis
gccaggccauggcgcaccgc

SEQ ID NO: 2844805 - RNA, 21 nt, Mycobacterium avium subsp. paratuberculosis
gccaggccauggcgcaccgcg

SEQ ID NO: 2844806 - RNA, 22 nt, Mycobacterium avium subsp. paratuberculosis
gccaggccauggcgcaccgcgg

SEQ ID NO: 2844807 - RNA, 15 nt, Mycobacterium avium subsp. paratuberculosis
gccaggcccaccguc

SEQ ID NO: 2844808 - RNA, 16 nt, Mycobacterium avium subsp. paratuberculosis
gccaggcccaccgucg

SEQ ID NO: 2844809 - RNA, 23 nt, Mycobacterium avium subsp. paratuberculosis
gccaggcccaccgucgccacgau

SEQ ID NO: 2844810 - RNA, 23 nt, Mycobacterium avium subsp. paratuberculosis
gccaggcccagcccggccccacc

SEQ ID NO: 2844811 - RNA, 16 nt, Mycobacterium avium subsp. paratuberculosis
gccaggcccugccagc

SEQ ID NO: 2844812 - RNA, 18 nt, Mycobacterium avium subsp. paratuberculosis
gccaggcccugccagcgc

SEQ ID NO: 2844813 - RNA, 14 nt, Mycobacterium avium subsp. paratuberculosis
gccaggccgccggg

SEQ ID NO: 2844814 - RNA, 18 nt, Mycobacterium avium subsp. paratuberculosis
gccaggccgccgggccgc

SEQ ID NO: 2844815 - RNA, 18 nt, Mycobacterium avium subsp. paratuberculosis
gccaggccgcgagcacga

SEQ ID NO: 2844816 - RNA, 17 nt, Mycobacterium avium subsp. paratuberculosis
gccaggccggccugccg

SEQ ID NO: 2844817 - RNA, 18 nt, Mycobacterium avium subsp. paratuberculosis
gccaggccggccugccgg

SEQ ID NO: 2844818 - RNA, 20 nt, Mycobacterium avium subsp. paratuberculosis
gccaggccggccugccggau

SEQ ID NO: 2844819 - RNA, 12 nt, Mycobacterium avium subsp. paratuberculosis
gccaggccggcg

SEQ ID NO: 2844820 - RNA, 15 nt, Mycobacterium avium subsp. paratuberculosis
gccaggccggcgacg

SEQ ID NO: 2844821 - RNA, 21 nt, Mycobacterium avium subsp. paratuberculosis
gccaggccggcgacgccggcg

SEQ ID NO: 2844822 - RNA, 20 nt, Mycobacterium avium subsp. paratuberculosis
gccagguuccaccgggcguc

SEQ ID NO: 2844823 - RNA, 22 nt, Mycobacterium avium subsp. paratuberculosis
gccagguuccaccgggcgucgg

SEQ ID NO: 2844824 - RNA, 17 nt, Mycobacterium avium subsp. paratuberculosis
gccagguugcgccgucc

SEQ ID NO: 2844825 - RNA, 19 nt, Mycobacterium avium subsp. paratuberculosis
gccagguugcgccguccgg

SEQ ID NO: 2844826 - RNA, 20 nt, Mycobacterium avium subsp. paratuberculosis
gccagguugcgccguccggc

SEQ ID NO: 2844827 - RNA, 21 nt, Mycobacterium avium subsp. paratuberculosis
gccagguugcgccguccggcc

SEQ ID NO: 2844828 - RNA, 23 nt, Mycobacterium avium subsp. paratuberculosis
gccagguugcgccguccggccac

SEQ ID NO: 2844829 - RNA, 15 nt, Mycobacterium avium subsp. paratuberculosis
gccagguuggcggcg

SEQ ID NO: 2844830 - RNA, 16 nt, Mycobacterium avium subsp. paratuberculosis
gccagguuggcggcgg

SEQ ID NO: 2844831 - RNA, 20 nt, Mycobacterium avium subsp. paratuberculosis
gccagguuggcggcggcccg

SEQ ID NO: 2844832 - RNA, 14 nt, Mycobacterium avium subsp. paratuberculosis
gccagguuggucag

SEQ ID NO: 2844833 - RNA, 18 nt, Mycobacterium avium subsp. paratuberculosis
gccagguuggucagcagc

SEQ ID NO: 2844834 - RNA, 15 nt, Mycobacterium avium subsp. paratuberculosis
gccaguaccagcggc

SEQ ID NO: 2844835 - RNA, 16 nt, Mycobacterium avium subsp. paratuberculosis
gccaguaccagcggcc

SEQ ID NO: 2844836 - RNA, 17 nt, Mycobacterium avium subsp. paratuberculosis
gccaguaccagcggccg

SEQ ID NO: 2844837 - RNA, 22 nt, Mycobacterium avium subsp. paratuberculosis
gccaguaccagcggccgucgcg

SEQ ID NO: 2844838 - RNA, 23 nt, Mycobacterium avium subsp. paratuberculosis
gccaguaccagcggccgucgcgc

SEQ ID NO: 2844839 - RNA, 15 nt, Mycobacterium avium subsp. paratuberculosis
gccaguccaggccgc

SEQ ID NO: 2844840 - RNA, 14 nt, Mycobacterium avium subsp. paratuberculosis
gccaguccgccgcc

SEQ ID NO: 2844841 - RNA, 15 nt, Mycobacterium avium subsp. paratuberculosis
gccaguccgccgccg

SEQ ID NO: 2844842 - RNA, 16 nt, Mycobacterium avium subsp. paratuberculosis
gccaguccggcagcag

SEQ ID NO: 2844843 - RNA, 18 nt, Mycobacterium avium subsp. paratuberculosis
gccaguccggcagcagcg

SEQ ID NO: 2844844 - RNA, 19 nt, Mycobacterium avium subsp. paratuberculosis
gccaguccggcagcagcga

SEQ ID NO: 2844845 - RNA, 20 nt, Mycobacterium avium subsp. paratuberculosis
gccaguccggcagcagcgag

SEQ ID NO: 2844846 - RNA, 15 nt, Mycobacterium avium subsp. paratuberculosis
gccaguccggcgccg

SEQ ID NO: 2844847 - RNA, 15 nt, Mycobacterium avium subsp. paratuberculosis
gccaguccugggcca

SEQ ID NO: 2844848 - RNA, 15 nt, Mycobacterium avium subsp. paratuberculosis
gccagucgaaguucg

SEQ ID NO: 2844849 - RNA, 19 nt, Mycobacterium avium subsp. paratuberculosis
gccagucgaaguucggcau

SEQ ID NO: 2844850 - RNA, 13 nt, Mycobacterium avium subsp. paratuberculosis
gccagucgccgcg

SEQ ID NO: 2844851 - RNA, 16 nt, Mycobacterium avium subsp. paratuberculosis
gccagucgccgcgcag

SEQ ID NO: 2844852 - RNA, 12 nt, Mycobacterium avium subsp. paratuberculosis
gccagucgccgg

SEQ ID NO: 2844853 - RNA, 14 nt, Mycobacterium avium subsp. paratuberculosis
gccagucgccggcc

SEQ ID NO: 2844854 - RNA, 16 nt, Mycobacterium avium subsp. paratuberculosis
gccagucgcggcgaac

SEQ ID NO: 2844855 - RNA, 20 nt, Mycobacterium avium subsp. paratuberculosis
gccagucgcggcgaaccagc

SEQ ID NO: 2844856 - RNA, 23 nt, Mycobacterium avium subsp. paratuberculosis
gccagucguacucccaggccgcg

SEQ ID NO: 2844857 - RNA, 18 nt, Mycobacterium avium subsp. paratuberculosis
gccagucugagcccgggc

SEQ ID NO: 2844858 - RNA, 20 nt, Mycobacterium avium subsp. paratuberculosis
gccagucugagcccgggcag

SEQ ID NO: 2844859 - RNA, 15 nt, Mycobacterium avium subsp. paratuberculosis
gccagugauccuggu

SEQ ID NO: 2844860 - RNA, 14 nt, Mycobacterium avium subsp. paratuberculosis
gccagugccgggcc

SEQ ID NO: 2844861 - RNA, 16 nt, Mycobacterium avium subsp. paratuberculosis
gccaguggcugcacgu

SEQ ID NO: 2844862 - RNA, 21 nt, Mycobacterium avium subsp. paratuberculosis
gccagugggggaauggcgguc

SEQ ID NO: 2844863 - RNA, 20 nt, Mycobacterium avium subsp. paratuberculosis
gccaguguggccgcggcggc

SEQ ID NO: 2844864 - RNA, 16 nt, Mycobacterium avium subsp. paratuberculosis
gccaguucccggccag

SEQ ID NO: 2844865 - RNA, 16 nt, Mycobacterium avium subsp. paratuberculosis
gccaguucccgggcga

SEQ ID NO: 2844866 - RNA, 14 nt, Mycobacterium avium subsp. paratuberculosis
gccaguucgacgau

SEQ ID NO: 2844867 - RNA, 18 nt, Mycobacterium avium subsp. paratuberculosis
gccaguucgagcgccgcg

SEQ ID NO: 2844868 - RNA, 12 nt, Mycobacterium avium subsp. paratuberculosis
gccaguucgcca

SEQ ID NO: 2844869 - RNA, 13 nt, Mycobacterium avium subsp. paratuberculosis
gccaguucgccgg

SEQ ID NO: 2844870 - RNA, 15 nt, Mycobacterium avium subsp. paratuberculosis
gccaguucgccggug

SEQ ID NO: 2844871 - RNA, 16 nt, Mycobacterium avium subsp. paratuberculosis
gccaguucgccgguga

SEQ ID NO: 2844872 - RNA, 18 nt, Mycobacterium avium subsp. paratuberculosis
gccaguucggguccgcgg

SEQ ID NO: 2844873 - RNA, 15 nt, Mycobacterium avium subsp. paratuberculosis
gccaguucgucgcgc

SEQ ID NO: 2844874 - RNA, 16 nt, Mycobacterium avium subsp. paratuberculosis
gccaguucgucgcgcg

SEQ ID NO: 2844875 - RNA, 17 nt, Mycobacterium avium subsp. paratuberculosis
gccaguucgucgcgcga

SEQ ID NO: 2844876 - RNA, 15 nt, Mycobacterium avium subsp. paratuberculosis
gccaguucgucggcc

SEQ ID NO: 2844877 - RNA, 16 nt, Mycobacterium avium subsp. paratuberculosis
gccaguucgucggccg

SEQ ID NO: 2844878 - RNA, 20 nt, Mycobacterium avium subsp. paratuberculosis
gccaguucgucggccgucgg

SEQ ID NO: 2844879 - RNA, 21 nt, Mycobacterium avium subsp. paratuberculosis
gccaguugaaguccggcgguc

SEQ ID NO: 2844880 - RNA, 22 nt, Mycobacterium avium subsp. paratuberculosis
gccaguugaaguccggcggucg

SEQ ID NO: 2844881 - RNA, 23 nt, Mycobacterium avium subsp. paratuberculosis
gccaguugaaguccggcggucgc

SEQ ID NO: 2844882 - RNA, 14 nt, Mycobacterium avium subsp. paratuberculosis
gccaguugaucagc

SEQ ID NO: 2844883 - RNA, 18 nt, Mycobacterium avium subsp. paratuberculosis
gccaguugaucagcccga

SEQ ID NO: 2844884 - RNA, 19 nt, Mycobacterium avium subsp. paratuberculosis
gccaguugcacuuucggca

SEQ ID NO: 2844885 - RNA, 19 nt, Mycobacterium avium subsp. paratuberculosis
gccaguugggggccagcgc

SEQ ID NO: 2844886 - RNA, 21 nt, Mycobacterium avium subsp. paratuberculosis
gccaguugggggccagcgccg

SEQ ID NO: 2844887 - RNA, 19 nt, Mycobacterium avium subsp. paratuberculosis
gccaguuguuggccgggca

SEQ ID NO: 2844888 - RNA, 13 nt, Mycobacterium avium subsp. paratuberculosis
gccaguuugccgu

SEQ ID NO: 2844889 - RNA, 17 nt, Mycobacterium avium subsp. paratuberculosis
gccaguuugccgucggg

SEQ ID NO: 2844890 - RNA, 16 nt, Mycobacterium avium subsp. paratuberculosis
gccauaaaccggccgg

SEQ ID NO: 2844891 - RNA, 20 nt, Mycobacterium avium subsp. paratuberculosis
gccauaccuugucggcgucu

SEQ ID NO: 2844892 - RNA, 19 nt, Mycobacterium avium subsp. paratuberculosis
gccauagaccauaaucggc

SEQ ID NO: 2844893 - RNA, 17 nt, Mycobacterium avium subsp. paratuberculosis
gccaucaaccgauuucg

SEQ ID NO: 2844894 - RNA, 22 nt, Mycobacterium avium subsp. paratuberculosis
gccaucaaccgauuucggccag

SEQ ID NO: 2844895 - RNA, 15 nt, Mycobacterium avium subsp. paratuberculosis
gccaucaccagcgcg

SEQ ID NO: 2844896 - RNA, 16 nt, Mycobacterium avium subsp. paratuberculosis
gccaucaccagcgcgu

SEQ ID NO: 2844897 - RNA, 22 nt, Mycobacterium avium subsp. paratuberculosis
gccaucaccagcgcguagagca

SEQ ID NO: 2844898 - RNA, 23 nt, Mycobacterium avium subsp. paratuberculosis
gccaucaccagcgcguagagcau

SEQ ID NO: 2844899 - RNA, 22 nt, Mycobacterium avium subsp. paratuberculosis
gccaucaccuccuuggccaggc

SEQ ID NO: 2844900 - RNA, 23 nt, Mycobacterium avium subsp. paratuberculosis
gccaucaccuccuuggccaggcg

SEQ ID NO: 2844901 - RNA, 15 nt, Mycobacterium avium subsp. paratuberculosis
gccaucacggugccg

SEQ ID NO: 2844902 - RNA, 19 nt, Mycobacterium avium subsp. paratuberculosis
gccaucacggugccgaguu

SEQ ID NO: 2844903 - RNA, 18 nt, Mycobacterium avium subsp. paratuberculosis
gccaucagaacgcccgca

SEQ ID NO: 2844904 - RNA, 13 nt, Mycobacterium avium subsp. paratuberculosis
gccaucagcagcg

SEQ ID NO: 2844905 - RNA, 18 nt, Mycobacterium avium subsp. paratuberculosis
gccaucagcccggcgucc

SEQ ID NO: 2844906 - RNA, 21 nt, Mycobacterium avium subsp. paratuberculosis
gccauggcggcauccccagcu

SEQ ID NO: 2844907 - RNA, 22 nt, Mycobacterium avium subsp. paratuberculosis
gccauggcggcauccccagcug

SEQ ID NO: 2844908 - RNA, 16 nt, Mycobacterium avium subsp. paratuberculosis
gccauggcggcccgcg

SEQ ID NO: 2844909 - RNA, 20 nt, Mycobacterium avium subsp. paratuberculosis
gccauggcggcccgcgccgg

SEQ ID NO: 2844910 - RNA, 23 nt, Mycobacterium avium subsp. paratuberculosis
gccauggcggcccgcgccggcgu

SEQ ID NO: 2844911 - RNA, 14 nt, Mycobacterium avium subsp. paratuberculosis
gccaugggcaucgu

SEQ ID NO: 2844912 - RNA, 18 nt, Mycobacterium avium subsp. paratuberculosis
gccaugggguugaccuug

SEQ ID NO: 2844913 - RNA, 20 nt, Mycobacterium avium subsp. paratuberculosis
gccaugggguugaccuugac

SEQ ID NO: 2844914 - RNA, 19 nt, Mycobacterium avium subsp. paratuberculosis
gccaugggucucggcgagg

SEQ ID NO: 2844915 - RNA, 22 nt, Mycobacterium avium subsp. paratuberculosis
gccauguacggauugcggacgc

SEQ ID NO: 2844916 - RNA, 16 nt, Mycobacterium avium subsp. paratuberculosis
gccauguccccgacca

SEQ ID NO: 2844917 - RNA, 16 nt, Mycobacterium avium subsp. paratuberculosis
gccauguccccgccgg

SEQ ID NO: 2844918 - RNA, 19 nt, Mycobacterium avium subsp. paratuberculosis
gccauguccccgccggugg

SEQ ID NO: 2844919 - RNA, 21 nt, Mycobacterium avium subsp. paratuberculosis
gccauguccccgccgguggcg

SEQ ID NO: 2844920 - RNA, 14 nt, Mycobacterium avium subsp. paratuberculosis
gccauguccggcag

SEQ ID NO: 2844921 - RNA, 18 nt, Mycobacterium avium subsp. paratuberculosis
gccauguccggcaggcuc

SEQ ID NO: 2844922 - RNA, 22 nt, Mycobacterium avium subsp. paratuberculosis
gccauguccggcaggcucagca

SEQ ID NO: 2844923 - RNA, 20 nt, Mycobacterium avium subsp. paratuberculosis
gccaugucgaugucgacgcc

SEQ ID NO: 2844924 - RNA, 14 nt, Mycobacterium avium subsp. paratuberculosis
gccaugucggagcu

SEQ ID NO: 2844925 - RNA, 18 nt, Mycobacterium avium subsp. paratuberculosis
gccaugucggagcugcgc

SEQ ID NO: 2844926 - RNA, 15 nt, Mycobacterium avium subsp. paratuberculosis
gccaugugccggcgc

SEQ ID NO: 2844927 - RNA, 19 nt, Mycobacterium avium subsp. paratuberculosis
gccauugucaucaugguga

SEQ ID NO: 2844928 - RNA, 22 nt, Mycobacterium avium subsp. paratuberculosis
gccauugucaucauggugaagg

SEQ ID NO: 2844929 - RNA, 23 nt, Mycobacterium avium subsp. paratuberculosis
gccauuuccguugugccaccgcc

SEQ ID NO: 2844930 - RNA, 21 nt, Mycobacterium avium subsp. paratuberculosis
gcccaacaacucgacguucgg

SEQ ID NO: 2844931 - RNA, 22 nt, Mycobacterium avium subsp. paratuberculosis
gcccaacaacucgacguucggc

SEQ ID NO: 2844932 - RNA, 20 nt, Mycobacterium avium subsp. paratuberculosis
gcccaacagcucgcgggccu

SEQ ID NO: 2844933 - RNA, 19 nt, Mycobacterium avium subsp. paratuberculosis
gcccaaccgcauucggccg

SEQ ID NO: 2844934 - RNA, 22 nt, Mycobacterium avium subsp. paratuberculosis
gcccaaccgcauucggccgcca

SEQ ID NO: 2844935 - RNA, 23 nt, Mycobacterium avium subsp. paratuberculosis
gcccaaccgcauucggccgccac

SEQ ID NO: 2844936 - RNA, 20 nt, Mycobacterium avium subsp. paratuberculosis
gcccaaccggaucggcuagc

SEQ ID NO: 2844937 - RNA, 16 nt, Mycobacterium avium subsp. paratuberculosis
gcccaacgacgucggc

SEQ ID NO: 2844938 - RNA, 19 nt, Mycobacterium avium subsp. paratuberculosis
gcccaacgacgucggcguc

SEQ ID NO: 2844939 - RNA, 20 nt, Mycobacterium avium subsp. paratuberculosis
gcccaacuacccgccgacgc

SEQ ID NO: 2844940 - RNA, 14 nt, Mycobacterium avium subsp. paratuberculosis
gcccaacuggcgac

SEQ ID NO: 2844941 - RNA, 13 nt, Mycobacterium avium subsp. paratuberculosis
gcccaagacccgc

SEQ ID NO: 2844942 - RNA, 23 nt, Mycobacterium avium subsp. paratuberculosis
gcccaagccggccaggcccagcc

SEQ ID NO: 2844943 - RNA, 15 nt, Mycobacterium avium subsp. paratuberculosis
gcccaagugcccgcg

SEQ ID NO: 2844944 - RNA, 17 nt, Mycobacterium avium subsp. paratuberculosis
gcccaauaccguuccgc

SEQ ID NO: 2844945 - RNA, 17 nt, Mycobacterium avium subsp. paratuberculosis
gcccaaugaucugggcc

SEQ ID NO: 2844946 - RNA, 23 nt, Mycobacterium avium subsp. paratuberculosis
gcccaaugcuuuuugcggaccca

SEQ ID NO: 2844947 - RNA, 16 nt, Mycobacterium avium subsp. paratuberculosis
gcccaauucgacugcg

SEQ ID NO: 2844948 - RNA, 19 nt, Mycobacterium avium subsp. paratuberculosis
gcccacaccgacaccggcc

SEQ ID NO: 2844949 - RNA, 20 nt, Mycobacterium avium subsp. paratuberculosis
gcccacaccgacaccggccg

SEQ ID NO: 2844950 - RNA, 21 nt, Mycobacterium avium subsp. paratuberculosis
gcccacaccgacaccggccgg

SEQ ID NO: 2844951 - RNA, 14 nt, Mycobacterium avium subsp. paratuberculosis
gcccacaccggaug

SEQ ID NO: 2844952 - RNA, 22 nt, Mycobacterium avium subsp. paratuberculosis
gcccacaccggauggcugugga

SEQ ID NO: 2844953 - RNA, 18 nt, Mycobacterium avium subsp. paratuberculosis
gcccacacgcgauagacc

SEQ ID NO: 2844954 - RNA, 22 nt, Mycobacterium avium subsp. paratuberculosis
gcccacagcaacgacauccaga

SEQ ID NO: 2844955 - RNA, 21 nt, Mycobacterium avium subsp. paratuberculosis
gcccacagcagccgcaccucg

SEQ ID NO: 2844956 - RNA, 13 nt, Mycobacterium avium subsp. paratuberculosis
gcccacagccagg

SEQ ID NO: 2844957 - RNA, 15 nt, Mycobacterium avium subsp. paratuberculosis
gcccacagcgccagc

SEQ ID NO: 2844958 - RNA, 17 nt, Mycobacterium avium subsp. paratuberculosis
gcccacagcgccagcac

SEQ ID NO: 2844959 - RNA, 19 nt, Mycobacterium avium subsp. paratuberculosis
gcccacagcugacgggccg

SEQ ID NO: 2844960 - RNA, 22 nt, Mycobacterium avium subsp. paratuberculosis
gcccacagcugacgggccggcg

SEQ ID NO: 2844961 - RNA, 22 nt, Mycobacterium avium subsp. paratuberculosis
gcccacaggacguugaggcggc

SEQ ID NO: 2844962 - RNA, 15 nt, Mycobacterium avium subsp. paratuberculosis
gcccacagguccagc

SEQ ID NO: 2844963 - RNA, 20 nt, Mycobacterium avium subsp. paratuberculosis
gcccacagguccagcguccg

SEQ ID NO: 2844964 - RNA, 14 nt, Mycobacterium avium subsp. paratuberculosis
gcccacaguccgcc

SEQ ID NO: 2844965 - RNA, 17 nt, Mycobacterium avium subsp. paratuberculosis
gcccacauacaccggga

SEQ ID NO: 2844966 - RNA, 19 nt, Mycobacterium avium subsp. paratuberculosis
gcccaccaccacgaggacc

SEQ ID NO: 2844967 - RNA, 14 nt, Mycobacterium avium subsp. paratuberculosis
gcccaccaccgccu

SEQ ID NO: 2844968 - RNA, 17 nt, Mycobacterium avium subsp. paratuberculosis
gcccaccaccgccucga

SEQ ID NO: 2844969 - RNA, 19 nt, Mycobacterium avium subsp. paratuberculosis
gcccaccaccgccucgacg

SEQ ID NO: 2844970 - RNA, 22 nt, Mycobacterium avium subsp. paratuberculosis
gcccaccaccgccucgacggug

SEQ ID NO: 2844971 - RNA, 13 nt, Mycobacterium avium subsp. paratuberculosis
gcccaccaccggc

SEQ ID NO: 2844972 - RNA, 18 nt, Mycobacterium avium subsp. paratuberculosis
gcccaccaccggcuuggc

SEQ ID NO: 2844973 - RNA, 20 nt, Mycobacterium avium subsp. paratuberculosis
gcccaccaccggcuuggcca

SEQ ID NO: 2844974 - RNA, 22 nt, Mycobacterium avium subsp. paratuberculosis
gcccaccaccggcuuggccacg

SEQ ID NO: 2844975 - RNA, 17 nt, Mycobacterium avium subsp. paratuberculosis
gcccaccacgaacgcgc

SEQ ID NO: 2844976 - RNA, 19 nt, Mycobacterium avium subsp. paratuberculosis
gcccaccacgaacgcgccg

SEQ ID NO: 2844977 - RNA, 21 nt, Mycobacterium avium subsp. paratuberculosis
gcccaccacgaacgcgccgcc

SEQ ID NO: 2844978 - RNA, 22 nt, Mycobacterium avium subsp. paratuberculosis
gcccaccacgaacgcgccgccg

SEQ ID NO: 2844979 - RNA, 19 nt, Mycobacterium avium subsp. paratuberculosis
gcccaccacgacgacgugg

SEQ ID NO: 2844980 - RNA, 22 nt, Mycobacterium avium subsp. paratuberculosis
gcccaccacgacgacguggugg

SEQ ID NO: 2844981 - RNA, 13 nt, Mycobacterium avium subsp. paratuberculosis
gcccaccagcaca

SEQ ID NO: 2844982 - RNA, 18 nt, Mycobacterium avium subsp. paratuberculosis
gcccaccagcacaccgga

SEQ ID NO: 2844983 - RNA, 19 nt, Mycobacterium avium subsp. paratuberculosis
gcccaccagcacaccggau

SEQ ID NO: 2844984 - RNA, 13 nt, Mycobacterium avium subsp. paratuberculosis
gcccaccagcagg

SEQ ID NO: 2844985 - RNA, 14 nt, Mycobacterium avium subsp. paratuberculosis
gcccaccagcaggu

SEQ ID NO: 2844986 - RNA, 16 nt, Mycobacterium avium subsp. paratuberculosis
gcccaccagcaggucg

SEQ ID NO: 2844987 - RNA, 17 nt, Mycobacterium avium subsp. paratuberculosis
gcccaccagcaggucga

SEQ ID NO: 2844988 - RNA, 20 nt, Mycobacterium avium subsp. paratuberculosis
gcccaccagcaggucgaucu

SEQ ID NO: 2844989 - RNA, 12 nt, Mycobacterium avium subsp. paratuberculosis
gcccaccagcau

SEQ ID NO: 2844990 - RNA, 16 nt, Mycobacterium avium subsp. paratuberculosis
gcccacgacgucuggg

SEQ ID NO: 2844991 - RNA, 23 nt, Mycobacterium avium subsp. paratuberculosis
gcccacgacgucugggccgccga

SEQ ID NO: 2844992 - RNA, 18 nt, Mycobacterium avium subsp. paratuberculosis
gcccacgaucacgucggu

SEQ ID NO: 2844993 - RNA, 15 nt, Mycobacterium avium subsp. paratuberculosis
gcccacgcagccguc

SEQ ID NO: 2844994 - RNA, 16 nt, Mycobacterium avium subsp. paratuberculosis
gcccacgcagccgucg

SEQ ID NO: 2844995 - RNA, 17 nt, Mycobacterium avium subsp. paratuberculosis
gcccacgcagccgucga

SEQ ID NO: 2844996 - RNA, 13 nt, Mycobacterium avium subsp. paratuberculosis
gcccacgccgagg

SEQ ID NO: 2844997 - RNA, 21 nt, Mycobacterium avium subsp. paratuberculosis
gcccacgccgagggugccggc

SEQ ID NO: 2844998 - RNA, 18 nt, Mycobacterium avium subsp. paratuberculosis
gcccacgccgcccaggcc

SEQ ID NO: 2844999 - RNA, 19 nt, Mycobacterium avium subsp. paratuberculosis
gcccacgccgguggggucg

SEQ ID NO: 2845000 - RNA, 15 nt, Mycobacterium avium subsp. paratuberculosis
gcccacgccgucguc

SEQ ID NO: 2845001 - RNA, 17 nt, Mycobacterium avium subsp. paratuberculosis
gcccacgccgucgucgu

SEQ ID NO: 2845002 - RNA, 18 nt, Mycobacterium avium subsp. paratuberculosis
gcccacgcucgacgcguc

SEQ ID NO: 2845003 - RNA, 20 nt, Mycobacterium avium subsp. paratuberculosis
gcccacgcucgacgcgucga

SEQ ID NO: 2845004 - RNA, 22 nt, Mycobacterium avium subsp. paratuberculosis
gcccacgcucgacgcgucgaca

SEQ ID NO: 2845005 - RNA, 13 nt, Mycobacterium avium subsp. paratuberculosis
gcccacggccacc

SEQ ID NO: 2845006 - RNA, 17 nt, Mycobacterium avium subsp. paratuberculosis
gcccacgggucgccgau

SEQ ID NO: 2845007 - RNA, 15 nt, Mycobacterium avium subsp. paratuberculosis
gcccacguaggggcc

SEQ ID NO: 2845008 - RNA, 20 nt, Mycobacterium avium subsp. paratuberculosis
gcccacguaggggcccgggu

SEQ ID NO: 2845009 - RNA, 16 nt, Mycobacterium avium subsp. paratuberculosis
gcccacgucgcgccga

SEQ ID NO: 2845010 - RNA, 18 nt, Mycobacterium avium subsp. paratuberculosis
gcccacgugccaucgcug

SEQ ID NO: 2845011 - RNA, 16 nt, Mycobacterium avium subsp. paratuberculosis
gcccacguucagcgac

SEQ ID NO: 2845012 - RNA, 18 nt, Mycobacterium avium subsp. paratuberculosis
gcccacguugagcacgcc

SEQ ID NO: 2845013 - RNA, 19 nt, Mycobacterium avium subsp. paratuberculosis
gcccacguugagcacgccc

SEQ ID NO: 2845014 - RNA, 16 nt, Mycobacterium avium subsp. paratuberculosis
gcccagaacgacgcgc

SEQ ID NO: 2845015 - RNA, 17 nt, Mycobacterium avium subsp. paratuberculosis
gcccagaacgacgcgcu

SEQ ID NO: 2845016 - RNA, 18 nt, Mycobacterium avium subsp. paratuberculosis
gcccagaacgacgcgcuc

SEQ ID NO: 2845017 - RNA, 20 nt, Mycobacterium avium subsp. paratuberculosis
gcccagaacgacgcgcucag

SEQ ID NO: 2845018 - RNA, 21 nt, Mycobacterium avium subsp. paratuberculosis
gcccagaacgacgcgcucagc

SEQ ID NO: 2845019 - RNA, 14 nt, Mycobacterium avium subsp. paratuberculosis
gcccagaacugggc

SEQ ID NO: 2845020 - RNA, 18 nt, Mycobacterium avium subsp. paratuberculosis
gcccagaacugggccgcc

SEQ ID NO: 2845021 - RNA, 19 nt, Mycobacterium avium subsp. paratuberculosis
gcccagaacugggccgccg

SEQ ID NO: 2845022 - RNA, 20 nt, Mycobacterium avium subsp. paratuberculosis
gcccagaacugggccgccgu

SEQ ID NO: 2845023 - RNA, 21 nt, Mycobacterium avium subsp. paratuberculosis
gcccagaacugggccgccguc

SEQ ID NO: 2845024 - RNA, 22 nt, Mycobacterium avium subsp. paratuberculosis
gcccagaacugggccgccgucg

SEQ ID NO: 2845025 - RNA, 23 nt, Mycobacterium avium subsp. paratuberculosis
gcccagaacugggccgccgucgc

SEQ ID NO: 2845026 - RNA, 24 nt, Mycobacterium avium subsp. paratuberculosis
gcccagaacugggccgccgucgcc

SEQ ID NO: 2845027 - RNA, 16 nt, Mycobacterium avium subsp. paratuberculosis
gcccagaagccccggu

SEQ ID NO: 2845028 - RNA, 17 nt, Mycobacterium avium subsp. paratuberculosis
gcccagacaggccggcc

SEQ ID NO: 2845029 - RNA, 18 nt, Mycobacterium avium subsp. paratuberculosis
gcccagacaggccggccg

SEQ ID NO: 2845030 - RNA, 19 nt, Mycobacterium avium subsp. paratuberculosis
gcccagacaggccggccgc

SEQ ID NO: 2845031 - RNA, 21 nt, Mycobacterium avium subsp. paratuberculosis
gcccagacgaugucgucgccg

SEQ ID NO: 2845032 - RNA, 14 nt, Mycobacterium avium subsp. paratuberculosis
gcccagacgcgggc

SEQ ID NO: 2845033 - RNA, 17 nt, Mycobacterium avium subsp. paratuberculosis
gcccagacgcgggcgcc

SEQ ID NO: 2845034 - RNA, 18 nt, Mycobacterium avium subsp. paratuberculosis
gcccagacgcgggcgccc

SEQ ID NO: 2845035 - RNA, 19 nt, Mycobacterium avium subsp. paratuberculosis
gcccagacgcgggcgccca

SEQ ID NO: 2845036 - RNA, 21 nt, Mycobacterium avium subsp. paratuberculosis
gcccagacgcgggcgcccagc

SEQ ID NO: 2845037 - RNA, 21 nt, Mycobacterium avium subsp. paratuberculosis
gcccagacgguuccaccgguc

SEQ ID NO: 2845038 - RNA, 16 nt, Mycobacterium avium subsp. paratuberculosis
gcccagauacgccgcg

SEQ ID NO: 2845039 - RNA, 18 nt, Mycobacterium avium subsp. paratuberculosis
gcccagauacgccgcgac

SEQ ID NO: 2845040 - RNA, 20 nt, Mycobacterium avium subsp. paratuberculosis
gcccagauacgccgcgacga

SEQ ID NO: 2845041 - RNA, 15 nt, Mycobacterium avium subsp. paratuberculosis
gcccagauagaucgc

SEQ ID NO: 2845042 - RNA, 18 nt, Mycobacterium avium subsp. paratuberculosis
gcccagaucgacgccgac

SEQ ID NO: 2845043 - RNA, 19 nt, Mycobacterium avium subsp. paratuberculosis
gcccagaucgacgccgacc

SEQ ID NO: 2845044 - RNA, 21 nt, Mycobacterium avium subsp. paratuberculosis
gcccagaucgacgccgaccgc

SEQ ID NO: 2845045 - RNA, 23 nt, Mycobacterium avium subsp. paratuberculosis
gcccagaucgacgccgaccgcgg

SEQ ID NO: 2845046 - RNA, 24 nt, Mycobacterium avium subsp. paratuberculosis
gcccagaucgacgccgaccgcggu

SEQ ID NO: 2845047 - RNA, 15 nt, Mycobacterium avium subsp. paratuberculosis
gcccagaucgccgac

SEQ ID NO: 2845048 - RNA, 16 nt, Mycobacterium avium subsp. paratuberculosis
gcccagaucgccgacc

SEQ ID NO: 2845049 - RNA, 17 nt, Mycobacterium avium subsp. paratuberculosis
gcccagaucgccgaccc

SEQ ID NO: 2845050 - RNA, 20 nt, Mycobacterium avium subsp. paratuberculosis
gcccagaucgcgguccacca

SEQ ID NO: 2845051 - RNA, 15 nt, Mycobacterium avium subsp. paratuberculosis
gcccagaucggccag

SEQ ID NO: 2845052 - RNA, 16 nt, Mycobacterium avium subsp. paratuberculosis
gcccagaucggccagc

SEQ ID NO: 2845053 - RNA, 16 nt, Mycobacterium avium subsp. paratuberculosis
gcccagaugccgccgc

SEQ ID NO: 2845054 - RNA, 17 nt, Mycobacterium avium subsp. paratuberculosis
gcccagaugccgccgcc

SEQ ID NO: 2845055 - RNA, 18 nt, Mycobacterium avium subsp. paratuberculosis
gcccagaugccgccgcca

SEQ ID NO: 2845056 - RNA, 17 nt, Mycobacterium avium subsp. paratuberculosis
gcccagauugcggcccu

SEQ ID NO: 2845057 - RNA, 18 nt, Mycobacterium avium subsp. paratuberculosis
gcccagcaaacccagcac

SEQ ID NO: 2845058 - RNA, 19 nt, Mycobacterium avium subsp. paratuberculosis
gcccagcaaacccagcacc

SEQ ID NO: 2845059 - RNA, 20 nt, Mycobacterium avium subsp. paratuberculosis
gcccagcaaacccagcacca

SEQ ID NO: 2845060 - RNA, 11 nt, Mycobacterium avium subsp. paratuberculosis
gcccagcacca

SEQ ID NO: 2845061 - RNA, 14 nt, Mycobacterium avium subsp. paratuberculosis
gcccagcaccacca

SEQ ID NO: 2845062 - RNA, 16 nt, Mycobacterium avium subsp. paratuberculosis
gcccagcaccaccacg

SEQ ID NO: 2845063 - RNA, 17 nt, Mycobacterium avium subsp. paratuberculosis
gcccagcaccaccacgu

SEQ ID NO: 2845064 - RNA, 23 nt, Mycobacterium avium subsp. paratuberculosis
gcccagcaccaccuugucaccga

SEQ ID NO: 2845065 - RNA, 13 nt, Mycobacterium avium subsp. paratuberculosis
gcccagcaccacu

SEQ ID NO: 2845066 - RNA, 22 nt, Mycobacterium avium subsp. paratuberculosis
gcccagcaccacuuccagcacc

SEQ ID NO: 2845067 - RNA, 13 nt, Mycobacterium avium subsp. paratuberculosis
gcccagcacccgc

SEQ ID NO: 2845068 - RNA, 14 nt, Mycobacterium avium subsp. paratuberculosis
gcccagcacccgcu

SEQ ID NO: 2845069 - RNA, 17 nt, Mycobacterium avium subsp. paratuberculosis
gcccagcacccgcucgc

SEQ ID NO: 2845070 - RNA, 19 nt, Mycobacterium avium subsp. paratuberculosis
gcccagcacccgcucgccg

SEQ ID NO: 2845071 - RNA, 23 nt, Mycobacterium avium subsp. paratuberculosis
gcccagcacccgcucgccgauga

SEQ ID NO: 2845072 - RNA, 22 nt, Mycobacterium avium subsp. paratuberculosis
gcccagcacccgguuccaccgg

SEQ ID NO: 2845073 - RNA, 12 nt, Mycobacterium avium subsp. paratuberculosis
gcccagcaccgc

SEQ ID NO: 2845074 - RNA, 20 nt, Mycobacterium avium subsp. paratuberculosis
gcccagccggucgccgggcc

SEQ ID NO: 2845075 - RNA, 20 nt, Mycobacterium avium subsp. paratuberculosis
gcccagccggugcgagccgc

SEQ ID NO: 2845076 - RNA, 19 nt, Mycobacterium avium subsp. paratuberculosis
gcccagccgucgcaccgcc

SEQ ID NO: 2845077 - RNA, 21 nt, Mycobacterium avium subsp. paratuberculosis
gcccagcgacucggccaggau

SEQ ID NO: 2845078 - RNA, 14 nt, Mycobacterium avium subsp. paratuberculosis
gcccagcgagcugc

SEQ ID NO: 2845079 - RNA, 16 nt, Mycobacterium avium subsp. paratuberculosis
gcccagcgagcugccg

SEQ ID NO: 2845080 - RNA, 19 nt, Mycobacterium avium subsp. paratuberculosis
gcccagcgagcugccggcg

SEQ ID NO: 2845081 - RNA, 23 nt, Mycobacterium avium subsp. paratuberculosis
gcccagcgagcugccggcggccg

SEQ ID NO: 2845082 - RNA, 16 nt, Mycobacterium avium subsp. paratuberculosis
gcccagcgcagcaucg

SEQ ID NO: 2845083 - RNA, 13 nt, Mycobacterium avium subsp. paratuberculosis
gcccagcgcagcg

SEQ ID NO: 2845084 - RNA, 15 nt, Mycobacterium avium subsp. paratuberculosis
gcccagcgcagcgcc

SEQ ID NO: 2845085 - RNA, 19 nt, Mycobacterium avium subsp. paratuberculosis
gcccagcgcagcgccucgg

SEQ ID NO: 2845086 - RNA, 15 nt, Mycobacterium avium subsp. paratuberculosis
gcccagcgcauccac

SEQ ID NO: 2845087 - RNA, 12 nt, Mycobacterium avium subsp. paratuberculosis
gcccagcgccac

SEQ ID NO: 2845088 - RNA, 22 nt, Mycobacterium avium subsp. paratuberculosis
gcccagcgcccguagccgcggu

SEQ ID NO: 2845089 - RNA, 13 nt, Mycobacterium avium subsp. paratuberculosis
gcccagcgccgcg

SEQ ID NO: 2845090 - RNA, 14 nt, Mycobacterium avium subsp. paratuberculosis
gcccagcgccgcgg

SEQ ID NO: 2845091 - RNA, 13 nt, Mycobacterium avium subsp. paratuberculosis
gcccagcgcgacg

SEQ ID NO: 2845092 - RNA, 16 nt, Mycobacterium avium subsp. paratuberculosis
gcccagcgcgacgucg

SEQ ID NO: 2845093 - RNA, 20 nt, Mycobacterium avium subsp. paratuberculosis
gcccagcgcgaggucgacgg

SEQ ID NO: 2845094 - RNA, 12 nt, Mycobacterium avium subsp. paratuberculosis
gcccagcgcgcg

SEQ ID NO: 2845095 - RNA, 15 nt, Mycobacterium avium subsp. paratuberculosis
gcccagcgcgcgauc

SEQ ID NO: 2845096 - RNA, 20 nt, Mycobacterium avium subsp. paratuberculosis
gcccagcgcgcgaucgccgg

SEQ ID NO: 2845097 - RNA, 22 nt, Mycobacterium avium subsp. paratuberculosis
gcccagcgcgcgaucgccggug

SEQ ID NO: 2845098 - RNA, 23 nt, Mycobacterium avium subsp. paratuberculosis
gcccagcgcgcgaucgccggugc

SEQ ID NO: 2845099 - RNA, 15 nt, Mycobacterium avium subsp. paratuberculosis
gcccagcgcgcggcg

SEQ ID NO: 2845100 - RNA, 14 nt, Mycobacterium avium subsp. paratuberculosis
gcccagcgcgcggu

SEQ ID NO: 2845101 - RNA, 16 nt, Mycobacterium avium subsp. paratuberculosis
gcccagcgcggcgaac

SEQ ID NO: 2845102 - RNA, 22 nt, Mycobacterium avium subsp. paratuberculosis
gcccagcgcggcgaacccgagc

SEQ ID NO: 2845103 - RNA, 14 nt, Mycobacterium avium subsp. paratuberculosis
gcccagcgcggcgg

SEQ ID NO: 2845104 - RNA, 15 nt, Mycobacterium avium subsp. paratuberculosis
gcccagcgcggcggc

SEQ ID NO: 2845105 - RNA, 17 nt, Mycobacterium avium subsp. paratuberculosis
gcccagcgcggcggcca

SEQ ID NO: 2845106 - RNA, 13 nt, Mycobacterium avium subsp. paratuberculosis
gcccagcgcggua

SEQ ID NO: 2845107 - RNA, 13 nt, Mycobacterium avium subsp. paratuberculosis
gcccagcgcgguc

SEQ ID NO: 2845108 - RNA, 17 nt, Mycobacterium avium subsp. paratuberculosis
gcccagcgcggucgcca

SEQ ID NO: 2845109 - RNA, 19 nt, Mycobacterium avium subsp. paratuberculosis
gcccagcgcggucgccacc

SEQ ID NO: 2845110 - RNA, 19 nt, Mycobacterium avium subsp. paratuberculosis
gcccagcgcguugcggccg

SEQ ID NO: 2845111 - RNA, 20 nt, Mycobacterium avium subsp. paratuberculosis
gcccagcgcguugcggccgu

SEQ ID NO: 2845112 - RNA, 21 nt, Mycobacterium avium subsp. paratuberculosis
gcccagcgcguugcggccguc

SEQ ID NO: 2845113 - RNA, 14 nt, Mycobacterium avium subsp. paratuberculosis
gcccagcggcacga

SEQ ID NO: 2845114 - RNA, 17 nt, Mycobacterium avium subsp. paratuberculosis
gcccagcggcacgaagu

SEQ ID NO: 2845115 - RNA, 14 nt, Mycobacterium avium subsp. paratuberculosis
gcccagcggcaugg

SEQ ID NO: 2845116 - RNA, 15 nt, Mycobacterium avium subsp. paratuberculosis
gcccagcggcauggc

SEQ ID NO: 2845117 - RNA, 14 nt, Mycobacterium avium subsp. paratuberculosis
gcccagcggccccg

SEQ ID NO: 2845118 - RNA, 16 nt, Mycobacterium avium subsp. paratuberculosis
gcccagcggccccggc

SEQ ID NO: 2845119 - RNA, 18 nt, Mycobacterium avium subsp. paratuberculosis
gcccagcggccccggcuc

SEQ ID NO: 2845120 - RNA, 14 nt, Mycobacterium avium subsp. paratuberculosis
gcccagcggcgaug

SEQ ID NO: 2845121 - RNA, 23 nt, Mycobacterium avium subsp. paratuberculosis
gcccagcggcuguagcacccggc

SEQ ID NO: 2845122 - RNA, 21 nt, Mycobacterium avium subsp. paratuberculosis
gcccagcggcuugagccggau

SEQ ID NO: 2845123 - RNA, 12 nt, Mycobacterium avium subsp. paratuberculosis
gcccagcggggc

SEQ ID NO: 2845124 - RNA, 12 nt, Mycobacterium avium subsp. paratuberculosis
gcccagcgguga

SEQ ID NO: 2845125 - RNA, 22 nt, Mycobacterium avium subsp. paratuberculosis
gcccagcgucaacucgucggcg

SEQ ID NO: 2845126 - RNA, 16 nt, Mycobacterium avium subsp. paratuberculosis
gcccagcgucucggcg

SEQ ID NO: 2845127 - RNA, 20 nt, Mycobacterium avium subsp. paratuberculosis
gcccagcgucucggcggccg

SEQ ID NO: 2845128 - RNA, 12 nt, Mycobacterium avium subsp. paratuberculosis
gcccagcguggu

SEQ ID NO: 2845129 - RNA, 23 nt, Mycobacterium avium subsp. paratuberculosis
gcccagcguggucacccgcagcc

SEQ ID NO: 2845130 - RNA, 18 nt, Mycobacterium avium subsp. paratuberculosis
gcccagcgugucggcgau

SEQ ID NO: 2845131 - RNA, 19 nt, Mycobacterium avium subsp. paratuberculosis
gcccagcgugucggcgauc

SEQ ID NO: 2845132 - RNA, 21 nt, Mycobacterium avium subsp. paratuberculosis
gcccagcuccaaugcggccga

SEQ ID NO: 2845133 - RNA, 22 nt, Mycobacterium avium subsp. paratuberculosis
gcccagcuccaaugcggccgac

SEQ ID NO: 2845134 - RNA, 22 nt, Mycobacterium avium subsp. paratuberculosis
gcccagcuccacgcguagccga

SEQ ID NO: 2845135 - RNA, 12 nt, Mycobacterium avium subsp. paratuberculosis
gcccagcucggu

SEQ ID NO: 2845136 - RNA, 14 nt, Mycobacterium avium subsp. paratuberculosis
gcccagcucgguga

SEQ ID NO: 2845137 - RNA, 15 nt, Mycobacterium avium subsp. paratuberculosis
gcccagcucggugau

SEQ ID NO: 2845138 - RNA, 22 nt, Mycobacterium avium subsp. paratuberculosis
gcccagcucggugaucugcacc

SEQ ID NO: 2845139 - RNA, 23 nt, Mycobacterium avium subsp. paratuberculosis
gcccagcucggugaucugcacca

SEQ ID NO: 2845140 - RNA, 23 nt, Mycobacterium avium subsp. paratuberculosis
gcccagcucggugaugaucgccg

SEQ ID NO: 2845141 - RNA, 23 nt, Mycobacterium avium subsp. paratuberculosis
gcccagcucggugcgcauggcgu

SEQ ID NO: 2845142 - RNA, 20 nt, Mycobacterium avium subsp. paratuberculosis
gcccagcucguugccggcgg

SEQ ID NO: 2845143 - RNA, 21 nt, Mycobacterium avium subsp. paratuberculosis
gcccagcucguugccggcggc

SEQ ID NO: 2845144 - RNA, 24 nt, Mycobacterium avium subsp. paratuberculosis
gcccagcucguugccggcggccag

SEQ ID NO: 2845145 - RNA, 19 nt, Mycobacterium avium subsp. paratuberculosis
gcccagcugcacccaccgg

SEQ ID NO: 2845146 - RNA, 17 nt, Mycobacterium avium subsp. paratuberculosis
gcccagcugcgcggagc

SEQ ID NO: 2845147 - RNA, 18 nt, Mycobacterium avium subsp. paratuberculosis
gcccagcugcucgagcau

SEQ ID NO: 2845148 - RNA, 13 nt, Mycobacterium avium subsp. paratuberculosis
gcccagcugcugg

SEQ ID NO: 2845149 - RNA, 14 nt, Mycobacterium avium subsp. paratuberculosis
gcccagcugggcca

SEQ ID NO: 2845150 - RNA, 15 nt, Mycobacterium avium subsp. paratuberculosis
gcccagcugggccag

SEQ ID NO: 2845151 - RNA, 16 nt, Mycobacterium avium subsp. paratuberculosis
gcccagcugggccagc

SEQ ID NO: 2845152 - RNA, 17 nt, Mycobacterium avium subsp. paratuberculosis
gcccagcugggccagcg

SEQ ID NO: 2845153 - RNA, 19 nt, Mycobacterium avium subsp. paratuberculosis
gcccagcugggccagcgcg

SEQ ID NO: 2845154 - RNA, 20 nt, Mycobacterium avium subsp. paratuberculosis
gcccagcugggccagcgcgg

SEQ ID NO: 2845155 - RNA, 16 nt, Mycobacterium avium subsp. paratuberculosis
gcccaggaacgcgccg

SEQ ID NO: 2845156 - RNA, 17 nt, Mycobacterium avium subsp. paratuberculosis
gcccaggaacgcgccgg

SEQ ID NO: 2845157 - RNA, 18 nt, Mycobacterium avium subsp. paratuberculosis
gcccaggaaguagccggc

SEQ ID NO: 2845158 - RNA, 21 nt, Mycobacterium avium subsp. paratuberculosis
gcccaggaaguagccggccag

SEQ ID NO: 2845159 - RNA, 13 nt, Mycobacterium avium subsp. paratuberculosis
gcccaucgacccg

SEQ ID NO: 2845160 - RNA, 13 nt, Mycobacterium avium subsp. paratuberculosis
gcccaucgccacg

SEQ ID NO: 2845161 - RNA, 15 nt, Mycobacterium avium subsp. paratuberculosis
gcccaucgccacgcc

SEQ ID NO: 2845162 - RNA, 16 nt, Mycobacterium avium subsp. paratuberculosis
gcccaucgccacgccg

SEQ ID NO: 2845163 - RNA, 17 nt, Mycobacterium avium subsp. paratuberculosis
gcccaucgccacgccgu

SEQ ID NO: 2845164 - RNA, 21 nt, Mycobacterium avium subsp. paratuberculosis
gcccaucgccacgccguggcc

SEQ ID NO: 2845165 - RNA, 13 nt, Mycobacterium avium subsp. paratuberculosis
gcccaucgcggcc

SEQ ID NO: 2845166 - RNA, 16 nt, Mycobacterium avium subsp. paratuberculosis
gcccaucgcggccgcc

SEQ ID NO: 2845167 - RNA, 16 nt, Mycobacterium avium subsp. paratuberculosis
gcccaucgcggucagc

SEQ ID NO: 2845168 - RNA, 17 nt, Mycobacterium avium subsp. paratuberculosis
gcccaucggcagcccgg

SEQ ID NO: 2845169 - RNA, 23 nt, Mycobacterium avium subsp. paratuberculosis
gcccaucugcacagcuucggcgc

SEQ ID NO: 2845170 - RNA, 17 nt, Mycobacterium avium subsp. paratuberculosis
gcccaugaacgcgucgc

SEQ ID NO: 2845171 - RNA, 20 nt, Mycobacterium avium subsp. paratuberculosis
gcccaugaacgcgucgccgu

SEQ ID NO: 2845172 - RNA, 22 nt, Mycobacterium avium subsp. paratuberculosis
gcccaugcccaugucgaucggc

SEQ ID NO: 2845173 - RNA, 15 nt, Mycobacterium avium subsp. paratuberculosis
gcccaugccgaugcc

SEQ ID NO: 2845174 - RNA, 13 nt, Mycobacterium avium subsp. paratuberculosis
gcccaugccgcca

SEQ ID NO: 2845175 - RNA, 23 nt, Mycobacterium avium subsp. paratuberculosis
gcccauguccagguacgcgacgg

SEQ ID NO: 2845176 - RNA, 20 nt, Mycobacterium avium subsp. paratuberculosis
gcccaugucgaucggcucgg

SEQ ID NO: 2845177 - RNA, 21 nt, Mycobacterium avium subsp. paratuberculosis
gcccaugucgaucggcucggc

SEQ ID NO: 2845178 - RNA, 23 nt, Mycobacterium avium subsp. paratuberculosis
gcccaugucgaucggcucggcgc

SEQ ID NO: 2845179 - RNA, 15 nt, Mycobacterium avium subsp. paratuberculosis
gcccaugucgccggu

SEQ ID NO: 2845180 - RNA, 16 nt, Mycobacterium avium subsp. paratuberculosis
gcccaugucgccggug

SEQ ID NO: 2845181 - RNA, 19 nt, Mycobacterium avium subsp. paratuberculosis
gccccaacggugaucgaca

SEQ ID NO: 2845182 - RNA, 19 nt, Mycobacterium avium subsp. paratuberculosis
gccccacacgaugcgcggu

SEQ ID NO: 2845183 - RNA, 20 nt, Mycobacterium avium subsp. paratuberculosis
gccccacacgaugcgcggua

SEQ ID NO: 2845184 - RNA, 16 nt, Mycobacterium avium subsp. paratuberculosis
gccccacacgcucggc

SEQ ID NO: 2845185 - RNA, 18 nt, Mycobacterium avium subsp. paratuberculosis
gccccacacgcucggcgc

SEQ ID NO: 2845186 - RNA, 21 nt, Mycobacterium avium subsp. paratuberculosis
gccccacacgcucggcgcgcg

SEQ ID NO: 2845187 - RNA, 14 nt, Mycobacterium avium subsp. paratuberculosis
gccccaccaccgcc

SEQ ID NO: 2845188 - RNA, 20 nt, Mycobacterium avium subsp. paratuberculosis
gccccaccaccgccaccagc

SEQ ID NO: 2845189 - RNA, 23 nt, Mycobacterium avium subsp. paratuberculosis
gccccaccaccgccaccagcgca

SEQ ID NO: 2845190 - RNA, 15 nt, Mycobacterium avium subsp. paratuberculosis
gccccaccaccgccg

SEQ ID NO: 2845191 - RNA, 17 nt, Mycobacterium avium subsp. paratuberculosis
gccccaccaccgccggc

SEQ ID NO: 2845192 - RNA, 18 nt, Mycobacterium avium subsp. paratuberculosis
gccccaccaccgccggcc

SEQ ID NO: 2845193 - RNA, 19 nt, Mycobacterium avium subsp. paratuberculosis
gccccaccaccgccggccc

SEQ ID NO: 2845194 - RNA, 21 nt, Mycobacterium avium subsp. paratuberculosis
gccccaccaccgccggcccag

SEQ ID NO: 2845195 - RNA, 23 nt, Mycobacterium avium subsp. paratuberculosis
gccccaccaccgccggcccaggc

SEQ ID NO: 2845196 - RNA, 13 nt, Mycobacterium avium subsp. paratuberculosis
gccccaccccgga

SEQ ID NO: 2845197 - RNA, 20 nt, Mycobacterium avium subsp. paratuberculosis
gccccaccgccgcugcgcgc

SEQ ID NO: 2845198 - RNA, 12 nt, Mycobacterium avium subsp. paratuberculosis
gccccacgccag

SEQ ID NO: 2845199 - RNA, 21 nt, Mycobacterium avium subsp. paratuberculosis
gccccacgccagucauggcag

SEQ ID NO: 2845200 - RNA, 21 nt, Mycobacterium avium subsp. paratuberculosis
gccccacgccaugugccggcg

SEQ ID NO: 2845201 - RNA, 15 nt, Mycobacterium avium subsp. paratuberculosis
gccccacgccuggcg

SEQ ID NO: 2845202 - RNA, 16 nt, Mycobacterium avium subsp. paratuberculosis
gccccacgccuggcgg

SEQ ID NO: 2845203 - RNA, 21 nt, Mycobacterium avium subsp. paratuberculosis
gccccacgcgcucagcgcggc

SEQ ID NO: 2845204 - RNA, 22 nt, Mycobacterium avium subsp. paratuberculosis
gccccacgcgcucagcgcggcc

SEQ ID NO: 2845205 - RNA, 23 nt, Mycobacterium avium subsp. paratuberculosis
gccccacgcgcucagcgcggcca

SEQ ID NO: 2845206 - RNA, 13 nt, Mycobacterium avium subsp. paratuberculosis
gccccacggcccg

SEQ ID NO: 2845207 - RNA, 14 nt, Mycobacterium avium subsp. paratuberculosis
gccccacggcgcgu

SEQ ID NO: 2845208 - RNA, 15 nt, Mycobacterium avium subsp. paratuberculosis
gccccacggcgcgug

SEQ ID NO: 2845209 - RNA, 21 nt, Mycobacterium avium subsp. paratuberculosis
gccccacggucuuugccggcc

SEQ ID NO: 2845210 - RNA, 22 nt, Mycobacterium avium subsp. paratuberculosis
gccccagaaccgcucggcggcg

SEQ ID NO: 2845211 - RNA, 17 nt, Mycobacterium avium subsp. paratuberculosis
gccccagacgaaguaga

SEQ ID NO: 2845212 - RNA, 24 nt, Mycobacterium avium subsp. paratuberculosis
gccccagacgauuugggcgguccg

SEQ ID NO: 2845213 - RNA, 14 nt, Mycobacterium avium subsp. paratuberculosis
gccccagacguuuc

SEQ ID NO: 2845214 - RNA, 22 nt, Mycobacterium avium subsp. paratuberculosis
gccccagacguuuccguccggc

SEQ ID NO: 2845215 - RNA, 23 nt, Mycobacterium avium subsp. paratuberculosis
gccccagacguuuccguccggcg

SEQ ID NO: 2845216 - RNA, 21 nt, Mycobacterium avium subsp. paratuberculosis
gccccagcacgaucccgccgc

SEQ ID NO: 2845217 - RNA, 14 nt, Mycobacterium avium subsp. paratuberculosis
gccccagccacagc

SEQ ID NO: 2845218 - RNA, 12 nt, Mycobacterium avium subsp. paratuberculosis
gccccagccacc

SEQ ID NO: 2845219 - RNA, 14 nt, Mycobacterium avium subsp. paratuberculosis
gccccagccaccgu

SEQ ID NO: 2845220 - RNA, 23 nt, Mycobacterium avium subsp. paratuberculosis
gccccagccaccguggccccacg

SEQ ID NO: 2845221 - RNA, 17 nt, Mycobacterium avium subsp. paratuberculosis
gccccagccccucgccg

SEQ ID NO: 2845222 - RNA, 20 nt, Mycobacterium avium subsp. paratuberculosis
gccccagccccucgccgggc

SEQ ID NO: 2845223 - RNA, 17 nt, Mycobacterium avium subsp. paratuberculosis
gccccagcccggcuggc

SEQ ID NO: 2845224 - RNA, 18 nt, Mycobacterium avium subsp. paratuberculosis
gccccagcccggcuggca

SEQ ID NO: 2845225 - RNA, 13 nt, Mycobacterium avium subsp. paratuberculosis
gccccagcccggg

SEQ ID NO: 2845226 - RNA, 14 nt, Mycobacterium avium subsp. paratuberculosis
gccccagccgacca

SEQ ID NO: 2845227 - RNA, 16 nt, Mycobacterium avium subsp. paratuberculosis
gccccagccgaccagu

SEQ ID NO: 2845228 - RNA, 18 nt, Mycobacterium avium subsp. paratuberculosis
gccccagccgaccaguuc

SEQ ID NO: 2845229 - RNA, 15 nt, Mycobacterium avium subsp. paratuberculosis
gccccagccgccgcg

SEQ ID NO: 2845230 - RNA, 16 nt, Mycobacterium avium subsp. paratuberculosis
gccccagccgccgcga

SEQ ID NO: 2845231 - RNA, 12 nt, Mycobacterium avium subsp. paratuberculosis
gccccagcgagc

SEQ ID NO: 2845232 - RNA, 20 nt, Mycobacterium avium subsp. paratuberculosis
gccccagcgagcaggucacc

SEQ ID NO: 2845233 - RNA, 13 nt, Mycobacterium avium subsp. paratuberculosis
gccccagcuccuc

SEQ ID NO: 2845234 - RNA, 16 nt, Mycobacterium avium subsp. paratuberculosis
gccccagcuccucggc

SEQ ID NO: 2845235 - RNA, 20 nt, Mycobacterium avium subsp. paratuberculosis
gccccagcuccucggcccca

SEQ ID NO: 2845236 - RNA, 14 nt, Mycobacterium avium subsp. paratuberculosis
gccccaggcccggu

SEQ ID NO: 2845237 - RNA, 21 nt, Mycobacterium avium subsp. paratuberculosis
gccccaggcccgguugagugc

SEQ ID NO: 2845238 - RNA, 23 nt, Mycobacterium avium subsp. paratuberculosis
gccccaggcgaacauggcggcca

SEQ ID NO: 2845239 - RNA, 24 nt, Mycobacterium avium subsp. paratuberculosis
gccccaggcgaacauggcggccag

SEQ ID NO: 2845240 - RNA, 14 nt, Mycobacterium avium subsp. paratuberculosis
gccccaggcgcccu

SEQ ID NO: 2845241 - RNA, 18 nt, Mycobacterium avium subsp. paratuberculosis
gccccaggcgcccugcac

SEQ ID NO: 2845242 - RNA, 15 nt, Mycobacterium avium subsp. paratuberculosis
gccccagggaccagu

SEQ ID NO: 2845243 - RNA, 18 nt, Mycobacterium avium subsp. paratuberculosis
gccccgacgaucgcgccg

SEQ ID NO: 2845244 - RNA, 19 nt, Mycobacterium avium subsp. paratuberculosis
gccccgacgugcagcgcca

SEQ ID NO: 2845245 - RNA, 20 nt, Mycobacterium avium subsp. paratuberculosis
gccccgacgugcagcgccag

SEQ ID NO: 2845246 - RNA, 21 nt, Mycobacterium avium subsp. paratuberculosis
gccccgacgugcagcgccagc

SEQ ID NO: 2845247 - RNA, 15 nt, Mycobacterium avium subsp. paratuberculosis
gccccgagaucccag

SEQ ID NO: 2845248 - RNA, 18 nt, Mycobacterium avium subsp. paratuberculosis
gccccgagaucccagcgg

SEQ ID NO: 2845249 - RNA, 21 nt, Mycobacterium avium subsp. paratuberculosis
gccccgagcagcgggucgucg

SEQ ID NO: 2845250 - RNA, 15 nt, Mycobacterium avium subsp. paratuberculosis
gccccgagccgacga

SEQ ID NO: 2845251 - RNA, 12 nt, Mycobacterium avium subsp. paratuberculosis
gccccgagccgc

SEQ ID NO: 2845252 - RNA, 20 nt, Mycobacterium avium subsp. paratuberculosis
gccccgagcgucacgccagc

SEQ ID NO: 2845253 - RNA, 21 nt, Mycobacterium avium subsp. paratuberculosis
gccccgagcgucacgccagcg

SEQ ID NO: 2845254 - RNA, 22 nt, Mycobacterium avium subsp. paratuberculosis
gccccgagcgucacgccagcgu

SEQ ID NO: 2845255 - RNA, 18 nt, Mycobacterium avium subsp. paratuberculosis
gccccgaguccacgacgu

SEQ ID NO: 2845256 - RNA, 19 nt, Mycobacterium avium subsp. paratuberculosis
gccccgaguccacgacguc

SEQ ID NO: 2845257 - RNA, 17 nt, Mycobacterium avium subsp. paratuberculosis
gccccgaguuccagcuc

SEQ ID NO: 2845258 - RNA, 19 nt, Mycobacterium avium subsp. paratuberculosis
gccccgaguuccagcuccg

SEQ ID NO: 2845259 - RNA, 18 nt, Mycobacterium avium subsp. paratuberculosis
gccccgaucggauccgcc

SEQ ID NO: 2845260 - RNA, 16 nt, Mycobacterium avium subsp. paratuberculosis
gccccgcaccgagccu

SEQ ID NO: 2845261 - RNA, 17 nt, Mycobacterium avium subsp. paratuberculosis
gccccgcaccgagccug

SEQ ID NO: 2845262 - RNA, 18 nt, Mycobacterium avium subsp. paratuberculosis
gccccgcaccgagccugg

SEQ ID NO: 2845263 - RNA, 14 nt, Mycobacterium avium subsp. paratuberculosis
gccccgcaccgcca

SEQ ID NO: 2845264 - RNA, 15 nt, Mycobacterium avium subsp. paratuberculosis
gccccgcaccgccag

SEQ ID NO: 2845265 - RNA, 21 nt, Mycobacterium avium subsp. paratuberculosis
gccccgcagugaaauucgcgc

SEQ ID NO: 2845266 - RNA, 22 nt, Mycobacterium avium subsp. paratuberculosis
gccccgcagugaaauucgcgcc

SEQ ID NO: 2845267 - RNA, 20 nt, Mycobacterium avium subsp. paratuberculosis
gccccgccagauagggcagc

SEQ ID NO: 2845268 - RNA, 22 nt, Mycobacterium avium subsp. paratuberculosis
gccccgccagcagaugccgccc

SEQ ID NO: 2845269 - RNA, 23 nt, Mycobacterium avium subsp. paratuberculosis
gccccgccagcagaugccgccca

SEQ ID NO: 2845270 - RNA, 14 nt, Mycobacterium avium subsp. paratuberculosis
gccccgccaggcgg

SEQ ID NO: 2845271 - RNA, 15 nt, Mycobacterium avium subsp. paratuberculosis
gccccgccaggcggc

SEQ ID NO: 2845272 - RNA, 18 nt, Mycobacterium avium subsp. paratuberculosis
gccccgccaggcggcgac

SEQ ID NO: 2845273 - RNA, 19 nt, Mycobacterium avium subsp. paratuberculosis
gccccgccaggcggcgacg

SEQ ID NO: 2845274 - RNA, 23 nt, Mycobacterium avium subsp. paratuberculosis
gccccgcccgaucccgucgucgg

SEQ ID NO: 2845275 - RNA, 19 nt, Mycobacterium avium subsp. paratuberculosis
gccccgcccgcgacugucg

SEQ ID NO: 2845276 - RNA, 14 nt, Mycobacterium avium subsp. paratuberculosis
gccccgcccggcgc

SEQ ID NO: 2845277 - RNA, 17 nt, Mycobacterium avium subsp. paratuberculosis
gccccgcccggcgcgca

SEQ ID NO: 2845278 - RNA, 18 nt, Mycobacterium avium subsp. paratuberculosis
gccccgcccggcgcgcag

SEQ ID NO: 2845279 - RNA, 19 nt, Mycobacterium avium subsp. paratuberculosis
gccccgcccggcgcgcagc

SEQ ID NO: 2845280 - RNA, 15 nt, Mycobacterium avium subsp. paratuberculosis
gccccgcccggcggc

SEQ ID NO: 2845281 - RNA, 16 nt, Mycobacterium avium subsp. paratuberculosis
gccccgcccggggcgg

SEQ ID NO: 2845282 - RNA, 22 nt, Mycobacterium avium subsp. paratuberculosis
gccccgcccuugaacggcacca

SEQ ID NO: 2845283 - RNA, 23 nt, Mycobacterium avium subsp. paratuberculosis
gccccgcccuugaacggcaccag

SEQ ID NO: 2845284 - RNA, 18 nt, Mycobacterium avium subsp. paratuberculosis
gccccgccgcgccgggcg

SEQ ID NO: 2845285 - RNA, 12 nt, Mycobacterium avium subsp. paratuberculosis
gccccgccgcgg

SEQ ID NO: 2845286 - RNA, 13 nt, Mycobacterium avium subsp. paratuberculosis
gccccgccgcggc

SEQ ID NO: 2845287 - RNA, 15 nt, Mycobacterium avium subsp. paratuberculosis
gccccgccgcggcca

SEQ ID NO: 2845288 - RNA, 18 nt, Mycobacterium avium subsp. paratuberculosis
gccccgccgcggccaggu

SEQ ID NO: 2845289 - RNA, 15 nt, Mycobacterium avium subsp. paratuberculosis
gccccgccggugucg

SEQ ID NO: 2845290 - RNA, 20 nt, Mycobacterium avium subsp. paratuberculosis
gccccgccggugucggcgac

SEQ ID NO: 2845291 - RNA, 21 nt, Mycobacterium avium subsp. paratuberculosis
gccccgccguuucagcagcgc

SEQ ID NO: 2845292 - RNA, 22 nt, Mycobacterium avium subsp. paratuberculosis
gccccgcgacacgccgcgcauc

SEQ ID NO: 2845293 - RNA, 12 nt, Mycobacterium avium subsp. paratuberculosis
gccccgcgaccg

SEQ ID NO: 2845294 - RNA, 14 nt, Mycobacterium avium subsp. paratuberculosis
gccccgcgaccgca

SEQ ID NO: 2845295 - RNA, 15 nt, Mycobacterium avium subsp. paratuberculosis
gccccgcgaccgcag

SEQ ID NO: 2845296 - RNA, 16 nt, Mycobacterium avium subsp. paratuberculosis
gccccgcgaccgcagc

SEQ ID NO: 2845297 - RNA, 18 nt, Mycobacterium avium subsp. paratuberculosis
gccccgcgaccgcagcag

SEQ ID NO: 2845298 - RNA, 20 nt, Mycobacterium avium subsp. paratuberculosis
gccccgcgaccgcagcaggc

SEQ ID NO: 2845299 - RNA, 22 nt, Mycobacterium avium subsp. paratuberculosis
gccccgcgaccgcagcaggcgg

SEQ ID NO: 2845300 - RNA, 21 nt, Mycobacterium avium subsp. paratuberculosis
gccccgcgcgaucaggccggc

SEQ ID NO: 2845301 - RNA, 23 nt, Mycobacterium avium subsp. paratuberculosis
gccccgcgcgaucaggccggcca

SEQ ID NO: 2845302 - RNA, 15 nt, Mycobacterium avium subsp. paratuberculosis
gccccgcgugacggc

SEQ ID NO: 2845303 - RNA, 22 nt, Mycobacterium avium subsp. paratuberculosis
gccccgcgugacggccgcggcg

SEQ ID NO: 2845304 - RNA, 15 nt, Mycobacterium avium subsp. paratuberculosis
gccccgcuccuccuc

SEQ ID NO: 2845305 - RNA, 16 nt, Mycobacterium avium subsp. paratuberculosis
gccccgcuccuccucg

SEQ ID NO: 2845306 - RNA, 20 nt, Mycobacterium avium subsp. paratuberculosis
gccccgcuccuccucgcgcc

SEQ ID NO: 2845307 - RNA, 21 nt, Mycobacterium avium subsp. paratuberculosis
gccccgcuccuccucgcgccg

SEQ ID NO: 2845308 - RNA, 22 nt, Mycobacterium avium subsp. paratuberculosis
gccccgcuccuccucgcgccgc

SEQ ID NO: 2845309 - RNA, 23 nt, Mycobacterium avium subsp. paratuberculosis
gccccgcuccuccucgcgccgcc

SEQ ID NO: 2845310 - RNA, 22 nt, Mycobacterium avium subsp. paratuberculosis
gccccgcugccggaccucgacc

SEQ ID NO: 2845311 - RNA, 15 nt, Mycobacterium avium subsp. paratuberculosis
gccccgcugccgucc

SEQ ID NO: 2845312 - RNA, 19 nt, Mycobacterium avium subsp. paratuberculosis
gccccgcugccguccggcg

SEQ ID NO: 2845313 - RNA, 21 nt, Mycobacterium avium subsp. paratuberculosis
gccccgcugccguccggcggc

SEQ ID NO: 2845314 - RNA, 14 nt, Mycobacterium avium subsp. paratuberculosis
gccccggaccggag

SEQ ID NO: 2845315 - RNA, 14 nt, Mycobacterium avium subsp. paratuberculosis
gccccggagauggu

SEQ ID NO: 2845316 - RNA, 16 nt, Mycobacterium avium subsp. paratuberculosis
gccccggauccgucgc

SEQ ID NO: 2845317 - RNA, 21 nt, Mycobacterium avium subsp. paratuberculosis
gccccggauccgucgccccgc

SEQ ID NO: 2845318 - RNA, 23 nt, Mycobacterium avium subsp. paratuberculosis
gccccggauccgucgccccgcac

SEQ ID NO: 2845319 - RNA, 16 nt, Mycobacterium avium subsp. paratuberculosis
gccccggcaucgacau

SEQ ID NO: 2845320 - RNA, 22 nt, Mycobacterium avium subsp. paratuberculosis
gccccggcaucgacaugcccgg

SEQ ID NO: 2845321 - RNA, 23 nt, Mycobacterium avium subsp. paratuberculosis
gccccggcaucgacaugcccggc

SEQ ID NO: 2845322 - RNA, 14 nt, Mycobacterium avium subsp. paratuberculosis
gccccggcccggcg

SEQ ID NO: 2845323 - RNA, 13 nt, Mycobacterium avium subsp. paratuberculosis
gccccggcccguc

SEQ ID NO: 2845324 - RNA, 14 nt, Mycobacterium avium subsp. paratuberculosis
gccccggcccgucc

SEQ ID NO: 2845325 - RNA, 17 nt, Mycobacterium avium subsp. paratuberculosis
gccccggccgagccggc

SEQ ID NO: 2845326 - RNA, 19 nt, Mycobacterium avium subsp. paratuberculosis
gccccggccgagccggcgu

SEQ ID NO: 2845327 - RNA, 19 nt, Mycobacterium avium subsp. paratuberculosis
gccccuucgaugucgccgg

SEQ ID NO: 2845328 - RNA, 22 nt, Mycobacterium avium subsp. paratuberculosis
gccccuucgaugucgccggcga

SEQ ID NO: 2845329 - RNA, 21 nt, Mycobacterium avium subsp. paratuberculosis
gcccgaaaaauaggugaccuc

SEQ ID NO: 2845330 - RNA, 20 nt, Mycobacterium avium subsp. paratuberculosis
gcccgaaaacgcccggguga

SEQ ID NO: 2845331 - RNA, 16 nt, Mycobacterium avium subsp. paratuberculosis
gcccgaaaguccccgg

SEQ ID NO: 2845332 - RNA, 18 nt, Mycobacterium avium subsp. paratuberculosis
gcccgaacaccuccucgg

SEQ ID NO: 2845333 - RNA, 16 nt, Mycobacterium avium subsp. paratuberculosis
gcccgaacacgggcgg

SEQ ID NO: 2845334 - RNA, 14 nt, Mycobacterium avium subsp. paratuberculosis
gcccgaacagccgg

SEQ ID NO: 2845335 - RNA, 17 nt, Mycobacterium avium subsp. paratuberculosis
gcccgaacagccgggcc

SEQ ID NO: 2845336 - RNA, 21 nt, Mycobacterium avium subsp. paratuberculosis
gcccgaacagccgggccagca

SEQ ID NO: 2845337 - RNA, 23 nt, Mycobacterium avium subsp. paratuberculosis
gcccgaacaucgccucggccgcg

SEQ ID NO: 2845338 - RNA, 17 nt, Mycobacterium avium subsp. paratuberculosis
gcccgaacgcgcgucgg

SEQ ID NO: 2845339 - RNA, 23 nt, Mycobacterium avium subsp. paratuberculosis
gcccgaacucauggcgugcucgg

SEQ ID NO: 2845340 - RNA, 23 nt, Mycobacterium avium subsp. paratuberculosis
gcccgaagcugagguggccuccc

SEQ ID NO: 2845341 - RNA, 17 nt, Mycobacterium avium subsp. paratuberculosis
gcccgaauugcgcugca

SEQ ID NO: 2845342 - RNA, 17 nt, Mycobacterium avium subsp. paratuberculosis
gcccgacaccgccccgc

SEQ ID NO: 2845343 - RNA, 20 nt, Mycobacterium avium subsp. paratuberculosis
gcccgacaccgccccgccgc

SEQ ID NO: 2845344 - RNA, 13 nt, Mycobacterium avium subsp. paratuberculosis
gcccgacauccag

SEQ ID NO: 2845345 - RNA, 20 nt, Mycobacterium avium subsp. paratuberculosis
gcccgacauccaggaccgcg

SEQ ID NO: 2845346 - RNA, 21 nt, Mycobacterium avium subsp. paratuberculosis
gcccgacauccaggaccgcgc

SEQ ID NO: 2845347 - RNA, 24 nt, Mycobacterium avium subsp. paratuberculosis
gcccgacauccaggaccgcgcgcc

SEQ ID NO: 2845348 - RNA, 19 nt, Mycobacterium avium subsp. paratuberculosis
gcccgacaucugccgggcg

SEQ ID NO: 2845349 - RNA, 22 nt, Mycobacterium avium subsp. paratuberculosis
gcccgacaucugccgggcggcg

SEQ ID NO: 2845350 - RNA, 23 nt, Mycobacterium avium subsp. paratuberculosis
gcccgacaucugccgggcggcga

SEQ ID NO: 2845351 - RNA, 23 nt, Mycobacterium avium subsp. paratuberculosis
gcccgaccaccuccccgcggugc

SEQ ID NO: 2845352 - RNA, 24 nt, Mycobacterium avium subsp. paratuberculosis
gcccgaccaccuccccgcggugcc

SEQ ID NO: 2845353 - RNA, 13 nt, Mycobacterium avium subsp. paratuberculosis
gcccgaccagcgg

SEQ ID NO: 2845354 - RNA, 15 nt, Mycobacterium avium subsp. paratuberculosis
gcccgaccagcgggc

SEQ ID NO: 2845355 - RNA, 17 nt, Mycobacterium avium subsp. paratuberculosis
gcccgaccagcgggccg

SEQ ID NO: 2845356 - RNA, 15 nt, Mycobacterium avium subsp. paratuberculosis
gcccgacccgcacca

SEQ ID NO: 2845357 - RNA, 13 nt, Mycobacterium avium subsp. paratuberculosis
gcccgacccggcu

SEQ ID NO: 2845358 - RNA, 15 nt, Mycobacterium avium subsp. paratuberculosis
gcccgacccggucag

SEQ ID NO: 2845359 - RNA, 19 nt, Mycobacterium avium subsp. paratuberculosis
gcccgacccggucagcucg

SEQ ID NO: 2845360 - RNA, 13 nt, Mycobacterium avium subsp. paratuberculosis
gcccgaccgcgcc

SEQ ID NO: 2845361 - RNA, 14 nt, Mycobacterium avium subsp. paratuberculosis
gcccgaccgcgccg

SEQ ID NO: 2845362 - RNA, 18 nt, Mycobacterium avium subsp. paratuberculosis
gcccgaccgcgccgaaca

SEQ ID NO: 2845363 - RNA, 14 nt, Mycobacterium avium subsp. paratuberculosis
gcccgacgacgacg

SEQ ID NO: 2845364 - RNA, 19 nt, Mycobacterium avium subsp. paratuberculosis
gcccgacgacgacgucgac

SEQ ID NO: 2845365 - RNA, 20 nt, Mycobacterium avium subsp. paratuberculosis
gcccgacgacgacgucgacg

SEQ ID NO: 2845366 - RNA, 22 nt, Mycobacterium avium subsp. paratuberculosis
gcccgacgacgacgucgacgac

SEQ ID NO: 2845367 - RNA, 13 nt, Mycobacterium avium subsp. paratuberculosis
gcccgacgacgau

SEQ ID NO: 2845368 - RNA, 14 nt, Mycobacterium avium subsp. paratuberculosis
gcccgacgacgccg

SEQ ID NO: 2845369 - RNA, 15 nt, Mycobacterium avium subsp. paratuberculosis
gcccgacgacgccgu

SEQ ID NO: 2845370 - RNA, 21 nt, Mycobacterium avium subsp. paratuberculosis
gcccgacgaugcggggcggcg

SEQ ID NO: 2845371 - RNA, 15 nt, Mycobacterium avium subsp. paratuberculosis
gcccgacgccggacc

SEQ ID NO: 2845372 - RNA, 20 nt, Mycobacterium avium subsp. paratuberculosis
gcccgacgccggaccccaca

SEQ ID NO: 2845373 - RNA, 22 nt, Mycobacterium avium subsp. paratuberculosis
gcccgacggauucccgaacagg

SEQ ID NO: 2845374 - RNA, 16 nt, Mycobacterium avium subsp. paratuberculosis
gcccgacggcagcacc

SEQ ID NO: 2845375 - RNA, 17 nt, Mycobacterium avium subsp. paratuberculosis
gcccgacggcagcaccg

SEQ ID NO: 2845376 - RNA, 21 nt, Mycobacterium avium subsp. paratuberculosis
gcccgacggcagcaccgccga

SEQ ID NO: 2845377 - RNA, 13 nt, Mycobacterium avium subsp. paratuberculosis
gcccgacggcgcg

SEQ ID NO: 2845378 - RNA, 16 nt, Mycobacterium avium subsp. paratuberculosis
gcccgacgggcgugcc

SEQ ID NO: 2845379 - RNA, 20 nt, Mycobacterium avium subsp. paratuberculosis
gcccgacgggcgugccggcg

SEQ ID NO: 2845380 - RNA, 22 nt, Mycobacterium avium subsp. paratuberculosis
gcccgacgggcgugccggcggc

SEQ ID NO: 2845381 - RNA, 19 nt, Mycobacterium avium subsp. paratuberculosis
gcccgacggguucgcgcag

SEQ ID NO: 2845382 - RNA, 20 nt, Mycobacterium avium subsp. paratuberculosis
gcccgacggguucgcgcagc

SEQ ID NO: 2845383 - RNA, 17 nt, Mycobacterium avium subsp. paratuberculosis
gcccgacggucgccacc

SEQ ID NO: 2845384 - RNA, 13 nt, Mycobacterium avium subsp. paratuberculosis
gcccgacuccuca

SEQ ID NO: 2845385 - RNA, 22 nt, Mycobacterium avium subsp. paratuberculosis
gcccgagaguccgccgccgggc

SEQ ID NO: 2845386 - RNA, 17 nt, Mycobacterium avium subsp. paratuberculosis
gcccgagaucaccggcu

SEQ ID NO: 2845387 - RNA, 23 nt, Mycobacterium avium subsp. paratuberculosis
gcccgagaucaccggcuuggcgg

SEQ ID NO: 2845388 - RNA, 14 nt, Mycobacterium avium subsp. paratuberculosis
gcccgagcaccagc

SEQ ID NO: 2845389 - RNA, 15 nt, Mycobacterium avium subsp. paratuberculosis
gcccgagcaccagcg

SEQ ID NO: 2845390 - RNA, 23 nt, Mycobacterium avium subsp. paratuberculosis
gcccgagcaccugaacggccgcg

SEQ ID NO: 2845391 - RNA, 18 nt, Mycobacterium avium subsp. paratuberculosis
gcccgagcacguugugcu

SEQ ID NO: 2845392 - RNA, 12 nt, Mycobacterium avium subsp. paratuberculosis
gcccgagcccga

SEQ ID NO: 2845393 - RNA, 16 nt, Mycobacterium avium subsp. paratuberculosis
gcccgagcccgacggc

SEQ ID NO: 2845394 - RNA, 19 nt, Mycobacterium avium subsp. paratuberculosis
gcccgagcccugcgccagc

SEQ ID NO: 2845395 - RNA, 15 nt, Mycobacterium avium subsp. paratuberculosis
gcccgagcggcauca

SEQ ID NO: 2845396 - RNA, 21 nt, Mycobacterium avium subsp. paratuberculosis
gcccgagcggcgacuccagca

SEQ ID NO: 2845397 - RNA, 22 nt, Mycobacterium avium subsp. paratuberculosis
gcccgagcggcgacuccagcag

SEQ ID NO: 2845398 - RNA, 20 nt, Mycobacterium avium subsp. paratuberculosis
gcccgagcgucacgccagcg

SEQ ID NO: 2845399 - RNA, 21 nt, Mycobacterium avium subsp. paratuberculosis
gcccgagcgucacgccagcgu

SEQ ID NO: 2845400 - RNA, 18 nt, Mycobacterium avium subsp. paratuberculosis
gcccgagcgucauuccgc

SEQ ID NO: 2845401 - RNA, 21 nt, Mycobacterium avium subsp. paratuberculosis
gcccgagcgucauuccgccgc

SEQ ID NO: 2845402 - RNA, 22 nt, Mycobacterium avium subsp. paratuberculosis
gcccgagcgucauuccgccgcg

SEQ ID NO: 2845403 - RNA, 18 nt, Mycobacterium avium subsp. paratuberculosis
gcccgagcugaucgcggc

SEQ ID NO: 2845404 - RNA, 20 nt, Mycobacterium avium subsp. paratuberculosis
gcccgagcugaucgcggccg

SEQ ID NO: 2845405 - RNA, 22 nt, Mycobacterium avium subsp. paratuberculosis
gcccgagcugaucgcggccggc

SEQ ID NO: 2845406 - RNA, 20 nt, Mycobacterium avium subsp. paratuberculosis
gcccgaggucauaucgacgg

SEQ ID NO: 2845407 - RNA, 21 nt, Mycobacterium avium subsp. paratuberculosis
gcccgaggucauaucgacggc

SEQ ID NO: 2845408 - RNA, 23 nt, Mycobacterium avium subsp. paratuberculosis
gcccgaggucauaucgacggccc

SEQ ID NO: 2845409 - RNA, 16 nt, Mycobacterium avium subsp. paratuberculosis
gcccgagguccucgcg

SEQ ID NO: 2845410 - RNA, 19 nt, Mycobacterium avium subsp. paratuberculosis
gcccgagguccucgcgcaa

SEQ ID NO: 2845411 - RNA, 23 nt, Mycobacterium avium subsp. paratuberculosis
gcccgcaguucggccgccgugcu

SEQ ID NO: 2845412 - RNA, 13 nt, Mycobacterium avium subsp. paratuberculosis
gcccgcaucgaau

SEQ ID NO: 2845413 - RNA, 20 nt, Mycobacterium avium subsp. paratuberculosis
gcccgcaucgaauccacgaa

SEQ ID NO: 2845414 - RNA, 14 nt, Mycobacterium avium subsp. paratuberculosis
gcccgcaucgcaca

SEQ ID NO: 2845415 - RNA, 15 nt, Mycobacterium avium subsp. paratuberculosis
gcccgcaucgccgaa

SEQ ID NO: 2845416 - RNA, 19 nt, Mycobacterium avium subsp. paratuberculosis
gcccgcaucgccgaaccgg

SEQ ID NO: 2845417 - RNA, 22 nt, Mycobacterium avium subsp. paratuberculosis
gcccgcaucgccgaaccgggcg

SEQ ID NO: 2845418 - RNA, 16 nt, Mycobacterium avium subsp. paratuberculosis
gcccgcaucgcggcga

SEQ ID NO: 2845419 - RNA, 19 nt, Mycobacterium avium subsp. paratuberculosis
gcccgcaucgcggcgaugg

SEQ ID NO: 2845420 - RNA, 20 nt, Mycobacterium avium subsp. paratuberculosis
gcccgcaucgcggcgauggu

SEQ ID NO: 2845421 - RNA, 14 nt, Mycobacterium avium subsp. paratuberculosis
gcccgcaugcaccg

SEQ ID NO: 2845422 - RNA, 17 nt, Mycobacterium avium subsp. paratuberculosis
gcccgcaugcaccggug

SEQ ID NO: 2845423 - RNA, 19 nt, Mycobacterium avium subsp. paratuberculosis
gcccgccaaaacggggugg

SEQ ID NO: 2845424 - RNA, 11 nt, Mycobacterium avium subsp. paratuberculosis
gcccgccaccc

SEQ ID NO: 2845425 - RNA, 22 nt, Mycobacterium avium subsp. paratuberculosis
gcccgccacccgaggccguuca

SEQ ID NO: 2845426 - RNA, 17 nt, Mycobacterium avium subsp. paratuberculosis
gcccgccacggccagca

SEQ ID NO: 2845427 - RNA, 22 nt, Mycobacterium avium subsp. paratuberculosis
gcccgccacggccagcaccgcc

SEQ ID NO: 2845428 - RNA, 16 nt, Mycobacterium avium subsp. paratuberculosis
gcccgccacgugcggc

SEQ ID NO: 2845429 - RNA, 20 nt, Mycobacterium avium subsp. paratuberculosis
gcccgccacgugcggcugcg

SEQ ID NO: 2845430 - RNA, 15 nt, Mycobacterium avium subsp. paratuberculosis
gcccgccagcauggu

SEQ ID NO: 2845431 - RNA, 22 nt, Mycobacterium avium subsp. paratuberculosis
gcccgccaggaauaacgccggc

SEQ ID NO: 2845432 - RNA, 12 nt, Mycobacterium avium subsp. paratuberculosis
gcccgccaucgc

SEQ ID NO: 2845433 - RNA, 17 nt, Mycobacterium avium subsp. paratuberculosis
gcccgccaucgcccggu

SEQ ID NO: 2845434 - RNA, 20 nt, Mycobacterium avium subsp. paratuberculosis
gcccgccaucgcccggugcg

SEQ ID NO: 2845435 - RNA, 23 nt, Mycobacterium avium subsp. paratuberculosis
gcccgccaucgcccggugcgcca

SEQ ID NO: 2845436 - RNA, 20 nt, Mycobacterium avium subsp. paratuberculosis
gcccgcccacauacaccggg

SEQ ID NO: 2845437 - RNA, 21 nt, Mycobacterium avium subsp. paratuberculosis
gcccgcccacauacaccggga

SEQ ID NO: 2845438 - RNA, 12 nt, Mycobacterium avium subsp. paratuberculosis
gcccgcccacca

SEQ ID NO: 2845439 - RNA, 14 nt, Mycobacterium avium subsp. paratuberculosis
gcccgcccacgggu

SEQ ID NO: 2845440 - RNA, 17 nt, Mycobacterium avium subsp. paratuberculosis
gcccgcccacgggucgc

SEQ ID NO: 2845441 - RNA, 20 nt, Mycobacterium avium subsp. paratuberculosis
gcccgcccacgggucgccga

SEQ ID NO: 2845442 - RNA, 22 nt, Mycobacterium avium subsp. paratuberculosis
gcccgcccacgggucgccgauc

SEQ ID NO: 2845443 - RNA, 17 nt, Mycobacterium avium subsp. paratuberculosis
gcccgcccagcgcagca

SEQ ID NO: 2845444 - RNA, 14 nt, Mycobacterium avium subsp. paratuberculosis
gcccgcccagcgcc

SEQ ID NO: 2845445 - RNA, 23 nt, Mycobacterium avium subsp. paratuberculosis
gcccgcccagcgccacgguggcg

SEQ ID NO: 2845446 - RNA, 14 nt, Mycobacterium avium subsp. paratuberculosis
gcccgcccagcugc

SEQ ID NO: 2845447 - RNA, 12 nt, Mycobacterium avium subsp. paratuberculosis
gcccgcccaggc

SEQ ID NO: 2845448 - RNA, 15 nt, Mycobacterium avium subsp. paratuberculosis
gcccgcccaggccgc

SEQ ID NO: 2845449 - RNA, 16 nt, Mycobacterium avium subsp. paratuberculosis
gcccgcccaggccgcc

SEQ ID NO: 2845450 - RNA, 18 nt, Mycobacterium avium subsp. paratuberculosis
gcccgcccaggccgccag

SEQ ID NO: 2845451 - RNA, 19 nt, Mycobacterium avium subsp. paratuberculosis
gcccgcccaggccgccagc

SEQ ID NO: 2845452 - RNA, 20 nt, Mycobacterium avium subsp. paratuberculosis
gcccgcccaggccgccagcu

SEQ ID NO: 2845453 - RNA, 23 nt, Mycobacterium avium subsp. paratuberculosis
gcccgcccaggccgccagcucgu

SEQ ID NO: 2845454 - RNA, 19 nt, Mycobacterium avium subsp. paratuberculosis
gcccgccccgacgugcagc

SEQ ID NO: 2845455 - RNA, 22 nt, Mycobacterium avium subsp. paratuberculosis
gcccgccccgacgugcagcgcc

SEQ ID NO: 2845456 - RNA, 17 nt, Mycobacterium avium subsp. paratuberculosis
gcccgccccgcccggcg

SEQ ID NO: 2845457 - RNA, 18 nt, Mycobacterium avium subsp. paratuberculosis
gcccgccccgcccggcgg

SEQ ID NO: 2845458 - RNA, 17 nt, Mycobacterium avium subsp. paratuberculosis
gcccgccccugagggug

SEQ ID NO: 2845459 - RNA, 15 nt, Mycobacterium avium subsp. paratuberculosis
gcccgcccgagcguc

SEQ ID NO: 2845460 - RNA, 16 nt, Mycobacterium avium subsp. paratuberculosis
gcccgcccgagcguca

SEQ ID NO: 2845461 - RNA, 20 nt, Mycobacterium avium subsp. paratuberculosis
gcccgcccgagcgucauucc

SEQ ID NO: 2845462 - RNA, 15 nt, Mycobacterium avium subsp. paratuberculosis
gcccgcccgcagcgg

SEQ ID NO: 2845463 - RNA, 19 nt, Mycobacterium avium subsp. paratuberculosis
gcccgcccgcagcggcggu

SEQ ID NO: 2845464 - RNA, 12 nt, Mycobacterium avium subsp. paratuberculosis
gcccgcccggca

SEQ ID NO: 2845465 - RNA, 13 nt, Mycobacterium avium subsp. paratuberculosis
gcccgcccggcac

SEQ ID NO: 2845466 - RNA, 15 nt, Mycobacterium avium subsp. paratuberculosis
gcccgcccggcacga

SEQ ID NO: 2845467 - RNA, 12 nt, Mycobacterium avium subsp. paratuberculosis
gcccgcccggcc

SEQ ID NO: 2845468 - RNA, 13 nt, Mycobacterium avium subsp. paratuberculosis
gcccgcccggccc

SEQ ID NO: 2845469 - RNA, 16 nt, Mycobacterium avium subsp. paratuberculosis
gcccgcccggcccggc

SEQ ID NO: 2845470 - RNA, 18 nt, Mycobacterium avium subsp. paratuberculosis
gcccgcccggcccggcgc

SEQ ID NO: 2845471 - RNA, 20 nt, Mycobacterium avium subsp. paratuberculosis
gcccgcccggcccggcgcgg

SEQ ID NO: 2845472 - RNA, 22 nt, Mycobacterium avium subsp. paratuberculosis
gcccgcccggcccggcgcggcc

SEQ ID NO: 2845473 - RNA, 13 nt, Mycobacterium avium subsp. paratuberculosis
gcccgcccggcgg

SEQ ID NO: 2845474 - RNA, 14 nt, Mycobacterium avium subsp. paratuberculosis
gcccgcccggcggc

SEQ ID NO: 2845475 - RNA, 16 nt, Mycobacterium avium subsp. paratuberculosis
gcccgcccggcggcgc

SEQ ID NO: 2845476 - RNA, 18 nt, Mycobacterium avium subsp. paratuberculosis
gcccgcccggcggcgcug

SEQ ID NO: 2845477 - RNA, 19 nt, Mycobacterium avium subsp. paratuberculosis
gcccgcccuuggccgcgga

SEQ ID NO: 2845478 - RNA, 21 nt, Mycobacterium avium subsp. paratuberculosis
gcccgcccuugucgauccggu

SEQ ID NO: 2845479 - RNA, 17 nt, Mycobacterium avium subsp. paratuberculosis
gcccgccgaacaccggc

SEQ ID NO: 2845480 - RNA, 18 nt, Mycobacterium avium subsp. paratuberculosis
gcccgccgaacaccggca

SEQ ID NO: 2845481 - RNA, 19 nt, Mycobacterium avium subsp. paratuberculosis
gcccgccgaacaccggcag

SEQ ID NO: 2845482 - RNA, 21 nt, Mycobacterium avium subsp. paratuberculosis
gcccgccgaacaccggcagcg

SEQ ID NO: 2845483 - RNA, 13 nt, Mycobacterium avium subsp. paratuberculosis
gcccgccgaacgc

SEQ ID NO: 2845484 - RNA, 19 nt, Mycobacterium avium subsp. paratuberculosis
gcccgccgaacgccuccgc

SEQ ID NO: 2845485 - RNA, 14 nt, Mycobacterium avium subsp. paratuberculosis
gcccgccgaccacc

SEQ ID NO: 2845486 - RNA, 21 nt, Mycobacterium avium subsp. paratuberculosis
gcccgccgaccaccuugcgca

SEQ ID NO: 2845487 - RNA, 22 nt, Mycobacterium avium subsp. paratuberculosis
gcccgccgaccaccuugcgcag

SEQ ID NO: 2845488 - RNA, 23 nt, Mycobacterium avium subsp. paratuberculosis
gcccgccgaccaccuugcgcagc

SEQ ID NO: 2845489 - RNA, 18 nt, Mycobacterium avium subsp. paratuberculosis
gcccgccgacgcccaggc

SEQ ID NO: 2845490 - RNA, 13 nt, Mycobacterium avium subsp. paratuberculosis
gcccgccgacggc

SEQ ID NO: 2845491 - RNA, 21 nt, Mycobacterium avium subsp. paratuberculosis
gcccgccgacggcugcccggc

SEQ ID NO: 2845492 - RNA, 21 nt, Mycobacterium avium subsp. paratuberculosis
gcccgccgaucgaucagccgc

SEQ ID NO: 2845493 - RNA, 22 nt, Mycobacterium avium subsp. paratuberculosis
gcccgccgaucgaucagccgcg

SEQ ID NO: 2845494 - RNA, 16 nt, Mycobacterium avium subsp. paratuberculosis
gcccgccgccaccacg

SEQ ID NO: 2845495 - RNA, 15 nt, Mycobacterium avium subsp. paratuberculosis
gcccgcgaucggcgc

SEQ ID NO: 2845496 - RNA, 17 nt, Mycobacterium avium subsp. paratuberculosis
gcccgcgaucggcgcca

SEQ ID NO: 2845497 - RNA, 18 nt, Mycobacterium avium subsp. paratuberculosis
gcccgcgaucggcgccac

SEQ ID NO: 2845498 - RNA, 22 nt, Mycobacterium avium subsp. paratuberculosis
gcccgcgcaauacccgaccagc

SEQ ID NO: 2845499 - RNA, 15 nt, Mycobacterium avium subsp. paratuberculosis
gcccgcgcaccgcga

SEQ ID NO: 2845500 - RNA, 16 nt, Mycobacterium avium subsp. paratuberculosis
gcccgcgcaccgcgaa

SEQ ID NO: 2845501 - RNA, 14 nt, Mycobacterium avium subsp. paratuberculosis
gcccgcgcaccguc

SEQ ID NO: 2845502 - RNA, 16 nt, Mycobacterium avium subsp. paratuberculosis
gcccgcgcaccgucau

SEQ ID NO: 2845503 - RNA, 22 nt, Mycobacterium avium subsp. paratuberculosis
gcccgcgcaccgucaucgcggc

SEQ ID NO: 2845504 - RNA, 12 nt, Mycobacterium avium subsp. paratuberculosis
gcccgcgcaggc

SEQ ID NO: 2845505 - RNA, 17 nt, Mycobacterium avium subsp. paratuberculosis
gcccgcgcaucccgucg

SEQ ID NO: 2845506 - RNA, 19 nt, Mycobacterium avium subsp. paratuberculosis
gcccgcgcaucccgucgac

SEQ ID NO: 2845507 - RNA, 18 nt, Mycobacterium avium subsp. paratuberculosis
gcccgcgccagcucggcg

SEQ ID NO: 2845508 - RNA, 15 nt, Mycobacterium avium subsp. paratuberculosis
gcccgcgcccaccug

SEQ ID NO: 2845509 - RNA, 12 nt, Mycobacterium avium subsp. paratuberculosis
gcccgcgcccau

SEQ ID NO: 2845510 - RNA, 23 nt, Mycobacterium avium subsp. paratuberculosis
gcccgcgcccaugaacgcgucgc

SEQ ID NO: 2845511 - RNA, 16 nt, Mycobacterium avium subsp. paratuberculosis
gcccgcgccccggccu

SEQ ID NO: 2845512 - RNA, 18 nt, Mycobacterium avium subsp. paratuberculosis
gcccgcgccccggcggcc

SEQ ID NO: 2845513 - RNA, 22 nt, Mycobacterium avium subsp. paratuberculosis
gcccgcgccccggcggccacgc

SEQ ID NO: 2845514 - RNA, 16 nt, Mycobacterium avium subsp. paratuberculosis
gcccgcgcccgcucga

SEQ ID NO: 2845515 - RNA, 19 nt, Mycobacterium avium subsp. paratuberculosis
gcccgcgccgaccagcgcg

SEQ ID NO: 2845516 - RNA, 22 nt, Mycobacterium avium subsp. paratuberculosis
gcccgcgccgacggccgcgccg

SEQ ID NO: 2845517 - RNA, 14 nt, Mycobacterium avium subsp. paratuberculosis
gcccgcgccgagca

SEQ ID NO: 2845518 - RNA, 18 nt, Mycobacterium avium subsp. paratuberculosis
gcccgcgccgagcaaccg

SEQ ID NO: 2845519 - RNA, 12 nt, Mycobacterium avium subsp. paratuberculosis
gcccgcgccgcg

SEQ ID NO: 2845520 - RNA, 14 nt, Mycobacterium avium subsp. paratuberculosis
gcccgcgccgcguc

SEQ ID NO: 2845521 - RNA, 22 nt, Mycobacterium avium subsp. paratuberculosis
gcccgcgccgcgucgucgucga

SEQ ID NO: 2845522 - RNA, 17 nt, Mycobacterium avium subsp. paratuberculosis
gcccgcgcgagcgcagc

SEQ ID NO: 2845523 - RNA, 16 nt, Mycobacterium avium subsp. paratuberculosis
gcccgcgcgaucggcg

SEQ ID NO: 2845524 - RNA, 14 nt, Mycobacterium avium subsp. paratuberculosis
gcccgcgcgaugcg

SEQ ID NO: 2845525 - RNA, 19 nt, Mycobacterium avium subsp. paratuberculosis
gcccgcgcgaugcgggcgc

SEQ ID NO: 2845526 - RNA, 21 nt, Mycobacterium avium subsp. paratuberculosis
gcccgcgcgaugcgggcgccg

SEQ ID NO: 2845527 - RNA, 14 nt, Mycobacterium avium subsp. paratuberculosis
gcccgcgcgcucgg

SEQ ID NO: 2845528 - RNA, 20 nt, Mycobacterium avium subsp. paratuberculosis
gcccgcgcgcucgggggugc

SEQ ID NO: 2845529 - RNA, 15 nt, Mycobacterium avium subsp. paratuberculosis
gcccgcgcgcugacc

SEQ ID NO: 2845530 - RNA, 13 nt, Mycobacterium avium subsp. paratuberculosis
gcccgcgcggccg

SEQ ID NO: 2845531 - RNA, 14 nt, Mycobacterium avium subsp. paratuberculosis
gcccgcgcggccgc

SEQ ID NO: 2845532 - RNA, 15 nt, Mycobacterium avium subsp. paratuberculosis
gcccgcgcggccgcc

SEQ ID NO: 2845533 - RNA, 16 nt, Mycobacterium avium subsp. paratuberculosis
gcccgcgcggccgcca

SEQ ID NO: 2845534 - RNA, 15 nt, Mycobacterium avium subsp. paratuberculosis
gcccgcgcggcggcc

SEQ ID NO: 2845535 - RNA, 18 nt, Mycobacterium avium subsp. paratuberculosis
gcccgcgcggcggugucg

SEQ ID NO: 2845536 - RNA, 21 nt, Mycobacterium avium subsp. paratuberculosis
gcccgcgcggcucacagcgcg

SEQ ID NO: 2845537 - RNA, 16 nt, Mycobacterium avium subsp. paratuberculosis
gcccgcgcgggcugca

SEQ ID NO: 2845538 - RNA, 17 nt, Mycobacterium avium subsp. paratuberculosis
gcccgcgcgggguccca

SEQ ID NO: 2845539 - RNA, 12 nt, Mycobacterium avium subsp. paratuberculosis
gcccgcgcgugg

SEQ ID NO: 2845540 - RNA, 16 nt, Mycobacterium avium subsp. paratuberculosis
gcccgcgcgugggcca

SEQ ID NO: 2845541 - RNA, 15 nt, Mycobacterium avium subsp. paratuberculosis
gcccgcgcguggucc

SEQ ID NO: 2845542 - RNA, 17 nt, Mycobacterium avium subsp. paratuberculosis
gcccgcgcgugguccca

SEQ ID NO: 2845543 - RNA, 13 nt, Mycobacterium avium subsp. paratuberculosis
gcccgcgcuggug

SEQ ID NO: 2845544 - RNA, 14 nt, Mycobacterium avium subsp. paratuberculosis
gcccgcgcuggugc

SEQ ID NO: 2845545 - RNA, 14 nt, Mycobacterium avium subsp. paratuberculosis
gcccgcggaucgcg

SEQ ID NO: 2845546 - RNA, 15 nt, Mycobacterium avium subsp. paratuberculosis
gcccgcggcacgcug

SEQ ID NO: 2845547 - RNA, 23 nt, Mycobacterium avium subsp. paratuberculosis
gcccgcggcacgcugcgccagcc

SEQ ID NO: 2845548 - RNA, 17 nt, Mycobacterium avium subsp. paratuberculosis
gcccgcggcaucgucgg

SEQ ID NO: 2845549 - RNA, 12 nt, Mycobacterium avium subsp. paratuberculosis
gcccgcggccau

SEQ ID NO: 2845550 - RNA, 14 nt, Mycobacterium avium subsp. paratuberculosis
gcccgcggccaucg

SEQ ID NO: 2845551 - RNA, 15 nt, Mycobacterium avium subsp. paratuberculosis
gcccgcggccaucgc

SEQ ID NO: 2845552 - RNA, 13 nt, Mycobacterium avium subsp. paratuberculosis
gcccgcggccgcc

SEQ ID NO: 2845553 - RNA, 14 nt, Mycobacterium avium subsp. paratuberculosis
gcccgcggccgccg

SEQ ID NO: 2845554 - RNA, 19 nt, Mycobacterium avium subsp. paratuberculosis
gcccgcggccgccgccgcg

SEQ ID NO: 2845555 - RNA, 20 nt, Mycobacterium avium subsp. paratuberculosis
gcccgcggccgccgccgcgg

SEQ ID NO: 2845556 - RNA, 17 nt, Mycobacterium avium subsp. paratuberculosis
gcccgcggccuccagcc

SEQ ID NO: 2845557 - RNA, 15 nt, Mycobacterium avium subsp. paratuberculosis
gcccgcggcgcgcag

SEQ ID NO: 2845558 - RNA, 12 nt, Mycobacterium avium subsp. paratuberculosis
gcccgcggcgga

SEQ ID NO: 2845559 - RNA, 21 nt, Mycobacterium avium subsp. paratuberculosis
gcccgcggcggauccagcacc

SEQ ID NO: 2845560 - RNA, 22 nt, Mycobacterium avium subsp. paratuberculosis
gcccgcggcggauccagcaccg

SEQ ID NO: 2845561 - RNA, 19 nt, Mycobacterium avium subsp. paratuberculosis
gcccgcgggacacggcggc

SEQ ID NO: 2845562 - RNA, 21 nt, Mycobacterium avium subsp. paratuberculosis
gcccgcgggacacggcggcgc

SEQ ID NO: 2845563 - RNA, 16 nt, Mycobacterium avium subsp. paratuberculosis
gcccgcgggaucagcg

SEQ ID NO: 2845564 - RNA, 17 nt, Mycobacterium avium subsp. paratuberculosis
gcccgcgggaucagcgu

SEQ ID NO: 2845565 - RNA, 22 nt, Mycobacterium avium subsp. paratuberculosis
gcccgcgggaucagcguguugg

SEQ ID NO: 2845566 - RNA, 17 nt, Mycobacterium avium subsp. paratuberculosis
gcccgcgggccagacug

SEQ ID NO: 2845567 - RNA, 21 nt, Mycobacterium avium subsp. paratuberculosis
gcccgcgggccagacugcgca

SEQ ID NO: 2845568 - RNA, 20 nt, Mycobacterium avium subsp. paratuberculosis
gcccgcggggcguacgcgcu

SEQ ID NO: 2845569 - RNA, 18 nt, Mycobacterium avium subsp. paratuberculosis
gcccgcggguagcccguc

SEQ ID NO: 2845570 - RNA, 21 nt, Mycobacterium avium subsp. paratuberculosis
gcccgcggguagcccgucgac

SEQ ID NO: 2845571 - RNA, 22 nt, Mycobacterium avium subsp. paratuberculosis
gcccgcggguagcccgucgacg

SEQ ID NO: 2845572 - RNA, 17 nt, Mycobacterium avium subsp. paratuberculosis
gcccgcgggugcagccg

SEQ ID NO: 2845573 - RNA, 20 nt, Mycobacterium avium subsp. paratuberculosis
gcccgcgggugcagccggau

SEQ ID NO: 2845574 - RNA, 23 nt, Mycobacterium avium subsp. paratuberculosis
gcccgcggguguuucggucggcg

SEQ ID NO: 2845575 - RNA, 19 nt, Mycobacterium avium subsp. paratuberculosis
gcccgcggucaugcgcggg

SEQ ID NO: 2845576 - RNA, 21 nt, Mycobacterium avium subsp. paratuberculosis
gcccgcggugcagucggucgg

SEQ ID NO: 2845577 - RNA, 20 nt, Mycobacterium avium subsp. paratuberculosis
gcccgcgguggaacccagca

SEQ ID NO: 2845578 - RNA, 21 nt, Mycobacterium avium subsp. paratuberculosis
gcccgcggugugcuggccagc

SEQ ID NO: 2845579 - RNA, 22 nt, Mycobacterium avium subsp. paratuberculosis
gcccgcggugugcuggccagca

SEQ ID NO: 2845580 - RNA, 14 nt, Mycobacterium avium subsp. paratuberculosis
gcccggaccgcggu

SEQ ID NO: 2845581 - RNA, 14 nt, Mycobacterium avium subsp. paratuberculosis
gcccggaccggccg

SEQ ID NO: 2845582 - RNA, 21 nt, Mycobacterium avium subsp. paratuberculosis
gcccggaccggccgugcgcgu

SEQ ID NO: 2845583 - RNA, 13 nt, Mycobacterium avium subsp. paratuberculosis
gcccggaccggcu

SEQ ID NO: 2845584 - RNA, 19 nt, Mycobacterium avium subsp. paratuberculosis
gcccggacgaugccgcggc

SEQ ID NO: 2845585 - RNA, 15 nt, Mycobacterium avium subsp. paratuberculosis
gcccggacgcgcaca

SEQ ID NO: 2845586 - RNA, 19 nt, Mycobacterium avium subsp. paratuberculosis
gcccggacgcgcacacggc

SEQ ID NO: 2845587 - RNA, 19 nt, Mycobacterium avium subsp. paratuberculosis
gcccggagaaaccgucggc

SEQ ID NO: 2845588 - RNA, 20 nt, Mycobacterium avium subsp. paratuberculosis
gcccggagaaaccgucggcc

SEQ ID NO: 2845589 - RNA, 21 nt, Mycobacterium avium subsp. paratuberculosis
gcccggagaaaccgucggccc

SEQ ID NO: 2845590 - RNA, 22 nt, Mycobacterium avium subsp. paratuberculosis
gcccggagaaaccgucggcccg

SEQ ID NO: 2845591 - RNA, 22 nt, Mycobacterium avium subsp. paratuberculosis
gcccggagaacuccuugagcuc

SEQ ID NO: 2845592 - RNA, 16 nt, Mycobacterium avium subsp. paratuberculosis
gcccggagcugucggu

SEQ ID NO: 2845593 - RNA, 17 nt, Mycobacterium avium subsp. paratuberculosis
gcccggagcugucggug

SEQ ID NO: 2845594 - RNA, 15 nt, Mycobacterium avium subsp. paratuberculosis
gcccggaggcgaugc

SEQ ID NO: 2845595 - RNA, 22 nt, Mycobacterium avium subsp. paratuberculosis
gcccggagguucgccggaaugg

SEQ ID NO: 2845596 - RNA, 24 nt, Mycobacterium avium subsp. paratuberculosis
gcccggagguucgccggaauggca

SEQ ID NO: 2845597 - RNA, 16 nt, Mycobacterium avium subsp. paratuberculosis
gcccggaguagccggu

SEQ ID NO: 2845598 - RNA, 15 nt, Mycobacterium avium subsp. paratuberculosis
gcccggaguccggcu

SEQ ID NO: 2845599 - RNA, 17 nt, Mycobacterium avium subsp. paratuberculosis
gcccggaucagcugacc

SEQ ID NO: 2845600 - RNA, 19 nt, Mycobacterium avium subsp. paratuberculosis
gcccggaucagcugaccgg

SEQ ID NO: 2845601 - RNA, 21 nt, Mycobacterium avium subsp. paratuberculosis
gcccggaucgucuugcggccc

SEQ ID NO: 2845602 - RNA, 22 nt, Mycobacterium avium subsp. paratuberculosis
gcccggaucgucuugcggccca

SEQ ID NO: 2845603 - RNA, 24 nt, Mycobacterium avium subsp. paratuberculosis
gcccggaucgucuugcggcccaac

SEQ ID NO: 2845604 - RNA, 16 nt, Mycobacterium avium subsp. paratuberculosis
gcccggaugccggcgc

SEQ ID NO: 2845605 - RNA, 20 nt, Mycobacterium avium subsp. paratuberculosis
gcccggaugccggcgcccag

SEQ ID NO: 2845606 - RNA, 13 nt, Mycobacterium avium subsp. paratuberculosis
gcccggauggccg

SEQ ID NO: 2845607 - RNA, 16 nt, Mycobacterium avium subsp. paratuberculosis
gcccggauggccgggc

SEQ ID NO: 2845608 - RNA, 15 nt, Mycobacterium avium subsp. paratuberculosis
gcccggaugucgggc

SEQ ID NO: 2845609 - RNA, 20 nt, Mycobacterium avium subsp. paratuberculosis
gcccggauucgcggcggcgc

SEQ ID NO: 2845610 - RNA, 21 nt, Mycobacterium avium subsp. paratuberculosis
gcccggauucgcggcggcgcc

SEQ ID NO: 2845611 - RNA, 13 nt, Mycobacterium avium subsp. paratuberculosis
gcccggcaacacg

SEQ ID NO: 2845612 - RNA, 14 nt, Mycobacterium avium subsp. paratuberculosis
gcccggcaccgcgg

SEQ ID NO: 2845613 - RNA, 16 nt, Mycobacterium avium subsp. paratuberculosis
gcccggcaccgcggcg

SEQ ID NO: 2845614 - RNA, 19 nt, Mycobacterium avium subsp. paratuberculosis
gcccggcaccgcggcggug

SEQ ID NO: 2845615 - RNA, 21 nt, Mycobacterium avium subsp. paratuberculosis
gcccggcaccgcggcgguguc

SEQ ID NO: 2845616 - RNA, 19 nt, Mycobacterium avium subsp. paratuberculosis
gcccggcacgaacgcgacg

SEQ ID NO: 2845617 - RNA, 14 nt, Mycobacterium avium subsp. paratuberculosis
gcccggcagccgcu

SEQ ID NO: 2845618 - RNA, 17 nt, Mycobacterium avium subsp. paratuberculosis
gcccggcagccgcuccg

SEQ ID NO: 2845619 - RNA, 13 nt, Mycobacterium avium subsp. paratuberculosis
gcccggcagccgg

SEQ ID NO: 2845620 - RNA, 16 nt, Mycobacterium avium subsp. paratuberculosis
gcccggcagcggggcg

SEQ ID NO: 2845621 - RNA, 14 nt, Mycobacterium avium subsp. paratuberculosis
gcccggccaacggg

SEQ ID NO: 2845622 - RNA, 23 nt, Mycobacterium avium subsp. paratuberculosis
gcccggccaacgggaagagcggc

SEQ ID NO: 2845623 - RNA, 11 nt, Mycobacterium avium subsp. paratuberculosis
gcccggccacc

SEQ ID NO: 2845624 - RNA, 16 nt, Mycobacterium avium subsp. paratuberculosis
gcccggccaccaggga

SEQ ID NO: 2845625 - RNA, 12 nt, Mycobacterium avium subsp. paratuberculosis
gcccggccaccu

SEQ ID NO: 2845626 - RNA, 13 nt, Mycobacterium avium subsp. paratuberculosis
gcccggccaccug

SEQ ID NO: 2845627 - RNA, 17 nt, Mycobacterium avium subsp. paratuberculosis
gcccggccacucgccgc

SEQ ID NO: 2845628 - RNA, 18 nt, Mycobacterium avium subsp. paratuberculosis
gcccggccacucgccgcg

SEQ ID NO: 2845629 - RNA, 19 nt, Mycobacterium avium subsp. paratuberculosis
gcccggccacucgccgcga

SEQ ID NO: 2845630 - RNA, 12 nt, Mycobacterium avium subsp. paratuberculosis
gcccggccagca

SEQ ID NO: 2845631 - RNA, 13 nt, Mycobacterium avium subsp. paratuberculosis
gcccggccagcag

SEQ ID NO: 2845632 - RNA, 15 nt, Mycobacterium avium subsp. paratuberculosis
gcccggccagcaggu

SEQ ID NO: 2845633 - RNA, 19 nt, Mycobacterium avium subsp. paratuberculosis
gcccggccagccggccgcu

SEQ ID NO: 2845634 - RNA, 21 nt, Mycobacterium avium subsp. paratuberculosis
gcccggccagccggccgcuga

SEQ ID NO: 2845635 - RNA, 15 nt, Mycobacterium avium subsp. paratuberculosis
gcccggccagccggg

SEQ ID NO: 2845636 - RNA, 17 nt, Mycobacterium avium subsp. paratuberculosis
gcccggccagccgggcg

SEQ ID NO: 2845637 - RNA, 15 nt, Mycobacterium avium subsp. paratuberculosis
gcccggccagccggu

SEQ ID NO: 2845638 - RNA, 20 nt, Mycobacterium avium subsp. paratuberculosis
gcccggccagccgguaugcg

SEQ ID NO: 2845639 - RNA, 15 nt, Mycobacterium avium subsp. paratuberculosis
gcccggccagcggca

SEQ ID NO: 2845640 - RNA, 17 nt, Mycobacterium avium subsp. paratuberculosis
gcccggccagcggcauc

SEQ ID NO: 2845641 - RNA, 11 nt, Mycobacterium avium subsp. paratuberculosis
gcccggccagu

SEQ ID NO: 2845642 - RNA, 18 nt, Mycobacterium avium subsp. paratuberculosis
gcccggccaguccggcag

SEQ ID NO: 2845643 - RNA, 22 nt, Mycobacterium avium subsp. paratuberculosis
gcccggccaguccggcagcagc

SEQ ID NO: 2845644 - RNA, 21 nt, Mycobacterium avium subsp. paratuberculosis
gcccggccauaaagccgucgu

SEQ ID NO: 2845645 - RNA, 17 nt, Mycobacterium avium subsp. paratuberculosis
gcccggccaucugcgcg

SEQ ID NO: 2845646 - RNA, 18 nt, Mycobacterium avium subsp. paratuberculosis
gcccggccaucugcgcga

SEQ ID NO: 2845647 - RNA, 13 nt, Mycobacterium avium subsp. paratuberculosis
gcccggcccagcc

SEQ ID NO: 2845648 - RNA, 15 nt, Mycobacterium avium subsp. paratuberculosis
gcccggcccagccgc

SEQ ID NO: 2845649 - RNA, 18 nt, Mycobacterium avium subsp. paratuberculosis
gcccggcccagccggucg

SEQ ID NO: 2845650 - RNA, 22 nt, Mycobacterium avium subsp. paratuberculosis
gcccggcccaggcacagcgaaa

SEQ ID NO: 2845651 - RNA, 14 nt, Mycobacterium avium subsp. paratuberculosis
gcccggccccaccg

SEQ ID NO: 2845652 - RNA, 15 nt, Mycobacterium avium subsp. paratuberculosis
gcccggccccaccgc

SEQ ID NO: 2845653 - RNA, 17 nt, Mycobacterium avium subsp. paratuberculosis
gcccggccccaccgccg

SEQ ID NO: 2845654 - RNA, 18 nt, Mycobacterium avium subsp. paratuberculosis
gcccggccccaccgccgc

SEQ ID NO: 2845655 - RNA, 21 nt, Mycobacterium avium subsp. paratuberculosis
gcccggccccaccgccgcugc

SEQ ID NO: 2845656 - RNA, 18 nt, Mycobacterium avium subsp. paratuberculosis
gcccggcccccugcucag

SEQ ID NO: 2845657 - RNA, 23 nt, Mycobacterium avium subsp. paratuberculosis
gcccggcccccugcucagcggcc

SEQ ID NO: 2845658 - RNA, 14 nt, Mycobacterium avium subsp. paratuberculosis
gcccggcccgccgc

SEQ ID NO: 2845659 - RNA, 17 nt, Mycobacterium avium subsp. paratuberculosis
gcccggcccgccgcugc

SEQ ID NO: 2845660 - RNA, 20 nt, Mycobacterium avium subsp. paratuberculosis
gcccggcccgccgcugcagc

SEQ ID NO: 2845661 - RNA, 16 nt, Mycobacterium avium subsp. paratuberculosis
gcccggcccgcuggcc

SEQ ID NO: 2845662 - RNA, 16 nt, Mycobacterium avium subsp. paratuberculosis
gcccggcccggcgaug

SEQ ID NO: 2845663 - RNA, 17 nt, Mycobacterium avium subsp. paratuberculosis
gcccggcccggcgcggc

SEQ ID NO: 2845664 - RNA, 18 nt, Mycobacterium avium subsp. paratuberculosis
gcccggcccggcgcggcc

SEQ ID NO: 2845665 - RNA, 23 nt, Mycobacterium avium subsp. paratuberculosis
gcccggcguacagcaauccgcug

SEQ ID NO: 2845666 - RNA, 17 nt, Mycobacterium avium subsp. paratuberculosis
gcccggcgucacgcugg

SEQ ID NO: 2845667 - RNA, 11 nt, Mycobacterium avium subsp. paratuberculosis
gcccggcgucc

SEQ ID NO: 2845668 - RNA, 20 nt, Mycobacterium avium subsp. paratuberculosis
gcccggcguccgcgaacggg

SEQ ID NO: 2845669 - RNA, 15 nt, Mycobacterium avium subsp. paratuberculosis
gcccggcguccugca

SEQ ID NO: 2845670 - RNA, 13 nt, Mycobacterium avium subsp. paratuberculosis
gcccggcgucggu

SEQ ID NO: 2845671 - RNA, 14 nt, Mycobacterium avium subsp. paratuberculosis
gcccggcgucggug

SEQ ID NO: 2845672 - RNA, 14 nt, Mycobacterium avium subsp. paratuberculosis
gcccggcgugggcc

SEQ ID NO: 2845673 - RNA, 19 nt, Mycobacterium avium subsp. paratuberculosis
gcccggcgugggccgcagc

SEQ ID NO: 2845674 - RNA, 24 nt, Mycobacterium avium subsp. paratuberculosis
gcccggcgugggccgcagcgcggc

SEQ ID NO: 2845675 - RNA, 19 nt, Mycobacterium avium subsp. paratuberculosis
gcccggcguuccagcgcac

SEQ ID NO: 2845676 - RNA, 22 nt, Mycobacterium avium subsp. paratuberculosis
gcccggcguuggacagcucgac

SEQ ID NO: 2845677 - RNA, 19 nt, Mycobacterium avium subsp. paratuberculosis
gcccggcuaauucgggccg

SEQ ID NO: 2845678 - RNA, 21 nt, Mycobacterium avium subsp. paratuberculosis
gcccggcuaauucgggccgcc

SEQ ID NO: 2845679 - RNA, 23 nt, Mycobacterium avium subsp. paratuberculosis
gcccggcuaauucgggccgccgc

SEQ ID NO: 2845680 - RNA, 20 nt, Mycobacterium avium subsp. paratuberculosis
gcccggcuacucggacgccg

SEQ ID NO: 2845681 - RNA, 14 nt, Mycobacterium avium subsp. paratuberculosis
gcccggcucaaacc

SEQ ID NO: 2845682 - RNA, 15 nt, Mycobacterium avium subsp. paratuberculosis
gcccggcucaaugcc

SEQ ID NO: 2845683 - RNA, 21 nt, Mycobacterium avium subsp. paratuberculosis
gcccggcucagcgcgacgugc

SEQ ID NO: 2845684 - RNA, 16 nt, Mycobacterium avium subsp. paratuberculosis
gcccggcuccccgacc

SEQ ID NO: 2845685 - RNA, 17 nt, Mycobacterium avium subsp. paratuberculosis
gcccggcuccccgacca

SEQ ID NO: 2845686 - RNA, 23 nt, Mycobacterium avium subsp. paratuberculosis
gcccggcucgaaguggcagcgcu

SEQ ID NO: 2845687 - RNA, 16 nt, Mycobacterium avium subsp. paratuberculosis
gcccggcucgccgggc

SEQ ID NO: 2845688 - RNA, 18 nt, Mycobacterium avium subsp. paratuberculosis
gcccggcucggugcgcca

SEQ ID NO: 2845689 - RNA, 14 nt, Mycobacterium avium subsp. paratuberculosis
gcccggcugcgcag

SEQ ID NO: 2845690 - RNA, 15 nt, Mycobacterium avium subsp. paratuberculosis
gcccggcugcgcagc

SEQ ID NO: 2845691 - RNA, 22 nt, Mycobacterium avium subsp. paratuberculosis
gcccggcugcgcagcgcagcac

SEQ ID NO: 2845692 - RNA, 15 nt, Mycobacterium avium subsp. paratuberculosis
gcccggcugcgccgc

SEQ ID NO: 2845693 - RNA, 16 nt, Mycobacterium avium subsp. paratuberculosis
gcccggcugcgccgcg

SEQ ID NO: 2845694 - RNA, 18 nt, Mycobacterium avium subsp. paratuberculosis
gcccggcugcgccgcgcu

SEQ ID NO: 2845695 - RNA, 18 nt, Mycobacterium avium subsp. paratuberculosis
gcccggcuggcaggucgc

SEQ ID NO: 2845696 - RNA, 20 nt, Mycobacterium avium subsp. paratuberculosis
gcccggcuggcaggucgcgc

SEQ ID NO: 2845697 - RNA, 22 nt, Mycobacterium avium subsp. paratuberculosis
gcccggcuggcaggucgcgccg

SEQ ID NO: 2845698 - RNA, 14 nt, Mycobacterium avium subsp. paratuberculosis
gcccggcugggcgc

SEQ ID NO: 2845699 - RNA, 17 nt, Mycobacterium avium subsp. paratuberculosis
gcccggcugggcgcgca

SEQ ID NO: 2845700 - RNA, 19 nt, Mycobacterium avium subsp. paratuberculosis
gcccggcugggcgcgcaac

SEQ ID NO: 2845701 - RNA, 18 nt, Mycobacterium avium subsp. paratuberculosis
gcccggcuucgccgccgc

SEQ ID NO: 2845702 - RNA, 16 nt, Mycobacterium avium subsp. paratuberculosis
gcccggcuucgccgcg

SEQ ID NO: 2845703 - RNA, 19 nt, Mycobacterium avium subsp. paratuberculosis
gcccggcuucgccgcgcuu

SEQ ID NO: 2845704 - RNA, 20 nt, Mycobacterium avium subsp. paratuberculosis
gcccggcuucgccgcgcuug

SEQ ID NO: 2845705 - RNA, 20 nt, Mycobacterium avium subsp. paratuberculosis
gcccgggaaagcgggugacc

SEQ ID NO: 2845706 - RNA, 18 nt, Mycobacterium avium subsp. paratuberculosis
gcccgggaagccgcagca

SEQ ID NO: 2845707 - RNA, 21 nt, Mycobacterium avium subsp. paratuberculosis
gcccgggaagccgcagcaggu

SEQ ID NO: 2845708 - RNA, 20 nt, Mycobacterium avium subsp. paratuberculosis
gcccgggaagcuggugguga

SEQ ID NO: 2845709 - RNA, 19 nt, Mycobacterium avium subsp. paratuberculosis
gcccgggagaaccucaacg

SEQ ID NO: 2845710 - RNA, 16 nt, Mycobacterium avium subsp. paratuberculosis
gcccgggcacgacggu

SEQ ID NO: 2845711 - RNA, 20 nt, Mycobacterium avium subsp. paratuberculosis
gcccgggcacgacggucagc

SEQ ID NO: 2845712 - RNA, 13 nt, Mycobacterium avium subsp. paratuberculosis
gcccgggcaggca

SEQ ID NO: 2845713 - RNA, 16 nt, Mycobacterium avium subsp. paratuberculosis
gcccgggcaggcggcg

SEQ ID NO: 2845714 - RNA, 22 nt, Mycobacterium avium subsp. paratuberculosis
gcccgggcaggcggcgcgccag

SEQ ID NO: 2845715 - RNA, 17 nt, Mycobacterium avium subsp. paratuberculosis
gcccgggcaucccgccg

SEQ ID NO: 2845716 - RNA, 18 nt, Mycobacterium avium subsp. paratuberculosis
gcccgggcaucccgccga

SEQ ID NO: 2845717 - RNA, 22 nt, Mycobacterium avium subsp. paratuberculosis
gcccgggccacacccgucgacu

SEQ ID NO: 2845718 - RNA, 14 nt, Mycobacterium avium subsp. paratuberculosis
gcccgggccagguc

SEQ ID NO: 2845719 - RNA, 16 nt, Mycobacterium avium subsp. paratuberculosis
gcccgggcccggggug

SEQ ID NO: 2845720 - RNA, 12 nt, Mycobacterium avium subsp. paratuberculosis
gcccgggccgca

SEQ ID NO: 2845721 - RNA, 14 nt, Mycobacterium avium subsp. paratuberculosis
gcccgggccgcagc

SEQ ID NO: 2845722 - RNA, 16 nt, Mycobacterium avium subsp. paratuberculosis
gcccgggccgcagcuc

SEQ ID NO: 2845723 - RNA, 17 nt, Mycobacterium avium subsp. paratuberculosis
gcccgggccgcagcucg

SEQ ID NO: 2845724 - RNA, 17 nt, Mycobacterium avium subsp. paratuberculosis
gcccgggccggaggugc

SEQ ID NO: 2845725 - RNA, 22 nt, Mycobacterium avium subsp. paratuberculosis
gcccgggccggaggugcggguc

SEQ ID NO: 2845726 - RNA, 19 nt, Mycobacterium avium subsp. paratuberculosis
gcccgggccgucaucgccg

SEQ ID NO: 2845727 - RNA, 22 nt, Mycobacterium avium subsp. paratuberculosis
gcccgggccgucaucgccgacg

SEQ ID NO: 2845728 - RNA, 13 nt, Mycobacterium avium subsp. paratuberculosis
gcccgggccgucc

SEQ ID NO: 2845729 - RNA, 14 nt, Mycobacterium avium subsp. paratuberculosis
gcccgggccguccg

SEQ ID NO: 2845730 - RNA, 21 nt, Mycobacterium avium subsp. paratuberculosis
gcccgggcgacuucguuggug

SEQ ID NO: 2845731 - RNA, 22 nt, Mycobacterium avium subsp. paratuberculosis
gcccgggcgccgagaacaggcc

SEQ ID NO: 2845732 - RNA, 19 nt, Mycobacterium avium subsp. paratuberculosis
gcccgggcgcugagcacgg

SEQ ID NO: 2845733 - RNA, 20 nt, Mycobacterium avium subsp. paratuberculosis
gcccgggcgcugagcacggu

SEQ ID NO: 2845734 - RNA, 17 nt, Mycobacterium avium subsp. paratuberculosis
gcccgggcggcccgcau

SEQ ID NO: 2845735 - RNA, 20 nt, Mycobacterium avium subsp. paratuberculosis
gcccgggcggcccgcaucga

SEQ ID NO: 2845736 - RNA, 17 nt, Mycobacterium avium subsp. paratuberculosis
gcccgggcggcccgggu

SEQ ID NO: 2845737 - RNA, 21 nt, Mycobacterium avium subsp. paratuberculosis
gcccgggcggcgaguccggcc

SEQ ID NO: 2845738 - RNA, 13 nt, Mycobacterium avium subsp. paratuberculosis
gcccgggcggcgg

SEQ ID NO: 2845739 - RNA, 19 nt, Mycobacterium avium subsp. paratuberculosis
gcccgggcuaucgcccggc

SEQ ID NO: 2845740 - RNA, 13 nt, Mycobacterium avium subsp. paratuberculosis
gcccgggcucgca

SEQ ID NO: 2845741 - RNA, 18 nt, Mycobacterium avium subsp. paratuberculosis
gcccgggcugcagcagcg

SEQ ID NO: 2845742 - RNA, 19 nt, Mycobacterium avium subsp. paratuberculosis
gcccgggcugcagcagcga

SEQ ID NO: 2845743 - RNA, 23 nt, Mycobacterium avium subsp. paratuberculosis
gcccgggcuguugaccacggccu

SEQ ID NO: 2845744 - RNA, 14 nt, Mycobacterium avium subsp. paratuberculosis
gcccggggcgcgga

SEQ ID NO: 2845745 - RNA, 20 nt, Mycobacterium avium subsp. paratuberculosis
gcccggggcgcggaccgcac

SEQ ID NO: 2845746 - RNA, 21 nt, Mycobacterium avium subsp. paratuberculosis
gcccggggcgcggaccgcacc

SEQ ID NO: 2845747 - RNA, 16 nt, Mycobacterium avium subsp. paratuberculosis
gcccggggcggcgaug

SEQ ID NO: 2845748 - RNA, 21 nt, Mycobacterium avium subsp. paratuberculosis
gcccgggguccaccggccgau

SEQ ID NO: 2845749 - RNA, 14 nt, Mycobacterium avium subsp. paratuberculosis
gcccgucacgcugg

SEQ ID NO: 2845750 - RNA, 16 nt, Mycobacterium avium subsp. paratuberculosis
gcccgucacgcuggcg

SEQ ID NO: 2845751 - RNA, 17 nt, Mycobacterium avium subsp. paratuberculosis
gcccgucacgcuggcgu

SEQ ID NO: 2845752 - RNA, 19 nt, Mycobacterium avium subsp. paratuberculosis
gcccgucacgcuggcguga

SEQ ID NO: 2845753 - RNA, 14 nt, Mycobacterium avium subsp. paratuberculosis
gcccgucacggccg

SEQ ID NO: 2845754 - RNA, 18 nt, Mycobacterium avium subsp. paratuberculosis
gcccgucacggccgucca

SEQ ID NO: 2845755 - RNA, 13 nt, Mycobacterium avium subsp. paratuberculosis
gcccgucagcccc

SEQ ID NO: 2845756 - RNA, 23 nt, Mycobacterium avium subsp. paratuberculosis
gcccgucagccccuuaccggccg

SEQ ID NO: 2845757 - RNA, 16 nt, Mycobacterium avium subsp. paratuberculosis
gcccgucaggccucga

SEQ ID NO: 2845758 - RNA, 21 nt, Mycobacterium avium subsp. paratuberculosis
gcccgucaggccucgaggauc

SEQ ID NO: 2845759 - RNA, 22 nt, Mycobacterium avium subsp. paratuberculosis
gcccgucaggccucgaggaucg

SEQ ID NO: 2845760 - RNA, 13 nt, Mycobacterium avium subsp. paratuberculosis
gcccguccagcgc

SEQ ID NO: 2845761 - RNA, 16 nt, Mycobacterium avium subsp. paratuberculosis
gcccguccagcgcaug

SEQ ID NO: 2845762 - RNA, 13 nt, Mycobacterium avium subsp. paratuberculosis
gcccguccccacc

SEQ ID NO: 2845763 - RNA, 13 nt, Mycobacterium avium subsp. paratuberculosis
gcccgucccgccg

SEQ ID NO: 2845764 - RNA, 14 nt, Mycobacterium avium subsp. paratuberculosis
gcccgucccgccga

SEQ ID NO: 2845765 - RNA, 15 nt, Mycobacterium avium subsp. paratuberculosis
gcccgucccgccgac

SEQ ID NO: 2845766 - RNA, 16 nt, Mycobacterium avium subsp. paratuberculosis
gcccgucccgccgacg

SEQ ID NO: 2845767 - RNA, 21 nt, Mycobacterium avium subsp. paratuberculosis
gcccgucccggcccauggcga

SEQ ID NO: 2845768 - RNA, 23 nt, Mycobacterium avium subsp. paratuberculosis
gcccgucccggcccauggcgaac

SEQ ID NO: 2845769 - RNA, 17 nt, Mycobacterium avium subsp. paratuberculosis
gcccgucccugcgcgga

SEQ ID NO: 2845770 - RNA, 13 nt, Mycobacterium avium subsp. paratuberculosis
gcccguccgcccc

SEQ ID NO: 2845771 - RNA, 15 nt, Mycobacterium avium subsp. paratuberculosis
gcccguccgccccgc

SEQ ID NO: 2845772 - RNA, 18 nt, Mycobacterium avium subsp. paratuberculosis
gcccguccgccccgcugc

SEQ ID NO: 2845773 - RNA, 20 nt, Mycobacterium avium subsp. paratuberculosis
gcccguccgccccgcugccg

SEQ ID NO: 2845774 - RNA, 17 nt, Mycobacterium avium subsp. paratuberculosis
gcccguccgggccggcc

SEQ ID NO: 2845775 - RNA, 22 nt, Mycobacterium avium subsp. paratuberculosis
gcccguccgggccggccagacc

SEQ ID NO: 2845776 - RNA, 15 nt, Mycobacterium avium subsp. paratuberculosis
gcccgucgacgggcc

SEQ ID NO: 2845777 - RNA, 18 nt, Mycobacterium avium subsp. paratuberculosis
gcccgucgacgggccacc

SEQ ID NO: 2845778 - RNA, 13 nt, Mycobacterium avium subsp. paratuberculosis
gcccgucgacguc

SEQ ID NO: 2845779 - RNA, 17 nt, Mycobacterium avium subsp. paratuberculosis
gcccgucgagcgucacg

SEQ ID NO: 2845780 - RNA, 20 nt, Mycobacterium avium subsp. paratuberculosis
gcccgucgagcgucacgcug

SEQ ID NO: 2845781 - RNA, 19 nt, Mycobacterium avium subsp. paratuberculosis
gcccgucgagcgucauucc

SEQ ID NO: 2845782 - RNA, 21 nt, Mycobacterium avium subsp. paratuberculosis
gcccgucgagcgucauuccgc

SEQ ID NO: 2845783 - RNA, 16 nt, Mycobacterium avium subsp. paratuberculosis
gcccgucgaucccgga

SEQ ID NO: 2845784 - RNA, 13 nt, Mycobacterium avium subsp. paratuberculosis
gcccgucgccacc

SEQ ID NO: 2845785 - RNA, 15 nt, Mycobacterium avium subsp. paratuberculosis
gcccgucgccaccac

SEQ ID NO: 2845786 - RNA, 18 nt, Mycobacterium avium subsp. paratuberculosis
gcccgucgccaccacggc

SEQ ID NO: 2845787 - RNA, 19 nt, Mycobacterium avium subsp. paratuberculosis
gcccgucgccaccacggcg

SEQ ID NO: 2845788 - RNA, 22 nt, Mycobacterium avium subsp. paratuberculosis
gcccgucgccgaucagcaccag

SEQ ID NO: 2845789 - RNA, 22 nt, Mycobacterium avium subsp. paratuberculosis
gcccgucgccgugcguccaguc

SEQ ID NO: 2845790 - RNA, 15 nt, Mycobacterium avium subsp. paratuberculosis
gcccgucgccuccga

SEQ ID NO: 2845791 - RNA, 22 nt, Mycobacterium avium subsp. paratuberculosis
gcccgucgccuccugcuggcgc

SEQ ID NO: 2845792 - RNA, 12 nt, Mycobacterium avium subsp. paratuberculosis
gcccgucgcgca

SEQ ID NO: 2845793 - RNA, 13 nt, Mycobacterium avium subsp. paratuberculosis
gcccgucgcgcaa

SEQ ID NO: 2845794 - RNA, 21 nt, Mycobacterium avium subsp. paratuberculosis
gcccgucgcgucccuggcgau

SEQ ID NO: 2845795 - RNA, 22 nt, Mycobacterium avium subsp. paratuberculosis
gcccgucggaggacaacgcguc

SEQ ID NO: 2845796 - RNA, 18 nt, Mycobacterium avium subsp. paratuberculosis
gcccgucggcaacgccgg

SEQ ID NO: 2845797 - RNA, 12 nt, Mycobacterium avium subsp. paratuberculosis
gcccgucggccu

SEQ ID NO: 2845798 - RNA, 18 nt, Mycobacterium avium subsp. paratuberculosis
gcccgucggccuccagcc

SEQ ID NO: 2845799 - RNA, 17 nt, Mycobacterium avium subsp. paratuberculosis
gcccgucggccucggcg

SEQ ID NO: 2845800 - RNA, 12 nt, Mycobacterium avium subsp. paratuberculosis
gcccgucggcgu

SEQ ID NO: 2845801 - RNA, 12 nt, Mycobacterium avium subsp. paratuberculosis
gcccgucgggcg

SEQ ID NO: 2845802 - RNA, 13 nt, Mycobacterium avium subsp. paratuberculosis
gcccgucgggcgc

SEQ ID NO: 2845803 - RNA, 14 nt, Mycobacterium avium subsp. paratuberculosis
gcccgucgggcgcg

SEQ ID NO: 2845804 - RNA, 16 nt, Mycobacterium avium subsp. paratuberculosis
gcccgucgggcgcggc

SEQ ID NO: 2845805 - RNA, 14 nt, Mycobacterium avium subsp. paratuberculosis
gcccgucgggcggg

SEQ ID NO: 2845806 - RNA, 18 nt, Mycobacterium avium subsp. paratuberculosis
gcccgucggggcccggcc

SEQ ID NO: 2845807 - RNA, 13 nt, Mycobacterium avium subsp. paratuberculosis
gcccgucgucggu

SEQ ID NO: 2845808 - RNA, 19 nt, Mycobacterium avium subsp. paratuberculosis
gcccgucucggcgugcucg

SEQ ID NO: 2845809 - RNA, 21 nt, Mycobacterium avium subsp. paratuberculosis
gcccgucucggcgugcucggc

SEQ ID NO: 2845810 - RNA, 23 nt, Mycobacterium avium subsp. paratuberculosis
gcccgucucggcgugcucggcca

SEQ ID NO: 2845811 - RNA, 17 nt, Mycobacterium avium subsp. paratuberculosis
gcccgugaucgccacgg

SEQ ID NO: 2845812 - RNA, 22 nt, Mycobacterium avium subsp. paratuberculosis
gcccgugaucgccacggcggug

SEQ ID NO: 2845813 - RNA, 18 nt, Mycobacterium avium subsp. paratuberculosis
gcccgugccgcaccuggu

SEQ ID NO: 2845814 - RNA, 13 nt, Mycobacterium avium subsp. paratuberculosis
gcccguggccagc

SEQ ID NO: 2845815 - RNA, 14 nt, Mycobacterium avium subsp. paratuberculosis
gcccguggccagcg

SEQ ID NO: 2845816 - RNA, 15 nt, Mycobacterium avium subsp. paratuberculosis
gcccguggccagcgc

SEQ ID NO: 2845817 - RNA, 19 nt, Mycobacterium avium subsp. paratuberculosis
gcccguggccagcgccagc

SEQ ID NO: 2845818 - RNA, 15 nt, Mycobacterium avium subsp. paratuberculosis
gcccguggcccacgg

SEQ ID NO: 2845819 - RNA, 17 nt, Mycobacterium avium subsp. paratuberculosis
gcccgugucgcggccuc

SEQ ID NO: 2845820 - RNA, 24 nt, Mycobacterium avium subsp. paratuberculosis
gcccguucgaugaugggcgaucga

SEQ ID NO: 2845821 - RNA, 17 nt, Mycobacterium avium subsp. paratuberculosis
gcccguugagcaccgcg

SEQ ID NO: 2845822 - RNA, 18 nt, Mycobacterium avium subsp. paratuberculosis
gcccguugagcaccgcga

SEQ ID NO: 2845823 - RNA, 21 nt, Mycobacterium avium subsp. paratuberculosis
gcccguugagcaccgcgaaga

SEQ ID NO: 2845824 - RNA, 16 nt, Mycobacterium avium subsp. paratuberculosis
gcccguugcccgauca

SEQ ID NO: 2845825 - RNA, 19 nt, Mycobacterium avium subsp. paratuberculosis
gcccguugcugcguucggc

SEQ ID NO: 2845826 - RNA, 22 nt, Mycobacterium avium subsp. paratuberculosis
gcccguugcugcguucggcgau

SEQ ID NO: 2845827 - RNA, 20 nt, Mycobacterium avium subsp. paratuberculosis
gcccguugucgagcaccgcg

SEQ ID NO: 2845828 - RNA, 22 nt, Mycobacterium avium subsp. paratuberculosis
gcccguugucgagcaccgcgau

SEQ ID NO: 2845829 - RNA, 13 nt, Mycobacterium avium subsp. paratuberculosis
gcccguuguggcg

SEQ ID NO: 2845830 - RNA, 22 nt, Mycobacterium avium subsp. paratuberculosis
gcccguuguggcggccagcgag

SEQ ID NO: 2845831 - RNA, 17 nt, Mycobacterium avium subsp. paratuberculosis
gcccuaacgugcccggc

SEQ ID NO: 2845832 - RNA, 14 nt, Mycobacterium avium subsp. paratuberculosis
gcccuacccgucca

SEQ ID NO: 2845833 - RNA, 14 nt, Mycobacterium avium subsp. paratuberculosis
gcccuagcgguggc

SEQ ID NO: 2845834 - RNA, 22 nt, Mycobacterium avium subsp. paratuberculosis
gcccugcagguagguggccagc

SEQ ID NO: 2845835 - RNA, 13 nt, Mycobacterium avium subsp. paratuberculosis
gcccugccacagc

SEQ ID NO: 2845836 - RNA, 17 nt, Mycobacterium avium subsp. paratuberculosis
gcccugccacagcgaca

SEQ ID NO: 2845837 - RNA, 15 nt, Mycobacterium avium subsp. paratuberculosis
gcccugcccgucggg

SEQ ID NO: 2845838 - RNA, 16 nt, Mycobacterium avium subsp. paratuberculosis
gcccugcccgucgggc

SEQ ID NO: 2845839 - RNA, 20 nt, Mycobacterium avium subsp. paratuberculosis
gcccugcccgucgggcgcgg

SEQ ID NO: 2845840 - RNA, 16 nt, Mycobacterium avium subsp. paratuberculosis
gcccugcgagcccggg

SEQ ID NO: 2845841 - RNA, 14 nt, Mycobacterium avium subsp. paratuberculosis
gcccugcgccagca

SEQ ID NO: 2845842 - RNA, 16 nt, Mycobacterium avium subsp. paratuberculosis
gcccugcgccagcagc

SEQ ID NO: 2845843 - RNA, 24 nt, Mycobacterium avium subsp. paratuberculosis
gcccugcgccagcagcagcgcggc

SEQ ID NO: 2845844 - RNA, 14 nt, Mycobacterium avium subsp. paratuberculosis
gcccugcgcggccu

SEQ ID NO: 2845845 - RNA, 18 nt, Mycobacterium avium subsp. paratuberculosis
gcccugcgcggccugcag

SEQ ID NO: 2845846 - RNA, 18 nt, Mycobacterium avium subsp. paratuberculosis
gcccugcucggccagcgg

SEQ ID NO: 2845847 - RNA, 14 nt, Mycobacterium avium subsp. paratuberculosis
gcccugcucgguga

SEQ ID NO: 2845848 - RNA, 16 nt, Mycobacterium avium subsp. paratuberculosis
gcccugcucggugaug

SEQ ID NO: 2845849 - RNA, 17 nt, Mycobacterium avium subsp. paratuberculosis
gcccugcucggugaugc

SEQ ID NO: 2845850 - RNA, 18 nt, Mycobacterium avium subsp. paratuberculosis
gcccugcucggugaugcc

SEQ ID NO: 2845851 - RNA, 20 nt, Mycobacterium avium subsp. paratuberculosis
gcccugcucggugaugccga

SEQ ID NO: 2845852 - RNA, 14 nt, Mycobacterium avium subsp. paratuberculosis
gcccugcucgucgu

SEQ ID NO: 2845853 - RNA, 14 nt, Mycobacterium avium subsp. paratuberculosis
gcccugcucuucgc

SEQ ID NO: 2845854 - RNA, 17 nt, Mycobacterium avium subsp. paratuberculosis
gcccugcucuucgcgcg

SEQ ID NO: 2845855 - RNA, 17 nt, Mycobacterium avium subsp. paratuberculosis
gcccugcugggagcggc

SEQ ID NO: 2845856 - RNA, 16 nt, Mycobacterium avium subsp. paratuberculosis
gcccugcuugaacagc

SEQ ID NO: 2845857 - RNA, 17 nt, Mycobacterium avium subsp. paratuberculosis
gcccugcuugaacagca

SEQ ID NO: 2845858 - RNA, 18 nt, Mycobacterium avium subsp. paratuberculosis
gcccugcuugaacagcac

SEQ ID NO: 2845859 - RNA, 17 nt, Mycobacterium avium subsp. paratuberculosis
gcccugcuugaccgcga

SEQ ID NO: 2845860 - RNA, 18 nt, Mycobacterium avium subsp. paratuberculosis
gcccuggaaggcgaucac

SEQ ID NO: 2845861 - RNA, 22 nt, Mycobacterium avium subsp. paratuberculosis
gcccuggacgaguggucggccg

SEQ ID NO: 2845862 - RNA, 23 nt, Mycobacterium avium subsp. paratuberculosis
gcccuggauauccagccuugcag

SEQ ID NO: 2845863 - RNA, 18 nt, Mycobacterium avium subsp. paratuberculosis
gcccuggaugucacgguc

SEQ ID NO: 2845864 - RNA, 20 nt, Mycobacterium avium subsp. paratuberculosis
gcccuggcauccgucggccu

SEQ ID NO: 2845865 - RNA, 20 nt, Mycobacterium avium subsp. paratuberculosis
gcccuggccgccggccgcgc

SEQ ID NO: 2845866 - RNA, 15 nt, Mycobacterium avium subsp. paratuberculosis
gcccuggcgggcggc

SEQ ID NO: 2845867 - RNA, 16 nt, Mycobacterium avium subsp. paratuberculosis
gcccuggcgggcggcc

SEQ ID NO: 2845868 - RNA, 19 nt, Mycobacterium avium subsp. paratuberculosis
gcccuggcgggcggcccgc

SEQ ID NO: 2845869 - RNA, 18 nt, Mycobacterium avium subsp. paratuberculosis
gcccuggcuguagcgguc

SEQ ID NO: 2845870 - RNA, 21 nt, Mycobacterium avium subsp. paratuberculosis
gcccugggaggaagugcacgc

SEQ ID NO: 2845871 - RNA, 19 nt, Mycobacterium avium subsp. paratuberculosis
gcccugguacgcgccgucg

SEQ ID NO: 2845872 - RNA, 23 nt, Mycobacterium avium subsp. paratuberculosis
gcccugguaggccuggaaccggg

SEQ ID NO: 2845873 - RNA, 15 nt, Mycobacterium avium subsp. paratuberculosis
gcccuggucggccag

SEQ ID NO: 2845874 - RNA, 18 nt, Mycobacterium avium subsp. paratuberculosis
gcccuggugcaacaccga

SEQ ID NO: 2845875 - RNA, 21 nt, Mycobacterium avium subsp. paratuberculosis
gcccugguugagcaccgcgau

SEQ ID NO: 2845876 - RNA, 14 nt, Mycobacterium avium subsp. paratuberculosis
gcccugugaggcgu

SEQ ID NO: 2845877 - RNA, 18 nt, Mycobacterium avium subsp. paratuberculosis
gcccuguucgccgucgcg

SEQ ID NO: 2845878 - RNA, 17 nt, Mycobacterium avium subsp. paratuberculosis
gcccuucaccucggccu

SEQ ID NO: 2845879 - RNA, 13 nt, Mycobacterium avium subsp. paratuberculosis
gcccuuccagcac

SEQ ID NO: 2845880 - RNA, 14 nt, Mycobacterium avium subsp. paratuberculosis
gcccuuccagcacc

SEQ ID NO: 2845881 - RNA, 15 nt, Mycobacterium avium subsp. paratuberculosis
gcccuuccagcaccc

SEQ ID NO: 2845882 - RNA, 17 nt, Mycobacterium avium subsp. paratuberculosis
gcccuuccccggcggcc

SEQ ID NO: 2845883 - RNA, 12 nt, Mycobacterium avium subsp. paratuberculosis
gcccuucgaccu

SEQ ID NO: 2845884 - RNA, 16 nt, Mycobacterium avium subsp. paratuberculosis
gcccuucgaccucgag

SEQ ID NO: 2845885 - RNA, 16 nt, Mycobacterium avium subsp. paratuberculosis
gcccuucgcggugugc

SEQ ID NO: 2845886 - RNA, 13 nt, Mycobacterium avium subsp. paratuberculosis
gcccuucggcgcc

SEQ ID NO: 2845887 - RNA, 15 nt, Mycobacterium avium subsp. paratuberculosis
gcccuugaagcgcag

SEQ ID NO: 2845888 - RNA, 14 nt, Mycobacterium avium subsp. paratuberculosis
gcccuugaccgccu

SEQ ID NO: 2845889 - RNA, 18 nt, Mycobacterium avium subsp. paratuberculosis
gcccuugaccgccugcuu

SEQ ID NO: 2845890 - RNA, 17 nt, Mycobacterium avium subsp. paratuberculosis
gcccuugagcacgguga

SEQ ID NO: 2845891 - RNA, 22 nt, Mycobacterium avium subsp. paratuberculosis
gcccuugagcuucccggcgguc

SEQ ID NO: 2845892 - RNA, 21 nt, Mycobacterium avium subsp. paratuberculosis
gcccuugaucgucuugccgaa

SEQ ID NO: 2845893 - RNA, 18 nt, Mycobacterium avium subsp. paratuberculosis
gcccuugcagcacaccgg

SEQ ID NO: 2845894 - RNA, 14 nt, Mycobacterium avium subsp. paratuberculosis
gcccuugccccacc

SEQ ID NO: 2845895 - RNA, 13 nt, Mycobacterium avium subsp. paratuberculosis
gcccuugcucgcg

SEQ ID NO: 2845896 - RNA, 14 nt, Mycobacterium avium subsp. paratuberculosis
gcccuugcucgcgg

SEQ ID NO: 2845897 - RNA, 17 nt, Mycobacterium avium subsp. paratuberculosis
gcccuugcucgcggcgu

SEQ ID NO: 2845898 - RNA, 20 nt, Mycobacterium avium subsp. paratuberculosis
gcccuugcucgcggcguagg

SEQ ID NO: 2845899 - RNA, 14 nt, Mycobacterium avium subsp. paratuberculosis
gcccuuggccagca

SEQ ID NO: 2845900 - RNA, 18 nt, Mycobacterium avium subsp. paratuberculosis
gcccuuggcgaagcguuu

SEQ ID NO: 2845901 - RNA, 17 nt, Mycobacterium avium subsp. paratuberculosis
gcccuuggcgcccagcg

SEQ ID NO: 2845902 - RNA, 18 nt, Mycobacterium avium subsp. paratuberculosis
gcccuuggcgcccagcgu

SEQ ID NO: 2845903 - RNA, 20 nt, Mycobacterium avium subsp. paratuberculosis
gcccuuggcggccacgacgg

SEQ ID NO: 2845904 - RNA, 21 nt, Mycobacterium avium subsp. paratuberculosis
gcccuuggcggccacgacggc

SEQ ID NO: 2845905 - RNA, 15 nt, Mycobacterium avium subsp. paratuberculosis
gcccuuguccucgag

SEQ ID NO: 2845906 - RNA, 16 nt, Mycobacterium avium subsp. paratuberculosis
gcccuuguugauggug

SEQ ID NO: 2845907 - RNA, 19 nt, Mycobacterium avium subsp. paratuberculosis
gcccuuuacccggacgaug

SEQ ID NO: 2845908 - RNA, 20 nt, Mycobacterium avium subsp. paratuberculosis
gccgaaaaaccugcggugcc

SEQ ID NO: 2845909 - RNA, 16 nt, Mycobacterium avium subsp. paratuberculosis
gccgaaaaacgcgacg

SEQ ID NO: 2845910 - RNA, 14 nt, Mycobacterium avium subsp. paratuberculosis
gccgaaacaccggc

SEQ ID NO: 2845911 - RNA, 22 nt, Mycobacterium avium subsp. paratuberculosis
gccgaaacaccggcuucgggau

SEQ ID NO: 2845912 - RNA, 20 nt, Mycobacterium avium subsp. paratuberculosis
gccgaaacggugcccgcagc

SEQ ID NO: 2845913 - RNA, 22 nt, Mycobacterium avium subsp. paratuberculosis
gccgaaacggugcccgcagcau

SEQ ID NO: 2845914 - RNA, 23 nt, Mycobacterium avium subsp. paratuberculosis
gccgaaacggugcccgcagcauc

SEQ ID NO: 2845915 - RNA, 22 nt, Mycobacterium avium subsp. paratuberculosis
gccgaaagccuccgcgaucagc

SEQ ID NO: 2845916 - RNA, 23 nt, Mycobacterium avium subsp. paratuberculosis
gccgaaagguuuucccggccgcc

SEQ ID NO: 2845917 - RNA, 21 nt, Mycobacterium avium subsp. paratuberculosis
gccgaaaucaacgcgccgaac

SEQ ID NO: 2845918 - RNA, 20 nt, Mycobacterium avium subsp. paratuberculosis
gccgaacaacagggccgcgc

SEQ ID NO: 2845919 - RNA, 22 nt, Mycobacterium avium subsp. paratuberculosis
gccgaagauggccagcgcggcg

SEQ ID NO: 2845920 - RNA, 18 nt, Mycobacterium avium subsp. paratuberculosis
gccgaagaugucggugcc

SEQ ID NO: 2845921 - RNA, 19 nt, Mycobacterium avium subsp. paratuberculosis
gccgaagaugucggugccg

SEQ ID NO: 2845922 - RNA, 15 nt, Mycobacterium avium subsp. paratuberculosis
gccgaagcccgcagc

SEQ ID NO: 2845923 - RNA, 19 nt, Mycobacterium avium subsp. paratuberculosis
gccgaagcccgcagcgaac

SEQ ID NO: 2845924 - RNA, 14 nt, Mycobacterium avium subsp. paratuberculosis
gccgaagccgccgu

SEQ ID NO: 2845925 - RNA, 16 nt, Mycobacterium avium subsp. paratuberculosis
gccgaagccgccgucc

SEQ ID NO: 2845926 - RNA, 22 nt, Mycobacterium avium subsp. paratuberculosis
gccgaagccgccguccccgcgc

SEQ ID NO: 2845927 - RNA, 16 nt, Mycobacterium avium subsp. paratuberculosis
gccgaagccggcgcag

SEQ ID NO: 2845928 - RNA, 16 nt, Mycobacterium avium subsp. paratuberculosis
gccgaagccggcucga

SEQ ID NO: 2845929 - RNA, 14 nt, Mycobacterium avium subsp. paratuberculosis
gccgaagccgucga

SEQ ID NO: 2845930 - RNA, 17 nt, Mycobacterium avium subsp. paratuberculosis
gccgaagccguugacgg

SEQ ID NO: 2845931 - RNA, 14 nt, Mycobacterium avium subsp. paratuberculosis
gccgaagcgccacg

SEQ ID NO: 2845932 - RNA, 14 nt, Mycobacterium avium subsp. paratuberculosis
gccgaagcgccgca

SEQ ID NO: 2845933 - RNA, 17 nt, Mycobacterium avium subsp. paratuberculosis
gccgaagcggcgcacgc

SEQ ID NO: 2845934 - RNA, 15 nt, Mycobacterium avium subsp. paratuberculosis
gccgaagcgggucgg

SEQ ID NO: 2845935 - RNA, 20 nt, Mycobacterium avium subsp. paratuberculosis
gccgaagcgggucggggagc

SEQ ID NO: 2845936 - RNA, 15 nt, Mycobacterium avium subsp. paratuberculosis
gccgaagcguuccgc

SEQ ID NO: 2845937 - RNA, 17 nt, Mycobacterium avium subsp. paratuberculosis
gccgaagcguuccgccg

SEQ ID NO: 2845938 - RNA, 20 nt, Mycobacterium avium subsp. paratuberculosis
gccgaagcguuccgccgucc

SEQ ID NO: 2845939 - RNA, 14 nt, Mycobacterium avium subsp. paratuberculosis
gccgaaggcggcgc

SEQ ID NO: 2845940 - RNA, 16 nt, Mycobacterium avium subsp. paratuberculosis
gccgaaggcggcgccg

SEQ ID NO: 2845941 - RNA, 22 nt, Mycobacterium avium subsp. paratuberculosis
gccgaaggcggcgccggccggg

SEQ ID NO: 2845942 - RNA, 12 nt, Mycobacterium avium subsp. paratuberculosis
gccgaaggcuuu

SEQ ID NO: 2845943 - RNA, 22 nt, Mycobacterium avium subsp. paratuberculosis
gccgaaguauccggucagcgcc

SEQ ID NO: 2845944 - RNA, 23 nt, Mycobacterium avium subsp. paratuberculosis
gccgaaguauccggucagcgcca

SEQ ID NO: 2845945 - RNA, 14 nt, Mycobacterium avium subsp. paratuberculosis
gccgaagucgcuga

SEQ ID NO: 2845946 - RNA, 20 nt, Mycobacterium avium subsp. paratuberculosis
gccgaagugcucgaacgcgc

SEQ ID NO: 2845947 - RNA, 17 nt, Mycobacterium avium subsp. paratuberculosis
gccgaaguuccagccga

SEQ ID NO: 2845948 - RNA, 20 nt, Mycobacterium avium subsp. paratuberculosis
gccgaaguuccagccgaucg

SEQ ID NO: 2845949 - RNA, 22 nt, Mycobacterium avium subsp. paratuberculosis
gccgaaguuccagccgaucgcg

SEQ ID NO: 2845950 - RNA, 13 nt, Mycobacterium avium subsp. paratuberculosis
gccgaaguugucg

SEQ ID NO: 2845951 - RNA, 15 nt, Mycobacterium avium subsp. paratuberculosis
gccgaauccggccgg

SEQ ID NO: 2845952 - RNA, 16 nt, Mycobacterium avium subsp. paratuberculosis
gccgaauccggccgga

SEQ ID NO: 2845953 - RNA, 23 nt, Mycobacterium avium subsp. paratuberculosis
gccgaauccggccggagaccgcc

SEQ ID NO: 2845954 - RNA, 14 nt, Mycobacterium avium subsp. paratuberculosis
gccgaauccgggca

SEQ ID NO: 2845955 - RNA, 14 nt, Mycobacterium avium subsp. paratuberculosis
gccgaaugccacgc

SEQ ID NO: 2845956 - RNA, 23 nt, Mycobacterium avium subsp. paratuberculosis
gccgaauugcuuacgcaucgccg

SEQ ID NO: 2845957 - RNA, 17 nt, Mycobacterium avium subsp. paratuberculosis
gccgaauuguucggcca

SEQ ID NO: 2845958 - RNA, 18 nt, Mycobacterium avium subsp. paratuberculosis
gccgaauuguucggccac

SEQ ID NO: 2845959 - RNA, 14 nt, Mycobacterium avium subsp. paratuberculosis
gccgacaacauccg

SEQ ID NO: 2845960 - RNA, 15 nt, Mycobacterium avium subsp. paratuberculosis
gccgacaacauccgc

SEQ ID NO: 2845961 - RNA, 19 nt, Mycobacterium avium subsp. paratuberculosis
gccgacaacgacagcaccc

SEQ ID NO: 2845962 - RNA, 21 nt, Mycobacterium avium subsp. paratuberculosis
gccgacaacgacagcacccag

SEQ ID NO: 2845963 - RNA, 16 nt, Mycobacterium avium subsp. paratuberculosis
gccgacaccaccacga

SEQ ID NO: 2845964 - RNA, 13 nt, Mycobacterium avium subsp. paratuberculosis
gccgacaccaccg

SEQ ID NO: 2845965 - RNA, 15 nt, Mycobacterium avium subsp. paratuberculosis
gccgacaccaccgcg

SEQ ID NO: 2845966 - RNA, 16 nt, Mycobacterium avium subsp. paratuberculosis
gccgacaccaccgcgc

SEQ ID NO: 2845967 - RNA, 17 nt, Mycobacterium avium subsp. paratuberculosis
gccgacaccaccgcgcg

SEQ ID NO: 2845968 - RNA, 18 nt, Mycobacterium avium subsp. paratuberculosis
gccgacaccaccgcgcgc

SEQ ID NO: 2845969 - RNA, 12 nt, Mycobacterium avium subsp. paratuberculosis
gccgacaccagc

SEQ ID NO: 2845970 - RNA, 14 nt, Mycobacterium avium subsp. paratuberculosis
gccgacaccagcgc

SEQ ID NO: 2845971 - RNA, 15 nt, Mycobacterium avium subsp. paratuberculosis
gccgacaccagcgcg

SEQ ID NO: 2845972 - RNA, 12 nt, Mycobacterium avium subsp. paratuberculosis
gccgacacccca

SEQ ID NO: 2845973 - RNA, 14 nt, Mycobacterium avium subsp. paratuberculosis
gccgacaccccaca

SEQ ID NO: 2845974 - RNA, 20 nt, Mycobacterium avium subsp. paratuberculosis
gccgacaccccacaccgucc

SEQ ID NO: 2845975 - RNA, 23 nt, Mycobacterium avium subsp. paratuberculosis
gccgacaccccacaccguccgac

SEQ ID NO: 2845976 - RNA, 18 nt, Mycobacterium avium subsp. paratuberculosis
gccgacaccccgaugccg

SEQ ID NO: 2845977 - RNA, 21 nt, Mycobacterium avium subsp. paratuberculosis
gccgacaccgcauuugccgac

SEQ ID NO: 2845978 - RNA, 14 nt, Mycobacterium avium subsp. paratuberculosis
gccgacaccggguc

SEQ ID NO: 2845979 - RNA, 15 nt, Mycobacterium avium subsp. paratuberculosis
gccgacaccgucgcc

SEQ ID NO: 2845980 - RNA, 18 nt, Mycobacterium avium subsp. paratuberculosis
gccgacacguaggccgcc

SEQ ID NO: 2845981 - RNA, 17 nt, Mycobacterium avium subsp. paratuberculosis
gccgacagaugcggcac

SEQ ID NO: 2845982 - RNA, 19 nt, Mycobacterium avium subsp. paratuberculosis
gccgacagaugcggcacca

SEQ ID NO: 2845983 - RNA, 21 nt, Mycobacterium avium subsp. paratuberculosis
gccgacagaugcggcaccagc

SEQ ID NO: 2845984 - RNA, 22 nt, Mycobacterium avium subsp. paratuberculosis
gccgacagaugcggcaccagcc

SEQ ID NO: 2845985 - RNA, 21 nt, Mycobacterium avium subsp. paratuberculosis
gccgacagcaccucgcccugc

SEQ ID NO: 2845986 - RNA, 13 nt, Mycobacterium avium subsp. paratuberculosis
gccgacagcacgc

SEQ ID NO: 2845987 - RNA, 15 nt, Mycobacterium avium subsp. paratuberculosis
gccgacagcacgccg

SEQ ID NO: 2845988 - RNA, 17 nt, Mycobacterium avium subsp. paratuberculosis
gccgacagcacgccggg

SEQ ID NO: 2845989 - RNA, 22 nt, Mycobacterium avium subsp. paratuberculosis
gccgacagcacgccgggcaugc

SEQ ID NO: 2845990 - RNA, 13 nt, Mycobacterium avium subsp. paratuberculosis
gccgacagcagcu

SEQ ID NO: 2845991 - RNA, 14 nt, Mycobacterium avium subsp. paratuberculosis
gccgacagcagcuc

SEQ ID NO: 2845992 - RNA, 12 nt, Mycobacterium avium subsp. paratuberculosis
gccgacagcgac

SEQ ID NO: 2845993 - RNA, 23 nt, Mycobacterium avium subsp. paratuberculosis
gccgacagggugccaaggucgcc

SEQ ID NO: 2845994 - RNA, 22 nt, Mycobacterium avium subsp. paratuberculosis
gccgacagguagcaggcgcgca

SEQ ID NO: 2845995 - RNA, 13 nt, Mycobacterium avium subsp. paratuberculosis
gccgacagucgcg

SEQ ID NO: 2845996 - RNA, 15 nt, Mycobacterium avium subsp. paratuberculosis
gccgacagucgcggg

SEQ ID NO: 2845997 - RNA, 20 nt, Mycobacterium avium subsp. paratuberculosis
gccgacagucgcgggcagcc

SEQ ID NO: 2845998 - RNA, 24 nt, Mycobacterium avium subsp. paratuberculosis
gccgacagucgcgggcagccggcg

SEQ ID NO: 2845999 - RNA, 17 nt, Mycobacterium avium subsp. paratuberculosis
gccgacagucgcgggcg

SEQ ID NO: 2846000 - RNA, 21 nt, Mycobacterium avium subsp. paratuberculosis
gccgacagucgcgggcgagcc

SEQ ID NO: 2846001 - RNA, 16 nt, Mycobacterium avium subsp. paratuberculosis
gccgacauccggguag

SEQ ID NO: 2846002 - RNA, 16 nt, Mycobacterium avium subsp. paratuberculosis
gccgacaucgcccggu

SEQ ID NO: 2846003 - RNA, 14 nt, Mycobacterium avium subsp. paratuberculosis
gccgacaucgcggc

SEQ ID NO: 2846004 - RNA, 20 nt, Mycobacterium avium subsp. paratuberculosis
gccgaccggucucgaccgcg

SEQ ID NO: 2846005 - RNA, 21 nt, Mycobacterium avium subsp. paratuberculosis
gccgaccggucucgaccgcgg

SEQ ID NO: 2846006 - RNA, 23 nt, Mycobacterium avium subsp. paratuberculosis
gccgaccggucucgaccgcggcg

SEQ ID NO: 2846007 - RNA, 13 nt, Mycobacterium avium subsp. paratuberculosis
gccgaccucggcc

SEQ ID NO: 2846008 - RNA, 15 nt, Mycobacterium avium subsp. paratuberculosis
gccgaccucggccag

SEQ ID NO: 2846009 - RNA, 16 nt, Mycobacterium avium subsp. paratuberculosis
gccgaccucggccagc

SEQ ID NO: 2846010 - RNA, 17 nt, Mycobacterium avium subsp. paratuberculosis
gccgaccucggccagcg

SEQ ID NO: 2846011 - RNA, 16 nt, Mycobacterium avium subsp. paratuberculosis
gccgaccucggcgacg

SEQ ID NO: 2846012 - RNA, 15 nt, Mycobacterium avium subsp. paratuberculosis
gccgaccucgucggc

SEQ ID NO: 2846013 - RNA, 16 nt, Mycobacterium avium subsp. paratuberculosis
gccgaccucgucggcg

SEQ ID NO: 2846014 - RNA, 19 nt, Mycobacterium avium subsp. paratuberculosis
gccgaccucgucggcggug

SEQ ID NO: 2846015 - RNA, 20 nt, Mycobacterium avium subsp. paratuberculosis
gccgaccucgucggcggugc

SEQ ID NO: 2846016 - RNA, 21 nt, Mycobacterium avium subsp. paratuberculosis
gccgaccucgucggcggugcc

SEQ ID NO: 2846017 - RNA, 22 nt, Mycobacterium avium subsp. paratuberculosis
gccgaccucgucggcggugccg

SEQ ID NO: 2846018 - RNA, 16 nt, Mycobacterium avium subsp. paratuberculosis
gccgaccugcacgcug

SEQ ID NO: 2846019 - RNA, 13 nt, Mycobacterium avium subsp. paratuberculosis
gccgaccugcgcg

SEQ ID NO: 2846020 - RNA, 14 nt, Mycobacterium avium subsp. paratuberculosis
gccgaccugcgcga

SEQ ID NO: 2846021 - RNA, 16 nt, Mycobacterium avium subsp. paratuberculosis
gccgaccugcgcgacg

SEQ ID NO: 2846022 - RNA, 21 nt, Mycobacterium avium subsp. paratuberculosis
gccgaccugcgcgacggcgcu

SEQ ID NO: 2846023 - RNA, 17 nt, Mycobacterium avium subsp. paratuberculosis
gccgaccuggcggccgg

SEQ ID NO: 2846024 - RNA, 14 nt, Mycobacterium avium subsp. paratuberculosis
gccgaccugggcgg

SEQ ID NO: 2846025 - RNA, 19 nt, Mycobacterium avium subsp. paratuberculosis
gccgaccugggcggccacc

SEQ ID NO: 2846026 - RNA, 23 nt, Mycobacterium avium subsp. paratuberculosis
gccgaccugggcggccaccgcgc

SEQ ID NO: 2846027 - RNA, 15 nt, Mycobacterium avium subsp. paratuberculosis
gccgaccuggucgcc

SEQ ID NO: 2846028 - RNA, 17 nt, Mycobacterium avium subsp. paratuberculosis
gccgaccuggucgccga

SEQ ID NO: 2846029 - RNA, 20 nt, Mycobacterium avium subsp. paratuberculosis
gccgaccuguagggcgagcu

SEQ ID NO: 2846030 - RNA, 18 nt, Mycobacterium avium subsp. paratuberculosis
gccgaccuugacccaggc

SEQ ID NO: 2846031 - RNA, 20 nt, Mycobacterium avium subsp. paratuberculosis
gccgaccuuggcguuguuga

SEQ ID NO: 2846032 - RNA, 16 nt, Mycobacterium avium subsp. paratuberculosis
gccgacgaacaagggc

SEQ ID NO: 2846033 - RNA, 19 nt, Mycobacterium avium subsp. paratuberculosis
gccgacgaagaucccgcug

SEQ ID NO: 2846034 - RNA, 21 nt, Mycobacterium avium subsp. paratuberculosis
gccgacgaagaucccgcuggc

SEQ ID NO: 2846035 - RNA, 22 nt, Mycobacterium avium subsp. paratuberculosis
gccgacgaagaucccgcuggcc

SEQ ID NO: 2846036 - RNA, 18 nt, Mycobacterium avium subsp. paratuberculosis
gccgacgaagaugcgccc

SEQ ID NO: 2846037 - RNA, 20 nt, Mycobacterium avium subsp. paratuberculosis
gccgacgaagaugcgcccgg

SEQ ID NO: 2846038 - RNA, 21 nt, Mycobacterium avium subsp. paratuberculosis
gccgacgaagaugcgcccggu

SEQ ID NO: 2846039 - RNA, 22 nt, Mycobacterium avium subsp. paratuberculosis
gccgacgaagaugcgcccgguc

SEQ ID NO: 2846040 - RNA, 17 nt, Mycobacterium avium subsp. paratuberculosis
gccgacgaccaguucgc

SEQ ID NO: 2846041 - RNA, 20 nt, Mycobacterium avium subsp. paratuberculosis
gccgacgaccucgucgucga

SEQ ID NO: 2846042 - RNA, 21 nt, Mycobacterium avium subsp. paratuberculosis
gccgacgacggcgaacgucga

SEQ ID NO: 2846043 - RNA, 17 nt, Mycobacterium avium subsp. paratuberculosis
gccgacgagcucgccgc

SEQ ID NO: 2846044 - RNA, 23 nt, Mycobacterium avium subsp. paratuberculosis
gccgacgauacgugcucccgccg

SEQ ID NO: 2846045 - RNA, 20 nt, Mycobacterium avium subsp. paratuberculosis
gccgacgaucccggcgagca

SEQ ID NO: 2846046 - RNA, 22 nt, Mycobacterium avium subsp. paratuberculosis
gccgacgaucccggcgagcacg

SEQ ID NO: 2846047 - RNA, 23 nt, Mycobacterium avium subsp. paratuberculosis
gccgacgaucccggcgagcacgc

SEQ ID NO: 2846048 - RNA, 14 nt, Mycobacterium avium subsp. paratuberculosis
gccgacgauccgcg

SEQ ID NO: 2846049 - RNA, 15 nt, Mycobacterium avium subsp. paratuberculosis
gccgacgauccgcgc

SEQ ID NO: 2846050 - RNA, 17 nt, Mycobacterium avium subsp. paratuberculosis
gccgacgauccgcgccc

SEQ ID NO: 2846051 - RNA, 18 nt, Mycobacterium avium subsp. paratuberculosis
gccgacgauccgcgccgc

SEQ ID NO: 2846052 - RNA, 19 nt, Mycobacterium avium subsp. paratuberculosis
gccgacgauccgcgccgcg

SEQ ID NO: 2846053 - RNA, 17 nt, Mycobacterium avium subsp. paratuberculosis
gccgacgauccgggcgc

SEQ ID NO: 2846054 - RNA, 18 nt, Mycobacterium avium subsp. paratuberculosis
gccgacgauccgggcgcc

SEQ ID NO: 2846055 - RNA, 20 nt, Mycobacterium avium subsp. paratuberculosis
gccgacgaugagggccagca

SEQ ID NO: 2846056 - RNA, 22 nt, Mycobacterium avium subsp. paratuberculosis
gccgacgaugagggccagcagu

SEQ ID NO: 2846057 - RNA, 23 nt, Mycobacterium avium subsp. paratuberculosis
gccgacgaugucgaaacccagga

SEQ ID NO: 2846058 - RNA, 16 nt, Mycobacterium avium subsp. paratuberculosis
gccgacgaugucggcu

SEQ ID NO: 2846059 - RNA, 20 nt, Mycobacterium avium subsp. paratuberculosis
gccgacgaugucggcuucgu

SEQ ID NO: 2846060 - RNA, 12 nt, Mycobacterium avium subsp. paratuberculosis
gccgacgcaugu

SEQ ID NO: 2846061 - RNA, 19 nt, Mycobacterium avium subsp. paratuberculosis
gccgacgcauguccgccgu

SEQ ID NO: 2846062 - RNA, 19 nt, Mycobacterium avium subsp. paratuberculosis
gccgacgcauuucccgagu

SEQ ID NO: 2846063 - RNA, 14 nt, Mycobacterium avium subsp. paratuberculosis
gccgacgccagcac

SEQ ID NO: 2846064 - RNA, 15 nt, Mycobacterium avium subsp. paratuberculosis
gccgacgccagcacg

SEQ ID NO: 2846065 - RNA, 16 nt, Mycobacterium avium subsp. paratuberculosis
gccgacgccagcacgu

SEQ ID NO: 2846066 - RNA, 18 nt, Mycobacterium avium subsp. paratuberculosis
gccgacgccagcacgugg

SEQ ID NO: 2846067 - RNA, 21 nt, Mycobacterium avium subsp. paratuberculosis
gccgacgccagcacguggccg

SEQ ID NO: 2846068 - RNA, 16 nt, Mycobacterium avium subsp. paratuberculosis
gccgacgcccacagcg

SEQ ID NO: 2846069 - RNA, 19 nt, Mycobacterium avium subsp. paratuberculosis
gccgacgcccacagcgcca

SEQ ID NO: 2846070 - RNA, 20 nt, Mycobacterium avium subsp. paratuberculosis
gccgacgcccacagcgccag

SEQ ID NO: 2846071 - RNA, 13 nt, Mycobacterium avium subsp. paratuberculosis
gccgacgcccagc

SEQ ID NO: 2846072 - RNA, 14 nt, Mycobacterium avium subsp. paratuberculosis
gccgacgcccagca

SEQ ID NO: 2846073 - RNA, 15 nt, Mycobacterium avium subsp. paratuberculosis
gccgacgcccagcac

SEQ ID NO: 2846074 - RNA, 17 nt, Mycobacterium avium subsp. paratuberculosis
gccgacgcccagcaccg

SEQ ID NO: 2846075 - RNA, 16 nt, Mycobacterium avium subsp. paratuberculosis
gccgacgcccagcgcg

SEQ ID NO: 2846076 - RNA, 17 nt, Mycobacterium avium subsp. paratuberculosis
gccgacgcccagcgcgg

SEQ ID NO: 2846077 - RNA, 19 nt, Mycobacterium avium subsp. paratuberculosis
gccgacgcccagcgcggcg

SEQ ID NO: 2846078 - RNA, 17 nt, Mycobacterium avium subsp. paratuberculosis
gccgacgcccaggcuca

SEQ ID NO: 2846079 - RNA, 20 nt, Mycobacterium avium subsp. paratuberculosis
gccgacgccgaagaucagcg

SEQ ID NO: 2846080 - RNA, 13 nt, Mycobacterium avium subsp. paratuberculosis
gccgacgccggcc

SEQ ID NO: 2846081 - RNA, 14 nt, Mycobacterium avium subsp. paratuberculosis
gccgacgccggcca

SEQ ID NO: 2846082 - RNA, 17 nt, Mycobacterium avium subsp. paratuberculosis
gccgacgccggccacca

SEQ ID NO: 2846083 - RNA, 20 nt, Mycobacterium avium subsp. paratuberculosis
gccgacgccggccaccaaca

SEQ ID NO: 2846084 - RNA, 14 nt, Mycobacterium avium subsp. paratuberculosis
gccgacgccgucga

SEQ ID NO: 2846085 - RNA, 12 nt, Mycobacterium avium subsp. paratuberculosis
gccgacgccguu

SEQ ID NO: 2846086 - RNA, 14 nt, Mycobacterium avium subsp. paratuberculosis
gccgacgccugcgc

SEQ ID NO: 2846087 - RNA, 15 nt, Mycobacterium avium subsp. paratuberculosis
gccgacgccugcgcg

SEQ ID NO: 2846088 - RNA, 21 nt, Mycobacterium avium subsp. paratuberculosis
gccgagagcucuugcgcccca

SEQ ID NO: 2846089 - RNA, 22 nt, Mycobacterium avium subsp. paratuberculosis
gccgagagcucuugcgccccag

SEQ ID NO: 2846090 - RNA, 16 nt, Mycobacterium avium subsp. paratuberculosis
gccgagauccaccgcg

SEQ ID NO: 2846091 - RNA, 19 nt, Mycobacterium avium subsp. paratuberculosis
gccgagauccaccgcgcgg

SEQ ID NO: 2846092 - RNA, 15 nt, Mycobacterium avium subsp. paratuberculosis
gccgagaucgcggug

SEQ ID NO: 2846093 - RNA, 17 nt, Mycobacterium avium subsp. paratuberculosis
gccgagauggcaacacg

SEQ ID NO: 2846094 - RNA, 23 nt, Mycobacterium avium subsp. paratuberculosis
gccgagauuggacgacaccacgg

SEQ ID NO: 2846095 - RNA, 16 nt, Mycobacterium avium subsp. paratuberculosis
gccgagcaacagcccg

SEQ ID NO: 2846096 - RNA, 23 nt, Mycobacterium avium subsp. paratuberculosis
gccgagcaacagcccgaccgucg

SEQ ID NO: 2846097 - RNA, 15 nt, Mycobacterium avium subsp. paratuberculosis
gccgagcaaccggga

SEQ ID NO: 2846098 - RNA, 11 nt, Mycobacterium avium subsp. paratuberculosis
gccgagcacac

SEQ ID NO: 2846099 - RNA, 15 nt, Mycobacterium avium subsp. paratuberculosis
gccgagcaccaggcg

SEQ ID NO: 2846100 - RNA, 17 nt, Mycobacterium avium subsp. paratuberculosis
gccgagcaccaggcgca

SEQ ID NO: 2846101 - RNA, 20 nt, Mycobacterium avium subsp. paratuberculosis
gccgagcaccaggcgcacca

SEQ ID NO: 2846102 - RNA, 22 nt, Mycobacterium avium subsp. paratuberculosis
gccgagcaccaggcgcaccagc

SEQ ID NO: 2846103 - RNA, 23 nt, Mycobacterium avium subsp. paratuberculosis
gccgagcaccaggcgcaccagcu

SEQ ID NO: 2846104 - RNA, 20 nt, Mycobacterium avium subsp. paratuberculosis
gccgagcaccccgucgagca

SEQ ID NO: 2846105 - RNA, 23 nt, Mycobacterium avium subsp. paratuberculosis
gccgagcaccccgucgagcagcc

SEQ ID NO: 2846106 - RNA, 12 nt, Mycobacterium avium subsp. paratuberculosis
gccgagcaccgg

SEQ ID NO: 2846107 - RNA, 16 nt, Mycobacterium avium subsp. paratuberculosis
gccgagcaccggcagc

SEQ ID NO: 2846108 - RNA, 17 nt, Mycobacterium avium subsp. paratuberculosis
gccgagcaccggcagca

SEQ ID NO: 2846109 - RNA, 18 nt, Mycobacterium avium subsp. paratuberculosis
gccgagcaccggcagcac

SEQ ID NO: 2846110 - RNA, 13 nt, Mycobacterium avium subsp. paratuberculosis
gccgagcaccggg

SEQ ID NO: 2846111 - RNA, 20 nt, Mycobacterium avium subsp. paratuberculosis
gccgagcaccgggcugucgg

SEQ ID NO: 2846112 - RNA, 11 nt, Mycobacterium avium subsp. paratuberculosis
gccgagcaccu

SEQ ID NO: 2846113 - RNA, 16 nt, Mycobacterium avium subsp. paratuberculosis
gccgagcaccuccgac

SEQ ID NO: 2846114 - RNA, 17 nt, Mycobacterium avium subsp. paratuberculosis
gccgagcaccucgucgc

SEQ ID NO: 2846115 - RNA, 19 nt, Mycobacterium avium subsp. paratuberculosis
gccgagcaccucgucgccg

SEQ ID NO: 2846116 - RNA, 23 nt, Mycobacterium avium subsp. paratuberculosis
gccgagcaccucgucgccgucgg

SEQ ID NO: 2846117 - RNA, 13 nt, Mycobacterium avium subsp. paratuberculosis
gccgagcaccugg

SEQ ID NO: 2846118 - RNA, 16 nt, Mycobacterium avium subsp. paratuberculosis
gccgagcacgaacgcg

SEQ ID NO: 2846119 - RNA, 17 nt, Mycobacterium avium subsp. paratuberculosis
gccgagcacgaacgcgg

SEQ ID NO: 2846120 - RNA, 20 nt, Mycobacterium avium subsp. paratuberculosis
gccgagcacgaacgcggccg

SEQ ID NO: 2846121 - RNA, 21 nt, Mycobacterium avium subsp. paratuberculosis
gccgagcacgaacgcggccgc

SEQ ID NO: 2846122 - RNA, 16 nt, Mycobacterium avium subsp. paratuberculosis
gccgagcacgcagccg

SEQ ID NO: 2846123 - RNA, 14 nt, Mycobacterium avium subsp. paratuberculosis
gccgagcacgcggc

SEQ ID NO: 2846124 - RNA, 15 nt, Mycobacterium avium subsp. paratuberculosis
gccgagcacgcggcc

SEQ ID NO: 2846125 - RNA, 16 nt, Mycobacterium avium subsp. paratuberculosis
gccgagcacgcggccg

SEQ ID NO: 2846126 - RNA, 17 nt, Mycobacterium avium subsp. paratuberculosis
gccgagcacgcggccgc

SEQ ID NO: 2846127 - RNA, 19 nt, Mycobacterium avium subsp. paratuberculosis
gccgagcacgcggccgcgc

SEQ ID NO: 2846128 - RNA, 20 nt, Mycobacterium avium subsp. paratuberculosis
gccgagcacgcggccgcgcc

SEQ ID NO: 2846129 - RNA, 21 nt, Mycobacterium avium subsp. paratuberculosis
gccgagcacgcggccgcgccg

SEQ ID NO: 2846130 - RNA, 16 nt, Mycobacterium avium subsp. paratuberculosis
gccgagcacggcucgu

SEQ ID NO: 2846131 - RNA, 19 nt, Mycobacterium avium subsp. paratuberculosis
gccgagcacggcucgucca

SEQ ID NO: 2846132 - RNA, 16 nt, Mycobacterium avium subsp. paratuberculosis
gccgagcagagcuacg

SEQ ID NO: 2846133 - RNA, 19 nt, Mycobacterium avium subsp. paratuberculosis
gccgagcagagcuacggac

SEQ ID NO: 2846134 - RNA, 15 nt, Mycobacterium avium subsp. paratuberculosis
gccgagcagaucggg

SEQ ID NO: 2846135 - RNA, 20 nt, Mycobacterium avium subsp. paratuberculosis
gccgagcagaucggguccca

SEQ ID NO: 2846136 - RNA, 14 nt, Mycobacterium avium subsp. paratuberculosis
gccgagcagcaccg

SEQ ID NO: 2846137 - RNA, 15 nt, Mycobacterium avium subsp. paratuberculosis
gccgagcagcaccgc

SEQ ID NO: 2846138 - RNA, 17 nt, Mycobacterium avium subsp. paratuberculosis
gccgagcagcaccggca

SEQ ID NO: 2846139 - RNA, 14 nt, Mycobacterium avium subsp. paratuberculosis
gccgagcagccggg

SEQ ID NO: 2846140 - RNA, 15 nt, Mycobacterium avium subsp. paratuberculosis
gccgagcagccgggc

SEQ ID NO: 2846141 - RNA, 16 nt, Mycobacterium avium subsp. paratuberculosis
gccgagcagccgggcc

SEQ ID NO: 2846142 - RNA, 17 nt, Mycobacterium avium subsp. paratuberculosis
gccgagcagccgggcca

SEQ ID NO: 2846143 - RNA, 18 nt, Mycobacterium avium subsp. paratuberculosis
gccgagcagccgggccag

SEQ ID NO: 2846144 - RNA, 17 nt, Mycobacterium avium subsp. paratuberculosis
gccgagcagccggucca

SEQ ID NO: 2846145 - RNA, 12 nt, Mycobacterium avium subsp. paratuberculosis
gccgagcagcuc

SEQ ID NO: 2846146 - RNA, 16 nt, Mycobacterium avium subsp. paratuberculosis
gccgagcagcucagcc

SEQ ID NO: 2846147 - RNA, 15 nt, Mycobacterium avium subsp. paratuberculosis
gccgagcagcucggc

SEQ ID NO: 2846148 - RNA, 16 nt, Mycobacterium avium subsp. paratuberculosis
gccgagcagcucggcg

SEQ ID NO: 2846149 - RNA, 17 nt, Mycobacterium avium subsp. paratuberculosis
gccgagcagcucggcgg

SEQ ID NO: 2846150 - RNA, 13 nt, Mycobacterium avium subsp. paratuberculosis
gccgagcccgccg

SEQ ID NO: 2846151 - RNA, 16 nt, Mycobacterium avium subsp. paratuberculosis
gccgagcccgccggcg

SEQ ID NO: 2846152 - RNA, 18 nt, Mycobacterium avium subsp. paratuberculosis
gccgagcccgccggcggc

SEQ ID NO: 2846153 - RNA, 19 nt, Mycobacterium avium subsp. paratuberculosis
gccgagcccgccggcggcg

SEQ ID NO: 2846154 - RNA, 23 nt, Mycobacterium avium subsp. paratuberculosis
gccgagcccuuugcgcugcccga

SEQ ID NO: 2846155 - RNA, 14 nt, Mycobacterium avium subsp. paratuberculosis
gccgagccgacccg

SEQ ID NO: 2846156 - RNA, 15 nt, Mycobacterium avium subsp. paratuberculosis
gccgagccgacccgg

SEQ ID NO: 2846157 - RNA, 13 nt, Mycobacterium avium subsp. paratuberculosis
gccgagccgagcc

SEQ ID NO: 2846158 - RNA, 17 nt, Mycobacterium avium subsp. paratuberculosis
gccgagccgagccgacc

SEQ ID NO: 2846159 - RNA, 15 nt, Mycobacterium avium subsp. paratuberculosis
gccgagccgaggccg

SEQ ID NO: 2846160 - RNA, 21 nt, Mycobacterium avium subsp. paratuberculosis
gccgagccgaggccgauggcg

SEQ ID NO: 2846161 - RNA, 16 nt, Mycobacterium avium subsp. paratuberculosis
gccgagccgcaccgcc

SEQ ID NO: 2846162 - RNA, 17 nt, Mycobacterium avium subsp. paratuberculosis
gccgagccgcaccgccu

SEQ ID NO: 2846163 - RNA, 23 nt, Mycobacterium avium subsp. paratuberculosis
gccgagccgcaccgccucaugcc

SEQ ID NO: 2846164 - RNA, 13 nt, Mycobacterium avium subsp. paratuberculosis
gccgagccgcgcc

SEQ ID NO: 2846165 - RNA, 16 nt, Mycobacterium avium subsp. paratuberculosis
gccgagccgcgccacg

SEQ ID NO: 2846166 - RNA, 17 nt, Mycobacterium avium subsp. paratuberculosis
gccgagccgcgccacgc

SEQ ID NO: 2846167 - RNA, 18 nt, Mycobacterium avium subsp. paratuberculosis
gccgagccgcgccacgcg

SEQ ID NO: 2846168 - RNA, 15 nt, Mycobacterium avium subsp. paratuberculosis
gccgagccgcgggug

SEQ ID NO: 2846169 - RNA, 16 nt, Mycobacterium avium subsp. paratuberculosis
gccgagccgcuccacc

SEQ ID NO: 2846170 - RNA, 19 nt, Mycobacterium avium subsp. paratuberculosis
gccgagccgcuccaccgcg

SEQ ID NO: 2846171 - RNA, 23 nt, Mycobacterium avium subsp. paratuberculosis
gccgagccgcuugguggcgccgg

SEQ ID NO: 2846172 - RNA, 13 nt, Mycobacterium avium subsp. paratuberculosis
gccgagccggcac

SEQ ID NO: 2846173 - RNA, 19 nt, Mycobacterium avium subsp. paratuberculosis
gccgaggcugucggaggcc

SEQ ID NO: 2846174 - RNA, 22 nt, Mycobacterium avium subsp. paratuberculosis
gccgaggcugucggaggccucc

SEQ ID NO: 2846175 - RNA, 14 nt, Mycobacterium avium subsp. paratuberculosis
gccgagggccagca

SEQ ID NO: 2846176 - RNA, 17 nt, Mycobacterium avium subsp. paratuberculosis
gccgagggccagcagcc

SEQ ID NO: 2846177 - RNA, 18 nt, Mycobacterium avium subsp. paratuberculosis
gccgagggccagcagcca

SEQ ID NO: 2846178 - RNA, 15 nt, Mycobacterium avium subsp. paratuberculosis
gccgagggcccgggc

SEQ ID NO: 2846179 - RNA, 17 nt, Mycobacterium avium subsp. paratuberculosis
gccgagggcccgggcag

SEQ ID NO: 2846180 - RNA, 18 nt, Mycobacterium avium subsp. paratuberculosis
gccgagggcccgggcagg

SEQ ID NO: 2846181 - RNA, 20 nt, Mycobacterium avium subsp. paratuberculosis
gccgagggcccgggcaggca

SEQ ID NO: 2846182 - RNA, 14 nt, Mycobacterium avium subsp. paratuberculosis
gccgagggcgacga

SEQ ID NO: 2846183 - RNA, 22 nt, Mycobacterium avium subsp. paratuberculosis
gccgagggcgacgaugccggcc

SEQ ID NO: 2846184 - RNA, 14 nt, Mycobacterium avium subsp. paratuberculosis
gccgagggcggcgg

SEQ ID NO: 2846185 - RNA, 21 nt, Mycobacterium avium subsp. paratuberculosis
gccgagggggaagucgaccgg

SEQ ID NO: 2846186 - RNA, 22 nt, Mycobacterium avium subsp. paratuberculosis
gccgagggggaagucgaccggg

SEQ ID NO: 2846187 - RNA, 13 nt, Mycobacterium avium subsp. paratuberculosis
gccgagggugccg

SEQ ID NO: 2846188 - RNA, 21 nt, Mycobacterium avium subsp. paratuberculosis
gccgagggugccggccaccgg

SEQ ID NO: 2846189 - RNA, 16 nt, Mycobacterium avium subsp. paratuberculosis
gccgagguagccgcgc

SEQ ID NO: 2846190 - RNA, 18 nt, Mycobacterium avium subsp. paratuberculosis
gccgagguagccgcgcac

SEQ ID NO: 2846191 - RNA, 20 nt, Mycobacterium avium subsp. paratuberculosis
gccgagguagccgcgcacca

SEQ ID NO: 2846192 - RNA, 20 nt, Mycobacterium avium subsp. paratuberculosis
gccgagguagucggccuccu

SEQ ID NO: 2846193 - RNA, 16 nt, Mycobacterium avium subsp. paratuberculosis
gccgaggucaccaccg

SEQ ID NO: 2846194 - RNA, 18 nt, Mycobacterium avium subsp. paratuberculosis
gccgaggucaccaccgag

SEQ ID NO: 2846195 - RNA, 15 nt, Mycobacterium avium subsp. paratuberculosis
gccgaggucaccgcg

SEQ ID NO: 2846196 - RNA, 15 nt, Mycobacterium avium subsp. paratuberculosis
gccgagguccgcggu

SEQ ID NO: 2846197 - RNA, 17 nt, Mycobacterium avium subsp. paratuberculosis
gccgagguccucgaccu

SEQ ID NO: 2846198 - RNA, 21 nt, Mycobacterium avium subsp. paratuberculosis
gccgaggucgccgacgccguc

SEQ ID NO: 2846199 - RNA, 14 nt, Mycobacterium avium subsp. paratuberculosis
gccgaggucgccgg

SEQ ID NO: 2846200 - RNA, 15 nt, Mycobacterium avium subsp. paratuberculosis
gccgaggucgccggu

SEQ ID NO: 2846201 - RNA, 18 nt, Mycobacterium avium subsp. paratuberculosis
gccgaggucgcggcggcc

SEQ ID NO: 2846202 - RNA, 19 nt, Mycobacterium avium subsp. paratuberculosis
gccgaggucgcggcggccg

SEQ ID NO: 2846203 - RNA, 14 nt, Mycobacterium avium subsp. paratuberculosis
gccgaggucggucg

SEQ ID NO: 2846204 - RNA, 18 nt, Mycobacterium avium subsp. paratuberculosis
gccgaggucggucgcggc

SEQ ID NO: 2846205 - RNA, 22 nt, Mycobacterium avium subsp. paratuberculosis
gccgaggucggucgcggcaucc

SEQ ID NO: 2846206 - RNA, 23 nt, Mycobacterium avium subsp. paratuberculosis
gccgaggucuuucaucgccccgg

SEQ ID NO: 2846207 - RNA, 17 nt, Mycobacterium avium subsp. paratuberculosis
gccgaggugcugucguc

SEQ ID NO: 2846208 - RNA, 18 nt, Mycobacterium avium subsp. paratuberculosis
gccgaggugcugucgucg

SEQ ID NO: 2846209 - RNA, 22 nt, Mycobacterium avium subsp. paratuberculosis
gccgaggugcugucgucgcccu

SEQ ID NO: 2846210 - RNA, 19 nt, Mycobacterium avium subsp. paratuberculosis
gccgagguggcccgccacg

SEQ ID NO: 2846211 - RNA, 16 nt, Mycobacterium avium subsp. paratuberculosis
gccgagguggccgcca

SEQ ID NO: 2846212 - RNA, 19 nt, Mycobacterium avium subsp. paratuberculosis
gccgagguggccgccagca

SEQ ID NO: 2846213 - RNA, 20 nt, Mycobacterium avium subsp. paratuberculosis
gccgagguggccgccagcac

SEQ ID NO: 2846214 - RNA, 21 nt, Mycobacterium avium subsp. paratuberculosis
gccgagguggccgccagcacc

SEQ ID NO: 2846215 - RNA, 16 nt, Mycobacterium avium subsp. paratuberculosis
gccgaguaacucggcc

SEQ ID NO: 2846216 - RNA, 17 nt, Mycobacterium avium subsp. paratuberculosis
gccgaguaacucggccu

SEQ ID NO: 2846217 - RNA, 17 nt, Mycobacterium avium subsp. paratuberculosis
gccgaguaccgacgaga

SEQ ID NO: 2846218 - RNA, 23 nt, Mycobacterium avium subsp. paratuberculosis
gccgaguaccgacgagaucagca

SEQ ID NO: 2846219 - RNA, 18 nt, Mycobacterium avium subsp. paratuberculosis
gccgaguauccgcgcagc

SEQ ID NO: 2846220 - RNA, 23 nt, Mycobacterium avium subsp. paratuberculosis
gccgaguccgggccgccggccgc

SEQ ID NO: 2846221 - RNA, 19 nt, Mycobacterium avium subsp. paratuberculosis
gccgagucgacgugcucgg

SEQ ID NO: 2846222 - RNA, 14 nt, Mycobacterium avium subsp. paratuberculosis
gccgagucgaucgc

SEQ ID NO: 2846223 - RNA, 16 nt, Mycobacterium avium subsp. paratuberculosis
gccgagucgaucgcca

SEQ ID NO: 2846224 - RNA, 20 nt, Mycobacterium avium subsp. paratuberculosis
gccgagucgaucgccagcgc

SEQ ID NO: 2846225 - RNA, 22 nt, Mycobacterium avium subsp. paratuberculosis
gccgagucgaucgccagcgcgc

SEQ ID NO: 2846226 - RNA, 23 nt, Mycobacterium avium subsp. paratuberculosis
gccgagucgaucgccagcgcgca

SEQ ID NO: 2846227 - RNA, 17 nt, Mycobacterium avium subsp. paratuberculosis
gccgagucgcgccgcgu

SEQ ID NO: 2846228 - RNA, 23 nt, Mycobacterium avium subsp. paratuberculosis
gccgagucgcgccgcgucgcgcc

SEQ ID NO: 2846229 - RNA, 19 nt, Mycobacterium avium subsp. paratuberculosis
gccgaguuccugcgaccgc

SEQ ID NO: 2846230 - RNA, 21 nt, Mycobacterium avium subsp. paratuberculosis
gccgaguuccugcgaccgccg

SEQ ID NO: 2846231 - RNA, 23 nt, Mycobacterium avium subsp. paratuberculosis
gccgaguuccugcgaccgccgcc

SEQ ID NO: 2846232 - RNA, 18 nt, Mycobacterium avium subsp. paratuberculosis
gccgaguucgaccucggu

SEQ ID NO: 2846233 - RNA, 20 nt, Mycobacterium avium subsp. paratuberculosis
gccgaguucgaccucgguga

SEQ ID NO: 2846234 - RNA, 16 nt, Mycobacterium avium subsp. paratuberculosis
gccgaguuuggcgucg

SEQ ID NO: 2846235 - RNA, 17 nt, Mycobacterium avium subsp. paratuberculosis
gccgaguuuggcgucga

SEQ ID NO: 2846236 - RNA, 18 nt, Mycobacterium avium subsp. paratuberculosis
gccgaguuuggcgucgau

SEQ ID NO: 2846237 - RNA, 20 nt, Mycobacterium avium subsp. paratuberculosis
gccgaguuuggcgucgaugc

SEQ ID NO: 2846238 - RNA, 21 nt, Mycobacterium avium subsp. paratuberculosis
gccgauacaugugccgauguc

SEQ ID NO: 2846239 - RNA, 16 nt, Mycobacterium avium subsp. paratuberculosis
gccgaucaacaggccc

SEQ ID NO: 2846240 - RNA, 18 nt, Mycobacterium avium subsp. paratuberculosis
gccgaucaacaggcccag

SEQ ID NO: 2846241 - RNA, 19 nt, Mycobacterium avium subsp. paratuberculosis
gccgaucaacaggcccagc

SEQ ID NO: 2846242 - RNA, 20 nt, Mycobacterium avium subsp. paratuberculosis
gccgaucaacaggcccagca

SEQ ID NO: 2846243 - RNA, 22 nt, Mycobacterium avium subsp. paratuberculosis
gccgaucaacaggcccagcagc

SEQ ID NO: 2846244 - RNA, 20 nt, Mycobacterium avium subsp. paratuberculosis
gccgaucaccgcguugucgg

SEQ ID NO: 2846245 - RNA, 23 nt, Mycobacterium avium subsp. paratuberculosis
gccgaucaccgcguugucggcga

SEQ ID NO: 2846246 - RNA, 14 nt, Mycobacterium avium subsp. paratuberculosis
gccgaucaccggcg

SEQ ID NO: 2846247 - RNA, 14 nt, Mycobacterium avium subsp. paratuberculosis
gccgaucaccucga

SEQ ID NO: 2846248 - RNA, 15 nt, Mycobacterium avium subsp. paratuberculosis
gccgaucaccucgaa

SEQ ID NO: 2846249 - RNA, 15 nt, Mycobacterium avium subsp. paratuberculosis
gccgaucaccucgau

SEQ ID NO: 2846250 - RNA, 16 nt, Mycobacterium avium subsp. paratuberculosis
gccgaucaccucgccg

SEQ ID NO: 2846251 - RNA, 17 nt, Mycobacterium avium subsp. paratuberculosis
gccgaucaccucgccgg

SEQ ID NO: 2846252 - RNA, 19 nt, Mycobacterium avium subsp. paratuberculosis
gccgaucaccucgccggcc

SEQ ID NO: 2846253 - RNA, 20 nt, Mycobacterium avium subsp. paratuberculosis
gccgaucaccucgccggccg

SEQ ID NO: 2846254 - RNA, 21 nt, Mycobacterium avium subsp. paratuberculosis
gccgaucaccucgccggccgg

SEQ ID NO: 2846255 - RNA, 13 nt, Mycobacterium avium subsp. paratuberculosis
gccgaucacgaac

SEQ ID NO: 2846256 - RNA, 13 nt, Mycobacterium avium subsp. paratuberculosis
gccgaucacgccg

SEQ ID NO: 2846257 - RNA, 21 nt, Mycobacterium avium subsp. paratuberculosis
gccgaugacguugcgcgccau

SEQ ID NO: 2846258 - RNA, 19 nt, Mycobacterium avium subsp. paratuberculosis
gccgaugagccucagcgcg

SEQ ID NO: 2846259 - RNA, 22 nt, Mycobacterium avium subsp. paratuberculosis
gccgaugagccucagcgcgcaa

SEQ ID NO: 2846260 - RNA, 16 nt, Mycobacterium avium subsp. paratuberculosis
gccgaugaugaaaccg

SEQ ID NO: 2846261 - RNA, 20 nt, Mycobacterium avium subsp. paratuberculosis
gccgaugaugaaaccggcca

SEQ ID NO: 2846262 - RNA, 22 nt, Mycobacterium avium subsp. paratuberculosis
gccgaugaugaaaccggccagc

SEQ ID NO: 2846263 - RNA, 23 nt, Mycobacterium avium subsp. paratuberculosis
gccgaugaugaaaccggccagca

SEQ ID NO: 2846264 - RNA, 22 nt, Mycobacterium avium subsp. paratuberculosis
gccgaugaugaugccgcccauc

SEQ ID NO: 2846265 - RNA, 20 nt, Mycobacterium avium subsp. paratuberculosis
gccgaugaugguggcggcca

SEQ ID NO: 2846266 - RNA, 22 nt, Mycobacterium avium subsp. paratuberculosis
gccgaugaugguggcggccacc

SEQ ID NO: 2846267 - RNA, 14 nt, Mycobacterium avium subsp. paratuberculosis
gccgaugcagcaca

SEQ ID NO: 2846268 - RNA, 21 nt, Mycobacterium avium subsp. paratuberculosis
gccgaugcagcacauccagcc

SEQ ID NO: 2846269 - RNA, 15 nt, Mycobacterium avium subsp. paratuberculosis
gccgaugcccagcag

SEQ ID NO: 2846270 - RNA, 19 nt, Mycobacterium avium subsp. paratuberculosis
gccgaugcccaucacgccc

SEQ ID NO: 2846271 - RNA, 14 nt, Mycobacterium avium subsp. paratuberculosis
gccgaugcccgccc

SEQ ID NO: 2846272 - RNA, 16 nt, Mycobacterium avium subsp. paratuberculosis
gccgaugccgaacguc

SEQ ID NO: 2846273 - RNA, 13 nt, Mycobacterium avium subsp. paratuberculosis
gccgaugccgcgc

SEQ ID NO: 2846274 - RNA, 16 nt, Mycobacterium avium subsp. paratuberculosis
gccgaugccgcgcugc

SEQ ID NO: 2846275 - RNA, 14 nt, Mycobacterium avium subsp. paratuberculosis
gccgaugccggccu

SEQ ID NO: 2846276 - RNA, 15 nt, Mycobacterium avium subsp. paratuberculosis
gccgaugccggccug

SEQ ID NO: 2846277 - RNA, 13 nt, Mycobacterium avium subsp. paratuberculosis
gccgaugccggcg

SEQ ID NO: 2846278 - RNA, 12 nt, Mycobacterium avium subsp. paratuberculosis
gccgaugcgccc

SEQ ID NO: 2846279 - RNA, 16 nt, Mycobacterium avium subsp. paratuberculosis
gccgaugcgcccgcgc

SEQ ID NO: 2846280 - RNA, 21 nt, Mycobacterium avium subsp. paratuberculosis
gccgaugcgcccgcgccaccc

SEQ ID NO: 2846281 - RNA, 23 nt, Mycobacterium avium subsp. paratuberculosis
gccgaugcgcccgcgccaccccg

SEQ ID NO: 2846282 - RNA, 15 nt, Mycobacterium avium subsp. paratuberculosis
gccgaugcgcccgcu

SEQ ID NO: 2846283 - RNA, 19 nt, Mycobacterium avium subsp. paratuberculosis
gccgaugcgcccgcugcgg

SEQ ID NO: 2846284 - RNA, 19 nt, Mycobacterium avium subsp. paratuberculosis
gccgaugcgccgcaccagu

SEQ ID NO: 2846285 - RNA, 16 nt, Mycobacterium avium subsp. paratuberculosis
gccgaugcugagcggg

SEQ ID NO: 2846286 - RNA, 17 nt, Mycobacterium avium subsp. paratuberculosis
gccgaugcugagcgggu

SEQ ID NO: 2846287 - RNA, 19 nt, Mycobacterium avium subsp. paratuberculosis
gccgaugcugagcgggucg

SEQ ID NO: 2846288 - RNA, 23 nt, Mycobacterium avium subsp. paratuberculosis
gccgauggaacgcaagaagucgg

SEQ ID NO: 2846289 - RNA, 17 nt, Mycobacterium avium subsp. paratuberculosis
gccgauggcccaggccg

SEQ ID NO: 2846290 - RNA, 16 nt, Mycobacterium avium subsp. paratuberculosis
gccgauggccuggugg

SEQ ID NO: 2846291 - RNA, 17 nt, Mycobacterium avium subsp. paratuberculosis
gccgauggccugguggc

SEQ ID NO: 2846292 - RNA, 18 nt, Mycobacterium avium subsp. paratuberculosis
gccgauggccugguggcc

SEQ ID NO: 2846293 - RNA, 12 nt, Mycobacterium avium subsp. paratuberculosis
gccgauggcgcc

SEQ ID NO: 2846294 - RNA, 13 nt, Mycobacterium avium subsp. paratuberculosis
gccgauggcgguc

SEQ ID NO: 2846295 - RNA, 15 nt, Mycobacterium avium subsp. paratuberculosis
gccgauggcggucca

SEQ ID NO: 2846296 - RNA, 21 nt, Mycobacterium avium subsp. paratuberculosis
gccgauggcgguccaccacca

SEQ ID NO: 2846297 - RNA, 21 nt, Mycobacterium avium subsp. paratuberculosis
gccgauggucagcugccgcac

SEQ ID NO: 2846298 - RNA, 17 nt, Mycobacterium avium subsp. paratuberculosis
gccgauggugaccucgg

SEQ ID NO: 2846299 - RNA, 21 nt, Mycobacterium avium subsp. paratuberculosis
gccgauggugaccucggucga

SEQ ID NO: 2846300 - RNA, 18 nt, Mycobacterium avium subsp. paratuberculosis
gccgauggugacggugcc

SEQ ID NO: 2846301 - RNA, 20 nt, Mycobacterium avium subsp. paratuberculosis
gccgauggugacggugccgc

SEQ ID NO: 2846302 - RNA, 23 nt, Mycobacterium avium subsp. paratuberculosis
gccgauguaggacaggucgcggu

SEQ ID NO: 2846303 - RNA, 19 nt, Mycobacterium avium subsp. paratuberculosis
gccgauguaguccagccca

SEQ ID NO: 2846304 - RNA, 16 nt, Mycobacterium avium subsp. paratuberculosis
gccgauguccccgcgg

SEQ ID NO: 2846305 - RNA, 17 nt, Mycobacterium avium subsp. paratuberculosis
gccgauguccccgcggg

SEQ ID NO: 2846306 - RNA, 18 nt, Mycobacterium avium subsp. paratuberculosis
gccgauguccccgcgggu

SEQ ID NO: 2846307 - RNA, 20 nt, Mycobacterium avium subsp. paratuberculosis
gccgauguccccgcggguga

SEQ ID NO: 2846308 - RNA, 17 nt, Mycobacterium avium subsp. paratuberculosis
gccgaugucggccgguc

SEQ ID NO: 2846309 - RNA, 15 nt, Mycobacterium avium subsp. paratuberculosis
gccgaugucggcguu

SEQ ID NO: 2846310 - RNA, 13 nt, Mycobacterium avium subsp. paratuberculosis
gccgaugucgucg

SEQ ID NO: 2846311 - RNA, 14 nt, Mycobacterium avium subsp. paratuberculosis
gccgaugucgucga

SEQ ID NO: 2846312 - RNA, 17 nt, Mycobacterium avium subsp. paratuberculosis
gccgaugucgucgaacg

SEQ ID NO: 2846313 - RNA, 19 nt, Mycobacterium avium subsp. paratuberculosis
gccgaugucgucgaacgcg

SEQ ID NO: 2846314 - RNA, 20 nt, Mycobacterium avium subsp. paratuberculosis
gccgaugucgucgaacgcgg

SEQ ID NO: 2846315 - RNA, 17 nt, Mycobacterium avium subsp. paratuberculosis
gccgaugucugaucgcg

SEQ ID NO: 2846316 - RNA, 16 nt, Mycobacterium avium subsp. paratuberculosis
gccgaugugaucggcg

SEQ ID NO: 2846317 - RNA, 20 nt, Mycobacterium avium subsp. paratuberculosis
gccgaugugaucggcggcca

SEQ ID NO: 2846318 - RNA, 22 nt, Mycobacterium avium subsp. paratuberculosis
gccgaugugaucggcggccacc

SEQ ID NO: 2846319 - RNA, 15 nt, Mycobacterium avium subsp. paratuberculosis
gccgauguggccggc

SEQ ID NO: 2846320 - RNA, 19 nt, Mycobacterium avium subsp. paratuberculosis
gccgauguggccggcgaug

SEQ ID NO: 2846321 - RNA, 21 nt, Mycobacterium avium subsp. paratuberculosis
gccgauguggccggcgauggc

SEQ ID NO: 2846322 - RNA, 20 nt, Mycobacterium avium subsp. paratuberculosis
gccgauguggcgggcguccu

SEQ ID NO: 2846323 - RNA, 16 nt, Mycobacterium avium subsp. paratuberculosis
gccgauguucaccccg

SEQ ID NO: 2846324 - RNA, 17 nt, Mycobacterium avium subsp. paratuberculosis
gccgauguucaccccga

SEQ ID NO: 2846325 - RNA, 18 nt, Mycobacterium avium subsp. paratuberculosis
gccgauucaaccccgcgc

SEQ ID NO: 2846326 - RNA, 19 nt, Mycobacterium avium subsp. paratuberculosis
gccgauucaaccccgcgcg

SEQ ID NO: 2846327 - RNA, 14 nt, Mycobacterium avium subsp. paratuberculosis
gccgauuccagcaa

SEQ ID NO: 2846328 - RNA, 16 nt, Mycobacterium avium subsp. paratuberculosis
gccgauuccagcaacu

SEQ ID NO: 2846329 - RNA, 14 nt, Mycobacterium avium subsp. paratuberculosis
gccgauuccggccg

SEQ ID NO: 2846330 - RNA, 18 nt, Mycobacterium avium subsp. paratuberculosis
gccgauuccggccggccg

SEQ ID NO: 2846331 - RNA, 22 nt, Mycobacterium avium subsp. paratuberculosis
gccgauuccggccggccgccgg

SEQ ID NO: 2846332 - RNA, 16 nt, Mycobacterium avium subsp. paratuberculosis
gccgauuccgucggug

SEQ ID NO: 2846333 - RNA, 19 nt, Mycobacterium avium subsp. paratuberculosis
gccgauuccgucgguggcg

SEQ ID NO: 2846334 - RNA, 18 nt, Mycobacterium avium subsp. paratuberculosis
gccgauucggcgccgcga

SEQ ID NO: 2846335 - RNA, 21 nt, Mycobacterium avium subsp. paratuberculosis
gccgauucggcgccgcgaccc

SEQ ID NO: 2846336 - RNA, 13 nt, Mycobacterium avium subsp. paratuberculosis
gccgcaacagccg

SEQ ID NO: 2846337 - RNA, 15 nt, Mycobacterium avium subsp. paratuberculosis
gccgcaacagccggc

SEQ ID NO: 2846338 - RNA, 21 nt, Mycobacterium avium subsp. paratuberculosis
gccgcaacggcgcaacggauu

SEQ ID NO: 2846339 - RNA, 13 nt, Mycobacterium avium subsp. paratuberculosis
gccgcaacggcgg

SEQ ID NO: 2846340 - RNA, 16 nt, Mycobacterium avium subsp. paratuberculosis
gccgcaacggcggucg

SEQ ID NO: 2846341 - RNA, 17 nt, Mycobacterium avium subsp. paratuberculosis
gccgcagcagccgcgcc

SEQ ID NO: 2846342 - RNA, 21 nt, Mycobacterium avium subsp. paratuberculosis
gccgcagcagccgcgccaccg

SEQ ID NO: 2846343 - RNA, 23 nt, Mycobacterium avium subsp. paratuberculosis
gccgcagcagccgcgccaccgcg

SEQ ID NO: 2846344 - RNA, 13 nt, Mycobacterium avium subsp. paratuberculosis
gccgcagcagcga

SEQ ID NO: 2846345 - RNA, 15 nt, Mycobacterium avium subsp. paratuberculosis
gccgcagcagcgagg

SEQ ID NO: 2846346 - RNA, 15 nt, Mycobacterium avium subsp. paratuberculosis
gccgcagcaggcacu

SEQ ID NO: 2846347 - RNA, 21 nt, Mycobacterium avium subsp. paratuberculosis
gccgcagcaggugcaucgcca

SEQ ID NO: 2846348 - RNA, 22 nt, Mycobacterium avium subsp. paratuberculosis
gccgcagcaggugcaucgccac

SEQ ID NO: 2846349 - RNA, 16 nt, Mycobacterium avium subsp. paratuberculosis
gccgcagcaggugcgc

SEQ ID NO: 2846350 - RNA, 18 nt, Mycobacterium avium subsp. paratuberculosis
gccgcagcaggugcgcca

SEQ ID NO: 2846351 - RNA, 22 nt, Mycobacterium avium subsp. paratuberculosis
gccgcagcaggugcgccagauc

SEQ ID NO: 2846352 - RNA, 18 nt, Mycobacterium avium subsp. paratuberculosis
gccgcagcccaggcccag

SEQ ID NO: 2846353 - RNA, 12 nt, Mycobacterium avium subsp. paratuberculosis
gccgcagcccgc

SEQ ID NO: 2846354 - RNA, 11 nt, Mycobacterium avium subsp. paratuberculosis
gccgcagccga

SEQ ID NO: 2846355 - RNA, 13 nt, Mycobacterium avium subsp. paratuberculosis
gccgcagccgcgc

SEQ ID NO: 2846356 - RNA, 14 nt, Mycobacterium avium subsp. paratuberculosis
gccgcagccgcgcg

SEQ ID NO: 2846357 - RNA, 15 nt, Mycobacterium avium subsp. paratuberculosis
gccgcagccgcgcgg

SEQ ID NO: 2846358 - RNA, 16 nt, Mycobacterium avium subsp. paratuberculosis
gccgcagccgcgcggc

SEQ ID NO: 2846359 - RNA, 17 nt, Mycobacterium avium subsp. paratuberculosis
gccgcagccgcgcggcc

SEQ ID NO: 2846360 - RNA, 18 nt, Mycobacterium avium subsp. paratuberculosis
gccgcagccgcgcggccg

SEQ ID NO: 2846361 - RNA, 19 nt, Mycobacterium avium subsp. paratuberculosis
gccgcagccgcgcggccgg

SEQ ID NO: 2846362 - RNA, 12 nt, Mycobacterium avium subsp. paratuberculosis
gccgcagccggg

SEQ ID NO: 2846363 - RNA, 13 nt, Mycobacterium avium subsp. paratuberculosis
gccgcagccgggu

SEQ ID NO: 2846364 - RNA, 17 nt, Mycobacterium avium subsp. paratuberculosis
gccgcagccgggugggc

SEQ ID NO: 2846365 - RNA, 19 nt, Mycobacterium avium subsp. paratuberculosis
gccgcagccuucuuggcgg

SEQ ID NO: 2846366 - RNA, 22 nt, Mycobacterium avium subsp. paratuberculosis
gccgcagccuucuuggcgggcg

SEQ ID NO: 2846367 - RNA, 17 nt, Mycobacterium avium subsp. paratuberculosis
gccgcagcgcagcgucg

SEQ ID NO: 2846368 - RNA, 18 nt, Mycobacterium avium subsp. paratuberculosis
gccgcagcgcaucgccgg

SEQ ID NO: 2846369 - RNA, 20 nt, Mycobacterium avium subsp. paratuberculosis
gccgcagcgcaucgccggcg

SEQ ID NO: 2846370 - RNA, 23 nt, Mycobacterium avium subsp. paratuberculosis
gccgcagcgcaucgccggcgaug

SEQ ID NO: 2846371 - RNA, 12 nt, Mycobacterium avium subsp. paratuberculosis
gccgcagcgccc

SEQ ID NO: 2846372 - RNA, 15 nt, Mycobacterium avium subsp. paratuberculosis
gccgcagcgcccggc

SEQ ID NO: 2846373 - RNA, 18 nt, Mycobacterium avium subsp. paratuberculosis
gccgcagcgcccggcagc

SEQ ID NO: 2846374 - RNA, 15 nt, Mycobacterium avium subsp. paratuberculosis
gccgcagcgcgacga

SEQ ID NO: 2846375 - RNA, 22 nt, Mycobacterium avium subsp. paratuberculosis
gccgcagcgcgacgaacagcac

SEQ ID NO: 2846376 - RNA, 13 nt, Mycobacterium avium subsp. paratuberculosis
gccgcagcgcgcg

SEQ ID NO: 2846377 - RNA, 16 nt, Mycobacterium avium subsp. paratuberculosis
gccgcagcgcgcgacc

SEQ ID NO: 2846378 - RNA, 17 nt, Mycobacterium avium subsp. paratuberculosis
gccgcagcgcgcgaccg

SEQ ID NO: 2846379 - RNA, 22 nt, Mycobacterium avium subsp. paratuberculosis
gccgcagcgcgcgaccgcgaug

SEQ ID NO: 2846380 - RNA, 19 nt, Mycobacterium avium subsp. paratuberculosis
gccgcagcgcgcgcucggu

SEQ ID NO: 2846381 - RNA, 13 nt, Mycobacterium avium subsp. paratuberculosis
gccgcagcgcggc

SEQ ID NO: 2846382 - RNA, 14 nt, Mycobacterium avium subsp. paratuberculosis
gccgcagcgcggcg

SEQ ID NO: 2846383 - RNA, 20 nt, Mycobacterium avium subsp. paratuberculosis
gccgcagcggcaggucgucg

SEQ ID NO: 2846384 - RNA, 21 nt, Mycobacterium avium subsp. paratuberculosis
gccgcagcggcaggucgucgu

SEQ ID NO: 2846385 - RNA, 12 nt, Mycobacterium avium subsp. paratuberculosis
gccgcagcggcg

SEQ ID NO: 2846386 - RNA, 13 nt, Mycobacterium avium subsp. paratuberculosis
gccgcagcggcgc

SEQ ID NO: 2846387 - RNA, 14 nt, Mycobacterium avium subsp. paratuberculosis
gccgcagcggcgcc

SEQ ID NO: 2846388 - RNA, 15 nt, Mycobacterium avium subsp. paratuberculosis
gccgcagcggcgccg

SEQ ID NO: 2846389 - RNA, 18 nt, Mycobacterium avium subsp. paratuberculosis
gccgcagcggcgccgcag

SEQ ID NO: 2846390 - RNA, 17 nt, Mycobacterium avium subsp. paratuberculosis
gccgcagcggcgccggg

SEQ ID NO: 2846391 - RNA, 17 nt, Mycobacterium avium subsp. paratuberculosis
gccgcagcggcggcacg

SEQ ID NO: 2846392 - RNA, 20 nt, Mycobacterium avium subsp. paratuberculosis
gccgcagcggcggcucgucc

SEQ ID NO: 2846393 - RNA, 21 nt, Mycobacterium avium subsp. paratuberculosis
gccgcagcgggauuggcgcca

SEQ ID NO: 2846394 - RNA, 15 nt, Mycobacterium avium subsp. paratuberculosis
gccgcagcggugauc

SEQ ID NO: 2846395 - RNA, 18 nt, Mycobacterium avium subsp. paratuberculosis
gccgcagcggugaucgcg

SEQ ID NO: 2846396 - RNA, 21 nt, Mycobacterium avium subsp. paratuberculosis
gccgcagcggugaucgcguca

SEQ ID NO: 2846397 - RNA, 16 nt, Mycobacterium avium subsp. paratuberculosis
gccgcagcgugggcac

SEQ ID NO: 2846398 - RNA, 20 nt, Mycobacterium avium subsp. paratuberculosis
gccgcagcgugggcaccggc

SEQ ID NO: 2846399 - RNA, 22 nt, Mycobacterium avium subsp. paratuberculosis
gccgcagcgugggcaccggcac

SEQ ID NO: 2846400 - RNA, 16 nt, Mycobacterium avium subsp. paratuberculosis
gccgcagcucgaucac

SEQ ID NO: 2846401 - RNA, 22 nt, Mycobacterium avium subsp. paratuberculosis
gccgcagcucgaucacccaggu

SEQ ID NO: 2846402 - RNA, 13 nt, Mycobacterium avium subsp. paratuberculosis
gccgcagcucgcc

SEQ ID NO: 2846403 - RNA, 14 nt, Mycobacterium avium subsp. paratuberculosis
gccgcagcucgccc

SEQ ID NO: 2846404 - RNA, 16 nt, Mycobacterium avium subsp. paratuberculosis
gccgcagcucgcccag

SEQ ID NO: 2846405 - RNA, 17 nt, Mycobacterium avium subsp. paratuberculosis
gccgcagcucgcccagc

SEQ ID NO: 2846406 - RNA, 18 nt, Mycobacterium avium subsp. paratuberculosis
gccgcagcucgcccagca

SEQ ID NO: 2846407 - RNA, 19 nt, Mycobacterium avium subsp. paratuberculosis
gccgcagcucgcccagcac

SEQ ID NO: 2846408 - RNA, 15 nt, Mycobacterium avium subsp. paratuberculosis
gccgcagcugcugcg

SEQ ID NO: 2846409 - RNA, 17 nt, Mycobacterium avium subsp. paratuberculosis
gccgcagcugcugcggc

SEQ ID NO: 2846410 - RNA, 18 nt, Mycobacterium avium subsp. paratuberculosis
gccgcagcugcugcggcc

SEQ ID NO: 2846411 - RNA, 15 nt, Mycobacterium avium subsp. paratuberculosis
gccgcagcuguucgg

SEQ ID NO: 2846412 - RNA, 17 nt, Mycobacterium avium subsp. paratuberculosis
gccgcaggagaucggcg

SEQ ID NO: 2846413 - RNA, 18 nt, Mycobacterium avium subsp. paratuberculosis
gccgcaggagaucggcgc

SEQ ID NO: 2846414 - RNA, 22 nt, Mycobacterium avium subsp. paratuberculosis
gccgcaggagaucggcgcggag

SEQ ID NO: 2846415 - RNA, 12 nt, Mycobacterium avium subsp. paratuberculosis
gccgcaggcgaa

SEQ ID NO: 2846416 - RNA, 23 nt, Mycobacterium avium subsp. paratuberculosis
gccgcaggcgaacaccucgguga

SEQ ID NO: 2846417 - RNA, 14 nt, Mycobacterium avium subsp. paratuberculosis
gccgcaggcgaagg

SEQ ID NO: 2846418 - RNA, 13 nt, Mycobacterium avium subsp. paratuberculosis
gccgcaggcggcc

SEQ ID NO: 2846419 - RNA, 16 nt, Mycobacterium avium subsp. paratuberculosis
gccgcaggcggccagc

SEQ ID NO: 2846420 - RNA, 17 nt, Mycobacterium avium subsp. paratuberculosis
gccgcaggcggccagca

SEQ ID NO: 2846421 - RNA, 18 nt, Mycobacterium avium subsp. paratuberculosis
gccgcaggcggccagcac

SEQ ID NO: 2846422 - RNA, 19 nt, Mycobacterium avium subsp. paratuberculosis
gccgcaggcggccagcacc

SEQ ID NO: 2846423 - RNA, 20 nt, Mycobacterium avium subsp. paratuberculosis
gccgcaggcggccagcacca

SEQ ID NO: 2846424 - RNA, 13 nt, Mycobacterium avium subsp. paratuberculosis
gccgcaggguggc

SEQ ID NO: 2846425 - RNA, 18 nt, Mycobacterium avium subsp. paratuberculosis
gccgcaggguggccagca

SEQ ID NO: 2846426 - RNA, 18 nt, Mycobacterium avium subsp. paratuberculosis
gccgccagcaccaccguc

SEQ ID NO: 2846427 - RNA, 19 nt, Mycobacterium avium subsp. paratuberculosis
gccgccagcaccaccguca

SEQ ID NO: 2846428 - RNA, 13 nt, Mycobacterium avium subsp. paratuberculosis
gccgccagcaccu

SEQ ID NO: 2846429 - RNA, 15 nt, Mycobacterium avium subsp. paratuberculosis
gccgccagcaccucg

SEQ ID NO: 2846430 - RNA, 13 nt, Mycobacterium avium subsp. paratuberculosis
gccgccagcacgu

SEQ ID NO: 2846431 - RNA, 13 nt, Mycobacterium avium subsp. paratuberculosis
gccgccagcagca

SEQ ID NO: 2846432 - RNA, 15 nt, Mycobacterium avium subsp. paratuberculosis
gccgccagcagcacg

SEQ ID NO: 2846433 - RNA, 17 nt, Mycobacterium avium subsp. paratuberculosis
gccgccagcagcacggc

SEQ ID NO: 2846434 - RNA, 17 nt, Mycobacterium avium subsp. paratuberculosis
gccgccagcagcagcgc

SEQ ID NO: 2846435 - RNA, 23 nt, Mycobacterium avium subsp. paratuberculosis
gccgccagcaguguccagucggc

SEQ ID NO: 2846436 - RNA, 13 nt, Mycobacterium avium subsp. paratuberculosis
gccgccagccagc

SEQ ID NO: 2846437 - RNA, 15 nt, Mycobacterium avium subsp. paratuberculosis
gccgccagccagccg

SEQ ID NO: 2846438 - RNA, 13 nt, Mycobacterium avium subsp. paratuberculosis
gccgccagccgca

SEQ ID NO: 2846439 - RNA, 15 nt, Mycobacterium avium subsp. paratuberculosis
gccgccagccgcagc

SEQ ID NO: 2846440 - RNA, 17 nt, Mycobacterium avium subsp. paratuberculosis
gccgccagccgcgucuu

SEQ ID NO: 2846441 - RNA, 14 nt, Mycobacterium avium subsp. paratuberculosis
gccgccagccgguc

SEQ ID NO: 2846442 - RNA, 15 nt, Mycobacterium avium subsp. paratuberculosis
gccgccagccgguca

SEQ ID NO: 2846443 - RNA, 13 nt, Mycobacterium avium subsp. paratuberculosis
gccgccagcgcca

SEQ ID NO: 2846444 - RNA, 14 nt, Mycobacterium avium subsp. paratuberculosis
gccgccagcgcccg

SEQ ID NO: 2846445 - RNA, 15 nt, Mycobacterium avium subsp. paratuberculosis
gccgccagcgcccgc

SEQ ID NO: 2846446 - RNA, 18 nt, Mycobacterium avium subsp. paratuberculosis
gccgccagcgcccgcgcg

SEQ ID NO: 2846447 - RNA, 24 nt, Mycobacterium avium subsp. paratuberculosis
gccgccagcgcccgcgcgugggcc

SEQ ID NO: 2846448 - RNA, 17 nt, Mycobacterium avium subsp. paratuberculosis
gccgccagcgcggcgau

SEQ ID NO: 2846449 - RNA, 18 nt, Mycobacterium avium subsp. paratuberculosis
gccgccagcgcggggucg

SEQ ID NO: 2846450 - RNA, 19 nt, Mycobacterium avium subsp. paratuberculosis
gccgccagcgcggggucgg

SEQ ID NO: 2846451 - RNA, 22 nt, Mycobacterium avium subsp. paratuberculosis
gccgccagcgcggggucggcca

SEQ ID NO: 2846452 - RNA, 16 nt, Mycobacterium avium subsp. paratuberculosis
gccgccagcucgucca

SEQ ID NO: 2846453 - RNA, 19 nt, Mycobacterium avium subsp. paratuberculosis
gccgccaggaugucguccu

SEQ ID NO: 2846454 - RNA, 12 nt, Mycobacterium avium subsp. paratuberculosis
gccgccagggcc

SEQ ID NO: 2846455 - RNA, 16 nt, Mycobacterium avium subsp. paratuberculosis
gccgccagggccaggu

SEQ ID NO: 2846456 - RNA, 14 nt, Mycobacterium avium subsp. paratuberculosis
gccgccagggcgcg

SEQ ID NO: 2846457 - RNA, 16 nt, Mycobacterium avium subsp. paratuberculosis
gccgccagggcgcggc

SEQ ID NO: 2846458 - RNA, 17 nt, Mycobacterium avium subsp. paratuberculosis
gccgccagggcgcggcg

SEQ ID NO: 2846459 - RNA, 19 nt, Mycobacterium avium subsp. paratuberculosis
gccgccagggucucgggca

SEQ ID NO: 2846460 - RNA, 20 nt, Mycobacterium avium subsp. paratuberculosis
gccgccagggucucgggcag

SEQ ID NO: 2846461 - RNA, 16 nt, Mycobacterium avium subsp. paratuberculosis
gccgccaggucggggc

SEQ ID NO: 2846462 - RNA, 17 nt, Mycobacterium avium subsp. paratuberculosis
gccgccaggucggggcc

SEQ ID NO: 2846463 - RNA, 19 nt, Mycobacterium avium subsp. paratuberculosis
gccgccaggucggggcccg

SEQ ID NO: 2846464 - RNA, 17 nt, Mycobacterium avium subsp. paratuberculosis
gccgccagguuggcggc

SEQ ID NO: 2846465 - RNA, 18 nt, Mycobacterium avium subsp. paratuberculosis
gccgccaguuguuggccg

SEQ ID NO: 2846466 - RNA, 15 nt, Mycobacterium avium subsp. paratuberculosis
gccgccaucaccgcg

SEQ ID NO: 2846467 - RNA, 16 nt, Mycobacterium avium subsp. paratuberculosis
gccgccaucaccgcgc

SEQ ID NO: 2846468 - RNA, 17 nt, Mycobacterium avium subsp. paratuberculosis
gccgccaucaccgcgcu

SEQ ID NO: 2846469 - RNA, 14 nt, Mycobacterium avium subsp. paratuberculosis
gccgccauccgcgc

SEQ ID NO: 2846470 - RNA, 17 nt, Mycobacterium avium subsp. paratuberculosis
gccgccauccgcgccga

SEQ ID NO: 2846471 - RNA, 20 nt, Mycobacterium avium subsp. paratuberculosis
gccgccauccgcgccgaacg

SEQ ID NO: 2846472 - RNA, 20 nt, Mycobacterium avium subsp. paratuberculosis
gccgccauccguucggcucu

SEQ ID NO: 2846473 - RNA, 21 nt, Mycobacterium avium subsp. paratuberculosis
gccgccauccguucggcucug

SEQ ID NO: 2846474 - RNA, 19 nt, Mycobacterium avium subsp. paratuberculosis
gccgccauccugucauccg

SEQ ID NO: 2846475 - RNA, 17 nt, Mycobacterium avium subsp. paratuberculosis
gccgccaucgaucgggc

SEQ ID NO: 2846476 - RNA, 22 nt, Mycobacterium avium subsp. paratuberculosis
gccgccaucgaucgggcgucgc

SEQ ID NO: 2846477 - RNA, 16 nt, Mycobacterium avium subsp. paratuberculosis
gccgccaucgccgccg

SEQ ID NO: 2846478 - RNA, 17 nt, Mycobacterium avium subsp. paratuberculosis
gccgccaucgccgccgc

SEQ ID NO: 2846479 - RNA, 16 nt, Mycobacterium avium subsp. paratuberculosis
gccgccaucgccucgu

SEQ ID NO: 2846480 - RNA, 17 nt, Mycobacterium avium subsp. paratuberculosis
gccgccaucgccucguc

SEQ ID NO: 2846481 - RNA, 19 nt, Mycobacterium avium subsp. paratuberculosis
gccgccaucgccucguccc

SEQ ID NO: 2846482 - RNA, 16 nt, Mycobacterium avium subsp. paratuberculosis
gccgcccaacgacguc

SEQ ID NO: 2846483 - RNA, 17 nt, Mycobacterium avium subsp. paratuberculosis
gccgcccaacgacgucg

SEQ ID NO: 2846484 - RNA, 23 nt, Mycobacterium avium subsp. paratuberculosis
gccgcccaacgacgucggcguca

SEQ ID NO: 2846485 - RNA, 14 nt, Mycobacterium avium subsp. paratuberculosis
gccgcccacaccga

SEQ ID NO: 2846486 - RNA, 19 nt, Mycobacterium avium subsp. paratuberculosis
gccgcccacaccgacaccg

SEQ ID NO: 2846487 - RNA, 23 nt, Mycobacterium avium subsp. paratuberculosis
gccgcccacaccgacaccggccg

SEQ ID NO: 2846488 - RNA, 24 nt, Mycobacterium avium subsp. paratuberculosis
gccgcccacaccgacaccggccgg

SEQ ID NO: 2846489 - RNA, 14 nt, Mycobacterium avium subsp. paratuberculosis
gccgcccaccaccg

SEQ ID NO: 2846490 - RNA, 15 nt, Mycobacterium avium subsp. paratuberculosis
gccgcccaccaccgg

SEQ ID NO: 2846491 - RNA, 16 nt, Mycobacterium avium subsp. paratuberculosis
gccgcccaccaccggc

SEQ ID NO: 2846492 - RNA, 17 nt, Mycobacterium avium subsp. paratuberculosis
gccgcccaccaccggcu

SEQ ID NO: 2846493 - RNA, 18 nt, Mycobacterium avium subsp. paratuberculosis
gccgcccaccaccggcuu

SEQ ID NO: 2846494 - RNA, 13 nt, Mycobacterium avium subsp. paratuberculosis
gccgcccaccagc

SEQ ID NO: 2846495 - RNA, 17 nt, Mycobacterium avium subsp. paratuberculosis
gccgcccaccuucccaa

SEQ ID NO: 2846496 - RNA, 15 nt, Mycobacterium avium subsp. paratuberculosis
gccgcccacgccgcc

SEQ ID NO: 2846497 - RNA, 20 nt, Mycobacterium avium subsp. paratuberculosis
gccgcccacgccgcccaggc

SEQ ID NO: 2846498 - RNA, 21 nt, Mycobacterium avium subsp. paratuberculosis
gccgcccacgccgugcagaac

SEQ ID NO: 2846499 - RNA, 12 nt, Mycobacterium avium subsp. paratuberculosis
gccgcccagcag

SEQ ID NO: 2846500 - RNA, 13 nt, Mycobacterium avium subsp. paratuberculosis
gccgcccagcagc

SEQ ID NO: 2846501 - RNA, 19 nt, Mycobacterium avium subsp. paratuberculosis
gccgcccagcagcgggccc

SEQ ID NO: 2846502 - RNA, 20 nt, Mycobacterium avium subsp. paratuberculosis
gccgcccagcagcgggcccg

SEQ ID NO: 2846503 - RNA, 23 nt, Mycobacterium avium subsp. paratuberculosis
gccgcccagcagcgggcccgggc

SEQ ID NO: 2846504 - RNA, 13 nt, Mycobacterium avium subsp. paratuberculosis
gccgcccagcccg

SEQ ID NO: 2846505 - RNA, 16 nt, Mycobacterium avium subsp. paratuberculosis
gccgcccagcccgcgc

SEQ ID NO: 2846506 - RNA, 14 nt, Mycobacterium avium subsp. paratuberculosis
gccgcccagcggcc

SEQ ID NO: 2846507 - RNA, 15 nt, Mycobacterium avium subsp. paratuberculosis
gccgcccagcgguga

SEQ ID NO: 2846508 - RNA, 13 nt, Mycobacterium avium subsp. paratuberculosis
gccgcccaggccc

SEQ ID NO: 2846509 - RNA, 19 nt, Mycobacterium avium subsp. paratuberculosis
gccgcccaggccccggccg

SEQ ID NO: 2846510 - RNA, 19 nt, Mycobacterium avium subsp. paratuberculosis
gccgcccaggccgagcgca

SEQ ID NO: 2846511 - RNA, 17 nt, Mycobacterium avium subsp. paratuberculosis
gccgccgacagcaccuc

SEQ ID NO: 2846512 - RNA, 22 nt, Mycobacterium avium subsp. paratuberculosis
gccgccgaccacaugccguugc

SEQ ID NO: 2846513 - RNA, 14 nt, Mycobacterium avium subsp. paratuberculosis
gccgccgaccacgc

SEQ ID NO: 2846514 - RNA, 17 nt, Mycobacterium avium subsp. paratuberculosis
gccgccgaccacgccgc

SEQ ID NO: 2846515 - RNA, 18 nt, Mycobacterium avium subsp. paratuberculosis
gccgccgaccacgccgcg

SEQ ID NO: 2846516 - RNA, 21 nt, Mycobacterium avium subsp. paratuberculosis
gccgccgaccacgccgcgcuu

SEQ ID NO: 2846517 - RNA, 16 nt, Mycobacterium avium subsp. paratuberculosis
gccgccgaccgcccgc

SEQ ID NO: 2846518 - RNA, 17 nt, Mycobacterium avium subsp. paratuberculosis
gccgccgaccgcccgcu

SEQ ID NO: 2846519 - RNA, 14 nt, Mycobacterium avium subsp. paratuberculosis
gccgccgaccgccg

SEQ ID NO: 2846520 - RNA, 15 nt, Mycobacterium avium subsp. paratuberculosis
gccgccgaccgccga

SEQ ID NO: 2846521 - RNA, 17 nt, Mycobacterium avium subsp. paratuberculosis
gccgccgaccgccgagc

SEQ ID NO: 2846522 - RNA, 21 nt, Mycobacterium avium subsp. paratuberculosis
gccgccgaccgccgagcgggc

SEQ ID NO: 2846523 - RNA, 20 nt, Mycobacterium avium subsp. paratuberculosis
gccgccgacgaagaugcgcc

SEQ ID NO: 2846524 - RNA, 16 nt, Mycobacterium avium subsp. paratuberculosis
gccgccgacgacggcg

SEQ ID NO: 2846525 - RNA, 17 nt, Mycobacterium avium subsp. paratuberculosis
gccgccgacgacggcga

SEQ ID NO: 2846526 - RNA, 15 nt, Mycobacterium avium subsp. paratuberculosis
gccgccgacgauguc

SEQ ID NO: 2846527 - RNA, 13 nt, Mycobacterium avium subsp. paratuberculosis
gccgccgacggug

SEQ ID NO: 2846528 - RNA, 14 nt, Mycobacterium avium subsp. paratuberculosis
gccgccgacggugg

SEQ ID NO: 2846529 - RNA, 21 nt, Mycobacterium avium subsp. paratuberculosis
gccgccgacgguggcccccac

SEQ ID NO: 2846530 - RNA, 19 nt, Mycobacterium avium subsp. paratuberculosis
gccgccgacuccccgcccg

SEQ ID NO: 2846531 - RNA, 21 nt, Mycobacterium avium subsp. paratuberculosis
gccgccgacuccccgcccggc

SEQ ID NO: 2846532 - RNA, 22 nt, Mycobacterium avium subsp. paratuberculosis
gccgccgacugugcgaugucgg

SEQ ID NO: 2846533 - RNA, 17 nt, Mycobacterium avium subsp. paratuberculosis
gccgccgagcaacagcc

SEQ ID NO: 2846534 - RNA, 24 nt, Mycobacterium avium subsp. paratuberculosis
gccgccgagcaacagcccgaccgu

SEQ ID NO: 2846535 - RNA, 15 nt, Mycobacterium avium subsp. paratuberculosis
gccgccgagccgcgg

SEQ ID NO: 2846536 - RNA, 14 nt, Mycobacterium avium subsp. paratuberculosis
gccgccgagcguca

SEQ ID NO: 2846537 - RNA, 12 nt, Mycobacterium avium subsp. paratuberculosis
gccgccgagggc

SEQ ID NO: 2846538 - RNA, 16 nt, Mycobacterium avium subsp. paratuberculosis
gccgccgagggccagc

SEQ ID NO: 2846539 - RNA, 17 nt, Mycobacterium avium subsp. paratuberculosis
gccgccgagggccagca

SEQ ID NO: 2846540 - RNA, 20 nt, Mycobacterium avium subsp. paratuberculosis
gccgccgagggccagcagcc

SEQ ID NO: 2846541 - RNA, 23 nt, Mycobacterium avium subsp. paratuberculosis
gccgccgagggccagcagccagc

SEQ ID NO: 2846542 - RNA, 17 nt, Mycobacterium avium subsp. paratuberculosis
gccgccgaucaacaggc

SEQ ID NO: 2846543 - RNA, 19 nt, Mycobacterium avium subsp. paratuberculosis
gccgccgaucaacaggccc

SEQ ID NO: 2846544 - RNA, 21 nt, Mycobacterium avium subsp. paratuberculosis
gccgccgaucaacaggcccag

SEQ ID NO: 2846545 - RNA, 22 nt, Mycobacterium avium subsp. paratuberculosis
gccgccgaucaacaggcccagc

SEQ ID NO: 2846546 - RNA, 23 nt, Mycobacterium avium subsp. paratuberculosis
gccgccgaucaacaggcccagca

SEQ ID NO: 2846547 - RNA, 15 nt, Mycobacterium avium subsp. paratuberculosis
gccgccgaugacggc

SEQ ID NO: 2846548 - RNA, 16 nt, Mycobacterium avium subsp. paratuberculosis
gccgccgaugacggcg

SEQ ID NO: 2846549 - RNA, 17 nt, Mycobacterium avium subsp. paratuberculosis
gccgccgaugacggcgc

SEQ ID NO: 2846550 - RNA, 16 nt, Mycobacterium avium subsp. paratuberculosis
gccgccgaugcgcccg

SEQ ID NO: 2846551 - RNA, 17 nt, Mycobacterium avium subsp. paratuberculosis
gccgccgaugcgcccgc

SEQ ID NO: 2846552 - RNA, 21 nt, Mycobacterium avium subsp. paratuberculosis
gccgccgaugcgcccgcugcg

SEQ ID NO: 2846553 - RNA, 21 nt, Mycobacterium avium subsp. paratuberculosis
gccgccgaugugaucggcggc

SEQ ID NO: 2846554 - RNA, 22 nt, Mycobacterium avium subsp. paratuberculosis
gccgccgaugugaucggcggcc

SEQ ID NO: 2846555 - RNA, 21 nt, Mycobacterium avium subsp. paratuberculosis
gccgccgauucaaccccgcgc

SEQ ID NO: 2846556 - RNA, 16 nt, Mycobacterium avium subsp. paratuberculosis
gccgccgauuccggcc

SEQ ID NO: 2846557 - RNA, 17 nt, Mycobacterium avium subsp. paratuberculosis
gccgccgauuccggccg

SEQ ID NO: 2846558 - RNA, 18 nt, Mycobacterium avium subsp. paratuberculosis
gccgccgauuccggccgg

SEQ ID NO: 2846559 - RNA, 15 nt, Mycobacterium avium subsp. paratuberculosis
gccgccgcaccggcc

SEQ ID NO: 2846560 - RNA, 20 nt, Mycobacterium avium subsp. paratuberculosis
gccgccgcaccggccggccc

SEQ ID NO: 2846561 - RNA, 22 nt, Mycobacterium avium subsp. paratuberculosis
gccgccgcaccggccggccccg

SEQ ID NO: 2846562 - RNA, 14 nt, Mycobacterium avium subsp. paratuberculosis
gccgccgcagcagc

SEQ ID NO: 2846563 - RNA, 15 nt, Mycobacterium avium subsp. paratuberculosis
gccgccgcagcagcc

SEQ ID NO: 2846564 - RNA, 14 nt, Mycobacterium avium subsp. paratuberculosis
gccgccgcagcgca

SEQ ID NO: 2846565 - RNA, 16 nt, Mycobacterium avium subsp. paratuberculosis
gccgccgcagcgcagc

SEQ ID NO: 2846566 - RNA, 22 nt, Mycobacterium avium subsp. paratuberculosis
gccgccgcauuccucggccagc

SEQ ID NO: 2846567 - RNA, 23 nt, Mycobacterium avium subsp. paratuberculosis
gccgccgcauuccucggccagcu

SEQ ID NO: 2846568 - RNA, 14 nt, Mycobacterium avium subsp. paratuberculosis
gccgccgccaccgu

SEQ ID NO: 2846569 - RNA, 15 nt, Mycobacterium avium subsp. paratuberculosis
gccgccgccaccguc

SEQ ID NO: 2846570 - RNA, 16 nt, Mycobacterium avium subsp. paratuberculosis
gccgccgccaccgucg

SEQ ID NO: 2846571 - RNA, 20 nt, Mycobacterium avium subsp. paratuberculosis
gccgccgccaccgucgccgg

SEQ ID NO: 2846572 - RNA, 12 nt, Mycobacterium avium subsp. paratuberculosis
gccgccgccagc

SEQ ID NO: 2846573 - RNA, 14 nt, Mycobacterium avium subsp. paratuberculosis
gccgccgccagcac

SEQ ID NO: 2846574 - RNA, 20 nt, Mycobacterium avium subsp. paratuberculosis
gccgccgccagcaccaccgu

SEQ ID NO: 2846575 - RNA, 16 nt, Mycobacterium avium subsp. paratuberculosis
gccgccgccagcgcgg

SEQ ID NO: 2846576 - RNA, 12 nt, Mycobacterium avium subsp. paratuberculosis
gccgccgcccgc

SEQ ID NO: 2846577 - RNA, 21 nt, Mycobacterium avium subsp. paratuberculosis
gccgccgcccgcgcggcggcc

SEQ ID NO: 2846578 - RNA, 14 nt, Mycobacterium avium subsp. paratuberculosis
gccgccgcccuggc

SEQ ID NO: 2846579 - RNA, 19 nt, Mycobacterium avium subsp. paratuberculosis
gccgccgcccuggccccag

SEQ ID NO: 2846580 - RNA, 16 nt, Mycobacterium avium subsp. paratuberculosis
gccgccgccgaccaca

SEQ ID NO: 2846581 - RNA, 14 nt, Mycobacterium avium subsp. paratuberculosis
gccgccgccgagcu

SEQ ID NO: 2846582 - RNA, 17 nt, Mycobacterium avium subsp. paratuberculosis
gccgccgccgagcucgg

SEQ ID NO: 2846583 - RNA, 13 nt, Mycobacterium avium subsp. paratuberculosis
gccgccgccgauc

SEQ ID NO: 2846584 - RNA, 14 nt, Mycobacterium avium subsp. paratuberculosis
gccgccgccgccca

SEQ ID NO: 2846585 - RNA, 14 nt, Mycobacterium avium subsp. paratuberculosis
gccgccgccggcgg

SEQ ID NO: 2846586 - RNA, 16 nt, Mycobacterium avium subsp. paratuberculosis
gccgccgccggcggug

SEQ ID NO: 2846587 - RNA, 15 nt, Mycobacterium avium subsp. paratuberculosis
gccgccgccggcguc

SEQ ID NO: 2846588 - RNA, 12 nt, Mycobacterium avium subsp. paratuberculosis
gccgccgccggg

SEQ ID NO: 2846589 - RNA, 19 nt, Mycobacterium avium subsp. paratuberculosis
gccgccgcgaacucaggcg

SEQ ID NO: 2846590 - RNA, 15 nt, Mycobacterium avium subsp. paratuberculosis
gccgccgcgaccaca

SEQ ID NO: 2846591 - RNA, 12 nt, Mycobacterium avium subsp. paratuberculosis
gccgccgcgacg

SEQ ID NO: 2846592 - RNA, 17 nt, Mycobacterium avium subsp. paratuberculosis
gccgccgcgacgaugcc

SEQ ID NO: 2846593 - RNA, 18 nt, Mycobacterium avium subsp. paratuberculosis
gccgccgcgacgaugccg

SEQ ID NO: 2846594 - RNA, 20 nt, Mycobacterium avium subsp. paratuberculosis
gccgccgcgacgaugccggc

SEQ ID NO: 2846595 - RNA, 23 nt, Mycobacterium avium subsp. paratuberculosis
gccgccgcgacgaugccggcguc

SEQ ID NO: 2846596 - RNA, 16 nt, Mycobacterium avium subsp. paratuberculosis
gccgccgggccgccga

SEQ ID NO: 2846597 - RNA, 14 nt, Mycobacterium avium subsp. paratuberculosis
gccgccgggccggc

SEQ ID NO: 2846598 - RNA, 20 nt, Mycobacterium avium subsp. paratuberculosis
gccgccgggccggcggccag

SEQ ID NO: 2846599 - RNA, 12 nt, Mycobacterium avium subsp. paratuberculosis
gccgccgggccu

SEQ ID NO: 2846600 - RNA, 16 nt, Mycobacterium avium subsp. paratuberculosis
gccgccgggcgccacc

SEQ ID NO: 2846601 - RNA, 19 nt, Mycobacterium avium subsp. paratuberculosis
gccgccgggcgccacccgc

SEQ ID NO: 2846602 - RNA, 13 nt, Mycobacterium avium subsp. paratuberculosis
gccgccgggcgua

SEQ ID NO: 2846603 - RNA, 22 nt, Mycobacterium avium subsp. paratuberculosis
gccgccgggcguagucgauggc

SEQ ID NO: 2846604 - RNA, 15 nt, Mycobacterium avium subsp. paratuberculosis
gccgccggggacccg

SEQ ID NO: 2846605 - RNA, 16 nt, Mycobacterium avium subsp. paratuberculosis
gccgccggggacccgc

SEQ ID NO: 2846606 - RNA, 18 nt, Mycobacterium avium subsp. paratuberculosis
gccgccggggacccgcac

SEQ ID NO: 2846607 - RNA, 22 nt, Mycobacterium avium subsp. paratuberculosis
gccgccggggacccgcaccgga

SEQ ID NO: 2846608 - RNA, 12 nt, Mycobacterium avium subsp. paratuberculosis
gccgccggggcc

SEQ ID NO: 2846609 - RNA, 13 nt, Mycobacterium avium subsp. paratuberculosis
gccgccggggcgc

SEQ ID NO: 2846610 - RNA, 15 nt, Mycobacterium avium subsp. paratuberculosis
gccgccggggcgccg

SEQ ID NO: 2846611 - RNA, 19 nt, Mycobacterium avium subsp. paratuberculosis
gccgccggggcgccgccga

SEQ ID NO: 2846612 - RNA, 20 nt, Mycobacterium avium subsp. paratuberculosis
gccgccggggcgccgccgaa

SEQ ID NO: 2846613 - RNA, 22 nt, Mycobacterium avium subsp. paratuberculosis
gccgccggggcgggcagcacca

SEQ ID NO: 2846614 - RNA, 13 nt, Mycobacterium avium subsp. paratuberculosis
gccgccggggcgu

SEQ ID NO: 2846615 - RNA, 15 nt, Mycobacterium avium subsp. paratuberculosis
gccgccggggcgucg

SEQ ID NO: 2846616 - RNA, 16 nt, Mycobacterium avium subsp. paratuberculosis
gccgccggggcgucgg

SEQ ID NO: 2846617 - RNA, 17 nt, Mycobacterium avium subsp. paratuberculosis
gccgccggggcgucgga

SEQ ID NO: 2846618 - RNA, 15 nt, Mycobacterium avium subsp. paratuberculosis
gccgccggggugcac

SEQ ID NO: 2846619 - RNA, 21 nt, Mycobacterium avium subsp. paratuberculosis
gccgccggggugcaccguggu

SEQ ID NO: 2846620 - RNA, 22 nt, Mycobacterium avium subsp. paratuberculosis
gccgccggggugcaccguggug

SEQ ID NO: 2846621 - RNA, 21 nt, Mycobacterium avium subsp. paratuberculosis
gccgccggguccuugcgcccc

SEQ ID NO: 2846622 - RNA, 22 nt, Mycobacterium avium subsp. paratuberculosis
gccgccggguccuugcgccccg

SEQ ID NO: 2846623 - RNA, 12 nt, Mycobacterium avium subsp. paratuberculosis
gccgccgggugg

SEQ ID NO: 2846624 - RNA, 14 nt, Mycobacterium avium subsp. paratuberculosis
gccgccggguggcg

SEQ ID NO: 2846625 - RNA, 13 nt, Mycobacterium avium subsp. paratuberculosis
gccgccggucacg

SEQ ID NO: 2846626 - RNA, 20 nt, Mycobacterium avium subsp. paratuberculosis
gccgccggucacggcgucgg

SEQ ID NO: 2846627 - RNA, 23 nt, Mycobacterium avium subsp. paratuberculosis
gccgccggucacggcgucggcgu

SEQ ID NO: 2846628 - RNA, 16 nt, Mycobacterium avium subsp. paratuberculosis
gccgccgguccagugc

SEQ ID NO: 2846629 - RNA, 14 nt, Mycobacterium avium subsp. paratuberculosis
gccgccggucgccc

SEQ ID NO: 2846630 - RNA, 16 nt, Mycobacterium avium subsp. paratuberculosis
gccgccggugaacacg

SEQ ID NO: 2846631 - RNA, 22 nt, Mycobacterium avium subsp. paratuberculosis
gccgccggugaacacgaacggc

SEQ ID NO: 2846632 - RNA, 20 nt, Mycobacterium avium subsp. paratuberculosis
gccgccggugaagaucagcg

SEQ ID NO: 2846633 - RNA, 23 nt, Mycobacterium avium subsp. paratuberculosis
gccgccggugaagaucagcgcgu

SEQ ID NO: 2846634 - RNA, 13 nt, Mycobacterium avium subsp. paratuberculosis
gccgccggugacc

SEQ ID NO: 2846635 - RNA, 14 nt, Mycobacterium avium subsp. paratuberculosis
gccgccggugccga

SEQ ID NO: 2846636 - RNA, 17 nt, Mycobacterium avium subsp. paratuberculosis
gccgccggugccgacga

SEQ ID NO: 2846637 - RNA, 22 nt, Mycobacterium avium subsp. paratuberculosis
gccgccgguggagauggccagc

SEQ ID NO: 2846638 - RNA, 23 nt, Mycobacterium avium subsp. paratuberculosis
gccgccgguggagauggccagca

SEQ ID NO: 2846639 - RNA, 13 nt, Mycobacterium avium subsp. paratuberculosis
gccgccgguggcg

SEQ ID NO: 2846640 - RNA, 20 nt, Mycobacterium avium subsp. paratuberculosis
gccgccgguggcgucgguga

SEQ ID NO: 2846641 - RNA, 22 nt, Mycobacterium avium subsp. paratuberculosis
gccgccgguugaucacccgggu

SEQ ID NO: 2846642 - RNA, 17 nt, Mycobacterium avium subsp. paratuberculosis
gccgccguagccggcgg

SEQ ID NO: 2846643 - RNA, 21 nt, Mycobacterium avium subsp. paratuberculosis
gccgccguagccggcgguggc

SEQ ID NO: 2846644 - RNA, 17 nt, Mycobacterium avium subsp. paratuberculosis
gccgccguaucccugcc

SEQ ID NO: 2846645 - RNA, 13 nt, Mycobacterium avium subsp. paratuberculosis
gccgccguccagc

SEQ ID NO: 2846646 - RNA, 18 nt, Mycobacterium avium subsp. paratuberculosis
gccgccguccagcgucac

SEQ ID NO: 2846647 - RNA, 21 nt, Mycobacterium avium subsp. paratuberculosis
gccgccgucccaccggcgaug

SEQ ID NO: 2846648 - RNA, 12 nt, Mycobacterium avium subsp. paratuberculosis
gccgccgucccc

SEQ ID NO: 2846649 - RNA, 15 nt, Mycobacterium avium subsp. paratuberculosis
gccgccguccccgcg

SEQ ID NO: 2846650 - RNA, 20 nt, Mycobacterium avium subsp. paratuberculosis
gccgccguccccgcgcggcu

SEQ ID NO: 2846651 - RNA, 13 nt, Mycobacterium avium subsp. paratuberculosis
gccgccgucgacg

SEQ ID NO: 2846652 - RNA, 14 nt, Mycobacterium avium subsp. paratuberculosis
gccgccgucgacga

SEQ ID NO: 2846653 - RNA, 17 nt, Mycobacterium avium subsp. paratuberculosis
gccgccgucgacgacga

SEQ ID NO: 2846654 - RNA, 18 nt, Mycobacterium avium subsp. paratuberculosis
gccgccgucgacgacgaa

SEQ ID NO: 2846655 - RNA, 13 nt, Mycobacterium avium subsp. paratuberculosis
gccgccgucgcca

SEQ ID NO: 2846656 - RNA, 20 nt, Mycobacterium avium subsp. paratuberculosis
gccgccgucgccaccaccgc

SEQ ID NO: 2846657 - RNA, 23 nt, Mycobacterium avium subsp. paratuberculosis
gccgccgucgccaccaccgcgcc

SEQ ID NO: 2846658 - RNA, 14 nt, Mycobacterium avium subsp. paratuberculosis
gccgccgucgcgcc

SEQ ID NO: 2846659 - RNA, 21 nt, Mycobacterium avium subsp. paratuberculosis
gccgccgucgcgccaggacca

SEQ ID NO: 2846660 - RNA, 14 nt, Mycobacterium avium subsp. paratuberculosis
gccgccgucggugu

SEQ ID NO: 2846661 - RNA, 16 nt, Mycobacterium avium subsp. paratuberculosis
gccgccgucguagccg

SEQ ID NO: 2846662 - RNA, 18 nt, Mycobacterium avium subsp. paratuberculosis
gccgccgugcgcggcgac

SEQ ID NO: 2846663 - RNA, 17 nt, Mycobacterium avium subsp. paratuberculosis
gccgccguggcccacgc

SEQ ID NO: 2846664 - RNA, 17 nt, Mycobacterium avium subsp. paratuberculosis
gccgccguguaggccgc

SEQ ID NO: 2846665 - RNA, 12 nt, Mycobacterium avium subsp. paratuberculosis
gccgccguucgc

SEQ ID NO: 2846666 - RNA, 17 nt, Mycobacterium avium subsp. paratuberculosis
gccgccguucgccggcg

SEQ ID NO: 2846667 - RNA, 22 nt, Mycobacterium avium subsp. paratuberculosis
gccgccguucgccggcgacggc

SEQ ID NO: 2846668 - RNA, 20 nt, Mycobacterium avium subsp. paratuberculosis
gccgccguucucgcgcaggu

SEQ ID NO: 2846669 - RNA, 13 nt, Mycobacterium avium subsp. paratuberculosis
gccgccucacgca

SEQ ID NO: 2846670 - RNA, 14 nt, Mycobacterium avium subsp. paratuberculosis
gccgccucacgcag

SEQ ID NO: 2846671 - RNA, 15 nt, Mycobacterium avium subsp. paratuberculosis
gccgccuccagcacg

SEQ ID NO: 2846672 - RNA, 15 nt, Mycobacterium avium subsp. paratuberculosis
gccgccucccgcagc

SEQ ID NO: 2846673 - RNA, 21 nt, Mycobacterium avium subsp. paratuberculosis
gccgccucccgcagcgccagc

SEQ ID NO: 2846674 - RNA, 17 nt, Mycobacterium avium subsp. paratuberculosis
gccgccuccgacagccg

SEQ ID NO: 2846675 - RNA, 18 nt, Mycobacterium avium subsp. paratuberculosis
gccgccuccgacagccgc

SEQ ID NO: 2846676 - RNA, 19 nt, Mycobacterium avium subsp. paratuberculosis
gccgccuccgacagccgca

SEQ ID NO: 2846677 - RNA, 14 nt, Mycobacterium avium subsp. paratuberculosis
gccgccuccgggcu

SEQ ID NO: 2846678 - RNA, 15 nt, Mycobacterium avium subsp. paratuberculosis
gccgccuccgggcug

SEQ ID NO: 2846679 - RNA, 18 nt, Mycobacterium avium subsp. paratuberculosis
gccgccucgaagucgccg

SEQ ID NO: 2846680 - RNA, 23 nt, Mycobacterium avium subsp. paratuberculosis
gccgccucgaagucgccggccuc

SEQ ID NO: 2846681 - RNA, 22 nt, Mycobacterium avium subsp. paratuberculosis
gccgcgagucgagguugaugcc

SEQ ID NO: 2846682 - RNA, 17 nt, Mycobacterium avium subsp. paratuberculosis
gccgcgauccagcgcug

SEQ ID NO: 2846683 - RNA, 14 nt, Mycobacterium avium subsp. paratuberculosis
gccgcgauccgggc

SEQ ID NO: 2846684 - RNA, 22 nt, Mycobacterium avium subsp. paratuberculosis
gccgcgauccgggcauggucac

SEQ ID NO: 2846685 - RNA, 16 nt, Mycobacterium avium subsp. paratuberculosis
gccgcgaucgccaacg

SEQ ID NO: 2846686 - RNA, 19 nt, Mycobacterium avium subsp. paratuberculosis
gccgcgaucgccaacgcgc

SEQ ID NO: 2846687 - RNA, 14 nt, Mycobacterium avium subsp. paratuberculosis
gccgcgaucggcgu

SEQ ID NO: 2846688 - RNA, 21 nt, Mycobacterium avium subsp. paratuberculosis
gccgcgaucucggcggacucg

SEQ ID NO: 2846689 - RNA, 15 nt, Mycobacterium avium subsp. paratuberculosis
gccgcgaucuugccg

SEQ ID NO: 2846690 - RNA, 15 nt, Mycobacterium avium subsp. paratuberculosis
gccgcgaugaggcuc

SEQ ID NO: 2846691 - RNA, 18 nt, Mycobacterium avium subsp. paratuberculosis
gccgcgaugcaacaccga

SEQ ID NO: 2846692 - RNA, 23 nt, Mycobacterium avium subsp. paratuberculosis
gccgcgaugcaacaccgaacgcc

SEQ ID NO: 2846693 - RNA, 19 nt, Mycobacterium avium subsp. paratuberculosis
gccgcgaugcccgccggcc

SEQ ID NO: 2846694 - RNA, 22 nt, Mycobacterium avium subsp. paratuberculosis
gccgcgaugucggugggccgca

SEQ ID NO: 2846695 - RNA, 13 nt, Mycobacterium avium subsp. paratuberculosis
gccgcgcaccacc

SEQ ID NO: 2846696 - RNA, 23 nt, Mycobacterium avium subsp. paratuberculosis
gccgcgcaccaccucuucgugca

SEQ ID NO: 2846697 - RNA, 20 nt, Mycobacterium avium subsp. paratuberculosis
gccgcgcaccacgguggcgc

SEQ ID NO: 2846698 - RNA, 21 nt, Mycobacterium avium subsp. paratuberculosis
gccgcgcaccacgguggcgcc

SEQ ID NO: 2846699 - RNA, 22 nt, Mycobacterium avium subsp. paratuberculosis
gccgcgcaccccgaaccgcccg

SEQ ID NO: 2846700 - RNA, 13 nt, Mycobacterium avium subsp. paratuberculosis
gccgcgcacccgg

SEQ ID NO: 2846701 - RNA, 15 nt, Mycobacterium avium subsp. paratuberculosis
gccgcgcacccggcc

SEQ ID NO: 2846702 - RNA, 17 nt, Mycobacterium avium subsp. paratuberculosis
gccgcgcacccggccac

SEQ ID NO: 2846703 - RNA, 12 nt, Mycobacterium avium subsp. paratuberculosis
gccgcgcaccgc

SEQ ID NO: 2846704 - RNA, 16 nt, Mycobacterium avium subsp. paratuberculosis
gccgcgcacgacgugg

SEQ ID NO: 2846705 - RNA, 22 nt, Mycobacterium avium subsp. paratuberculosis
gccgcgcacgacguggagucga

SEQ ID NO: 2846706 - RNA, 20 nt, Mycobacterium avium subsp. paratuberculosis
gccgcgcacuggagugcugc

SEQ ID NO: 2846707 - RNA, 22 nt, Mycobacterium avium subsp. paratuberculosis
gccgcgcacuggagugcugcag

SEQ ID NO: 2846708 - RNA, 23 nt, Mycobacterium avium subsp. paratuberculosis
gccgcgcacuggagugcugcaga

SEQ ID NO: 2846709 - RNA, 15 nt, Mycobacterium avium subsp. paratuberculosis
gccgcgcagaucgau

SEQ ID NO: 2846710 - RNA, 19 nt, Mycobacterium avium subsp. paratuberculosis
gccgcgcagaucgccagca

SEQ ID NO: 2846711 - RNA, 20 nt, Mycobacterium avium subsp. paratuberculosis
gccgcgcagaucgccagcac

SEQ ID NO: 2846712 - RNA, 12 nt, Mycobacterium avium subsp. paratuberculosis
gccgcgcagcac

SEQ ID NO: 2846713 - RNA, 13 nt, Mycobacterium avium subsp. paratuberculosis
gccgcgcagcacc

SEQ ID NO: 2846714 - RNA, 14 nt, Mycobacterium avium subsp. paratuberculosis
gccgcgcagcaccg

SEQ ID NO: 2846715 - RNA, 16 nt, Mycobacterium avium subsp. paratuberculosis
gccgcgcagcaccgcg

SEQ ID NO: 2846716 - RNA, 17 nt, Mycobacterium avium subsp. paratuberculosis
gccgcgcagcaccgcgu

SEQ ID NO: 2846717 - RNA, 19 nt, Mycobacterium avium subsp. paratuberculosis
gccgcgcagcaccgcgucg

SEQ ID NO: 2846718 - RNA, 22 nt, Mycobacterium avium subsp. paratuberculosis
gccgcgcagcaccgcgucggcg

SEQ ID NO: 2846719 - RNA, 17 nt, Mycobacterium avium subsp. paratuberculosis
gccgcgcagcaccguca

SEQ ID NO: 2846720 - RNA, 17 nt, Mycobacterium avium subsp. paratuberculosis
gccgcgcagccagaccu

SEQ ID NO: 2846721 - RNA, 20 nt, Mycobacterium avium subsp. paratuberculosis
gccgcgcagccagaccucgc

SEQ ID NO: 2846722 - RNA, 22 nt, Mycobacterium avium subsp. paratuberculosis
gccgcgcagccagaccucgccg

SEQ ID NO: 2846723 - RNA, 15 nt, Mycobacterium avium subsp. paratuberculosis
gccgcgcagcggggc

SEQ ID NO: 2846724 - RNA, 15 nt, Mycobacterium avium subsp. paratuberculosis
gccgcgcagcguguc

SEQ ID NO: 2846725 - RNA, 21 nt, Mycobacterium avium subsp. paratuberculosis
gccgcgcagcgugucgggguc

SEQ ID NO: 2846726 - RNA, 14 nt, Mycobacterium avium subsp. paratuberculosis
gccgcgcagcucga

SEQ ID NO: 2846727 - RNA, 14 nt, Mycobacterium avium subsp. paratuberculosis
gccgcgcagcucgg

SEQ ID NO: 2846728 - RNA, 22 nt, Mycobacterium avium subsp. paratuberculosis
gccgcgcagcucggggucggcg

SEQ ID NO: 2846729 - RNA, 13 nt, Mycobacterium avium subsp. paratuberculosis
gccgcgcaggccg

SEQ ID NO: 2846730 - RNA, 17 nt, Mycobacterium avium subsp. paratuberculosis
gccgcgcaggccgccga

SEQ ID NO: 2846731 - RNA, 18 nt, Mycobacterium avium subsp. paratuberculosis
gccgcgcaggccgccgac

SEQ ID NO: 2846732 - RNA, 19 nt, Mycobacterium avium subsp. paratuberculosis
gccgcgcaggccgccgacg

SEQ ID NO: 2846733 - RNA, 21 nt, Mycobacterium avium subsp. paratuberculosis
gccgcgcaggccgccgacgac

SEQ ID NO: 2846734 - RNA, 22 nt, Mycobacterium avium subsp. paratuberculosis
gccgcgcaucaucgcccagcgc

SEQ ID NO: 2846735 - RNA, 13 nt, Mycobacterium avium subsp. paratuberculosis
gccgcgcauccgc

SEQ ID NO: 2846736 - RNA, 15 nt, Mycobacterium avium subsp. paratuberculosis
gccgcgcauccgcac

SEQ ID NO: 2846737 - RNA, 16 nt, Mycobacterium avium subsp. paratuberculosis
gccgcgccaacgaggc

SEQ ID NO: 2846738 - RNA, 14 nt, Mycobacterium avium subsp. paratuberculosis
gccgcgccacagcg

SEQ ID NO: 2846739 - RNA, 17 nt, Mycobacterium avium subsp. paratuberculosis
gccgcgccaccgaggcc

SEQ ID NO: 2846740 - RNA, 23 nt, Mycobacterium avium subsp. paratuberculosis
gccgcgccaccgaggccagcaga

SEQ ID NO: 2846741 - RNA, 13 nt, Mycobacterium avium subsp. paratuberculosis
gccgcgccaccgc

SEQ ID NO: 2846742 - RNA, 18 nt, Mycobacterium avium subsp. paratuberculosis
gccgcgccaccgcggggc

SEQ ID NO: 2846743 - RNA, 22 nt, Mycobacterium avium subsp. paratuberculosis
gccgcgccaccgcggggcuggg

SEQ ID NO: 2846744 - RNA, 14 nt, Mycobacterium avium subsp. paratuberculosis
gccgcgccacgcgc

SEQ ID NO: 2846745 - RNA, 17 nt, Mycobacterium avium subsp. paratuberculosis
gccgcgccacgcgcagg

SEQ ID NO: 2846746 - RNA, 12 nt, Mycobacterium avium subsp. paratuberculosis
gccgcgccagca

SEQ ID NO: 2846747 - RNA, 15 nt, Mycobacterium avium subsp. paratuberculosis
gccgcgccagcaccu

SEQ ID NO: 2846748 - RNA, 19 nt, Mycobacterium avium subsp. paratuberculosis
gccgcgccagcaccucggc

SEQ ID NO: 2846749 - RNA, 13 nt, Mycobacterium avium subsp. paratuberculosis
gccgcgccagccg

SEQ ID NO: 2846750 - RNA, 20 nt, Mycobacterium avium subsp. paratuberculosis
gccgcgccagccgccgccga

SEQ ID NO: 2846751 - RNA, 21 nt, Mycobacterium avium subsp. paratuberculosis
gccgcgccagccgccgccgac

SEQ ID NO: 2846752 - RNA, 14 nt, Mycobacterium avium subsp. paratuberculosis
gccgcgcccacccg

SEQ ID NO: 2846753 - RNA, 15 nt, Mycobacterium avium subsp. paratuberculosis
gccgcgcccacccgc

SEQ ID NO: 2846754 - RNA, 18 nt, Mycobacterium avium subsp. paratuberculosis
gccgcgcccacccgcgca

SEQ ID NO: 2846755 - RNA, 21 nt, Mycobacterium avium subsp. paratuberculosis
gccgcgcccacccgcgcacgc

SEQ ID NO: 2846756 - RNA, 14 nt, Mycobacterium avium subsp. paratuberculosis
gccgcgcccagcac

SEQ ID NO: 2846757 - RNA, 20 nt, Mycobacterium avium subsp. paratuberculosis
gccgcgcccaguguggggcc

SEQ ID NO: 2846758 - RNA, 20 nt, Mycobacterium avium subsp. paratuberculosis
gccgcgcccaucgcggccgc

SEQ ID NO: 2846759 - RNA, 15 nt, Mycobacterium avium subsp. paratuberculosis
gccgcgccccgagca

SEQ ID NO: 2846760 - RNA, 17 nt, Mycobacterium avium subsp. paratuberculosis
gccgcgccccgagcagc

SEQ ID NO: 2846761 - RNA, 20 nt, Mycobacterium avium subsp. paratuberculosis
gccgcgccccggcgcgccug

SEQ ID NO: 2846762 - RNA, 13 nt, Mycobacterium avium subsp. paratuberculosis
gccgcgcccgccg

SEQ ID NO: 2846763 - RNA, 23 nt, Mycobacterium avium subsp. paratuberculosis
gccgcgcccgccggcccagcucc

SEQ ID NO: 2846764 - RNA, 11 nt, Mycobacterium avium subsp. paratuberculosis
gccgcgcccgg

SEQ ID NO: 2846765 - RNA, 13 nt, Mycobacterium avium subsp. paratuberculosis
gccgcgcccggcu

SEQ ID NO: 2846766 - RNA, 22 nt, Mycobacterium avium subsp. paratuberculosis
gccgcgcguagaucaucuggcu

SEQ ID NO: 2846767 - RNA, 14 nt, Mycobacterium avium subsp. paratuberculosis
gccgcgcgugcagc

SEQ ID NO: 2846768 - RNA, 20 nt, Mycobacterium avium subsp. paratuberculosis
gccgcgcgugcagccgggcg

SEQ ID NO: 2846769 - RNA, 17 nt, Mycobacterium avium subsp. paratuberculosis
gccgcgcgugcccgcgg

SEQ ID NO: 2846770 - RNA, 19 nt, Mycobacterium avium subsp. paratuberculosis
gccgcgcgugcccgcgguc

SEQ ID NO: 2846771 - RNA, 13 nt, Mycobacterium avium subsp. paratuberculosis
gccgcgcgugcgc

SEQ ID NO: 2846772 - RNA, 20 nt, Mycobacterium avium subsp. paratuberculosis
gccgcgcucaacccgggccg

SEQ ID NO: 2846773 - RNA, 23 nt, Mycobacterium avium subsp. paratuberculosis
gccgcgcucaacccgggccggac

SEQ ID NO: 2846774 - RNA, 13 nt, Mycobacterium avium subsp. paratuberculosis
gccgcgcucgaac

SEQ ID NO: 2846775 - RNA, 19 nt, Mycobacterium avium subsp. paratuberculosis
gccgcgcucgaacucaccg

SEQ ID NO: 2846776 - RNA, 20 nt, Mycobacterium avium subsp. paratuberculosis
gccgcgcucgaacucaccgg

SEQ ID NO: 2846777 - RNA, 17 nt, Mycobacterium avium subsp. paratuberculosis
gccgcgcucgcaccagc

SEQ ID NO: 2846778 - RNA, 18 nt, Mycobacterium avium subsp. paratuberculosis
gccgcgcucgcaccagcg

SEQ ID NO: 2846779 - RNA, 14 nt, Mycobacterium avium subsp. paratuberculosis
gccgcgcucggcca

SEQ ID NO: 2846780 - RNA, 15 nt, Mycobacterium avium subsp. paratuberculosis
gccgcgcucggccau

SEQ ID NO: 2846781 - RNA, 16 nt, Mycobacterium avium subsp. paratuberculosis
gccgcgcucggccauc

SEQ ID NO: 2846782 - RNA, 18 nt, Mycobacterium avium subsp. paratuberculosis
gccgcgcucggccauccg

SEQ ID NO: 2846783 - RNA, 16 nt, Mycobacterium avium subsp. paratuberculosis
gccgcgcugaacgcgg

SEQ ID NO: 2846784 - RNA, 18 nt, Mycobacterium avium subsp. paratuberculosis
gccgcgcugaacgcggug

SEQ ID NO: 2846785 - RNA, 16 nt, Mycobacterium avium subsp. paratuberculosis
gccgcgcugcgccggg

SEQ ID NO: 2846786 - RNA, 15 nt, Mycobacterium avium subsp. paratuberculosis
gccgcgcuggccagc

SEQ ID NO: 2846787 - RNA, 14 nt, Mycobacterium avium subsp. paratuberculosis
gccgcgcuggccga

SEQ ID NO: 2846788 - RNA, 14 nt, Mycobacterium avium subsp. paratuberculosis
gccgcgcuggccgg

SEQ ID NO: 2846789 - RNA, 22 nt, Mycobacterium avium subsp. paratuberculosis
gccgcgcuggccggguuccggu

SEQ ID NO: 2846790 - RNA, 14 nt, Mycobacterium avium subsp. paratuberculosis
gccgcgcuggcgca

SEQ ID NO: 2846791 - RNA, 15 nt, Mycobacterium avium subsp. paratuberculosis
gccgcgcuggcgcag

SEQ ID NO: 2846792 - RNA, 19 nt, Mycobacterium avium subsp. paratuberculosis
gccgcgcuggcgcaggcgc

SEQ ID NO: 2846793 - RNA, 23 nt, Mycobacterium avium subsp. paratuberculosis
gccgcgcuggcgcaggcgcuggg

SEQ ID NO: 2846794 - RNA, 19 nt, Mycobacterium avium subsp. paratuberculosis
gccgcgcuggucaacucga

SEQ ID NO: 2846795 - RNA, 23 nt, Mycobacterium avium subsp. paratuberculosis
gccgcgcuggucaacucgacccg

SEQ ID NO: 2846796 - RNA, 16 nt, Mycobacterium avium subsp. paratuberculosis
gccgcgcuguccacgu

SEQ ID NO: 2846797 - RNA, 15 nt, Mycobacterium avium subsp. paratuberculosis
gccgcgcuugacggc

SEQ ID NO: 2846798 - RNA, 14 nt, Mycobacterium avium subsp. paratuberculosis
gccgcgcuugcgac

SEQ ID NO: 2846799 - RNA, 17 nt, Mycobacterium avium subsp. paratuberculosis
gccgcgcuugcgaccgc

SEQ ID NO: 2846800 - RNA, 20 nt, Mycobacterium avium subsp. paratuberculosis
gccgcgcuugcgaccgccgc

SEQ ID NO: 2846801 - RNA, 18 nt, Mycobacterium avium subsp. paratuberculosis
gccgcgcuugcgaucgcc

SEQ ID NO: 2846802 - RNA, 13 nt, Mycobacterium avium subsp. paratuberculosis
gccgcggaacgca

SEQ ID NO: 2846803 - RNA, 16 nt, Mycobacterium avium subsp. paratuberculosis
gccgcggaagccccag

SEQ ID NO: 2846804 - RNA, 19 nt, Mycobacterium avium subsp. paratuberculosis
gccgcggaagccccaggcc

SEQ ID NO: 2846805 - RNA, 20 nt, Mycobacterium avium subsp. paratuberculosis
gccgcggaagccccaggccc

SEQ ID NO: 2846806 - RNA, 16 nt, Mycobacterium avium subsp. paratuberculosis
gccgcggaaggccagc

SEQ ID NO: 2846807 - RNA, 17 nt, Mycobacterium avium subsp. paratuberculosis
gccgcggaaggccagcu

SEQ ID NO: 2846808 - RNA, 19 nt, Mycobacterium avium subsp. paratuberculosis
gccgcggaaggccagcucc

SEQ ID NO: 2846809 - RNA, 20 nt, Mycobacterium avium subsp. paratuberculosis
gccgcggacauucugcacga

SEQ ID NO: 2846810 - RNA, 18 nt, Mycobacterium avium subsp. paratuberculosis
gccgcggaccccagcgug

SEQ ID NO: 2846811 - RNA, 19 nt, Mycobacterium avium subsp. paratuberculosis
gccgcggaccccagcguga

SEQ ID NO: 2846812 - RNA, 22 nt, Mycobacterium avium subsp. paratuberculosis
gccgcggaccccagcgugacgu

SEQ ID NO: 2846813 - RNA, 15 nt, Mycobacterium avium subsp. paratuberculosis
gccgcggacccgacg

SEQ ID NO: 2846814 - RNA, 14 nt, Mycobacterium avium subsp. paratuberculosis
gccgcggacggcca

SEQ ID NO: 2846815 - RNA, 15 nt, Mycobacterium avium subsp. paratuberculosis
gccgcggacggccag

SEQ ID NO: 2846816 - RNA, 16 nt, Mycobacterium avium subsp. paratuberculosis
gccgcggacggccagc

SEQ ID NO: 2846817 - RNA, 17 nt, Mycobacterium avium subsp. paratuberculosis
gccgcggacggccagcc

SEQ ID NO: 2846818 - RNA, 19 nt, Mycobacterium avium subsp. paratuberculosis
gccgcggacggccagcccg

SEQ ID NO: 2846819 - RNA, 13 nt, Mycobacterium avium subsp. paratuberculosis
gccgcggacggcg

SEQ ID NO: 2846820 - RNA, 16 nt, Mycobacterium avium subsp. paratuberculosis
gccgcggacggcgaac

SEQ ID NO: 2846821 - RNA, 16 nt, Mycobacterium avium subsp. paratuberculosis
gccgcggaguaggcgc

SEQ ID NO: 2846822 - RNA, 20 nt, Mycobacterium avium subsp. paratuberculosis
gccgcggaguaggcgccgcc

SEQ ID NO: 2846823 - RNA, 17 nt, Mycobacterium avium subsp. paratuberculosis
gccgcggaucagcagga

SEQ ID NO: 2846824 - RNA, 23 nt, Mycobacterium avium subsp. paratuberculosis
gccgcggaucgguuucuccaccc

SEQ ID NO: 2846825 - RNA, 18 nt, Mycobacterium avium subsp. paratuberculosis
gccgcggaugaccagguc

SEQ ID NO: 2846826 - RNA, 20 nt, Mycobacterium avium subsp. paratuberculosis
gccgcggaugaccaggucgc

SEQ ID NO: 2846827 - RNA, 22 nt, Mycobacterium avium subsp. paratuberculosis
gccgcggaugaccaggucgccg

SEQ ID NO: 2846828 - RNA, 20 nt, Mycobacterium avium subsp. paratuberculosis
gccgcggauggccucggcga

SEQ ID NO: 2846829 - RNA, 22 nt, Mycobacterium avium subsp. paratuberculosis
gccgcggauggccucggcgaug

SEQ ID NO: 2846830 - RNA, 21 nt, Mycobacterium avium subsp. paratuberculosis
gccgcggauggugacggccgu

SEQ ID NO: 2846831 - RNA, 18 nt, Mycobacterium avium subsp. paratuberculosis
gccgcggauuccggcauc

SEQ ID NO: 2846832 - RNA, 20 nt, Mycobacterium avium subsp. paratuberculosis
gccgcggauuccggcaucgg

SEQ ID NO: 2846833 - RNA, 15 nt, Mycobacterium avium subsp. paratuberculosis
gccgcggcaacgcca

SEQ ID NO: 2846834 - RNA, 20 nt, Mycobacterium avium subsp. paratuberculosis
gccgcggcaacgccagccag

SEQ ID NO: 2846835 - RNA, 21 nt, Mycobacterium avium subsp. paratuberculosis
gccgcggcaacgccagccaga

SEQ ID NO: 2846836 - RNA, 14 nt, Mycobacterium avium subsp. paratuberculosis
gccgcggcaccuuc

SEQ ID NO: 2846837 - RNA, 22 nt, Mycobacterium avium subsp. paratuberculosis
gccgcggcaccuucaccgacca

SEQ ID NO: 2846838 - RNA, 13 nt, Mycobacterium avium subsp. paratuberculosis
gccgcggccaagu

SEQ ID NO: 2846839 - RNA, 21 nt, Mycobacterium avium subsp. paratuberculosis
gccgcggccaagugcggucgg

SEQ ID NO: 2846840 - RNA, 12 nt, Mycobacterium avium subsp. paratuberculosis
gccgcggccaca

SEQ ID NO: 2846841 - RNA, 12 nt, Mycobacterium avium subsp. paratuberculosis
gccgcggccacc

SEQ ID NO: 2846842 - RNA, 13 nt, Mycobacterium avium subsp. paratuberculosis
gccgcggccaccg

SEQ ID NO: 2846843 - RNA, 14 nt, Mycobacterium avium subsp. paratuberculosis
gccgcggccaccgg

SEQ ID NO: 2846844 - RNA, 13 nt, Mycobacterium avium subsp. paratuberculosis
gccgcggccacgc

SEQ ID NO: 2846845 - RNA, 13 nt, Mycobacterium avium subsp. paratuberculosis
gccgcggccagcc

SEQ ID NO: 2846846 - RNA, 14 nt, Mycobacterium avium subsp. paratuberculosis
gccgcggccagccg

SEQ ID NO: 2846847 - RNA, 16 nt, Mycobacterium avium subsp. paratuberculosis
gccgcggccagccggu

SEQ ID NO: 2846848 - RNA, 14 nt, Mycobacterium avium subsp. paratuberculosis
gccgcggccagcgc

SEQ ID NO: 2846849 - RNA, 15 nt, Mycobacterium avium subsp. paratuberculosis
gccgcggccagcgcc

SEQ ID NO: 2846850 - RNA, 13 nt, Mycobacterium avium subsp. paratuberculosis
gccgcggccagcu

SEQ ID NO: 2846851 - RNA, 20 nt, Mycobacterium avium subsp. paratuberculosis
gccgcggcgguggccugccc

SEQ ID NO: 2846852 - RNA, 14 nt, Mycobacterium avium subsp. paratuberculosis
gccgcggcgucggg

SEQ ID NO: 2846853 - RNA, 17 nt, Mycobacterium avium subsp. paratuberculosis
gccgcggcgugcaacug

SEQ ID NO: 2846854 - RNA, 13 nt, Mycobacterium avium subsp. paratuberculosis
gccgcggcuccag

SEQ ID NO: 2846855 - RNA, 18 nt, Mycobacterium avium subsp. paratuberculosis
gccgcggcuccagcagcg

SEQ ID NO: 2846856 - RNA, 12 nt, Mycobacterium avium subsp. paratuberculosis
gccgcggcucga

SEQ ID NO: 2846857 - RNA, 22 nt, Mycobacterium avium subsp. paratuberculosis
gccgcggcucgauggacgccag

SEQ ID NO: 2846858 - RNA, 13 nt, Mycobacterium avium subsp. paratuberculosis
gccgcggcucgcg

SEQ ID NO: 2846859 - RNA, 16 nt, Mycobacterium avium subsp. paratuberculosis
gccgcggcucgcgacg

SEQ ID NO: 2846860 - RNA, 20 nt, Mycobacterium avium subsp. paratuberculosis
gccgcggcucgcgacgcggc

SEQ ID NO: 2846861 - RNA, 15 nt, Mycobacterium avium subsp. paratuberculosis
gccgcgggaggccca

SEQ ID NO: 2846862 - RNA, 16 nt, Mycobacterium avium subsp. paratuberculosis
gccgcgggaggcccag

SEQ ID NO: 2846863 - RNA, 17 nt, Mycobacterium avium subsp. paratuberculosis
gccgcgggaggcccagu

SEQ ID NO: 2846864 - RNA, 20 nt, Mycobacterium avium subsp. paratuberculosis
gccgcgggaugcuuggucgc

SEQ ID NO: 2846865 - RNA, 14 nt, Mycobacterium avium subsp. paratuberculosis
gccgcgggccagca

SEQ ID NO: 2846866 - RNA, 16 nt, Mycobacterium avium subsp. paratuberculosis
gccgcgggccagcagc

SEQ ID NO: 2846867 - RNA, 21 nt, Mycobacterium avium subsp. paratuberculosis
gccgcgggccagcagccgggu

SEQ ID NO: 2846868 - RNA, 14 nt, Mycobacterium avium subsp. paratuberculosis
gccgcgggccagcc

SEQ ID NO: 2846869 - RNA, 15 nt, Mycobacterium avium subsp. paratuberculosis
gccgcgggccagcca

SEQ ID NO: 2846870 - RNA, 16 nt, Mycobacterium avium subsp. paratuberculosis
gccgcgggccagccag

SEQ ID NO: 2846871 - RNA, 12 nt, Mycobacterium avium subsp. paratuberculosis
gccgcgggccca

SEQ ID NO: 2846872 - RNA, 18 nt, Mycobacterium avium subsp. paratuberculosis
gccgcgggcccaccgcca

SEQ ID NO: 2846873 - RNA, 20 nt, Mycobacterium avium subsp. paratuberculosis
gccgcgggcggucgcgcagc

SEQ ID NO: 2846874 - RNA, 19 nt, Mycobacterium avium subsp. paratuberculosis
gccgcgggcguucaucacc

SEQ ID NO: 2846875 - RNA, 14 nt, Mycobacterium avium subsp. paratuberculosis
gccgcgggcucccg

SEQ ID NO: 2846876 - RNA, 18 nt, Mycobacterium avium subsp. paratuberculosis
gccgcgggcucccgcucg

SEQ ID NO: 2846877 - RNA, 12 nt, Mycobacterium avium subsp. paratuberculosis
gccgcggggccg

SEQ ID NO: 2846878 - RNA, 17 nt, Mycobacterium avium subsp. paratuberculosis
gccgcggggccggcgcu

SEQ ID NO: 2846879 - RNA, 21 nt, Mycobacterium avium subsp. paratuberculosis
gccgcggggccggcgcuggcg

SEQ ID NO: 2846880 - RNA, 20 nt, Mycobacterium avium subsp. paratuberculosis
gccgcgggucgauaugcugc

SEQ ID NO: 2846881 - RNA, 21 nt, Mycobacterium avium subsp. paratuberculosis
gccgcgggucgauaugcugca

SEQ ID NO: 2846882 - RNA, 15 nt, Mycobacterium avium subsp. paratuberculosis
gccgcgggucggcga

SEQ ID NO: 2846883 - RNA, 22 nt, Mycobacterium avium subsp. paratuberculosis
gccgcgggucggcgacggcgcu

SEQ ID NO: 2846884 - RNA, 20 nt, Mycobacterium avium subsp. paratuberculosis
gccgcgggugaaauccgacg

SEQ ID NO: 2846885 - RNA, 17 nt, Mycobacterium avium subsp. paratuberculosis
gccgcgggugacgaucu

SEQ ID NO: 2846886 - RNA, 19 nt, Mycobacterium avium subsp. paratuberculosis
gccgcgggugacgaucugg

SEQ ID NO: 2846887 - RNA, 23 nt, Mycobacterium avium subsp. paratuberculosis
gccgcgggugacgaucuggcgca

SEQ ID NO: 2846888 - RNA, 15 nt, Mycobacterium avium subsp. paratuberculosis
gccgcgggugcggca

SEQ ID NO: 2846889 - RNA, 17 nt, Mycobacterium avium subsp. paratuberculosis
gccgcgggugcggcacg

SEQ ID NO: 2846890 - RNA, 16 nt, Mycobacterium avium subsp. paratuberculosis
gccgcgggugcggccc

SEQ ID NO: 2846891 - RNA, 17 nt, Mycobacterium avium subsp. paratuberculosis
gccgcgggugcggccca

SEQ ID NO: 2846892 - RNA, 17 nt, Mycobacterium avium subsp. paratuberculosis
gccgcggguggccagcc

SEQ ID NO: 2846893 - RNA, 16 nt, Mycobacterium avium subsp. paratuberculosis
gccgcggguggcgcca

SEQ ID NO: 2846894 - RNA, 17 nt, Mycobacterium avium subsp. paratuberculosis
gccgcggguggcgccac

SEQ ID NO: 2846895 - RNA, 17 nt, Mycobacterium avium subsp. paratuberculosis
gccgcgggugucgcccu

SEQ ID NO: 2846896 - RNA, 20 nt, Mycobacterium avium subsp. paratuberculosis
gccgcgggugucgcccucgg

SEQ ID NO: 2846897 - RNA, 17 nt, Mycobacterium avium subsp. paratuberculosis
gccgcgguagcggaccu

SEQ ID NO: 2846898 - RNA, 21 nt, Mycobacterium avium subsp. paratuberculosis
gccgcgguagcggaccugcga

SEQ ID NO: 2846899 - RNA, 14 nt, Mycobacterium avium subsp. paratuberculosis
gccgcggucaucga

SEQ ID NO: 2846900 - RNA, 15 nt, Mycobacterium avium subsp. paratuberculosis
gccgcggucaucgag

SEQ ID NO: 2846901 - RNA, 17 nt, Mycobacterium avium subsp. paratuberculosis
gccgcggucaucgagcc

SEQ ID NO: 2846902 - RNA, 14 nt, Mycobacterium avium subsp. paratuberculosis
gccgcggucgcacu

SEQ ID NO: 2846903 - RNA, 13 nt, Mycobacterium avium subsp. paratuberculosis
gccgcggucgccc

SEQ ID NO: 2846904 - RNA, 14 nt, Mycobacterium avium subsp. paratuberculosis
gccgcggucgcccc

SEQ ID NO: 2846905 - RNA, 15 nt, Mycobacterium avium subsp. paratuberculosis
gccgcggucgccccg

SEQ ID NO: 2846906 - RNA, 16 nt, Mycobacterium avium subsp. paratuberculosis
gccgcggucgccccgg

SEQ ID NO: 2846907 - RNA, 21 nt, Mycobacterium avium subsp. paratuberculosis
gccgcggucgccccggccgcg

SEQ ID NO: 2846908 - RNA, 18 nt, Mycobacterium avium subsp. paratuberculosis
gccgcggucgcugacccg

SEQ ID NO: 2846909 - RNA, 22 nt, Mycobacterium avium subsp. paratuberculosis
gccgcggucgcugacccgccgc

SEQ ID NO: 2846910 - RNA, 23 nt, Mycobacterium avium subsp. paratuberculosis
gccgcggucucgaccgacugcga

SEQ ID NO: 2846911 - RNA, 17 nt, Mycobacterium avium subsp. paratuberculosis
gccgcggugaccgcgcc

SEQ ID NO: 2846912 - RNA, 21 nt, Mycobacterium avium subsp. paratuberculosis
gccgcggugaccgcgccgcgg

SEQ ID NO: 2846913 - RNA, 12 nt, Mycobacterium avium subsp. paratuberculosis
gccgcggugcgc

SEQ ID NO: 2846914 - RNA, 13 nt, Mycobacterium avium subsp. paratuberculosis
gccgcggugcgcg

SEQ ID NO: 2846915 - RNA, 14 nt, Mycobacterium avium subsp. paratuberculosis
gccgcggugcgcga

SEQ ID NO: 2846916 - RNA, 16 nt, Mycobacterium avium subsp. paratuberculosis
gccgcggugcgcgagu

SEQ ID NO: 2846917 - RNA, 19 nt, Mycobacterium avium subsp. paratuberculosis
gccgcggugcggcccgcgg

SEQ ID NO: 2846918 - RNA, 15 nt, Mycobacterium avium subsp. paratuberculosis
gccgcggugcguuug

SEQ ID NO: 2846919 - RNA, 17 nt, Mycobacterium avium subsp. paratuberculosis
gccgcgguggccgggau

SEQ ID NO: 2846920 - RNA, 19 nt, Mycobacterium avium subsp. paratuberculosis
gccgcgguggccgggaugc

SEQ ID NO: 2846921 - RNA, 12 nt, Mycobacterium avium subsp. paratuberculosis
gccgcgguggcg

SEQ ID NO: 2846922 - RNA, 15 nt, Mycobacterium avium subsp. paratuberculosis
gccgcgguggcgccg

SEQ ID NO: 2846923 - RNA, 16 nt, Mycobacterium avium subsp. paratuberculosis
gccgcgguggcgccgc

SEQ ID NO: 2846924 - RNA, 18 nt, Mycobacterium avium subsp. paratuberculosis
gccgcgguggcgccgcgg

SEQ ID NO: 2846925 - RNA, 22 nt, Mycobacterium avium subsp. paratuberculosis
gccgcgguggcgccgcgggcgg

SEQ ID NO: 2846926 - RNA, 19 nt, Mycobacterium avium subsp. paratuberculosis
gccgcgguggguccgccgg

SEQ ID NO: 2846927 - RNA, 21 nt, Mycobacterium avium subsp. paratuberculosis
gccgcgguggguccgccgggc

SEQ ID NO: 2846928 - RNA, 22 nt, Mycobacterium avium subsp. paratuberculosis
gccgcgguggguccgccgggcg

SEQ ID NO: 2846929 - RNA, 11 nt, Mycobacterium avium subsp. paratuberculosis
gccgcgguggu

SEQ ID NO: 2846930 - RNA, 13 nt, Mycobacterium avium subsp. paratuberculosis
gccgcggugguga

SEQ ID NO: 2846931 - RNA, 14 nt, Mycobacterium avium subsp. paratuberculosis
gccgcggugguggg

SEQ ID NO: 2846932 - RNA, 16 nt, Mycobacterium avium subsp. paratuberculosis
gccgcgguggugggcg

SEQ ID NO: 2846933 - RNA, 19 nt, Mycobacterium avium subsp. paratuberculosis
gccgcgguggugggcgcgg

SEQ ID NO: 2846934 - RNA, 20 nt, Mycobacterium avium subsp. paratuberculosis
gccgcgguucuuguccucga

SEQ ID NO: 2846935 - RNA, 15 nt, Mycobacterium avium subsp. paratuberculosis
gccgcgguuggucac

SEQ ID NO: 2846936 - RNA, 24 nt, Mycobacterium avium subsp. paratuberculosis
gccgcucaccgccgagccgcucca

SEQ ID NO: 2846937 - RNA, 22 nt, Mycobacterium avium subsp. paratuberculosis
gccgcucagcgauugcggccgc

SEQ ID NO: 2846938 - RNA, 23 nt, Mycobacterium avium subsp. paratuberculosis
gccgcucagcgauugcggccgcc

SEQ ID NO: 2846939 - RNA, 14 nt, Mycobacterium avium subsp. paratuberculosis
gccgcucagcgggc

SEQ ID NO: 2846940 - RNA, 17 nt, Mycobacterium avium subsp. paratuberculosis
gccgcucagcgggcggc

SEQ ID NO: 2846941 - RNA, 18 nt, Mycobacterium avium subsp. paratuberculosis
gccgcucagcgggcggcc

SEQ ID NO: 2846942 - RNA, 19 nt, Mycobacterium avium subsp. paratuberculosis
gccgcucagcgggcggcca

SEQ ID NO: 2846943 - RNA, 20 nt, Mycobacterium avium subsp. paratuberculosis
gccgcucagcgggcggccag

SEQ ID NO: 2846944 - RNA, 14 nt, Mycobacterium avium subsp. paratuberculosis
gccgcuccaccgcg

SEQ ID NO: 2846945 - RNA, 13 nt, Mycobacterium avium subsp. paratuberculosis
gccgcucccgcag

SEQ ID NO: 2846946 - RNA, 15 nt, Mycobacterium avium subsp. paratuberculosis
gccgcucccggcgca

SEQ ID NO: 2846947 - RNA, 22 nt, Mycobacterium avium subsp. paratuberculosis
gccgcucccggcgcagcaacuc

SEQ ID NO: 2846948 - RNA, 13 nt, Mycobacterium avium subsp. paratuberculosis
gccgcuccgcggc

SEQ ID NO: 2846949 - RNA, 14 nt, Mycobacterium avium subsp. paratuberculosis
gccgcuccgcggcg

SEQ ID NO: 2846950 - RNA, 15 nt, Mycobacterium avium subsp. paratuberculosis
gccgcuccgcggcgg

SEQ ID NO: 2846951 - RNA, 18 nt, Mycobacterium avium subsp. paratuberculosis
gccgcuccgcggcgggcg

SEQ ID NO: 2846952 - RNA, 21 nt, Mycobacterium avium subsp. paratuberculosis
gccgcuccgcggcgggcgugc

SEQ ID NO: 2846953 - RNA, 21 nt, Mycobacterium avium subsp. paratuberculosis
gccgcuccggcccgagcacca

SEQ ID NO: 2846954 - RNA, 23 nt, Mycobacterium avium subsp. paratuberculosis
gccgcuccggcccgagcaccacc

SEQ ID NO: 2846955 - RNA, 15 nt, Mycobacterium avium subsp. paratuberculosis
gccgcuccggucgcg

SEQ ID NO: 2846956 - RNA, 19 nt, Mycobacterium avium subsp. paratuberculosis
gccgcucgaccccucggca

SEQ ID NO: 2846957 - RNA, 15 nt, Mycobacterium avium subsp. paratuberculosis
gccgcucgcccagcg

SEQ ID NO: 2846958 - RNA, 16 nt, Mycobacterium avium subsp. paratuberculosis
gccgcucgcccagcgc

SEQ ID NO: 2846959 - RNA, 18 nt, Mycobacterium avium subsp. paratuberculosis
gccgcucgcccagcgcgg

SEQ ID NO: 2846960 - RNA, 19 nt, Mycobacterium avium subsp. paratuberculosis
gccgcucgcccagcgcggc

SEQ ID NO: 2846961 - RNA, 12 nt, Mycobacterium avium subsp. paratuberculosis
gccgcucgccgg

SEQ ID NO: 2846962 - RNA, 14 nt, Mycobacterium avium subsp. paratuberculosis
gccgcucgccgggg

SEQ ID NO: 2846963 - RNA, 22 nt, Mycobacterium avium subsp. paratuberculosis
gccgcucgcuauaucgcaccgg

SEQ ID NO: 2846964 - RNA, 23 nt, Mycobacterium avium subsp. paratuberculosis
gccgcucgcuauaucgcaccggc

SEQ ID NO: 2846965 - RNA, 14 nt, Mycobacterium avium subsp. paratuberculosis
gccgcucggaguuc

SEQ ID NO: 2846966 - RNA, 23 nt, Mycobacterium avium subsp. paratuberculosis
gccgcucggaguucgcccgcagc

SEQ ID NO: 2846967 - RNA, 13 nt, Mycobacterium avium subsp. paratuberculosis
gccgcucggccag

SEQ ID NO: 2846968 - RNA, 15 nt, Mycobacterium avium subsp. paratuberculosis
gccgcucggccagca

SEQ ID NO: 2846969 - RNA, 20 nt, Mycobacterium avium subsp. paratuberculosis
gccgcucggccagcagcacc

SEQ ID NO: 2846970 - RNA, 20 nt, Mycobacterium avium subsp. paratuberculosis
gccgcucggccagcgcagcg

SEQ ID NO: 2846971 - RNA, 12 nt, Mycobacterium avium subsp. paratuberculosis
gccgcucggcgc

SEQ ID NO: 2846972 - RNA, 19 nt, Mycobacterium avium subsp. paratuberculosis
gccgcucggggaucccgaa

SEQ ID NO: 2846973 - RNA, 19 nt, Mycobacterium avium subsp. paratuberculosis
gccgcucgggugucgccga

SEQ ID NO: 2846974 - RNA, 20 nt, Mycobacterium avium subsp. paratuberculosis
gccgcucguaguuggggccg

SEQ ID NO: 2846975 - RNA, 23 nt, Mycobacterium avium subsp. paratuberculosis
gccgcucguaguuggggccggcc

SEQ ID NO: 2846976 - RNA, 17 nt, Mycobacterium avium subsp. paratuberculosis
gccgcucgucgaguccg

SEQ ID NO: 2846977 - RNA, 13 nt, Mycobacterium avium subsp. paratuberculosis
gccgcucgucggc

SEQ ID NO: 2846978 - RNA, 14 nt, Mycobacterium avium subsp. paratuberculosis
gccgcucgucggcc

SEQ ID NO: 2846979 - RNA, 17 nt, Mycobacterium avium subsp. paratuberculosis
gccgcucgucggccagc

SEQ ID NO: 2846980 - RNA, 14 nt, Mycobacterium avium subsp. paratuberculosis
gccgcucgucgggc

SEQ ID NO: 2846981 - RNA, 16 nt, Mycobacterium avium subsp. paratuberculosis
gccgcucgucgggcac

SEQ ID NO: 2846982 - RNA, 14 nt, Mycobacterium avium subsp. paratuberculosis
gccgcucuucgacg

SEQ ID NO: 2846983 - RNA, 16 nt, Mycobacterium avium subsp. paratuberculosis
gccgcucuucgacgac

SEQ ID NO: 2846984 - RNA, 17 nt, Mycobacterium avium subsp. paratuberculosis
gccgcucuucgacgacc

SEQ ID NO: 2846985 - RNA, 21 nt, Mycobacterium avium subsp. paratuberculosis
gccgcucuucgacgacccgau

SEQ ID NO: 2846986 - RNA, 20 nt, Mycobacterium avium subsp. paratuberculosis
gccgcugaaauccgggguca

SEQ ID NO: 2846987 - RNA, 15 nt, Mycobacterium avium subsp. paratuberculosis
gccgcugaacgcgau

SEQ ID NO: 2846988 - RNA, 20 nt, Mycobacterium avium subsp. paratuberculosis
gccgcugacgauggcgaccg

SEQ ID NO: 2846989 - RNA, 23 nt, Mycobacterium avium subsp. paratuberculosis
gccgcugacgauggcgaccgcgc

SEQ ID NO: 2846990 - RNA, 13 nt, Mycobacterium avium subsp. paratuberculosis
gccgcugacgguc

SEQ ID NO: 2846991 - RNA, 16 nt, Mycobacterium avium subsp. paratuberculosis
gccgcugacggucgcc

SEQ ID NO: 2846992 - RNA, 17 nt, Mycobacterium avium subsp. paratuberculosis
gccgcugacggucgccg

SEQ ID NO: 2846993 - RNA, 19 nt, Mycobacterium avium subsp. paratuberculosis
gccgcugacggucgccgac

SEQ ID NO: 2846994 - RNA, 20 nt, Mycobacterium avium subsp. paratuberculosis
gccgcugacggucgccgacu

SEQ ID NO: 2846995 - RNA, 20 nt, Mycobacterium avium subsp. paratuberculosis
gccgcugacugcgaucgccg

SEQ ID NO: 2846996 - RNA, 16 nt, Mycobacterium avium subsp. paratuberculosis
gccgcugagcuucugc

SEQ ID NO: 2846997 - RNA, 23 nt, Mycobacterium avium subsp. paratuberculosis
gccgcugaucaaaaacccguuga

SEQ ID NO: 2846998 - RNA, 16 nt, Mycobacterium avium subsp. paratuberculosis
gccgcugaucaugaag

SEQ ID NO: 2846999 - RNA, 21 nt, Mycobacterium avium subsp. paratuberculosis
gccgcugaucaugaagucgcg

SEQ ID NO: 2847000 - RNA, 16 nt, Mycobacterium avium subsp. paratuberculosis
gccgcugcagcgccgc

SEQ ID NO: 2847001 - RNA, 20 nt, Mycobacterium avium subsp. paratuberculosis
gccgcugcagcgccgcccgc

SEQ ID NO: 2847002 - RNA, 13 nt, Mycobacterium avium subsp. paratuberculosis
gccgcugcagcug

SEQ ID NO: 2847003 - RNA, 23 nt, Mycobacterium avium subsp. paratuberculosis
gccgcugcagcugcucguccugg

SEQ ID NO: 2847004 - RNA, 14 nt, Mycobacterium avium subsp. paratuberculosis
gccgcugcauccgc

SEQ ID NO: 2847005 - RNA, 15 nt, Mycobacterium avium subsp. paratuberculosis
gccgcugcauccgca

SEQ ID NO: 2847006 - RNA, 17 nt, Mycobacterium avium subsp. paratuberculosis
gccgcugcauccgcagc

SEQ ID NO: 2847007 - RNA, 18 nt, Mycobacterium avium subsp. paratuberculosis
gccgcugcauccgcagca

SEQ ID NO: 2847008 - RNA, 19 nt, Mycobacterium avium subsp. paratuberculosis
gccgcugcauccgcagcac

SEQ ID NO: 2847009 - RNA, 16 nt, Mycobacterium avium subsp. paratuberculosis
gccgcugcccgccgcg

SEQ ID NO: 2847010 - RNA, 17 nt, Mycobacterium avium subsp. paratuberculosis
gccgcugcccgccgcgu

SEQ ID NO: 2847011 - RNA, 14 nt, Mycobacterium avium subsp. paratuberculosis
gccgcugcccggcg

SEQ ID NO: 2847012 - RNA, 14 nt, Mycobacterium avium subsp. paratuberculosis
gccgcugcccgggc

SEQ ID NO: 2847013 - RNA, 21 nt, Mycobacterium avium subsp. paratuberculosis
gccgcugcccgggcaucccgc

SEQ ID NO: 2847014 - RNA, 15 nt, Mycobacterium avium subsp. paratuberculosis
gccgcugccgcaccc

SEQ ID NO: 2847015 - RNA, 20 nt, Mycobacterium avium subsp. paratuberculosis
gccgcugccgcaccccgugg

SEQ ID NO: 2847016 - RNA, 14 nt, Mycobacterium avium subsp. paratuberculosis
gccgcugccggggu

SEQ ID NO: 2847017 - RNA, 15 nt, Mycobacterium avium subsp. paratuberculosis
gccgcugccggggug

SEQ ID NO: 2847018 - RNA, 19 nt, Mycobacterium avium subsp. paratuberculosis
gccgcugccggggugcagc

SEQ ID NO: 2847019 - RNA, 21 nt, Mycobacterium avium subsp. paratuberculosis
gccgcugcgacaggucggcgg

SEQ ID NO: 2847020 - RNA, 15 nt, Mycobacterium avium subsp. paratuberculosis
gccgcugcgcccagc

SEQ ID NO: 2847021 - RNA, 15 nt, Mycobacterium avium subsp. paratuberculosis
gccggacaccuggag

SEQ ID NO: 2847022 - RNA, 14 nt, Mycobacterium avium subsp. paratuberculosis
gccggacacggcug

SEQ ID NO: 2847023 - RNA, 16 nt, Mycobacterium avium subsp. paratuberculosis
gccggacacggcugca

SEQ ID NO: 2847024 - RNA, 18 nt, Mycobacterium avium subsp. paratuberculosis
gccggacacggcugcacc

SEQ ID NO: 2847025 - RNA, 21 nt, Mycobacterium avium subsp. paratuberculosis
gccggacacggcugcacccuc

SEQ ID NO: 2847026 - RNA, 19 nt, Mycobacterium avium subsp. paratuberculosis
gccggacagaucgcccauc

SEQ ID NO: 2847027 - RNA, 13 nt, Mycobacterium avium subsp. paratuberculosis
gccggacagccgg

SEQ ID NO: 2847028 - RNA, 20 nt, Mycobacterium avium subsp. paratuberculosis
gccggacagccggggcagcu

SEQ ID NO: 2847029 - RNA, 14 nt, Mycobacterium avium subsp. paratuberculosis
gccggacagcgggc

SEQ ID NO: 2847030 - RNA, 16 nt, Mycobacterium avium subsp. paratuberculosis
gccggacagcgggccg

SEQ ID NO: 2847031 - RNA, 17 nt, Mycobacterium avium subsp. paratuberculosis
gccggacagcgggccga

SEQ ID NO: 2847032 - RNA, 14 nt, Mycobacterium avium subsp. paratuberculosis
gccggacagcgggu

SEQ ID NO: 2847033 - RNA, 16 nt, Mycobacterium avium subsp. paratuberculosis
gccggacagcuggcgg

SEQ ID NO: 2847034 - RNA, 17 nt, Mycobacterium avium subsp. paratuberculosis
gccggacagcuggcggu

SEQ ID NO: 2847035 - RNA, 18 nt, Mycobacterium avium subsp. paratuberculosis
gccggacaucucccgcac

SEQ ID NO: 2847036 - RNA, 19 nt, Mycobacterium avium subsp. paratuberculosis
gccggacccauucgucggc

SEQ ID NO: 2847037 - RNA, 23 nt, Mycobacterium avium subsp. paratuberculosis
gccggacccauucgucggcgguc

SEQ ID NO: 2847038 - RNA, 18 nt, Mycobacterium avium subsp. paratuberculosis
gccggacccccucggggc

SEQ ID NO: 2847039 - RNA, 18 nt, Mycobacterium avium subsp. paratuberculosis
gccggaccgauccggcgc

SEQ ID NO: 2847040 - RNA, 19 nt, Mycobacterium avium subsp. paratuberculosis
gccggaccgauccggcgcc

SEQ ID NO: 2847041 - RNA, 21 nt, Mycobacterium avium subsp. paratuberculosis
gccggaccgauccggcgcccg

SEQ ID NO: 2847042 - RNA, 13 nt, Mycobacterium avium subsp. paratuberculosis
gccggaccgcgcg

SEQ ID NO: 2847043 - RNA, 14 nt, Mycobacterium avium subsp. paratuberculosis
gccggaccgcgcgg

SEQ ID NO: 2847044 - RNA, 17 nt, Mycobacterium avium subsp. paratuberculosis
gccggaccgcgcgggcc

SEQ ID NO: 2847045 - RNA, 19 nt, Mycobacterium avium subsp. paratuberculosis
gccggaccgcuugacgccg

SEQ ID NO: 2847046 - RNA, 22 nt, Mycobacterium avium subsp. paratuberculosis
gccggaccgcuugacgccgccg

SEQ ID NO: 2847047 - RNA, 23 nt, Mycobacterium avium subsp. paratuberculosis
gccggaccgcuugacgccgccga

SEQ ID NO: 2847048 - RNA, 15 nt, Mycobacterium avium subsp. paratuberculosis
gccggaccguucggu

SEQ ID NO: 2847049 - RNA, 22 nt, Mycobacterium avium subsp. paratuberculosis
gccggaccguucgguccggaac

SEQ ID NO: 2847050 - RNA, 13 nt, Mycobacterium avium subsp. paratuberculosis
gccggaccucgac

SEQ ID NO: 2847051 - RNA, 17 nt, Mycobacterium avium subsp. paratuberculosis
gccggaccucgaccagc

SEQ ID NO: 2847052 - RNA, 19 nt, Mycobacterium avium subsp. paratuberculosis
gccggacgaacgaguugcc

SEQ ID NO: 2847053 - RNA, 17 nt, Mycobacterium avium subsp. paratuberculosis
gccggacgcuaagcgcu

SEQ ID NO: 2847054 - RNA, 18 nt, Mycobacterium avium subsp. paratuberculosis
gccggacgcuaagcgcug

SEQ ID NO: 2847055 - RNA, 21 nt, Mycobacterium avium subsp. paratuberculosis
gccggacgggaucggcgcguc

SEQ ID NO: 2847056 - RNA, 14 nt, Mycobacterium avium subsp. paratuberculosis
gccggacgggucga

SEQ ID NO: 2847057 - RNA, 18 nt, Mycobacterium avium subsp. paratuberculosis
gccggacgggucgaccgc

SEQ ID NO: 2847058 - RNA, 18 nt, Mycobacterium avium subsp. paratuberculosis
gccggacggugacgccgg

SEQ ID NO: 2847059 - RNA, 19 nt, Mycobacterium avium subsp. paratuberculosis
gccggacuauacacgccug

SEQ ID NO: 2847060 - RNA, 20 nt, Mycobacterium avium subsp. paratuberculosis
gccggacuauacacgccugg

SEQ ID NO: 2847061 - RNA, 21 nt, Mycobacterium avium subsp. paratuberculosis
gccggacuauacacgccugga

SEQ ID NO: 2847062 - RNA, 23 nt, Mycobacterium avium subsp. paratuberculosis
gccggacuauacacgccuggaca

SEQ ID NO: 2847063 - RNA, 21 nt, Mycobacterium avium subsp. paratuberculosis
gccggacucgaagaucgccug

SEQ ID NO: 2847064 - RNA, 16 nt, Mycobacterium avium subsp. paratuberculosis
gccggacucgaucgcc

SEQ ID NO: 2847065 - RNA, 19 nt, Mycobacterium avium subsp. paratuberculosis
gccggacucgaucgccacc

SEQ ID NO: 2847066 - RNA, 19 nt, Mycobacterium avium subsp. paratuberculosis
gccggacuugaugcugccc

SEQ ID NO: 2847067 - RNA, 23 nt, Mycobacterium avium subsp. paratuberculosis
gccggacuugaugcugcccggcg

SEQ ID NO: 2847068 - RNA, 17 nt, Mycobacterium avium subsp. paratuberculosis
gccggagaaggcgaacg

SEQ ID NO: 2847069 - RNA, 13 nt, Mycobacterium avium subsp. paratuberculosis
gccggagaccagc

SEQ ID NO: 2847070 - RNA, 18 nt, Mycobacterium avium subsp. paratuberculosis
gccggagaccgccguggc

SEQ ID NO: 2847071 - RNA, 19 nt, Mycobacterium avium subsp. paratuberculosis
gccggagagcccgucgucg

SEQ ID NO: 2847072 - RNA, 20 nt, Mycobacterium avium subsp. paratuberculosis
gccggagagcccgucgucgg

SEQ ID NO: 2847073 - RNA, 22 nt, Mycobacterium avium subsp. paratuberculosis
gccggagaucaauucugcugcc

SEQ ID NO: 2847074 - RNA, 23 nt, Mycobacterium avium subsp. paratuberculosis
gccggagaucaauucugcugccc

SEQ ID NO: 2847075 - RNA, 20 nt, Mycobacterium avium subsp. paratuberculosis
gccggagaucccguaggucg

SEQ ID NO: 2847076 - RNA, 21 nt, Mycobacterium avium subsp. paratuberculosis
gccggagaugaauucggcgau

SEQ ID NO: 2847077 - RNA, 22 nt, Mycobacterium avium subsp. paratuberculosis
gccggagccgaccucggcgacg

SEQ ID NO: 2847078 - RNA, 23 nt, Mycobacterium avium subsp. paratuberculosis
gccggagccgaccucggcgacga

SEQ ID NO: 2847079 - RNA, 13 nt, Mycobacterium avium subsp. paratuberculosis
gccggagccgauc

SEQ ID NO: 2847080 - RNA, 14 nt, Mycobacterium avium subsp. paratuberculosis
gccggagccgaucg

SEQ ID NO: 2847081 - RNA, 15 nt, Mycobacterium avium subsp. paratuberculosis
gccggagccgaucgc

SEQ ID NO: 2847082 - RNA, 14 nt, Mycobacterium avium subsp. paratuberculosis
gccggagccggaga

SEQ ID NO: 2847083 - RNA, 13 nt, Mycobacterium avium subsp. paratuberculosis
gccggagccggcc

SEQ ID NO: 2847084 - RNA, 15 nt, Mycobacterium avium subsp. paratuberculosis
gccggagccggccuc

SEQ ID NO: 2847085 - RNA, 17 nt, Mycobacterium avium subsp. paratuberculosis
gccggagccggccucgc

SEQ ID NO: 2847086 - RNA, 20 nt, Mycobacterium avium subsp. paratuberculosis
gccggagccggccucgccgg

SEQ ID NO: 2847087 - RNA, 22 nt, Mycobacterium avium subsp. paratuberculosis
gccggagccuucuugaccgcag

SEQ ID NO: 2847088 - RNA, 21 nt, Mycobacterium avium subsp. paratuberculosis
gccggagccuugcuggcggcc

SEQ ID NO: 2847089 - RNA, 13 nt, Mycobacterium avium subsp. paratuberculosis
gccggagccuugg

SEQ ID NO: 2847090 - RNA, 18 nt, Mycobacterium avium subsp. paratuberculosis
gccggagccuuggucgcg

SEQ ID NO: 2847091 - RNA, 22 nt, Mycobacterium avium subsp. paratuberculosis
gccggagccuuggucgcggccu

SEQ ID NO: 2847092 - RNA, 19 nt, Mycobacterium avium subsp. paratuberculosis
gccggagcgccccagggcc

SEQ ID NO: 2847093 - RNA, 22 nt, Mycobacterium avium subsp. paratuberculosis
gccggagcggauggcgccgucg

SEQ ID NO: 2847094 - RNA, 23 nt, Mycobacterium avium subsp. paratuberculosis
gccggagcggauggcgccgucga

SEQ ID NO: 2847095 - RNA, 13 nt, Mycobacterium avium subsp. paratuberculosis
gccggagcggugc

SEQ ID NO: 2847096 - RNA, 15 nt, Mycobacterium avium subsp. paratuberculosis
gccggagcggugcgg

SEQ ID NO: 2847097 - RNA, 16 nt, Mycobacterium avium subsp. paratuberculosis
gccggagcggugcggc

SEQ ID NO: 2847098 - RNA, 18 nt, Mycobacterium avium subsp. paratuberculosis
gccggagcggugcggcuc

SEQ ID NO: 2847099 - RNA, 17 nt, Mycobacterium avium subsp. paratuberculosis
gccggaggccagcucga

SEQ ID NO: 2847100 - RNA, 20 nt, Mycobacterium avium subsp. paratuberculosis
gccggaggccagcucgaccg

SEQ ID NO: 2847101 - RNA, 21 nt, Mycobacterium avium subsp. paratuberculosis
gccggaggccagcucgaccgc

SEQ ID NO: 2847102 - RNA, 13 nt, Mycobacterium avium subsp. paratuberculosis
gccggaggcggcg

SEQ ID NO: 2847103 - RNA, 21 nt, Mycobacterium avium subsp. paratuberculosis
gccggaggggcgacgggccga

SEQ ID NO: 2847104 - RNA, 23 nt, Mycobacterium avium subsp. paratuberculosis
gccggaggggcgacgggccgauc

SEQ ID NO: 2847105 - RNA, 22 nt, Mycobacterium avium subsp. paratuberculosis
gccggcagcaaccggcggcugg

SEQ ID NO: 2847106 - RNA, 17 nt, Mycobacterium avium subsp. paratuberculosis
gccggcagcauucgccg

SEQ ID NO: 2847107 - RNA, 23 nt, Mycobacterium avium subsp. paratuberculosis
gccggcagcauucgccggggucg

SEQ ID NO: 2847108 - RNA, 12 nt, Mycobacterium avium subsp. paratuberculosis
gccggcagcccg

SEQ ID NO: 2847109 - RNA, 13 nt, Mycobacterium avium subsp. paratuberculosis
gccggcagcccgg

SEQ ID NO: 2847110 - RNA, 14 nt, Mycobacterium avium subsp. paratuberculosis
gccggcagcccgga

SEQ ID NO: 2847111 - RNA, 16 nt, Mycobacterium avium subsp. paratuberculosis
gccggcagccggccac

SEQ ID NO: 2847112 - RNA, 18 nt, Mycobacterium avium subsp. paratuberculosis
gccggcagccggccaccu

SEQ ID NO: 2847113 - RNA, 14 nt, Mycobacterium avium subsp. paratuberculosis
gccggcagccggcg

SEQ ID NO: 2847114 - RNA, 17 nt, Mycobacterium avium subsp. paratuberculosis
gccggcagccggcgcgg

SEQ ID NO: 2847115 - RNA, 19 nt, Mycobacterium avium subsp. paratuberculosis
gccggcagccggcgcggug

SEQ ID NO: 2847116 - RNA, 16 nt, Mycobacterium avium subsp. paratuberculosis
gccggcagcggccgca

SEQ ID NO: 2847117 - RNA, 16 nt, Mycobacterium avium subsp. paratuberculosis
gccggcagcggcugcu

SEQ ID NO: 2847118 - RNA, 21 nt, Mycobacterium avium subsp. paratuberculosis
gccggcagcggcugcugcagc

SEQ ID NO: 2847119 - RNA, 13 nt, Mycobacterium avium subsp. paratuberculosis
gccggcagcugcc

SEQ ID NO: 2847120 - RNA, 13 nt, Mycobacterium avium subsp. paratuberculosis
gccggcaggccgc

SEQ ID NO: 2847121 - RNA, 19 nt, Mycobacterium avium subsp. paratuberculosis
gccggcaggccgcccgacc

SEQ ID NO: 2847122 - RNA, 18 nt, Mycobacterium avium subsp. paratuberculosis
gccggcaggucgaggccg

SEQ ID NO: 2847123 - RNA, 18 nt, Mycobacterium avium subsp. paratuberculosis
gccggcaguccggacacg

SEQ ID NO: 2847124 - RNA, 23 nt, Mycobacterium avium subsp. paratuberculosis
gccggcaguccggacacggccag

SEQ ID NO: 2847125 - RNA, 18 nt, Mycobacterium avium subsp. paratuberculosis
gccggcaguuccucgccg

SEQ ID NO: 2847126 - RNA, 18 nt, Mycobacterium avium subsp. paratuberculosis
gccggcaguugcggccgc

SEQ ID NO: 2847127 - RNA, 19 nt, Mycobacterium avium subsp. paratuberculosis
gccggcaguugcggccgcu

SEQ ID NO: 2847128 - RNA, 16 nt, Mycobacterium avium subsp. paratuberculosis
gccggcauaggccagc

SEQ ID NO: 2847129 - RNA, 17 nt, Mycobacterium avium subsp. paratuberculosis
gccggcauaggccagca

SEQ ID NO: 2847130 - RNA, 18 nt, Mycobacterium avium subsp. paratuberculosis
gccggcauaggccagcac

SEQ ID NO: 2847131 - RNA, 20 nt, Mycobacterium avium subsp. paratuberculosis
gccggcauaggccagcacca

SEQ ID NO: 2847132 - RNA, 22 nt, Mycobacterium avium subsp. paratuberculosis
gccggcauaggccagcaccagc

SEQ ID NO: 2847133 - RNA, 17 nt, Mycobacterium avium subsp. paratuberculosis
gccggcaucagcgagac

SEQ ID NO: 2847134 - RNA, 15 nt, Mycobacterium avium subsp. paratuberculosis
gccggcauccagcac

SEQ ID NO: 2847135 - RNA, 20 nt, Mycobacterium avium subsp. paratuberculosis
gccggcauccagcacggccg

SEQ ID NO: 2847136 - RNA, 13 nt, Mycobacterium avium subsp. paratuberculosis
gccggcauccucg

SEQ ID NO: 2847137 - RNA, 16 nt, Mycobacterium avium subsp. paratuberculosis
gccggcauccucggcg

SEQ ID NO: 2847138 - RNA, 22 nt, Mycobacterium avium subsp. paratuberculosis
gccggcauccucggcgcgucgg

SEQ ID NO: 2847139 - RNA, 19 nt, Mycobacterium avium subsp. paratuberculosis
gccggcaucgaccgcccgc

SEQ ID NO: 2847140 - RNA, 17 nt, Mycobacterium avium subsp. paratuberculosis
gccggccaacagcagcg

SEQ ID NO: 2847141 - RNA, 21 nt, Mycobacterium avium subsp. paratuberculosis
gccggccaacagcagcgccgc

SEQ ID NO: 2847142 - RNA, 23 nt, Mycobacterium avium subsp. paratuberculosis
gccggccaacagcagcgccgcgg

SEQ ID NO: 2847143 - RNA, 13 nt, Mycobacterium avium subsp. paratuberculosis
gccggccaaggca

SEQ ID NO: 2847144 - RNA, 21 nt, Mycobacterium avium subsp. paratuberculosis
gccggccaaggcaagucgucg

SEQ ID NO: 2847145 - RNA, 13 nt, Mycobacterium avium subsp. paratuberculosis
gccggccaccaac

SEQ ID NO: 2847146 - RNA, 18 nt, Mycobacterium avium subsp. paratuberculosis
gccggccaccaacagguc

SEQ ID NO: 2847147 - RNA, 22 nt, Mycobacterium avium subsp. paratuberculosis
gccggccaccaacaggucggcg

SEQ ID NO: 2847148 - RNA, 19 nt, Mycobacterium avium subsp. paratuberculosis
gccggccaccagcggccgg

SEQ ID NO: 2847149 - RNA, 20 nt, Mycobacterium avium subsp. paratuberculosis
gccggccaccagcggccgga

SEQ ID NO: 2847150 - RNA, 15 nt, Mycobacterium avium subsp. paratuberculosis
gccggccaccagguc

SEQ ID NO: 2847151 - RNA, 17 nt, Mycobacterium avium subsp. paratuberculosis
gccggccaccaggucgc

SEQ ID NO: 2847152 - RNA, 14 nt, Mycobacterium avium subsp. paratuberculosis
gccggccaccgccc

SEQ ID NO: 2847153 - RNA, 19 nt, Mycobacterium avium subsp. paratuberculosis
gccggccaccgccccagcc

SEQ ID NO: 2847154 - RNA, 21 nt, Mycobacterium avium subsp. paratuberculosis
gccggccaccgccccagccga

SEQ ID NO: 2847155 - RNA, 23 nt, Mycobacterium avium subsp. paratuberculosis
gccggccaccgccccagccgacc

SEQ ID NO: 2847156 - RNA, 13 nt, Mycobacterium avium subsp. paratuberculosis
gccggccaccggc

SEQ ID NO: 2847157 - RNA, 17 nt, Mycobacterium avium subsp. paratuberculosis
gccggccaccggcgcga

SEQ ID NO: 2847158 - RNA, 19 nt, Mycobacterium avium subsp. paratuberculosis
gccggccaccggcgcgacg

SEQ ID NO: 2847159 - RNA, 20 nt, Mycobacterium avium subsp. paratuberculosis
gccggccaccggcgcgacgg

SEQ ID NO: 2847160 - RNA, 22 nt, Mycobacterium avium subsp. paratuberculosis
gccggccaccucgucccagcgc

SEQ ID NO: 2847161 - RNA, 17 nt, Mycobacterium avium subsp. paratuberculosis
gccggccacgcucggcg

SEQ ID NO: 2847162 - RNA, 19 nt, Mycobacterium avium subsp. paratuberculosis
gccggccacgcucggcggc

SEQ ID NO: 2847163 - RNA, 23 nt, Mycobacterium avium subsp. paratuberculosis
gccggccacgcucggcggcgcgc

SEQ ID NO: 2847164 - RNA, 24 nt, Mycobacterium avium subsp. paratuberculosis
gccggccacgcucggcggcgcgca

SEQ ID NO: 2847165 - RNA, 21 nt, Mycobacterium avium subsp. paratuberculosis
gccggccagaucgacgccgcg

SEQ ID NO: 2847166 - RNA, 23 nt, Mycobacterium avium subsp. paratuberculosis
gccggccagaucgacgccgcggu

SEQ ID NO: 2847167 - RNA, 13 nt, Mycobacterium avium subsp. paratuberculosis
gccggccagcaca

SEQ ID NO: 2847168 - RNA, 13 nt, Mycobacterium avium subsp. paratuberculosis
gccggccagcacc

SEQ ID NO: 2847169 - RNA, 17 nt, Mycobacterium avium subsp. paratuberculosis
gccggccagcaccacgg

SEQ ID NO: 2847170 - RNA, 14 nt, Mycobacterium avium subsp. paratuberculosis
gccggccagcacgc

SEQ ID NO: 2847171 - RNA, 15 nt, Mycobacterium avium subsp. paratuberculosis
gccggccagcacgcc

SEQ ID NO: 2847172 - RNA, 16 nt, Mycobacterium avium subsp. paratuberculosis
gccggccagcacgccg

SEQ ID NO: 2847173 - RNA, 16 nt, Mycobacterium avium subsp. paratuberculosis
gccggccagcacggcc

SEQ ID NO: 2847174 - RNA, 19 nt, Mycobacterium avium subsp. paratuberculosis
gccggccagcacggccagc

SEQ ID NO: 2847175 - RNA, 24 nt, Mycobacterium avium subsp. paratuberculosis
gccggccagcacggccagccagcc

SEQ ID NO: 2847176 - RNA, 12 nt, Mycobacterium avium subsp. paratuberculosis
gccggccagcag

SEQ ID NO: 2847177 - RNA, 14 nt, Mycobacterium avium subsp. paratuberculosis
gccggccagcagca

SEQ ID NO: 2847178 - RNA, 17 nt, Mycobacterium avium subsp. paratuberculosis
gccggccagcagcaggu

SEQ ID NO: 2847179 - RNA, 18 nt, Mycobacterium avium subsp. paratuberculosis
gccggccagcagcaggua

SEQ ID NO: 2847180 - RNA, 14 nt, Mycobacterium avium subsp. paratuberculosis
gccggccagcagcc

SEQ ID NO: 2847181 - RNA, 11 nt, Mycobacterium avium subsp. paratuberculosis
gccggccagcc

SEQ ID NO: 2847182 - RNA, 16 nt, Mycobacterium avium subsp. paratuberculosis
gccggccagccgcgcg

SEQ ID NO: 2847183 - RNA, 17 nt, Mycobacterium avium subsp. paratuberculosis
gccggccagccgcgcga

SEQ ID NO: 2847184 - RNA, 22 nt, Mycobacterium avium subsp. paratuberculosis
gccggccagccgcgcgacgccg

SEQ ID NO: 2847185 - RNA, 13 nt, Mycobacterium avium subsp. paratuberculosis
gccggccagccgg

SEQ ID NO: 2847186 - RNA, 17 nt, Mycobacterium avium subsp. paratuberculosis
gccggccagccggcucu

SEQ ID NO: 2847187 - RNA, 13 nt, Mycobacterium avium subsp. paratuberculosis
gccggccagcgcg

SEQ ID NO: 2847188 - RNA, 20 nt, Mycobacterium avium subsp. paratuberculosis
gccggccagcgcgcggccca

SEQ ID NO: 2847189 - RNA, 14 nt, Mycobacterium avium subsp. paratuberculosis
gccggcccugcggc

SEQ ID NO: 2847190 - RNA, 16 nt, Mycobacterium avium subsp. paratuberculosis
gccggcccugcggcca

SEQ ID NO: 2847191 - RNA, 22 nt, Mycobacterium avium subsp. paratuberculosis
gccggcccugcggccagugccg

SEQ ID NO: 2847192 - RNA, 21 nt, Mycobacterium avium subsp. paratuberculosis
gccggccgaagcguuccgccg

SEQ ID NO: 2847193 - RNA, 18 nt, Mycobacterium avium subsp. paratuberculosis
gccggccgacaacgacag

SEQ ID NO: 2847194 - RNA, 22 nt, Mycobacterium avium subsp. paratuberculosis
gccggccgacaccccgaugccg

SEQ ID NO: 2847195 - RNA, 20 nt, Mycobacterium avium subsp. paratuberculosis
gccggccgacauggacgcgg

SEQ ID NO: 2847196 - RNA, 15 nt, Mycobacterium avium subsp. paratuberculosis
gccggccgaccgccu

SEQ ID NO: 2847197 - RNA, 14 nt, Mycobacterium avium subsp. paratuberculosis
gccggccgacgcgg

SEQ ID NO: 2847198 - RNA, 17 nt, Mycobacterium avium subsp. paratuberculosis
gccggccgacgcggccu

SEQ ID NO: 2847199 - RNA, 21 nt, Mycobacterium avium subsp. paratuberculosis
gccggccgagccgagccgacc

SEQ ID NO: 2847200 - RNA, 16 nt, Mycobacterium avium subsp. paratuberculosis
gccggccgagcgaagg

SEQ ID NO: 2847201 - RNA, 17 nt, Mycobacterium avium subsp. paratuberculosis
gccggccgaugaccucg

SEQ ID NO: 2847202 - RNA, 23 nt, Mycobacterium avium subsp. paratuberculosis
gccggccgaugaccucgcacagc

SEQ ID NO: 2847203 - RNA, 21 nt, Mycobacterium avium subsp. paratuberculosis
gccggccgcagcugcugcggc

SEQ ID NO: 2847204 - RNA, 13 nt, Mycobacterium avium subsp. paratuberculosis
gccggccgccagc

SEQ ID NO: 2847205 - RNA, 15 nt, Mycobacterium avium subsp. paratuberculosis
gccggccgccagcgc

SEQ ID NO: 2847206 - RNA, 17 nt, Mycobacterium avium subsp. paratuberculosis
gccggccgccagcgccc

SEQ ID NO: 2847207 - RNA, 22 nt, Mycobacterium avium subsp. paratuberculosis
gccggccgccagcgcccgcgcg

SEQ ID NO: 2847208 - RNA, 13 nt, Mycobacterium avium subsp. paratuberculosis
gccggccgcccgc

SEQ ID NO: 2847209 - RNA, 14 nt, Mycobacterium avium subsp. paratuberculosis
gccggccgccgcga

SEQ ID NO: 2847210 - RNA, 14 nt, Mycobacterium avium subsp. paratuberculosis
gccggccgccgcgc

SEQ ID NO: 2847211 - RNA, 20 nt, Mycobacterium avium subsp. paratuberculosis
gccggccgccgcgcauccgc

SEQ ID NO: 2847212 - RNA, 12 nt, Mycobacterium avium subsp. paratuberculosis
gccggccgccgg

SEQ ID NO: 2847213 - RNA, 15 nt, Mycobacterium avium subsp. paratuberculosis
gccggccgccggauc

SEQ ID NO: 2847214 - RNA, 14 nt, Mycobacterium avium subsp. paratuberculosis
gccggccgccggcg

SEQ ID NO: 2847215 - RNA, 19 nt, Mycobacterium avium subsp. paratuberculosis
gccggccgccggcggccaa

SEQ ID NO: 2847216 - RNA, 23 nt, Mycobacterium avium subsp. paratuberculosis
gccggccgccguaucccugccag

SEQ ID NO: 2847217 - RNA, 14 nt, Mycobacterium avium subsp. paratuberculosis
gccggccgccugga

SEQ ID NO: 2847218 - RNA, 23 nt, Mycobacterium avium subsp. paratuberculosis
gccggccgccuggacgacgucga

SEQ ID NO: 2847219 - RNA, 19 nt, Mycobacterium avium subsp. paratuberculosis
gccggccgcgcagaucgag

SEQ ID NO: 2847220 - RNA, 22 nt, Mycobacterium avium subsp. paratuberculosis
gccggccgcgcagaucgagauc

SEQ ID NO: 2847221 - RNA, 12 nt, Mycobacterium avium subsp. paratuberculosis
gccggccgcgcg

SEQ ID NO: 2847222 - RNA, 13 nt, Mycobacterium avium subsp. paratuberculosis
gccggccgcgcgc

SEQ ID NO: 2847223 - RNA, 15 nt, Mycobacterium avium subsp. paratuberculosis
gccggccgcgcgcgg

SEQ ID NO: 2847224 - RNA, 16 nt, Mycobacterium avium subsp. paratuberculosis
gccggccgcgcgcggc

SEQ ID NO: 2847225 - RNA, 17 nt, Mycobacterium avium subsp. paratuberculosis
gccggccgcgcgcggcg

SEQ ID NO: 2847226 - RNA, 21 nt, Mycobacterium avium subsp. paratuberculosis
gccggccgcgcgcggcgcgga

SEQ ID NO: 2847227 - RNA, 13 nt, Mycobacterium avium subsp. paratuberculosis
gccggccgcgcgu

SEQ ID NO: 2847228 - RNA, 14 nt, Mycobacterium avium subsp. paratuberculosis
gccggccgcgcgug

SEQ ID NO: 2847229 - RNA, 16 nt, Mycobacterium avium subsp. paratuberculosis
gccggccgcggcgugc

SEQ ID NO: 2847230 - RNA, 14 nt, Mycobacterium avium subsp. paratuberculosis
gccggccgcgggcg

SEQ ID NO: 2847231 - RNA, 17 nt, Mycobacterium avium subsp. paratuberculosis
gccggccgcgggcgauu

SEQ ID NO: 2847232 - RNA, 12 nt, Mycobacterium avium subsp. paratuberculosis
gccggccgcggu

SEQ ID NO: 2847233 - RNA, 21 nt, Mycobacterium avium subsp. paratuberculosis
gccggccgcggugugcccggc

SEQ ID NO: 2847234 - RNA, 20 nt, Mycobacterium avium subsp. paratuberculosis
gccggccgcguacuucgcgc

SEQ ID NO: 2847235 - RNA, 13 nt, Mycobacterium avium subsp. paratuberculosis
gccggccgcgucg

SEQ ID NO: 2847236 - RNA, 14 nt, Mycobacterium avium subsp. paratuberculosis
gccggccgcgucgc

SEQ ID NO: 2847237 - RNA, 19 nt, Mycobacterium avium subsp. paratuberculosis
gccggccgcgucgccgacc

SEQ ID NO: 2847238 - RNA, 20 nt, Mycobacterium avium subsp. paratuberculosis
gccggccgcgucgccgacca

SEQ ID NO: 2847239 - RNA, 17 nt, Mycobacterium avium subsp. paratuberculosis
gccggccgcuacccggc

SEQ ID NO: 2847240 - RNA, 15 nt, Mycobacterium avium subsp. paratuberculosis
gccggccgcucgcgg

SEQ ID NO: 2847241 - RNA, 21 nt, Mycobacterium avium subsp. paratuberculosis
gccggccgcucgcgggccaca

SEQ ID NO: 2847242 - RNA, 21 nt, Mycobacterium avium subsp. paratuberculosis
gccggccggacagaucgccca

SEQ ID NO: 2847243 - RNA, 20 nt, Mycobacterium avium subsp. paratuberculosis
gccggccggagcggauggcg

SEQ ID NO: 2847244 - RNA, 23 nt, Mycobacterium avium subsp. paratuberculosis
gccggccggagcggauggcgccg

SEQ ID NO: 2847245 - RNA, 13 nt, Mycobacterium avium subsp. paratuberculosis
gccggccggcacg

SEQ ID NO: 2847246 - RNA, 12 nt, Mycobacterium avium subsp. paratuberculosis
gccggccggcag

SEQ ID NO: 2847247 - RNA, 13 nt, Mycobacterium avium subsp. paratuberculosis
gccggccggcagc

SEQ ID NO: 2847248 - RNA, 14 nt, Mycobacterium avium subsp. paratuberculosis
gccggccggcagcu

SEQ ID NO: 2847249 - RNA, 15 nt, Mycobacterium avium subsp. paratuberculosis
gccggccggcagcug

SEQ ID NO: 2847250 - RNA, 17 nt, Mycobacterium avium subsp. paratuberculosis
gccggccggcagcugcc

SEQ ID NO: 2847251 - RNA, 17 nt, Mycobacterium avium subsp. paratuberculosis
gccggccggcaggucga

SEQ ID NO: 2847252 - RNA, 22 nt, Mycobacterium avium subsp. paratuberculosis
gccggccggcaggucgaggccg

SEQ ID NO: 2847253 - RNA, 11 nt, Mycobacterium avium subsp. paratuberculosis
gccggccggcc

SEQ ID NO: 2847254 - RNA, 13 nt, Mycobacterium avium subsp. paratuberculosis
gccggccggccga

SEQ ID NO: 2847255 - RNA, 14 nt, Mycobacterium avium subsp. paratuberculosis
gccggccggccgug

SEQ ID NO: 2847256 - RNA, 17 nt, Mycobacterium avium subsp. paratuberculosis
gccggccggccgugccg

SEQ ID NO: 2847257 - RNA, 13 nt, Mycobacterium avium subsp. paratuberculosis
gccggccggcgaa

SEQ ID NO: 2847258 - RNA, 15 nt, Mycobacterium avium subsp. paratuberculosis
gccggccggcgaagc

SEQ ID NO: 2847259 - RNA, 17 nt, Mycobacterium avium subsp. paratuberculosis
gccggccggcgaagccg

SEQ ID NO: 2847260 - RNA, 12 nt, Mycobacterium avium subsp. paratuberculosis
gccggccggcgc

SEQ ID NO: 2847261 - RNA, 16 nt, Mycobacterium avium subsp. paratuberculosis
gccggccggcgcgugc

SEQ ID NO: 2847262 - RNA, 18 nt, Mycobacterium avium subsp. paratuberculosis
gccggccggcggucaggc

SEQ ID NO: 2847263 - RNA, 13 nt, Mycobacterium avium subsp. paratuberculosis
gccggccgggacg

SEQ ID NO: 2847264 - RNA, 16 nt, Mycobacterium avium subsp. paratuberculosis
gccggccgggacgcgg

SEQ ID NO: 2847265 - RNA, 12 nt, Mycobacterium avium subsp. paratuberculosis
gccggccgggcg

SEQ ID NO: 2847266 - RNA, 13 nt, Mycobacterium avium subsp. paratuberculosis
gccggccgggcgg

SEQ ID NO: 2847267 - RNA, 14 nt, Mycobacterium avium subsp. paratuberculosis
gccggccgggcgga

SEQ ID NO: 2847268 - RNA, 23 nt, Mycobacterium avium subsp. paratuberculosis
gccggccgggcggacggcaccga

SEQ ID NO: 2847269 - RNA, 19 nt, Mycobacterium avium subsp. paratuberculosis
gccggccgggcugcgcagc

SEQ ID NO: 2847270 - RNA, 23 nt, Mycobacterium avium subsp. paratuberculosis
gccggccgggcugcgcagcaccg

SEQ ID NO: 2847271 - RNA, 11 nt, Mycobacterium avium subsp. paratuberculosis
gccggccgggg

SEQ ID NO: 2847272 - RNA, 14 nt, Mycobacterium avium subsp. paratuberculosis
gccggccggggcgg

SEQ ID NO: 2847273 - RNA, 14 nt, Mycobacterium avium subsp. paratuberculosis
gccggccgggucga

SEQ ID NO: 2847274 - RNA, 17 nt, Mycobacterium avium subsp. paratuberculosis
gccggcgacgccgcgcu

SEQ ID NO: 2847275 - RNA, 13 nt, Mycobacterium avium subsp. paratuberculosis
gccggcgacggcc

SEQ ID NO: 2847276 - RNA, 14 nt, Mycobacterium avium subsp. paratuberculosis
gccggcgacggcca

SEQ ID NO: 2847277 - RNA, 16 nt, Mycobacterium avium subsp. paratuberculosis
gccggcgacggccagc

SEQ ID NO: 2847278 - RNA, 19 nt, Mycobacterium avium subsp. paratuberculosis
gccggcgacggccagcgcg

SEQ ID NO: 2847279 - RNA, 20 nt, Mycobacterium avium subsp. paratuberculosis
gccggcgacggccagcgcgg

SEQ ID NO: 2847280 - RNA, 15 nt, Mycobacterium avium subsp. paratuberculosis
gccggcgacggcgag

SEQ ID NO: 2847281 - RNA, 20 nt, Mycobacterium avium subsp. paratuberculosis
gccggcgacgguggcgccca

SEQ ID NO: 2847282 - RNA, 22 nt, Mycobacterium avium subsp. paratuberculosis
gccggcgacgguggcgcccagc

SEQ ID NO: 2847283 - RNA, 18 nt, Mycobacterium avium subsp. paratuberculosis
gccggcgagcucgcggcc

SEQ ID NO: 2847284 - RNA, 15 nt, Mycobacterium avium subsp. paratuberculosis
gccggcgaggugggc

SEQ ID NO: 2847285 - RNA, 12 nt, Mycobacterium avium subsp. paratuberculosis
gccggcgagucg

SEQ ID NO: 2847286 - RNA, 19 nt, Mycobacterium avium subsp. paratuberculosis
gccggcgagugcgaaucau

SEQ ID NO: 2847287 - RNA, 19 nt, Mycobacterium avium subsp. paratuberculosis
gccggcgauaggcggccag

SEQ ID NO: 2847288 - RNA, 23 nt, Mycobacterium avium subsp. paratuberculosis
gccggcgauaggcggccagcucc

SEQ ID NO: 2847289 - RNA, 16 nt, Mycobacterium avium subsp. paratuberculosis
gccggcgaucaccggg

SEQ ID NO: 2847290 - RNA, 18 nt, Mycobacterium avium subsp. paratuberculosis
gccggcgauccgcgcggc

SEQ ID NO: 2847291 - RNA, 20 nt, Mycobacterium avium subsp. paratuberculosis
gccggcgauccgcgcggcga

SEQ ID NO: 2847292 - RNA, 22 nt, Mycobacterium avium subsp. paratuberculosis
gccggcgaucgacgucaccacc

SEQ ID NO: 2847293 - RNA, 23 nt, Mycobacterium avium subsp. paratuberculosis
gccggcgaucgacgucaccaccg

SEQ ID NO: 2847294 - RNA, 14 nt, Mycobacterium avium subsp. paratuberculosis
gccggcgaucgucg

SEQ ID NO: 2847295 - RNA, 19 nt, Mycobacterium avium subsp. paratuberculosis
gccggcgaucgucgccguc

SEQ ID NO: 2847296 - RNA, 20 nt, Mycobacterium avium subsp. paratuberculosis
gccggcgaucgucgccguca

SEQ ID NO: 2847297 - RNA, 21 nt, Mycobacterium avium subsp. paratuberculosis
gccggcgaucgucgccgucac

SEQ ID NO: 2847298 - RNA, 16 nt, Mycobacterium avium subsp. paratuberculosis
gccggcgaucuccacc

SEQ ID NO: 2847299 - RNA, 19 nt, Mycobacterium avium subsp. paratuberculosis
gccggcgaucuccaccgug

SEQ ID NO: 2847300 - RNA, 17 nt, Mycobacterium avium subsp. paratuberculosis
gccggcgaucucgucgc

SEQ ID NO: 2847301 - RNA, 17 nt, Mycobacterium avium subsp. paratuberculosis
gccggcgaugaacacgc

SEQ ID NO: 2847302 - RNA, 19 nt, Mycobacterium avium subsp. paratuberculosis
gccggcgaugaacacgccg

SEQ ID NO: 2847303 - RNA, 20 nt, Mycobacterium avium subsp. paratuberculosis
gccggcgaugaacacgccga

SEQ ID NO: 2847304 - RNA, 14 nt, Mycobacterium avium subsp. paratuberculosis
gccggcgaugcccg

SEQ ID NO: 2847305 - RNA, 15 nt, Mycobacterium avium subsp. paratuberculosis
gccggcgaugcccgu

SEQ ID NO: 2847306 - RNA, 15 nt, Mycobacterium avium subsp. paratuberculosis
gccggcgaugcgcgc

SEQ ID NO: 2847307 - RNA, 20 nt, Mycobacterium avium subsp. paratuberculosis
gccggcgaugcgcgccuccg

SEQ ID NO: 2847308 - RNA, 13 nt, Mycobacterium avium subsp. paratuberculosis
gccggcgauggcg

SEQ ID NO: 2847309 - RNA, 17 nt, Mycobacterium avium subsp. paratuberculosis
gccggcgauggcgcggc

SEQ ID NO: 2847310 - RNA, 19 nt, Mycobacterium avium subsp. paratuberculosis
gccggcgauggcgcggccg

SEQ ID NO: 2847311 - RNA, 13 nt, Mycobacterium avium subsp. paratuberculosis
gccggcgauggug

SEQ ID NO: 2847312 - RNA, 16 nt, Mycobacterium avium subsp. paratuberculosis
gccggcgaugguggcg

SEQ ID NO: 2847313 - RNA, 18 nt, Mycobacterium avium subsp. paratuberculosis
gccggcgaugguggcgcu

SEQ ID NO: 2847314 - RNA, 20 nt, Mycobacterium avium subsp. paratuberculosis
gccggcgaugguggcgcugc

SEQ ID NO: 2847315 - RNA, 14 nt, Mycobacterium avium subsp. paratuberculosis
gccggcgcacaucg

SEQ ID NO: 2847316 - RNA, 23 nt, Mycobacterium avium subsp. paratuberculosis
gccggcgcacaucguggcgacga

SEQ ID NO: 2847317 - RNA, 14 nt, Mycobacterium avium subsp. paratuberculosis
gccggcgcaccagg

SEQ ID NO: 2847318 - RNA, 19 nt, Mycobacterium avium subsp. paratuberculosis
gccggcgcaccaggguguc

SEQ ID NO: 2847319 - RNA, 13 nt, Mycobacterium avium subsp. paratuberculosis
gccggcgcacccg

SEQ ID NO: 2847320 - RNA, 15 nt, Mycobacterium avium subsp. paratuberculosis
gccggcgcacccgca

SEQ ID NO: 2847321 - RNA, 16 nt, Mycobacterium avium subsp. paratuberculosis
gccggcgcacccgcac

SEQ ID NO: 2847322 - RNA, 14 nt, Mycobacterium avium subsp. paratuberculosis
gccggcgcaccgcg

SEQ ID NO: 2847323 - RNA, 19 nt, Mycobacterium avium subsp. paratuberculosis
gccggcgcaccgcgucgac

SEQ ID NO: 2847324 - RNA, 14 nt, Mycobacterium avium subsp. paratuberculosis
gccggcgcagccgg

SEQ ID NO: 2847325 - RNA, 15 nt, Mycobacterium avium subsp. paratuberculosis
gccggcgcagcggcc

SEQ ID NO: 2847326 - RNA, 17 nt, Mycobacterium avium subsp. paratuberculosis
gccggcgcagcggcccg

SEQ ID NO: 2847327 - RNA, 13 nt, Mycobacterium avium subsp. paratuberculosis
gccggcgcaggug

SEQ ID NO: 2847328 - RNA, 17 nt, Mycobacterium avium subsp. paratuberculosis
gccggcgcaucaucucg

SEQ ID NO: 2847329 - RNA, 18 nt, Mycobacterium avium subsp. paratuberculosis
gccggcgcaucaucucgg

SEQ ID NO: 2847330 - RNA, 13 nt, Mycobacterium avium subsp. paratuberculosis
gccggcgcccagc

SEQ ID NO: 2847331 - RNA, 14 nt, Mycobacterium avium subsp. paratuberculosis
gccggcgcccagcg

SEQ ID NO: 2847332 - RNA, 16 nt, Mycobacterium avium subsp. paratuberculosis
gccggcgcccagcggc

SEQ ID NO: 2847333 - RNA, 17 nt, Mycobacterium avium subsp. paratuberculosis
gccggcgcccgcaggcc

SEQ ID NO: 2847334 - RNA, 22 nt, Mycobacterium avium subsp. paratuberculosis
gccggcgcccgcaggccgcgag

SEQ ID NO: 2847335 - RNA, 13 nt, Mycobacterium avium subsp. paratuberculosis
gccggcgcccguc

SEQ ID NO: 2847336 - RNA, 18 nt, Mycobacterium avium subsp. paratuberculosis
gccggcgcccgucacgcu

SEQ ID NO: 2847337 - RNA, 20 nt, Mycobacterium avium subsp. paratuberculosis
gccggcgcccgucacgcugg

SEQ ID NO: 2847338 - RNA, 13 nt, Mycobacterium avium subsp. paratuberculosis
gccggcgcccugc

SEQ ID NO: 2847339 - RNA, 17 nt, Mycobacterium avium subsp. paratuberculosis
gccggcgcccugcgcgc

SEQ ID NO: 2847340 - RNA, 22 nt, Mycobacterium avium subsp. paratuberculosis
gccggcgccgaagccgucgacc

SEQ ID NO: 2847341 - RNA, 13 nt, Mycobacterium avium subsp. paratuberculosis
gccggcgccgacc

SEQ ID NO: 2847342 - RNA, 16 nt, Mycobacterium avium subsp. paratuberculosis
gccggcgccgacgacg

SEQ ID NO: 2847343 - RNA, 21 nt, Mycobacterium avium subsp. paratuberculosis
gccggcgccgacgacgucgcg

SEQ ID NO: 2847344 - RNA, 23 nt, Mycobacterium avium subsp. paratuberculosis
gccggcgccgacgacgucgcgca

SEQ ID NO: 2847345 - RNA, 15 nt, Mycobacterium avium subsp. paratuberculosis
gccggcgccgauucc

SEQ ID NO: 2847346 - RNA, 23 nt, Mycobacterium avium subsp. paratuberculosis
gccggcgccgauuccgucggugg

SEQ ID NO: 2847347 - RNA, 12 nt, Mycobacterium avium subsp. paratuberculosis
gccggcgccgcc

SEQ ID NO: 2847348 - RNA, 20 nt, Mycobacterium avium subsp. paratuberculosis
gccggcgccgccggggcguc

SEQ ID NO: 2847349 - RNA, 13 nt, Mycobacterium avium subsp. paratuberculosis
gccggcgccgcgg

SEQ ID NO: 2847350 - RNA, 14 nt, Mycobacterium avium subsp. paratuberculosis
gccggcgccgcggg

SEQ ID NO: 2847351 - RNA, 20 nt, Mycobacterium avium subsp. paratuberculosis
gccggcgccgcgggugcggc

SEQ ID NO: 2847352 - RNA, 20 nt, Mycobacterium avium subsp. paratuberculosis
gccggcgccggaggggcgac

SEQ ID NO: 2847353 - RNA, 21 nt, Mycobacterium avium subsp. paratuberculosis
gccggcgccggaggggcgacg

SEQ ID NO: 2847354 - RNA, 12 nt, Mycobacterium avium subsp. paratuberculosis
gccggcgccggc

SEQ ID NO: 2847355 - RNA, 13 nt, Mycobacterium avium subsp. paratuberculosis
gccggcgccgggc

SEQ ID NO: 2847356 - RNA, 24 nt, Mycobacterium avium subsp. paratuberculosis
gccggcgccgggcgggcgcaggug

SEQ ID NO: 2847357 - RNA, 12 nt, Mycobacterium avium subsp. paratuberculosis
gccggcgccggu

SEQ ID NO: 2847358 - RNA, 13 nt, Mycobacterium avium subsp. paratuberculosis
gccggcgccggug

SEQ ID NO: 2847359 - RNA, 16 nt, Mycobacterium avium subsp. paratuberculosis
gccggcggcggccagc

SEQ ID NO: 2847360 - RNA, 22 nt, Mycobacterium avium subsp. paratuberculosis
gccggcggcggccagcgagucg

SEQ ID NO: 2847361 - RNA, 13 nt, Mycobacterium avium subsp. paratuberculosis
gccggcggcggcg

SEQ ID NO: 2847362 - RNA, 13 nt, Mycobacterium avium subsp. paratuberculosis
gccggcggcgggc

SEQ ID NO: 2847363 - RNA, 14 nt, Mycobacterium avium subsp. paratuberculosis
gccggcggcgggcu

SEQ ID NO: 2847364 - RNA, 19 nt, Mycobacterium avium subsp. paratuberculosis
gccggcggcgggcucggag

SEQ ID NO: 2847365 - RNA, 15 nt, Mycobacterium avium subsp. paratuberculosis
gccggcggcggugcg

SEQ ID NO: 2847366 - RNA, 22 nt, Mycobacterium avium subsp. paratuberculosis
gccggcggcggugcgucgggcg

SEQ ID NO: 2847367 - RNA, 17 nt, Mycobacterium avium subsp. paratuberculosis
gccggcggcgucccacg

SEQ ID NO: 2847368 - RNA, 12 nt, Mycobacterium avium subsp. paratuberculosis
gccggcggcguu

SEQ ID NO: 2847369 - RNA, 14 nt, Mycobacterium avium subsp. paratuberculosis
gccggcggcguuga

SEQ ID NO: 2847370 - RNA, 15 nt, Mycobacterium avium subsp. paratuberculosis
gccggcggcugugau

SEQ ID NO: 2847371 - RNA, 21 nt, Mycobacterium avium subsp. paratuberculosis
gccggcggcugugaucgcuga

SEQ ID NO: 2847372 - RNA, 16 nt, Mycobacterium avium subsp. paratuberculosis
gccggcgggcgcucga

SEQ ID NO: 2847373 - RNA, 13 nt, Mycobacterium avium subsp. paratuberculosis
gccggcggggcgg

SEQ ID NO: 2847374 - RNA, 14 nt, Mycobacterium avium subsp. paratuberculosis
gccggcggggcguc

SEQ ID NO: 2847375 - RNA, 16 nt, Mycobacterium avium subsp. paratuberculosis
gccggcggggcgucgc

SEQ ID NO: 2847376 - RNA, 20 nt, Mycobacterium avium subsp. paratuberculosis
gccggcggggcgucgcccgc

SEQ ID NO: 2847377 - RNA, 12 nt, Mycobacterium avium subsp. paratuberculosis
gccggcgggggc

SEQ ID NO: 2847378 - RNA, 15 nt, Mycobacterium avium subsp. paratuberculosis
gccggcgggggcgcg

SEQ ID NO: 2847379 - RNA, 16 nt, Mycobacterium avium subsp. paratuberculosis
gccggcgggggcgcgu

SEQ ID NO: 2847380 - RNA, 18 nt, Mycobacterium avium subsp. paratuberculosis
gccggcgggggcgcgucc

SEQ ID NO: 2847381 - RNA, 22 nt, Mycobacterium avium subsp. paratuberculosis
gccggcgggggcgcguccgcgg

SEQ ID NO: 2847382 - RNA, 12 nt, Mycobacterium avium subsp. paratuberculosis
gccggcggggug

SEQ ID NO: 2847383 - RNA, 13 nt, Mycobacterium avium subsp. paratuberculosis
gccggcggggugg

SEQ ID NO: 2847384 - RNA, 19 nt, Mycobacterium avium subsp. paratuberculosis
gccggcggggugggcaccu

SEQ ID NO: 2847385 - RNA, 22 nt, Mycobacterium avium subsp. paratuberculosis
gccggcggggugggcaccuggc

SEQ ID NO: 2847386 - RNA, 17 nt, Mycobacterium avium subsp. paratuberculosis
gccggcgggucagcagc

SEQ ID NO: 2847387 - RNA, 16 nt, Mycobacterium avium subsp. paratuberculosis
gccggcgggugagccg

SEQ ID NO: 2847388 - RNA, 20 nt, Mycobacterium avium subsp. paratuberculosis
gccggcggguucugauacac

SEQ ID NO: 2847389 - RNA, 16 nt, Mycobacterium avium subsp. paratuberculosis
gccggcggguuggccg

SEQ ID NO: 2847390 - RNA, 22 nt, Mycobacterium avium subsp. paratuberculosis
gccggcggguuggucccgauca

SEQ ID NO: 2847391 - RNA, 19 nt, Mycobacterium avium subsp. paratuberculosis
gccggcgguaccgccgauc

SEQ ID NO: 2847392 - RNA, 20 nt, Mycobacterium avium subsp. paratuberculosis
gccggcgguaugcccgggcc

SEQ ID NO: 2847393 - RNA, 21 nt, Mycobacterium avium subsp. paratuberculosis
gccggcgguaugcccgggccg

SEQ ID NO: 2847394 - RNA, 13 nt, Mycobacterium avium subsp. paratuberculosis
gccggcggucagc

SEQ ID NO: 2847395 - RNA, 12 nt, Mycobacterium avium subsp. paratuberculosis
gccggcggucga

SEQ ID NO: 2847396 - RNA, 16 nt, Mycobacterium avium subsp. paratuberculosis
gccggcggucgacacg

SEQ ID NO: 2847397 - RNA, 23 nt, Mycobacterium avium subsp. paratuberculosis
gccggcggucgacacgaucggca

SEQ ID NO: 2847398 - RNA, 22 nt, Mycobacterium avium subsp. paratuberculosis
gccggcggugauccgcccggcc

SEQ ID NO: 2847399 - RNA, 11 nt, Mycobacterium avium subsp. paratuberculosis
gccggcggugc

SEQ ID NO: 2847400 - RNA, 14 nt, Mycobacterium avium subsp. paratuberculosis
gccggcggugcagg

SEQ ID NO: 2847401 - RNA, 21 nt, Mycobacterium avium subsp. paratuberculosis
gccggcggugcagggucagca

SEQ ID NO: 2847402 - RNA, 14 nt, Mycobacterium avium subsp. paratuberculosis
gccggcggugcggc

SEQ ID NO: 2847403 - RNA, 17 nt, Mycobacterium avium subsp. paratuberculosis
gccggcggugcggcggg

SEQ ID NO: 2847404 - RNA, 17 nt, Mycobacterium avium subsp. paratuberculosis
gccggcgguggccaugc

SEQ ID NO: 2847405 - RNA, 17 nt, Mycobacterium avium subsp. paratuberculosis
gccggcgguggugccgc

SEQ ID NO: 2847406 - RNA, 20 nt, Mycobacterium avium subsp. paratuberculosis
gccggcgguggugccgccgu

SEQ ID NO: 2847407 - RNA, 17 nt, Mycobacterium avium subsp. paratuberculosis
gccggcgguguccacga

SEQ ID NO: 2847408 - RNA, 22 nt, Mycobacterium avium subsp. paratuberculosis
gccggcgguguccacgaugcgg

SEQ ID NO: 2847409 - RNA, 16 nt, Mycobacterium avium subsp. paratuberculosis
gccggcggugucgaga

SEQ ID NO: 2847410 - RNA, 16 nt, Mycobacterium avium subsp. paratuberculosis
gccggcgguucggcgg

SEQ ID NO: 2847411 - RNA, 19 nt, Mycobacterium avium subsp. paratuberculosis
gccggcgguucggcgggcc

SEQ ID NO: 2847412 - RNA, 13 nt, Mycobacterium avium subsp. paratuberculosis
gccggcguacccg

SEQ ID NO: 2847413 - RNA, 20 nt, Mycobacterium avium subsp. paratuberculosis
gccggcguacccgcccaugc

SEQ ID NO: 2847414 - RNA, 22 nt, Mycobacterium avium subsp. paratuberculosis
gccggcguacccgcccaugcac

SEQ ID NO: 2847415 - RNA, 13 nt, Mycobacterium avium subsp. paratuberculosis
gccggcguacucg

SEQ ID NO: 2847416 - RNA, 20 nt, Mycobacterium avium subsp. paratuberculosis
gccggcguacucgcacagcc

SEQ ID NO: 2847417 - RNA, 21 nt, Mycobacterium avium subsp. paratuberculosis
gccggcguacucgcacagccg

SEQ ID NO: 2847418 - RNA, 22 nt, Mycobacterium avium subsp. paratuberculosis
gccggcguacucgcacagccgg

SEQ ID NO: 2847419 - RNA, 16 nt, Mycobacterium avium subsp. paratuberculosis
gccggcguagaccagc

SEQ ID NO: 2847420 - RNA, 19 nt, Mycobacterium avium subsp. paratuberculosis
gccggcguagaccagcgac

SEQ ID NO: 2847421 - RNA, 21 nt, Mycobacterium avium subsp. paratuberculosis
gccggcguagaccagcgacgc

SEQ ID NO: 2847422 - RNA, 23 nt, Mycobacterium avium subsp. paratuberculosis
gccggcguagaccagcgacgcca

SEQ ID NO: 2847423 - RNA, 19 nt, Mycobacterium avium subsp. paratuberculosis
gccggcguagcagucggcc

SEQ ID NO: 2847424 - RNA, 20 nt, Mycobacterium avium subsp. paratuberculosis
gccggcguagcagucggccu

SEQ ID NO: 2847425 - RNA, 17 nt, Mycobacterium avium subsp. paratuberculosis
gccggcgucaauugcca

SEQ ID NO: 2847426 - RNA, 16 nt, Mycobacterium avium subsp. paratuberculosis
gccggcgucacucugg

SEQ ID NO: 2847427 - RNA, 12 nt, Mycobacterium avium subsp. paratuberculosis
gccggcguccag

SEQ ID NO: 2847428 - RNA, 14 nt, Mycobacterium avium subsp. paratuberculosis
gccggcguccagcg

SEQ ID NO: 2847429 - RNA, 19 nt, Mycobacterium avium subsp. paratuberculosis
gccggcguccagcgccgcc

SEQ ID NO: 2847430 - RNA, 22 nt, Mycobacterium avium subsp. paratuberculosis
gccggcguccagcgccgccacg

SEQ ID NO: 2847431 - RNA, 17 nt, Mycobacterium avium subsp. paratuberculosis
gccggcguccaggcgca

SEQ ID NO: 2847432 - RNA, 18 nt, Mycobacterium avium subsp. paratuberculosis
gccggcguccaggcgcac

SEQ ID NO: 2847433 - RNA, 21 nt, Mycobacterium avium subsp. paratuberculosis
gccggcguccaggcgcaccgc

SEQ ID NO: 2847434 - RNA, 21 nt, Mycobacterium avium subsp. paratuberculosis
gccggcguccaguucggccag

SEQ ID NO: 2847435 - RNA, 24 nt, Mycobacterium avium subsp. paratuberculosis
gccggcguccaguucggccagcgc

SEQ ID NO: 2847436 - RNA, 15 nt, Mycobacterium avium subsp. paratuberculosis
gccggcgucgacguc

SEQ ID NO: 2847437 - RNA, 14 nt, Mycobacterium avium subsp. paratuberculosis
gccggcgucgauga

SEQ ID NO: 2847438 - RNA, 16 nt, Mycobacterium avium subsp. paratuberculosis
gccggcgucgaugaug

SEQ ID NO: 2847439 - RNA, 21 nt, Mycobacterium avium subsp. paratuberculosis
gccggcgucgaugaugccggc

SEQ ID NO: 2847440 - RNA, 22 nt, Mycobacterium avium subsp. paratuberculosis
gccggcgucgaugaugccggcg

SEQ ID NO: 2847441 - RNA, 16 nt, Mycobacterium avium subsp. paratuberculosis
gccggcgucgccgcug

SEQ ID NO: 2847442 - RNA, 14 nt, Mycobacterium avium subsp. paratuberculosis
gccggcgucgcggu

SEQ ID NO: 2847443 - RNA, 15 nt, Mycobacterium avium subsp. paratuberculosis
gccggcgucgcggug

SEQ ID NO: 2847444 - RNA, 19 nt, Mycobacterium avium subsp. paratuberculosis
gccgggaucggcagcgcgc

SEQ ID NO: 2847445 - RNA, 20 nt, Mycobacterium avium subsp. paratuberculosis
gccgggaucggcagcgcgcc

SEQ ID NO: 2847446 - RNA, 19 nt, Mycobacterium avium subsp. paratuberculosis
gccgggaucggcggggcgc

SEQ ID NO: 2847447 - RNA, 23 nt, Mycobacterium avium subsp. paratuberculosis
gccgggaugccaguccugggccg

SEQ ID NO: 2847448 - RNA, 16 nt, Mycobacterium avium subsp. paratuberculosis
gccgggaugccgccgg

SEQ ID NO: 2847449 - RNA, 17 nt, Mycobacterium avium subsp. paratuberculosis
gccgggaugccgccggu

SEQ ID NO: 2847450 - RNA, 20 nt, Mycobacterium avium subsp. paratuberculosis
gccgggaugcgccaccgaca

SEQ ID NO: 2847451 - RNA, 19 nt, Mycobacterium avium subsp. paratuberculosis
gccgggauugugcuccagg

SEQ ID NO: 2847452 - RNA, 20 nt, Mycobacterium avium subsp. paratuberculosis
gccgggauugugcuccagga

SEQ ID NO: 2847453 - RNA, 19 nt, Mycobacterium avium subsp. paratuberculosis
gccgggauuucccgggcga

SEQ ID NO: 2847454 - RNA, 16 nt, Mycobacterium avium subsp. paratuberculosis
gccgggcaacagcgcg

SEQ ID NO: 2847455 - RNA, 18 nt, Mycobacterium avium subsp. paratuberculosis
gccgggcaacagcgcgcc

SEQ ID NO: 2847456 - RNA, 19 nt, Mycobacterium avium subsp. paratuberculosis
gccgggcaacagcgcgccg

SEQ ID NO: 2847457 - RNA, 21 nt, Mycobacterium avium subsp. paratuberculosis
gccgggcaacagcgcgccggc

SEQ ID NO: 2847458 - RNA, 22 nt, Mycobacterium avium subsp. paratuberculosis
gccgggcaacagcgcgccggcc

SEQ ID NO: 2847459 - RNA, 14 nt, Mycobacterium avium subsp. paratuberculosis
gccgggcaaccaca

SEQ ID NO: 2847460 - RNA, 22 nt, Mycobacterium avium subsp. paratuberculosis
gccgggcaaccacagcggcgca

SEQ ID NO: 2847461 - RNA, 14 nt, Mycobacterium avium subsp. paratuberculosis
gccgggcaccacca

SEQ ID NO: 2847462 - RNA, 21 nt, Mycobacterium avium subsp. paratuberculosis
gccgggcaccaccaccgacac

SEQ ID NO: 2847463 - RNA, 13 nt, Mycobacterium avium subsp. paratuberculosis
gccgggcaccagc

SEQ ID NO: 2847464 - RNA, 14 nt, Mycobacterium avium subsp. paratuberculosis
gccgggcaccagcg

SEQ ID NO: 2847465 - RNA, 22 nt, Mycobacterium avium subsp. paratuberculosis
gccgggcaccagcgacagcacc

SEQ ID NO: 2847466 - RNA, 19 nt, Mycobacterium avium subsp. paratuberculosis
gccgggcacccggguggac

SEQ ID NO: 2847467 - RNA, 23 nt, Mycobacterium avium subsp. paratuberculosis
gccgggcacccggguggacaccg

SEQ ID NO: 2847468 - RNA, 18 nt, Mycobacterium avium subsp. paratuberculosis
gccgggcaccgcgcccgc

SEQ ID NO: 2847469 - RNA, 14 nt, Mycobacterium avium subsp. paratuberculosis
gccgggcaccucgg

SEQ ID NO: 2847470 - RNA, 16 nt, Mycobacterium avium subsp. paratuberculosis
gccgggcaccucggcg

SEQ ID NO: 2847471 - RNA, 19 nt, Mycobacterium avium subsp. paratuberculosis
gccgggcaccucggcgucg

SEQ ID NO: 2847472 - RNA, 20 nt, Mycobacterium avium subsp. paratuberculosis
gccgggcaccucggcgucgg

SEQ ID NO: 2847473 - RNA, 22 nt, Mycobacterium avium subsp. paratuberculosis
gccgggcaccucggcgucggcg

SEQ ID NO: 2847474 - RNA, 16 nt, Mycobacterium avium subsp. paratuberculosis
gccgggcacgucgacg

SEQ ID NO: 2847475 - RNA, 17 nt, Mycobacterium avium subsp. paratuberculosis
gccgggcacgucgacgc

SEQ ID NO: 2847476 - RNA, 18 nt, Mycobacterium avium subsp. paratuberculosis
gccgggcacgucgacgcc

SEQ ID NO: 2847477 - RNA, 20 nt, Mycobacterium avium subsp. paratuberculosis
gccgggcacgucgacgcccu

SEQ ID NO: 2847478 - RNA, 13 nt, Mycobacterium avium subsp. paratuberculosis
gccgggcagcccg

SEQ ID NO: 2847479 - RNA, 14 nt, Mycobacterium avium subsp. paratuberculosis
gccgggcagcccgc

SEQ ID NO: 2847480 - RNA, 17 nt, Mycobacterium avium subsp. paratuberculosis
gccgggcagcccgccgc

SEQ ID NO: 2847481 - RNA, 19 nt, Mycobacterium avium subsp. paratuberculosis
gccgggcagcccgccgcgg

SEQ ID NO: 2847482 - RNA, 20 nt, Mycobacterium avium subsp. paratuberculosis
gccgggcagcccgccgcgga

SEQ ID NO: 2847483 - RNA, 24 nt, Mycobacterium avium subsp. paratuberculosis
gccgggcagcccgccgcggaucgg

SEQ ID NO: 2847484 - RNA, 14 nt, Mycobacterium avium subsp. paratuberculosis
gccgggcagcgcga

SEQ ID NO: 2847485 - RNA, 14 nt, Mycobacterium avium subsp. paratuberculosis
gccgggcagcgcgc

SEQ ID NO: 2847486 - RNA, 16 nt, Mycobacterium avium subsp. paratuberculosis
gccgggcagcgcgcga

SEQ ID NO: 2847487 - RNA, 17 nt, Mycobacterium avium subsp. paratuberculosis
gccgggcagcggcccca

SEQ ID NO: 2847488 - RNA, 18 nt, Mycobacterium avium subsp. paratuberculosis
gccgggcagcggccccac

SEQ ID NO: 2847489 - RNA, 16 nt, Mycobacterium avium subsp. paratuberculosis
gccgggcaggccggga

SEQ ID NO: 2847490 - RNA, 13 nt, Mycobacterium avium subsp. paratuberculosis
gccgggcaggugg

SEQ ID NO: 2847491 - RNA, 20 nt, Mycobacterium avium subsp. paratuberculosis
gccgggcagguggucggcga

SEQ ID NO: 2847492 - RNA, 22 nt, Mycobacterium avium subsp. paratuberculosis
gccgggcagguggucggcgaac

SEQ ID NO: 2847493 - RNA, 17 nt, Mycobacterium avium subsp. paratuberculosis
gccgggcagugcgcggc

SEQ ID NO: 2847494 - RNA, 20 nt, Mycobacterium avium subsp. paratuberculosis
gccgggcagugcgcggcguc

SEQ ID NO: 2847495 - RNA, 15 nt, Mycobacterium avium subsp. paratuberculosis
gccgggcauccgccc

SEQ ID NO: 2847496 - RNA, 17 nt, Mycobacterium avium subsp. paratuberculosis
gccgggcauccgcccgu

SEQ ID NO: 2847497 - RNA, 18 nt, Mycobacterium avium subsp. paratuberculosis
gccgggcauccgggccgc

SEQ ID NO: 2847498 - RNA, 19 nt, Mycobacterium avium subsp. paratuberculosis
gccgggcauccgggccgcc

SEQ ID NO: 2847499 - RNA, 21 nt, Mycobacterium avium subsp. paratuberculosis
gccgggcauccgggccgccgc

SEQ ID NO: 2847500 - RNA, 22 nt, Mycobacterium avium subsp. paratuberculosis
gccgggcauccgggccgccgcg

SEQ ID NO: 2847501 - RNA, 23 nt, Mycobacterium avium subsp. paratuberculosis
gccgggcaucucguugucgucgg

SEQ ID NO: 2847502 - RNA, 15 nt, Mycobacterium avium subsp. paratuberculosis
gccgggccacgccga

SEQ ID NO: 2847503 - RNA, 20 nt, Mycobacterium avium subsp. paratuberculosis
gccgggccagcaacagcagc

SEQ ID NO: 2847504 - RNA, 15 nt, Mycobacterium avium subsp. paratuberculosis
gccgggccagcagcu

SEQ ID NO: 2847505 - RNA, 18 nt, Mycobacterium avium subsp. paratuberculosis
gccgggccagcagcuuga

SEQ ID NO: 2847506 - RNA, 13 nt, Mycobacterium avium subsp. paratuberculosis
gccgggccagccc

SEQ ID NO: 2847507 - RNA, 14 nt, Mycobacterium avium subsp. paratuberculosis
gccgggccagcccg

SEQ ID NO: 2847508 - RNA, 16 nt, Mycobacterium avium subsp. paratuberculosis
gccgggccagcccggg

SEQ ID NO: 2847509 - RNA, 14 nt, Mycobacterium avium subsp. paratuberculosis
gccgggccagccgg

SEQ ID NO: 2847510 - RNA, 16 nt, Mycobacterium avium subsp. paratuberculosis
gccgggccagccggcc

SEQ ID NO: 2847511 - RNA, 17 nt, Mycobacterium avium subsp. paratuberculosis
gccgggccagccggccc

SEQ ID NO: 2847512 - RNA, 21 nt, Mycobacterium avium subsp. paratuberculosis
gccgggccagccggcccucca

SEQ ID NO: 2847513 - RNA, 16 nt, Mycobacterium avium subsp. paratuberculosis
gccgggccagguccca

SEQ ID NO: 2847514 - RNA, 12 nt, Mycobacterium avium subsp. paratuberculosis
gccgggcccgcu

SEQ ID NO: 2847515 - RNA, 18 nt, Mycobacterium avium subsp. paratuberculosis
gccgggcccgcucaccug

SEQ ID NO: 2847516 - RNA, 13 nt, Mycobacterium avium subsp. paratuberculosis
gccgggcccgggu

SEQ ID NO: 2847517 - RNA, 21 nt, Mycobacterium avium subsp. paratuberculosis
gccgggcccggguggcgucca

SEQ ID NO: 2847518 - RNA, 14 nt, Mycobacterium avium subsp. paratuberculosis
gccgggccgagcgc

SEQ ID NO: 2847519 - RNA, 17 nt, Mycobacterium avium subsp. paratuberculosis
gccgggccgagcgcgcc

SEQ ID NO: 2847520 - RNA, 22 nt, Mycobacterium avium subsp. paratuberculosis
gccgggccgcauccagcgccgc

SEQ ID NO: 2847521 - RNA, 16 nt, Mycobacterium avium subsp. paratuberculosis
gccgggccgcccgcgc

SEQ ID NO: 2847522 - RNA, 17 nt, Mycobacterium avium subsp. paratuberculosis
gccgggccgcccgcgcg

SEQ ID NO: 2847523 - RNA, 20 nt, Mycobacterium avium subsp. paratuberculosis
gccgggccgcccgcgcgugg

SEQ ID NO: 2847524 - RNA, 15 nt, Mycobacterium avium subsp. paratuberculosis
gccgggccgccgaug

SEQ ID NO: 2847525 - RNA, 14 nt, Mycobacterium avium subsp. paratuberculosis
gccgggccgccgcg

SEQ ID NO: 2847526 - RNA, 15 nt, Mycobacterium avium subsp. paratuberculosis
gccgggccgccgcgg

SEQ ID NO: 2847527 - RNA, 19 nt, Mycobacterium avium subsp. paratuberculosis
gccgggccgccgcggccac

SEQ ID NO: 2847528 - RNA, 14 nt, Mycobacterium avium subsp. paratuberculosis
gccgggcuggcgcu

SEQ ID NO: 2847529 - RNA, 15 nt, Mycobacterium avium subsp. paratuberculosis
gccgggcuggcgcug

SEQ ID NO: 2847530 - RNA, 16 nt, Mycobacterium avium subsp. paratuberculosis
gccgggcuggcgcugg

SEQ ID NO: 2847531 - RNA, 17 nt, Mycobacterium avium subsp. paratuberculosis
gccgggcuggcgcugga

SEQ ID NO: 2847532 - RNA, 16 nt, Mycobacterium avium subsp. paratuberculosis
gccgggcugguccgga

SEQ ID NO: 2847533 - RNA, 17 nt, Mycobacterium avium subsp. paratuberculosis
gccgggcuuccccaacc

SEQ ID NO: 2847534 - RNA, 24 nt, Mycobacterium avium subsp. paratuberculosis
gccgggcuuccccaaccuggacgg

SEQ ID NO: 2847535 - RNA, 23 nt, Mycobacterium avium subsp. paratuberculosis
gccgggcuuggucaugaacgccg

SEQ ID NO: 2847536 - RNA, 18 nt, Mycobacterium avium subsp. paratuberculosis
gccggggaaacgggaugc

SEQ ID NO: 2847537 - RNA, 22 nt, Mycobacterium avium subsp. paratuberculosis
gccggggaacaccggcgaggug

SEQ ID NO: 2847538 - RNA, 14 nt, Mycobacterium avium subsp. paratuberculosis
gccggggacgacgg

SEQ ID NO: 2847539 - RNA, 18 nt, Mycobacterium avium subsp. paratuberculosis
gccggggacgacggcggg

SEQ ID NO: 2847540 - RNA, 21 nt, Mycobacterium avium subsp. paratuberculosis
gccggggacggugcagccggg

SEQ ID NO: 2847541 - RNA, 14 nt, Mycobacterium avium subsp. paratuberculosis
gccggggaucgcgc

SEQ ID NO: 2847542 - RNA, 21 nt, Mycobacterium avium subsp. paratuberculosis
gccggggaucgcgcagccgcg

SEQ ID NO: 2847543 - RNA, 22 nt, Mycobacterium avium subsp. paratuberculosis
gccggggaucgcgcagccgcgg

SEQ ID NO: 2847544 - RNA, 12 nt, Mycobacterium avium subsp. paratuberculosis
gccggggcacca

SEQ ID NO: 2847545 - RNA, 21 nt, Mycobacterium avium subsp. paratuberculosis
gccggggcaccauugcgggaa

SEQ ID NO: 2847546 - RNA, 21 nt, Mycobacterium avium subsp. paratuberculosis
gccggggcagacccgcgucga

SEQ ID NO: 2847547 - RNA, 15 nt, Mycobacterium avium subsp. paratuberculosis
gccggggcagcaccc

SEQ ID NO: 2847548 - RNA, 17 nt, Mycobacterium avium subsp. paratuberculosis
gccggggcagcacccgc

SEQ ID NO: 2847549 - RNA, 23 nt, Mycobacterium avium subsp. paratuberculosis
gccggggcagcacccgcaccgug

SEQ ID NO: 2847550 - RNA, 15 nt, Mycobacterium avium subsp. paratuberculosis
gccggggcagcugcu

SEQ ID NO: 2847551 - RNA, 17 nt, Mycobacterium avium subsp. paratuberculosis
gccggggcagcugcugg

SEQ ID NO: 2847552 - RNA, 12 nt, Mycobacterium avium subsp. paratuberculosis
gccggggccagc

SEQ ID NO: 2847553 - RNA, 15 nt, Mycobacterium avium subsp. paratuberculosis
gccggggccagcacc

SEQ ID NO: 2847554 - RNA, 17 nt, Mycobacterium avium subsp. paratuberculosis
gccggggccccaacccc

SEQ ID NO: 2847555 - RNA, 20 nt, Mycobacterium avium subsp. paratuberculosis
gccggggcccucgcucaacc

SEQ ID NO: 2847556 - RNA, 16 nt, Mycobacterium avium subsp. paratuberculosis
gccggggccgcggcuc

SEQ ID NO: 2847557 - RNA, 15 nt, Mycobacterium avium subsp. paratuberculosis
gccggggccggcgau

SEQ ID NO: 2847558 - RNA, 14 nt, Mycobacterium avium subsp. paratuberculosis
gccggggcgaccag

SEQ ID NO: 2847559 - RNA, 12 nt, Mycobacterium avium subsp. paratuberculosis
gccggggcgcag

SEQ ID NO: 2847560 - RNA, 13 nt, Mycobacterium avium subsp. paratuberculosis
gccggggcgcaga

SEQ ID NO: 2847561 - RNA, 14 nt, Mycobacterium avium subsp. paratuberculosis
gccggggcgccgcc

SEQ ID NO: 2847562 - RNA, 20 nt, Mycobacterium avium subsp. paratuberculosis
gccggggcgcugagcagguc

SEQ ID NO: 2847563 - RNA, 19 nt, Mycobacterium avium subsp. paratuberculosis
gccggggcggauccccgcg

SEQ ID NO: 2847564 - RNA, 20 nt, Mycobacterium avium subsp. paratuberculosis
gccggggcggauccccgcgc

SEQ ID NO: 2847565 - RNA, 14 nt, Mycobacterium avium subsp. paratuberculosis
gccggggcgggcac

SEQ ID NO: 2847566 - RNA, 21 nt, Mycobacterium avium subsp. paratuberculosis
gccggggcgggcacgucgcgc

SEQ ID NO: 2847567 - RNA, 16 nt, Mycobacterium avium subsp. paratuberculosis
gccggggcgggcagca

SEQ ID NO: 2847568 - RNA, 17 nt, Mycobacterium avium subsp. paratuberculosis
gccggggcgggcggcgg

SEQ ID NO: 2847569 - RNA, 19 nt, Mycobacterium avium subsp. paratuberculosis
gccggggcucauacggcgg

SEQ ID NO: 2847570 - RNA, 21 nt, Mycobacterium avium subsp. paratuberculosis
gccggggcucauacggcggcu

SEQ ID NO: 2847571 - RNA, 22 nt, Mycobacterium avium subsp. paratuberculosis
gccggggcucauacggcggcuc

SEQ ID NO: 2847572 - RNA, 20 nt, Mycobacterium avium subsp. paratuberculosis
gccggggcuucgaacgcccg

SEQ ID NO: 2847573 - RNA, 24 nt, Mycobacterium avium subsp. paratuberculosis
gccgggggaggcguugcgucccgc

SEQ ID NO: 2847574 - RNA, 16 nt, Mycobacterium avium subsp. paratuberculosis
gccgggggaucaccuc

SEQ ID NO: 2847575 - RNA, 17 nt, Mycobacterium avium subsp. paratuberculosis
gccgggggaucaccuca

SEQ ID NO: 2847576 - RNA, 23 nt, Mycobacterium avium subsp. paratuberculosis
gccgggggaucaccucaucgccc

SEQ ID NO: 2847577 - RNA, 14 nt, Mycobacterium avium subsp. paratuberculosis
gccgggggccgagc

SEQ ID NO: 2847578 - RNA, 19 nt, Mycobacterium avium subsp. paratuberculosis
gccgggggcgcgggcggca

SEQ ID NO: 2847579 - RNA, 20 nt, Mycobacterium avium subsp. paratuberculosis
gccgggggcgcgggcggcag

SEQ ID NO: 2847580 - RNA, 15 nt, Mycobacterium avium subsp. paratuberculosis
gccgggggcggcggc

SEQ ID NO: 2847581 - RNA, 14 nt, Mycobacterium avium subsp. paratuberculosis
gccgggggcggugc

SEQ ID NO: 2847582 - RNA, 15 nt, Mycobacterium avium subsp. paratuberculosis
gccgggggcggugca

SEQ ID NO: 2847583 - RNA, 16 nt, Mycobacterium avium subsp. paratuberculosis
gccgggggcggugcag

SEQ ID NO: 2847584 - RNA, 18 nt, Mycobacterium avium subsp. paratuberculosis
gccgggggcggugcagcc

SEQ ID NO: 2847585 - RNA, 19 nt, Mycobacterium avium subsp. paratuberculosis
gccgggggcggugcagccg

SEQ ID NO: 2847586 - RNA, 20 nt, Mycobacterium avium subsp. paratuberculosis
gccgggggcggugcagccgg

SEQ ID NO: 2847587 - RNA, 14 nt, Mycobacterium avium subsp. paratuberculosis
gccgggggucggcu

SEQ ID NO: 2847588 - RNA, 19 nt, Mycobacterium avium subsp. paratuberculosis
gccgggguagaggccgcgg

SEQ ID NO: 2847589 - RNA, 21 nt, Mycobacterium avium subsp. paratuberculosis
gccgggguagaggccgcggau

SEQ ID NO: 2847590 - RNA, 17 nt, Mycobacterium avium subsp. paratuberculosis
gccgggguagggcggcg

SEQ ID NO: 2847591 - RNA, 13 nt, Mycobacterium avium subsp. paratuberculosis
gccgggguccgca

SEQ ID NO: 2847592 - RNA, 14 nt, Mycobacterium avium subsp. paratuberculosis
gccgggguccgcaa

SEQ ID NO: 2847593 - RNA, 20 nt, Mycobacterium avium subsp. paratuberculosis
gccgggguccgcaacgccgg

SEQ ID NO: 2847594 - RNA, 22 nt, Mycobacterium avium subsp. paratuberculosis
gccgggguccgcaacgccggcg

SEQ ID NO: 2847595 - RNA, 16 nt, Mycobacterium avium subsp. paratuberculosis
gccggggucgcgcgcg

SEQ ID NO: 2847596 - RNA, 17 nt, Mycobacterium avium subsp. paratuberculosis
gccggggucgcgcgcga

SEQ ID NO: 2847597 - RNA, 13 nt, Mycobacterium avium subsp. paratuberculosis
gccggggugcagc

SEQ ID NO: 2847598 - RNA, 18 nt, Mycobacterium avium subsp. paratuberculosis
gccggggugcccgggccg

SEQ ID NO: 2847599 - RNA, 19 nt, Mycobacterium avium subsp. paratuberculosis
gccggggugcccgggccgc

SEQ ID NO: 2847600 - RNA, 20 nt, Mycobacterium avium subsp. paratuberculosis
gccggggugcccgggccgca

SEQ ID NO: 2847601 - RNA, 21 nt, Mycobacterium avium subsp. paratuberculosis
gccgggguguagcggauggcg

SEQ ID NO: 2847602 - RNA, 13 nt, Mycobacterium avium subsp. paratuberculosis
gccggguagcgcc

SEQ ID NO: 2847603 - RNA, 16 nt, Mycobacterium avium subsp. paratuberculosis
gccggguagcgccgcc

SEQ ID NO: 2847604 - RNA, 17 nt, Mycobacterium avium subsp. paratuberculosis
gccggguagcgccgccg

SEQ ID NO: 2847605 - RNA, 18 nt, Mycobacterium avium subsp. paratuberculosis
gccggguagcgccgccgg

SEQ ID NO: 2847606 - RNA, 18 nt, Mycobacterium avium subsp. paratuberculosis
gccggguaguucaccccg

SEQ ID NO: 2847607 - RNA, 20 nt, Mycobacterium avium subsp. paratuberculosis
gccggguaucgacagucccg

SEQ ID NO: 2847608 - RNA, 14 nt, Mycobacterium avium subsp. paratuberculosis
gccgggucaccgga

SEQ ID NO: 2847609 - RNA, 14 nt, Mycobacterium avium subsp. paratuberculosis
gccgggucaguucg

SEQ ID NO: 2847610 - RNA, 20 nt, Mycobacterium avium subsp. paratuberculosis
gccgggucaguucgcggcgc

SEQ ID NO: 2847611 - RNA, 18 nt, Mycobacterium avium subsp. paratuberculosis
gccggguccacgccgagg

SEQ ID NO: 2847612 - RNA, 15 nt, Mycobacterium avium subsp. paratuberculosis
gccggguccagccgc

SEQ ID NO: 2847613 - RNA, 22 nt, Mycobacterium avium subsp. paratuberculosis
gccggucagcggcaacacgccg

SEQ ID NO: 2847614 - RNA, 23 nt, Mycobacterium avium subsp. paratuberculosis
gccggucagcggcaacacgccgg

SEQ ID NO: 2847615 - RNA, 22 nt, Mycobacterium avium subsp. paratuberculosis
gccggucaggcauuccaccgcg

SEQ ID NO: 2847616 - RNA, 18 nt, Mycobacterium avium subsp. paratuberculosis
gccggucauaggccgcgc

SEQ ID NO: 2847617 - RNA, 19 nt, Mycobacterium avium subsp. paratuberculosis
gccggucauaggccgcgca

SEQ ID NO: 2847618 - RNA, 16 nt, Mycobacterium avium subsp. paratuberculosis
gccggucauccgggcc

SEQ ID NO: 2847619 - RNA, 23 nt, Mycobacterium avium subsp. paratuberculosis
gccggucauccgggccaccacca

SEQ ID NO: 2847620 - RNA, 17 nt, Mycobacterium avium subsp. paratuberculosis
gccgguccagccgccgc

SEQ ID NO: 2847621 - RNA, 21 nt, Mycobacterium avium subsp. paratuberculosis
gccgguccagccgccgcgugg

SEQ ID NO: 2847622 - RNA, 16 nt, Mycobacterium avium subsp. paratuberculosis
gccgguccccggcgac

SEQ ID NO: 2847623 - RNA, 21 nt, Mycobacterium avium subsp. paratuberculosis
gccgguccccggcgaccaccc

SEQ ID NO: 2847624 - RNA, 17 nt, Mycobacterium avium subsp. paratuberculosis
gccggucccgcggcggc

SEQ ID NO: 2847625 - RNA, 16 nt, Mycobacterium avium subsp. paratuberculosis
gccggucccguugauc

SEQ ID NO: 2847626 - RNA, 22 nt, Mycobacterium avium subsp. paratuberculosis
gccgguccgaccagcggcccac

SEQ ID NO: 2847627 - RNA, 14 nt, Mycobacterium avium subsp. paratuberculosis
gccgguccgaccgc

SEQ ID NO: 2847628 - RNA, 22 nt, Mycobacterium avium subsp. paratuberculosis
gccgguccgaccgccaccaccc

SEQ ID NO: 2847629 - RNA, 18 nt, Mycobacterium avium subsp. paratuberculosis
gccgguccgacggcugcg

SEQ ID NO: 2847630 - RNA, 15 nt, Mycobacterium avium subsp. paratuberculosis
gccgguccgaucguc

SEQ ID NO: 2847631 - RNA, 22 nt, Mycobacterium avium subsp. paratuberculosis
gccgguccgaucguccggcgcc

SEQ ID NO: 2847632 - RNA, 15 nt, Mycobacterium avium subsp. paratuberculosis
gccgguccgcccaga

SEQ ID NO: 2847633 - RNA, 20 nt, Mycobacterium avium subsp. paratuberculosis
gccgguccgcccagacgcgg

SEQ ID NO: 2847634 - RNA, 13 nt, Mycobacterium avium subsp. paratuberculosis
gccgguccggccc

SEQ ID NO: 2847635 - RNA, 17 nt, Mycobacterium avium subsp. paratuberculosis
gccgguccggcccuggu

SEQ ID NO: 2847636 - RNA, 22 nt, Mycobacterium avium subsp. paratuberculosis
gccgguccggcccuggucggcc

SEQ ID NO: 2847637 - RNA, 13 nt, Mycobacterium avium subsp. paratuberculosis
gccgguccggcgg

SEQ ID NO: 2847638 - RNA, 17 nt, Mycobacterium avium subsp. paratuberculosis
gccgguccggcggcacc

SEQ ID NO: 2847639 - RNA, 20 nt, Mycobacterium avium subsp. paratuberculosis
gccgguccggcggcaccacc

SEQ ID NO: 2847640 - RNA, 21 nt, Mycobacterium avium subsp. paratuberculosis
gccgguccggcggcaccaccc

SEQ ID NO: 2847641 - RNA, 22 nt, Mycobacterium avium subsp. paratuberculosis
gccgguccggcggcaccacccg

SEQ ID NO: 2847642 - RNA, 21 nt, Mycobacterium avium subsp. paratuberculosis
gccgguccgugcacggccaac

SEQ ID NO: 2847643 - RNA, 13 nt, Mycobacterium avium subsp. paratuberculosis
gccgguccuggcc

SEQ ID NO: 2847644 - RNA, 18 nt, Mycobacterium avium subsp. paratuberculosis
gccgguccugggccuccg

SEQ ID NO: 2847645 - RNA, 20 nt, Mycobacterium avium subsp. paratuberculosis
gccgguccugggccuccggc

SEQ ID NO: 2847646 - RNA, 19 nt, Mycobacterium avium subsp. paratuberculosis
gccgguccuuggccugcuu

SEQ ID NO: 2847647 - RNA, 19 nt, Mycobacterium avium subsp. paratuberculosis
gccggucgaacgccagcgc

SEQ ID NO: 2847648 - RNA, 22 nt, Mycobacterium avium subsp. paratuberculosis
gccggucgaacgccagcgccgc

SEQ ID NO: 2847649 - RNA, 24 nt, Mycobacterium avium subsp. paratuberculosis
gccggucgaacgccagcgccgcaa

SEQ ID NO: 2847650 - RNA, 18 nt, Mycobacterium avium subsp. paratuberculosis
gccggucgaaggccccgg

SEQ ID NO: 2847651 - RNA, 19 nt, Mycobacterium avium subsp. paratuberculosis
gccggucgaaggccccggu

SEQ ID NO: 2847652 - RNA, 13 nt, Mycobacterium avium subsp. paratuberculosis
gccggucgacgaa

SEQ ID NO: 2847653 - RNA, 14 nt, Mycobacterium avium subsp. paratuberculosis
gccggucgacgcgg

SEQ ID NO: 2847654 - RNA, 15 nt, Mycobacterium avium subsp. paratuberculosis
gccggucgacgcggg

SEQ ID NO: 2847655 - RNA, 19 nt, Mycobacterium avium subsp. paratuberculosis
gccggucgacgcggggcgg

SEQ ID NO: 2847656 - RNA, 21 nt, Mycobacterium avium subsp. paratuberculosis
gccggucgacgcggggcggcg

SEQ ID NO: 2847657 - RNA, 23 nt, Mycobacterium avium subsp. paratuberculosis
gccggucgacgcggggcggcggc

SEQ ID NO: 2847658 - RNA, 16 nt, Mycobacterium avium subsp. paratuberculosis
gccggucgaggucgcc

SEQ ID NO: 2847659 - RNA, 14 nt, Mycobacterium avium subsp. paratuberculosis
gccggucgcaggug

SEQ ID NO: 2847660 - RNA, 15 nt, Mycobacterium avium subsp. paratuberculosis
gccggucgcccccuc

SEQ ID NO: 2847661 - RNA, 20 nt, Mycobacterium avium subsp. paratuberculosis
gccggucgcccccucggccg

SEQ ID NO: 2847662 - RNA, 12 nt, Mycobacterium avium subsp. paratuberculosis
gccggucgccga

SEQ ID NO: 2847663 - RNA, 13 nt, Mycobacterium avium subsp. paratuberculosis
gccggucgccgau

SEQ ID NO: 2847664 - RNA, 14 nt, Mycobacterium avium subsp. paratuberculosis
gccggucgccgggc

SEQ ID NO: 2847665 - RNA, 15 nt, Mycobacterium avium subsp. paratuberculosis
gccggucgccgggcc

SEQ ID NO: 2847666 - RNA, 16 nt, Mycobacterium avium subsp. paratuberculosis
gccggucgccgggccg

SEQ ID NO: 2847667 - RNA, 12 nt, Mycobacterium avium subsp. paratuberculosis
gccggucgccug

SEQ ID NO: 2847668 - RNA, 14 nt, Mycobacterium avium subsp. paratuberculosis
gccggucgccugcu

SEQ ID NO: 2847669 - RNA, 13 nt, Mycobacterium avium subsp. paratuberculosis
gccggucgcgcau

SEQ ID NO: 2847670 - RNA, 13 nt, Mycobacterium avium subsp. paratuberculosis
gccggucggcccg

SEQ ID NO: 2847671 - RNA, 15 nt, Mycobacterium avium subsp. paratuberculosis
gccggucggcccgcu

SEQ ID NO: 2847672 - RNA, 15 nt, Mycobacterium avium subsp. paratuberculosis
gccggucggcggaac

SEQ ID NO: 2847673 - RNA, 13 nt, Mycobacterium avium subsp. paratuberculosis
gccggucgggaug

SEQ ID NO: 2847674 - RNA, 14 nt, Mycobacterium avium subsp. paratuberculosis
gccggucgggaugg

SEQ ID NO: 2847675 - RNA, 22 nt, Mycobacterium avium subsp. paratuberculosis
gccggucgggauggcggcguug

SEQ ID NO: 2847676 - RNA, 19 nt, Mycobacterium avium subsp. paratuberculosis
gccggucggguugcgcgga

SEQ ID NO: 2847677 - RNA, 18 nt, Mycobacterium avium subsp. paratuberculosis
gccggucggucagucgcg

SEQ ID NO: 2847678 - RNA, 21 nt, Mycobacterium avium subsp. paratuberculosis
gccggucggucagucgcgccg

SEQ ID NO: 2847679 - RNA, 17 nt, Mycobacterium avium subsp. paratuberculosis
gccggucggucggccgc

SEQ ID NO: 2847680 - RNA, 22 nt, Mycobacterium avium subsp. paratuberculosis
gccggucggucggccgcacguc

SEQ ID NO: 2847681 - RNA, 12 nt, Mycobacterium avium subsp. paratuberculosis
gccggucguagc

SEQ ID NO: 2847682 - RNA, 17 nt, Mycobacterium avium subsp. paratuberculosis
gccggucguagcgucgg

SEQ ID NO: 2847683 - RNA, 22 nt, Mycobacterium avium subsp. paratuberculosis
gccggucguagcgucgggggcg

SEQ ID NO: 2847684 - RNA, 12 nt, Mycobacterium avium subsp. paratuberculosis
gccggucgucgg

SEQ ID NO: 2847685 - RNA, 13 nt, Mycobacterium avium subsp. paratuberculosis
gccggucgucggg

SEQ ID NO: 2847686 - RNA, 18 nt, Mycobacterium avium subsp. paratuberculosis
gccggucgucggggcauc

SEQ ID NO: 2847687 - RNA, 19 nt, Mycobacterium avium subsp. paratuberculosis
gccggucgugcgacuccug

SEQ ID NO: 2847688 - RNA, 22 nt, Mycobacterium avium subsp. paratuberculosis
gccggucguuacgacucggccu

SEQ ID NO: 2847689 - RNA, 21 nt, Mycobacterium avium subsp. paratuberculosis
gccggucuccaugucgucggc

SEQ ID NO: 2847690 - RNA, 15 nt, Mycobacterium avium subsp. paratuberculosis
gccggucucgaaacg

SEQ ID NO: 2847691 - RNA, 14 nt, Mycobacterium avium subsp. paratuberculosis
gccggucucgaaca

SEQ ID NO: 2847692 - RNA, 16 nt, Mycobacterium avium subsp. paratuberculosis
gccggucucgaacacg

SEQ ID NO: 2847693 - RNA, 23 nt, Mycobacterium avium subsp. paratuberculosis
gccggucucgaacacgccgucgu

SEQ ID NO: 2847694 - RNA, 15 nt, Mycobacterium avium subsp. paratuberculosis
gccggucugggcgac

SEQ ID NO: 2847695 - RNA, 23 nt, Mycobacterium avium subsp. paratuberculosis
gccggucugggcgaccaugccgc

SEQ ID NO: 2847696 - RNA, 19 nt, Mycobacterium avium subsp. paratuberculosis
gccggucuuggacagcagc

SEQ ID NO: 2847697 - RNA, 13 nt, Mycobacterium avium subsp. paratuberculosis
gccgguggccggu

SEQ ID NO: 2847698 - RNA, 14 nt, Mycobacterium avium subsp. paratuberculosis
gccgguggccggug

SEQ ID NO: 2847699 - RNA, 18 nt, Mycobacterium avium subsp. paratuberculosis
gccgguggccggugggcg

SEQ ID NO: 2847700 - RNA, 14 nt, Mycobacterium avium subsp. paratuberculosis
gccgguggcgacaa

SEQ ID NO: 2847701 - RNA, 13 nt, Mycobacterium avium subsp. paratuberculosis
gccgguggcggcc

SEQ ID NO: 2847702 - RNA, 15 nt, Mycobacterium avium subsp. paratuberculosis
gccgguggcggccac

SEQ ID NO: 2847703 - RNA, 17 nt, Mycobacterium avium subsp. paratuberculosis
gccgguggcggccacga

SEQ ID NO: 2847704 - RNA, 22 nt, Mycobacterium avium subsp. paratuberculosis
gccgguggcggccacgaucgcg

SEQ ID NO: 2847705 - RNA, 13 nt, Mycobacterium avium subsp. paratuberculosis
gccgguggcgucc

SEQ ID NO: 2847706 - RNA, 15 nt, Mycobacterium avium subsp. paratuberculosis
gccggugggcggcgc

SEQ ID NO: 2847707 - RNA, 16 nt, Mycobacterium avium subsp. paratuberculosis
gccggugggcggcgcc

SEQ ID NO: 2847708 - RNA, 20 nt, Mycobacterium avium subsp. paratuberculosis
gccggugggcggcgcccgac

SEQ ID NO: 2847709 - RNA, 21 nt, Mycobacterium avium subsp. paratuberculosis
gccggugggcggcgcccgaca

SEQ ID NO: 2847710 - RNA, 22 nt, Mycobacterium avium subsp. paratuberculosis
gccggugggcggcgcccgacau

SEQ ID NO: 2847711 - RNA, 13 nt, Mycobacterium avium subsp. paratuberculosis
gccgguggugcac

SEQ ID NO: 2847712 - RNA, 17 nt, Mycobacterium avium subsp. paratuberculosis
gccgguggugcaccggu

SEQ ID NO: 2847713 - RNA, 19 nt, Mycobacterium avium subsp. paratuberculosis
gccgguggugcaccgguuc

SEQ ID NO: 2847714 - RNA, 12 nt, Mycobacterium avium subsp. paratuberculosis
gccggugguguc

SEQ ID NO: 2847715 - RNA, 22 nt, Mycobacterium avium subsp. paratuberculosis
gccggugguuuugcggcccugc

SEQ ID NO: 2847716 - RNA, 18 nt, Mycobacterium avium subsp. paratuberculosis
gccggugucauaccagcc

SEQ ID NO: 2847717 - RNA, 20 nt, Mycobacterium avium subsp. paratuberculosis
gccggugucauaccagccgu

SEQ ID NO: 2847718 - RNA, 14 nt, Mycobacterium avium subsp. paratuberculosis
gccggugucggcga

SEQ ID NO: 2847719 - RNA, 17 nt, Mycobacterium avium subsp. paratuberculosis
gccggugucggcgacca

SEQ ID NO: 2847720 - RNA, 13 nt, Mycobacterium avium subsp. paratuberculosis
gccggugucgggg

SEQ ID NO: 2847721 - RNA, 19 nt, Mycobacterium avium subsp. paratuberculosis
gccggugucggugcgaccc

SEQ ID NO: 2847722 - RNA, 20 nt, Mycobacterium avium subsp. paratuberculosis
gccggugucggugcgacccg

SEQ ID NO: 2847723 - RNA, 21 nt, Mycobacterium avium subsp. paratuberculosis
gccggugucggugcgacccgg

SEQ ID NO: 2847724 - RNA, 23 nt, Mycobacterium avium subsp. paratuberculosis
gccggugugaucgagcaccagcg

SEQ ID NO: 2847725 - RNA, 21 nt, Mycobacterium avium subsp. paratuberculosis
gccggugugcagccacccguc

SEQ ID NO: 2847726 - RNA, 21 nt, Mycobacterium avium subsp. paratuberculosis
gccgguguucaagccggcgug

SEQ ID NO: 2847727 - RNA, 17 nt, Mycobacterium avium subsp. paratuberculosis
gccgguguucggcgcca

SEQ ID NO: 2847728 - RNA, 20 nt, Mycobacterium avium subsp. paratuberculosis
gccgguguucggcgccagcc

SEQ ID NO: 2847729 - RNA, 22 nt, Mycobacterium avium subsp. paratuberculosis
gccgguguucggcgccagccgc

SEQ ID NO: 2847730 - RNA, 15 nt, Mycobacterium avium subsp. paratuberculosis
gccgguguugccgac

SEQ ID NO: 2847731 - RNA, 17 nt, Mycobacterium avium subsp. paratuberculosis
gccgguguugccgacgg

SEQ ID NO: 2847732 - RNA, 18 nt, Mycobacterium avium subsp. paratuberculosis
gccgguguugccgacggc

SEQ ID NO: 2847733 - RNA, 15 nt, Mycobacterium avium subsp. paratuberculosis
gccgguuccuccgac

SEQ ID NO: 2847734 - RNA, 16 nt, Mycobacterium avium subsp. paratuberculosis
gccgguucgcuggcgg

SEQ ID NO: 2847735 - RNA, 20 nt, Mycobacterium avium subsp. paratuberculosis
gccgguucgcuggcggccag

SEQ ID NO: 2847736 - RNA, 22 nt, Mycobacterium avium subsp. paratuberculosis
gccgguucgcuggcggccagcg

SEQ ID NO: 2847737 - RNA, 23 nt, Mycobacterium avium subsp. paratuberculosis
gccgguucgcuggcggccagcgu

SEQ ID NO: 2847738 - RNA, 17 nt, Mycobacterium avium subsp. paratuberculosis
gccgguucgucccgcgc

SEQ ID NO: 2847739 - RNA, 17 nt, Mycobacterium avium subsp. paratuberculosis
gccgguucgucgugucg

SEQ ID NO: 2847740 - RNA, 17 nt, Mycobacterium avium subsp. paratuberculosis
gccgguugaucacccgg

SEQ ID NO: 2847741 - RNA, 14 nt, Mycobacterium avium subsp. paratuberculosis
gccgguugcggugg

SEQ ID NO: 2847742 - RNA, 19 nt, Mycobacterium avium subsp. paratuberculosis
gccgguugcgguggccgau

SEQ ID NO: 2847743 - RNA, 15 nt, Mycobacterium avium subsp. paratuberculosis
gccgguuggcggccg

SEQ ID NO: 2847744 - RNA, 14 nt, Mycobacterium avium subsp. paratuberculosis
gccgguuggugcgc

SEQ ID NO: 2847745 - RNA, 17 nt, Mycobacterium avium subsp. paratuberculosis
gccgguuggugcgccgu

SEQ ID NO: 2847746 - RNA, 19 nt, Mycobacterium avium subsp. paratuberculosis
gccgguuggugcgccguca

SEQ ID NO: 2847747 - RNA, 20 nt, Mycobacterium avium subsp. paratuberculosis
gccgguuguugcgguccagg

SEQ ID NO: 2847748 - RNA, 17 nt, Mycobacterium avium subsp. paratuberculosis
gccgguuuccaggacga

SEQ ID NO: 2847749 - RNA, 22 nt, Mycobacterium avium subsp. paratuberculosis
gccgguuuccaggacgaugcgc

SEQ ID NO: 2847750 - RNA, 23 nt, Mycobacterium avium subsp. paratuberculosis
gccgguuucgucggucugcaggu

SEQ ID NO: 2847751 - RNA, 19 nt, Mycobacterium avium subsp. paratuberculosis
gccgguuuucggcgugucg

SEQ ID NO: 2847752 - RNA, 18 nt, Mycobacterium avium subsp. paratuberculosis
gccguaaccgccguuggc

SEQ ID NO: 2847753 - RNA, 19 nt, Mycobacterium avium subsp. paratuberculosis
gccguaaguggcgccgcgg

SEQ ID NO: 2847754 - RNA, 14 nt, Mycobacterium avium subsp. paratuberculosis
gccguacacggcgg

SEQ ID NO: 2847755 - RNA, 19 nt, Mycobacterium avium subsp. paratuberculosis
gccguacagcugguccggc

SEQ ID NO: 2847756 - RNA, 22 nt, Mycobacterium avium subsp. paratuberculosis
gccguacagcugguccggccgg

SEQ ID NO: 2847757 - RNA, 14 nt, Mycobacterium avium subsp. paratuberculosis
gccguacaugguga

SEQ ID NO: 2847758 - RNA, 16 nt, Mycobacterium avium subsp. paratuberculosis
gccguaccgcaacacc

SEQ ID NO: 2847759 - RNA, 19 nt, Mycobacterium avium subsp. paratuberculosis
gccguaccgcaacaccgaa

SEQ ID NO: 2847760 - RNA, 23 nt, Mycobacterium avium subsp. paratuberculosis
gccguaccgcaacaccgaaagcc

SEQ ID NO: 2847761 - RNA, 21 nt, Mycobacterium avium subsp. paratuberculosis
gccguaccgcuuggcccaccg

SEQ ID NO: 2847762 - RNA, 22 nt, Mycobacterium avium subsp. paratuberculosis
gccguaccgcuuggcccaccga

SEQ ID NO: 2847763 - RNA, 15 nt, Mycobacterium avium subsp. paratuberculosis
gccguacgcgccggc

SEQ ID NO: 2847764 - RNA, 17 nt, Mycobacterium avium subsp. paratuberculosis
gccguacgcgccggcca

SEQ ID NO: 2847765 - RNA, 19 nt, Mycobacterium avium subsp. paratuberculosis
gccguacgcgccggccagc

SEQ ID NO: 2847766 - RNA, 21 nt, Mycobacterium avium subsp. paratuberculosis
gccguacgcgguucgugcgca

SEQ ID NO: 2847767 - RNA, 17 nt, Mycobacterium avium subsp. paratuberculosis
gccguagaccagcauca

SEQ ID NO: 2847768 - RNA, 17 nt, Mycobacterium avium subsp. paratuberculosis
gccguagacggucaggu

SEQ ID NO: 2847769 - RNA, 14 nt, Mycobacterium avium subsp. paratuberculosis
gccguagagcacga

SEQ ID NO: 2847770 - RNA, 21 nt, Mycobacterium avium subsp. paratuberculosis
gccguagaucucgcgccgcgc

SEQ ID NO: 2847771 - RNA, 14 nt, Mycobacterium avium subsp. paratuberculosis
gccguagccggcgg

SEQ ID NO: 2847772 - RNA, 15 nt, Mycobacterium avium subsp. paratuberculosis
gccguagccggcggu

SEQ ID NO: 2847773 - RNA, 13 nt, Mycobacterium avium subsp. paratuberculosis
gccguagccguag

SEQ ID NO: 2847774 - RNA, 18 nt, Mycobacterium avium subsp. paratuberculosis
gccguagcgcaacaccga

SEQ ID NO: 2847775 - RNA, 20 nt, Mycobacterium avium subsp. paratuberculosis
gccguagcgcaugaugccca

SEQ ID NO: 2847776 - RNA, 22 nt, Mycobacterium avium subsp. paratuberculosis
gccguagcgcaugaugcccagg

SEQ ID NO: 2847777 - RNA, 14 nt, Mycobacterium avium subsp. paratuberculosis
gccguagcgccggc

SEQ ID NO: 2847778 - RNA, 21 nt, Mycobacterium avium subsp. paratuberculosis
gccguagcgccggcaacaacg

SEQ ID NO: 2847779 - RNA, 17 nt, Mycobacterium avium subsp. paratuberculosis
gccguagcgcuggguga

SEQ ID NO: 2847780 - RNA, 23 nt, Mycobacterium avium subsp. paratuberculosis
gccguagcgcugggugaacaccc

SEQ ID NO: 2847781 - RNA, 16 nt, Mycobacterium avium subsp. paratuberculosis
gccgucccaccggcga

SEQ ID NO: 2847782 - RNA, 20 nt, Mycobacterium avium subsp. paratuberculosis
gccgucccaccggcgaugug

SEQ ID NO: 2847783 - RNA, 14 nt, Mycobacterium avium subsp. paratuberculosis
gccgucccaggaca

SEQ ID NO: 2847784 - RNA, 14 nt, Mycobacterium avium subsp. paratuberculosis
gccguccccaccga

SEQ ID NO: 2847785 - RNA, 17 nt, Mycobacterium avium subsp. paratuberculosis
gccguccccaccgauca

SEQ ID NO: 2847786 - RNA, 20 nt, Mycobacterium avium subsp. paratuberculosis
gccgucccccgagcgggccu

SEQ ID NO: 2847787 - RNA, 14 nt, Mycobacterium avium subsp. paratuberculosis
gccguccccgcgcg

SEQ ID NO: 2847788 - RNA, 17 nt, Mycobacterium avium subsp. paratuberculosis
gccguccccgcgcggcu

SEQ ID NO: 2847789 - RNA, 18 nt, Mycobacterium avium subsp. paratuberculosis
gccgucccgccgucucga

SEQ ID NO: 2847790 - RNA, 14 nt, Mycobacterium avium subsp. paratuberculosis
gccgucccggacgc

SEQ ID NO: 2847791 - RNA, 19 nt, Mycobacterium avium subsp. paratuberculosis
gccgucccggacgcugcgg

SEQ ID NO: 2847792 - RNA, 16 nt, Mycobacterium avium subsp. paratuberculosis
gccgucccgucacggc

SEQ ID NO: 2847793 - RNA, 19 nt, Mycobacterium avium subsp. paratuberculosis
gccgucccgucacggcugc

SEQ ID NO: 2847794 - RNA, 18 nt, Mycobacterium avium subsp. paratuberculosis
gccgucccguccgacggc

SEQ ID NO: 2847795 - RNA, 20 nt, Mycobacterium avium subsp. paratuberculosis
gccgucccuguucgcgccgg

SEQ ID NO: 2847796 - RNA, 23 nt, Mycobacterium avium subsp. paratuberculosis
gccguccgaaucguugagcacca

SEQ ID NO: 2847797 - RNA, 13 nt, Mycobacterium avium subsp. paratuberculosis
gccguccgacgug

SEQ ID NO: 2847798 - RNA, 13 nt, Mycobacterium avium subsp. paratuberculosis
gccguccgcaccg

SEQ ID NO: 2847799 - RNA, 16 nt, Mycobacterium avium subsp. paratuberculosis
gccguccgcaccgcga

SEQ ID NO: 2847800 - RNA, 17 nt, Mycobacterium avium subsp. paratuberculosis
gccguccgcaccgcgac

SEQ ID NO: 2847801 - RNA, 18 nt, Mycobacterium avium subsp. paratuberculosis
gccguccgcaccgcgacg

SEQ ID NO: 2847802 - RNA, 22 nt, Mycobacterium avium subsp. paratuberculosis
gccguccgcaccgcgacgagau

SEQ ID NO: 2847803 - RNA, 13 nt, Mycobacterium avium subsp. paratuberculosis
gccguccgccggc

SEQ ID NO: 2847804 - RNA, 15 nt, Mycobacterium avium subsp. paratuberculosis
gccguccgccggcug

SEQ ID NO: 2847805 - RNA, 13 nt, Mycobacterium avium subsp. paratuberculosis
gccguccgcggcg

SEQ ID NO: 2847806 - RNA, 18 nt, Mycobacterium avium subsp. paratuberculosis
gccguccgcggcggccag

SEQ ID NO: 2847807 - RNA, 19 nt, Mycobacterium avium subsp. paratuberculosis
gccguccggauagccgucg

SEQ ID NO: 2847808 - RNA, 13 nt, Mycobacterium avium subsp. paratuberculosis
gccguccggccac

SEQ ID NO: 2847809 - RNA, 13 nt, Mycobacterium avium subsp. paratuberculosis
gccguccggccgg

SEQ ID NO: 2847810 - RNA, 13 nt, Mycobacterium avium subsp. paratuberculosis
gccguccggcggc

SEQ ID NO: 2847811 - RNA, 15 nt, Mycobacterium avium subsp. paratuberculosis
gccguccggcggcaa

SEQ ID NO: 2847812 - RNA, 24 nt, Mycobacterium avium subsp. paratuberculosis
gccguccgggauaguucgccgccg

SEQ ID NO: 2847813 - RNA, 18 nt, Mycobacterium avium subsp. paratuberculosis
gccguccgggcacccgac

SEQ ID NO: 2847814 - RNA, 14 nt, Mycobacterium avium subsp. paratuberculosis
gccguccggggccg

SEQ ID NO: 2847815 - RNA, 15 nt, Mycobacterium avium subsp. paratuberculosis
gccguccggggccgg

SEQ ID NO: 2847816 - RNA, 17 nt, Mycobacterium avium subsp. paratuberculosis
gccguccggggccggug

SEQ ID NO: 2847817 - RNA, 14 nt, Mycobacterium avium subsp. paratuberculosis
gccguccggggugu

SEQ ID NO: 2847818 - RNA, 23 nt, Mycobacterium avium subsp. paratuberculosis
gccguccgggguguaggcgucgg

SEQ ID NO: 2847819 - RNA, 13 nt, Mycobacterium avium subsp. paratuberculosis
gccguccgggucc

SEQ ID NO: 2847820 - RNA, 16 nt, Mycobacterium avium subsp. paratuberculosis
gccguccggguccggc

SEQ ID NO: 2847821 - RNA, 22 nt, Mycobacterium avium subsp. paratuberculosis
gccguccgggucgcacagccgc

SEQ ID NO: 2847822 - RNA, 19 nt, Mycobacterium avium subsp. paratuberculosis
gccguccgggugcgggcug

SEQ ID NO: 2847823 - RNA, 24 nt, Mycobacterium avium subsp. paratuberculosis
gccguccggguucgacgccucggu

SEQ ID NO: 2847824 - RNA, 20 nt, Mycobacterium avium subsp. paratuberculosis
gccguccucgcgucgcgcgg

SEQ ID NO: 2847825 - RNA, 21 nt, Mycobacterium avium subsp. paratuberculosis
gccguccucgcgucgcgcggu

SEQ ID NO: 2847826 - RNA, 14 nt, Mycobacterium avium subsp. paratuberculosis
gccguccucggccg

SEQ ID NO: 2847827 - RNA, 20 nt, Mycobacterium avium subsp. paratuberculosis
gccguccucggccgccaccg

SEQ ID NO: 2847828 - RNA, 22 nt, Mycobacterium avium subsp. paratuberculosis
gccguccucggccgccaccgcc

SEQ ID NO: 2847829 - RNA, 21 nt, Mycobacterium avium subsp. paratuberculosis
gccguccugagguauucgucg

SEQ ID NO: 2847830 - RNA, 22 nt, Mycobacterium avium subsp. paratuberculosis
gccguccugagguauucgucga

SEQ ID NO: 2847831 - RNA, 20 nt, Mycobacterium avium subsp. paratuberculosis
gccguccuucucgaaccggg

SEQ ID NO: 2847832 - RNA, 14 nt, Mycobacterium avium subsp. paratuberculosis
gccguccuuggccg

SEQ ID NO: 2847833 - RNA, 17 nt, Mycobacterium avium subsp. paratuberculosis
gccguccuuggccgcca

SEQ ID NO: 2847834 - RNA, 21 nt, Mycobacterium avium subsp. paratuberculosis
gccguccuuggccgccagcac

SEQ ID NO: 2847835 - RNA, 16 nt, Mycobacterium avium subsp. paratuberculosis
gccguccuugucgcgc

SEQ ID NO: 2847836 - RNA, 17 nt, Mycobacterium avium subsp. paratuberculosis
gccguccuugucgcgca

SEQ ID NO: 2847837 - RNA, 21 nt, Mycobacterium avium subsp. paratuberculosis
gccguccuugucgcgcaccgc

SEQ ID NO: 2847838 - RNA, 22 nt, Mycobacterium avium subsp. paratuberculosis
gccguccuugucgcgcaccgcg

SEQ ID NO: 2847839 - RNA, 23 nt, Mycobacterium avium subsp. paratuberculosis
gccguccuugucgcgcaccgcgg

SEQ ID NO: 2847840 - RNA, 16 nt, Mycobacterium avium subsp. paratuberculosis
gccgucgaaacggcug

SEQ ID NO: 2847841 - RNA, 18 nt, Mycobacterium avium subsp. paratuberculosis
gccgucgaaacggcugcu

SEQ ID NO: 2847842 - RNA, 20 nt, Mycobacterium avium subsp. paratuberculosis
gccgucgaaacggcugcugc

SEQ ID NO: 2847843 - RNA, 22 nt, Mycobacterium avium subsp. paratuberculosis
gccgucgaacugcagccggcca

SEQ ID NO: 2847844 - RNA, 20 nt, Mycobacterium avium subsp. paratuberculosis
gccgucgaaggccgggcugg

SEQ ID NO: 2847845 - RNA, 13 nt, Mycobacterium avium subsp. paratuberculosis
gccgucgaccacg

SEQ ID NO: 2847846 - RNA, 15 nt, Mycobacterium avium subsp. paratuberculosis
gccgucgaccacgau

SEQ ID NO: 2847847 - RNA, 19 nt, Mycobacterium avium subsp. paratuberculosis
gccgucgaccacgaucguc

SEQ ID NO: 2847848 - RNA, 13 nt, Mycobacterium avium subsp. paratuberculosis
gccgucgaccccg

SEQ ID NO: 2847849 - RNA, 18 nt, Mycobacterium avium subsp. paratuberculosis
gccgucgaccccgccggc

SEQ ID NO: 2847850 - RNA, 20 nt, Mycobacterium avium subsp. paratuberculosis
gccgucgaccccgccggccc

SEQ ID NO: 2847851 - RNA, 22 nt, Mycobacterium avium subsp. paratuberculosis
gccgucgaccccgccggcccgg

SEQ ID NO: 2847852 - RNA, 12 nt, Mycobacterium avium subsp. paratuberculosis
gccgucgacccg

SEQ ID NO: 2847853 - RNA, 21 nt, Mycobacterium avium subsp. paratuberculosis
gccgucgacccguuccccggc

SEQ ID NO: 2847854 - RNA, 15 nt, Mycobacterium avium subsp. paratuberculosis
gccgucgaccggguc

SEQ ID NO: 2847855 - RNA, 12 nt, Mycobacterium avium subsp. paratuberculosis
gccgucgacgac

SEQ ID NO: 2847856 - RNA, 13 nt, Mycobacterium avium subsp. paratuberculosis
gccgucgacgacc

SEQ ID NO: 2847857 - RNA, 17 nt, Mycobacterium avium subsp. paratuberculosis
gccgucgacgaccacca

SEQ ID NO: 2847858 - RNA, 19 nt, Mycobacterium avium subsp. paratuberculosis
gccgucgacgaccaccacc

SEQ ID NO: 2847859 - RNA, 17 nt, Mycobacterium avium subsp. paratuberculosis
gccgucgacgacgaacu

SEQ ID NO: 2847860 - RNA, 21 nt, Mycobacterium avium subsp. paratuberculosis
gccgucgacgaucugcacacg

SEQ ID NO: 2847861 - RNA, 16 nt, Mycobacterium avium subsp. paratuberculosis
gccgucgacgcgugcg

SEQ ID NO: 2847862 - RNA, 16 nt, Mycobacterium avium subsp. paratuberculosis
gccgucgacggugauc

SEQ ID NO: 2847863 - RNA, 17 nt, Mycobacterium avium subsp. paratuberculosis
gccgucgacggugauca

SEQ ID NO: 2847864 - RNA, 16 nt, Mycobacterium avium subsp. paratuberculosis
gccgucgagccuggug

SEQ ID NO: 2847865 - RNA, 20 nt, Mycobacterium avium subsp. paratuberculosis
gccgucgaggaauccggucc

SEQ ID NO: 2847866 - RNA, 13 nt, Mycobacterium avium subsp. paratuberculosis
gccgucggcggag

SEQ ID NO: 2847867 - RNA, 12 nt, Mycobacterium avium subsp. paratuberculosis
gccgucggcggc

SEQ ID NO: 2847868 - RNA, 13 nt, Mycobacterium avium subsp. paratuberculosis
gccgucggcggcc

SEQ ID NO: 2847869 - RNA, 20 nt, Mycobacterium avium subsp. paratuberculosis
gccgucggcggccuugaacg

SEQ ID NO: 2847870 - RNA, 23 nt, Mycobacterium avium subsp. paratuberculosis
gccgucggcggccuugaacgcgu

SEQ ID NO: 2847871 - RNA, 16 nt, Mycobacterium avium subsp. paratuberculosis
gccgucggcgggaugg

SEQ ID NO: 2847872 - RNA, 15 nt, Mycobacterium avium subsp. paratuberculosis
gccgucggcgucggg

SEQ ID NO: 2847873 - RNA, 16 nt, Mycobacterium avium subsp. paratuberculosis
gccgucggcguucagc

SEQ ID NO: 2847874 - RNA, 19 nt, Mycobacterium avium subsp. paratuberculosis
gccgucggcguucagcggc

SEQ ID NO: 2847875 - RNA, 20 nt, Mycobacterium avium subsp. paratuberculosis
gccgucggcuuccuccucgg

SEQ ID NO: 2847876 - RNA, 14 nt, Mycobacterium avium subsp. paratuberculosis
gccgucgggacgcg

SEQ ID NO: 2847877 - RNA, 15 nt, Mycobacterium avium subsp. paratuberculosis
gccgucgggacgcgg

SEQ ID NO: 2847878 - RNA, 18 nt, Mycobacterium avium subsp. paratuberculosis
gccgucgggacgcggcag

SEQ ID NO: 2847879 - RNA, 22 nt, Mycobacterium avium subsp. paratuberculosis
gccgucgggacgcggcaggcgc

SEQ ID NO: 2847880 - RNA, 20 nt, Mycobacterium avium subsp. paratuberculosis
gccgucggggaugccgaacc

SEQ ID NO: 2847881 - RNA, 13 nt, Mycobacterium avium subsp. paratuberculosis
gccgucggggcgu

SEQ ID NO: 2847882 - RNA, 15 nt, Mycobacterium avium subsp. paratuberculosis
gccgucggggcgucg

SEQ ID NO: 2847883 - RNA, 17 nt, Mycobacterium avium subsp. paratuberculosis
gccgucggggcgucggc

SEQ ID NO: 2847884 - RNA, 13 nt, Mycobacterium avium subsp. paratuberculosis
gccgucggggcug

SEQ ID NO: 2847885 - RNA, 16 nt, Mycobacterium avium subsp. paratuberculosis
gccgucggggcugagu

SEQ ID NO: 2847886 - RNA, 17 nt, Mycobacterium avium subsp. paratuberculosis
gccgucggggucgcgcc

SEQ ID NO: 2847887 - RNA, 19 nt, Mycobacterium avium subsp. paratuberculosis
gccgucggggucgcgccgg

SEQ ID NO: 2847888 - RNA, 22 nt, Mycobacterium avium subsp. paratuberculosis
gccgucggggugcggucggcga

SEQ ID NO: 2847889 - RNA, 23 nt, Mycobacterium avium subsp. paratuberculosis
gccgucggggugcggucggcgac

SEQ ID NO: 2847890 - RNA, 18 nt, Mycobacterium avium subsp. paratuberculosis
gccgucgggucggcgagc

SEQ ID NO: 2847891 - RNA, 19 nt, Mycobacterium avium subsp. paratuberculosis
gccgucgggucggcgagca

SEQ ID NO: 2847892 - RNA, 19 nt, Mycobacterium avium subsp. paratuberculosis
gccgucgguaucgaggucc

SEQ ID NO: 2847893 - RNA, 22 nt, Mycobacterium avium subsp. paratuberculosis
gccgucggugaugacguagucg

SEQ ID NO: 2847894 - RNA, 23 nt, Mycobacterium avium subsp. paratuberculosis
gccgucggugcgcuccucgacgu

SEQ ID NO: 2847895 - RNA, 16 nt, Mycobacterium avium subsp. paratuberculosis
gccgucgguggccggu

SEQ ID NO: 2847896 - RNA, 16 nt, Mycobacterium avium subsp. paratuberculosis
gccgucggugggggcc

SEQ ID NO: 2847897 - RNA, 18 nt, Mycobacterium avium subsp. paratuberculosis
gccgucggugggggccag

SEQ ID NO: 2847898 - RNA, 14 nt, Mycobacterium avium subsp. paratuberculosis
gccgucgguggucc

SEQ ID NO: 2847899 - RNA, 24 nt, Mycobacterium avium subsp. paratuberculosis
gccgucggugguccagucgauagu

SEQ ID NO: 2847900 - RNA, 21 nt, Mycobacterium avium subsp. paratuberculosis
gccgucgguguagcgagugcc

SEQ ID NO: 2847901 - RNA, 19 nt, Mycobacterium avium subsp. paratuberculosis
gccgucgguguccaggucg

SEQ ID NO: 2847902 - RNA, 17 nt, Mycobacterium avium subsp. paratuberculosis
gccgucgguuucggucg

SEQ ID NO: 2847903 - RNA, 20 nt, Mycobacterium avium subsp. paratuberculosis
gccgucgguuucggucgcgg

SEQ ID NO: 2847904 - RNA, 22 nt, Mycobacterium avium subsp. paratuberculosis
gccgucgguuucggucgcggug

SEQ ID NO: 2847905 - RNA, 16 nt, Mycobacterium avium subsp. paratuberculosis
gccgucguagccgcgg

SEQ ID NO: 2847906 - RNA, 17 nt, Mycobacterium avium subsp. paratuberculosis
gccgucguaggcgcgga

SEQ ID NO: 2847907 - RNA, 22 nt, Mycobacterium avium subsp. paratuberculosis
gccgucguauucgacggcgacc

SEQ ID NO: 2847908 - RNA, 17 nt, Mycobacterium avium subsp. paratuberculosis
gccgucgucagccgggc

SEQ ID NO: 2847909 - RNA, 19 nt, Mycobacterium avium subsp. paratuberculosis
gccgucgucagccgggcca

SEQ ID NO: 2847910 - RNA, 20 nt, Mycobacterium avium subsp. paratuberculosis
gccgucgucagccgggccag

SEQ ID NO: 2847911 - RNA, 19 nt, Mycobacterium avium subsp. paratuberculosis
gccgucgucgagcaccacc

SEQ ID NO: 2847912 - RNA, 22 nt, Mycobacterium avium subsp. paratuberculosis
gccgucgucgagcaccacccgg

SEQ ID NO: 2847913 - RNA, 20 nt, Mycobacterium avium subsp. paratuberculosis
gccgucgucgaggccgaacc

SEQ ID NO: 2847914 - RNA, 15 nt, Mycobacterium avium subsp. paratuberculosis
gccgucgucgcugca

SEQ ID NO: 2847915 - RNA, 16 nt, Mycobacterium avium subsp. paratuberculosis
gccgucgucgcugcag

SEQ ID NO: 2847916 - RNA, 20 nt, Mycobacterium avium subsp. paratuberculosis
gccgucgucggacaccagca

SEQ ID NO: 2847917 - RNA, 22 nt, Mycobacterium avium subsp. paratuberculosis
gccgucgucggacaccagcaug

SEQ ID NO: 2847918 - RNA, 15 nt, Mycobacterium avium subsp. paratuberculosis
gccgucgucgggcag

SEQ ID NO: 2847919 - RNA, 18 nt, Mycobacterium avium subsp. paratuberculosis
gccgucgucgucgcucca

SEQ ID NO: 2847920 - RNA, 16 nt, Mycobacterium avium subsp. paratuberculosis
gccgucgucgucggcc

SEQ ID NO: 2847921 - RNA, 20 nt, Mycobacterium avium subsp. paratuberculosis
gccgucgucgucggccgggc

SEQ ID NO: 2847922 - RNA, 22 nt, Mycobacterium avium subsp. paratuberculosis
gccgucgucgucggccgggccg

SEQ ID NO: 2847923 - RNA, 19 nt, Mycobacterium avium subsp. paratuberculosis
gccgucgucgugcaccacg

SEQ ID NO: 2847924 - RNA, 22 nt, Mycobacterium avium subsp. paratuberculosis
gccgucgucgugcaccacgacg

SEQ ID NO: 2847925 - RNA, 23 nt, Mycobacterium avium subsp. paratuberculosis
gccgucgucguuguuggcggcgg

SEQ ID NO: 2847926 - RNA, 15 nt, Mycobacterium avium subsp. paratuberculosis
gccgucgugcucgag

SEQ ID NO: 2847927 - RNA, 20 nt, Mycobacterium avium subsp. paratuberculosis
gccgucguggguauccgccg

SEQ ID NO: 2847928 - RNA, 19 nt, Mycobacterium avium subsp. paratuberculosis
gccgucgugguggccgcga

SEQ ID NO: 2847929 - RNA, 20 nt, Mycobacterium avium subsp. paratuberculosis
gccgucguucuccauccggg

SEQ ID NO: 2847930 - RNA, 21 nt, Mycobacterium avium subsp. paratuberculosis
gccgucguucuccauccgggc

SEQ ID NO: 2847931 - RNA, 21 nt, Mycobacterium avium subsp. paratuberculosis
gccgucguugacgcccuccug

SEQ ID NO: 2847932 - RNA, 22 nt, Mycobacterium avium subsp. paratuberculosis
gccgucguugaucaggugcagc

SEQ ID NO: 2847933 - RNA, 16 nt, Mycobacterium avium subsp. paratuberculosis
gccgucuccucgacca

SEQ ID NO: 2847934 - RNA, 19 nt, Mycobacterium avium subsp. paratuberculosis
gccgucuccucgaccagcg

SEQ ID NO: 2847935 - RNA, 22 nt, Mycobacterium avium subsp. paratuberculosis
gccgucuccucgaccagcgcgc

SEQ ID NO: 2847936 - RNA, 17 nt, Mycobacterium avium subsp. paratuberculosis
gccgucucgaccacccg

SEQ ID NO: 2847937 - RNA, 21 nt, Mycobacterium avium subsp. paratuberculosis
gccgucucgaccacccggcgg

SEQ ID NO: 2847938 - RNA, 14 nt, Mycobacterium avium subsp. paratuberculosis
gccgucucgacccg

SEQ ID NO: 2847939 - RNA, 15 nt, Mycobacterium avium subsp. paratuberculosis
gccgucucgacccgg

SEQ ID NO: 2847940 - RNA, 16 nt, Mycobacterium avium subsp. paratuberculosis
gccgucucgagccggc

SEQ ID NO: 2847941 - RNA, 17 nt, Mycobacterium avium subsp. paratuberculosis
gccgucucgagccggcg

SEQ ID NO: 2847942 - RNA, 18 nt, Mycobacterium avium subsp. paratuberculosis
gccgucucgagccggcgc

SEQ ID NO: 2847943 - RNA, 15 nt, Mycobacterium avium subsp. paratuberculosis
gccgucucgucggcc

SEQ ID NO: 2847944 - RNA, 18 nt, Mycobacterium avium subsp. paratuberculosis
gccgucucgucggccgcg

SEQ ID NO: 2847945 - RNA, 16 nt, Mycobacterium avium subsp. paratuberculosis
gccgucugguccaccg

SEQ ID NO: 2847946 - RNA, 15 nt, Mycobacterium avium subsp. paratuberculosis
gccgucuuccgggcc

SEQ ID NO: 2847947 - RNA, 16 nt, Mycobacterium avium subsp. paratuberculosis
gccgucuuccgggcca

SEQ ID NO: 2847948 - RNA, 18 nt, Mycobacterium avium subsp. paratuberculosis
gccgucuugcccggcgag

SEQ ID NO: 2847949 - RNA, 14 nt, Mycobacterium avium subsp. paratuberculosis
gccgugaaccggcg

SEQ ID NO: 2847950 - RNA, 20 nt, Mycobacterium avium subsp. paratuberculosis
gccgugcggcacgccgcagc

SEQ ID NO: 2847951 - RNA, 14 nt, Mycobacterium avium subsp. paratuberculosis
gccgugcggcggcg

SEQ ID NO: 2847952 - RNA, 13 nt, Mycobacterium avium subsp. paratuberculosis
gccgugcggcguu

SEQ ID NO: 2847953 - RNA, 12 nt, Mycobacterium avium subsp. paratuberculosis
gccgugcucggc

SEQ ID NO: 2847954 - RNA, 15 nt, Mycobacterium avium subsp. paratuberculosis
gccgugcucggcggc

SEQ ID NO: 2847955 - RNA, 21 nt, Mycobacterium avium subsp. paratuberculosis
gccgugcucggcggcgggguc

SEQ ID NO: 2847956 - RNA, 22 nt, Mycobacterium avium subsp. paratuberculosis
gccgugcucggcggcggggucg

SEQ ID NO: 2847957 - RNA, 23 nt, Mycobacterium avium subsp. paratuberculosis
gccgugcugccggaacgagccgg

SEQ ID NO: 2847958 - RNA, 18 nt, Mycobacterium avium subsp. paratuberculosis
gccgugcugggacagcga

SEQ ID NO: 2847959 - RNA, 12 nt, Mycobacterium avium subsp. paratuberculosis
gccgugcugggc

SEQ ID NO: 2847960 - RNA, 13 nt, Mycobacterium avium subsp. paratuberculosis
gccgugcugggcg

SEQ ID NO: 2847961 - RNA, 21 nt, Mycobacterium avium subsp. paratuberculosis
gccguggaagauguugccgcc

SEQ ID NO: 2847962 - RNA, 22 nt, Mycobacterium avium subsp. paratuberculosis
gccguggaagauguugccgcca

SEQ ID NO: 2847963 - RNA, 15 nt, Mycobacterium avium subsp. paratuberculosis
gccguggaauucgaa

SEQ ID NO: 2847964 - RNA, 20 nt, Mycobacterium avium subsp. paratuberculosis
gccguggacccgccccgaca

SEQ ID NO: 2847965 - RNA, 20 nt, Mycobacterium avium subsp. paratuberculosis
gccguggacgagucccaugg

SEQ ID NO: 2847966 - RNA, 23 nt, Mycobacterium avium subsp. paratuberculosis
gccguggcaccgggugggccgac

SEQ ID NO: 2847967 - RNA, 13 nt, Mycobacterium avium subsp. paratuberculosis
gccguggcaggca

SEQ ID NO: 2847968 - RNA, 16 nt, Mycobacterium avium subsp. paratuberculosis
gccguggcaggcacga

SEQ ID NO: 2847969 - RNA, 13 nt, Mycobacterium avium subsp. paratuberculosis
gccguggcagggc

SEQ ID NO: 2847970 - RNA, 14 nt, Mycobacterium avium subsp. paratuberculosis
gccguggcagggcc

SEQ ID NO: 2847971 - RNA, 17 nt, Mycobacterium avium subsp. paratuberculosis
gccguggcagggccagc

SEQ ID NO: 2847972 - RNA, 18 nt, Mycobacterium avium subsp. paratuberculosis
gccguggcagggccagca

SEQ ID NO: 2847973 - RNA, 21 nt, Mycobacterium avium subsp. paratuberculosis
gccguggcagggccagcagcc

SEQ ID NO: 2847974 - RNA, 13 nt, Mycobacterium avium subsp. paratuberculosis
gccguggcccgcc

SEQ ID NO: 2847975 - RNA, 17 nt, Mycobacterium avium subsp. paratuberculosis
gccguggcccgcccagc

SEQ ID NO: 2847976 - RNA, 18 nt, Mycobacterium avium subsp. paratuberculosis
gccguggcccgcccagcg

SEQ ID NO: 2847977 - RNA, 16 nt, Mycobacterium avium subsp. paratuberculosis
gccguggcccggucgg

SEQ ID NO: 2847978 - RNA, 16 nt, Mycobacterium avium subsp. paratuberculosis
gccguggccgaacggc

SEQ ID NO: 2847979 - RNA, 13 nt, Mycobacterium avium subsp. paratuberculosis
gccguggccguca

SEQ ID NO: 2847980 - RNA, 17 nt, Mycobacterium avium subsp. paratuberculosis
gccguggccgucacgcu

SEQ ID NO: 2847981 - RNA, 14 nt, Mycobacterium avium subsp. paratuberculosis
gccguggccugcga

SEQ ID NO: 2847982 - RNA, 14 nt, Mycobacterium avium subsp. paratuberculosis
gccguggcgaacuc

SEQ ID NO: 2847983 - RNA, 18 nt, Mycobacterium avium subsp. paratuberculosis
gccguggcgaacucgacg

SEQ ID NO: 2847984 - RNA, 15 nt, Mycobacterium avium subsp. paratuberculosis
gccguggcggcccga

SEQ ID NO: 2847985 - RNA, 22 nt, Mycobacterium avium subsp. paratuberculosis
gccguggcggcccgaccagcgg

SEQ ID NO: 2847986 - RNA, 13 nt, Mycobacterium avium subsp. paratuberculosis
gccguggcggcgg

SEQ ID NO: 2847987 - RNA, 18 nt, Mycobacterium avium subsp. paratuberculosis
gccguggcggcgggccag

SEQ ID NO: 2847988 - RNA, 19 nt, Mycobacterium avium subsp. paratuberculosis
gccguggcggcgggccagc

SEQ ID NO: 2847989 - RNA, 14 nt, Mycobacterium avium subsp. paratuberculosis
gccguggcggcggu

SEQ ID NO: 2847990 - RNA, 17 nt, Mycobacterium avium subsp. paratuberculosis
gccguggcggcgguguc

SEQ ID NO: 2847991 - RNA, 19 nt, Mycobacterium avium subsp. paratuberculosis
gccgugggggucgacccgc

SEQ ID NO: 2847992 - RNA, 13 nt, Mycobacterium avium subsp. paratuberculosis
gccgugggugccg

SEQ ID NO: 2847993 - RNA, 14 nt, Mycobacterium avium subsp. paratuberculosis
gccgugggugccga

SEQ ID NO: 2847994 - RNA, 17 nt, Mycobacterium avium subsp. paratuberculosis
gccgugggugccgacga

SEQ ID NO: 2847995 - RNA, 17 nt, Mycobacterium avium subsp. paratuberculosis
gccgugggugucggcga

SEQ ID NO: 2847996 - RNA, 18 nt, Mycobacterium avium subsp. paratuberculosis
gccgugggugucggcgaa

SEQ ID NO: 2847997 - RNA, 19 nt, Mycobacterium avium subsp. paratuberculosis
gccgugggugucggcgaag

SEQ ID NO: 2847998 - RNA, 19 nt, Mycobacterium avium subsp. paratuberculosis
gccguggucaacggcaccg

SEQ ID NO: 2847999 - RNA, 22 nt, Mycobacterium avium subsp. paratuberculosis
gccguggucaacggcaccgaca

SEQ ID NO: 2848000 - RNA, 15 nt, Mycobacterium avium subsp. paratuberculosis
gccgugguccagccg

SEQ ID NO: 2848001 - RNA, 16 nt, Mycobacterium avium subsp. paratuberculosis
gccgugguccagccgg

SEQ ID NO: 2848002 - RNA, 20 nt, Mycobacterium avium subsp. paratuberculosis
gccgugguccagccggucgc

SEQ ID NO: 2848003 - RNA, 13 nt, Mycobacterium avium subsp. paratuberculosis
gccguggucggcg

SEQ ID NO: 2848004 - RNA, 14 nt, Mycobacterium avium subsp. paratuberculosis
gccguggucggugc

SEQ ID NO: 2848005 - RNA, 17 nt, Mycobacterium avium subsp. paratuberculosis
gccgugguuggcgauca

SEQ ID NO: 2848006 - RNA, 21 nt, Mycobacterium avium subsp. paratuberculosis
gccguguaggccgcgcuggcc

SEQ ID NO: 2848007 - RNA, 17 nt, Mycobacterium avium subsp. paratuberculosis
gccgugugcgcaucggc

SEQ ID NO: 2848008 - RNA, 18 nt, Mycobacterium avium subsp. paratuberculosis
gccgugugcgcaucggcg

SEQ ID NO: 2848009 - RNA, 21 nt, Mycobacterium avium subsp. paratuberculosis
gccgugugcgcaucggcgacg

SEQ ID NO: 2848010 - RNA, 23 nt, Mycobacterium avium subsp. paratuberculosis
gccgugugcgcaucggcgacgcc

SEQ ID NO: 2848011 - RNA, 23 nt, Mycobacterium avium subsp. paratuberculosis
gccguguugacguaacacccugc

SEQ ID NO: 2848012 - RNA, 18 nt, Mycobacterium avium subsp. paratuberculosis
gccguucagcgcggccac

SEQ ID NO: 2848013 - RNA, 13 nt, Mycobacterium avium subsp. paratuberculosis
gccguucaggucg

SEQ ID NO: 2848014 - RNA, 14 nt, Mycobacterium avium subsp. paratuberculosis
gccguuccagccgg

SEQ ID NO: 2848015 - RNA, 17 nt, Mycobacterium avium subsp. paratuberculosis
gccguuccagccggccc

SEQ ID NO: 2848016 - RNA, 18 nt, Mycobacterium avium subsp. paratuberculosis
gccguuccaucgggccca

SEQ ID NO: 2848017 - RNA, 22 nt, Mycobacterium avium subsp. paratuberculosis
gccguuccaucgggcccagcag

SEQ ID NO: 2848018 - RNA, 23 nt, Mycobacterium avium subsp. paratuberculosis
gccguuccaucgggcccagcagc

SEQ ID NO: 2848019 - RNA, 17 nt, Mycobacterium avium subsp. paratuberculosis
gccguuccgaugaagaa

SEQ ID NO: 2848020 - RNA, 13 nt, Mycobacterium avium subsp. paratuberculosis
gccguucgccggc

SEQ ID NO: 2848021 - RNA, 16 nt, Mycobacterium avium subsp. paratuberculosis
gccguucgccggccag

SEQ ID NO: 2848022 - RNA, 20 nt, Mycobacterium avium subsp. paratuberculosis
gccguucgccggccagcacg

SEQ ID NO: 2848023 - RNA, 14 nt, Mycobacterium avium subsp. paratuberculosis
gccguucgccggcg

SEQ ID NO: 2848024 - RNA, 15 nt, Mycobacterium avium subsp. paratuberculosis
gccguucgccggcga

SEQ ID NO: 2848025 - RNA, 16 nt, Mycobacterium avium subsp. paratuberculosis
gccguucgccgguacc

SEQ ID NO: 2848026 - RNA, 21 nt, Mycobacterium avium subsp. paratuberculosis
gccguucgccgguaccgccgg

SEQ ID NO: 2848027 - RNA, 23 nt, Mycobacterium avium subsp. paratuberculosis
gccguucgccgguaccgccggcc

SEQ ID NO: 2848028 - RNA, 21 nt, Mycobacterium avium subsp. paratuberculosis
gccguucgcgcacggcgcgca

SEQ ID NO: 2848029 - RNA, 21 nt, Mycobacterium avium subsp. paratuberculosis
gccguucgcugcccucggucg

SEQ ID NO: 2848030 - RNA, 15 nt, Mycobacterium avium subsp. paratuberculosis
gccguucggccagcg

SEQ ID NO: 2848031 - RNA, 16 nt, Mycobacterium avium subsp. paratuberculosis
gccguucggccagcgc

SEQ ID NO: 2848032 - RNA, 20 nt, Mycobacterium avium subsp. paratuberculosis
gccguucggccagcgccgcc

SEQ ID NO: 2848033 - RNA, 22 nt, Mycobacterium avium subsp. paratuberculosis
gccguucggccagcgccgccag

SEQ ID NO: 2848034 - RNA, 17 nt, Mycobacterium avium subsp. paratuberculosis
gccguucucguccuggg

SEQ ID NO: 2848035 - RNA, 14 nt, Mycobacterium avium subsp. paratuberculosis
gccucagggcgcgc

SEQ ID NO: 2848036 - RNA, 20 nt, Mycobacterium avium subsp. paratuberculosis
gccucagggcgcgcugucga

SEQ ID NO: 2848037 - RNA, 23 nt, Mycobacterium avium subsp. paratuberculosis
gccucagugucguggcgacaucg

SEQ ID NO: 2848038 - RNA, 21 nt, Mycobacterium avium subsp. paratuberculosis
gccuccaacccaaccugugcc

SEQ ID NO: 2848039 - RNA, 20 nt, Mycobacterium avium subsp. paratuberculosis
gccuccacauacgcggcggc

SEQ ID NO: 2848040 - RNA, 13 nt, Mycobacterium avium subsp. paratuberculosis
gccuccaccacca

SEQ ID NO: 2848041 - RNA, 15 nt, Mycobacterium avium subsp. paratuberculosis
gccuccaccaccaug

SEQ ID NO: 2848042 - RNA, 13 nt, Mycobacterium avium subsp. paratuberculosis
gccuccaccagcg

SEQ ID NO: 2848043 - RNA, 15 nt, Mycobacterium avium subsp. paratuberculosis
gccuccaccagcggc

SEQ ID NO: 2848044 - RNA, 16 nt, Mycobacterium avium subsp. paratuberculosis
gccuccaccagcggcg

SEQ ID NO: 2848045 - RNA, 12 nt, Mycobacterium avium subsp. paratuberculosis
gccuccaccggc

SEQ ID NO: 2848046 - RNA, 18 nt, Mycobacterium avium subsp. paratuberculosis
gccuccaccggcaaucgg

SEQ ID NO: 2848047 - RNA, 16 nt, Mycobacterium avium subsp. paratuberculosis
gccuccacgucaccga

SEQ ID NO: 2848048 - RNA, 18 nt, Mycobacterium avium subsp. paratuberculosis
gccuccacgucaccgacg

SEQ ID NO: 2848049 - RNA, 19 nt, Mycobacterium avium subsp. paratuberculosis
gccuccacgucaccgacgc

SEQ ID NO: 2848050 - RNA, 21 nt, Mycobacterium avium subsp. paratuberculosis
gccuccagcacgucggggugg

SEQ ID NO: 2848051 - RNA, 13 nt, Mycobacterium avium subsp. paratuberculosis
gccuccagccagc

SEQ ID NO: 2848052 - RNA, 17 nt, Mycobacterium avium subsp. paratuberculosis
gccuccagccagcgcgc

SEQ ID NO: 2848053 - RNA, 19 nt, Mycobacterium avium subsp. paratuberculosis
gccuccagccagcgcgcga

SEQ ID NO: 2848054 - RNA, 20 nt, Mycobacterium avium subsp. paratuberculosis
gccuccagccagcgcgcgau

SEQ ID NO: 2848055 - RNA, 24 nt, Mycobacterium avium subsp. paratuberculosis
gccuccagccagcgcgcgaucagc

SEQ ID NO: 2848056 - RNA, 13 nt, Mycobacterium avium subsp. paratuberculosis
gccuccagccgcu

SEQ ID NO: 2848057 - RNA, 17 nt, Mycobacterium avium subsp. paratuberculosis
gccuccagccgcuccgc

SEQ ID NO: 2848058 - RNA, 19 nt, Mycobacterium avium subsp. paratuberculosis
gccuccagccgcuccucgu

SEQ ID NO: 2848059 - RNA, 22 nt, Mycobacterium avium subsp. paratuberculosis
gccuccagccgcuccucguuga

SEQ ID NO: 2848060 - RNA, 13 nt, Mycobacterium avium subsp. paratuberculosis
gccuccagccggc

SEQ ID NO: 2848061 - RNA, 14 nt, Mycobacterium avium subsp. paratuberculosis
gccuccagccggcg

SEQ ID NO: 2848062 - RNA, 15 nt, Mycobacterium avium subsp. paratuberculosis
gccuccagccggcgg

SEQ ID NO: 2848063 - RNA, 15 nt, Mycobacterium avium subsp. paratuberculosis
gccuccagcuguuga

SEQ ID NO: 2848064 - RNA, 20 nt, Mycobacterium avium subsp. paratuberculosis
gccuccagcuguugacgggc

SEQ ID NO: 2848065 - RNA, 22 nt, Mycobacterium avium subsp. paratuberculosis
gccuccaggcugaaucccuccg

SEQ ID NO: 2848066 - RNA, 22 nt, Mycobacterium avium subsp. paratuberculosis
gccuccagguagacgaugccca

SEQ ID NO: 2848067 - RNA, 18 nt, Mycobacterium avium subsp. paratuberculosis
gccuccagguucgccgcc

SEQ ID NO: 2848068 - RNA, 19 nt, Mycobacterium avium subsp. paratuberculosis
gccuccagguucgccgccc

SEQ ID NO: 2848069 - RNA, 18 nt, Mycobacterium avium subsp. paratuberculosis
gccuccauucgggccagc

SEQ ID NO: 2848070 - RNA, 22 nt, Mycobacterium avium subsp. paratuberculosis
gccuccauucgggccagcgccg

SEQ ID NO: 2848071 - RNA, 14 nt, Mycobacterium avium subsp. paratuberculosis
gccucccacagguc

SEQ ID NO: 2848072 - RNA, 15 nt, Mycobacterium avium subsp. paratuberculosis
gccucccacucgucg

SEQ ID NO: 2848073 - RNA, 20 nt, Mycobacterium avium subsp. paratuberculosis
gccucccacucgucgaucga

SEQ ID NO: 2848074 - RNA, 14 nt, Mycobacterium avium subsp. paratuberculosis
gccuccccauccgc

SEQ ID NO: 2848075 - RNA, 18 nt, Mycobacterium avium subsp. paratuberculosis
gccuccccauccgcggcc

SEQ ID NO: 2848076 - RNA, 19 nt, Mycobacterium avium subsp. paratuberculosis
gccuccccauccgcggcca

SEQ ID NO: 2848077 - RNA, 14 nt, Mycobacterium avium subsp. paratuberculosis
gccucccccacccg

SEQ ID NO: 2848078 - RNA, 18 nt, Mycobacterium avium subsp. paratuberculosis
gccucccccacccgcacg

SEQ ID NO: 2848079 - RNA, 18 nt, Mycobacterium avium subsp. paratuberculosis
gccucccccuugccggug

SEQ ID NO: 2848080 - RNA, 15 nt, Mycobacterium avium subsp. paratuberculosis
gccucccgcagcgcc

SEQ ID NO: 2848081 - RNA, 20 nt, Mycobacterium avium subsp. paratuberculosis
gccucccgguaggcggcgag

SEQ ID NO: 2848082 - RNA, 21 nt, Mycobacterium avium subsp. paratuberculosis
gccucccgguaggcggcgaga

SEQ ID NO: 2848083 - RNA, 20 nt, Mycobacterium avium subsp. paratuberculosis
gccuccgaauccagcgcgcc

SEQ ID NO: 2848084 - RNA, 23 nt, Mycobacterium avium subsp. paratuberculosis
gccuccgaauccagcgcgccgcu

SEQ ID NO: 2848085 - RNA, 14 nt, Mycobacterium avium subsp. paratuberculosis
gccuccgacagccg

SEQ ID NO: 2848086 - RNA, 15 nt, Mycobacterium avium subsp. paratuberculosis
gccuccgacagccgc

SEQ ID NO: 2848087 - RNA, 15 nt, Mycobacterium avium subsp. paratuberculosis
gccuccgaccagccg

SEQ ID NO: 2848088 - RNA, 16 nt, Mycobacterium avium subsp. paratuberculosis
gccuccgaccagccgg

SEQ ID NO: 2848089 - RNA, 12 nt, Mycobacterium avium subsp. paratuberculosis
gccuccgacccg

SEQ ID NO: 2848090 - RNA, 15 nt, Mycobacterium avium subsp. paratuberculosis
gccuccgagauggac

SEQ ID NO: 2848091 - RNA, 18 nt, Mycobacterium avium subsp. paratuberculosis
gccuccgagauggacagc

SEQ ID NO: 2848092 - RNA, 21 nt, Mycobacterium avium subsp. paratuberculosis
gccuccgagauggacagcacc

SEQ ID NO: 2848093 - RNA, 15 nt, Mycobacterium avium subsp. paratuberculosis
gccuccgagcggcgc

SEQ ID NO: 2848094 - RNA, 17 nt, Mycobacterium avium subsp. paratuberculosis
gccuccgagcggcgcag

SEQ ID NO: 2848095 - RNA, 18 nt, Mycobacterium avium subsp. paratuberculosis
gccuccgagcggcgcagg

SEQ ID NO: 2848096 - RNA, 22 nt, Mycobacterium avium subsp. paratuberculosis
gccuccgccaccuccuccgguc

SEQ ID NO: 2848097 - RNA, 17 nt, Mycobacterium avium subsp. paratuberculosis
gccuccgcccgggugca

SEQ ID NO: 2848098 - RNA, 18 nt, Mycobacterium avium subsp. paratuberculosis
gccuccgcccgggugcag

SEQ ID NO: 2848099 - RNA, 22 nt, Mycobacterium avium subsp. paratuberculosis
gccuccgcccgggugcaggccc

SEQ ID NO: 2848100 - RNA, 13 nt, Mycobacterium avium subsp. paratuberculosis
gccuccgccgccc

SEQ ID NO: 2848101 - RNA, 14 nt, Mycobacterium avium subsp. paratuberculosis
gccuccgccgcccc

SEQ ID NO: 2848102 - RNA, 15 nt, Mycobacterium avium subsp. paratuberculosis
gccuccgcgaucagc

SEQ ID NO: 2848103 - RNA, 17 nt, Mycobacterium avium subsp. paratuberculosis
gccuccgcgaucagcuc

SEQ ID NO: 2848104 - RNA, 12 nt, Mycobacterium avium subsp. paratuberculosis
gccuccgcgcgc

SEQ ID NO: 2848105 - RNA, 15 nt, Mycobacterium avium subsp. paratuberculosis
gccuccgcgcgcggc

SEQ ID NO: 2848106 - RNA, 21 nt, Mycobacterium avium subsp. paratuberculosis
gccuccggagugacgucgcgc

SEQ ID NO: 2848107 - RNA, 17 nt, Mycobacterium avium subsp. paratuberculosis
gccuccggauggcgguc

SEQ ID NO: 2848108 - RNA, 22 nt, Mycobacterium avium subsp. paratuberculosis
gccuccggauggcggucgcgcc

SEQ ID NO: 2848109 - RNA, 16 nt, Mycobacterium avium subsp. paratuberculosis
gccuccggcaguacgc

SEQ ID NO: 2848110 - RNA, 21 nt, Mycobacterium avium subsp. paratuberculosis
gccuccggcaguacgcgccgg

SEQ ID NO: 2848111 - RNA, 23 nt, Mycobacterium avium subsp. paratuberculosis
gccuccggcaguacgcgccggcc

SEQ ID NO: 2848112 - RNA, 12 nt, Mycobacterium avium subsp. paratuberculosis
gccuccggcggc

SEQ ID NO: 2848113 - RNA, 13 nt, Mycobacterium avium subsp. paratuberculosis
gccuccggcggca

SEQ ID NO: 2848114 - RNA, 23 nt, Mycobacterium avium subsp. paratuberculosis
gccuccgggaaggcggccgcgaa

SEQ ID NO: 2848115 - RNA, 17 nt, Mycobacterium avium subsp. paratuberculosis
gccuccgguuugcgccg

SEQ ID NO: 2848116 - RNA, 18 nt, Mycobacterium avium subsp. paratuberculosis
gccuccgguuugcgccgg

SEQ ID NO: 2848117 - RNA, 23 nt, Mycobacterium avium subsp. paratuberculosis
gccuccgguuugcgccggcucca

SEQ ID NO: 2848118 - RNA, 17 nt, Mycobacterium avium subsp. paratuberculosis
gccuccgucagcgccgc

SEQ ID NO: 2848119 - RNA, 21 nt, Mycobacterium avium subsp. paratuberculosis
gccuccgucagcgccgcccgc

SEQ ID NO: 2848120 - RNA, 23 nt, Mycobacterium avium subsp. paratuberculosis
gccucggccuuggccaccgccug

SEQ ID NO: 2848121 - RNA, 19 nt, Mycobacterium avium subsp. paratuberculosis
gccucggcgaccgcccggg

SEQ ID NO: 2848122 - RNA, 15 nt, Mycobacterium avium subsp. paratuberculosis
gccucggcgagccgc

SEQ ID NO: 2848123 - RNA, 17 nt, Mycobacterium avium subsp. paratuberculosis
gccucggcgagccgcuc

SEQ ID NO: 2848124 - RNA, 14 nt, Mycobacterium avium subsp. paratuberculosis
gccucggcgaucgg

SEQ ID NO: 2848125 - RNA, 17 nt, Mycobacterium avium subsp. paratuberculosis
gccucggcgaucggccg

SEQ ID NO: 2848126 - RNA, 19 nt, Mycobacterium avium subsp. paratuberculosis
gccucggcgaucggccgcu

SEQ ID NO: 2848127 - RNA, 15 nt, Mycobacterium avium subsp. paratuberculosis
gccucggcgccucgg

SEQ ID NO: 2848128 - RNA, 18 nt, Mycobacterium avium subsp. paratuberculosis
gccucggcgccucggcgu

SEQ ID NO: 2848129 - RNA, 15 nt, Mycobacterium avium subsp. paratuberculosis
gccucggcgcgggcg

SEQ ID NO: 2848130 - RNA, 13 nt, Mycobacterium avium subsp. paratuberculosis
gccucggcgcugc

SEQ ID NO: 2848131 - RNA, 15 nt, Mycobacterium avium subsp. paratuberculosis
gccucggcgcugccc

SEQ ID NO: 2848132 - RNA, 17 nt, Mycobacterium avium subsp. paratuberculosis
gccucggcgcugcccgc

SEQ ID NO: 2848133 - RNA, 19 nt, Mycobacterium avium subsp. paratuberculosis
gccucggcgcugcccgccg

SEQ ID NO: 2848134 - RNA, 21 nt, Mycobacterium avium subsp. paratuberculosis
gccucggcgcugcccgccgcg

SEQ ID NO: 2848135 - RNA, 14 nt, Mycobacterium avium subsp. paratuberculosis
gccucggcggaguc

SEQ ID NO: 2848136 - RNA, 13 nt, Mycobacterium avium subsp. paratuberculosis
gccucggcggccg

SEQ ID NO: 2848137 - RNA, 14 nt, Mycobacterium avium subsp. paratuberculosis
gccucggcggccgc

SEQ ID NO: 2848138 - RNA, 17 nt, Mycobacterium avium subsp. paratuberculosis
gccucggcggccgcccg

SEQ ID NO: 2848139 - RNA, 22 nt, Mycobacterium avium subsp. paratuberculosis
gccucggcggccgcccgggcgg

SEQ ID NO: 2848140 - RNA, 23 nt, Mycobacterium avium subsp. paratuberculosis
gccucggcggccgggaugccgcc

SEQ ID NO: 2848141 - RNA, 20 nt, Mycobacterium avium subsp. paratuberculosis
gccucggcgggccgcccggc

SEQ ID NO: 2848142 - RNA, 21 nt, Mycobacterium avium subsp. paratuberculosis
gccucggcgggccgcccggcg

SEQ ID NO: 2848143 - RNA, 14 nt, Mycobacterium avium subsp. paratuberculosis
gccucggcgguggc

SEQ ID NO: 2848144 - RNA, 19 nt, Mycobacterium avium subsp. paratuberculosis
gccucggcgucaccgcggg

SEQ ID NO: 2848145 - RNA, 20 nt, Mycobacterium avium subsp. paratuberculosis
gccucggcgucaccgcgggu

SEQ ID NO: 2848146 - RNA, 12 nt, Mycobacterium avium subsp. paratuberculosis
gccucggcgucc

SEQ ID NO: 2848147 - RNA, 17 nt, Mycobacterium avium subsp. paratuberculosis
gccucggcgucccggcg

SEQ ID NO: 2848148 - RNA, 19 nt, Mycobacterium avium subsp. paratuberculosis
gccucggcgucccggcguc

SEQ ID NO: 2848149 - RNA, 13 nt, Mycobacterium avium subsp. paratuberculosis
gccucggcguggc

SEQ ID NO: 2848150 - RNA, 19 nt, Mycobacterium avium subsp. paratuberculosis
gccucggcguggcaggcga

SEQ ID NO: 2848151 - RNA, 14 nt, Mycobacterium avium subsp. paratuberculosis
gccucgggccggca

SEQ ID NO: 2848152 - RNA, 17 nt, Mycobacterium avium subsp. paratuberculosis
gccucgggccggcagcc

SEQ ID NO: 2848153 - RNA, 18 nt, Mycobacterium avium subsp. paratuberculosis
gccucgggccggcagccg

SEQ ID NO: 2848154 - RNA, 19 nt, Mycobacterium avium subsp. paratuberculosis
gccucgggccggcagccgg

SEQ ID NO: 2848155 - RNA, 23 nt, Mycobacterium avium subsp. paratuberculosis
gccucgggccggcagccggccac

SEQ ID NO: 2848156 - RNA, 14 nt, Mycobacterium avium subsp. paratuberculosis
gccucgggcgacga

SEQ ID NO: 2848157 - RNA, 21 nt, Mycobacterium avium subsp. paratuberculosis
gccucgggcgacgacgcgguc

SEQ ID NO: 2848158 - RNA, 20 nt, Mycobacterium avium subsp. paratuberculosis
gccucggggaucgccaggcg

SEQ ID NO: 2848159 - RNA, 21 nt, Mycobacterium avium subsp. paratuberculosis
gccucggggaucgccaggcgu

SEQ ID NO: 2848160 - RNA, 21 nt, Mycobacterium avium subsp. paratuberculosis
gccucgggggugaaggcggcc

SEQ ID NO: 2848161 - RNA, 19 nt, Mycobacterium avium subsp. paratuberculosis
gccucggucacggucuggc

SEQ ID NO: 2848162 - RNA, 17 nt, Mycobacterium avium subsp. paratuberculosis
gccucggugaagccgcg

SEQ ID NO: 2848163 - RNA, 24 nt, Mycobacterium avium subsp. paratuberculosis
gccucggugaagccgcggacggcg

SEQ ID NO: 2848164 - RNA, 22 nt, Mycobacterium avium subsp. paratuberculosis
gccucggugagcagcucgguca

SEQ ID NO: 2848165 - RNA, 15 nt, Mycobacterium avium subsp. paratuberculosis
gccucggugcggaac

SEQ ID NO: 2848166 - RNA, 21 nt, Mycobacterium avium subsp. paratuberculosis
gccucggugcggaacaccgcc

SEQ ID NO: 2848167 - RNA, 18 nt, Mycobacterium avium subsp. paratuberculosis
gccucggugcucaucagc

SEQ ID NO: 2848168 - RNA, 14 nt, Mycobacterium avium subsp. paratuberculosis
gccucgguggcggu

SEQ ID NO: 2848169 - RNA, 17 nt, Mycobacterium avium subsp. paratuberculosis
gccucgguggcgguggc

SEQ ID NO: 2848170 - RNA, 18 nt, Mycobacterium avium subsp. paratuberculosis
gccucgguggcgguggcc

SEQ ID NO: 2848171 - RNA, 15 nt, Mycobacterium avium subsp. paratuberculosis
gccucgguggucgac

SEQ ID NO: 2848172 - RNA, 18 nt, Mycobacterium avium subsp. paratuberculosis
gccucgguggucgacgag

SEQ ID NO: 2848173 - RNA, 19 nt, Mycobacterium avium subsp. paratuberculosis
gccucgguggucgacgagc

SEQ ID NO: 2848174 - RNA, 22 nt, Mycobacterium avium subsp. paratuberculosis
gccucgguggucgacgagcccg

SEQ ID NO: 2848175 - RNA, 16 nt, Mycobacterium avium subsp. paratuberculosis
gccucgguggucgcgu

SEQ ID NO: 2848176 - RNA, 16 nt, Mycobacterium avium subsp. paratuberculosis
gccucgguucugcagc

SEQ ID NO: 2848177 - RNA, 12 nt, Mycobacterium avium subsp. paratuberculosis
gccucguccagg

SEQ ID NO: 2848178 - RNA, 15 nt, Mycobacterium avium subsp. paratuberculosis
gccucgucgaagguc

SEQ ID NO: 2848179 - RNA, 16 nt, Mycobacterium avium subsp. paratuberculosis
gccucgucgaccgcgg

SEQ ID NO: 2848180 - RNA, 14 nt, Mycobacterium avium subsp. paratuberculosis
gccucgucgacguc

SEQ ID NO: 2848181 - RNA, 18 nt, Mycobacterium avium subsp. paratuberculosis
gccucgucgacgucgggg

SEQ ID NO: 2848182 - RNA, 16 nt, Mycobacterium avium subsp. paratuberculosis
gccucgucgagccggg

SEQ ID NO: 2848183 - RNA, 17 nt, Mycobacterium avium subsp. paratuberculosis
gccucgucgagccgggc

SEQ ID NO: 2848184 - RNA, 18 nt, Mycobacterium avium subsp. paratuberculosis
gccucgucgagccgggcc

SEQ ID NO: 2848185 - RNA, 19 nt, Mycobacterium avium subsp. paratuberculosis
gccucgucgagccgggccc

SEQ ID NO: 2848186 - RNA, 23 nt, Mycobacterium avium subsp. paratuberculosis
gccucgucgagccgggcccgggu

SEQ ID NO: 2848187 - RNA, 19 nt, Mycobacterium avium subsp. paratuberculosis
gccucgucgaugucggcgg

SEQ ID NO: 2848188 - RNA, 20 nt, Mycobacterium avium subsp. paratuberculosis
gccucgucgaugucggcggc

SEQ ID NO: 2848189 - RNA, 22 nt, Mycobacterium avium subsp. paratuberculosis
gccucgucgaugucggcggccc

SEQ ID NO: 2848190 - RNA, 13 nt, Mycobacterium avium subsp. paratuberculosis
gccucgucgccgc

SEQ ID NO: 2848191 - RNA, 18 nt, Mycobacterium avium subsp. paratuberculosis
gccucgucggcgagcagc

SEQ ID NO: 2848192 - RNA, 13 nt, Mycobacterium avium subsp. paratuberculosis
gccucgucggcgc

SEQ ID NO: 2848193 - RNA, 19 nt, Mycobacterium avium subsp. paratuberculosis
gccucgucggcgccgucgc

SEQ ID NO: 2848194 - RNA, 22 nt, Mycobacterium avium subsp. paratuberculosis
gccucgucggcgccgucgcggg

SEQ ID NO: 2848195 - RNA, 16 nt, Mycobacterium avium subsp. paratuberculosis
gccucgucgucgucga

SEQ ID NO: 2848196 - RNA, 20 nt, Mycobacterium avium subsp. paratuberculosis
gccucguugagcacaaagcc

SEQ ID NO: 2848197 - RNA, 17 nt, Mycobacterium avium subsp. paratuberculosis
gccucguuggccagcuc

SEQ ID NO: 2848198 - RNA, 18 nt, Mycobacterium avium subsp. paratuberculosis
gccucguuggccagcucg

SEQ ID NO: 2848199 - RNA, 17 nt, Mycobacterium avium subsp. paratuberculosis
gccucucgucgacgaug

SEQ ID NO: 2848200 - RNA, 16 nt, Mycobacterium avium subsp. paratuberculosis
gccucuucggcgcgcc

SEQ ID NO: 2848201 - RNA, 20 nt, Mycobacterium avium subsp. paratuberculosis
gccucuucggcgcgccggcg

SEQ ID NO: 2848202 - RNA, 15 nt, Mycobacterium avium subsp. paratuberculosis
gccucuucgucggcc

SEQ ID NO: 2848203 - RNA, 18 nt, Mycobacterium avium subsp. paratuberculosis
gccugaaccagcucgugc

SEQ ID NO: 2848204 - RNA, 15 nt, Mycobacterium avium subsp. paratuberculosis
gccugcgcggcggcg

SEQ ID NO: 2848205 - RNA, 15 nt, Mycobacterium avium subsp. paratuberculosis
gccugcgcgggcgcg

SEQ ID NO: 2848206 - RNA, 19 nt, Mycobacterium avium subsp. paratuberculosis
gccugcgcgggcgcggaca

SEQ ID NO: 2848207 - RNA, 13 nt, Mycobacterium avium subsp. paratuberculosis
gccugcgcgucgu

SEQ ID NO: 2848208 - RNA, 16 nt, Mycobacterium avium subsp. paratuberculosis
gccugcgcgucgucgc

SEQ ID NO: 2848209 - RNA, 21 nt, Mycobacterium avium subsp. paratuberculosis
gccugcgcgucgucgcccgaa

SEQ ID NO: 2848210 - RNA, 15 nt, Mycobacterium avium subsp. paratuberculosis
gccugcgcugcggcc

SEQ ID NO: 2848211 - RNA, 18 nt, Mycobacterium avium subsp. paratuberculosis
gccugcgcugcggccaau

SEQ ID NO: 2848212 - RNA, 17 nt, Mycobacterium avium subsp. paratuberculosis
gccugcggcaacagcac

SEQ ID NO: 2848213 - RNA, 21 nt, Mycobacterium avium subsp. paratuberculosis
gccugcggcaacagcaccagc

SEQ ID NO: 2848214 - RNA, 18 nt, Mycobacterium avium subsp. paratuberculosis
gccugcggcccagcguag

SEQ ID NO: 2848215 - RNA, 13 nt, Mycobacterium avium subsp. paratuberculosis
gccugcggccugc

SEQ ID NO: 2848216 - RNA, 15 nt, Mycobacterium avium subsp. paratuberculosis
gccugcggccugcac

SEQ ID NO: 2848217 - RNA, 16 nt, Mycobacterium avium subsp. paratuberculosis
gccugcggccugcaca

SEQ ID NO: 2848218 - RNA, 16 nt, Mycobacterium avium subsp. paratuberculosis
gccugcggcgcggcca

SEQ ID NO: 2848219 - RNA, 18 nt, Mycobacterium avium subsp. paratuberculosis
gccugcggcgcggccacc

SEQ ID NO: 2848220 - RNA, 20 nt, Mycobacterium avium subsp. paratuberculosis
gccugcggcgcggccacccc

SEQ ID NO: 2848221 - RNA, 21 nt, Mycobacterium avium subsp. paratuberculosis
gccugcggcgcggccaccccg

SEQ ID NO: 2848222 - RNA, 15 nt, Mycobacterium avium subsp. paratuberculosis
gccugcggcggcaac

SEQ ID NO: 2848223 - RNA, 22 nt, Mycobacterium avium subsp. paratuberculosis
gccugcggcggcaacggguugc

SEQ ID NO: 2848224 - RNA, 13 nt, Mycobacterium avium subsp. paratuberculosis
gccugcggcggcc

SEQ ID NO: 2848225 - RNA, 18 nt, Mycobacterium avium subsp. paratuberculosis
gccugcggcggccgcagc

SEQ ID NO: 2848226 - RNA, 16 nt, Mycobacterium avium subsp. paratuberculosis
gccugcgggcccagcu

SEQ ID NO: 2848227 - RNA, 17 nt, Mycobacterium avium subsp. paratuberculosis
gccugcgggcccagcuc

SEQ ID NO: 2848228 - RNA, 17 nt, Mycobacterium avium subsp. paratuberculosis
gccugcgggcgccggcu

SEQ ID NO: 2848229 - RNA, 20 nt, Mycobacterium avium subsp. paratuberculosis
gccugcggguucuggccgug

SEQ ID NO: 2848230 - RNA, 20 nt, Mycobacterium avium subsp. paratuberculosis
gccugcggugagcugaucgc

SEQ ID NO: 2848231 - RNA, 14 nt, Mycobacterium avium subsp. paratuberculosis
gccugcggugaugc

SEQ ID NO: 2848232 - RNA, 21 nt, Mycobacterium avium subsp. paratuberculosis
gccugcggugaugcgcggcga

SEQ ID NO: 2848233 - RNA, 18 nt, Mycobacterium avium subsp. paratuberculosis
gccugcgucacuccucga

SEQ ID NO: 2848234 - RNA, 21 nt, Mycobacterium avium subsp. paratuberculosis
gccugcgucacuccucgaucu

SEQ ID NO: 2848235 - RNA, 23 nt, Mycobacterium avium subsp. paratuberculosis
gccugcgucacuccucgaucugg

SEQ ID NO: 2848236 - RNA, 19 nt, Mycobacterium avium subsp. paratuberculosis
gccugcuccagcgagucga

SEQ ID NO: 2848237 - RNA, 12 nt, Mycobacterium avium subsp. paratuberculosis
gccugcucgaag

SEQ ID NO: 2848238 - RNA, 18 nt, Mycobacterium avium subsp. paratuberculosis
gccugcugaauuagggga

SEQ ID NO: 2848239 - RNA, 20 nt, Mycobacterium avium subsp. paratuberculosis
gccugcugcccauccaggcc

SEQ ID NO: 2848240 - RNA, 18 nt, Mycobacterium avium subsp. paratuberculosis
gccugcuucucgccgucg

SEQ ID NO: 2848241 - RNA, 22 nt, Mycobacterium avium subsp. paratuberculosis
gccugcuugagguugacgugca

SEQ ID NO: 2848242 - RNA, 22 nt, Mycobacterium avium subsp. paratuberculosis
gccugcuugaugaugccggccg

SEQ ID NO: 2848243 - RNA, 23 nt, Mycobacterium avium subsp. paratuberculosis
gccugcuugaugaugccggccgc

SEQ ID NO: 2848244 - RNA, 13 nt, Mycobacterium avium subsp. paratuberculosis
gccugcuugggca

SEQ ID NO: 2848245 - RNA, 20 nt, Mycobacterium avium subsp. paratuberculosis
gccugcuugggcagcagcuc

SEQ ID NO: 2848246 - RNA, 22 nt, Mycobacterium avium subsp. paratuberculosis
gccugcuugggcagcagcucga

SEQ ID NO: 2848247 - RNA, 23 nt, Mycobacterium avium subsp. paratuberculosis
gccugcuugggcagcagcucgau

SEQ ID NO: 2848248 - RNA, 22 nt, Mycobacterium avium subsp. paratuberculosis
gccugcuuggucgccugcacga

SEQ ID NO: 2848249 - RNA, 16 nt, Mycobacterium avium subsp. paratuberculosis
gccugcuuuucggccg

SEQ ID NO: 2848250 - RNA, 20 nt, Mycobacterium avium subsp. paratuberculosis
gccuggaagaugacccgccu

SEQ ID NO: 2848251 - RNA, 16 nt, Mycobacterium avium subsp. paratuberculosis
gccuggacgacgucga

SEQ ID NO: 2848252 - RNA, 15 nt, Mycobacterium avium subsp. paratuberculosis
gccuggcacgacgcc

SEQ ID NO: 2848253 - RNA, 16 nt, Mycobacterium avium subsp. paratuberculosis
gccuggcagcugccga

SEQ ID NO: 2848254 - RNA, 17 nt, Mycobacterium avium subsp. paratuberculosis
gccuggccaccucgacg

SEQ ID NO: 2848255 - RNA, 21 nt, Mycobacterium avium subsp. paratuberculosis
gccuggccaccucgacggcgu

SEQ ID NO: 2848256 - RNA, 17 nt, Mycobacterium avium subsp. paratuberculosis
gccuggccacguggucg

SEQ ID NO: 2848257 - RNA, 21 nt, Mycobacterium avium subsp. paratuberculosis
gccuggcccaaaaacaucguc

SEQ ID NO: 2848258 - RNA, 23 nt, Mycobacterium avium subsp. paratuberculosis
gccuggcccaaaaacaucgucaa

SEQ ID NO: 2848259 - RNA, 14 nt, Mycobacterium avium subsp. paratuberculosis
gccuggcccagaca

SEQ ID NO: 2848260 - RNA, 22 nt, Mycobacterium avium subsp. paratuberculosis
gccuggcccagacaggccggcc

SEQ ID NO: 2848261 - RNA, 13 nt, Mycobacterium avium subsp. paratuberculosis
gccuggcccagcc

SEQ ID NO: 2848262 - RNA, 16 nt, Mycobacterium avium subsp. paratuberculosis
gccuggcccagccgcg

SEQ ID NO: 2848263 - RNA, 18 nt, Mycobacterium avium subsp. paratuberculosis
gccuggccgucgcggcgc

SEQ ID NO: 2848264 - RNA, 19 nt, Mycobacterium avium subsp. paratuberculosis
gccuggcgcagggcguucg

SEQ ID NO: 2848265 - RNA, 15 nt, Mycobacterium avium subsp. paratuberculosis
gccuggcgcuccagc

SEQ ID NO: 2848266 - RNA, 16 nt, Mycobacterium avium subsp. paratuberculosis
gccuggcgcuccagcc

SEQ ID NO: 2848267 - RNA, 15 nt, Mycobacterium avium subsp. paratuberculosis
gccuggcggaaggcc

SEQ ID NO: 2848268 - RNA, 22 nt, Mycobacterium avium subsp. paratuberculosis
gccuggcggaaggccgcgcggg

SEQ ID NO: 2848269 - RNA, 17 nt, Mycobacterium avium subsp. paratuberculosis
gccuggcggcgacccgg

SEQ ID NO: 2848270 - RNA, 17 nt, Mycobacterium avium subsp. paratuberculosis
gccuggcuccccggcga

SEQ ID NO: 2848271 - RNA, 22 nt, Mycobacterium avium subsp. paratuberculosis
gccugggauugccgggcaccag

SEQ ID NO: 2848272 - RNA, 17 nt, Mycobacterium avium subsp. paratuberculosis
gccugggcgaccacguc

SEQ ID NO: 2848273 - RNA, 18 nt, Mycobacterium avium subsp. paratuberculosis
gccugggcguacagcggc

SEQ ID NO: 2848274 - RNA, 22 nt, Mycobacterium avium subsp. paratuberculosis
gccugggugaccgagucgucgc

SEQ ID NO: 2848275 - RNA, 19 nt, Mycobacterium avium subsp. paratuberculosis
gccugguacagcaccgccg

SEQ ID NO: 2848276 - RNA, 22 nt, Mycobacterium avium subsp. paratuberculosis
gccugguacagcaccgccgcgg

SEQ ID NO: 2848277 - RNA, 18 nt, Mycobacterium avium subsp. paratuberculosis
gccugguagcugagcagc

SEQ ID NO: 2848278 - RNA, 15 nt, Mycobacterium avium subsp. paratuberculosis
gccugguaggccgcc

SEQ ID NO: 2848279 - RNA, 20 nt, Mycobacterium avium subsp. paratuberculosis
gccugguagggguccuccag

SEQ ID NO: 2848280 - RNA, 19 nt, Mycobacterium avium subsp. paratuberculosis
gccuggucaaggugcugaa

SEQ ID NO: 2848281 - RNA, 17 nt, Mycobacterium avium subsp. paratuberculosis
gccuggucgaacagcac

SEQ ID NO: 2848282 - RNA, 19 nt, Mycobacterium avium subsp. paratuberculosis
gccuggucgaacagcacgc

SEQ ID NO: 2848283 - RNA, 15 nt, Mycobacterium avium subsp. paratuberculosis
gccuggucggcgacc

SEQ ID NO: 2848284 - RNA, 14 nt, Mycobacterium avium subsp. paratuberculosis
gccugguggcccag

SEQ ID NO: 2848285 - RNA, 18 nt, Mycobacterium avium subsp. paratuberculosis
gccugguggcccaggcag

SEQ ID NO: 2848286 - RNA, 19 nt, Mycobacterium avium subsp. paratuberculosis
gccugguggcccaggcaga

SEQ ID NO: 2848287 - RNA, 20 nt, Mycobacterium avium subsp. paratuberculosis
gccugguuggucaauccggg

SEQ ID NO: 2848288 - RNA, 18 nt, Mycobacterium avium subsp. paratuberculosis
gccuugucggcgaugucg

SEQ ID NO: 2848289 - RNA, 13 nt, Mycobacterium avium subsp. paratuberculosis
gccuugucguccu

SEQ ID NO: 2848290 - RNA, 15 nt, Mycobacterium avium subsp. paratuberculosis
gccuuguugcggcgc

SEQ ID NO: 2848291 - RNA, 18 nt, Mycobacterium avium subsp. paratuberculosis
gccuuuccacaucugcuu

SEQ ID NO: 2848292 - RNA, 15 nt, Mycobacterium avium subsp. paratuberculosis
gccuuuccgcgcggc

SEQ ID NO: 2848293 - RNA, 20 nt, Mycobacterium avium subsp. paratuberculosis
gccuuugacguucgcguuga

SEQ ID NO: 2848294 - RNA, 17 nt, Mycobacterium avium subsp. paratuberculosis
gccuuuugcacccgcca

SEQ ID NO: 2848295 - RNA, 19 nt, Mycobacterium avium subsp. paratuberculosis
gccuuuugcacccgccaug

SEQ ID NO: 2848296 - RNA, 19 nt, Mycobacterium avium subsp. paratuberculosis
gcgaaaaaacggcggcgga

SEQ ID NO: 2848297 - RNA, 20 nt, Mycobacterium avium subsp. paratuberculosis
gcgaaaaaacggcggcggaa

SEQ ID NO: 2848298 - RNA, 17 nt, Mycobacterium avium subsp. paratuberculosis
gcgaaaacgccugcgcc

SEQ ID NO: 2848299 - RNA, 20 nt, Mycobacterium avium subsp. paratuberculosis
gcgaaaacgccugcgccgcc

SEQ ID NO: 2848300 - RNA, 16 nt, Mycobacterium avium subsp. paratuberculosis
gcgaaaauaccgccgg

SEQ ID NO: 2848301 - RNA, 18 nt, Mycobacterium avium subsp. paratuberculosis
gcgaaaauaccgccggcc

SEQ ID NO: 2848302 - RNA, 20 nt, Mycobacterium avium subsp. paratuberculosis
gcgaaaauggcugcccggca

SEQ ID NO: 2848303 - RNA, 19 nt, Mycobacterium avium subsp. paratuberculosis
gcgaaacacagcagcacgc

SEQ ID NO: 2848304 - RNA, 18 nt, Mycobacterium avium subsp. paratuberculosis
gcgaaacaccaagcacca

SEQ ID NO: 2848305 - RNA, 13 nt, Mycobacterium avium subsp. paratuberculosis
gcgaaacccccgg

SEQ ID NO: 2848306 - RNA, 15 nt, Mycobacterium avium subsp. paratuberculosis
gcgaaacccccggga

SEQ ID NO: 2848307 - RNA, 20 nt, Mycobacterium avium subsp. paratuberculosis
gcgaaacccccgggaugccu

SEQ ID NO: 2848308 - RNA, 14 nt, Mycobacterium avium subsp. paratuberculosis
gcgaaagcacccga

SEQ ID NO: 2848309 - RNA, 18 nt, Mycobacterium avium subsp. paratuberculosis
gcgaaagcagcguucggu

SEQ ID NO: 2848310 - RNA, 22 nt, Mycobacterium avium subsp. paratuberculosis
gcgaaagcagcguucggucagc

SEQ ID NO: 2848311 - RNA, 14 nt, Mycobacterium avium subsp. paratuberculosis
gcgaaagcccaggc

SEQ ID NO: 2848312 - RNA, 19 nt, Mycobacterium avium subsp. paratuberculosis
gcgaaagcccaggcccggc

SEQ ID NO: 2848313 - RNA, 14 nt, Mycobacterium avium subsp. paratuberculosis
gcgaaagcgucggc

SEQ ID NO: 2848314 - RNA, 15 nt, Mycobacterium avium subsp. paratuberculosis
gcgaaagcgucggcu

SEQ ID NO: 2848315 - RNA, 18 nt, Mycobacterium avium subsp. paratuberculosis
gcgaaagcgucggcuagc

SEQ ID NO: 2848316 - RNA, 23 nt, Mycobacterium avium subsp. paratuberculosis
gcgaaagucccccaaaacccggc

SEQ ID NO: 2848317 - RNA, 20 nt, Mycobacterium avium subsp. paratuberculosis
gcgaaagugcaacugccgac

SEQ ID NO: 2848318 - RNA, 20 nt, Mycobacterium avium subsp. paratuberculosis
gcgaaagugcuacugccgac

SEQ ID NO: 2848319 - RNA, 19 nt, Mycobacterium avium subsp. paratuberculosis
gcgaaauaacccaccccga

SEQ ID NO: 2848320 - RNA, 15 nt, Mycobacterium avium subsp. paratuberculosis
gcgaaaucgcgggcc

SEQ ID NO: 2848321 - RNA, 16 nt, Mycobacterium avium subsp. paratuberculosis
gcgaaaucgcgggccu

SEQ ID NO: 2848322 - RNA, 14 nt, Mycobacterium avium subsp. paratuberculosis
gcgaacaacgccac

SEQ ID NO: 2848323 - RNA, 21 nt, Mycobacterium avium subsp. paratuberculosis
gcgaacaauuccucugcgcgc

SEQ ID NO: 2848324 - RNA, 21 nt, Mycobacterium avium subsp. paratuberculosis
gcgaacaccacgguccccgcg

SEQ ID NO: 2848325 - RNA, 17 nt, Mycobacterium avium subsp. paratuberculosis
gcgaacaccagaugccg

SEQ ID NO: 2848326 - RNA, 20 nt, Mycobacterium avium subsp. paratuberculosis
gcgaacaccagaugccgcuc

SEQ ID NO: 2848327 - RNA, 22 nt, Mycobacterium avium subsp. paratuberculosis
gcgaacaccagaugccgcucgg

SEQ ID NO: 2848328 - RNA, 24 nt, Mycobacterium avium subsp. paratuberculosis
gcgaacaccagaugccgcucggcg

SEQ ID NO: 2848329 - RNA, 13 nt, Mycobacterium avium subsp. paratuberculosis
gcgaacaccagcc

SEQ ID NO: 2848330 - RNA, 19 nt, Mycobacterium avium subsp. paratuberculosis
gcgaacaccucggcgaugc

SEQ ID NO: 2848331 - RNA, 13 nt, Mycobacterium avium subsp. paratuberculosis
gcgaacaccugcu

SEQ ID NO: 2848332 - RNA, 14 nt, Mycobacterium avium subsp. paratuberculosis
gcgaacacgucggc

SEQ ID NO: 2848333 - RNA, 17 nt, Mycobacterium avium subsp. paratuberculosis
gcgaacacgucggccag

SEQ ID NO: 2848334 - RNA, 15 nt, Mycobacterium avium subsp. paratuberculosis
gcgaacacgugcagc

SEQ ID NO: 2848335 - RNA, 15 nt, Mycobacterium avium subsp. paratuberculosis
gcgaacagcagcacc

SEQ ID NO: 2848336 - RNA, 19 nt, Mycobacterium avium subsp. paratuberculosis
gcgaacagcagcacccggg

SEQ ID NO: 2848337 - RNA, 12 nt, Mycobacterium avium subsp. paratuberculosis
gcgaacagccga

SEQ ID NO: 2848338 - RNA, 22 nt, Mycobacterium avium subsp. paratuberculosis
gcgaacagccgaccgaucagcg

SEQ ID NO: 2848339 - RNA, 14 nt, Mycobacterium avium subsp. paratuberculosis
gcgaacagcgccga

SEQ ID NO: 2848340 - RNA, 16 nt, Mycobacterium avium subsp. paratuberculosis
gcgaacagcgccgacu

SEQ ID NO: 2848341 - RNA, 14 nt, Mycobacterium avium subsp. paratuberculosis
gcgaacagcgcggc

SEQ ID NO: 2848342 - RNA, 13 nt, Mycobacterium avium subsp. paratuberculosis
gcgaacaggaugc

SEQ ID NO: 2848343 - RNA, 15 nt, Mycobacterium avium subsp. paratuberculosis
gcgaacaggcccugc

SEQ ID NO: 2848344 - RNA, 16 nt, Mycobacterium avium subsp. paratuberculosis
gcgaacaggcccugcu

SEQ ID NO: 2848345 - RNA, 21 nt, Mycobacterium avium subsp. paratuberculosis
gcgaacagguccuugcccagc

SEQ ID NO: 2848346 - RNA, 22 nt, Mycobacterium avium subsp. paratuberculosis
gcgaacagguccuugcccagca

SEQ ID NO: 2848347 - RNA, 20 nt, Mycobacterium avium subsp. paratuberculosis
gcgaacagugcacugccgac

SEQ ID NO: 2848348 - RNA, 15 nt, Mycobacterium avium subsp. paratuberculosis
gcgaacaucgccagc

SEQ ID NO: 2848349 - RNA, 16 nt, Mycobacterium avium subsp. paratuberculosis
gcgaacaucgccagca

SEQ ID NO: 2848350 - RNA, 17 nt, Mycobacterium avium subsp. paratuberculosis
gcgaacaucgccagcaa

SEQ ID NO: 2848351 - RNA, 24 nt, Mycobacterium avium subsp. paratuberculosis
gcgaacaucuuggucagccgcggc

SEQ ID NO: 2848352 - RNA, 17 nt, Mycobacterium avium subsp. paratuberculosis
gcgaacauggcggccag

SEQ ID NO: 2848353 - RNA, 21 nt, Mycobacterium avium subsp. paratuberculosis
gcgaacauggcggccagccgg

SEQ ID NO: 2848354 - RNA, 22 nt, Mycobacterium avium subsp. paratuberculosis
gcgaacauggucgcccacaccg

SEQ ID NO: 2848355 - RNA, 20 nt, Mycobacterium avium subsp. paratuberculosis
gcgaaccacgggucgcugug

SEQ ID NO: 2848356 - RNA, 14 nt, Mycobacterium avium subsp. paratuberculosis
gcgaaccagcaugc

SEQ ID NO: 2848357 - RNA, 15 nt, Mycobacterium avium subsp. paratuberculosis
gcgaaccagcgcccg

SEQ ID NO: 2848358 - RNA, 15 nt, Mycobacterium avium subsp. paratuberculosis
gcgaaccagggcagc

SEQ ID NO: 2848359 - RNA, 18 nt, Mycobacterium avium subsp. paratuberculosis
gcgaacccgagcaccccg

SEQ ID NO: 2848360 - RNA, 20 nt, Mycobacterium avium subsp. paratuberculosis
gcgaacccgagcaccccggc

SEQ ID NO: 2848361 - RNA, 21 nt, Mycobacterium avium subsp. paratuberculosis
gcgaacccgagcaccccggcg

SEQ ID NO: 2848362 - RNA, 23 nt, Mycobacterium avium subsp. paratuberculosis
gcgaacccgccagggcgacgccg

SEQ ID NO: 2848363 - RNA, 13 nt, Mycobacterium avium subsp. paratuberculosis
gcgaacccggcgc

SEQ ID NO: 2848364 - RNA, 15 nt, Mycobacterium avium subsp. paratuberculosis
gcgaacccggcgccc

SEQ ID NO: 2848365 - RNA, 18 nt, Mycobacterium avium subsp. paratuberculosis
gcgaacccggcgcccggc

SEQ ID NO: 2848366 - RNA, 19 nt, Mycobacterium avium subsp. paratuberculosis
gcgaacccggcgcccggcc

SEQ ID NO: 2848367 - RNA, 20 nt, Mycobacterium avium subsp. paratuberculosis
gcgaacccggcgcccggccg

SEQ ID NO: 2848368 - RNA, 17 nt, Mycobacterium avium subsp. paratuberculosis
gcgaacccugaccgugc

SEQ ID NO: 2848369 - RNA, 15 nt, Mycobacterium avium subsp. paratuberculosis
gcgaaccgcggcggc

SEQ ID NO: 2848370 - RNA, 16 nt, Mycobacterium avium subsp. paratuberculosis
gcgaaccgggcccgua

SEQ ID NO: 2848371 - RNA, 19 nt, Mycobacterium avium subsp. paratuberculosis
gcgaaccguucgucgucgc

SEQ ID NO: 2848372 - RNA, 21 nt, Mycobacterium avium subsp. paratuberculosis
gcgaacgacgucgagguguug

SEQ ID NO: 2848373 - RNA, 17 nt, Mycobacterium avium subsp. paratuberculosis
gcgaagucccacugccc

SEQ ID NO: 2848374 - RNA, 21 nt, Mycobacterium avium subsp. paratuberculosis
gcgaaguccgacgagucgacg

SEQ ID NO: 2848375 - RNA, 13 nt, Mycobacterium avium subsp. paratuberculosis
gcgaagucgccgc

SEQ ID NO: 2848376 - RNA, 14 nt, Mycobacterium avium subsp. paratuberculosis
gcgaagucgccgcc

SEQ ID NO: 2848377 - RNA, 15 nt, Mycobacterium avium subsp. paratuberculosis
gcgaagucgccgccc

SEQ ID NO: 2848378 - RNA, 17 nt, Mycobacterium avium subsp. paratuberculosis
gcgaagucgccggccag

SEQ ID NO: 2848379 - RNA, 18 nt, Mycobacterium avium subsp. paratuberculosis
gcgaagucgccggccagg

SEQ ID NO: 2848380 - RNA, 13 nt, Mycobacterium avium subsp. paratuberculosis
gcgaaguucggca

SEQ ID NO: 2848381 - RNA, 19 nt, Mycobacterium avium subsp. paratuberculosis
gcgaaguuggucaccacca

SEQ ID NO: 2848382 - RNA, 16 nt, Mycobacterium avium subsp. paratuberculosis
gcgaauaaggggguag

SEQ ID NO: 2848383 - RNA, 16 nt, Mycobacterium avium subsp. paratuberculosis
gcgaauacaccgucca

SEQ ID NO: 2848384 - RNA, 18 nt, Mycobacterium avium subsp. paratuberculosis
gcgaauaccagggcgagg

SEQ ID NO: 2848385 - RNA, 18 nt, Mycobacterium avium subsp. paratuberculosis
gcgaauaccaucaacccg

SEQ ID NO: 2848386 - RNA, 15 nt, Mycobacterium avium subsp. paratuberculosis
gcgaauacccgccca

SEQ ID NO: 2848387 - RNA, 17 nt, Mycobacterium avium subsp. paratuberculosis
gcgaauacccgcccagc

SEQ ID NO: 2848388 - RNA, 19 nt, Mycobacterium avium subsp. paratuberculosis
gcgaauacccgcccagcac

SEQ ID NO: 2848389 - RNA, 17 nt, Mycobacterium avium subsp. paratuberculosis
gcgaauauuucgccgau

SEQ ID NO: 2848390 - RNA, 13 nt, Mycobacterium avium subsp. paratuberculosis
gcgaaucagcagc

SEQ ID NO: 2848391 - RNA, 17 nt, Mycobacterium avium subsp. paratuberculosis
gcgaaucccggccucgu

SEQ ID NO: 2848392 - RNA, 17 nt, Mycobacterium avium subsp. paratuberculosis
gcgaauccgaccggcuc

SEQ ID NO: 2848393 - RNA, 18 nt, Mycobacterium avium subsp. paratuberculosis
gcgaauccgaccggcuca

SEQ ID NO: 2848394 - RNA, 17 nt, Mycobacterium avium subsp. paratuberculosis
gcgaauccgggccuccu

SEQ ID NO: 2848395 - RNA, 17 nt, Mycobacterium avium subsp. paratuberculosis
gcgaauccgggugucga

SEQ ID NO: 2848396 - RNA, 20 nt, Mycobacterium avium subsp. paratuberculosis
gcgaauccgggugucgacgc

SEQ ID NO: 2848397 - RNA, 21 nt, Mycobacterium avium subsp. paratuberculosis
gcgaauccgggugucgacgcc

SEQ ID NO: 2848398 - RNA, 21 nt, Mycobacterium avium subsp. paratuberculosis
gcgaauccggucaacgccgcg

SEQ ID NO: 2848399 - RNA, 22 nt, Mycobacterium avium subsp. paratuberculosis
gcgaauccggucaacgccgcgc

SEQ ID NO: 2848400 - RNA, 14 nt, Mycobacterium avium subsp. paratuberculosis
gcgaaucgaccggg

SEQ ID NO: 2848401 - RNA, 19 nt, Mycobacterium avium subsp. paratuberculosis
gcgaaucgauaacgcgcgc

SEQ ID NO: 2848402 - RNA, 16 nt, Mycobacterium avium subsp. paratuberculosis
gcgaaucggcgcacag

SEQ ID NO: 2848403 - RNA, 18 nt, Mycobacterium avium subsp. paratuberculosis
gcgaaucggcgcacagcu

SEQ ID NO: 2848404 - RNA, 14 nt, Mycobacterium avium subsp. paratuberculosis
gcgaaucggggucg

SEQ ID NO: 2848405 - RNA, 16 nt, Mycobacterium avium subsp. paratuberculosis
gcgaaucgguccggcg

SEQ ID NO: 2848406 - RNA, 17 nt, Mycobacterium avium subsp. paratuberculosis
gcgaaucgguccggcga

SEQ ID NO: 2848407 - RNA, 15 nt, Mycobacterium avium subsp. paratuberculosis
gcgaaucgucggcga

SEQ ID NO: 2848408 - RNA, 16 nt, Mycobacterium avium subsp. paratuberculosis
gcgaaucgucggcgau

SEQ ID NO: 2848409 - RNA, 16 nt, Mycobacterium avium subsp. paratuberculosis
gcgaaucugucgaugg

SEQ ID NO: 2848410 - RNA, 17 nt, Mycobacterium avium subsp. paratuberculosis
gcgaaucugucgauggc

SEQ ID NO: 2848411 - RNA, 13 nt, Mycobacterium avium subsp. paratuberculosis
gcgaaugacgcgc

SEQ ID NO: 2848412 - RNA, 14 nt, Mycobacterium avium subsp. paratuberculosis
gcgaaugucgacca

SEQ ID NO: 2848413 - RNA, 18 nt, Mycobacterium avium subsp. paratuberculosis
gcgaaugucgaccaccgg

SEQ ID NO: 2848414 - RNA, 17 nt, Mycobacterium avium subsp. paratuberculosis
gcgaauuccucagcgcc

SEQ ID NO: 2848415 - RNA, 18 nt, Mycobacterium avium subsp. paratuberculosis
gcgaauuccucagcgccc

SEQ ID NO: 2848416 - RNA, 21 nt, Mycobacterium avium subsp. paratuberculosis
gcgaauuccucagcgccccaa

SEQ ID NO: 2848417 - RNA, 14 nt, Mycobacterium avium subsp. paratuberculosis
gcgaauuguucugc

SEQ ID NO: 2848418 - RNA, 16 nt, Mycobacterium avium subsp. paratuberculosis
gcgacaaaggaggggc

SEQ ID NO: 2848419 - RNA, 19 nt, Mycobacterium avium subsp. paratuberculosis
gcgacaaaggaggggcgcg

SEQ ID NO: 2848420 - RNA, 15 nt, Mycobacterium avium subsp. paratuberculosis
gcgacaacagcacga

SEQ ID NO: 2848421 - RNA, 14 nt, Mycobacterium avium subsp. paratuberculosis
gcgacaacagcgcc

SEQ ID NO: 2848422 - RNA, 15 nt, Mycobacterium avium subsp. paratuberculosis
gcgacaacagcgccg

SEQ ID NO: 2848423 - RNA, 16 nt, Mycobacterium avium subsp. paratuberculosis
gcgacaacagcgccga

SEQ ID NO: 2848424 - RNA, 23 nt, Mycobacterium avium subsp. paratuberculosis
gcgacaacagcgccgagacgugg

SEQ ID NO: 2848425 - RNA, 15 nt, Mycobacterium avium subsp. paratuberculosis
gcgacaacggccccc

SEQ ID NO: 2848426 - RNA, 20 nt, Mycobacterium avium subsp. paratuberculosis
gcgacaacggcccccacgag

SEQ ID NO: 2848427 - RNA, 15 nt, Mycobacterium avium subsp. paratuberculosis
gcgacaacgggccgc

SEQ ID NO: 2848428 - RNA, 16 nt, Mycobacterium avium subsp. paratuberculosis
gcgacaacgggccgcc

SEQ ID NO: 2848429 - RNA, 15 nt, Mycobacterium avium subsp. paratuberculosis
gcgacaacguggugu

SEQ ID NO: 2848430 - RNA, 21 nt, Mycobacterium avium subsp. paratuberculosis
gcgacaaggucgaccgcgcac

SEQ ID NO: 2848431 - RNA, 20 nt, Mycobacterium avium subsp. paratuberculosis
gcgacaccacggugaacggg

SEQ ID NO: 2848432 - RNA, 14 nt, Mycobacterium avium subsp. paratuberculosis
gcgacaccaggucg

SEQ ID NO: 2848433 - RNA, 15 nt, Mycobacterium avium subsp. paratuberculosis
gcgacaccaggucga

SEQ ID NO: 2848434 - RNA, 17 nt, Mycobacterium avium subsp. paratuberculosis
gcgacacccagcggcgc

SEQ ID NO: 2848435 - RNA, 19 nt, Mycobacterium avium subsp. paratuberculosis
gcgacacccagcggcgcgg

SEQ ID NO: 2848436 - RNA, 22 nt, Mycobacterium avium subsp. paratuberculosis
gcgacaccccgcgagucaccgg

SEQ ID NO: 2848437 - RNA, 16 nt, Mycobacterium avium subsp. paratuberculosis
gcgacacccgcgacga

SEQ ID NO: 2848438 - RNA, 21 nt, Mycobacterium avium subsp. paratuberculosis
gcgacacccgcgacgacaccg

SEQ ID NO: 2848439 - RNA, 22 nt, Mycobacterium avium subsp. paratuberculosis
gcgacacccgcgacgacaccgu

SEQ ID NO: 2848440 - RNA, 13 nt, Mycobacterium avium subsp. paratuberculosis
gcgacaccgcaug

SEQ ID NO: 2848441 - RNA, 20 nt, Mycobacterium avium subsp. paratuberculosis
gcgacaccgcauggccggcg

SEQ ID NO: 2848442 - RNA, 14 nt, Mycobacterium avium subsp. paratuberculosis
gcgacaccgcgucc

SEQ ID NO: 2848443 - RNA, 15 nt, Mycobacterium avium subsp. paratuberculosis
gcgacaccgcguccu

SEQ ID NO: 2848444 - RNA, 12 nt, Mycobacterium avium subsp. paratuberculosis
gcgacaccggac

SEQ ID NO: 2848445 - RNA, 12 nt, Mycobacterium avium subsp. paratuberculosis
gcgacaccggcg

SEQ ID NO: 2848446 - RNA, 15 nt, Mycobacterium avium subsp. paratuberculosis
gcgacaccggcguga

SEQ ID NO: 2848447 - RNA, 21 nt, Mycobacterium avium subsp. paratuberculosis
gcgacaccugcucaccgagcu

SEQ ID NO: 2848448 - RNA, 22 nt, Mycobacterium avium subsp. paratuberculosis
gcgacacgccgacgauccgcgc

SEQ ID NO: 2848449 - RNA, 18 nt, Mycobacterium avium subsp. paratuberculosis
gcgacacggaaaccgcug

SEQ ID NO: 2848450 - RNA, 22 nt, Mycobacterium avium subsp. paratuberculosis
gcgacacggaaaccgcugcggc

SEQ ID NO: 2848451 - RNA, 20 nt, Mycobacterium avium subsp. paratuberculosis
gcgacacgucgacacgccgg

SEQ ID NO: 2848452 - RNA, 21 nt, Mycobacterium avium subsp. paratuberculosis
gcgacacgucgacacgccggc

SEQ ID NO: 2848453 - RNA, 19 nt, Mycobacterium avium subsp. paratuberculosis
gcgacagaaaucgcgcaga

SEQ ID NO: 2848454 - RNA, 14 nt, Mycobacterium avium subsp. paratuberculosis
gcgacagcacccgc

SEQ ID NO: 2848455 - RNA, 15 nt, Mycobacterium avium subsp. paratuberculosis
gcgacagcacccgcu

SEQ ID NO: 2848456 - RNA, 14 nt, Mycobacterium avium subsp. paratuberculosis
gcgacagcacgggc

SEQ ID NO: 2848457 - RNA, 15 nt, Mycobacterium avium subsp. paratuberculosis
gcgacagcacgggcg

SEQ ID NO: 2848458 - RNA, 18 nt, Mycobacterium avium subsp. paratuberculosis
gcgaccagcgcgccggcc

SEQ ID NO: 2848459 - RNA, 19 nt, Mycobacterium avium subsp. paratuberculosis
gcgaccagcggcagcagca

SEQ ID NO: 2848460 - RNA, 22 nt, Mycobacterium avium subsp. paratuberculosis
gcgaccagcggcagcagcacca

SEQ ID NO: 2848461 - RNA, 15 nt, Mycobacterium avium subsp. paratuberculosis
gcgaccagcucgggc

SEQ ID NO: 2848462 - RNA, 16 nt, Mycobacterium avium subsp. paratuberculosis
gcgaccaguagaagug

SEQ ID NO: 2848463 - RNA, 20 nt, Mycobacterium avium subsp. paratuberculosis
gcgaccaguagaaguggccg

SEQ ID NO: 2848464 - RNA, 17 nt, Mycobacterium avium subsp. paratuberculosis
gcgaccaguaggccagc

SEQ ID NO: 2848465 - RNA, 20 nt, Mycobacterium avium subsp. paratuberculosis
gcgaccaguaggccagcauc

SEQ ID NO: 2848466 - RNA, 15 nt, Mycobacterium avium subsp. paratuberculosis
gcgaccagucggcgu

SEQ ID NO: 2848467 - RNA, 22 nt, Mycobacterium avium subsp. paratuberculosis
gcgaccagugcaccucgacgaa

SEQ ID NO: 2848468 - RNA, 15 nt, Mycobacterium avium subsp. paratuberculosis
gcgaccaucagcccg

SEQ ID NO: 2848469 - RNA, 16 nt, Mycobacterium avium subsp. paratuberculosis
gcgaccaucagcccgg

SEQ ID NO: 2848470 - RNA, 16 nt, Mycobacterium avium subsp. paratuberculosis
gcgaccaucagccugc

SEQ ID NO: 2848471 - RNA, 21 nt, Mycobacterium avium subsp. paratuberculosis
gcgaccaucagccugcgguga

SEQ ID NO: 2848472 - RNA, 12 nt, Mycobacterium avium subsp. paratuberculosis
gcgaccauccac

SEQ ID NO: 2848473 - RNA, 21 nt, Mycobacterium avium subsp. paratuberculosis
gcgaccauccacucgggccag

SEQ ID NO: 2848474 - RNA, 22 nt, Mycobacterium avium subsp. paratuberculosis
gcgaccauccacucgggccagc

SEQ ID NO: 2848475 - RNA, 16 nt, Mycobacterium avium subsp. paratuberculosis
gcgaccaugcccagca

SEQ ID NO: 2848476 - RNA, 17 nt, Mycobacterium avium subsp. paratuberculosis
gcgaccaugcccagcag

SEQ ID NO: 2848477 - RNA, 18 nt, Mycobacterium avium subsp. paratuberculosis
gcgaccaugcccagcagu

SEQ ID NO: 2848478 - RNA, 23 nt, Mycobacterium avium subsp. paratuberculosis
gcgaccaugcccagcaguccggc

SEQ ID NO: 2848479 - RNA, 15 nt, Mycobacterium avium subsp. paratuberculosis
gcgaccaugcccggc

SEQ ID NO: 2848480 - RNA, 17 nt, Mycobacterium avium subsp. paratuberculosis
gcgaccaugcccggcgc

SEQ ID NO: 2848481 - RNA, 13 nt, Mycobacterium avium subsp. paratuberculosis
gcgaccaugccgc

SEQ ID NO: 2848482 - RNA, 14 nt, Mycobacterium avium subsp. paratuberculosis
gcgaccaugccgcg

SEQ ID NO: 2848483 - RNA, 16 nt, Mycobacterium avium subsp. paratuberculosis
gcgaccaugccgcggg

SEQ ID NO: 2848484 - RNA, 18 nt, Mycobacterium avium subsp. paratuberculosis
gcgaccaugccgcgggcc

SEQ ID NO: 2848485 - RNA, 19 nt, Mycobacterium avium subsp. paratuberculosis
gcgaccaugccgcgggcca

SEQ ID NO: 2848486 - RNA, 20 nt, Mycobacterium avium subsp. paratuberculosis
gcgaccaugccgcgggccag

SEQ ID NO: 2848487 - RNA, 13 nt, Mycobacterium avium subsp. paratuberculosis
gcgacccaccguc

SEQ ID NO: 2848488 - RNA, 18 nt, Mycobacterium avium subsp. paratuberculosis
gcgacccaccgucgaaga

SEQ ID NO: 2848489 - RNA, 20 nt, Mycobacterium avium subsp. paratuberculosis
gcgacccagacuugggcagc

SEQ ID NO: 2848490 - RNA, 15 nt, Mycobacterium avium subsp. paratuberculosis
gcgacccaggccgcc

SEQ ID NO: 2848491 - RNA, 16 nt, Mycobacterium avium subsp. paratuberculosis
gcgacccaggccgccg

SEQ ID NO: 2848492 - RNA, 18 nt, Mycobacterium avium subsp. paratuberculosis
gcgacccaggccgccgcc

SEQ ID NO: 2848493 - RNA, 19 nt, Mycobacterium avium subsp. paratuberculosis
gcgacccaggccgccgcca

SEQ ID NO: 2848494 - RNA, 22 nt, Mycobacterium avium subsp. paratuberculosis
gcgacccaggccgccgccaccg

SEQ ID NO: 2848495 - RNA, 23 nt, Mycobacterium avium subsp. paratuberculosis
gcgacccaggccgccgccaccgu

SEQ ID NO: 2848496 - RNA, 14 nt, Mycobacterium avium subsp. paratuberculosis
gcgaccccgccguc

SEQ ID NO: 2848497 - RNA, 13 nt, Mycobacterium avium subsp. paratuberculosis
gcgaccccggcca

SEQ ID NO: 2848498 - RNA, 14 nt, Mycobacterium avium subsp. paratuberculosis
gcgaccccggccag

SEQ ID NO: 2848499 - RNA, 13 nt, Mycobacterium avium subsp. paratuberculosis
gcgaccccguucg

SEQ ID NO: 2848500 - RNA, 17 nt, Mycobacterium avium subsp. paratuberculosis
gcgaccccguucgccga

SEQ ID NO: 2848501 - RNA, 18 nt, Mycobacterium avium subsp. paratuberculosis
gcgaccccuacgggcgca

SEQ ID NO: 2848502 - RNA, 20 nt, Mycobacterium avium subsp. paratuberculosis
gcgaccccuacgggcgcacc

SEQ ID NO: 2848503 - RNA, 22 nt, Mycobacterium avium subsp. paratuberculosis
gcgaccccuacgggcgcaccgc

SEQ ID NO: 2848504 - RNA, 23 nt, Mycobacterium avium subsp. paratuberculosis
gcgaccccuacgggcgcaccgcg

SEQ ID NO: 2848505 - RNA, 17 nt, Mycobacterium avium subsp. paratuberculosis
gcgaccccuccaacggc

SEQ ID NO: 2848506 - RNA, 20 nt, Mycobacterium avium subsp. paratuberculosis
gcgaccccuccaacggccgc

SEQ ID NO: 2848507 - RNA, 21 nt, Mycobacterium avium subsp. paratuberculosis
gcgaccccuccaacggccgca

SEQ ID NO: 2848508 - RNA, 18 nt, Mycobacterium avium subsp. paratuberculosis
gcgacccgcacgaugccg

SEQ ID NO: 2848509 - RNA, 21 nt, Mycobacterium avium subsp. paratuberculosis
gcgacccgcacgaugccgcgc

SEQ ID NO: 2848510 - RNA, 17 nt, Mycobacterium avium subsp. paratuberculosis
gcgacccgcucgacgcg

SEQ ID NO: 2848511 - RNA, 18 nt, Mycobacterium avium subsp. paratuberculosis
gcgacccgcucgacgcgc

SEQ ID NO: 2848512 - RNA, 21 nt, Mycobacterium avium subsp. paratuberculosis
gcgacccgcucgacgcgcacc

SEQ ID NO: 2848513 - RNA, 19 nt, Mycobacterium avium subsp. paratuberculosis
gcgacccgcuucgcccggc

SEQ ID NO: 2848514 - RNA, 16 nt, Mycobacterium avium subsp. paratuberculosis
gcgacccggccgagcg

SEQ ID NO: 2848515 - RNA, 22 nt, Mycobacterium avium subsp. paratuberculosis
gcgacccggccgagcgcgccga

SEQ ID NO: 2848516 - RNA, 16 nt, Mycobacterium avium subsp. paratuberculosis
gcgacccgggccgcca

SEQ ID NO: 2848517 - RNA, 19 nt, Mycobacterium avium subsp. paratuberculosis
gcgaccgaggucgacgccc

SEQ ID NO: 2848518 - RNA, 22 nt, Mycobacterium avium subsp. paratuberculosis
gcgaccgcagcaggcggacggc

SEQ ID NO: 2848519 - RNA, 15 nt, Mycobacterium avium subsp. paratuberculosis
gcgaccgcaggucga

SEQ ID NO: 2848520 - RNA, 17 nt, Mycobacterium avium subsp. paratuberculosis
gcgaccgcaggucgaug

SEQ ID NO: 2848521 - RNA, 19 nt, Mycobacterium avium subsp. paratuberculosis
gcgaccgcaggucgauggc

SEQ ID NO: 2848522 - RNA, 14 nt, Mycobacterium avium subsp. paratuberculosis
gcgaccgcccgggc

SEQ ID NO: 2848523 - RNA, 16 nt, Mycobacterium avium subsp. paratuberculosis
gcgaccgcccgggcca

SEQ ID NO: 2848524 - RNA, 17 nt, Mycobacterium avium subsp. paratuberculosis
gcgaccgcccgggccag

SEQ ID NO: 2848525 - RNA, 20 nt, Mycobacterium avium subsp. paratuberculosis
gcgaccgcccggggcgcgga

SEQ ID NO: 2848526 - RNA, 23 nt, Mycobacterium avium subsp. paratuberculosis
gcgaccgcccggggcgcggaccg

SEQ ID NO: 2848527 - RNA, 12 nt, Mycobacterium avium subsp. paratuberculosis
gcgaccgccgcc

SEQ ID NO: 2848528 - RNA, 14 nt, Mycobacterium avium subsp. paratuberculosis
gcgaccgccgccgc

SEQ ID NO: 2848529 - RNA, 15 nt, Mycobacterium avium subsp. paratuberculosis
gcgaccgccgccgcg

SEQ ID NO: 2848530 - RNA, 18 nt, Mycobacterium avium subsp. paratuberculosis
gcgaccgccgccgcgacc

SEQ ID NO: 2848531 - RNA, 22 nt, Mycobacterium avium subsp. paratuberculosis
gcgaccgccgcguacagccagc

SEQ ID NO: 2848532 - RNA, 13 nt, Mycobacterium avium subsp. paratuberculosis
gcgaccgccgcua

SEQ ID NO: 2848533 - RNA, 13 nt, Mycobacterium avium subsp. paratuberculosis
gcgaccgccggac

SEQ ID NO: 2848534 - RNA, 22 nt, Mycobacterium avium subsp. paratuberculosis
gcgaccgccggacaccaccgcg

SEQ ID NO: 2848535 - RNA, 23 nt, Mycobacterium avium subsp. paratuberculosis
gcgaccgccggacaccaccgcgg

SEQ ID NO: 2848536 - RNA, 16 nt, Mycobacterium avium subsp. paratuberculosis
gcgaccgccucgucgg

SEQ ID NO: 2848537 - RNA, 13 nt, Mycobacterium avium subsp. paratuberculosis
gcgaccgccuugu

SEQ ID NO: 2848538 - RNA, 23 nt, Mycobacterium avium subsp. paratuberculosis
gcgaccgccuugucggcgauguc

SEQ ID NO: 2848539 - RNA, 19 nt, Mycobacterium avium subsp. paratuberculosis
gcgaccgcgacgaucacgg

SEQ ID NO: 2848540 - RNA, 14 nt, Mycobacterium avium subsp. paratuberculosis
gcgaccgcgacggu

SEQ ID NO: 2848541 - RNA, 17 nt, Mycobacterium avium subsp. paratuberculosis
gcgaccgcgacggugga

SEQ ID NO: 2848542 - RNA, 19 nt, Mycobacterium avium subsp. paratuberculosis
gcgacgaucagcagccggg

SEQ ID NO: 2848543 - RNA, 20 nt, Mycobacterium avium subsp. paratuberculosis
gcgacgaucagcagccgggc

SEQ ID NO: 2848544 - RNA, 21 nt, Mycobacterium avium subsp. paratuberculosis
gcgacgaucagcagccgggcc

SEQ ID NO: 2848545 - RNA, 18 nt, Mycobacterium avium subsp. paratuberculosis
gcgacgaucgcgacggcc

SEQ ID NO: 2848546 - RNA, 21 nt, Mycobacterium avium subsp. paratuberculosis
gcgacgaugaagacccgccgg

SEQ ID NO: 2848547 - RNA, 21 nt, Mycobacterium avium subsp. paratuberculosis
gcgacgaugccggccgggacg

SEQ ID NO: 2848548 - RNA, 15 nt, Mycobacterium avium subsp. paratuberculosis
gcgacgaugccggcg

SEQ ID NO: 2848549 - RNA, 19 nt, Mycobacterium avium subsp. paratuberculosis
gcgacgaugccggcgucgu

SEQ ID NO: 2848550 - RNA, 19 nt, Mycobacterium avium subsp. paratuberculosis
gcgacgaugcggccguugg

SEQ ID NO: 2848551 - RNA, 16 nt, Mycobacterium avium subsp. paratuberculosis
gcgacgauggccaggc

SEQ ID NO: 2848552 - RNA, 19 nt, Mycobacterium avium subsp. paratuberculosis
gcgacgaugucgacccgcg

SEQ ID NO: 2848553 - RNA, 20 nt, Mycobacterium avium subsp. paratuberculosis
gcgacgaugucgacccgcgg

SEQ ID NO: 2848554 - RNA, 15 nt, Mycobacterium avium subsp. paratuberculosis
gcgacgcaccucggc

SEQ ID NO: 2848555 - RNA, 17 nt, Mycobacterium avium subsp. paratuberculosis
gcgacgcaccucggccg

SEQ ID NO: 2848556 - RNA, 20 nt, Mycobacterium avium subsp. paratuberculosis
gcgacgcaccucggccgggu

SEQ ID NO: 2848557 - RNA, 21 nt, Mycobacterium avium subsp. paratuberculosis
gcgacgcacgaaaccgcgugg

SEQ ID NO: 2848558 - RNA, 21 nt, Mycobacterium avium subsp. paratuberculosis
gcgacgccacggggcugcggg

SEQ ID NO: 2848559 - RNA, 23 nt, Mycobacterium avium subsp. paratuberculosis
gcgacgccacggggcugcgggcc

SEQ ID NO: 2848560 - RNA, 14 nt, Mycobacterium avium subsp. paratuberculosis
gcgacgccagcacc

SEQ ID NO: 2848561 - RNA, 12 nt, Mycobacterium avium subsp. paratuberculosis
gcgacgccagcg

SEQ ID NO: 2848562 - RNA, 14 nt, Mycobacterium avium subsp. paratuberculosis
gcgacgccagcggc

SEQ ID NO: 2848563 - RNA, 15 nt, Mycobacterium avium subsp. paratuberculosis
gcgacgccagcggca

SEQ ID NO: 2848564 - RNA, 17 nt, Mycobacterium avium subsp. paratuberculosis
gcgacgccagcggcagc

SEQ ID NO: 2848565 - RNA, 18 nt, Mycobacterium avium subsp. paratuberculosis
gcgacgccagcggcagcg

SEQ ID NO: 2848566 - RNA, 23 nt, Mycobacterium avium subsp. paratuberculosis
gcgacgccagcggcagcgccagc

SEQ ID NO: 2848567 - RNA, 18 nt, Mycobacterium avium subsp. paratuberculosis
gcgacgccaugucgaugu

SEQ ID NO: 2848568 - RNA, 19 nt, Mycobacterium avium subsp. paratuberculosis
gcgacgccaugucgauguc

SEQ ID NO: 2848569 - RNA, 19 nt, Mycobacterium avium subsp. paratuberculosis
gcgacgcccagaacgacgc

SEQ ID NO: 2848570 - RNA, 13 nt, Mycobacterium avium subsp. paratuberculosis
gcgacgccgccgc

SEQ ID NO: 2848571 - RNA, 14 nt, Mycobacterium avium subsp. paratuberculosis
gcgacgccgccgcc

SEQ ID NO: 2848572 - RNA, 13 nt, Mycobacterium avium subsp. paratuberculosis
gcgacgccgccgu

SEQ ID NO: 2848573 - RNA, 15 nt, Mycobacterium avium subsp. paratuberculosis
gcgacgccgccgucg

SEQ ID NO: 2848574 - RNA, 19 nt, Mycobacterium avium subsp. paratuberculosis
gcgacgccgccgucguagc

SEQ ID NO: 2848575 - RNA, 21 nt, Mycobacterium avium subsp. paratuberculosis
gcgacgccgcgcagcggggcg

SEQ ID NO: 2848576 - RNA, 14 nt, Mycobacterium avium subsp. paratuberculosis
gcgacgccgcgcug

SEQ ID NO: 2848577 - RNA, 18 nt, Mycobacterium avium subsp. paratuberculosis
gcgacgccgcgcuggccg

SEQ ID NO: 2848578 - RNA, 21 nt, Mycobacterium avium subsp. paratuberculosis
gcgacgccgcgcuggccgggu

SEQ ID NO: 2848579 - RNA, 22 nt, Mycobacterium avium subsp. paratuberculosis
gcgacgccgcggaagccccagg

SEQ ID NO: 2848580 - RNA, 23 nt, Mycobacterium avium subsp. paratuberculosis
gcgacgccgcggaagccccaggc

SEQ ID NO: 2848581 - RNA, 14 nt, Mycobacterium avium subsp. paratuberculosis
gcgacgccggcgag

SEQ ID NO: 2848582 - RNA, 13 nt, Mycobacterium avium subsp. paratuberculosis
gcgacgccgucgg

SEQ ID NO: 2848583 - RNA, 15 nt, Mycobacterium avium subsp. paratuberculosis
gcgacgccgucgggg

SEQ ID NO: 2848584 - RNA, 23 nt, Mycobacterium avium subsp. paratuberculosis
gcgacgcgcaugcccuggacgag

SEQ ID NO: 2848585 - RNA, 12 nt, Mycobacterium avium subsp. paratuberculosis
gcgacgcgcggu

SEQ ID NO: 2848586 - RNA, 14 nt, Mycobacterium avium subsp. paratuberculosis
gcgacgcgcucggc

SEQ ID NO: 2848587 - RNA, 16 nt, Mycobacterium avium subsp. paratuberculosis
gcgacgcgcucggcga

SEQ ID NO: 2848588 - RNA, 17 nt, Mycobacterium avium subsp. paratuberculosis
gcgacgcgcucggcgac

SEQ ID NO: 2848589 - RNA, 13 nt, Mycobacterium avium subsp. paratuberculosis
gcgacgcggcggg

SEQ ID NO: 2848590 - RNA, 11 nt, Mycobacterium avium subsp. paratuberculosis
gcgacgcggcu

SEQ ID NO: 2848591 - RNA, 14 nt, Mycobacterium avium subsp. paratuberculosis
gcgacgcggcucgc

SEQ ID NO: 2848592 - RNA, 17 nt, Mycobacterium avium subsp. paratuberculosis
gcgacgcgggauugccg

SEQ ID NO: 2848593 - RNA, 19 nt, Mycobacterium avium subsp. paratuberculosis
gcgacgcggugagcgcgcc

SEQ ID NO: 2848594 - RNA, 23 nt, Mycobacterium avium subsp. paratuberculosis
gcgacgcggugagcgcgccggcc

SEQ ID NO: 2848595 - RNA, 14 nt, Mycobacterium avium subsp. paratuberculosis
gcgacgcucaggcg

SEQ ID NO: 2848596 - RNA, 18 nt, Mycobacterium avium subsp. paratuberculosis
gcgacgcucaggcgucca

SEQ ID NO: 2848597 - RNA, 20 nt, Mycobacterium avium subsp. paratuberculosis
gcgacgcucaggcguccagc

SEQ ID NO: 2848598 - RNA, 18 nt, Mycobacterium avium subsp. paratuberculosis
gcgacgcugaacagcagc

SEQ ID NO: 2848599 - RNA, 14 nt, Mycobacterium avium subsp. paratuberculosis
gcgacgcugagcgc

SEQ ID NO: 2848600 - RNA, 17 nt, Mycobacterium avium subsp. paratuberculosis
gcgacgcugagcgccag

SEQ ID NO: 2848601 - RNA, 20 nt, Mycobacterium avium subsp. paratuberculosis
gcgacgcugagcgccaggcc

SEQ ID NO: 2848602 - RNA, 13 nt, Mycobacterium avium subsp. paratuberculosis
gcgacgcugccgg

SEQ ID NO: 2848603 - RNA, 15 nt, Mycobacterium avium subsp. paratuberculosis
gcgacgcugccgggg

SEQ ID NO: 2848604 - RNA, 17 nt, Mycobacterium avium subsp. paratuberculosis
gcgacgcugccggggcg

SEQ ID NO: 2848605 - RNA, 21 nt, Mycobacterium avium subsp. paratuberculosis
gcgacgcugccggggcgcagc

SEQ ID NO: 2848606 - RNA, 14 nt, Mycobacterium avium subsp. paratuberculosis
gcgacgcugccggu

SEQ ID NO: 2848607 - RNA, 16 nt, Mycobacterium avium subsp. paratuberculosis
gcgacgcugguggccu

SEQ ID NO: 2848608 - RNA, 16 nt, Mycobacterium avium subsp. paratuberculosis
gcgacgcugugcucgg

SEQ ID NO: 2848609 - RNA, 15 nt, Mycobacterium avium subsp. paratuberculosis
gcgacggaucggccg

SEQ ID NO: 2848610 - RNA, 17 nt, Mycobacterium avium subsp. paratuberculosis
gcgacggaucggccgcg

SEQ ID NO: 2848611 - RNA, 20 nt, Mycobacterium avium subsp. paratuberculosis
gcgacggaucggccgcgucg

SEQ ID NO: 2848612 - RNA, 22 nt, Mycobacterium avium subsp. paratuberculosis
gcgacggaucggccgcgucggg

SEQ ID NO: 2848613 - RNA, 16 nt, Mycobacterium avium subsp. paratuberculosis
gcgacggcaauccggc

SEQ ID NO: 2848614 - RNA, 15 nt, Mycobacterium avium subsp. paratuberculosis
gcgacggcaccgccg

SEQ ID NO: 2848615 - RNA, 16 nt, Mycobacterium avium subsp. paratuberculosis
gcgacggcaccgccgg

SEQ ID NO: 2848616 - RNA, 21 nt, Mycobacterium avium subsp. paratuberculosis
gcgacggcaccgccggcggcc

SEQ ID NO: 2848617 - RNA, 13 nt, Mycobacterium avium subsp. paratuberculosis
gcgacggcagcac

SEQ ID NO: 2848618 - RNA, 16 nt, Mycobacterium avium subsp. paratuberculosis
gcgacggcagcaccuc

SEQ ID NO: 2848619 - RNA, 21 nt, Mycobacterium avium subsp. paratuberculosis
gcgacggcagcgcgauccggg

SEQ ID NO: 2848620 - RNA, 15 nt, Mycobacterium avium subsp. paratuberculosis
gcgacggcaggucgg

SEQ ID NO: 2848621 - RNA, 16 nt, Mycobacterium avium subsp. paratuberculosis
gcgacggcaggucggu

SEQ ID NO: 2848622 - RNA, 18 nt, Mycobacterium avium subsp. paratuberculosis
gcgacggcaggucggugc

SEQ ID NO: 2848623 - RNA, 16 nt, Mycobacterium avium subsp. paratuberculosis
gcgacggccagaccgc

SEQ ID NO: 2848624 - RNA, 12 nt, Mycobacterium avium subsp. paratuberculosis
gcgacggccagc

SEQ ID NO: 2848625 - RNA, 14 nt, Mycobacterium avium subsp. paratuberculosis
gcgacggccagcgc

SEQ ID NO: 2848626 - RNA, 12 nt, Mycobacterium avium subsp. paratuberculosis
gcgacggcccgc

SEQ ID NO: 2848627 - RNA, 17 nt, Mycobacterium avium subsp. paratuberculosis
gcgacgucgccggccug

SEQ ID NO: 2848628 - RNA, 18 nt, Mycobacterium avium subsp. paratuberculosis
gcgacgucgccggccugc

SEQ ID NO: 2848629 - RNA, 21 nt, Mycobacterium avium subsp. paratuberculosis
gcgacgucgccggccugcccg

SEQ ID NO: 2848630 - RNA, 14 nt, Mycobacterium avium subsp. paratuberculosis
gcgacgucggagau

SEQ ID NO: 2848631 - RNA, 19 nt, Mycobacterium avium subsp. paratuberculosis
gcgacgucggggucgucgc

SEQ ID NO: 2848632 - RNA, 22 nt, Mycobacterium avium subsp. paratuberculosis
gcgacgucgguguagucggcga

SEQ ID NO: 2848633 - RNA, 13 nt, Mycobacterium avium subsp. paratuberculosis
gcgacgucgucgc

SEQ ID NO: 2848634 - RNA, 18 nt, Mycobacterium avium subsp. paratuberculosis
gcgacgucgucgcccacc

SEQ ID NO: 2848635 - RNA, 21 nt, Mycobacterium avium subsp. paratuberculosis
gcgacgucgucgcccacccgc

SEQ ID NO: 2848636 - RNA, 12 nt, Mycobacterium avium subsp. paratuberculosis
gcgacgucgugc

SEQ ID NO: 2848637 - RNA, 16 nt, Mycobacterium avium subsp. paratuberculosis
gcgacgucgugcacgc

SEQ ID NO: 2848638 - RNA, 19 nt, Mycobacterium avium subsp. paratuberculosis
gcgacgucgugcacgccgu

SEQ ID NO: 2848639 - RNA, 18 nt, Mycobacterium avium subsp. paratuberculosis
gcgacgucguggcccgga

SEQ ID NO: 2848640 - RNA, 19 nt, Mycobacterium avium subsp. paratuberculosis
gcgacgucguggcccggau

SEQ ID NO: 2848641 - RNA, 14 nt, Mycobacterium avium subsp. paratuberculosis
gcgacgucugcggc

SEQ ID NO: 2848642 - RNA, 15 nt, Mycobacterium avium subsp. paratuberculosis
gcgacgucugcggcu

SEQ ID NO: 2848643 - RNA, 18 nt, Mycobacterium avium subsp. paratuberculosis
gcgacgucugcggcucgg

SEQ ID NO: 2848644 - RNA, 22 nt, Mycobacterium avium subsp. paratuberculosis
gcgacgucugcggcucggcgcu

SEQ ID NO: 2848645 - RNA, 17 nt, Mycobacterium avium subsp. paratuberculosis
gcgacgugaucggcggc

SEQ ID NO: 2848646 - RNA, 19 nt, Mycobacterium avium subsp. paratuberculosis
gcgacgugaucggcggccu

SEQ ID NO: 2848647 - RNA, 19 nt, Mycobacterium avium subsp. paratuberculosis
gcgacgugauggucgucgu

SEQ ID NO: 2848648 - RNA, 21 nt, Mycobacterium avium subsp. paratuberculosis
gcgacgugauggucgucgugg

SEQ ID NO: 2848649 - RNA, 22 nt, Mycobacterium avium subsp. paratuberculosis
gcgacgugauggucgucguggu

SEQ ID NO: 2848650 - RNA, 13 nt, Mycobacterium avium subsp. paratuberculosis
gcgacgugccggc

SEQ ID NO: 2848651 - RNA, 14 nt, Mycobacterium avium subsp. paratuberculosis
gcgacgugccggcg

SEQ ID NO: 2848652 - RNA, 15 nt, Mycobacterium avium subsp. paratuberculosis
gcgacgugccggcga

SEQ ID NO: 2848653 - RNA, 15 nt, Mycobacterium avium subsp. paratuberculosis
gcgacgugccggcgg

SEQ ID NO: 2848654 - RNA, 16 nt, Mycobacterium avium subsp. paratuberculosis
gcgacgugccggcggc

SEQ ID NO: 2848655 - RNA, 20 nt, Mycobacterium avium subsp. paratuberculosis
gcgacgugccggcggcaggu

SEQ ID NO: 2848656 - RNA, 19 nt, Mycobacterium avium subsp. paratuberculosis
gcgacuccagcagcgccag

SEQ ID NO: 2848657 - RNA, 20 nt, Mycobacterium avium subsp. paratuberculosis
gcgacuccagcagcgccagc

SEQ ID NO: 2848658 - RNA, 17 nt, Mycobacterium avium subsp. paratuberculosis
gcgacuccagcgcgauc

SEQ ID NO: 2848659 - RNA, 13 nt, Mycobacterium avium subsp. paratuberculosis
gcgacuccggcgc

SEQ ID NO: 2848660 - RNA, 20 nt, Mycobacterium avium subsp. paratuberculosis
gcgacuccggcgccggucag

SEQ ID NO: 2848661 - RNA, 21 nt, Mycobacterium avium subsp. paratuberculosis
gcgacuccggcgccggucagc

SEQ ID NO: 2848662 - RNA, 13 nt, Mycobacterium avium subsp. paratuberculosis
gcgacuccugacg

SEQ ID NO: 2848663 - RNA, 14 nt, Mycobacterium avium subsp. paratuberculosis
gcgacuccugacgc

SEQ ID NO: 2848664 - RNA, 21 nt, Mycobacterium avium subsp. paratuberculosis
gcgacuccugacgcaccucgc

SEQ ID NO: 2848665 - RNA, 17 nt, Mycobacterium avium subsp. paratuberculosis
gcgacucgaccccgccc

SEQ ID NO: 2848666 - RNA, 14 nt, Mycobacterium avium subsp. paratuberculosis
gcgacucggccagg

SEQ ID NO: 2848667 - RNA, 14 nt, Mycobacterium avium subsp. paratuberculosis
gcgacucguuggcc

SEQ ID NO: 2848668 - RNA, 17 nt, Mycobacterium avium subsp. paratuberculosis
gcgacucguuggccggc

SEQ ID NO: 2848669 - RNA, 13 nt, Mycobacterium avium subsp. paratuberculosis
gcgacugcacccg

SEQ ID NO: 2848670 - RNA, 23 nt, Mycobacterium avium subsp. paratuberculosis
gcgacugcacccgaacggaccgg

SEQ ID NO: 2848671 - RNA, 20 nt, Mycobacterium avium subsp. paratuberculosis
gcgacugcaggugacggaug

SEQ ID NO: 2848672 - RNA, 18 nt, Mycobacterium avium subsp. paratuberculosis
gcgacugcgugcugggca

SEQ ID NO: 2848673 - RNA, 19 nt, Mycobacterium avium subsp. paratuberculosis
gcgacugggcgcccacccg

SEQ ID NO: 2848674 - RNA, 20 nt, Mycobacterium avium subsp. paratuberculosis
gcgacugggugcucccgcca

SEQ ID NO: 2848675 - RNA, 15 nt, Mycobacterium avium subsp. paratuberculosis
gcgacugucggcgcc

SEQ ID NO: 2848676 - RNA, 19 nt, Mycobacterium avium subsp. paratuberculosis
gcgacugucggcucgcccg

SEQ ID NO: 2848677 - RNA, 23 nt, Mycobacterium avium subsp. paratuberculosis
gcgacugucggcucgcccgcgac

SEQ ID NO: 2848678 - RNA, 23 nt, Mycobacterium avium subsp. paratuberculosis
gcgacuucguugguggucgacgc

SEQ ID NO: 2848679 - RNA, 14 nt, Mycobacterium avium subsp. paratuberculosis
gcgacuucuacggc

SEQ ID NO: 2848680 - RNA, 15 nt, Mycobacterium avium subsp. paratuberculosis
gcgacuucuacggcg

SEQ ID NO: 2848681 - RNA, 22 nt, Mycobacterium avium subsp. paratuberculosis
gcgacuucuacggcgggccggc

SEQ ID NO: 2848682 - RNA, 23 nt, Mycobacterium avium subsp. paratuberculosis
gcgacuucuacggcgggccggcg

SEQ ID NO: 2848683 - RNA, 17 nt, Mycobacterium avium subsp. paratuberculosis
gcgacuucuucgccggc

SEQ ID NO: 2848684 - RNA, 18 nt, Mycobacterium avium subsp. paratuberculosis
gcgacuugaccagcagcu

SEQ ID NO: 2848685 - RNA, 21 nt, Mycobacterium avium subsp. paratuberculosis
gcgacuugaccagcagcugga

SEQ ID NO: 2848686 - RNA, 15 nt, Mycobacterium avium subsp. paratuberculosis
gcgacuugccgccgg

SEQ ID NO: 2848687 - RNA, 13 nt, Mycobacterium avium subsp. paratuberculosis
gcgacuugcgcgc

SEQ ID NO: 2848688 - RNA, 20 nt, Mycobacterium avium subsp. paratuberculosis
gcgacuugcgcgccgugacg

SEQ ID NO: 2848689 - RNA, 14 nt, Mycobacterium avium subsp. paratuberculosis
gcgacuugguggcc

SEQ ID NO: 2848690 - RNA, 18 nt, Mycobacterium avium subsp. paratuberculosis
gcgacuugguggccagca

SEQ ID NO: 2848691 - RNA, 19 nt, Mycobacterium avium subsp. paratuberculosis
gcgacuugguggccagcac

SEQ ID NO: 2848692 - RNA, 20 nt, Mycobacterium avium subsp. paratuberculosis
gcgacuugguggccagcacc

SEQ ID NO: 2848693 - RNA, 21 nt, Mycobacterium avium subsp. paratuberculosis
gcgacuugguggccagcacca

SEQ ID NO: 2848694 - RNA, 23 nt, Mycobacterium avium subsp. paratuberculosis
gcgacuugguggccagcaccacg

SEQ ID NO: 2848695 - RNA, 17 nt, Mycobacterium avium subsp. paratuberculosis
gcgagaaaaucgcccgc

SEQ ID NO: 2848696 - RNA, 16 nt, Mycobacterium avium subsp. paratuberculosis
gcgagaaccggcgcag

SEQ ID NO: 2848697 - RNA, 15 nt, Mycobacterium avium subsp. paratuberculosis
gcgagaagucgccga

SEQ ID NO: 2848698 - RNA, 17 nt, Mycobacterium avium subsp. paratuberculosis
gcgagaagucgccgacg

SEQ ID NO: 2848699 - RNA, 15 nt, Mycobacterium avium subsp. paratuberculosis
gcgagaccgucggug

SEQ ID NO: 2848700 - RNA, 15 nt, Mycobacterium avium subsp. paratuberculosis
gcgagaccucccggc

SEQ ID NO: 2848701 - RNA, 16 nt, Mycobacterium avium subsp. paratuberculosis
gcgagaccucccggcg

SEQ ID NO: 2848702 - RNA, 17 nt, Mycobacterium avium subsp. paratuberculosis
gcgagaccucccggcgc

SEQ ID NO: 2848703 - RNA, 18 nt, Mycobacterium avium subsp. paratuberculosis
gcgagaccucccggcgcc

SEQ ID NO: 2848704 - RNA, 16 nt, Mycobacterium avium subsp. paratuberculosis
gcgagacgagccgccg

SEQ ID NO: 2848705 - RNA, 17 nt, Mycobacterium avium subsp. paratuberculosis
gcgagacgagccgccgc

SEQ ID NO: 2848706 - RNA, 18 nt, Mycobacterium avium subsp. paratuberculosis
gcgagaguaucgccacgc

SEQ ID NO: 2848707 - RNA, 17 nt, Mycobacterium avium subsp. paratuberculosis
gcgagaucaacaccgcg

SEQ ID NO: 2848708 - RNA, 20 nt, Mycobacterium avium subsp. paratuberculosis
gcgagaucccgguucccggc

SEQ ID NO: 2848709 - RNA, 18 nt, Mycobacterium avium subsp. paratuberculosis
gcgagaugaucagccgcc

SEQ ID NO: 2848710 - RNA, 19 nt, Mycobacterium avium subsp. paratuberculosis
gcgagaugaucagccgccc

SEQ ID NO: 2848711 - RNA, 14 nt, Mycobacterium avium subsp. paratuberculosis
gcgagcggcccugc

SEQ ID NO: 2848712 - RNA, 20 nt, Mycobacterium avium subsp. paratuberculosis
gcgagcggcccugcgcggcc

SEQ ID NO: 2848713 - RNA, 13 nt, Mycobacterium avium subsp. paratuberculosis
gcgagcgggcacg

SEQ ID NO: 2848714 - RNA, 17 nt, Mycobacterium avium subsp. paratuberculosis
gcgagcgggcacgccgc

SEQ ID NO: 2848715 - RNA, 20 nt, Mycobacterium avium subsp. paratuberculosis
gcgagcgguuggcgacgcug

SEQ ID NO: 2848716 - RNA, 16 nt, Mycobacterium avium subsp. paratuberculosis
gcgagcgucacgcugg

SEQ ID NO: 2848717 - RNA, 21 nt, Mycobacterium avium subsp. paratuberculosis
gcgagcgucacgcuggcguga

SEQ ID NO: 2848718 - RNA, 18 nt, Mycobacterium avium subsp. paratuberculosis
gcgagcgucgccgcgugg

SEQ ID NO: 2848719 - RNA, 18 nt, Mycobacterium avium subsp. paratuberculosis
gcgagcucaggccggccu

SEQ ID NO: 2848720 - RNA, 20 nt, Mycobacterium avium subsp. paratuberculosis
gcgagcucguucucggcgaa

SEQ ID NO: 2848721 - RNA, 14 nt, Mycobacterium avium subsp. paratuberculosis
gcgagcugaccggc

SEQ ID NO: 2848722 - RNA, 15 nt, Mycobacterium avium subsp. paratuberculosis
gcgagcugaccggcc

SEQ ID NO: 2848723 - RNA, 16 nt, Mycobacterium avium subsp. paratuberculosis
gcgagcugaccggcca

SEQ ID NO: 2848724 - RNA, 18 nt, Mycobacterium avium subsp. paratuberculosis
gcgagcugaccggccacc

SEQ ID NO: 2848725 - RNA, 18 nt, Mycobacterium avium subsp. paratuberculosis
gcgagcugaucggcguug

SEQ ID NO: 2848726 - RNA, 21 nt, Mycobacterium avium subsp. paratuberculosis
gcgagcugaucggcguuggcg

SEQ ID NO: 2848727 - RNA, 19 nt, Mycobacterium avium subsp. paratuberculosis
gcgagcugccccuucgcga

SEQ ID NO: 2848728 - RNA, 21 nt, Mycobacterium avium subsp. paratuberculosis
gcgagcugccccuucgcgaca

SEQ ID NO: 2848729 - RNA, 12 nt, Mycobacterium avium subsp. paratuberculosis
gcgagcugccgg

SEQ ID NO: 2848730 - RNA, 13 nt, Mycobacterium avium subsp. paratuberculosis
gcgagcugccggc

SEQ ID NO: 2848731 - RNA, 15 nt, Mycobacterium avium subsp. paratuberculosis
gcgagcugccggcgg

SEQ ID NO: 2848732 - RNA, 17 nt, Mycobacterium avium subsp. paratuberculosis
gcgagcugccggcggcc

SEQ ID NO: 2848733 - RNA, 18 nt, Mycobacterium avium subsp. paratuberculosis
gcgagcugccggcggccg

SEQ ID NO: 2848734 - RNA, 19 nt, Mycobacterium avium subsp. paratuberculosis
gcgagcugccggcggccgc

SEQ ID NO: 2848735 - RNA, 14 nt, Mycobacterium avium subsp. paratuberculosis
gcgagcugcgggug

SEQ ID NO: 2848736 - RNA, 22 nt, Mycobacterium avium subsp. paratuberculosis
gcgagcugcgggugcucagccu

SEQ ID NO: 2848737 - RNA, 15 nt, Mycobacterium avium subsp. paratuberculosis
gcgagcugcuucguc

SEQ ID NO: 2848738 - RNA, 16 nt, Mycobacterium avium subsp. paratuberculosis
gcgagcugcuucgucg

SEQ ID NO: 2848739 - RNA, 17 nt, Mycobacterium avium subsp. paratuberculosis
gcgagcugcuucgucgc

SEQ ID NO: 2848740 - RNA, 22 nt, Mycobacterium avium subsp. paratuberculosis
gcgagcuggccgcccaccacga

SEQ ID NO: 2848741 - RNA, 15 nt, Mycobacterium avium subsp. paratuberculosis
gcgagcuuggcgggc

SEQ ID NO: 2848742 - RNA, 19 nt, Mycobacterium avium subsp. paratuberculosis
gcgaggaacccgaccgcga

SEQ ID NO: 2848743 - RNA, 22 nt, Mycobacterium avium subsp. paratuberculosis
gcgaggaacucagcgcccagga

SEQ ID NO: 2848744 - RNA, 15 nt, Mycobacterium avium subsp. paratuberculosis
gcgaggaaguccggc

SEQ ID NO: 2848745 - RNA, 17 nt, Mycobacterium avium subsp. paratuberculosis
gcgaggaaguccggcgc

SEQ ID NO: 2848746 - RNA, 19 nt, Mycobacterium avium subsp. paratuberculosis
gcgaggaaguccggcgcgc

SEQ ID NO: 2848747 - RNA, 23 nt, Mycobacterium avium subsp. paratuberculosis
gcgaggaaguccggcgcgcccgg

SEQ ID NO: 2848748 - RNA, 19 nt, Mycobacterium avium subsp. paratuberculosis
gcgaggaaucgcggcaggc

SEQ ID NO: 2848749 - RNA, 20 nt, Mycobacterium avium subsp. paratuberculosis
gcgaggaaucgcggcaggcg

SEQ ID NO: 2848750 - RNA, 14 nt, Mycobacterium avium subsp. paratuberculosis
gcgaggacgucgag

SEQ ID NO: 2848751 - RNA, 19 nt, Mycobacterium avium subsp. paratuberculosis
gcgaggacgucgagcggcg

SEQ ID NO: 2848752 - RNA, 14 nt, Mycobacterium avium subsp. paratuberculosis
gcgaggacgucguc

SEQ ID NO: 2848753 - RNA, 22 nt, Mycobacterium avium subsp. paratuberculosis
gcgaggaucgcgaugucgacgg

SEQ ID NO: 2848754 - RNA, 18 nt, Mycobacterium avium subsp. paratuberculosis
gcgaggauuucgcucagc

SEQ ID NO: 2848755 - RNA, 13 nt, Mycobacterium avium subsp. paratuberculosis
gcgaggccaggcg

SEQ ID NO: 2848756 - RNA, 23 nt, Mycobacterium avium subsp. paratuberculosis
gcgaggccaucaucccguacucg

SEQ ID NO: 2848757 - RNA, 13 nt, Mycobacterium avium subsp. paratuberculosis
gcgaggccgccau

SEQ ID NO: 2848758 - RNA, 13 nt, Mycobacterium avium subsp. paratuberculosis
gcgaggccucgcc

SEQ ID NO: 2848759 - RNA, 15 nt, Mycobacterium avium subsp. paratuberculosis
gcgaggccucgccgc

SEQ ID NO: 2848760 - RNA, 18 nt, Mycobacterium avium subsp. paratuberculosis
gcgaggccucgccgcugg

SEQ ID NO: 2848761 - RNA, 13 nt, Mycobacterium avium subsp. paratuberculosis
gcgaggcgcgcag

SEQ ID NO: 2848762 - RNA, 20 nt, Mycobacterium avium subsp. paratuberculosis
gcgaggcgcgcagguagccg

SEQ ID NO: 2848763 - RNA, 12 nt, Mycobacterium avium subsp. paratuberculosis
gcgaggcggcca

SEQ ID NO: 2848764 - RNA, 14 nt, Mycobacterium avium subsp. paratuberculosis
gcgaggcggccagc

SEQ ID NO: 2848765 - RNA, 22 nt, Mycobacterium avium subsp. paratuberculosis
gcgaggcggguaggcgucgcgc

SEQ ID NO: 2848766 - RNA, 18 nt, Mycobacterium avium subsp. paratuberculosis
gcgaggcggucggcggag

SEQ ID NO: 2848767 - RNA, 17 nt, Mycobacterium avium subsp. paratuberculosis
gcgaggcguccagcgcg

SEQ ID NO: 2848768 - RNA, 19 nt, Mycobacterium avium subsp. paratuberculosis
gcgaggcguccagcgcguc

SEQ ID NO: 2848769 - RNA, 17 nt, Mycobacterium avium subsp. paratuberculosis
gcgagggccguugcggc

SEQ ID NO: 2848770 - RNA, 15 nt, Mycobacterium avium subsp. paratuberculosis
gcgagggcgggccag

SEQ ID NO: 2848771 - RNA, 14 nt, Mycobacterium avium subsp. paratuberculosis
gcgagggggugggu

SEQ ID NO: 2848772 - RNA, 19 nt, Mycobacterium avium subsp. paratuberculosis
gcgagguaauggugggcgu

SEQ ID NO: 2848773 - RNA, 14 nt, Mycobacterium avium subsp. paratuberculosis
gcgagguagaccgc

SEQ ID NO: 2848774 - RNA, 15 nt, Mycobacterium avium subsp. paratuberculosis
gcgagguagaccgcc

SEQ ID NO: 2848775 - RNA, 16 nt, Mycobacterium avium subsp. paratuberculosis
gcgagguagaccgccg

SEQ ID NO: 2848776 - RNA, 16 nt, Mycobacterium avium subsp. paratuberculosis
gcgagguccuugcgga

SEQ ID NO: 2848777 - RNA, 13 nt, Mycobacterium avium subsp. paratuberculosis
gcgaggucgucga

SEQ ID NO: 2848778 - RNA, 15 nt, Mycobacterium avium subsp. paratuberculosis
gcgaggucguucgac

SEQ ID NO: 2848779 - RNA, 14 nt, Mycobacterium avium subsp. paratuberculosis
gcgaggucucccgg

SEQ ID NO: 2848780 - RNA, 12 nt, Mycobacterium avium subsp. paratuberculosis
gcgaggugcgcc

SEQ ID NO: 2848781 - RNA, 16 nt, Mycobacterium avium subsp. paratuberculosis
gcgaggugggcaccag

SEQ ID NO: 2848782 - RNA, 23 nt, Mycobacterium avium subsp. paratuberculosis
gcgaggugguuucggggucgccg

SEQ ID NO: 2848783 - RNA, 22 nt, Mycobacterium avium subsp. paratuberculosis
gcgaggugugaggagucgggca

SEQ ID NO: 2848784 - RNA, 21 nt, Mycobacterium avium subsp. paratuberculosis
gcgaguaaggccgaggcgagu

SEQ ID NO: 2848785 - RNA, 15 nt, Mycobacterium avium subsp. paratuberculosis
gcgaguacaccucga

SEQ ID NO: 2848786 - RNA, 16 nt, Mycobacterium avium subsp. paratuberculosis
gcgaguacaccucgag

SEQ ID NO: 2848787 - RNA, 23 nt, Mycobacterium avium subsp. paratuberculosis
gcgaguacaccucgagcuugccg

SEQ ID NO: 2848788 - RNA, 13 nt, Mycobacterium avium subsp. paratuberculosis
gcgaguacccgcc

SEQ ID NO: 2848789 - RNA, 16 nt, Mycobacterium avium subsp. paratuberculosis
gcgaguacccgccgca

SEQ ID NO: 2848790 - RNA, 15 nt, Mycobacterium avium subsp. paratuberculosis
gcgaguaggcgaaga

SEQ ID NO: 2848791 - RNA, 15 nt, Mycobacterium avium subsp. paratuberculosis
gcgagucaucgccac

SEQ ID NO: 2848792 - RNA, 18 nt, Mycobacterium avium subsp. paratuberculosis
gcgaguccagccagccgc

SEQ ID NO: 2848793 - RNA, 18 nt, Mycobacterium avium subsp. paratuberculosis
gcgaguccgcggaggcga

SEQ ID NO: 2848794 - RNA, 14 nt, Mycobacterium avium subsp. paratuberculosis
gcgaguccggccag

SEQ ID NO: 2848795 - RNA, 15 nt, Mycobacterium avium subsp. paratuberculosis
gcgaguccggccagg

SEQ ID NO: 2848796 - RNA, 18 nt, Mycobacterium avium subsp. paratuberculosis
gcgauccagcgcuggccg

SEQ ID NO: 2848797 - RNA, 19 nt, Mycobacterium avium subsp. paratuberculosis
gcgauccagcgcuggccgg

SEQ ID NO: 2848798 - RNA, 22 nt, Mycobacterium avium subsp. paratuberculosis
gcgauccagcgcuggccggcca

SEQ ID NO: 2848799 - RNA, 20 nt, Mycobacterium avium subsp. paratuberculosis
gcgauccagguguaccagug

SEQ ID NO: 2848800 - RNA, 14 nt, Mycobacterium avium subsp. paratuberculosis
gcgauccgcaggcc

SEQ ID NO: 2848801 - RNA, 19 nt, Mycobacterium avium subsp. paratuberculosis
gcgauccgcaggccgucgc

SEQ ID NO: 2848802 - RNA, 24 nt, Mycobacterium avium subsp. paratuberculosis
gcgauccgcaggccgucgccgguc

SEQ ID NO: 2848803 - RNA, 19 nt, Mycobacterium avium subsp. paratuberculosis
gcgauccgcgcggcgacga

SEQ ID NO: 2848804 - RNA, 17 nt, Mycobacterium avium subsp. paratuberculosis
gcgauccgcgcgucggg

SEQ ID NO: 2848805 - RNA, 15 nt, Mycobacterium avium subsp. paratuberculosis
gcgauccggccggcg

SEQ ID NO: 2848806 - RNA, 21 nt, Mycobacterium avium subsp. paratuberculosis
gcgauccgggcacgcagcggc

SEQ ID NO: 2848807 - RNA, 14 nt, Mycobacterium avium subsp. paratuberculosis
gcgauccgggcgcc

SEQ ID NO: 2848808 - RNA, 20 nt, Mycobacterium avium subsp. paratuberculosis
gcgauccgggcgccggccgg

SEQ ID NO: 2848809 - RNA, 21 nt, Mycobacterium avium subsp. paratuberculosis
gcgauccgggcgccggccggc

SEQ ID NO: 2848810 - RNA, 22 nt, Mycobacterium avium subsp. paratuberculosis
gcgauccgggcgccggccggcg

SEQ ID NO: 2848811 - RNA, 16 nt, Mycobacterium avium subsp. paratuberculosis
gcgaucgacaccagcg

SEQ ID NO: 2848812 - RNA, 17 nt, Mycobacterium avium subsp. paratuberculosis
gcgaucgacagcuccaa

SEQ ID NO: 2848813 - RNA, 16 nt, Mycobacterium avium subsp. paratuberculosis
gcgaucgacgucacca

SEQ ID NO: 2848814 - RNA, 20 nt, Mycobacterium avium subsp. paratuberculosis
gcgaucgaggaucucccggg

SEQ ID NO: 2848815 - RNA, 19 nt, Mycobacterium avium subsp. paratuberculosis
gcgaucgagggggucauca

SEQ ID NO: 2848816 - RNA, 19 nt, Mycobacterium avium subsp. paratuberculosis
gcgaucgaggugauguugg

SEQ ID NO: 2848817 - RNA, 23 nt, Mycobacterium avium subsp. paratuberculosis
gcgaucgaggugauguuggccgc

SEQ ID NO: 2848818 - RNA, 21 nt, Mycobacterium avium subsp. paratuberculosis
gcgaucgaucccuuggcggcg

SEQ ID NO: 2848819 - RNA, 22 nt, Mycobacterium avium subsp. paratuberculosis
gcgaucgaucccuuggcggcgg

SEQ ID NO: 2848820 - RNA, 23 nt, Mycobacterium avium subsp. paratuberculosis
gcgaucgaucccuuggcggcggc

SEQ ID NO: 2848821 - RNA, 19 nt, Mycobacterium avium subsp. paratuberculosis
gcgaucgaugaauccgcgc

SEQ ID NO: 2848822 - RNA, 21 nt, Mycobacterium avium subsp. paratuberculosis
gcgaucgaugaauccgcgcag

SEQ ID NO: 2848823 - RNA, 18 nt, Mycobacterium avium subsp. paratuberculosis
gcgaucgaugcccagcgc

SEQ ID NO: 2848824 - RNA, 20 nt, Mycobacterium avium subsp. paratuberculosis
gcgaucgaugcccagcgcgc

SEQ ID NO: 2848825 - RNA, 13 nt, Mycobacterium avium subsp. paratuberculosis
gcgaucgccagcg

SEQ ID NO: 2848826 - RNA, 22 nt, Mycobacterium avium subsp. paratuberculosis
gcgaucgccagcgcggugucga

SEQ ID NO: 2848827 - RNA, 12 nt, Mycobacterium avium subsp. paratuberculosis
gcgaucgccgac

SEQ ID NO: 2848828 - RNA, 13 nt, Mycobacterium avium subsp. paratuberculosis
gcgaucgccgacg

SEQ ID NO: 2848829 - RNA, 18 nt, Mycobacterium avium subsp. paratuberculosis
gcgaucgccgacgccagc

SEQ ID NO: 2848830 - RNA, 16 nt, Mycobacterium avium subsp. paratuberculosis
gcgaucgccgacgucg

SEQ ID NO: 2848831 - RNA, 17 nt, Mycobacterium avium subsp. paratuberculosis
gcgaucgccgauccggc

SEQ ID NO: 2848832 - RNA, 19 nt, Mycobacterium avium subsp. paratuberculosis
gcgaucgccgauccggcgc

SEQ ID NO: 2848833 - RNA, 20 nt, Mycobacterium avium subsp. paratuberculosis
gcgaucgccgauccggcgcc

SEQ ID NO: 2848834 - RNA, 21 nt, Mycobacterium avium subsp. paratuberculosis
gcgaucgccgggauggugagc

SEQ ID NO: 2848835 - RNA, 13 nt, Mycobacterium avium subsp. paratuberculosis
gcgaucgccgggg

SEQ ID NO: 2848836 - RNA, 15 nt, Mycobacterium avium subsp. paratuberculosis
gcgaucgccggugcg

SEQ ID NO: 2848837 - RNA, 17 nt, Mycobacterium avium subsp. paratuberculosis
gcgaucgccggugcggc

SEQ ID NO: 2848838 - RNA, 13 nt, Mycobacterium avium subsp. paratuberculosis
gcgaucgccucgg

SEQ ID NO: 2848839 - RNA, 16 nt, Mycobacterium avium subsp. paratuberculosis
gcgaucgccucggccu

SEQ ID NO: 2848840 - RNA, 13 nt, Mycobacterium avium subsp. paratuberculosis
gcgaucgcggcca

SEQ ID NO: 2848841 - RNA, 14 nt, Mycobacterium avium subsp. paratuberculosis
gcgaucgcggccac

SEQ ID NO: 2848842 - RNA, 13 nt, Mycobacterium avium subsp. paratuberculosis
gcgaucgcgucga

SEQ ID NO: 2848843 - RNA, 18 nt, Mycobacterium avium subsp. paratuberculosis
gcgaucggauggugccca

SEQ ID NO: 2848844 - RNA, 19 nt, Mycobacterium avium subsp. paratuberculosis
gcgaucggcaggucgucga

SEQ ID NO: 2848845 - RNA, 14 nt, Mycobacterium avium subsp. paratuberculosis
gcgaucggcgagcc

SEQ ID NO: 2848846 - RNA, 16 nt, Mycobacterium avium subsp. paratuberculosis
gcgaucggcgagccgg

SEQ ID NO: 2848847 - RNA, 18 nt, Mycobacterium avium subsp. paratuberculosis
gcgaucggcgagccggga

SEQ ID NO: 2848848 - RNA, 13 nt, Mycobacterium avium subsp. paratuberculosis
gcgaucggcgcca

SEQ ID NO: 2848849 - RNA, 15 nt, Mycobacterium avium subsp. paratuberculosis
gcgaucggcgccacg

SEQ ID NO: 2848850 - RNA, 16 nt, Mycobacterium avium subsp. paratuberculosis
gcgaucggcgccacga

SEQ ID NO: 2848851 - RNA, 21 nt, Mycobacterium avium subsp. paratuberculosis
gcgaucggcgccacgaccagc

SEQ ID NO: 2848852 - RNA, 15 nt, Mycobacterium avium subsp. paratuberculosis
gcgaucggcgcggcg

SEQ ID NO: 2848853 - RNA, 13 nt, Mycobacterium avium subsp. paratuberculosis
gcgaucggcggcu

SEQ ID NO: 2848854 - RNA, 16 nt, Mycobacterium avium subsp. paratuberculosis
gcgaucggcgguccgc

SEQ ID NO: 2848855 - RNA, 19 nt, Mycobacterium avium subsp. paratuberculosis
gcgaucggcgguccgccgc

SEQ ID NO: 2848856 - RNA, 20 nt, Mycobacterium avium subsp. paratuberculosis
gcgaucggcgguccgccgca

SEQ ID NO: 2848857 - RNA, 16 nt, Mycobacterium avium subsp. paratuberculosis
gcgaucggcgugccgg

SEQ ID NO: 2848858 - RNA, 16 nt, Mycobacterium avium subsp. paratuberculosis
gcgaucgggucaccgg

SEQ ID NO: 2848859 - RNA, 20 nt, Mycobacterium avium subsp. paratuberculosis
gcgaucgggucaccggccga

SEQ ID NO: 2848860 - RNA, 19 nt, Mycobacterium avium subsp. paratuberculosis
gcgaucggugaacccgccg

SEQ ID NO: 2848861 - RNA, 20 nt, Mycobacterium avium subsp. paratuberculosis
gcgaucggugaacccgccgg

SEQ ID NO: 2848862 - RNA, 22 nt, Mycobacterium avium subsp. paratuberculosis
gcgaucgguguccagccgcacg

SEQ ID NO: 2848863 - RNA, 13 nt, Mycobacterium avium subsp. paratuberculosis
gcgaucgucgacc

SEQ ID NO: 2848864 - RNA, 20 nt, Mycobacterium avium subsp. paratuberculosis
gcgaucgucgaccaccacga

SEQ ID NO: 2848865 - RNA, 16 nt, Mycobacterium avium subsp. paratuberculosis
gcgaucgucucgucga

SEQ ID NO: 2848866 - RNA, 18 nt, Mycobacterium avium subsp. paratuberculosis
gcgaucgucucgucgaga

SEQ ID NO: 2848867 - RNA, 16 nt, Mycobacterium avium subsp. paratuberculosis
gcgaucuccgucaccg

SEQ ID NO: 2848868 - RNA, 16 nt, Mycobacterium avium subsp. paratuberculosis
gcgaucucgauggcca

SEQ ID NO: 2848869 - RNA, 19 nt, Mycobacterium avium subsp. paratuberculosis
gcgaucucgauggccacgc

SEQ ID NO: 2848870 - RNA, 19 nt, Mycobacterium avium subsp. paratuberculosis
gcgaucucgauggccucgu

SEQ ID NO: 2848871 - RNA, 22 nt, Mycobacterium avium subsp. paratuberculosis
gcgaucucgauguagagcggga

SEQ ID NO: 2848872 - RNA, 23 nt, Mycobacterium avium subsp. paratuberculosis
gcgaucucgccgaaggccggguc

SEQ ID NO: 2848873 - RNA, 24 nt, Mycobacterium avium subsp. paratuberculosis
gcgaucucgccgaaggccgggucg

SEQ ID NO: 2848874 - RNA, 14 nt, Mycobacterium avium subsp. paratuberculosis
gcgaucucggcgga

SEQ ID NO: 2848875 - RNA, 19 nt, Mycobacterium avium subsp. paratuberculosis
gcgaucucggcggacucgg

SEQ ID NO: 2848876 - RNA, 17 nt, Mycobacterium avium subsp. paratuberculosis
gcgaucucggcggccgc

SEQ ID NO: 2848877 - RNA, 23 nt, Mycobacterium avium subsp. paratuberculosis
gcgaucucggcggccgcguccuc

SEQ ID NO: 2848878 - RNA, 17 nt, Mycobacterium avium subsp. paratuberculosis
gcgaucucggucaccga

SEQ ID NO: 2848879 - RNA, 19 nt, Mycobacterium avium subsp. paratuberculosis
gcgaucucgucccacggcg

SEQ ID NO: 2848880 - RNA, 16 nt, Mycobacterium avium subsp. paratuberculosis
gcgaugggcgcgauca

SEQ ID NO: 2848881 - RNA, 17 nt, Mycobacterium avium subsp. paratuberculosis
gcgaugggcgcgaucag

SEQ ID NO: 2848882 - RNA, 18 nt, Mycobacterium avium subsp. paratuberculosis
gcgaugggugaucgcggc

SEQ ID NO: 2848883 - RNA, 20 nt, Mycobacterium avium subsp. paratuberculosis
gcgaugggugaucgcggccc

SEQ ID NO: 2848884 - RNA, 22 nt, Mycobacterium avium subsp. paratuberculosis
gcgauggugaugcggaugcccg

SEQ ID NO: 2848885 - RNA, 20 nt, Mycobacterium avium subsp. paratuberculosis
gcgauggugaugugcggcgc

SEQ ID NO: 2848886 - RNA, 16 nt, Mycobacterium avium subsp. paratuberculosis
gcgauggugcccucgu

SEQ ID NO: 2848887 - RNA, 19 nt, Mycobacterium avium subsp. paratuberculosis
gcgauggugcccucguggu

SEQ ID NO: 2848888 - RNA, 22 nt, Mycobacterium avium subsp. paratuberculosis
gcgauggugccgaagcgccgca

SEQ ID NO: 2848889 - RNA, 18 nt, Mycobacterium avium subsp. paratuberculosis
gcgauggugccgccggug

SEQ ID NO: 2848890 - RNA, 13 nt, Mycobacterium avium subsp. paratuberculosis
gcgauggugcugc

SEQ ID NO: 2848891 - RNA, 18 nt, Mycobacterium avium subsp. paratuberculosis
gcgauggugcugcccggc

SEQ ID NO: 2848892 - RNA, 19 nt, Mycobacterium avium subsp. paratuberculosis
gcgauggugcugcccggcg

SEQ ID NO: 2848893 - RNA, 13 nt, Mycobacterium avium subsp. paratuberculosis
gcgaugguggcgu

SEQ ID NO: 2848894 - RNA, 15 nt, Mycobacterium avium subsp. paratuberculosis
gcgauggugggcagc

SEQ ID NO: 2848895 - RNA, 19 nt, Mycobacterium avium subsp. paratuberculosis
gcgauggugggcagccggc

SEQ ID NO: 2848896 - RNA, 20 nt, Mycobacterium avium subsp. paratuberculosis
gcgauguagcggacgggccg

SEQ ID NO: 2848897 - RNA, 19 nt, Mycobacterium avium subsp. paratuberculosis
gcgauguccgacagcccgc

SEQ ID NO: 2848898 - RNA, 23 nt, Mycobacterium avium subsp. paratuberculosis
gcgauguccuugucgcucaacgg

SEQ ID NO: 2848899 - RNA, 14 nt, Mycobacterium avium subsp. paratuberculosis
gcgaugucgacggu

SEQ ID NO: 2848900 - RNA, 15 nt, Mycobacterium avium subsp. paratuberculosis
gcgaugucgacgugg

SEQ ID NO: 2848901 - RNA, 16 nt, Mycobacterium avium subsp. paratuberculosis
gcgaugucgggcaccu

SEQ ID NO: 2848902 - RNA, 17 nt, Mycobacterium avium subsp. paratuberculosis
gcgaugucgggcaccug

SEQ ID NO: 2848903 - RNA, 21 nt, Mycobacterium avium subsp. paratuberculosis
gcgaugugccacuucgacggc

SEQ ID NO: 2848904 - RNA, 22 nt, Mycobacterium avium subsp. paratuberculosis
gcgauguggguggucagcgcgg

SEQ ID NO: 2848905 - RNA, 16 nt, Mycobacterium avium subsp. paratuberculosis
gcgauuaggucggugg

SEQ ID NO: 2848906 - RNA, 20 nt, Mycobacterium avium subsp. paratuberculosis
gcgauucgucgucguuggcc

SEQ ID NO: 2848907 - RNA, 18 nt, Mycobacterium avium subsp. paratuberculosis
gcgauucucgcugcggcg

SEQ ID NO: 2848908 - RNA, 16 nt, Mycobacterium avium subsp. paratuberculosis
gcgauugcacaccgcu

SEQ ID NO: 2848909 - RNA, 18 nt, Mycobacterium avium subsp. paratuberculosis
gcgauugcggccgccggc

SEQ ID NO: 2848910 - RNA, 20 nt, Mycobacterium avium subsp. paratuberculosis
gcgauugcggccgccggcca

SEQ ID NO: 2848911 - RNA, 15 nt, Mycobacterium avium subsp. paratuberculosis
gcgauuucgucggcg

SEQ ID NO: 2848912 - RNA, 17 nt, Mycobacterium avium subsp. paratuberculosis
gcgcaacaccgaaagcc

SEQ ID NO: 2848913 - RNA, 17 nt, Mycobacterium avium subsp. paratuberculosis
gcgcaacaccucggcga

SEQ ID NO: 2848914 - RNA, 19 nt, Mycobacterium avium subsp. paratuberculosis
gcgcaacaccucggcgacg

SEQ ID NO: 2848915 - RNA, 21 nt, Mycobacterium avium subsp. paratuberculosis
gcgcaacaccucggcgacguc

SEQ ID NO: 2848916 - RNA, 15 nt, Mycobacterium avium subsp. paratuberculosis
gcgcaacagcaccuc

SEQ ID NO: 2848917 - RNA, 22 nt, Mycobacterium avium subsp. paratuberculosis
gcgcaacagcauuucgcgcggc

SEQ ID NO: 2848918 - RNA, 19 nt, Mycobacterium avium subsp. paratuberculosis
gcgcaacagcgucucgacg

SEQ ID NO: 2848919 - RNA, 22 nt, Mycobacterium avium subsp. paratuberculosis
gcgcaacagcgugcacacccgc

SEQ ID NO: 2848920 - RNA, 18 nt, Mycobacterium avium subsp. paratuberculosis
gcgcaaccaacucgcgau

SEQ ID NO: 2848921 - RNA, 20 nt, Mycobacterium avium subsp. paratuberculosis
gcgcaaccaacucgcgaugu

SEQ ID NO: 2848922 - RNA, 12 nt, Mycobacterium avium subsp. paratuberculosis
gcgcaaccgcgg

SEQ ID NO: 2848923 - RNA, 16 nt, Mycobacterium avium subsp. paratuberculosis
gcgcaaccgcggcggc

SEQ ID NO: 2848924 - RNA, 17 nt, Mycobacterium avium subsp. paratuberculosis
gcgcaaccgcggcggcg

SEQ ID NO: 2848925 - RNA, 14 nt, Mycobacterium avium subsp. paratuberculosis
gcgcaaccgggccg

SEQ ID NO: 2848926 - RNA, 15 nt, Mycobacterium avium subsp. paratuberculosis
gcgcaaccgggccgc

SEQ ID NO: 2848927 - RNA, 20 nt, Mycobacterium avium subsp. paratuberculosis
gcgcaaccgggccgcacccc

SEQ ID NO: 2848928 - RNA, 18 nt, Mycobacterium avium subsp. paratuberculosis
gcgcaacgauucacccag

SEQ ID NO: 2848929 - RNA, 19 nt, Mycobacterium avium subsp. paratuberculosis
gcgcaacgauucacccagc

SEQ ID NO: 2848930 - RNA, 23 nt, Mycobacterium avium subsp. paratuberculosis
gcgcaacgauucacccagcgagc

SEQ ID NO: 2848931 - RNA, 17 nt, Mycobacterium avium subsp. paratuberculosis
gcgcaacggcgucgaca

SEQ ID NO: 2848932 - RNA, 21 nt, Mycobacterium avium subsp. paratuberculosis
gcgcaacguguacucggcguc

SEQ ID NO: 2848933 - RNA, 17 nt, Mycobacterium avium subsp. paratuberculosis
gcgcaacugggugguca

SEQ ID NO: 2848934 - RNA, 20 nt, Mycobacterium avium subsp. paratuberculosis
gcgcaagcaccggcuggccg

SEQ ID NO: 2848935 - RNA, 14 nt, Mycobacterium avium subsp. paratuberculosis
gcgcaaguagcgcu

SEQ ID NO: 2848936 - RNA, 19 nt, Mycobacterium avium subsp. paratuberculosis
gcgcaauacccgaccagca

SEQ ID NO: 2848937 - RNA, 20 nt, Mycobacterium avium subsp. paratuberculosis
gcgcaaucaaaaaccccgcu

SEQ ID NO: 2848938 - RNA, 22 nt, Mycobacterium avium subsp. paratuberculosis
gcgcaaugccaucgucacuucg

SEQ ID NO: 2848939 - RNA, 12 nt, Mycobacterium avium subsp. paratuberculosis
gcgcaaugccgc

SEQ ID NO: 2848940 - RNA, 21 nt, Mycobacterium avium subsp. paratuberculosis
gcgcaauugaacuguuuuucc

SEQ ID NO: 2848941 - RNA, 13 nt, Mycobacterium avium subsp. paratuberculosis
gcgcacaacagcc

SEQ ID NO: 2848942 - RNA, 15 nt, Mycobacterium avium subsp. paratuberculosis
gcgcacaacgaggcc

SEQ ID NO: 2848943 - RNA, 19 nt, Mycobacterium avium subsp. paratuberculosis
gcgcacaacgaggcccgga

SEQ ID NO: 2848944 - RNA, 13 nt, Mycobacterium avium subsp. paratuberculosis
gcgcacacaccgu

SEQ ID NO: 2848945 - RNA, 17 nt, Mycobacterium avium subsp. paratuberculosis
gcgcacacaccguaccg

SEQ ID NO: 2848946 - RNA, 21 nt, Mycobacterium avium subsp. paratuberculosis
gcgcacacaccguaccgagga

SEQ ID NO: 2848947 - RNA, 20 nt, Mycobacterium avium subsp. paratuberculosis
gcgcacacagcagcagcacc

SEQ ID NO: 2848948 - RNA, 21 nt, Mycobacterium avium subsp. paratuberculosis
gcgcacacagcagcagcacca

SEQ ID NO: 2848949 - RNA, 22 nt, Mycobacterium avium subsp. paratuberculosis
gcgcacacagcagcagcaccag

SEQ ID NO: 2848950 - RNA, 24 nt, Mycobacterium avium subsp. paratuberculosis
gcgcacacagcagcagcaccaggc

SEQ ID NO: 2848951 - RNA, 15 nt, Mycobacterium avium subsp. paratuberculosis
gcgcacacggccucg

SEQ ID NO: 2848952 - RNA, 16 nt, Mycobacterium avium subsp. paratuberculosis
gcgcacacggccucgc

SEQ ID NO: 2848953 - RNA, 19 nt, Mycobacterium avium subsp. paratuberculosis
gcgcacagaucgucucggc

SEQ ID NO: 2848954 - RNA, 23 nt, Mycobacterium avium subsp. paratuberculosis
gcgcacagaucgucucggccagc

SEQ ID NO: 2848955 - RNA, 13 nt, Mycobacterium avium subsp. paratuberculosis
gcgcacagcgcca

SEQ ID NO: 2848956 - RNA, 14 nt, Mycobacterium avium subsp. paratuberculosis
gcgcacagcgccac

SEQ ID NO: 2848957 - RNA, 16 nt, Mycobacterium avium subsp. paratuberculosis
gcgcacagcgccacac

SEQ ID NO: 2848958 - RNA, 19 nt, Mycobacterium avium subsp. paratuberculosis
gcgcacagcuaggucgugg

SEQ ID NO: 2848959 - RNA, 20 nt, Mycobacterium avium subsp. paratuberculosis
gcgcacagcuaggucguggc

SEQ ID NO: 2848960 - RNA, 16 nt, Mycobacterium avium subsp. paratuberculosis
gcgcacagcuuucggg

SEQ ID NO: 2848961 - RNA, 20 nt, Mycobacterium avium subsp. paratuberculosis
gcgcacagcuuucgggcggc

SEQ ID NO: 2848962 - RNA, 18 nt, Mycobacterium avium subsp. paratuberculosis
gcgcacaggaacgcgucg

SEQ ID NO: 2848963 - RNA, 18 nt, Mycobacterium avium subsp. paratuberculosis
gcgcacaucacgguggcc

SEQ ID NO: 2848964 - RNA, 21 nt, Mycobacterium avium subsp. paratuberculosis
gcgcaccgcggccucggcguc

SEQ ID NO: 2848965 - RNA, 14 nt, Mycobacterium avium subsp. paratuberculosis
gcgcaccgcggcgg

SEQ ID NO: 2848966 - RNA, 15 nt, Mycobacterium avium subsp. paratuberculosis
gcgcaccgcggcgug

SEQ ID NO: 2848967 - RNA, 16 nt, Mycobacterium avium subsp. paratuberculosis
gcgcaccgcggcgugc

SEQ ID NO: 2848968 - RNA, 19 nt, Mycobacterium avium subsp. paratuberculosis
gcgcaccgcggcgugcgcc

SEQ ID NO: 2848969 - RNA, 13 nt, Mycobacterium avium subsp. paratuberculosis
gcgcaccgcgggc

SEQ ID NO: 2848970 - RNA, 18 nt, Mycobacterium avium subsp. paratuberculosis
gcgcaccgcgggcagcag

SEQ ID NO: 2848971 - RNA, 23 nt, Mycobacterium avium subsp. paratuberculosis
gcgcaccgcgucgaccaccgccg

SEQ ID NO: 2848972 - RNA, 23 nt, Mycobacterium avium subsp. paratuberculosis
gcgcaccgcgucgaugcgggccc

SEQ ID NO: 2848973 - RNA, 13 nt, Mycobacterium avium subsp. paratuberculosis
gcgcaccggcgau

SEQ ID NO: 2848974 - RNA, 15 nt, Mycobacterium avium subsp. paratuberculosis
gcgcaccggcgaugc

SEQ ID NO: 2848975 - RNA, 16 nt, Mycobacterium avium subsp. paratuberculosis
gcgcaccggcgcuggu

SEQ ID NO: 2848976 - RNA, 16 nt, Mycobacterium avium subsp. paratuberculosis
gcgcaccgggaccagc

SEQ ID NO: 2848977 - RNA, 19 nt, Mycobacterium avium subsp. paratuberculosis
gcgcaccgggaccagcgcg

SEQ ID NO: 2848978 - RNA, 23 nt, Mycobacterium avium subsp. paratuberculosis
gcgcaccgggaccagcgcggugc

SEQ ID NO: 2848979 - RNA, 19 nt, Mycobacterium avium subsp. paratuberculosis
gcgcaccgggacgggucgg

SEQ ID NO: 2848980 - RNA, 20 nt, Mycobacterium avium subsp. paratuberculosis
gcgcaccgggacgggucggu

SEQ ID NO: 2848981 - RNA, 15 nt, Mycobacterium avium subsp. paratuberculosis
gcgcaccgggcccgc

SEQ ID NO: 2848982 - RNA, 17 nt, Mycobacterium avium subsp. paratuberculosis
gcgcaccgggcccgccc

SEQ ID NO: 2848983 - RNA, 18 nt, Mycobacterium avium subsp. paratuberculosis
gcgcaccgggcccgcccg

SEQ ID NO: 2848984 - RNA, 17 nt, Mycobacterium avium subsp. paratuberculosis
gcgcaccggucagcgcu

SEQ ID NO: 2848985 - RNA, 18 nt, Mycobacterium avium subsp. paratuberculosis
gcgcaccggucagcgcua

SEQ ID NO: 2848986 - RNA, 20 nt, Mycobacterium avium subsp. paratuberculosis
gcgcaccgguuugucggcgc

SEQ ID NO: 2848987 - RNA, 21 nt, Mycobacterium avium subsp. paratuberculosis
gcgcaccgguuugucggcgcc

SEQ ID NO: 2848988 - RNA, 17 nt, Mycobacterium avium subsp. paratuberculosis
gcgcaccgucaucgcgg

SEQ ID NO: 2848989 - RNA, 19 nt, Mycobacterium avium subsp. paratuberculosis
gcgcaccgucaucgcggcg

SEQ ID NO: 2848990 - RNA, 15 nt, Mycobacterium avium subsp. paratuberculosis
gcgcaccgugccgcc

SEQ ID NO: 2848991 - RNA, 22 nt, Mycobacterium avium subsp. paratuberculosis
gcgcaccgugccgcccgucgcc

SEQ ID NO: 2848992 - RNA, 18 nt, Mycobacterium avium subsp. paratuberculosis
gcgcaccgugucgucgcu

SEQ ID NO: 2848993 - RNA, 23 nt, Mycobacterium avium subsp. paratuberculosis
gcgcaccgugucgucgcugacgc

SEQ ID NO: 2848994 - RNA, 19 nt, Mycobacterium avium subsp. paratuberculosis
gcgcaccugaaccgcgcac

SEQ ID NO: 2848995 - RNA, 23 nt, Mycobacterium avium subsp. paratuberculosis
gcgcaccugaaccgcgcacucga

SEQ ID NO: 2848996 - RNA, 15 nt, Mycobacterium avium subsp. paratuberculosis
gcgcaccugcggccc

SEQ ID NO: 2848997 - RNA, 18 nt, Mycobacterium avium subsp. paratuberculosis
gcgcaccugcggccccug

SEQ ID NO: 2848998 - RNA, 18 nt, Mycobacterium avium subsp. paratuberculosis
gcgcaccuggcgcagcac

SEQ ID NO: 2848999 - RNA, 19 nt, Mycobacterium avium subsp. paratuberculosis
gcgcaccuggcgcagcacc

SEQ ID NO: 2849000 - RNA, 22 nt, Mycobacterium avium subsp. paratuberculosis
gcgcaccuggcgcagcaccgac

SEQ ID NO: 2849001 - RNA, 24 nt, Mycobacterium avium subsp. paratuberculosis
gcgcaccuggucggucagcucgaa

SEQ ID NO: 2849002 - RNA, 16 nt, Mycobacterium avium subsp. paratuberculosis
gcgcaccuucccggcc

SEQ ID NO: 2849003 - RNA, 17 nt, Mycobacterium avium subsp. paratuberculosis
gcgcaccuucccggccg

SEQ ID NO: 2849004 - RNA, 19 nt, Mycobacterium avium subsp. paratuberculosis
gcgcaccuucccggccgcc

SEQ ID NO: 2849005 - RNA, 21 nt, Mycobacterium avium subsp. paratuberculosis
gcgcaccuucccggccgccaa

SEQ ID NO: 2849006 - RNA, 14 nt, Mycobacterium avium subsp. paratuberculosis
gcgcacgaacggcg

SEQ ID NO: 2849007 - RNA, 23 nt, Mycobacterium avium subsp. paratuberculosis
gcgcacgaacggcgcgaaccggg

SEQ ID NO: 2849008 - RNA, 15 nt, Mycobacterium avium subsp. paratuberculosis
gcgcacgacguggag

SEQ ID NO: 2849009 - RNA, 15 nt, Mycobacterium avium subsp. paratuberculosis
gcgcacgaucgggcg

SEQ ID NO: 2849010 - RNA, 15 nt, Mycobacterium avium subsp. paratuberculosis
gcgcacgaucugcag

SEQ ID NO: 2849011 - RNA, 19 nt, Mycobacterium avium subsp. paratuberculosis
gcgcacgaucugcaggccg

SEQ ID NO: 2849012 - RNA, 18 nt, Mycobacterium avium subsp. paratuberculosis
gcgcacgcagugccgcac

SEQ ID NO: 2849013 - RNA, 22 nt, Mycobacterium avium subsp. paratuberculosis
gcgcacgcagugccgcaccagc

SEQ ID NO: 2849014 - RNA, 13 nt, Mycobacterium avium subsp. paratuberculosis
gcgcacgccaucg

SEQ ID NO: 2849015 - RNA, 15 nt, Mycobacterium avium subsp. paratuberculosis
gcgcacgccaucgcc

SEQ ID NO: 2849016 - RNA, 19 nt, Mycobacterium avium subsp. paratuberculosis
gcgcacgccaucgccucgg

SEQ ID NO: 2849017 - RNA, 23 nt, Mycobacterium avium subsp. paratuberculosis
gcgcacgcccaugaucacaccgc

SEQ ID NO: 2849018 - RNA, 19 nt, Mycobacterium avium subsp. paratuberculosis
gcgcacgcggacacgaacg

SEQ ID NO: 2849019 - RNA, 13 nt, Mycobacterium avium subsp. paratuberculosis
gcgcacgcucgcg

SEQ ID NO: 2849020 - RNA, 15 nt, Mycobacterium avium subsp. paratuberculosis
gcgcacgcucgcggu

SEQ ID NO: 2849021 - RNA, 16 nt, Mycobacterium avium subsp. paratuberculosis
gcgcacgcucgcggug

SEQ ID NO: 2849022 - RNA, 21 nt, Mycobacterium avium subsp. paratuberculosis
gcgcacgcucgcggugcgcgc

SEQ ID NO: 2849023 - RNA, 14 nt, Mycobacterium avium subsp. paratuberculosis
gcgcacgcugcugg

SEQ ID NO: 2849024 - RNA, 16 nt, Mycobacterium avium subsp. paratuberculosis
gcgcacgcugcugguc

SEQ ID NO: 2849025 - RNA, 14 nt, Mycobacterium avium subsp. paratuberculosis
gcgcacgcuggccg

SEQ ID NO: 2849026 - RNA, 15 nt, Mycobacterium avium subsp. paratuberculosis
gcgcacgcuggccgg

SEQ ID NO: 2849027 - RNA, 16 nt, Mycobacterium avium subsp. paratuberculosis
gcgcacgcuggccggc

SEQ ID NO: 2849028 - RNA, 19 nt, Mycobacterium avium subsp. paratuberculosis
gcgcacgcuggccggcagc

SEQ ID NO: 2849029 - RNA, 18 nt, Mycobacterium avium subsp. paratuberculosis
gcgcacgcuuuuucgcga

SEQ ID NO: 2849030 - RNA, 15 nt, Mycobacterium avium subsp. paratuberculosis
gcgcacggcgcccag

SEQ ID NO: 2849031 - RNA, 16 nt, Mycobacterium avium subsp. paratuberculosis
gcgcacggcgcgcacc

SEQ ID NO: 2849032 - RNA, 16 nt, Mycobacterium avium subsp. paratuberculosis
gcgcacggugcccguc

SEQ ID NO: 2849033 - RNA, 22 nt, Mycobacterium avium subsp. paratuberculosis
gcgcacggugcccgucggcaac

SEQ ID NO: 2849034 - RNA, 16 nt, Mycobacterium avium subsp. paratuberculosis
gcgcacguaccgguac

SEQ ID NO: 2849035 - RNA, 20 nt, Mycobacterium avium subsp. paratuberculosis
gcgcacguaccgguacagcg

SEQ ID NO: 2849036 - RNA, 22 nt, Mycobacterium avium subsp. paratuberculosis
gcgcacguaccgguacagcgac

SEQ ID NO: 2849037 - RNA, 16 nt, Mycobacterium avium subsp. paratuberculosis
gcgcacguagcccagc

SEQ ID NO: 2849038 - RNA, 18 nt, Mycobacterium avium subsp. paratuberculosis
gcgcacguagcccagcgc

SEQ ID NO: 2849039 - RNA, 19 nt, Mycobacterium avium subsp. paratuberculosis
gcgcacguagcccagcgcg

SEQ ID NO: 2849040 - RNA, 13 nt, Mycobacterium avium subsp. paratuberculosis
gcgcacgucaccg

SEQ ID NO: 2849041 - RNA, 15 nt, Mycobacterium avium subsp. paratuberculosis
gcgcacgucgccgcc

SEQ ID NO: 2849042 - RNA, 17 nt, Mycobacterium avium subsp. paratuberculosis
gcgcacgucggccgcca

SEQ ID NO: 2849043 - RNA, 20 nt, Mycobacterium avium subsp. paratuberculosis
gcgcacgucggccgccaggg

SEQ ID NO: 2849044 - RNA, 23 nt, Mycobacterium avium subsp. paratuberculosis
gcgcacgucggccgccagggcca

SEQ ID NO: 2849045 - RNA, 21 nt, Mycobacterium avium subsp. paratuberculosis
gcgcacguuggcggccagcgc

SEQ ID NO: 2849046 - RNA, 22 nt, Mycobacterium avium subsp. paratuberculosis
gcgcacguuggcggccagcgcg

SEQ ID NO: 2849047 - RNA, 15 nt, Mycobacterium avium subsp. paratuberculosis
gcgcacucgaacggc

SEQ ID NO: 2849048 - RNA, 16 nt, Mycobacterium avium subsp. paratuberculosis
gcgcagcccagccagc

SEQ ID NO: 2849049 - RNA, 18 nt, Mycobacterium avium subsp. paratuberculosis
gcgcagcccagccagcga

SEQ ID NO: 2849050 - RNA, 20 nt, Mycobacterium avium subsp. paratuberculosis
gcgcagcccagccagcgaca

SEQ ID NO: 2849051 - RNA, 15 nt, Mycobacterium avium subsp. paratuberculosis
gcgcagcccccggac

SEQ ID NO: 2849052 - RNA, 16 nt, Mycobacterium avium subsp. paratuberculosis
gcgcagcccgagcggc

SEQ ID NO: 2849053 - RNA, 20 nt, Mycobacterium avium subsp. paratuberculosis
gcgcagcccgaucgccagcg

SEQ ID NO: 2849054 - RNA, 23 nt, Mycobacterium avium subsp. paratuberculosis
gcgcagcccgaucgccagcgccc

SEQ ID NO: 2849055 - RNA, 17 nt, Mycobacterium avium subsp. paratuberculosis
gcgcagcccgccgggau

SEQ ID NO: 2849056 - RNA, 22 nt, Mycobacterium avium subsp. paratuberculosis
gcgcagcccgccgggaugcgcc

SEQ ID NO: 2849057 - RNA, 12 nt, Mycobacterium avium subsp. paratuberculosis
gcgcagcccggc

SEQ ID NO: 2849058 - RNA, 13 nt, Mycobacterium avium subsp. paratuberculosis
gcgcagcccggcg

SEQ ID NO: 2849059 - RNA, 14 nt, Mycobacterium avium subsp. paratuberculosis
gcgcagcccggcgg

SEQ ID NO: 2849060 - RNA, 15 nt, Mycobacterium avium subsp. paratuberculosis
gcgcagcccggcggu

SEQ ID NO: 2849061 - RNA, 12 nt, Mycobacterium avium subsp. paratuberculosis
gcgcagccgccg

SEQ ID NO: 2849062 - RNA, 15 nt, Mycobacterium avium subsp. paratuberculosis
gcgcagccgccgggc

SEQ ID NO: 2849063 - RNA, 14 nt, Mycobacterium avium subsp. paratuberculosis
gcgcagccgcggug

SEQ ID NO: 2849064 - RNA, 15 nt, Mycobacterium avium subsp. paratuberculosis
gcgcagccgcggugg

SEQ ID NO: 2849065 - RNA, 17 nt, Mycobacterium avium subsp. paratuberculosis
gcgcagccgcgguggcg

SEQ ID NO: 2849066 - RNA, 19 nt, Mycobacterium avium subsp. paratuberculosis
gcgcagccgcugcagcgcc

SEQ ID NO: 2849067 - RNA, 21 nt, Mycobacterium avium subsp. paratuberculosis
gcgcagccgcugcagcgccgc

SEQ ID NO: 2849068 - RNA, 23 nt, Mycobacterium avium subsp. paratuberculosis
gcgcagccgcugcagcgccgccc

SEQ ID NO: 2849069 - RNA, 14 nt, Mycobacterium avium subsp. paratuberculosis
gcgcagccggcagc

SEQ ID NO: 2849070 - RNA, 13 nt, Mycobacterium avium subsp. paratuberculosis
gcgcagccggcca

SEQ ID NO: 2849071 - RNA, 16 nt, Mycobacterium avium subsp. paratuberculosis
gcgcagccggccaccg

SEQ ID NO: 2849072 - RNA, 17 nt, Mycobacterium avium subsp. paratuberculosis
gcgcagccggccaccgc

SEQ ID NO: 2849073 - RNA, 14 nt, Mycobacterium avium subsp. paratuberculosis
gcgcagccggccgu

SEQ ID NO: 2849074 - RNA, 13 nt, Mycobacterium avium subsp. paratuberculosis
gcgcagccgggcg

SEQ ID NO: 2849075 - RNA, 14 nt, Mycobacterium avium subsp. paratuberculosis
gcgcagccgggcgg

SEQ ID NO: 2849076 - RNA, 15 nt, Mycobacterium avium subsp. paratuberculosis
gcgcagccgggcggc

SEQ ID NO: 2849077 - RNA, 20 nt, Mycobacterium avium subsp. paratuberculosis
gcgcagccgucgcaucagcu

SEQ ID NO: 2849078 - RNA, 23 nt, Mycobacterium avium subsp. paratuberculosis
gcgcagcgaaacucguugccagc

SEQ ID NO: 2849079 - RNA, 15 nt, Mycobacterium avium subsp. paratuberculosis
gcgcagcgaccuggu

SEQ ID NO: 2849080 - RNA, 20 nt, Mycobacterium avium subsp. paratuberculosis
gcgcagcgaccugguccacc

SEQ ID NO: 2849081 - RNA, 17 nt, Mycobacterium avium subsp. paratuberculosis
gcgcagcgagucggcga

SEQ ID NO: 2849082 - RNA, 18 nt, Mycobacterium avium subsp. paratuberculosis
gcgcagcgagucggcgaa

SEQ ID NO: 2849083 - RNA, 19 nt, Mycobacterium avium subsp. paratuberculosis
gcgcagcgagucggcgaag

SEQ ID NO: 2849084 - RNA, 12 nt, Mycobacterium avium subsp. paratuberculosis
gcgcagcgcacg

SEQ ID NO: 2849085 - RNA, 18 nt, Mycobacterium avium subsp. paratuberculosis
gcgcagcgcacgucgccg

SEQ ID NO: 2849086 - RNA, 13 nt, Mycobacterium avium subsp. paratuberculosis
gcgcagcgcagca

SEQ ID NO: 2849087 - RNA, 12 nt, Mycobacterium avium subsp. paratuberculosis
gcgcagcgccag

SEQ ID NO: 2849088 - RNA, 19 nt, Mycobacterium avium subsp. paratuberculosis
gcgcagcgccaggcagaag

SEQ ID NO: 2849089 - RNA, 13 nt, Mycobacterium avium subsp. paratuberculosis
gcgcagcgcccag

SEQ ID NO: 2849090 - RNA, 14 nt, Mycobacterium avium subsp. paratuberculosis
gcgcagcgccgcgc

SEQ ID NO: 2849091 - RNA, 15 nt, Mycobacterium avium subsp. paratuberculosis
gcgcagcgccgcgcc

SEQ ID NO: 2849092 - RNA, 16 nt, Mycobacterium avium subsp. paratuberculosis
gcgcagcgccgcgccg

SEQ ID NO: 2849093 - RNA, 15 nt, Mycobacterium avium subsp. paratuberculosis
gcgcagcgccucggc

SEQ ID NO: 2849094 - RNA, 16 nt, Mycobacterium avium subsp. paratuberculosis
gcgcagcgccucggcg

SEQ ID NO: 2849095 - RNA, 17 nt, Mycobacterium avium subsp. paratuberculosis
gcgcagcgccucggcgg

SEQ ID NO: 2849096 - RNA, 16 nt, Mycobacterium avium subsp. paratuberculosis
gcgcagcgcgaugucc

SEQ ID NO: 2849097 - RNA, 15 nt, Mycobacterium avium subsp. paratuberculosis
gcgcagcgcgucgcg

SEQ ID NO: 2849098 - RNA, 18 nt, Mycobacterium avium subsp. paratuberculosis
gcgcagcgcgucgcgccc

SEQ ID NO: 2849099 - RNA, 21 nt, Mycobacterium avium subsp. paratuberculosis
gcgcagcgcgucgcgcccggc

SEQ ID NO: 2849100 - RNA, 15 nt, Mycobacterium avium subsp. paratuberculosis
gcgcagcgcgucggg

SEQ ID NO: 2849101 - RNA, 17 nt, Mycobacterium avium subsp. paratuberculosis
gcgcagcgcgucgggcu

SEQ ID NO: 2849102 - RNA, 23 nt, Mycobacterium avium subsp. paratuberculosis
gcgcagcgcgucgucggucaggc

SEQ ID NO: 2849103 - RNA, 24 nt, Mycobacterium avium subsp. paratuberculosis
gcgcagcggggaggcccagcccgc

SEQ ID NO: 2849104 - RNA, 13 nt, Mycobacterium avium subsp. paratuberculosis
gcgcagcggggcg

SEQ ID NO: 2849105 - RNA, 17 nt, Mycobacterium avium subsp. paratuberculosis
gcgcagcggggcgcgca

SEQ ID NO: 2849106 - RNA, 18 nt, Mycobacterium avium subsp. paratuberculosis
gcgcagcggggcgcgcag

SEQ ID NO: 2849107 - RNA, 14 nt, Mycobacterium avium subsp. paratuberculosis
gcgcagcgucaacg

SEQ ID NO: 2849108 - RNA, 21 nt, Mycobacterium avium subsp. paratuberculosis
gcgcagcgucaucgcguagug

SEQ ID NO: 2849109 - RNA, 13 nt, Mycobacterium avium subsp. paratuberculosis
gcgcagcgucggc

SEQ ID NO: 2849110 - RNA, 14 nt, Mycobacterium avium subsp. paratuberculosis
gcgcagcgucggcg

SEQ ID NO: 2849111 - RNA, 16 nt, Mycobacterium avium subsp. paratuberculosis
gcgcagcgucggcgug

SEQ ID NO: 2849112 - RNA, 19 nt, Mycobacterium avium subsp. paratuberculosis
gcgcagcgucggcgugccc

SEQ ID NO: 2849113 - RNA, 21 nt, Mycobacterium avium subsp. paratuberculosis
gcgcagcgucucccgggugcg

SEQ ID NO: 2849114 - RNA, 23 nt, Mycobacterium avium subsp. paratuberculosis
gcgcagcgucucccgggugcgcg

SEQ ID NO: 2849115 - RNA, 20 nt, Mycobacterium avium subsp. paratuberculosis
gcgcagcgucuccucgaccg

SEQ ID NO: 2849116 - RNA, 17 nt, Mycobacterium avium subsp. paratuberculosis
gcgcagcgucucgaucg

SEQ ID NO: 2849117 - RNA, 22 nt, Mycobacterium avium subsp. paratuberculosis
gcgcagcgucuugcccagcggg

SEQ ID NO: 2849118 - RNA, 13 nt, Mycobacterium avium subsp. paratuberculosis
gcgcagcgugucg

SEQ ID NO: 2849119 - RNA, 14 nt, Mycobacterium avium subsp. paratuberculosis
gcgcagcgugucgg

SEQ ID NO: 2849120 - RNA, 15 nt, Mycobacterium avium subsp. paratuberculosis
gcgcagcgugucggg

SEQ ID NO: 2849121 - RNA, 16 nt, Mycobacterium avium subsp. paratuberculosis
gcgcagcgugucgggg

SEQ ID NO: 2849122 - RNA, 19 nt, Mycobacterium avium subsp. paratuberculosis
gcgcagcgugucggggucg

SEQ ID NO: 2849123 - RNA, 21 nt, Mycobacterium avium subsp. paratuberculosis
gcgcagcgugucggggucggc

SEQ ID NO: 2849124 - RNA, 17 nt, Mycobacterium avium subsp. paratuberculosis
gcgcagcgugugcaccu

SEQ ID NO: 2849125 - RNA, 15 nt, Mycobacterium avium subsp. paratuberculosis
gcgcagcucgacgac

SEQ ID NO: 2849126 - RNA, 22 nt, Mycobacterium avium subsp. paratuberculosis
gcgcagcucgacgaccucgccg

SEQ ID NO: 2849127 - RNA, 14 nt, Mycobacterium avium subsp. paratuberculosis
gcgcagcucgcgca

SEQ ID NO: 2849128 - RNA, 17 nt, Mycobacterium avium subsp. paratuberculosis
gcgcagcucgcgcagcu

SEQ ID NO: 2849129 - RNA, 16 nt, Mycobacterium avium subsp. paratuberculosis
gcgcagcucggggucg

SEQ ID NO: 2849130 - RNA, 20 nt, Mycobacterium avium subsp. paratuberculosis
gcgcagcucggggucggcgu

SEQ ID NO: 2849131 - RNA, 16 nt, Mycobacterium avium subsp. paratuberculosis
gcgcagcucgucgugg

SEQ ID NO: 2849132 - RNA, 22 nt, Mycobacterium avium subsp. paratuberculosis
gcgcagcugcagcuccucggcg

SEQ ID NO: 2849133 - RNA, 16 nt, Mycobacterium avium subsp. paratuberculosis
gcgcaguugcgcggcg

SEQ ID NO: 2849134 - RNA, 18 nt, Mycobacterium avium subsp. paratuberculosis
gcgcaguugcgcggcggg

SEQ ID NO: 2849135 - RNA, 20 nt, Mycobacterium avium subsp. paratuberculosis
gcgcaguugcgcggcgggcg

SEQ ID NO: 2849136 - RNA, 14 nt, Mycobacterium avium subsp. paratuberculosis
gcgcauaccagcgc

SEQ ID NO: 2849137 - RNA, 16 nt, Mycobacterium avium subsp. paratuberculosis
gcgcauaccagcgcug

SEQ ID NO: 2849138 - RNA, 16 nt, Mycobacterium avium subsp. paratuberculosis
gcgcaucaccgagguc

SEQ ID NO: 2849139 - RNA, 13 nt, Mycobacterium avium subsp. paratuberculosis
gcgcaucagcgcc

SEQ ID NO: 2849140 - RNA, 14 nt, Mycobacterium avium subsp. paratuberculosis
gcgcaucagcgcca

SEQ ID NO: 2849141 - RNA, 15 nt, Mycobacterium avium subsp. paratuberculosis
gcgcaucagcgccac

SEQ ID NO: 2849142 - RNA, 17 nt, Mycobacterium avium subsp. paratuberculosis
gcgcaucagcgccacca

SEQ ID NO: 2849143 - RNA, 19 nt, Mycobacterium avium subsp. paratuberculosis
gcgcaucagcgccaccagc

SEQ ID NO: 2849144 - RNA, 23 nt, Mycobacterium avium subsp. paratuberculosis
gcgcaucagcgccaccagcaccg

SEQ ID NO: 2849145 - RNA, 18 nt, Mycobacterium avium subsp. paratuberculosis
gcgcaucagcggagugac

SEQ ID NO: 2849146 - RNA, 15 nt, Mycobacterium avium subsp. paratuberculosis
gcgcaucagcggggc

SEQ ID NO: 2849147 - RNA, 21 nt, Mycobacterium avium subsp. paratuberculosis
gcgcaucagcucuucgacgau

SEQ ID NO: 2849148 - RNA, 22 nt, Mycobacterium avium subsp. paratuberculosis
gcgcaucagcucuucgacgaug

SEQ ID NO: 2849149 - RNA, 14 nt, Mycobacterium avium subsp. paratuberculosis
gcgcaucaucgccc

SEQ ID NO: 2849150 - RNA, 16 nt, Mycobacterium avium subsp. paratuberculosis
gcgcaucaucgcccag

SEQ ID NO: 2849151 - RNA, 18 nt, Mycobacterium avium subsp. paratuberculosis
gcgcaucaucgcccagcg

SEQ ID NO: 2849152 - RNA, 23 nt, Mycobacterium avium subsp. paratuberculosis
gcgcaucaucgcccagcgcagcg

SEQ ID NO: 2849153 - RNA, 18 nt, Mycobacterium avium subsp. paratuberculosis
gcgcaucaucucggcgaa

SEQ ID NO: 2849154 - RNA, 13 nt, Mycobacterium avium subsp. paratuberculosis
gcgcauccaccag

SEQ ID NO: 2849155 - RNA, 14 nt, Mycobacterium avium subsp. paratuberculosis
gcgcauccaccagg

SEQ ID NO: 2849156 - RNA, 17 nt, Mycobacterium avium subsp. paratuberculosis
gcgcauccaccagggcg

SEQ ID NO: 2849157 - RNA, 19 nt, Mycobacterium avium subsp. paratuberculosis
gcgcauccaccagggcggu

SEQ ID NO: 2849158 - RNA, 20 nt, Mycobacterium avium subsp. paratuberculosis
gcgcauccaccagggcggug

SEQ ID NO: 2849159 - RNA, 17 nt, Mycobacterium avium subsp. paratuberculosis
gcgcauccgacaccgcc

SEQ ID NO: 2849160 - RNA, 12 nt, Mycobacterium avium subsp. paratuberculosis
gcgcauccgcac

SEQ ID NO: 2849161 - RNA, 20 nt, Mycobacterium avium subsp. paratuberculosis
gcgcauccucauagccggcc

SEQ ID NO: 2849162 - RNA, 21 nt, Mycobacterium avium subsp. paratuberculosis
gcgcauccucauagccggccg

SEQ ID NO: 2849163 - RNA, 22 nt, Mycobacterium avium subsp. paratuberculosis
gcgcauccucauagccggccgc

SEQ ID NO: 2849164 - RNA, 23 nt, Mycobacterium avium subsp. paratuberculosis
gcgcauccucauagccggccgcg

SEQ ID NO: 2849165 - RNA, 19 nt, Mycobacterium avium subsp. paratuberculosis
gcgcaucgacugcgacacc

SEQ ID NO: 2849166 - RNA, 13 nt, Mycobacterium avium subsp. paratuberculosis
gcgcaucgagcug

SEQ ID NO: 2849167 - RNA, 14 nt, Mycobacterium avium subsp. paratuberculosis
gcgcaucgagcugc

SEQ ID NO: 2849168 - RNA, 14 nt, Mycobacterium avium subsp. paratuberculosis
gcgcaucgccggcg

SEQ ID NO: 2849169 - RNA, 22 nt, Mycobacterium avium subsp. paratuberculosis
gcgcaucgccggcgaugcgcgc

SEQ ID NO: 2849170 - RNA, 23 nt, Mycobacterium avium subsp. paratuberculosis
gcgcaucgccggcgaugcgcgcc

SEQ ID NO: 2849171 - RNA, 19 nt, Mycobacterium avium subsp. paratuberculosis
gcgcaucgccggcgcgcug

SEQ ID NO: 2849172 - RNA, 15 nt, Mycobacterium avium subsp. paratuberculosis
gcgcaucgccucggc

SEQ ID NO: 2849173 - RNA, 16 nt, Mycobacterium avium subsp. paratuberculosis
gcgcaucgccucggcg

SEQ ID NO: 2849174 - RNA, 18 nt, Mycobacterium avium subsp. paratuberculosis
gcgcaucgccucggcggc

SEQ ID NO: 2849175 - RNA, 19 nt, Mycobacterium avium subsp. paratuberculosis
gcgcaucgccucggcggcc

SEQ ID NO: 2849176 - RNA, 23 nt, Mycobacterium avium subsp. paratuberculosis
gcgcaucgccucggcggccgccc

SEQ ID NO: 2849177 - RNA, 18 nt, Mycobacterium avium subsp. paratuberculosis
gcgcaucgcgggccaccg

SEQ ID NO: 2849178 - RNA, 17 nt, Mycobacterium avium subsp. paratuberculosis
gcgcaucggcgacgccg

SEQ ID NO: 2849179 - RNA, 19 nt, Mycobacterium avium subsp. paratuberculosis
gcgcaucggcgacgccgcc

SEQ ID NO: 2849180 - RNA, 15 nt, Mycobacterium avium subsp. paratuberculosis
gcgcaucggucacca

SEQ ID NO: 2849181 - RNA, 19 nt, Mycobacterium avium subsp. paratuberculosis
gcgcaucggucaccagcuc

SEQ ID NO: 2849182 - RNA, 18 nt, Mycobacterium avium subsp. paratuberculosis
gcgcaucggucagcaaca

SEQ ID NO: 2849183 - RNA, 19 nt, Mycobacterium avium subsp. paratuberculosis
gcgcaucggucagcaacag

SEQ ID NO: 2849184 - RNA, 15 nt, Mycobacterium avium subsp. paratuberculosis
gcgcaucguugccgg

SEQ ID NO: 2849185 - RNA, 19 nt, Mycobacterium avium subsp. paratuberculosis
gcgcaucguugccggcggc

SEQ ID NO: 2849186 - RNA, 20 nt, Mycobacterium avium subsp. paratuberculosis
gcgcaucguugccggcggcg

SEQ ID NO: 2849187 - RNA, 17 nt, Mycobacterium avium subsp. paratuberculosis
gcgcaucugcucggcgu

SEQ ID NO: 2849188 - RNA, 19 nt, Mycobacterium avium subsp. paratuberculosis
gcgcaucugcucggcgucc

SEQ ID NO: 2849189 - RNA, 21 nt, Mycobacterium avium subsp. paratuberculosis
gcgcaucugcucggcguccag

SEQ ID NO: 2849190 - RNA, 22 nt, Mycobacterium avium subsp. paratuberculosis
gcgcaugaccgauccgccggcg

SEQ ID NO: 2849191 - RNA, 12 nt, Mycobacterium avium subsp. paratuberculosis
gcgcaugacggc

SEQ ID NO: 2849192 - RNA, 15 nt, Mycobacterium avium subsp. paratuberculosis
gcgcaugacggccug

SEQ ID NO: 2849193 - RNA, 23 nt, Mycobacterium avium subsp. paratuberculosis
gcgcaugacggccugcaccacca

SEQ ID NO: 2849194 - RNA, 17 nt, Mycobacterium avium subsp. paratuberculosis
gcgcaugaugcccaggc

SEQ ID NO: 2849195 - RNA, 15 nt, Mycobacterium avium subsp. paratuberculosis
gcgcaugccagacca

SEQ ID NO: 2849196 - RNA, 17 nt, Mycobacterium avium subsp. paratuberculosis
gcgcaugccagaccaca

SEQ ID NO: 2849197 - RNA, 19 nt, Mycobacterium avium subsp. paratuberculosis
gcgcaugcccuggacgagu

SEQ ID NO: 2849198 - RNA, 23 nt, Mycobacterium avium subsp. paratuberculosis
gcgcaugccgaacaacagggccg

SEQ ID NO: 2849199 - RNA, 14 nt, Mycobacterium avium subsp. paratuberculosis
gcgcauggcgugcu

SEQ ID NO: 2849200 - RNA, 14 nt, Mycobacterium avium subsp. paratuberculosis
gcgcauggucaggu

SEQ ID NO: 2849201 - RNA, 22 nt, Mycobacterium avium subsp. paratuberculosis
gcgcauggucagguaggcgucg

SEQ ID NO: 2849202 - RNA, 19 nt, Mycobacterium avium subsp. paratuberculosis
gcgcauguaggacaccccg

SEQ ID NO: 2849203 - RNA, 21 nt, Mycobacterium avium subsp. paratuberculosis
gcgcauguaggacaccccggc

SEQ ID NO: 2849204 - RNA, 15 nt, Mycobacterium avium subsp. paratuberculosis
gcgcauucaccagcu

SEQ ID NO: 2849205 - RNA, 14 nt, Mycobacterium avium subsp. paratuberculosis
gcgcauucggcgac

SEQ ID NO: 2849206 - RNA, 20 nt, Mycobacterium avium subsp. paratuberculosis
gcgccaacaacucgacgcuc

SEQ ID NO: 2849207 - RNA, 21 nt, Mycobacterium avium subsp. paratuberculosis
gcgccaacauggcgcagaaca

SEQ ID NO: 2849208 - RNA, 21 nt, Mycobacterium avium subsp. paratuberculosis
gcgccaacgaggcacggcccg

SEQ ID NO: 2849209 - RNA, 22 nt, Mycobacterium avium subsp. paratuberculosis
gcgccaacgaggcacggcccgc

SEQ ID NO: 2849210 - RNA, 22 nt, Mycobacterium avium subsp. paratuberculosis
gcgccaacugaauuccuggccg

SEQ ID NO: 2849211 - RNA, 18 nt, Mycobacterium avium subsp. paratuberculosis
gcgccaaugguuuucguc

SEQ ID NO: 2849212 - RNA, 17 nt, Mycobacterium avium subsp. paratuberculosis
gcgccacaacuggccgg

SEQ ID NO: 2849213 - RNA, 20 nt, Mycobacterium avium subsp. paratuberculosis
gcgccacaacuggccgggau

SEQ ID NO: 2849214 - RNA, 17 nt, Mycobacterium avium subsp. paratuberculosis
gcgccacaauggauccg

SEQ ID NO: 2849215 - RNA, 13 nt, Mycobacterium avium subsp. paratuberculosis
gcgccacaccgaa

SEQ ID NO: 2849216 - RNA, 22 nt, Mycobacterium avium subsp. paratuberculosis
gcgccacaccgaagaaccccga

SEQ ID NO: 2849217 - RNA, 13 nt, Mycobacterium avium subsp. paratuberculosis
gcgccagcacggc

SEQ ID NO: 2849218 - RNA, 15 nt, Mycobacterium avium subsp. paratuberculosis
gcgccagcacggcca

SEQ ID NO: 2849219 - RNA, 16 nt, Mycobacterium avium subsp. paratuberculosis
gcgccagcacggccac

SEQ ID NO: 2849220 - RNA, 17 nt, Mycobacterium avium subsp. paratuberculosis
gcgccagcacggccacc

SEQ ID NO: 2849221 - RNA, 18 nt, Mycobacterium avium subsp. paratuberculosis
gcgccagcacggccacca

SEQ ID NO: 2849222 - RNA, 19 nt, Mycobacterium avium subsp. paratuberculosis
gcgccagcacggccaccag

SEQ ID NO: 2849223 - RNA, 20 nt, Mycobacterium avium subsp. paratuberculosis
gcgccagcacggccaccagc

SEQ ID NO: 2849224 - RNA, 21 nt, Mycobacterium avium subsp. paratuberculosis
gcgccagcacggccaccagca

SEQ ID NO: 2849225 - RNA, 12 nt, Mycobacterium avium subsp. paratuberculosis
gcgccagcagca

SEQ ID NO: 2849226 - RNA, 16 nt, Mycobacterium avium subsp. paratuberculosis
gcgccagcagcaacgc

SEQ ID NO: 2849227 - RNA, 19 nt, Mycobacterium avium subsp. paratuberculosis
gcgccagcagcagcgcggc

SEQ ID NO: 2849228 - RNA, 22 nt, Mycobacterium avium subsp. paratuberculosis
gcgccagcagcagcgcggcaug

SEQ ID NO: 2849229 - RNA, 13 nt, Mycobacterium avium subsp. paratuberculosis
gcgccagcagcgc

SEQ ID NO: 2849230 - RNA, 17 nt, Mycobacterium avium subsp. paratuberculosis
gcgccagcagcgcgccg

SEQ ID NO: 2849231 - RNA, 21 nt, Mycobacterium avium subsp. paratuberculosis
gcgccagcagcgcgccgcgcu

SEQ ID NO: 2849232 - RNA, 16 nt, Mycobacterium avium subsp. paratuberculosis
gcgccagcagcggcac

SEQ ID NO: 2849233 - RNA, 13 nt, Mycobacterium avium subsp. paratuberculosis
gcgccagcagggc

SEQ ID NO: 2849234 - RNA, 13 nt, Mycobacterium avium subsp. paratuberculosis
gcgccagcaugcc

SEQ ID NO: 2849235 - RNA, 12 nt, Mycobacterium avium subsp. paratuberculosis
gcgccagcccgc

SEQ ID NO: 2849236 - RNA, 16 nt, Mycobacterium avium subsp. paratuberculosis
gcgccagcccgcccag

SEQ ID NO: 2849237 - RNA, 15 nt, Mycobacterium avium subsp. paratuberculosis
gcgccagcccgguga

SEQ ID NO: 2849238 - RNA, 21 nt, Mycobacterium avium subsp. paratuberculosis
gcgccagcccggugaucgccg

SEQ ID NO: 2849239 - RNA, 19 nt, Mycobacterium avium subsp. paratuberculosis
gcgccagccgcaccgcgac

SEQ ID NO: 2849240 - RNA, 17 nt, Mycobacterium avium subsp. paratuberculosis
gcgccagccgccgccga

SEQ ID NO: 2849241 - RNA, 21 nt, Mycobacterium avium subsp. paratuberculosis
gcgccagccgccgccgaccac

SEQ ID NO: 2849242 - RNA, 14 nt, Mycobacterium avium subsp. paratuberculosis
gcgccagcgaccgc

SEQ ID NO: 2849243 - RNA, 15 nt, Mycobacterium avium subsp. paratuberculosis
gcgccagcgaccgca

SEQ ID NO: 2849244 - RNA, 16 nt, Mycobacterium avium subsp. paratuberculosis
gcgccagcgaccgcag

SEQ ID NO: 2849245 - RNA, 18 nt, Mycobacterium avium subsp. paratuberculosis
gcgccagcgaccgcaggu

SEQ ID NO: 2849246 - RNA, 16 nt, Mycobacterium avium subsp. paratuberculosis
gcgccagcgacggccg

SEQ ID NO: 2849247 - RNA, 19 nt, Mycobacterium avium subsp. paratuberculosis
gcgccagcgacggccgggu

SEQ ID NO: 2849248 - RNA, 19 nt, Mycobacterium avium subsp. paratuberculosis
gcgccagcgagugggugaa

SEQ ID NO: 2849249 - RNA, 14 nt, Mycobacterium avium subsp. paratuberculosis
gcgccagcgccagc

SEQ ID NO: 2849250 - RNA, 19 nt, Mycobacterium avium subsp. paratuberculosis
gcgccagcgccagcguggc

SEQ ID NO: 2849251 - RNA, 16 nt, Mycobacterium avium subsp. paratuberculosis
gcgccagcgcggugcc

SEQ ID NO: 2849252 - RNA, 18 nt, Mycobacterium avium subsp. paratuberculosis
gcgccagcgcggugccca

SEQ ID NO: 2849253 - RNA, 20 nt, Mycobacterium avium subsp. paratuberculosis
gcgccagcgcggugcccagc

SEQ ID NO: 2849254 - RNA, 15 nt, Mycobacterium avium subsp. paratuberculosis
gcgccagcgcgugcg

SEQ ID NO: 2849255 - RNA, 13 nt, Mycobacterium avium subsp. paratuberculosis
gcgccagcggccg

SEQ ID NO: 2849256 - RNA, 14 nt, Mycobacterium avium subsp. paratuberculosis
gcgccagcggucca

SEQ ID NO: 2849257 - RNA, 19 nt, Mycobacterium avium subsp. paratuberculosis
gcgccagcgguccagcgug

SEQ ID NO: 2849258 - RNA, 19 nt, Mycobacterium avium subsp. paratuberculosis
gcgccagcgucugcugcgc

SEQ ID NO: 2849259 - RNA, 20 nt, Mycobacterium avium subsp. paratuberculosis
gcgccagcgugaacagcgcc

SEQ ID NO: 2849260 - RNA, 22 nt, Mycobacterium avium subsp. paratuberculosis
gcgccagcgugaacagcgcccg

SEQ ID NO: 2849261 - RNA, 18 nt, Mycobacterium avium subsp. paratuberculosis
gcgccagcguggccagca

SEQ ID NO: 2849262 - RNA, 21 nt, Mycobacterium avium subsp. paratuberculosis
gcgccagcguggccagcaccg

SEQ ID NO: 2849263 - RNA, 19 nt, Mycobacterium avium subsp. paratuberculosis
gcgccagcguggcgaacgc

SEQ ID NO: 2849264 - RNA, 17 nt, Mycobacterium avium subsp. paratuberculosis
gcgccagcuccagcagc

SEQ ID NO: 2849265 - RNA, 14 nt, Mycobacterium avium subsp. paratuberculosis
gcgccagcucggcg

SEQ ID NO: 2849266 - RNA, 20 nt, Mycobacterium avium subsp. paratuberculosis
gcgccagcucggcggccggg

SEQ ID NO: 2849267 - RNA, 17 nt, Mycobacterium avium subsp. paratuberculosis
gcgccagcugggugguc

SEQ ID NO: 2849268 - RNA, 23 nt, Mycobacterium avium subsp. paratuberculosis
gcgccagcuggguggucaccagc

SEQ ID NO: 2849269 - RNA, 16 nt, Mycobacterium avium subsp. paratuberculosis
gcgccaggaccagcgg

SEQ ID NO: 2849270 - RNA, 15 nt, Mycobacterium avium subsp. paratuberculosis
gcgccaggauccgcc

SEQ ID NO: 2849271 - RNA, 18 nt, Mycobacterium avium subsp. paratuberculosis
gcgccaggauccgcccgc

SEQ ID NO: 2849272 - RNA, 19 nt, Mycobacterium avium subsp. paratuberculosis
gcgccaggauccgcccgcc

SEQ ID NO: 2849273 - RNA, 19 nt, Mycobacterium avium subsp. paratuberculosis
gcgccaggcagaagcucca

SEQ ID NO: 2849274 - RNA, 20 nt, Mycobacterium avium subsp. paratuberculosis
gcgccaggcagaagcuccac

SEQ ID NO: 2849275 - RNA, 16 nt, Mycobacterium avium subsp. paratuberculosis
gcgccaggcaggcggc

SEQ ID NO: 2849276 - RNA, 17 nt, Mycobacterium avium subsp. paratuberculosis
gcgccaggcaggcggcc

SEQ ID NO: 2849277 - RNA, 18 nt, Mycobacterium avium subsp. paratuberculosis
gcgccaggcaggcggcca

SEQ ID NO: 2849278 - RNA, 19 nt, Mycobacterium avium subsp. paratuberculosis
gcgccaggcaggcggccag

SEQ ID NO: 2849279 - RNA, 13 nt, Mycobacterium avium subsp. paratuberculosis
gcgccaggccaug

SEQ ID NO: 2849280 - RNA, 17 nt, Mycobacterium avium subsp. paratuberculosis
gcgccaggccauggcgc

SEQ ID NO: 2849281 - RNA, 22 nt, Mycobacterium avium subsp. paratuberculosis
gcgccaggccauggcgcaccgc

SEQ ID NO: 2849282 - RNA, 23 nt, Mycobacterium avium subsp. paratuberculosis
gcgccaggccauggcgcaccgcg

SEQ ID NO: 2849283 - RNA, 13 nt, Mycobacterium avium subsp. paratuberculosis
gcgccaggccggc

SEQ ID NO: 2849284 - RNA, 14 nt, Mycobacterium avium subsp. paratuberculosis
gcgccaggccggcg

SEQ ID NO: 2849285 - RNA, 17 nt, Mycobacterium avium subsp. paratuberculosis
gcgccaggccggcgacg

SEQ ID NO: 2849286 - RNA, 17 nt, Mycobacterium avium subsp. paratuberculosis
gcgccagggucuggccc

SEQ ID NO: 2849287 - RNA, 20 nt, Mycobacterium avium subsp. paratuberculosis
gcgccagggucuggcccggu

SEQ ID NO: 2849288 - RNA, 22 nt, Mycobacterium avium subsp. paratuberculosis
gcgccagggucuggcccggugc

SEQ ID NO: 2849289 - RNA, 17 nt, Mycobacterium avium subsp. paratuberculosis
gcgccagggugccccgc

SEQ ID NO: 2849290 - RNA, 22 nt, Mycobacterium avium subsp. paratuberculosis
gcgccagggugccccgcaccgc

SEQ ID NO: 2849291 - RNA, 22 nt, Mycobacterium avium subsp. paratuberculosis
gcgccaggucgggguccaggcc

SEQ ID NO: 2849292 - RNA, 23 nt, Mycobacterium avium subsp. paratuberculosis
gcgccaggucgggguccaggccg

SEQ ID NO: 2849293 - RNA, 22 nt, Mycobacterium avium subsp. paratuberculosis
gcgccaggugggugaacgccug

SEQ ID NO: 2849294 - RNA, 19 nt, Mycobacterium avium subsp. paratuberculosis
gcgccaguaguggaucagc

SEQ ID NO: 2849295 - RNA, 22 nt, Mycobacterium avium subsp. paratuberculosis
gcgccaguaguggaucagccag

SEQ ID NO: 2849296 - RNA, 22 nt, Mycobacterium avium subsp. paratuberculosis
gcgccagugggggaauggcggu

SEQ ID NO: 2849297 - RNA, 15 nt, Mycobacterium avium subsp. paratuberculosis
gcgccaguugcucgg

SEQ ID NO: 2849298 - RNA, 16 nt, Mycobacterium avium subsp. paratuberculosis
gcgccaguugcucggg

SEQ ID NO: 2849299 - RNA, 21 nt, Mycobacterium avium subsp. paratuberculosis
gcgccaguuugccgucgggac

SEQ ID NO: 2849300 - RNA, 22 nt, Mycobacterium avium subsp. paratuberculosis
gcgccaguuugccgucgggacg

SEQ ID NO: 2849301 - RNA, 20 nt, Mycobacterium avium subsp. paratuberculosis
gcgccccagggccucggcga

SEQ ID NO: 2849302 - RNA, 15 nt, Mycobacterium avium subsp. paratuberculosis
gcgccccagugcagg

SEQ ID NO: 2849303 - RNA, 13 nt, Mycobacterium avium subsp. paratuberculosis
gcgcccccagcgg

SEQ ID NO: 2849304 - RNA, 15 nt, Mycobacterium avium subsp. paratuberculosis
gcgcccccagcgggg

SEQ ID NO: 2849305 - RNA, 16 nt, Mycobacterium avium subsp. paratuberculosis
gcgccccccugcucgc

SEQ ID NO: 2849306 - RNA, 20 nt, Mycobacterium avium subsp. paratuberculosis
gcgccccccugcucgcugug

SEQ ID NO: 2849307 - RNA, 21 nt, Mycobacterium avium subsp. paratuberculosis
gcgcccccgacaggcccaccc

SEQ ID NO: 2849308 - RNA, 14 nt, Mycobacterium avium subsp. paratuberculosis
gcgcccccgcgacg

SEQ ID NO: 2849309 - RNA, 16 nt, Mycobacterium avium subsp. paratuberculosis
gcgcccccgcgacguc

SEQ ID NO: 2849310 - RNA, 15 nt, Mycobacterium avium subsp. paratuberculosis
gcgccccgaaguucg

SEQ ID NO: 2849311 - RNA, 19 nt, Mycobacterium avium subsp. paratuberculosis
gcgccccgacaucgccauc

SEQ ID NO: 2849312 - RNA, 15 nt, Mycobacterium avium subsp. paratuberculosis
gcgccccgagcagcg

SEQ ID NO: 2849313 - RNA, 16 nt, Mycobacterium avium subsp. paratuberculosis
gcgccccgagcagcgg

SEQ ID NO: 2849314 - RNA, 19 nt, Mycobacterium avium subsp. paratuberculosis
gcgccccgagcagcggguc

SEQ ID NO: 2849315 - RNA, 15 nt, Mycobacterium avium subsp. paratuberculosis
gcgccccgcccgcga

SEQ ID NO: 2849316 - RNA, 20 nt, Mycobacterium avium subsp. paratuberculosis
gcgccccgccgggaucggcg

SEQ ID NO: 2849317 - RNA, 14 nt, Mycobacterium avium subsp. paratuberculosis
gcgccccggcccgg

SEQ ID NO: 2849318 - RNA, 15 nt, Mycobacterium avium subsp. paratuberculosis
gcgccccggcgcuga

SEQ ID NO: 2849319 - RNA, 12 nt, Mycobacterium avium subsp. paratuberculosis
gcgccccggcgg

SEQ ID NO: 2849320 - RNA, 13 nt, Mycobacterium avium subsp. paratuberculosis
gcgccccggcggc

SEQ ID NO: 2849321 - RNA, 14 nt, Mycobacterium avium subsp. paratuberculosis
gcgccccggcgggc

SEQ ID NO: 2849322 - RNA, 23 nt, Mycobacterium avium subsp. paratuberculosis
gcgccccggcgggcggccgaucc

SEQ ID NO: 2849323 - RNA, 20 nt, Mycobacterium avium subsp. paratuberculosis
gcgccccgggauccgaggcg

SEQ ID NO: 2849324 - RNA, 12 nt, Mycobacterium avium subsp. paratuberculosis
gcgccccggucc

SEQ ID NO: 2849325 - RNA, 13 nt, Mycobacterium avium subsp. paratuberculosis
gcgccccgguccg

SEQ ID NO: 2849326 - RNA, 21 nt, Mycobacterium avium subsp. paratuberculosis
gcgccccgguccggcugaacg

SEQ ID NO: 2849327 - RNA, 17 nt, Mycobacterium avium subsp. paratuberculosis
gcgccccuggcgucggg

SEQ ID NO: 2849328 - RNA, 15 nt, Mycobacterium avium subsp. paratuberculosis
gcgcccgacauccag

SEQ ID NO: 2849329 - RNA, 20 nt, Mycobacterium avium subsp. paratuberculosis
gcgcccgacgaugcggggcg

SEQ ID NO: 2849330 - RNA, 13 nt, Mycobacterium avium subsp. paratuberculosis
gcgcccgacgccg

SEQ ID NO: 2849331 - RNA, 16 nt, Mycobacterium avium subsp. paratuberculosis
gcgcccgacgccggac

SEQ ID NO: 2849332 - RNA, 18 nt, Mycobacterium avium subsp. paratuberculosis
gcgcccgacggucgccac

SEQ ID NO: 2849333 - RNA, 19 nt, Mycobacterium avium subsp. paratuberculosis
gcgcccgagccgcacaaca

SEQ ID NO: 2849334 - RNA, 18 nt, Mycobacterium avium subsp. paratuberculosis
gcgcccgagucacccggc

SEQ ID NO: 2849335 - RNA, 13 nt, Mycobacterium avium subsp. paratuberculosis
gcgcccgaucggc

SEQ ID NO: 2849336 - RNA, 15 nt, Mycobacterium avium subsp. paratuberculosis
gcgcccgaucggcac

SEQ ID NO: 2849337 - RNA, 16 nt, Mycobacterium avium subsp. paratuberculosis
gcgcccgauggaggug

SEQ ID NO: 2849338 - RNA, 17 nt, Mycobacterium avium subsp. paratuberculosis
gcgcccgauuccccggc

SEQ ID NO: 2849339 - RNA, 19 nt, Mycobacterium avium subsp. paratuberculosis
gcgcccgauuccccggcgu

SEQ ID NO: 2849340 - RNA, 12 nt, Mycobacterium avium subsp. paratuberculosis
gcgcccgcaggc

SEQ ID NO: 2849341 - RNA, 15 nt, Mycobacterium avium subsp. paratuberculosis
gcgcccgcaggccgc

SEQ ID NO: 2849342 - RNA, 20 nt, Mycobacterium avium subsp. paratuberculosis
gcgcccgcaggccgcgagcc

SEQ ID NO: 2849343 - RNA, 16 nt, Mycobacterium avium subsp. paratuberculosis
gcgcccgcauguucuc

SEQ ID NO: 2849344 - RNA, 20 nt, Mycobacterium avium subsp. paratuberculosis
gcgcccgcauguucucgagc

SEQ ID NO: 2849345 - RNA, 15 nt, Mycobacterium avium subsp. paratuberculosis
gcgcccgccccgacg

SEQ ID NO: 2849346 - RNA, 17 nt, Mycobacterium avium subsp. paratuberculosis
gcgcccgccccgacgug

SEQ ID NO: 2849347 - RNA, 13 nt, Mycobacterium avium subsp. paratuberculosis
gcgcccgcccgga

SEQ ID NO: 2849348 - RNA, 13 nt, Mycobacterium avium subsp. paratuberculosis
gcgcccgcccggc

SEQ ID NO: 2849349 - RNA, 14 nt, Mycobacterium avium subsp. paratuberculosis
gcgcccgcccggcc

SEQ ID NO: 2849350 - RNA, 18 nt, Mycobacterium avium subsp. paratuberculosis
gcgcccgcccggcccggc

SEQ ID NO: 2849351 - RNA, 20 nt, Mycobacterium avium subsp. paratuberculosis
gcgcccgcccggcccggcgc

SEQ ID NO: 2849352 - RNA, 19 nt, Mycobacterium avium subsp. paratuberculosis
gcgcccgccgaacaccggc

SEQ ID NO: 2849353 - RNA, 20 nt, Mycobacterium avium subsp. paratuberculosis
gcgcccgccgaacaccggca

SEQ ID NO: 2849354 - RNA, 15 nt, Mycobacterium avium subsp. paratuberculosis
gcgcccgccgccacc

SEQ ID NO: 2849355 - RNA, 20 nt, Mycobacterium avium subsp. paratuberculosis
gcgcccgccgccaccacggc

SEQ ID NO: 2849356 - RNA, 19 nt, Mycobacterium avium subsp. paratuberculosis
gcgcccgccgcguacaccg

SEQ ID NO: 2849357 - RNA, 21 nt, Mycobacterium avium subsp. paratuberculosis
gcgcccgccgcguacaccggc

SEQ ID NO: 2849358 - RNA, 19 nt, Mycobacterium avium subsp. paratuberculosis
gcgcccgccggcccagcuc

SEQ ID NO: 2849359 - RNA, 21 nt, Mycobacterium avium subsp. paratuberculosis
gcgcccgccggcccagcucca

SEQ ID NO: 2849360 - RNA, 23 nt, Mycobacterium avium subsp. paratuberculosis
gcgcccgccggcccagcuccacg

SEQ ID NO: 2849361 - RNA, 13 nt, Mycobacterium avium subsp. paratuberculosis
gcgcccgcgccac

SEQ ID NO: 2849362 - RNA, 17 nt, Mycobacterium avium subsp. paratuberculosis
gcgcccgcgccaccccg

SEQ ID NO: 2849363 - RNA, 12 nt, Mycobacterium avium subsp. paratuberculosis
gcgcccgcgcga

SEQ ID NO: 2849364 - RNA, 12 nt, Mycobacterium avium subsp. paratuberculosis
gcgcccgcgcgc

SEQ ID NO: 2849365 - RNA, 14 nt, Mycobacterium avium subsp. paratuberculosis
gcgcccgcgcgcuc

SEQ ID NO: 2849366 - RNA, 21 nt, Mycobacterium avium subsp. paratuberculosis
gcgcccgcgcgcucgggggug

SEQ ID NO: 2849367 - RNA, 14 nt, Mycobacterium avium subsp. paratuberculosis
gcgcccgcgcgggc

SEQ ID NO: 2849368 - RNA, 18 nt, Mycobacterium avium subsp. paratuberculosis
gcgcccgcgcgggcugca

SEQ ID NO: 2849369 - RNA, 12 nt, Mycobacterium avium subsp. paratuberculosis
gcgcccgcgcgu

SEQ ID NO: 2849370 - RNA, 17 nt, Mycobacterium avium subsp. paratuberculosis
gcgcccgcgcgugggcc

SEQ ID NO: 2849371 - RNA, 22 nt, Mycobacterium avium subsp. paratuberculosis
gcgcccgcgcgugggccaacgc

SEQ ID NO: 2849372 - RNA, 12 nt, Mycobacterium avium subsp. paratuberculosis
gcgcccgcggcc

SEQ ID NO: 2849373 - RNA, 16 nt, Mycobacterium avium subsp. paratuberculosis
gcgcccgcggccaucg

SEQ ID NO: 2849374 - RNA, 18 nt, Mycobacterium avium subsp. paratuberculosis
gcgcccgcggccaucgcc

SEQ ID NO: 2849375 - RNA, 19 nt, Mycobacterium avium subsp. paratuberculosis
gcgcccgcggccuccagcc

SEQ ID NO: 2849376 - RNA, 16 nt, Mycobacterium avium subsp. paratuberculosis
gcgcccgcggcgcgca

SEQ ID NO: 2849377 - RNA, 15 nt, Mycobacterium avium subsp. paratuberculosis
gcgcccgcgggugca

SEQ ID NO: 2849378 - RNA, 20 nt, Mycobacterium avium subsp. paratuberculosis
gcgcccgcgggugcagccgg

SEQ ID NO: 2849379 - RNA, 21 nt, Mycobacterium avium subsp. paratuberculosis
gcgcccgcgggugcagccgga

SEQ ID NO: 2849380 - RNA, 14 nt, Mycobacterium avium subsp. paratuberculosis
gcgcccgcuccggc

SEQ ID NO: 2849381 - RNA, 17 nt, Mycobacterium avium subsp. paratuberculosis
gcgcccgcuccggcgga

SEQ ID NO: 2849382 - RNA, 22 nt, Mycobacterium avium subsp. paratuberculosis
gcgcccgcucgaggggcuuggc

SEQ ID NO: 2849383 - RNA, 17 nt, Mycobacterium avium subsp. paratuberculosis
gcgcccgcugcgcgggu

SEQ ID NO: 2849384 - RNA, 18 nt, Mycobacterium avium subsp. paratuberculosis
gcgcccgcugcgcggguc

SEQ ID NO: 2849385 - RNA, 19 nt, Mycobacterium avium subsp. paratuberculosis
gcgcccgcugcgcgggucg

SEQ ID NO: 2849386 - RNA, 12 nt, Mycobacterium avium subsp. paratuberculosis
gcgcccugcugg

SEQ ID NO: 2849387 - RNA, 22 nt, Mycobacterium avium subsp. paratuberculosis
gcgcccugcugggagcggccca

SEQ ID NO: 2849388 - RNA, 15 nt, Mycobacterium avium subsp. paratuberculosis
gcgcccuggaucgcg

SEQ ID NO: 2849389 - RNA, 17 nt, Mycobacterium avium subsp. paratuberculosis
gcgcccuggaucgcgcc

SEQ ID NO: 2849390 - RNA, 18 nt, Mycobacterium avium subsp. paratuberculosis
gcgcccuggaucgcgccu

SEQ ID NO: 2849391 - RNA, 19 nt, Mycobacterium avium subsp. paratuberculosis
gcgcccuggugcaacaccg

SEQ ID NO: 2849392 - RNA, 20 nt, Mycobacterium avium subsp. paratuberculosis
gcgcccuggugcaacaccga

SEQ ID NO: 2849393 - RNA, 23 nt, Mycobacterium avium subsp. paratuberculosis
gcgcccugguugauccagcggcg

SEQ ID NO: 2849394 - RNA, 14 nt, Mycobacterium avium subsp. paratuberculosis
gcgcccuucggcgc

SEQ ID NO: 2849395 - RNA, 12 nt, Mycobacterium avium subsp. paratuberculosis
gcgcccuucuuc

SEQ ID NO: 2849396 - RNA, 15 nt, Mycobacterium avium subsp. paratuberculosis
gcgcccuugagcacg

SEQ ID NO: 2849397 - RNA, 19 nt, Mycobacterium avium subsp. paratuberculosis
gcgcccuugagcacgguga

SEQ ID NO: 2849398 - RNA, 21 nt, Mycobacterium avium subsp. paratuberculosis
gcgcccuugagcacggugauc

SEQ ID NO: 2849399 - RNA, 16 nt, Mycobacterium avium subsp. paratuberculosis
gcgcccuugagcucgg

SEQ ID NO: 2849400 - RNA, 19 nt, Mycobacterium avium subsp. paratuberculosis
gcgcccuugagcucggccu

SEQ ID NO: 2849401 - RNA, 17 nt, Mycobacterium avium subsp. paratuberculosis
gcgcccuugccgaugcc

SEQ ID NO: 2849402 - RNA, 20 nt, Mycobacterium avium subsp. paratuberculosis
gcgcccuugccgaugccggc

SEQ ID NO: 2849403 - RNA, 23 nt, Mycobacterium avium subsp. paratuberculosis
gcgcccuugccgaugccggcguu

SEQ ID NO: 2849404 - RNA, 21 nt, Mycobacterium avium subsp. paratuberculosis
gcgccgaaaaacgcgacggcc

SEQ ID NO: 2849405 - RNA, 16 nt, Mycobacterium avium subsp. paratuberculosis
gcgccgaacaacggcg

SEQ ID NO: 2849406 - RNA, 18 nt, Mycobacterium avium subsp. paratuberculosis
gcgccgaacaacugaccg

SEQ ID NO: 2849407 - RNA, 15 nt, Mycobacterium avium subsp. paratuberculosis
gcgccgaacaccacg

SEQ ID NO: 2849408 - RNA, 20 nt, Mycobacterium avium subsp. paratuberculosis
gcgccgaacaccacgccgag

SEQ ID NO: 2849409 - RNA, 18 nt, Mycobacterium avium subsp. paratuberculosis
gcgccgaacaccugcggc

SEQ ID NO: 2849410 - RNA, 19 nt, Mycobacterium avium subsp. paratuberculosis
gcgccgaacaccugcggcg

SEQ ID NO: 2849411 - RNA, 20 nt, Mycobacterium avium subsp. paratuberculosis
gcgccgaacaccugcggcgg

SEQ ID NO: 2849412 - RNA, 21 nt, Mycobacterium avium subsp. paratuberculosis
gcgccgaacaccugcggcggc

SEQ ID NO: 2849413 - RNA, 22 nt, Mycobacterium avium subsp. paratuberculosis
gcgccgaacaccugcggcggca

SEQ ID NO: 2849414 - RNA, 23 nt, Mycobacterium avium subsp. paratuberculosis
gcgccgaacaccugcggcggcag

SEQ ID NO: 2849415 - RNA, 20 nt, Mycobacterium avium subsp. paratuberculosis
gcgccgaacagaugccugcc

SEQ ID NO: 2849416 - RNA, 21 nt, Mycobacterium avium subsp. paratuberculosis
gcgccgaacagaugccugccc

SEQ ID NO: 2849417 - RNA, 19 nt, Mycobacterium avium subsp. paratuberculosis
gcgccgaaccgggugacga

SEQ ID NO: 2849418 - RNA, 21 nt, Mycobacterium avium subsp. paratuberculosis
gcgccgaaccgggugacgacc

SEQ ID NO: 2849419 - RNA, 22 nt, Mycobacterium avium subsp. paratuberculosis
gcgccgaaccgggugacgacca

SEQ ID NO: 2849420 - RNA, 19 nt, Mycobacterium avium subsp. paratuberculosis
gcgccgaacgcaccaccgc

SEQ ID NO: 2849421 - RNA, 21 nt, Mycobacterium avium subsp. paratuberculosis
gcgccgaacgcaccaccgcgg

SEQ ID NO: 2849422 - RNA, 16 nt, Mycobacterium avium subsp. paratuberculosis
gcgccgaacgccggau

SEQ ID NO: 2849423 - RNA, 21 nt, Mycobacterium avium subsp. paratuberculosis
gcgccgaacgccggauuggcg

SEQ ID NO: 2849424 - RNA, 15 nt, Mycobacterium avium subsp. paratuberculosis
gcgccgaacgucgag

SEQ ID NO: 2849425 - RNA, 18 nt, Mycobacterium avium subsp. paratuberculosis
gcgccgaacgucgagcgc

SEQ ID NO: 2849426 - RNA, 22 nt, Mycobacterium avium subsp. paratuberculosis
gcgccgaacgucgagcgcggcc

SEQ ID NO: 2849427 - RNA, 18 nt, Mycobacterium avium subsp. paratuberculosis
gcgccgaacgugcacuca

SEQ ID NO: 2849428 - RNA, 19 nt, Mycobacterium avium subsp. paratuberculosis
gcgccgaacucggcgccgc

SEQ ID NO: 2849429 - RNA, 15 nt, Mycobacterium avium subsp. paratuberculosis
gcgccgaagauggcc

SEQ ID NO: 2849430 - RNA, 18 nt, Mycobacterium avium subsp. paratuberculosis
gcgccgaagauggccagc

SEQ ID NO: 2849431 - RNA, 23 nt, Mycobacterium avium subsp. paratuberculosis
gcgccgaagauggccagcgcggc

SEQ ID NO: 2849432 - RNA, 19 nt, Mycobacterium avium subsp. paratuberculosis
gcgccgaagauggccagga

SEQ ID NO: 2849433 - RNA, 17 nt, Mycobacterium avium subsp. paratuberculosis
gcgccgaagcccgcagc

SEQ ID NO: 2849434 - RNA, 16 nt, Mycobacterium avium subsp. paratuberculosis
gcgccgaagccgucga

SEQ ID NO: 2849435 - RNA, 19 nt, Mycobacterium avium subsp. paratuberculosis
gcgccgaaugccacgccga

SEQ ID NO: 2849436 - RNA, 23 nt, Mycobacterium avium subsp. paratuberculosis
gcgccgaauucgguugucgcggu

SEQ ID NO: 2849437 - RNA, 17 nt, Mycobacterium avium subsp. paratuberculosis
gcgccgacagacccgac

SEQ ID NO: 2849438 - RNA, 21 nt, Mycobacterium avium subsp. paratuberculosis
gcgccgacagaugcggcacca

SEQ ID NO: 2849439 - RNA, 23 nt, Mycobacterium avium subsp. paratuberculosis
gcgccgacagaugcggcaccagc

SEQ ID NO: 2849440 - RNA, 18 nt, Mycobacterium avium subsp. paratuberculosis
gcgccgacagucgcgggc

SEQ ID NO: 2849441 - RNA, 13 nt, Mycobacterium avium subsp. paratuberculosis
gcgccgaccacgg

SEQ ID NO: 2849442 - RNA, 14 nt, Mycobacterium avium subsp. paratuberculosis
gcgccgaccacggc

SEQ ID NO: 2849443 - RNA, 19 nt, Mycobacterium avium subsp. paratuberculosis
gcgccgaccacggccccag

SEQ ID NO: 2849444 - RNA, 15 nt, Mycobacterium avium subsp. paratuberculosis
gcgccgaccagcgcg

SEQ ID NO: 2849445 - RNA, 14 nt, Mycobacterium avium subsp. paratuberculosis
gcgccgaccaggcu

SEQ ID NO: 2849446 - RNA, 17 nt, Mycobacterium avium subsp. paratuberculosis
gcgccgacccccgccgc

SEQ ID NO: 2849447 - RNA, 19 nt, Mycobacterium avium subsp. paratuberculosis
gcgccgacccgcccgccgg

SEQ ID NO: 2849448 - RNA, 22 nt, Mycobacterium avium subsp. paratuberculosis
gcgccgacccgcccgccgggca

SEQ ID NO: 2849449 - RNA, 15 nt, Mycobacterium avium subsp. paratuberculosis
gcgccgaccgagggc

SEQ ID NO: 2849450 - RNA, 18 nt, Mycobacterium avium subsp. paratuberculosis
gcgccgaccgcgagcacg

SEQ ID NO: 2849451 - RNA, 16 nt, Mycobacterium avium subsp. paratuberculosis
gcgccgaccgcgaucg

SEQ ID NO: 2849452 - RNA, 16 nt, Mycobacterium avium subsp. paratuberculosis
gcgccgaccucggcca

SEQ ID NO: 2849453 - RNA, 16 nt, Mycobacterium avium subsp. paratuberculosis
gcgccgaccucgucgg

SEQ ID NO: 2849454 - RNA, 18 nt, Mycobacterium avium subsp. paratuberculosis
gcgccgaccucgucggcg

SEQ ID NO: 2849455 - RNA, 22 nt, Mycobacterium avium subsp. paratuberculosis
gcgccgaccucgucggcggugc

SEQ ID NO: 2849456 - RNA, 14 nt, Mycobacterium avium subsp. paratuberculosis
gcgccgaccugguc

SEQ ID NO: 2849457 - RNA, 15 nt, Mycobacterium avium subsp. paratuberculosis
gcgccgaccuggucg

SEQ ID NO: 2849458 - RNA, 18 nt, Mycobacterium avium subsp. paratuberculosis
gcgccgaccuggucgccg

SEQ ID NO: 2849459 - RNA, 22 nt, Mycobacterium avium subsp. paratuberculosis
gcgccgaccuggucgccgaacg

SEQ ID NO: 2849460 - RNA, 23 nt, Mycobacterium avium subsp. paratuberculosis
gcgccgacgaccaguucgcccug

SEQ ID NO: 2849461 - RNA, 20 nt, Mycobacterium avium subsp. paratuberculosis
gcgccgacgacgucgcgcag

SEQ ID NO: 2849462 - RNA, 18 nt, Mycobacterium avium subsp. paratuberculosis
gcgccgacgaucccggcg

SEQ ID NO: 2849463 - RNA, 20 nt, Mycobacterium avium subsp. paratuberculosis
gcgccgacgaucccggcgag

SEQ ID NO: 2849464 - RNA, 23 nt, Mycobacterium avium subsp. paratuberculosis
gcgccgacgaucccggcgagcac

SEQ ID NO: 2849465 - RNA, 24 nt, Mycobacterium avium subsp. paratuberculosis
gcgccgacgaucccggcgagcacg

SEQ ID NO: 2849466 - RNA, 22 nt, Mycobacterium avium subsp. paratuberculosis
gcgccgacgcccacagcgccag

SEQ ID NO: 2849467 - RNA, 17 nt, Mycobacterium avium subsp. paratuberculosis
gcgccgacggccagcag

SEQ ID NO: 2849468 - RNA, 18 nt, Mycobacterium avium subsp. paratuberculosis
gcgccgacggccagcagg

SEQ ID NO: 2849469 - RNA, 15 nt, Mycobacterium avium subsp. paratuberculosis
gcgccgacggccgcg

SEQ ID NO: 2849470 - RNA, 22 nt, Mycobacterium avium subsp. paratuberculosis
gcgccgcacagccggcggcggc

SEQ ID NO: 2849471 - RNA, 20 nt, Mycobacterium avium subsp. paratuberculosis
gcgccgcaccaguuccugca

SEQ ID NO: 2849472 - RNA, 16 nt, Mycobacterium avium subsp. paratuberculosis
gcgccgcaccucgccg

SEQ ID NO: 2849473 - RNA, 18 nt, Mycobacterium avium subsp. paratuberculosis
gcgccgcaccucgccgau

SEQ ID NO: 2849474 - RNA, 17 nt, Mycobacterium avium subsp. paratuberculosis
gcgccgcacugcacggc

SEQ ID NO: 2849475 - RNA, 13 nt, Mycobacterium avium subsp. paratuberculosis
gcgccgcagcacg

SEQ ID NO: 2849476 - RNA, 23 nt, Mycobacterium avium subsp. paratuberculosis
gcgccgcagcaggugcaucgcca

SEQ ID NO: 2849477 - RNA, 20 nt, Mycobacterium avium subsp. paratuberculosis
gcgccgcagcgcgcgcucgg

SEQ ID NO: 2849478 - RNA, 23 nt, Mycobacterium avium subsp. paratuberculosis
gcgccgcagcgcgcgcucgguca

SEQ ID NO: 2849479 - RNA, 18 nt, Mycobacterium avium subsp. paratuberculosis
gcgccgcagcggcgccgg

SEQ ID NO: 2849480 - RNA, 15 nt, Mycobacterium avium subsp. paratuberculosis
gcgccgcagcgguga

SEQ ID NO: 2849481 - RNA, 23 nt, Mycobacterium avium subsp. paratuberculosis
gcgccgcagcggugaucgcguca

SEQ ID NO: 2849482 - RNA, 19 nt, Mycobacterium avium subsp. paratuberculosis
gcgccgcaggagaucggcg

SEQ ID NO: 2849483 - RNA, 22 nt, Mycobacterium avium subsp. paratuberculosis
gcgccgcaggagaucggcgcgg

SEQ ID NO: 2849484 - RNA, 19 nt, Mycobacterium avium subsp. paratuberculosis
gcgccgcaugaugcggcca

SEQ ID NO: 2849485 - RNA, 17 nt, Mycobacterium avium subsp. paratuberculosis
gcgccgcauuggcaccg

SEQ ID NO: 2849486 - RNA, 20 nt, Mycobacterium avium subsp. paratuberculosis
gcgccgcauuggcaccgucg

SEQ ID NO: 2849487 - RNA, 16 nt, Mycobacterium avium subsp. paratuberculosis
gcgccgcauuggugcc

SEQ ID NO: 2849488 - RNA, 17 nt, Mycobacterium avium subsp. paratuberculosis
gcgccgcauuggugccg

SEQ ID NO: 2849489 - RNA, 19 nt, Mycobacterium avium subsp. paratuberculosis
gcgccgcauuggugccggc

SEQ ID NO: 2849490 - RNA, 19 nt, Mycobacterium avium subsp. paratuberculosis
gcgccgccacaccucggcg

SEQ ID NO: 2849491 - RNA, 12 nt, Mycobacterium avium subsp. paratuberculosis
gcgccgccaccc

SEQ ID NO: 2849492 - RNA, 15 nt, Mycobacterium avium subsp. paratuberculosis
gcgccgccaccccag

SEQ ID NO: 2849493 - RNA, 17 nt, Mycobacterium avium subsp. paratuberculosis
gcgccgccaccccaggc

SEQ ID NO: 2849494 - RNA, 22 nt, Mycobacterium avium subsp. paratuberculosis
gcgccgccaccccaggcgaugc

SEQ ID NO: 2849495 - RNA, 14 nt, Mycobacterium avium subsp. paratuberculosis
gcgccgccaccggc

SEQ ID NO: 2849496 - RNA, 16 nt, Mycobacterium avium subsp. paratuberculosis
gcgccgccaccggccg

SEQ ID NO: 2849497 - RNA, 17 nt, Mycobacterium avium subsp. paratuberculosis
gcgccgccaccggccgg

SEQ ID NO: 2849498 - RNA, 19 nt, Mycobacterium avium subsp. paratuberculosis
gcgccgccacgcggcgcgc

SEQ ID NO: 2849499 - RNA, 16 nt, Mycobacterium avium subsp. paratuberculosis
gcgccgccacggccac

SEQ ID NO: 2849500 - RNA, 14 nt, Mycobacterium avium subsp. paratuberculosis
gcgccgccagcaac

SEQ ID NO: 2849501 - RNA, 20 nt, Mycobacterium avium subsp. paratuberculosis
gcgccgccagcaaccccgcg

SEQ ID NO: 2849502 - RNA, 21 nt, Mycobacterium avium subsp. paratuberculosis
gcgccgccagcaaccccgcgg

SEQ ID NO: 2849503 - RNA, 22 nt, Mycobacterium avium subsp. paratuberculosis
gcgccgccagcaaccccgcggu

SEQ ID NO: 2849504 - RNA, 20 nt, Mycobacterium avium subsp. paratuberculosis
gcgccgccaucgccucgucc

SEQ ID NO: 2849505 - RNA, 12 nt, Mycobacterium avium subsp. paratuberculosis
gcgccgcccaca

SEQ ID NO: 2849506 - RNA, 15 nt, Mycobacterium avium subsp. paratuberculosis
gcgccgcccacaccg

SEQ ID NO: 2849507 - RNA, 14 nt, Mycobacterium avium subsp. paratuberculosis
gcgccgcccaccag

SEQ ID NO: 2849508 - RNA, 13 nt, Mycobacterium avium subsp. paratuberculosis
gcgccgcccagcg

SEQ ID NO: 2849509 - RNA, 14 nt, Mycobacterium avium subsp. paratuberculosis
gcgccgcccagcgg

SEQ ID NO: 2849510 - RNA, 15 nt, Mycobacterium avium subsp. paratuberculosis
gcgccgcccagcggc

SEQ ID NO: 2849511 - RNA, 17 nt, Mycobacterium avium subsp. paratuberculosis
gcgccgcccagcggccc

SEQ ID NO: 2849512 - RNA, 19 nt, Mycobacterium avium subsp. paratuberculosis
gcgccgcccagcggccccg

SEQ ID NO: 2849513 - RNA, 21 nt, Mycobacterium avium subsp. paratuberculosis
gcgccgcccagcggccccggc

SEQ ID NO: 2849514 - RNA, 15 nt, Mycobacterium avium subsp. paratuberculosis
gcgccgcccagcggu

SEQ ID NO: 2849515 - RNA, 18 nt, Mycobacterium avium subsp. paratuberculosis
gcgccgcccccgcggcgu

SEQ ID NO: 2849516 - RNA, 20 nt, Mycobacterium avium subsp. paratuberculosis
gcgccgcccccgcggcgucc

SEQ ID NO: 2849517 - RNA, 22 nt, Mycobacterium avium subsp. paratuberculosis
gcgccgcccgcaccugcgcgcc

SEQ ID NO: 2849518 - RNA, 12 nt, Mycobacterium avium subsp. paratuberculosis
gcgccgcccggc

SEQ ID NO: 2849519 - RNA, 15 nt, Mycobacterium avium subsp. paratuberculosis
gcgccgcccggcgau

SEQ ID NO: 2849520 - RNA, 16 nt, Mycobacterium avium subsp. paratuberculosis
gcgccgcccggcgaua

SEQ ID NO: 2849521 - RNA, 17 nt, Mycobacterium avium subsp. paratuberculosis
gcgccgcccgggcccgg

SEQ ID NO: 2849522 - RNA, 14 nt, Mycobacterium avium subsp. paratuberculosis
gcgccgcccgggcg

SEQ ID NO: 2849523 - RNA, 19 nt, Mycobacterium avium subsp. paratuberculosis
gcgccgcccgggcggcccg

SEQ ID NO: 2849524 - RNA, 15 nt, Mycobacterium avium subsp. paratuberculosis
gcgccgcccguccag

SEQ ID NO: 2849525 - RNA, 19 nt, Mycobacterium avium subsp. paratuberculosis
gcgccgcccguccagcgca

SEQ ID NO: 2849526 - RNA, 15 nt, Mycobacterium avium subsp. paratuberculosis
gcgccgcccucgccg

SEQ ID NO: 2849527 - RNA, 16 nt, Mycobacterium avium subsp. paratuberculosis
gcgccgcccucgccga

SEQ ID NO: 2849528 - RNA, 23 nt, Mycobacterium avium subsp. paratuberculosis
gcgccgcccucgccgaaccgggg

SEQ ID NO: 2849529 - RNA, 21 nt, Mycobacterium avium subsp. paratuberculosis
gcgccgccgaacagcagcgcg

SEQ ID NO: 2849530 - RNA, 15 nt, Mycobacterium avium subsp. paratuberculosis
gcgccgccgaccacg

SEQ ID NO: 2849531 - RNA, 20 nt, Mycobacterium avium subsp. paratuberculosis
gcgccgccgaccgcccgcug

SEQ ID NO: 2849532 - RNA, 12 nt, Mycobacterium avium subsp. paratuberculosis
gcgccgccgagc

SEQ ID NO: 2849533 - RNA, 13 nt, Mycobacterium avium subsp. paratuberculosis
gcgccgccgagca

SEQ ID NO: 2849534 - RNA, 14 nt, Mycobacterium avium subsp. paratuberculosis
gcgccgccgagcaa

SEQ ID NO: 2849535 - RNA, 13 nt, Mycobacterium avium subsp. paratuberculosis
gcgccgccgagcc

SEQ ID NO: 2849536 - RNA, 20 nt, Mycobacterium avium subsp. paratuberculosis
gcgccgccgagccgcgggug

SEQ ID NO: 2849537 - RNA, 13 nt, Mycobacterium avium subsp. paratuberculosis
gcgccgccgccag

SEQ ID NO: 2849538 - RNA, 15 nt, Mycobacterium avium subsp. paratuberculosis
gcgccgccgccagcc

SEQ ID NO: 2849539 - RNA, 17 nt, Mycobacterium avium subsp. paratuberculosis
gcgccgccgccagccag

SEQ ID NO: 2849540 - RNA, 14 nt, Mycobacterium avium subsp. paratuberculosis
gcgccgccgccgcc

SEQ ID NO: 2849541 - RNA, 13 nt, Mycobacterium avium subsp. paratuberculosis
gcgccgccgcgca

SEQ ID NO: 2849542 - RNA, 19 nt, Mycobacterium avium subsp. paratuberculosis
gcgccgccgcgcaggccgc

SEQ ID NO: 2849543 - RNA, 21 nt, Mycobacterium avium subsp. paratuberculosis
gcgccgccgcgucgccgccgg

SEQ ID NO: 2849544 - RNA, 13 nt, Mycobacterium avium subsp. paratuberculosis
gcgccgccggcgu

SEQ ID NO: 2849545 - RNA, 14 nt, Mycobacterium avium subsp. paratuberculosis
gcgccgccggcguc

SEQ ID NO: 2849546 - RNA, 19 nt, Mycobacterium avium subsp. paratuberculosis
gcgccgccggcgucgacgu

SEQ ID NO: 2849547 - RNA, 21 nt, Mycobacterium avium subsp. paratuberculosis
gcgccgccggcgucgacgucg

SEQ ID NO: 2849548 - RNA, 14 nt, Mycobacterium avium subsp. paratuberculosis
gcgccgccggggcg

SEQ ID NO: 2849549 - RNA, 20 nt, Mycobacterium avium subsp. paratuberculosis
gcgccgccggucgcccccuc

SEQ ID NO: 2849550 - RNA, 22 nt, Mycobacterium avium subsp. paratuberculosis
gcgccgccggucgcccccucgg

SEQ ID NO: 2849551 - RNA, 23 nt, Mycobacterium avium subsp. paratuberculosis
gcgccgccggucgcccccucggc

SEQ ID NO: 2849552 - RNA, 14 nt, Mycobacterium avium subsp. paratuberculosis
gcgccgccggugac

SEQ ID NO: 2849553 - RNA, 22 nt, Mycobacterium avium subsp. paratuberculosis
gcgccgccguucgccggcgacg

SEQ ID NO: 2849554 - RNA, 20 nt, Mycobacterium avium subsp. paratuberculosis
gcgccgccuccgggcugccg

SEQ ID NO: 2849555 - RNA, 16 nt, Mycobacterium avium subsp. paratuberculosis
gcgccggacggcccgc

SEQ ID NO: 2849556 - RNA, 15 nt, Mycobacterium avium subsp. paratuberculosis
gcgccggacucgaag

SEQ ID NO: 2849557 - RNA, 23 nt, Mycobacterium avium subsp. paratuberculosis
gcgccggacucgaagaucgccug

SEQ ID NO: 2849558 - RNA, 13 nt, Mycobacterium avium subsp. paratuberculosis
gcgccggaggcca

SEQ ID NO: 2849559 - RNA, 15 nt, Mycobacterium avium subsp. paratuberculosis
gcgccggaggccagc

SEQ ID NO: 2849560 - RNA, 16 nt, Mycobacterium avium subsp. paratuberculosis
gcgccggaggccagcu

SEQ ID NO: 2849561 - RNA, 23 nt, Mycobacterium avium subsp. paratuberculosis
gcgccggaggccagcucgaccgc

SEQ ID NO: 2849562 - RNA, 23 nt, Mycobacterium avium subsp. paratuberculosis
gcgccggaggggcgacgggccga

SEQ ID NO: 2849563 - RNA, 21 nt, Mycobacterium avium subsp. paratuberculosis
gcgccggaguugccgauggcg

SEQ ID NO: 2849564 - RNA, 19 nt, Mycobacterium avium subsp. paratuberculosis
gcgccggaucggcccccgg

SEQ ID NO: 2849565 - RNA, 23 nt, Mycobacterium avium subsp. paratuberculosis
gcgccggaucggcccccgggccc

SEQ ID NO: 2849566 - RNA, 15 nt, Mycobacterium avium subsp. paratuberculosis
gcgccggaugccagc

SEQ ID NO: 2849567 - RNA, 16 nt, Mycobacterium avium subsp. paratuberculosis
gcgccggaugccagca

SEQ ID NO: 2849568 - RNA, 17 nt, Mycobacterium avium subsp. paratuberculosis
gcgccggaugccagcag

SEQ ID NO: 2849569 - RNA, 18 nt, Mycobacterium avium subsp. paratuberculosis
gcgccggaugccagcagg

SEQ ID NO: 2849570 - RNA, 22 nt, Mycobacterium avium subsp. paratuberculosis
gcgccggaugccagcagguccg

SEQ ID NO: 2849571 - RNA, 15 nt, Mycobacterium avium subsp. paratuberculosis
gcgccggaugcugcg

SEQ ID NO: 2849572 - RNA, 21 nt, Mycobacterium avium subsp. paratuberculosis
gcgccggaugcugcgcaacac

SEQ ID NO: 2849573 - RNA, 17 nt, Mycobacterium avium subsp. paratuberculosis
gcgccggaugggcgcac

SEQ ID NO: 2849574 - RNA, 17 nt, Mycobacterium avium subsp. paratuberculosis
gcgccggauucggcgcg

SEQ ID NO: 2849575 - RNA, 18 nt, Mycobacterium avium subsp. paratuberculosis
gcgccggauucggcgcgg

SEQ ID NO: 2849576 - RNA, 18 nt, Mycobacterium avium subsp. paratuberculosis
gcgccggcaacaacgcca

SEQ ID NO: 2849577 - RNA, 20 nt, Mycobacterium avium subsp. paratuberculosis
gcgccggcaacaacgccagc

SEQ ID NO: 2849578 - RNA, 20 nt, Mycobacterium avium subsp. paratuberculosis
gcgccggcaacuggccgccc

SEQ ID NO: 2849579 - RNA, 23 nt, Mycobacterium avium subsp. paratuberculosis
gcgccggcaccagcagccgcagc

SEQ ID NO: 2849580 - RNA, 15 nt, Mycobacterium avium subsp. paratuberculosis
gcgccggcacucguc

SEQ ID NO: 2849581 - RNA, 17 nt, Mycobacterium avium subsp. paratuberculosis
gcgccggcacugcugcc

SEQ ID NO: 2849582 - RNA, 23 nt, Mycobacterium avium subsp. paratuberculosis
gcgccggcacugcugcccgcgac

SEQ ID NO: 2849583 - RNA, 17 nt, Mycobacterium avium subsp. paratuberculosis
gcgccggcagcaaccgg

SEQ ID NO: 2849584 - RNA, 19 nt, Mycobacterium avium subsp. paratuberculosis
gcgccggcagcaaccggcg

SEQ ID NO: 2849585 - RNA, 16 nt, Mycobacterium avium subsp. paratuberculosis
gcgccggcagcgccuc

SEQ ID NO: 2849586 - RNA, 18 nt, Mycobacterium avium subsp. paratuberculosis
gcgccggcagcggccgca

SEQ ID NO: 2849587 - RNA, 17 nt, Mycobacterium avium subsp. paratuberculosis
gcgccggcauccagcac

SEQ ID NO: 2849588 - RNA, 22 nt, Mycobacterium avium subsp. paratuberculosis
gcgccggcauccagcacggccg

SEQ ID NO: 2849589 - RNA, 19 nt, Mycobacterium avium subsp. paratuberculosis
gcgccggcaucgaccgccc

SEQ ID NO: 2849590 - RNA, 13 nt, Mycobacterium avium subsp. paratuberculosis
gcgccggccagca

SEQ ID NO: 2849591 - RNA, 16 nt, Mycobacterium avium subsp. paratuberculosis
gcgccggccagcacca

SEQ ID NO: 2849592 - RNA, 15 nt, Mycobacterium avium subsp. paratuberculosis
gcgccggccagcacg

SEQ ID NO: 2849593 - RNA, 16 nt, Mycobacterium avium subsp. paratuberculosis
gcgccggccagcacgg

SEQ ID NO: 2849594 - RNA, 21 nt, Mycobacterium avium subsp. paratuberculosis
gcgccggccagcacggccagc

SEQ ID NO: 2849595 - RNA, 23 nt, Mycobacterium avium subsp. paratuberculosis
gcgccggccagcacggcggcgug

SEQ ID NO: 2849596 - RNA, 14 nt, Mycobacterium avium subsp. paratuberculosis
gcgccggccagcag

SEQ ID NO: 2849597 - RNA, 15 nt, Mycobacterium avium subsp. paratuberculosis
gcgccggccagcagc

SEQ ID NO: 2849598 - RNA, 18 nt, Mycobacterium avium subsp. paratuberculosis
gcgccggccagcagcagg

SEQ ID NO: 2849599 - RNA, 13 nt, Mycobacterium avium subsp. paratuberculosis
gcgccggccagcc

SEQ ID NO: 2849600 - RNA, 17 nt, Mycobacterium avium subsp. paratuberculosis
gcgccggccagccggcu

SEQ ID NO: 2849601 - RNA, 14 nt, Mycobacterium avium subsp. paratuberculosis
gcgccggccgccgg

SEQ ID NO: 2849602 - RNA, 15 nt, Mycobacterium avium subsp. paratuberculosis
gcgccggccgccgga

SEQ ID NO: 2849603 - RNA, 22 nt, Mycobacterium avium subsp. paratuberculosis
gcgccggccggacagaucgccc

SEQ ID NO: 2849604 - RNA, 14 nt, Mycobacterium avium subsp. paratuberculosis
gcgccggccggagc

SEQ ID NO: 2849605 - RNA, 13 nt, Mycobacterium avium subsp. paratuberculosis
gcgccggccggcg

SEQ ID NO: 2849606 - RNA, 14 nt, Mycobacterium avium subsp. paratuberculosis
gcgccggccggcgc

SEQ ID NO: 2849607 - RNA, 13 nt, Mycobacterium avium subsp. paratuberculosis
gcgccggccgggc

SEQ ID NO: 2849608 - RNA, 13 nt, Mycobacterium avium subsp. paratuberculosis
gcgccggccguca

SEQ ID NO: 2849609 - RNA, 21 nt, Mycobacterium avium subsp. paratuberculosis
gcgccggccgucacgcuggcg

SEQ ID NO: 2849610 - RNA, 17 nt, Mycobacterium avium subsp. paratuberculosis
gcgccggccuuggcccg

SEQ ID NO: 2849611 - RNA, 21 nt, Mycobacterium avium subsp. paratuberculosis
gcgccggccuuggcccgcgcc

SEQ ID NO: 2849612 - RNA, 20 nt, Mycobacterium avium subsp. paratuberculosis
gcgccggcgauaggcggcca

SEQ ID NO: 2849613 - RNA, 21 nt, Mycobacterium avium subsp. paratuberculosis
gcgccggcgauaggcggccag

SEQ ID NO: 2849614 - RNA, 21 nt, Mycobacterium avium subsp. paratuberculosis
gcgccggcgaugaacacgccg

SEQ ID NO: 2849615 - RNA, 17 nt, Mycobacterium avium subsp. paratuberculosis
gcgccggcgcacaucgu

SEQ ID NO: 2849616 - RNA, 13 nt, Mycobacterium avium subsp. paratuberculosis
gcgccggcgcagc

SEQ ID NO: 2849617 - RNA, 16 nt, Mycobacterium avium subsp. paratuberculosis
gcgccggcgcagcggc

SEQ ID NO: 2849618 - RNA, 19 nt, Mycobacterium avium subsp. paratuberculosis
gcgccggcgcagcggcccg

SEQ ID NO: 2849619 - RNA, 14 nt, Mycobacterium avium subsp. paratuberculosis
gcgccggcgcgcag

SEQ ID NO: 2849620 - RNA, 14 nt, Mycobacterium avium subsp. paratuberculosis
gcgccggcgcgcga

SEQ ID NO: 2849621 - RNA, 16 nt, Mycobacterium avium subsp. paratuberculosis
gcgccggcgcggccag

SEQ ID NO: 2849622 - RNA, 17 nt, Mycobacterium avium subsp. paratuberculosis
gcgccggcgcggccagc

SEQ ID NO: 2849623 - RNA, 13 nt, Mycobacterium avium subsp. paratuberculosis
gcgccggcgcggg

SEQ ID NO: 2849624 - RNA, 15 nt, Mycobacterium avium subsp. paratuberculosis
gcgccggcgcgggca

SEQ ID NO: 2849625 - RNA, 11 nt, Mycobacterium avium subsp. paratuberculosis
gcgccggcggc

SEQ ID NO: 2849626 - RNA, 12 nt, Mycobacterium avium subsp. paratuberculosis
gcgccggcggcc

SEQ ID NO: 2849627 - RNA, 14 nt, Mycobacterium avium subsp. paratuberculosis
gcgccggcggccac

SEQ ID NO: 2849628 - RNA, 16 nt, Mycobacterium avium subsp. paratuberculosis
gcgccggcggccacgc

SEQ ID NO: 2849629 - RNA, 14 nt, Mycobacterium avium subsp. paratuberculosis
gcgccggcggccgc

SEQ ID NO: 2849630 - RNA, 15 nt, Mycobacterium avium subsp. paratuberculosis
gcgccggcggccgcg

SEQ ID NO: 2849631 - RNA, 16 nt, Mycobacterium avium subsp. paratuberculosis
gcgccggcggccgcga

SEQ ID NO: 2849632 - RNA, 17 nt, Mycobacterium avium subsp. paratuberculosis
gcgccggcggccgcgac

SEQ ID NO: 2849633 - RNA, 13 nt, Mycobacterium avium subsp. paratuberculosis
gcgccggcggcgg

SEQ ID NO: 2849634 - RNA, 23 nt, Mycobacterium avium subsp. paratuberculosis
gcgccggcgguaugcccgggccg

SEQ ID NO: 2849635 - RNA, 12 nt, Mycobacterium avium subsp. paratuberculosis
gcgccggcgguc

SEQ ID NO: 2849636 - RNA, 19 nt, Mycobacterium avium subsp. paratuberculosis
gcgccggcggugcggcggg

SEQ ID NO: 2849637 - RNA, 14 nt, Mycobacterium avium subsp. paratuberculosis
gcgccggcgguguc

SEQ ID NO: 2849638 - RNA, 17 nt, Mycobacterium avium subsp. paratuberculosis
gcgccggcggugucgag

SEQ ID NO: 2849639 - RNA, 20 nt, Mycobacterium avium subsp. paratuberculosis
gcgccggcggugucgagaug

SEQ ID NO: 2849640 - RNA, 15 nt, Mycobacterium avium subsp. paratuberculosis
gcgccgguaggccgc

SEQ ID NO: 2849641 - RNA, 17 nt, Mycobacterium avium subsp. paratuberculosis
gcgccgguaggccgcgc

SEQ ID NO: 2849642 - RNA, 18 nt, Mycobacterium avium subsp. paratuberculosis
gcgccgguaggccgcgcc

SEQ ID NO: 2849643 - RNA, 19 nt, Mycobacterium avium subsp. paratuberculosis
gcgccgguaggccgcgccg

SEQ ID NO: 2849644 - RNA, 20 nt, Mycobacterium avium subsp. paratuberculosis
gcgccgguaggccgcgccga

SEQ ID NO: 2849645 - RNA, 17 nt, Mycobacterium avium subsp. paratuberculosis
gcgccgguaggcgcggg

SEQ ID NO: 2849646 - RNA, 19 nt, Mycobacterium avium subsp. paratuberculosis
gcgccgguaggcgcgggug

SEQ ID NO: 2849647 - RNA, 19 nt, Mycobacterium avium subsp. paratuberculosis
gcgccgguaggcggccagc

SEQ ID NO: 2849648 - RNA, 20 nt, Mycobacterium avium subsp. paratuberculosis
gcgccgguaggcggccagcg

SEQ ID NO: 2849649 - RNA, 21 nt, Mycobacterium avium subsp. paratuberculosis
gcgccgguaggcggccagcgc

SEQ ID NO: 2849650 - RNA, 22 nt, Mycobacterium avium subsp. paratuberculosis
gcgccgguaggcggccagcgcc

SEQ ID NO: 2849651 - RNA, 22 nt, Mycobacterium avium subsp. paratuberculosis
gcgccgguauauucgcgaugga

SEQ ID NO: 2849652 - RNA, 22 nt, Mycobacterium avium subsp. paratuberculosis
gcgccgguaucgagcaccagca

SEQ ID NO: 2849653 - RNA, 23 nt, Mycobacterium avium subsp. paratuberculosis
gcgccggucagaccccguaccag

SEQ ID NO: 2849654 - RNA, 13 nt, Mycobacterium avium subsp. paratuberculosis
gcgccggucagcg

SEQ ID NO: 2849655 - RNA, 15 nt, Mycobacterium avium subsp. paratuberculosis
gcgccggucagcggc

SEQ ID NO: 2849656 - RNA, 16 nt, Mycobacterium avium subsp. paratuberculosis
gcgccggucagcggca

SEQ ID NO: 2849657 - RNA, 23 nt, Mycobacterium avium subsp. paratuberculosis
gcgccggucccgcggcggcgcca

SEQ ID NO: 2849658 - RNA, 13 nt, Mycobacterium avium subsp. paratuberculosis
gcgccgguccggc

SEQ ID NO: 2849659 - RNA, 14 nt, Mycobacterium avium subsp. paratuberculosis
gcgccgguccggcc

SEQ ID NO: 2849660 - RNA, 15 nt, Mycobacterium avium subsp. paratuberculosis
gcgccgguccggccc

SEQ ID NO: 2849661 - RNA, 23 nt, Mycobacterium avium subsp. paratuberculosis
gcgccgguccggcccuggucggc

SEQ ID NO: 2849662 - RNA, 19 nt, Mycobacterium avium subsp. paratuberculosis
gcgccggucgacgcggggc

SEQ ID NO: 2849663 - RNA, 20 nt, Mycobacterium avium subsp. paratuberculosis
gcgccggucgacgcggggcg

SEQ ID NO: 2849664 - RNA, 15 nt, Mycobacterium avium subsp. paratuberculosis
gcgccggucggcgga

SEQ ID NO: 2849665 - RNA, 12 nt, Mycobacterium avium subsp. paratuberculosis
gcgccggucggu

SEQ ID NO: 2849666 - RNA, 14 nt, Mycobacterium avium subsp. paratuberculosis
gcgccggucggugc

SEQ ID NO: 2849667 - RNA, 17 nt, Mycobacterium avium subsp. paratuberculosis
gcgccggucggugcgau

SEQ ID NO: 2849668 - RNA, 22 nt, Mycobacterium avium subsp. paratuberculosis
gcgccggucguuacgacucggc

SEQ ID NO: 2849669 - RNA, 20 nt, Mycobacterium avium subsp. paratuberculosis
gcgccggugaagaucgcccg

SEQ ID NO: 2849670 - RNA, 21 nt, Mycobacterium avium subsp. paratuberculosis
gcgccggugaagaucgcccgc

SEQ ID NO: 2849671 - RNA, 22 nt, Mycobacterium avium subsp. paratuberculosis
gcgccggugaagaucgcccgcc

SEQ ID NO: 2849672 - RNA, 23 nt, Mycobacterium avium subsp. paratuberculosis
gcgccggugcaguacgcaucggc

SEQ ID NO: 2849673 - RNA, 19 nt, Mycobacterium avium subsp. paratuberculosis
gcgccggugccgcagccgu

SEQ ID NO: 2849674 - RNA, 20 nt, Mycobacterium avium subsp. paratuberculosis
gcgccggugccgcagccguc

SEQ ID NO: 2849675 - RNA, 17 nt, Mycobacterium avium subsp. paratuberculosis
gcgccgguggugucgac

SEQ ID NO: 2849676 - RNA, 19 nt, Mycobacterium avium subsp. paratuberculosis
gcgccgguggugucgacgg

SEQ ID NO: 2849677 - RNA, 17 nt, Mycobacterium avium subsp. paratuberculosis
gcgccgguguucggcgc

SEQ ID NO: 2849678 - RNA, 16 nt, Mycobacterium avium subsp. paratuberculosis
gcgccgguuccuccga

SEQ ID NO: 2849679 - RNA, 21 nt, Mycobacterium avium subsp. paratuberculosis
gcgccgguuccuccgacuuac

SEQ ID NO: 2849680 - RNA, 18 nt, Mycobacterium avium subsp. paratuberculosis
gcgccgguucgcuggcgg

SEQ ID NO: 2849681 - RNA, 21 nt, Mycobacterium avium subsp. paratuberculosis
gcgccgguucgcuggcggcca

SEQ ID NO: 2849682 - RNA, 23 nt, Mycobacterium avium subsp. paratuberculosis
gcgccgguucgcuggcggccagc

SEQ ID NO: 2849683 - RNA, 14 nt, Mycobacterium avium subsp. paratuberculosis
gcgccgguuucguc

SEQ ID NO: 2849684 - RNA, 17 nt, Mycobacterium avium subsp. paratuberculosis
gcgccgguuucgucggu

SEQ ID NO: 2849685 - RNA, 22 nt, Mycobacterium avium subsp. paratuberculosis
gcgccgguuuucggcgugucgu

SEQ ID NO: 2849686 - RNA, 17 nt, Mycobacterium avium subsp. paratuberculosis
gcgccguaccgcuuggc

SEQ ID NO: 2849687 - RNA, 15 nt, Mycobacterium avium subsp. paratuberculosis
gcgccguagcggccc

SEQ ID NO: 2849688 - RNA, 19 nt, Mycobacterium avium subsp. paratuberculosis
gcgccguagcggcccaggu

SEQ ID NO: 2849689 - RNA, 16 nt, Mycobacterium avium subsp. paratuberculosis
gcgccguagcgguauc

SEQ ID NO: 2849690 - RNA, 11 nt, Mycobacterium avium subsp. paratuberculosis
gcgccguaggu

SEQ ID NO: 2849691 - RNA, 16 nt, Mycobacterium avium subsp. paratuberculosis
gcgccguagguggcca

SEQ ID NO: 2849692 - RNA, 19 nt, Mycobacterium avium subsp. paratuberculosis
gcgccguagguggccauga

SEQ ID NO: 2849693 - RNA, 15 nt, Mycobacterium avium subsp. paratuberculosis
gcgccguagucgaau

SEQ ID NO: 2849694 - RNA, 22 nt, Mycobacterium avium subsp. paratuberculosis
gcgccguauuggcaggcgaugu

SEQ ID NO: 2849695 - RNA, 16 nt, Mycobacterium avium subsp. paratuberculosis
gcgccgucaccggcug

SEQ ID NO: 2849696 - RNA, 19 nt, Mycobacterium avium subsp. paratuberculosis
gcgccgucaccggcugccc

SEQ ID NO: 2849697 - RNA, 22 nt, Mycobacterium avium subsp. paratuberculosis
gcgccgucaccggcugcccgac

SEQ ID NO: 2849698 - RNA, 16 nt, Mycobacterium avium subsp. paratuberculosis
gcgccgucaucaccgc

SEQ ID NO: 2849699 - RNA, 19 nt, Mycobacterium avium subsp. paratuberculosis
gcgccgucaucaccgccga

SEQ ID NO: 2849700 - RNA, 15 nt, Mycobacterium avium subsp. paratuberculosis
gcgccgucaucgaca

SEQ ID NO: 2849701 - RNA, 13 nt, Mycobacterium avium subsp. paratuberculosis
gcgccguccagcu

SEQ ID NO: 2849702 - RNA, 15 nt, Mycobacterium avium subsp. paratuberculosis
gcgccguccagcucg

SEQ ID NO: 2849703 - RNA, 21 nt, Mycobacterium avium subsp. paratuberculosis
gcgccguccagcucgcguucg

SEQ ID NO: 2849704 - RNA, 16 nt, Mycobacterium avium subsp. paratuberculosis
gcgccgucccagccgg

SEQ ID NO: 2849705 - RNA, 18 nt, Mycobacterium avium subsp. paratuberculosis
gcgccgucccagccggac

SEQ ID NO: 2849706 - RNA, 14 nt, Mycobacterium avium subsp. paratuberculosis
gcgccgucccggac

SEQ ID NO: 2849707 - RNA, 15 nt, Mycobacterium avium subsp. paratuberculosis
gcgccguccgcaccg

SEQ ID NO: 2849708 - RNA, 17 nt, Mycobacterium avium subsp. paratuberculosis
gcgccguccgcaccgcg

SEQ ID NO: 2849709 - RNA, 23 nt, Mycobacterium avium subsp. paratuberculosis
gcgccguccgcaccgcgacgaga

SEQ ID NO: 2849710 - RNA, 16 nt, Mycobacterium avium subsp. paratuberculosis
gcgccguccgcggcgg

SEQ ID NO: 2849711 - RNA, 17 nt, Mycobacterium avium subsp. paratuberculosis
gcgccguccgcggcggc

SEQ ID NO: 2849712 - RNA, 18 nt, Mycobacterium avium subsp. paratuberculosis
gcgccguccgcggcggcc

SEQ ID NO: 2849713 - RNA, 19 nt, Mycobacterium avium subsp. paratuberculosis
gcgccguccgcggcggcca

SEQ ID NO: 2849714 - RNA, 20 nt, Mycobacterium avium subsp. paratuberculosis
gcgccguccgcggcggccag

SEQ ID NO: 2849715 - RNA, 21 nt, Mycobacterium avium subsp. paratuberculosis
gcgccguccgcggcggccagg

SEQ ID NO: 2849716 - RNA, 13 nt, Mycobacterium avium subsp. paratuberculosis
gcgccguccggcc

SEQ ID NO: 2849717 - RNA, 16 nt, Mycobacterium avium subsp. paratuberculosis
gcgccguccggccacg

SEQ ID NO: 2849718 - RNA, 17 nt, Mycobacterium avium subsp. paratuberculosis
gcgccguccuuggucac

SEQ ID NO: 2849719 - RNA, 13 nt, Mycobacterium avium subsp. paratuberculosis
gcgccgucgacca

SEQ ID NO: 2849720 - RNA, 14 nt, Mycobacterium avium subsp. paratuberculosis
gcgccgucgaccag

SEQ ID NO: 2849721 - RNA, 15 nt, Mycobacterium avium subsp. paratuberculosis
gcgccgucgaccagc

SEQ ID NO: 2849722 - RNA, 17 nt, Mycobacterium avium subsp. paratuberculosis
gcgccgucgaccagcuu

SEQ ID NO: 2849723 - RNA, 13 nt, Mycobacterium avium subsp. paratuberculosis
gcgccgucgagga

SEQ ID NO: 2849724 - RNA, 15 nt, Mycobacterium avium subsp. paratuberculosis
gcgccucgagcacca

SEQ ID NO: 2849725 - RNA, 17 nt, Mycobacterium avium subsp. paratuberculosis
gcgccucgagcaccacg

SEQ ID NO: 2849726 - RNA, 20 nt, Mycobacterium avium subsp. paratuberculosis
gcgccucgagcaccacggcc

SEQ ID NO: 2849727 - RNA, 22 nt, Mycobacterium avium subsp. paratuberculosis
gcgccucgagcaccacggcccg

SEQ ID NO: 2849728 - RNA, 17 nt, Mycobacterium avium subsp. paratuberculosis
gcgccucgaucaacgcc

SEQ ID NO: 2849729 - RNA, 18 nt, Mycobacterium avium subsp. paratuberculosis
gcgccucgaucaacgccg

SEQ ID NO: 2849730 - RNA, 14 nt, Mycobacterium avium subsp. paratuberculosis
gcgccucgccgacc

SEQ ID NO: 2849731 - RNA, 12 nt, Mycobacterium avium subsp. paratuberculosis
gcgccucgccgg

SEQ ID NO: 2849732 - RNA, 14 nt, Mycobacterium avium subsp. paratuberculosis
gcgccucgccgggc

SEQ ID NO: 2849733 - RNA, 15 nt, Mycobacterium avium subsp. paratuberculosis
gcgccucgccgggcc

SEQ ID NO: 2849734 - RNA, 19 nt, Mycobacterium avium subsp. paratuberculosis
gcgccucgccgggcccgcu

SEQ ID NO: 2849735 - RNA, 13 nt, Mycobacterium avium subsp. paratuberculosis
gcgccucgcgguc

SEQ ID NO: 2849736 - RNA, 19 nt, Mycobacterium avium subsp. paratuberculosis
gcgccucgcggucgacgga

SEQ ID NO: 2849737 - RNA, 19 nt, Mycobacterium avium subsp. paratuberculosis
gcgccucggccucgucgac

SEQ ID NO: 2849738 - RNA, 21 nt, Mycobacterium avium subsp. paratuberculosis
gcgccucggccucgucgacgu

SEQ ID NO: 2849739 - RNA, 22 nt, Mycobacterium avium subsp. paratuberculosis
gcgccucggccucgucgacguc

SEQ ID NO: 2849740 - RNA, 21 nt, Mycobacterium avium subsp. paratuberculosis
gcgccucggccugcgcccggc

SEQ ID NO: 2849741 - RNA, 15 nt, Mycobacterium avium subsp. paratuberculosis
gcgccucggcgaucg

SEQ ID NO: 2849742 - RNA, 23 nt, Mycobacterium avium subsp. paratuberculosis
gcgccucggcgaucggccgcugc

SEQ ID NO: 2849743 - RNA, 13 nt, Mycobacterium avium subsp. paratuberculosis
gcgccucggcgcc

SEQ ID NO: 2849744 - RNA, 17 nt, Mycobacterium avium subsp. paratuberculosis
gcgccucggcgccucgg

SEQ ID NO: 2849745 - RNA, 13 nt, Mycobacterium avium subsp. paratuberculosis
gcgccucggcggc

SEQ ID NO: 2849746 - RNA, 15 nt, Mycobacterium avium subsp. paratuberculosis
gcgccucggcggccc

SEQ ID NO: 2849747 - RNA, 17 nt, Mycobacterium avium subsp. paratuberculosis
gcgccucggcgggccgc

SEQ ID NO: 2849748 - RNA, 23 nt, Mycobacterium avium subsp. paratuberculosis
gcgccucggcgggccgcccggcg

SEQ ID NO: 2849749 - RNA, 12 nt, Mycobacterium avium subsp. paratuberculosis
gcgccucggcgu

SEQ ID NO: 2849750 - RNA, 13 nt, Mycobacterium avium subsp. paratuberculosis
gcgccucggcguc

SEQ ID NO: 2849751 - RNA, 14 nt, Mycobacterium avium subsp. paratuberculosis
gcgccucggcguca

SEQ ID NO: 2849752 - RNA, 19 nt, Mycobacterium avium subsp. paratuberculosis
gcgccucggcgucaccgcg

SEQ ID NO: 2849753 - RNA, 19 nt, Mycobacterium avium subsp. paratuberculosis
gcgccucggcgucccggcg

SEQ ID NO: 2849754 - RNA, 20 nt, Mycobacterium avium subsp. paratuberculosis
gcgccucggcgucccggcgu

SEQ ID NO: 2849755 - RNA, 15 nt, Mycobacterium avium subsp. paratuberculosis
gcgccucggcguggc

SEQ ID NO: 2849756 - RNA, 20 nt, Mycobacterium avium subsp. paratuberculosis
gcgccucggcguggcaggcg

SEQ ID NO: 2849757 - RNA, 16 nt, Mycobacterium avium subsp. paratuberculosis
gcgccucgucgagccg

SEQ ID NO: 2849758 - RNA, 23 nt, Mycobacterium avium subsp. paratuberculosis
gcgccucgugcaugugcucggcg

SEQ ID NO: 2849759 - RNA, 12 nt, Mycobacterium avium subsp. paratuberculosis
gcgccugauccg

SEQ ID NO: 2849760 - RNA, 14 nt, Mycobacterium avium subsp. paratuberculosis
gcgccugauccgcg

SEQ ID NO: 2849761 - RNA, 23 nt, Mycobacterium avium subsp. paratuberculosis
gcgccugauccgcggucagacga

SEQ ID NO: 2849762 - RNA, 15 nt, Mycobacterium avium subsp. paratuberculosis
gcgccugcaccggcg

SEQ ID NO: 2849763 - RNA, 16 nt, Mycobacterium avium subsp. paratuberculosis
gcgccugcaccggcga

SEQ ID NO: 2849764 - RNA, 20 nt, Mycobacterium avium subsp. paratuberculosis
gcgccugcaccggcgacggc

SEQ ID NO: 2849765 - RNA, 21 nt, Mycobacterium avium subsp. paratuberculosis
gcgccugcaccggcgacggcg

SEQ ID NO: 2849766 - RNA, 23 nt, Mycobacterium avium subsp. paratuberculosis
gcgccugcaccggcgacggcggu

SEQ ID NO: 2849767 - RNA, 17 nt, Mycobacterium avium subsp. paratuberculosis
gcgccugcacgcaggcc

SEQ ID NO: 2849768 - RNA, 16 nt, Mycobacterium avium subsp. paratuberculosis
gcgccugcacggugcc

SEQ ID NO: 2849769 - RNA, 13 nt, Mycobacterium avium subsp. paratuberculosis
gcgccugcccgga

SEQ ID NO: 2849770 - RNA, 13 nt, Mycobacterium avium subsp. paratuberculosis
gcgccugccuggc

SEQ ID NO: 2849771 - RNA, 14 nt, Mycobacterium avium subsp. paratuberculosis
gcgccugccuggcc

SEQ ID NO: 2849772 - RNA, 20 nt, Mycobacterium avium subsp. paratuberculosis
gcgccugcgagcacacccuc

SEQ ID NO: 2849773 - RNA, 15 nt, Mycobacterium avium subsp. paratuberculosis
gcgccugcgcggcgg

SEQ ID NO: 2849774 - RNA, 17 nt, Mycobacterium avium subsp. paratuberculosis
gcgccugcgcggcggcg

SEQ ID NO: 2849775 - RNA, 18 nt, Mycobacterium avium subsp. paratuberculosis
gcgccugcgcggcggcgu

SEQ ID NO: 2849776 - RNA, 12 nt, Mycobacterium avium subsp. paratuberculosis
gcgccugcggug

SEQ ID NO: 2849777 - RNA, 18 nt, Mycobacterium avium subsp. paratuberculosis
gcgccuggcgcagggcgu

SEQ ID NO: 2849778 - RNA, 18 nt, Mycobacterium avium subsp. paratuberculosis
gcgccugguccucccggg

SEQ ID NO: 2849779 - RNA, 23 nt, Mycobacterium avium subsp. paratuberculosis
gcgccugguccucccgggugggc

SEQ ID NO: 2849780 - RNA, 14 nt, Mycobacterium avium subsp. paratuberculosis
gcgccuucgacccg

SEQ ID NO: 2849781 - RNA, 15 nt, Mycobacterium avium subsp. paratuberculosis
gcgccuucgacccgg

SEQ ID NO: 2849782 - RNA, 14 nt, Mycobacterium avium subsp. paratuberculosis
gcgccuucggcgcc

SEQ ID NO: 2849783 - RNA, 21 nt, Mycobacterium avium subsp. paratuberculosis
gcgccuucggcgccagcccgc

SEQ ID NO: 2849784 - RNA, 21 nt, Mycobacterium avium subsp. paratuberculosis
gcgccuucuccagcuccucgg

SEQ ID NO: 2849785 - RNA, 22 nt, Mycobacterium avium subsp. paratuberculosis
gcgccuucuccagcuccucggu

SEQ ID NO: 2849786 - RNA, 21 nt, Mycobacterium avium subsp. paratuberculosis
gcgccuucuugcugcccgcgg

SEQ ID NO: 2849787 - RNA, 24 nt, Mycobacterium avium subsp. paratuberculosis
gcgccuucuugcugcccgcggccg

SEQ ID NO: 2849788 - RNA, 15 nt, Mycobacterium avium subsp. paratuberculosis
gcgccuucuuggccg

SEQ ID NO: 2849789 - RNA, 17 nt, Mycobacterium avium subsp. paratuberculosis
gcgccuucuuggccgcg

SEQ ID NO: 2849790 - RNA, 19 nt, Mycobacterium avium subsp. paratuberculosis
gcgccuucuuggccgcgcc

SEQ ID NO: 2849791 - RNA, 21 nt, Mycobacterium avium subsp. paratuberculosis
gcgccuucuuggccgcgcccu

SEQ ID NO: 2849792 - RNA, 15 nt, Mycobacterium avium subsp. paratuberculosis
gcgccuucuuggcgg

SEQ ID NO: 2849793 - RNA, 19 nt, Mycobacterium avium subsp. paratuberculosis
gcgccuucuuggcggcggu

SEQ ID NO: 2849794 - RNA, 14 nt, Mycobacterium avium subsp. paratuberculosis
gcgccuugaaccgg

SEQ ID NO: 2849795 - RNA, 14 nt, Mycobacterium avium subsp. paratuberculosis
gcgccuugaccgcg

SEQ ID NO: 2849796 - RNA, 21 nt, Mycobacterium avium subsp. paratuberculosis
gcgccuugaccgcguuggcgc

SEQ ID NO: 2849797 - RNA, 16 nt, Mycobacterium avium subsp. paratuberculosis
gcgccuugccgacgac

SEQ ID NO: 2849798 - RNA, 17 nt, Mycobacterium avium subsp. paratuberculosis
gcgccuugccgacgacg

SEQ ID NO: 2849799 - RNA, 24 nt, Mycobacterium avium subsp. paratuberculosis
gcgccuugccgucgagcaggguga

SEQ ID NO: 2849800 - RNA, 15 nt, Mycobacterium avium subsp. paratuberculosis
gcgccuuggccucgg

SEQ ID NO: 2849801 - RNA, 20 nt, Mycobacterium avium subsp. paratuberculosis
gcgccuuggccucgguggcg

SEQ ID NO: 2849802 - RNA, 16 nt, Mycobacterium avium subsp. paratuberculosis
gcgccuugggccaucc

SEQ ID NO: 2849803 - RNA, 21 nt, Mycobacterium avium subsp. paratuberculosis
gcgccuugguccgcaacgcgg

SEQ ID NO: 2849804 - RNA, 17 nt, Mycobacterium avium subsp. paratuberculosis
gcgccuuuugcacccgc

SEQ ID NO: 2849805 - RNA, 22 nt, Mycobacterium avium subsp. paratuberculosis
gcgccuuuugcacccgccaugg

SEQ ID NO: 2849806 - RNA, 15 nt, Mycobacterium avium subsp. paratuberculosis
gcgcgaaaaccagca

SEQ ID NO: 2849807 - RNA, 16 nt, Mycobacterium avium subsp. paratuberculosis
gcgcgaaaaccagcac

SEQ ID NO: 2849808 - RNA, 17 nt, Mycobacterium avium subsp. paratuberculosis
gcgcgaaaaccagcacc

SEQ ID NO: 2849809 - RNA, 19 nt, Mycobacterium avium subsp. paratuberculosis
gcgcgcagcaggcgccggu

SEQ ID NO: 2849810 - RNA, 20 nt, Mycobacterium avium subsp. paratuberculosis
gcgcgcagccagucgccggc

SEQ ID NO: 2849811 - RNA, 23 nt, Mycobacterium avium subsp. paratuberculosis
gcgcgcagccagucgccggccag

SEQ ID NO: 2849812 - RNA, 14 nt, Mycobacterium avium subsp. paratuberculosis
gcgcgcagcccagc

SEQ ID NO: 2849813 - RNA, 15 nt, Mycobacterium avium subsp. paratuberculosis
gcgcgcagcccagcc

SEQ ID NO: 2849814 - RNA, 17 nt, Mycobacterium avium subsp. paratuberculosis
gcgcgcagcccagccag

SEQ ID NO: 2849815 - RNA, 13 nt, Mycobacterium avium subsp. paratuberculosis
gcgcgcagccggc

SEQ ID NO: 2849816 - RNA, 16 nt, Mycobacterium avium subsp. paratuberculosis
gcgcgcagccggccgu

SEQ ID NO: 2849817 - RNA, 15 nt, Mycobacterium avium subsp. paratuberculosis
gcgcgcagcgugugc

SEQ ID NO: 2849818 - RNA, 15 nt, Mycobacterium avium subsp. paratuberculosis
gcgcgcaggaacguc

SEQ ID NO: 2849819 - RNA, 15 nt, Mycobacterium avium subsp. paratuberculosis
gcgcgcaggcacucg

SEQ ID NO: 2849820 - RNA, 18 nt, Mycobacterium avium subsp. paratuberculosis
gcgcgcaggccccggcgc

SEQ ID NO: 2849821 - RNA, 18 nt, Mycobacterium avium subsp. paratuberculosis
gcgcgcaggcgcaccacc

SEQ ID NO: 2849822 - RNA, 20 nt, Mycobacterium avium subsp. paratuberculosis
gcgcgcaggcgcaccaccag

SEQ ID NO: 2849823 - RNA, 16 nt, Mycobacterium avium subsp. paratuberculosis
gcgcgcaggcgcgcgg

SEQ ID NO: 2849824 - RNA, 17 nt, Mycobacterium avium subsp. paratuberculosis
gcgcgcaggcgcgcggc

SEQ ID NO: 2849825 - RNA, 20 nt, Mycobacterium avium subsp. paratuberculosis
gcgcgcaggcgcgcggccag

SEQ ID NO: 2849826 - RNA, 14 nt, Mycobacterium avium subsp. paratuberculosis
gcgcgcaggcuggc

SEQ ID NO: 2849827 - RNA, 17 nt, Mycobacterium avium subsp. paratuberculosis
gcgcgcagucgcaggcc

SEQ ID NO: 2849828 - RNA, 17 nt, Mycobacterium avium subsp. paratuberculosis
gcgcgcaguugcgcggc

SEQ ID NO: 2849829 - RNA, 13 nt, Mycobacterium avium subsp. paratuberculosis
gcgcgcaucgccg

SEQ ID NO: 2849830 - RNA, 20 nt, Mycobacterium avium subsp. paratuberculosis
gcgcgcaucgcgggccaccg

SEQ ID NO: 2849831 - RNA, 21 nt, Mycobacterium avium subsp. paratuberculosis
gcgcgcaucgcgggccaccgg

SEQ ID NO: 2849832 - RNA, 18 nt, Mycobacterium avium subsp. paratuberculosis
gcgcgcaucgucgcggcg

SEQ ID NO: 2849833 - RNA, 14 nt, Mycobacterium avium subsp. paratuberculosis
gcgcgcaucguggc

SEQ ID NO: 2849834 - RNA, 18 nt, Mycobacterium avium subsp. paratuberculosis
gcgcgcaucucgaaugcg

SEQ ID NO: 2849835 - RNA, 15 nt, Mycobacterium avium subsp. paratuberculosis
gcgcgcaucugcucg

SEQ ID NO: 2849836 - RNA, 17 nt, Mycobacterium avium subsp. paratuberculosis
gcgcgcaucugcucggc

SEQ ID NO: 2849837 - RNA, 18 nt, Mycobacterium avium subsp. paratuberculosis
gcgcgcaucugcucggcg

SEQ ID NO: 2849838 - RNA, 19 nt, Mycobacterium avium subsp. paratuberculosis
gcgcgcaucugcucggcgu

SEQ ID NO: 2849839 - RNA, 22 nt, Mycobacterium avium subsp. paratuberculosis
gcgcgcaucugcucggcgucca

SEQ ID NO: 2849840 - RNA, 23 nt, Mycobacterium avium subsp. paratuberculosis
gcgcgcaucugcucggcguccag

SEQ ID NO: 2849841 - RNA, 22 nt, Mycobacterium avium subsp. paratuberculosis
gcgcgccacgacguacccccgc

SEQ ID NO: 2849842 - RNA, 13 nt, Mycobacterium avium subsp. paratuberculosis
gcgcgccagcgug

SEQ ID NO: 2849843 - RNA, 12 nt, Mycobacterium avium subsp. paratuberculosis
gcgcgcccaccc

SEQ ID NO: 2849844 - RNA, 13 nt, Mycobacterium avium subsp. paratuberculosis
gcgcgcccacccg

SEQ ID NO: 2849845 - RNA, 16 nt, Mycobacterium avium subsp. paratuberculosis
gcgcgcccacccgcgc

SEQ ID NO: 2849846 - RNA, 23 nt, Mycobacterium avium subsp. paratuberculosis
gcgcgcccacccgcgccggcaga

SEQ ID NO: 2849847 - RNA, 14 nt, Mycobacterium avium subsp. paratuberculosis
gcgcgcccaggcug

SEQ ID NO: 2849848 - RNA, 15 nt, Mycobacterium avium subsp. paratuberculosis
gcgcgcccaggcuga

SEQ ID NO: 2849849 - RNA, 14 nt, Mycobacterium avium subsp. paratuberculosis
gcgcgccccagccc

SEQ ID NO: 2849850 - RNA, 22 nt, Mycobacterium avium subsp. paratuberculosis
gcgcgccccagccccucgccgg

SEQ ID NO: 2849851 - RNA, 12 nt, Mycobacterium avium subsp. paratuberculosis
gcgcgccccggc

SEQ ID NO: 2849852 - RNA, 14 nt, Mycobacterium avium subsp. paratuberculosis
gcgcgccccggccc

SEQ ID NO: 2849853 - RNA, 15 nt, Mycobacterium avium subsp. paratuberculosis
gcgcgccccggcccg

SEQ ID NO: 2849854 - RNA, 18 nt, Mycobacterium avium subsp. paratuberculosis
gcgcgccccggcccggcg

SEQ ID NO: 2849855 - RNA, 19 nt, Mycobacterium avium subsp. paratuberculosis
gcgcgccccggcccggcga

SEQ ID NO: 2849856 - RNA, 20 nt, Mycobacterium avium subsp. paratuberculosis
gcgcgccccggcccggcgaa

SEQ ID NO: 2849857 - RNA, 12 nt, Mycobacterium avium subsp. paratuberculosis
gcgcgcccgacg

SEQ ID NO: 2849858 - RNA, 22 nt, Mycobacterium avium subsp. paratuberculosis
gcgcgcccgacgaugcggggcg

SEQ ID NO: 2849859 - RNA, 23 nt, Mycobacterium avium subsp. paratuberculosis
gcgcgcccgacgaugcggggcgg

SEQ ID NO: 2849860 - RNA, 13 nt, Mycobacterium avium subsp. paratuberculosis
gcgcgcccgacgg

SEQ ID NO: 2849861 - RNA, 16 nt, Mycobacterium avium subsp. paratuberculosis
gcgcgcccgacggucg

SEQ ID NO: 2849862 - RNA, 13 nt, Mycobacterium avium subsp. paratuberculosis
gcgcgcccgagca

SEQ ID NO: 2849863 - RNA, 14 nt, Mycobacterium avium subsp. paratuberculosis
gcgcgcccgagcau

SEQ ID NO: 2849864 - RNA, 23 nt, Mycobacterium avium subsp. paratuberculosis
gcgcgcccgagcauuucgcgcac

SEQ ID NO: 2849865 - RNA, 12 nt, Mycobacterium avium subsp. paratuberculosis
gcgcgcccgcgg

SEQ ID NO: 2849866 - RNA, 13 nt, Mycobacterium avium subsp. paratuberculosis
gcgcgcccgcggc

SEQ ID NO: 2849867 - RNA, 15 nt, Mycobacterium avium subsp. paratuberculosis
gcgcgcccgcggcca

SEQ ID NO: 2849868 - RNA, 21 nt, Mycobacterium avium subsp. paratuberculosis
gcgcgcccggaaagcgcgggc

SEQ ID NO: 2849869 - RNA, 15 nt, Mycobacterium avium subsp. paratuberculosis
gcgcgcccggcaccg

SEQ ID NO: 2849870 - RNA, 12 nt, Mycobacterium avium subsp. paratuberculosis
gcgcgcccgucg

SEQ ID NO: 2849871 - RNA, 16 nt, Mycobacterium avium subsp. paratuberculosis
gcgcgcccgucgucgg

SEQ ID NO: 2849872 - RNA, 22 nt, Mycobacterium avium subsp. paratuberculosis
gcgcgcccgucgucggucagcu

SEQ ID NO: 2849873 - RNA, 22 nt, Mycobacterium avium subsp. paratuberculosis
gcgcgcccucgauaauggcggc

SEQ ID NO: 2849874 - RNA, 17 nt, Mycobacterium avium subsp. paratuberculosis
gcgcgcccugaggcccg

SEQ ID NO: 2849875 - RNA, 19 nt, Mycobacterium avium subsp. paratuberculosis
gcgcgcccugaggcccggu

SEQ ID NO: 2849876 - RNA, 12 nt, Mycobacterium avium subsp. paratuberculosis
gcgcgcccugcu

SEQ ID NO: 2849877 - RNA, 14 nt, Mycobacterium avium subsp. paratuberculosis
gcgcgcccugcugg

SEQ ID NO: 2849878 - RNA, 21 nt, Mycobacterium avium subsp. paratuberculosis
gcgcgccgaacaccugcggcg

SEQ ID NO: 2849879 - RNA, 22 nt, Mycobacterium avium subsp. paratuberculosis
gcgcgccgaagauggccagcgc

SEQ ID NO: 2849880 - RNA, 14 nt, Mycobacterium avium subsp. paratuberculosis
gcgcgccgaccacg

SEQ ID NO: 2849881 - RNA, 15 nt, Mycobacterium avium subsp. paratuberculosis
gcgcgccgaccacgg

SEQ ID NO: 2849882 - RNA, 13 nt, Mycobacterium avium subsp. paratuberculosis
gcgcgccgaccgc

SEQ ID NO: 2849883 - RNA, 18 nt, Mycobacterium avium subsp. paratuberculosis
gcgcgccgaccgcgagca

SEQ ID NO: 2849884 - RNA, 20 nt, Mycobacterium avium subsp. paratuberculosis
gcgcgccgaccgcgagcacg

SEQ ID NO: 2849885 - RNA, 22 nt, Mycobacterium avium subsp. paratuberculosis
gcgcgccgagagcgcgucgacg

SEQ ID NO: 2849886 - RNA, 13 nt, Mycobacterium avium subsp. paratuberculosis
gcgcgccgagcag

SEQ ID NO: 2849887 - RNA, 14 nt, Mycobacterium avium subsp. paratuberculosis
gcgcgccgagcagc

SEQ ID NO: 2849888 - RNA, 17 nt, Mycobacterium avium subsp. paratuberculosis
gcgcgccgagcagcugg

SEQ ID NO: 2849889 - RNA, 17 nt, Mycobacterium avium subsp. paratuberculosis
gcgcgccgagcgcuggu

SEQ ID NO: 2849890 - RNA, 19 nt, Mycobacterium avium subsp. paratuberculosis
gcgcgccgagguggcccgc

SEQ ID NO: 2849891 - RNA, 21 nt, Mycobacterium avium subsp. paratuberculosis
gcgcgccgagguggcccgcca

SEQ ID NO: 2849892 - RNA, 15 nt, Mycobacterium avium subsp. paratuberculosis
gcgcgccgauccggc

SEQ ID NO: 2849893 - RNA, 18 nt, Mycobacterium avium subsp. paratuberculosis
gcgcgccgaucgcccagu

SEQ ID NO: 2849894 - RNA, 23 nt, Mycobacterium avium subsp. paratuberculosis
gcgcgcggccuccagccgcgcgg

SEQ ID NO: 2849895 - RNA, 15 nt, Mycobacterium avium subsp. paratuberculosis
gcgcgcggcgacggu

SEQ ID NO: 2849896 - RNA, 16 nt, Mycobacterium avium subsp. paratuberculosis
gcgcgcggcgacggug

SEQ ID NO: 2849897 - RNA, 14 nt, Mycobacterium avium subsp. paratuberculosis
gcgcgcggcgcaga

SEQ ID NO: 2849898 - RNA, 14 nt, Mycobacterium avium subsp. paratuberculosis
gcgcgcggcggaug

SEQ ID NO: 2849899 - RNA, 22 nt, Mycobacterium avium subsp. paratuberculosis
gcgcgcggcggccaccgcgccg

SEQ ID NO: 2849900 - RNA, 12 nt, Mycobacterium avium subsp. paratuberculosis
gcgcgcggcgug

SEQ ID NO: 2849901 - RNA, 13 nt, Mycobacterium avium subsp. paratuberculosis
gcgcgcggcgugg

SEQ ID NO: 2849902 - RNA, 14 nt, Mycobacterium avium subsp. paratuberculosis
gcgcgcggcguggu

SEQ ID NO: 2849903 - RNA, 12 nt, Mycobacterium avium subsp. paratuberculosis
gcgcgcgggcca

SEQ ID NO: 2849904 - RNA, 13 nt, Mycobacterium avium subsp. paratuberculosis
gcgcgcgggcgcg

SEQ ID NO: 2849905 - RNA, 16 nt, Mycobacterium avium subsp. paratuberculosis
gcgcgcgggcgcgcgc

SEQ ID NO: 2849906 - RNA, 19 nt, Mycobacterium avium subsp. paratuberculosis
gcgcgcgggcgcgcgccgc

SEQ ID NO: 2849907 - RNA, 20 nt, Mycobacterium avium subsp. paratuberculosis
gcgcgcgggcgcgcgccgcc

SEQ ID NO: 2849908 - RNA, 21 nt, Mycobacterium avium subsp. paratuberculosis
gcgcgcgggcgcgcgccgccc

SEQ ID NO: 2849909 - RNA, 12 nt, Mycobacterium avium subsp. paratuberculosis
gcgcgcggggug

SEQ ID NO: 2849910 - RNA, 14 nt, Mycobacterium avium subsp. paratuberculosis
gcgcgcgggguguc

SEQ ID NO: 2849911 - RNA, 21 nt, Mycobacterium avium subsp. paratuberculosis
gcgcgcggggugucgcggcug

SEQ ID NO: 2849912 - RNA, 18 nt, Mycobacterium avium subsp. paratuberculosis
gcgcgcggugcgccagcg

SEQ ID NO: 2849913 - RNA, 17 nt, Mycobacterium avium subsp. paratuberculosis
gcgcgcguagcgcagcu

SEQ ID NO: 2849914 - RNA, 20 nt, Mycobacterium avium subsp. paratuberculosis
gcgcgcguagcgcagcucca

SEQ ID NO: 2849915 - RNA, 19 nt, Mycobacterium avium subsp. paratuberculosis
gcgcgcguauuccagcgcc

SEQ ID NO: 2849916 - RNA, 20 nt, Mycobacterium avium subsp. paratuberculosis
gcgcgcguauuccagcgcca

SEQ ID NO: 2849917 - RNA, 23 nt, Mycobacterium avium subsp. paratuberculosis
gcgcgcguauuccagcgccagcg

SEQ ID NO: 2849918 - RNA, 18 nt, Mycobacterium avium subsp. paratuberculosis
gcgcgcguuguccagcag

SEQ ID NO: 2849919 - RNA, 19 nt, Mycobacterium avium subsp. paratuberculosis
gcgcgcguuguccagcagc

SEQ ID NO: 2849920 - RNA, 14 nt, Mycobacterium avium subsp. paratuberculosis
gcgcgcucaaccgc

SEQ ID NO: 2849921 - RNA, 19 nt, Mycobacterium avium subsp. paratuberculosis
gcgcgcucaaccgcccagc

SEQ ID NO: 2849922 - RNA, 21 nt, Mycobacterium avium subsp. paratuberculosis
gcgcgcucaaccgcccagcgg

SEQ ID NO: 2849923 - RNA, 16 nt, Mycobacterium avium subsp. paratuberculosis
gcgcgcucggcguugg

SEQ ID NO: 2849924 - RNA, 15 nt, Mycobacterium avium subsp. paratuberculosis
gcgcgcucgggggug

SEQ ID NO: 2849925 - RNA, 16 nt, Mycobacterium avium subsp. paratuberculosis
gcgcgcucgggggugc

SEQ ID NO: 2849926 - RNA, 21 nt, Mycobacterium avium subsp. paratuberculosis
gcgcgcucgggggugcccggc

SEQ ID NO: 2849927 - RNA, 16 nt, Mycobacterium avium subsp. paratuberculosis
gcgcgcucggucagca

SEQ ID NO: 2849928 - RNA, 18 nt, Mycobacterium avium subsp. paratuberculosis
gcgcgcucggucagcacc

SEQ ID NO: 2849929 - RNA, 19 nt, Mycobacterium avium subsp. paratuberculosis
gcgcgcucggucagcaccg

SEQ ID NO: 2849930 - RNA, 14 nt, Mycobacterium avium subsp. paratuberculosis
gcgcgcucggugcu

SEQ ID NO: 2849931 - RNA, 13 nt, Mycobacterium avium subsp. paratuberculosis
gcgcgcucggugg

SEQ ID NO: 2849932 - RNA, 22 nt, Mycobacterium avium subsp. paratuberculosis
gcgcgcucgucgucggugaacg

SEQ ID NO: 2849933 - RNA, 19 nt, Mycobacterium avium subsp. paratuberculosis
gcgcgcucuaacuccgcuc

SEQ ID NO: 2849934 - RNA, 23 nt, Mycobacterium avium subsp. paratuberculosis
gcgcgcucuaacuccgcucgggc

SEQ ID NO: 2849935 - RNA, 17 nt, Mycobacterium avium subsp. paratuberculosis
gcgcgcugaagcgcgac

SEQ ID NO: 2849936 - RNA, 18 nt, Mycobacterium avium subsp. paratuberculosis
gcgcgcugaagcgcgacc

SEQ ID NO: 2849937 - RNA, 19 nt, Mycobacterium avium subsp. paratuberculosis
gcgcgcugaagcgcgaccc

SEQ ID NO: 2849938 - RNA, 20 nt, Mycobacterium avium subsp. paratuberculosis
gcgcgcugaagcgcgacccc

SEQ ID NO: 2849939 - RNA, 15 nt, Mycobacterium avium subsp. paratuberculosis
gcgcgcugaucgccg

SEQ ID NO: 2849940 - RNA, 15 nt, Mycobacterium avium subsp. paratuberculosis
gcgcgcugcaggccc

SEQ ID NO: 2849941 - RNA, 13 nt, Mycobacterium avium subsp. paratuberculosis
gcgcgcugccgcg

SEQ ID NO: 2849942 - RNA, 15 nt, Mycobacterium avium subsp. paratuberculosis
gcgcgcugccgcgcc

SEQ ID NO: 2849943 - RNA, 22 nt, Mycobacterium avium subsp. paratuberculosis
gcgcgcugccgcgccccgagca

SEQ ID NO: 2849944 - RNA, 17 nt, Mycobacterium avium subsp. paratuberculosis
gcgcgcugcggcgucgu

SEQ ID NO: 2849945 - RNA, 12 nt, Mycobacterium avium subsp. paratuberculosis
gcgcgcuggccg

SEQ ID NO: 2849946 - RNA, 15 nt, Mycobacterium avium subsp. paratuberculosis
gcgcgcuggccgcgu

SEQ ID NO: 2849947 - RNA, 21 nt, Mycobacterium avium subsp. paratuberculosis
gcgcgcuggugcgggccagca

SEQ ID NO: 2849948 - RNA, 18 nt, Mycobacterium avium subsp. paratuberculosis
gcgcgcuggugcugccga

SEQ ID NO: 2849949 - RNA, 19 nt, Mycobacterium avium subsp. paratuberculosis
gcgcgcuggugcugccgaa

SEQ ID NO: 2849950 - RNA, 21 nt, Mycobacterium avium subsp. paratuberculosis
gcgcgcuggugcugccgaaca

SEQ ID NO: 2849951 - RNA, 19 nt, Mycobacterium avium subsp. paratuberculosis
gcgcgcugucgacgcguug

SEQ ID NO: 2849952 - RNA, 18 nt, Mycobacterium avium subsp. paratuberculosis
gcgcgcugugcgccaugu

SEQ ID NO: 2849953 - RNA, 14 nt, Mycobacterium avium subsp. paratuberculosis
gcgcgcuugcgcuc

SEQ ID NO: 2849954 - RNA, 16 nt, Mycobacterium avium subsp. paratuberculosis
gcgcgcuugcgcucgg

SEQ ID NO: 2849955 - RNA, 17 nt, Mycobacterium avium subsp. paratuberculosis
gcgcggaaacuccuggc

SEQ ID NO: 2849956 - RNA, 23 nt, Mycobacterium avium subsp. paratuberculosis
gcgcggaaacuccuggccccgau

SEQ ID NO: 2849957 - RNA, 23 nt, Mycobacterium avium subsp. paratuberculosis
gcgcggaacagcgucgccgacgg

SEQ ID NO: 2849958 - RNA, 13 nt, Mycobacterium avium subsp. paratuberculosis
gcgcggaacgcgc

SEQ ID NO: 2849959 - RNA, 17 nt, Mycobacterium avium subsp. paratuberculosis
gcgcggaacgcgccggg

SEQ ID NO: 2849960 - RNA, 19 nt, Mycobacterium avium subsp. paratuberculosis
gcgcggaacgcgccgggca

SEQ ID NO: 2849961 - RNA, 16 nt, Mycobacterium avium subsp. paratuberculosis
gcgcggaaguggaccg

SEQ ID NO: 2849962 - RNA, 17 nt, Mycobacterium avium subsp. paratuberculosis
gcgcggaaugcucgaca

SEQ ID NO: 2849963 - RNA, 16 nt, Mycobacterium avium subsp. paratuberculosis
gcgcggacagcgcggu

SEQ ID NO: 2849964 - RNA, 17 nt, Mycobacterium avium subsp. paratuberculosis
gcgcggacagcgcggug

SEQ ID NO: 2849965 - RNA, 14 nt, Mycobacterium avium subsp. paratuberculosis
gcgcggacagcugc

SEQ ID NO: 2849966 - RNA, 19 nt, Mycobacterium avium subsp. paratuberculosis
gcgcggacagcugcgcggg

SEQ ID NO: 2849967 - RNA, 21 nt, Mycobacterium avium subsp. paratuberculosis
gcgcggacagcugcgcgggcg

SEQ ID NO: 2849968 - RNA, 18 nt, Mycobacterium avium subsp. paratuberculosis
gcgcggacauucggacgg

SEQ ID NO: 2849969 - RNA, 19 nt, Mycobacterium avium subsp. paratuberculosis
gcgcggacauucggacggc

SEQ ID NO: 2849970 - RNA, 20 nt, Mycobacterium avium subsp. paratuberculosis
gcgcggaccccagugcaggc

SEQ ID NO: 2849971 - RNA, 13 nt, Mycobacterium avium subsp. paratuberculosis
gcgcggaccgcac

SEQ ID NO: 2849972 - RNA, 15 nt, Mycobacterium avium subsp. paratuberculosis
gcgcggaccggcgau

SEQ ID NO: 2849973 - RNA, 23 nt, Mycobacterium avium subsp. paratuberculosis
gcgcggaccggcgauuucggccg

SEQ ID NO: 2849974 - RNA, 14 nt, Mycobacterium avium subsp. paratuberculosis
gcgcggacgcggcg

SEQ ID NO: 2849975 - RNA, 16 nt, Mycobacterium avium subsp. paratuberculosis
gcgcggacgcggcgga

SEQ ID NO: 2849976 - RNA, 19 nt, Mycobacterium avium subsp. paratuberculosis
gcgcggagaaggugucgca

SEQ ID NO: 2849977 - RNA, 17 nt, Mycobacterium avium subsp. paratuberculosis
gcgcggagauggugguc

SEQ ID NO: 2849978 - RNA, 15 nt, Mycobacterium avium subsp. paratuberculosis
gcgcggagccggccg

SEQ ID NO: 2849979 - RNA, 15 nt, Mycobacterium avium subsp. paratuberculosis
gcgcggccugcagca

SEQ ID NO: 2849980 - RNA, 17 nt, Mycobacterium avium subsp. paratuberculosis
gcgcggccugcagcacc

SEQ ID NO: 2849981 - RNA, 15 nt, Mycobacterium avium subsp. paratuberculosis
gcgcggcgacggugg

SEQ ID NO: 2849982 - RNA, 13 nt, Mycobacterium avium subsp. paratuberculosis
gcgcggcgaucag

SEQ ID NO: 2849983 - RNA, 18 nt, Mycobacterium avium subsp. paratuberculosis
gcgcggcgaucagcagca

SEQ ID NO: 2849984 - RNA, 21 nt, Mycobacterium avium subsp. paratuberculosis
gcgcggcgaucagcugcucgu

SEQ ID NO: 2849985 - RNA, 20 nt, Mycobacterium avium subsp. paratuberculosis
gcgcggcgaucucggcggcc

SEQ ID NO: 2849986 - RNA, 12 nt, Mycobacterium avium subsp. paratuberculosis
gcgcggcgauga

SEQ ID NO: 2849987 - RNA, 15 nt, Mycobacterium avium subsp. paratuberculosis
gcgcggcgcaccgag

SEQ ID NO: 2849988 - RNA, 14 nt, Mycobacterium avium subsp. paratuberculosis
gcgcggcgcaccgc

SEQ ID NO: 2849989 - RNA, 15 nt, Mycobacterium avium subsp. paratuberculosis
gcgcggcgcagcgcg

SEQ ID NO: 2849990 - RNA, 14 nt, Mycobacterium avium subsp. paratuberculosis
gcgcggcgcagggc

SEQ ID NO: 2849991 - RNA, 16 nt, Mycobacterium avium subsp. paratuberculosis
gcgcggcgcaguucga

SEQ ID NO: 2849992 - RNA, 17 nt, Mycobacterium avium subsp. paratuberculosis
gcgcggcgccagcggcc

SEQ ID NO: 2849993 - RNA, 11 nt, Mycobacterium avium subsp. paratuberculosis
gcgcggcgccc

SEQ ID NO: 2849994 - RNA, 14 nt, Mycobacterium avium subsp. paratuberculosis
gcgcggcgccggau

SEQ ID NO: 2849995 - RNA, 13 nt, Mycobacterium avium subsp. paratuberculosis
gcgcggcgcgcga

SEQ ID NO: 2849996 - RNA, 12 nt, Mycobacterium avium subsp. paratuberculosis
gcgcggcggagg

SEQ ID NO: 2849997 - RNA, 14 nt, Mycobacterium avium subsp. paratuberculosis
gcgcggcggauguc

SEQ ID NO: 2849998 - RNA, 17 nt, Mycobacterium avium subsp. paratuberculosis
gcgcggcggcaaccagc

SEQ ID NO: 2849999 - RNA, 11 nt, Mycobacterium avium subsp. paratuberculosis
gcgcggcggcc

SEQ ID NO: 2850000 - RNA, 12 nt, Mycobacterium avium subsp. paratuberculosis
gcgcggcggcca

SEQ ID NO: 2850001 - RNA, 13 nt, Mycobacterium avium subsp. paratuberculosis
gcgcggcggccaa

SEQ ID NO: 2850002 - RNA, 15 nt, Mycobacterium avium subsp. paratuberculosis
gcgcggcggccaacg

SEQ ID NO: 2850003 - RNA, 21 nt, Mycobacterium avium subsp. paratuberculosis
gcgcggcggccaacgcgacga

SEQ ID NO: 2850004 - RNA, 13 nt, Mycobacterium avium subsp. paratuberculosis
gcgcggcggccac

SEQ ID NO: 2850005 - RNA, 14 nt, Mycobacterium avium subsp. paratuberculosis
gcgcggcggccacc

SEQ ID NO: 2850006 - RNA, 16 nt, Mycobacterium avium subsp. paratuberculosis
gcgcggcggccaccgc

SEQ ID NO: 2850007 - RNA, 18 nt, Mycobacterium avium subsp. paratuberculosis
gcgcggcggccaccgcgc

SEQ ID NO: 2850008 - RNA, 23 nt, Mycobacterium avium subsp. paratuberculosis
gcgcggcggccaccucggcggca

SEQ ID NO: 2850009 - RNA, 14 nt, Mycobacterium avium subsp. paratuberculosis
gcgcggcggccagc

SEQ ID NO: 2850010 - RNA, 20 nt, Mycobacterium avium subsp. paratuberculosis
gcgcggcggccggccagcgc

SEQ ID NO: 2850011 - RNA, 13 nt, Mycobacterium avium subsp. paratuberculosis
gcgcggcggccuc

SEQ ID NO: 2850012 - RNA, 17 nt, Mycobacterium avium subsp. paratuberculosis
gcgcggcggcgacgucg

SEQ ID NO: 2850013 - RNA, 18 nt, Mycobacterium avium subsp. paratuberculosis
gcgcggcggcgacgucga

SEQ ID NO: 2850014 - RNA, 21 nt, Mycobacterium avium subsp. paratuberculosis
gcgcggcggcgacgucgacgg

SEQ ID NO: 2850015 - RNA, 17 nt, Mycobacterium avium subsp. paratuberculosis
gcgcggcggcgccgcgg

SEQ ID NO: 2850016 - RNA, 16 nt, Mycobacterium avium subsp. paratuberculosis
gcgcggcggcgccguc

SEQ ID NO: 2850017 - RNA, 21 nt, Mycobacterium avium subsp. paratuberculosis
gcgcggcggcgccgucgccga

SEQ ID NO: 2850018 - RNA, 12 nt, Mycobacterium avium subsp. paratuberculosis
gcgcggcggcgg

SEQ ID NO: 2850019 - RNA, 19 nt, Mycobacterium avium subsp. paratuberculosis
gcgcggcggcggcgcgggc

SEQ ID NO: 2850020 - RNA, 23 nt, Mycobacterium avium subsp. paratuberculosis
gcgcggcggcggcgcgggcgccc

SEQ ID NO: 2850021 - RNA, 19 nt, Mycobacterium avium subsp. paratuberculosis
gcgcggcggcguccgcggc

SEQ ID NO: 2850022 - RNA, 20 nt, Mycobacterium avium subsp. paratuberculosis
gcgcggcggcguccgcggcc

SEQ ID NO: 2850023 - RNA, 16 nt, Mycobacterium avium subsp. paratuberculosis
gcgcggcgggcccgca

SEQ ID NO: 2850024 - RNA, 13 nt, Mycobacterium avium subsp. paratuberculosis
gcgcggcgggcga

SEQ ID NO: 2850025 - RNA, 20 nt, Mycobacterium avium subsp. paratuberculosis
gcgcggcgguccagcgagcc

SEQ ID NO: 2850026 - RNA, 21 nt, Mycobacterium avium subsp. paratuberculosis
gcgcggcgguccagcgagccc

SEQ ID NO: 2850027 - RNA, 22 nt, Mycobacterium avium subsp. paratuberculosis
gcgcggcgguccagcgagcccu

SEQ ID NO: 2850028 - RNA, 22 nt, Mycobacterium avium subsp. paratuberculosis
gcgcggcggucgcgcgccggcg

SEQ ID NO: 2850029 - RNA, 14 nt, Mycobacterium avium subsp. paratuberculosis
gcgcggcggugagc

SEQ ID NO: 2850030 - RNA, 16 nt, Mycobacterium avium subsp. paratuberculosis
gcgcggcggugagccg

SEQ ID NO: 2850031 - RNA, 13 nt, Mycobacterium avium subsp. paratuberculosis
gcgcggcgguguc

SEQ ID NO: 2850032 - RNA, 21 nt, Mycobacterium avium subsp. paratuberculosis
gcgcggcgucaggggugccag

SEQ ID NO: 2850033 - RNA, 23 nt, Mycobacterium avium subsp. paratuberculosis
gcgcggcgucaggggugccagcc

SEQ ID NO: 2850034 - RNA, 14 nt, Mycobacterium avium subsp. paratuberculosis
gcgcggcguccacc

SEQ ID NO: 2850035 - RNA, 23 nt, Mycobacterium avium subsp. paratuberculosis
gcgcggcguccaccagcacgccg

SEQ ID NO: 2850036 - RNA, 19 nt, Mycobacterium avium subsp. paratuberculosis
gcgcggcguccucgaugac

SEQ ID NO: 2850037 - RNA, 14 nt, Mycobacterium avium subsp. paratuberculosis
gcgcggcgucggcc

SEQ ID NO: 2850038 - RNA, 15 nt, Mycobacterium avium subsp. paratuberculosis
gcgcggcgucggccg

SEQ ID NO: 2850039 - RNA, 21 nt, Mycobacterium avium subsp. paratuberculosis
gcgcggcgugguagccgccgu

SEQ ID NO: 2850040 - RNA, 19 nt, Mycobacterium avium subsp. paratuberculosis
gcgcggcguucuccagcac

SEQ ID NO: 2850041 - RNA, 21 nt, Mycobacterium avium subsp. paratuberculosis
gcgcggcguucuccagcaccc

SEQ ID NO: 2850042 - RNA, 21 nt, Mycobacterium avium subsp. paratuberculosis
gcgcggcuaguuggccggcuu

SEQ ID NO: 2850043 - RNA, 23 nt, Mycobacterium avium subsp. paratuberculosis
gcgcggcuaguuggccggcuucu

SEQ ID NO: 2850044 - RNA, 20 nt, Mycobacterium avium subsp. paratuberculosis
gcgcggcucacagcgcggcg

SEQ ID NO: 2850045 - RNA, 16 nt, Mycobacterium avium subsp. paratuberculosis
gcgcggcucacgacuc

SEQ ID NO: 2850046 - RNA, 20 nt, Mycobacterium avium subsp. paratuberculosis
gcgcggcucgcgggcgaugc

SEQ ID NO: 2850047 - RNA, 14 nt, Mycobacterium avium subsp. paratuberculosis
gcgcggcugcucga

SEQ ID NO: 2850048 - RNA, 13 nt, Mycobacterium avium subsp. paratuberculosis
gcgcggcuggccg

SEQ ID NO: 2850049 - RNA, 17 nt, Mycobacterium avium subsp. paratuberculosis
gcgcggcuuggccacca

SEQ ID NO: 2850050 - RNA, 23 nt, Mycobacterium avium subsp. paratuberculosis
gcgcggcuuggccaccaccacgg

SEQ ID NO: 2850051 - RNA, 12 nt, Mycobacterium avium subsp. paratuberculosis
gcgcgggaacga

SEQ ID NO: 2850052 - RNA, 16 nt, Mycobacterium avium subsp. paratuberculosis
gcgcgggaagccgccg

SEQ ID NO: 2850053 - RNA, 17 nt, Mycobacterium avium subsp. paratuberculosis
gcgcgggaagccgccgc

SEQ ID NO: 2850054 - RNA, 18 nt, Mycobacterium avium subsp. paratuberculosis
gcgcgggaagccgccgcc

SEQ ID NO: 2850055 - RNA, 16 nt, Mycobacterium avium subsp. paratuberculosis
gcgcgggaucggugcc

SEQ ID NO: 2850056 - RNA, 17 nt, Mycobacterium avium subsp. paratuberculosis
gcgcgggaucggugccg

SEQ ID NO: 2850057 - RNA, 16 nt, Mycobacterium avium subsp. paratuberculosis
gcgcgggcaccgucgu

SEQ ID NO: 2850058 - RNA, 13 nt, Mycobacterium avium subsp. paratuberculosis
gcgcgggcagccc

SEQ ID NO: 2850059 - RNA, 14 nt, Mycobacterium avium subsp. paratuberculosis
gcgcgggcagccca

SEQ ID NO: 2850060 - RNA, 21 nt, Mycobacterium avium subsp. paratuberculosis
gcgcgggcaugaaccaggccg

SEQ ID NO: 2850061 - RNA, 12 nt, Mycobacterium avium subsp. paratuberculosis
gcgcgggccagc

SEQ ID NO: 2850062 - RNA, 23 nt, Mycobacterium avium subsp. paratuberculosis
gcgcgggccagcagcagcagguc

SEQ ID NO: 2850063 - RNA, 17 nt, Mycobacterium avium subsp. paratuberculosis
gcgcgggccagcaguuc

SEQ ID NO: 2850064 - RNA, 13 nt, Mycobacterium avium subsp. paratuberculosis
gcgcgggccagcg

SEQ ID NO: 2850065 - RNA, 14 nt, Mycobacterium avium subsp. paratuberculosis
gcgcgggccagcgc

SEQ ID NO: 2850066 - RNA, 18 nt, Mycobacterium avium subsp. paratuberculosis
gcgcgggccagcgccuuc

SEQ ID NO: 2850067 - RNA, 17 nt, Mycobacterium avium subsp. paratuberculosis
gcgcgggccagcguuuc

SEQ ID NO: 2850068 - RNA, 14 nt, Mycobacterium avium subsp. paratuberculosis
gcgcgggccgcagc

SEQ ID NO: 2850069 - RNA, 15 nt, Mycobacterium avium subsp. paratuberculosis
gcgcgggccgcagcg

SEQ ID NO: 2850070 - RNA, 17 nt, Mycobacterium avium subsp. paratuberculosis
gcgcgggccgcagcgcg

SEQ ID NO: 2850071 - RNA, 18 nt, Mycobacterium avium subsp. paratuberculosis
gcgcgggccgcagcgcgc

SEQ ID NO: 2850072 - RNA, 13 nt, Mycobacterium avium subsp. paratuberculosis
gcgcgggccgcgu

SEQ ID NO: 2850073 - RNA, 21 nt, Mycobacterium avium subsp. paratuberculosis
gcgcgggccuaggaccccggc

SEQ ID NO: 2850074 - RNA, 14 nt, Mycobacterium avium subsp. paratuberculosis
gcgcgggcgaccug

SEQ ID NO: 2850075 - RNA, 22 nt, Mycobacterium avium subsp. paratuberculosis
gcgcgggcgaccugcgggccca

SEQ ID NO: 2850076 - RNA, 12 nt, Mycobacterium avium subsp. paratuberculosis
gcgcgggcgauu

SEQ ID NO: 2850077 - RNA, 22 nt, Mycobacterium avium subsp. paratuberculosis
gcgcgggcgauuucgucggcgg

SEQ ID NO: 2850078 - RNA, 13 nt, Mycobacterium avium subsp. paratuberculosis
gcgcgggcgcccg

SEQ ID NO: 2850079 - RNA, 14 nt, Mycobacterium avium subsp. paratuberculosis
gcgcgggcgcccgu

SEQ ID NO: 2850080 - RNA, 18 nt, Mycobacterium avium subsp. paratuberculosis
gcgcgggcgccgucgggg

SEQ ID NO: 2850081 - RNA, 15 nt, Mycobacterium avium subsp. paratuberculosis
gcgcgggcgcggcca

SEQ ID NO: 2850082 - RNA, 16 nt, Mycobacterium avium subsp. paratuberculosis
gcgcgggcgcggccag

SEQ ID NO: 2850083 - RNA, 13 nt, Mycobacterium avium subsp. paratuberculosis
gcgcgggcggcgu

SEQ ID NO: 2850084 - RNA, 14 nt, Mycobacterium avium subsp. paratuberculosis
gcgcgggcggcguc

SEQ ID NO: 2850085 - RNA, 17 nt, Mycobacterium avium subsp. paratuberculosis
gcgcgggcggcgucggc

SEQ ID NO: 2850086 - RNA, 13 nt, Mycobacterium avium subsp. paratuberculosis
gcgcgggcgucca

SEQ ID NO: 2850087 - RNA, 22 nt, Mycobacterium avium subsp. paratuberculosis
gcgcgggcguccacgaaaccca

SEQ ID NO: 2850088 - RNA, 14 nt, Mycobacterium avium subsp. paratuberculosis
gcgcgggcguccuc

SEQ ID NO: 2850089 - RNA, 21 nt, Mycobacterium avium subsp. paratuberculosis
gcgcgggcguccucgucggcg

SEQ ID NO: 2850090 - RNA, 22 nt, Mycobacterium avium subsp. paratuberculosis
gcgcgggcguccucgucggcga

SEQ ID NO: 2850091 - RNA, 23 nt, Mycobacterium avium subsp. paratuberculosis
gcgcgggcguccucgucggcgaa

SEQ ID NO: 2850092 - RNA, 17 nt, Mycobacterium avium subsp. paratuberculosis
gcgcgggcugcagggcc

SEQ ID NO: 2850093 - RNA, 14 nt, Mycobacterium avium subsp. paratuberculosis
gcgcggggccacca

SEQ ID NO: 2850094 - RNA, 19 nt, Mycobacterium avium subsp. paratuberculosis
gcgcggggccggcgcggug

SEQ ID NO: 2850095 - RNA, 20 nt, Mycobacterium avium subsp. paratuberculosis
gcgcggggccggcgcggugg

SEQ ID NO: 2850096 - RNA, 14 nt, Mycobacterium avium subsp. paratuberculosis
gcgcggggcggccg

SEQ ID NO: 2850097 - RNA, 18 nt, Mycobacterium avium subsp. paratuberculosis
gcgcggggcggccgccgg

SEQ ID NO: 2850098 - RNA, 18 nt, Mycobacterium avium subsp. paratuberculosis
gcgcgggggccgccgcga

SEQ ID NO: 2850099 - RNA, 22 nt, Mycobacterium avium subsp. paratuberculosis
gcgcgggggcggccugagccgc

SEQ ID NO: 2850100 - RNA, 23 nt, Mycobacterium avium subsp. paratuberculosis
gcgcggggucccaauccucgccg

SEQ ID NO: 2850101 - RNA, 16 nt, Mycobacterium avium subsp. paratuberculosis
gcgcggggucgggccg

SEQ ID NO: 2850102 - RNA, 18 nt, Mycobacterium avium subsp. paratuberculosis
gcgcgggguggcgccggc

SEQ ID NO: 2850103 - RNA, 19 nt, Mycobacterium avium subsp. paratuberculosis
gcgcgggguggcgccggcc

SEQ ID NO: 2850104 - RNA, 13 nt, Mycobacterium avium subsp. paratuberculosis
gcgcggguacggc

SEQ ID NO: 2850105 - RNA, 18 nt, Mycobacterium avium subsp. paratuberculosis
gcgcggguacggcggccg

SEQ ID NO: 2850106 - RNA, 23 nt, Mycobacterium avium subsp. paratuberculosis
gcgcggguagacguucuccccgc

SEQ ID NO: 2850107 - RNA, 14 nt, Mycobacterium avium subsp. paratuberculosis
gcgcgggucgagca

SEQ ID NO: 2850108 - RNA, 20 nt, Mycobacterium avium subsp. paratuberculosis
gcgcgggucgagcagcagcc

SEQ ID NO: 2850109 - RNA, 19 nt, Mycobacterium avium subsp. paratuberculosis
gcgcgggucgcgguucgca

SEQ ID NO: 2850110 - RNA, 20 nt, Mycobacterium avium subsp. paratuberculosis
gcgcgggucgcuggccgcga

SEQ ID NO: 2850111 - RNA, 18 nt, Mycobacterium avium subsp. paratuberculosis
gcgcgggucggcgccggc

SEQ ID NO: 2850112 - RNA, 19 nt, Mycobacterium avium subsp. paratuberculosis
gcgcgggucggcgccggcc

SEQ ID NO: 2850113 - RNA, 14 nt, Mycobacterium avium subsp. paratuberculosis
gcgcgggucgucgg

SEQ ID NO: 2850114 - RNA, 15 nt, Mycobacterium avium subsp. paratuberculosis
gcgcgggucgucggc

SEQ ID NO: 2850115 - RNA, 16 nt, Mycobacterium avium subsp. paratuberculosis
gcgcgggucgucggcc

SEQ ID NO: 2850116 - RNA, 13 nt, Mycobacterium avium subsp. paratuberculosis
gcgcgggugcggg

SEQ ID NO: 2850117 - RNA, 22 nt, Mycobacterium avium subsp. paratuberculosis
gcgcgguaaagucuucggcgau

SEQ ID NO: 2850118 - RNA, 21 nt, Mycobacterium avium subsp. paratuberculosis
gcgcgguaacagagcgggauc

SEQ ID NO: 2850119 - RNA, 14 nt, Mycobacterium avium subsp. paratuberculosis
gcgcggucaacacc

SEQ ID NO: 2850120 - RNA, 14 nt, Mycobacterium avium subsp. paratuberculosis
gcgcggucaucguc

SEQ ID NO: 2850121 - RNA, 19 nt, Mycobacterium avium subsp. paratuberculosis
gcgcgguccacggucagcg

SEQ ID NO: 2850122 - RNA, 16 nt, Mycobacterium avium subsp. paratuberculosis
gcgcgguccacggugg

SEQ ID NO: 2850123 - RNA, 21 nt, Mycobacterium avium subsp. paratuberculosis
gcgcgguccacgguggcgccg

SEQ ID NO: 2850124 - RNA, 18 nt, Mycobacterium avium subsp. paratuberculosis
gcgcggucgcaggcgagc

SEQ ID NO: 2850125 - RNA, 22 nt, Mycobacterium avium subsp. paratuberculosis
gcgcggucgcaggcgagccggu

SEQ ID NO: 2850126 - RNA, 14 nt, Mycobacterium avium subsp. paratuberculosis
gcgcggucgccacc

SEQ ID NO: 2850127 - RNA, 15 nt, Mycobacterium avium subsp. paratuberculosis
gcgcggucgccacca

SEQ ID NO: 2850128 - RNA, 12 nt, Mycobacterium avium subsp. paratuberculosis
gcgcggucggug

SEQ ID NO: 2850129 - RNA, 15 nt, Mycobacterium avium subsp. paratuberculosis
gcgcggucgguggcg

SEQ ID NO: 2850130 - RNA, 18 nt, Mycobacterium avium subsp. paratuberculosis
gcgcggucgguggcggug

SEQ ID NO: 2850131 - RNA, 20 nt, Mycobacterium avium subsp. paratuberculosis
gcgcggucgguggcggugcc

SEQ ID NO: 2850132 - RNA, 15 nt, Mycobacterium avium subsp. paratuberculosis
gcgcggucucgaucu

SEQ ID NO: 2850133 - RNA, 21 nt, Mycobacterium avium subsp. paratuberculosis
gcgcggucucgaucugcacca

SEQ ID NO: 2850134 - RNA, 15 nt, Mycobacterium avium subsp. paratuberculosis
gcgcggugagcagca

SEQ ID NO: 2850135 - RNA, 23 nt, Mycobacterium avium subsp. paratuberculosis
gcgcggugauucgaagaacacgc

SEQ ID NO: 2850136 - RNA, 22 nt, Mycobacterium avium subsp. paratuberculosis
gcgcggugcccggaacggcggg

SEQ ID NO: 2850137 - RNA, 12 nt, Mycobacterium avium subsp. paratuberculosis
gcgcggugccga

SEQ ID NO: 2850138 - RNA, 15 nt, Mycobacterium avium subsp. paratuberculosis
gcgcggugccgaccu

SEQ ID NO: 2850139 - RNA, 18 nt, Mycobacterium avium subsp. paratuberculosis
gcgcggugccgaccuggg

SEQ ID NO: 2850140 - RNA, 21 nt, Mycobacterium avium subsp. paratuberculosis
gcgcggugccgaccugggcgg

SEQ ID NO: 2850141 - RNA, 17 nt, Mycobacterium avium subsp. paratuberculosis
gcgcggugccggugauc

SEQ ID NO: 2850142 - RNA, 14 nt, Mycobacterium avium subsp. paratuberculosis
gcgcggugcgccag

SEQ ID NO: 2850143 - RNA, 17 nt, Mycobacterium avium subsp. paratuberculosis
gcgcggugcgccagcgc

SEQ ID NO: 2850144 - RNA, 15 nt, Mycobacterium avium subsp. paratuberculosis
gcgcggugcgccgac

SEQ ID NO: 2850145 - RNA, 18 nt, Mycobacterium avium subsp. paratuberculosis
gcgcggugcucggcgcgc

SEQ ID NO: 2850146 - RNA, 14 nt, Mycobacterium avium subsp. paratuberculosis
gcgcgguggccagc

SEQ ID NO: 2850147 - RNA, 16 nt, Mycobacterium avium subsp. paratuberculosis
gcgcgguggcgcgggu

SEQ ID NO: 2850148 - RNA, 19 nt, Mycobacterium avium subsp. paratuberculosis
gcgcgguggcgugcagcgc

SEQ ID NO: 2850149 - RNA, 12 nt, Mycobacterium avium subsp. paratuberculosis
gcgcgucggcga

SEQ ID NO: 2850150 - RNA, 13 nt, Mycobacterium avium subsp. paratuberculosis
gcgcgucggcgac

SEQ ID NO: 2850151 - RNA, 14 nt, Mycobacterium avium subsp. paratuberculosis
gcgcgucggcgacc

SEQ ID NO: 2850152 - RNA, 18 nt, Mycobacterium avium subsp. paratuberculosis
gcgcgucggcgaccgcgc

SEQ ID NO: 2850153 - RNA, 20 nt, Mycobacterium avium subsp. paratuberculosis
gcgcgucggcgaccgcgcgc

SEQ ID NO: 2850154 - RNA, 12 nt, Mycobacterium avium subsp. paratuberculosis
gcgcgucggcgu

SEQ ID NO: 2850155 - RNA, 14 nt, Mycobacterium avium subsp. paratuberculosis
gcgcgucggcgucu

SEQ ID NO: 2850156 - RNA, 16 nt, Mycobacterium avium subsp. paratuberculosis
gcgcgucgggcucgcg

SEQ ID NO: 2850157 - RNA, 18 nt, Mycobacterium avium subsp. paratuberculosis
gcgcgucgguaaucggcg

SEQ ID NO: 2850158 - RNA, 12 nt, Mycobacterium avium subsp. paratuberculosis
gcgcgucgguga

SEQ ID NO: 2850159 - RNA, 19 nt, Mycobacterium avium subsp. paratuberculosis
gcgcgucguacaccucggu

SEQ ID NO: 2850160 - RNA, 21 nt, Mycobacterium avium subsp. paratuberculosis
gcgcgucguagucgcucggcg

SEQ ID NO: 2850161 - RNA, 22 nt, Mycobacterium avium subsp. paratuberculosis
gcgcgucguagucgcucggcgg

SEQ ID NO: 2850162 - RNA, 23 nt, Mycobacterium avium subsp. paratuberculosis
gcgcgucguccgacaccaccugc

SEQ ID NO: 2850163 - RNA, 14 nt, Mycobacterium avium subsp. paratuberculosis
gcgcgucgucgaug

SEQ ID NO: 2850164 - RNA, 15 nt, Mycobacterium avium subsp. paratuberculosis
gcgcgucgucgaugg

SEQ ID NO: 2850165 - RNA, 22 nt, Mycobacterium avium subsp. paratuberculosis
gcgcgucgucgauggccaccag

SEQ ID NO: 2850166 - RNA, 16 nt, Mycobacterium avium subsp. paratuberculosis
gcgcgucgucgccgaa

SEQ ID NO: 2850167 - RNA, 22 nt, Mycobacterium avium subsp. paratuberculosis
gcgcgucgucggucaggccggc

SEQ ID NO: 2850168 - RNA, 14 nt, Mycobacterium avium subsp. paratuberculosis
gcgcgucguugccc

SEQ ID NO: 2850169 - RNA, 18 nt, Mycobacterium avium subsp. paratuberculosis
gcgcgucguugcccugaa

SEQ ID NO: 2850170 - RNA, 18 nt, Mycobacterium avium subsp. paratuberculosis
gcgcgucucccccgauca

SEQ ID NO: 2850171 - RNA, 21 nt, Mycobacterium avium subsp. paratuberculosis
gcgcgucucccccgaucagcg

SEQ ID NO: 2850172 - RNA, 14 nt, Mycobacterium avium subsp. paratuberculosis
gcgcgugaccccgg

SEQ ID NO: 2850173 - RNA, 21 nt, Mycobacterium avium subsp. paratuberculosis
gcgcgugaccccggcgaccag

SEQ ID NO: 2850174 - RNA, 14 nt, Mycobacterium avium subsp. paratuberculosis
gcgcgugacgcgcg

SEQ ID NO: 2850175 - RNA, 17 nt, Mycobacterium avium subsp. paratuberculosis
gcgcgugacgcgcguga

SEQ ID NO: 2850176 - RNA, 13 nt, Mycobacterium avium subsp. paratuberculosis
gcgcgugacggcg

SEQ ID NO: 2850177 - RNA, 18 nt, Mycobacterium avium subsp. paratuberculosis
gcgcgugacggcggggcg

SEQ ID NO: 2850178 - RNA, 20 nt, Mycobacterium avium subsp. paratuberculosis
gcgcgugacggcggggcgga

SEQ ID NO: 2850179 - RNA, 14 nt, Mycobacterium avium subsp. paratuberculosis
gcgcgugaucggug

SEQ ID NO: 2850180 - RNA, 18 nt, Mycobacterium avium subsp. paratuberculosis
gcgcgugaucggugcccg

SEQ ID NO: 2850181 - RNA, 23 nt, Mycobacterium avium subsp. paratuberculosis
gcgcgugaugggugggcagcucg

SEQ ID NO: 2850182 - RNA, 13 nt, Mycobacterium avium subsp. paratuberculosis
gcgcgugcacgaa

SEQ ID NO: 2850183 - RNA, 12 nt, Mycobacterium avium subsp. paratuberculosis
gcgcgugcgccg

SEQ ID NO: 2850184 - RNA, 16 nt, Mycobacterium avium subsp. paratuberculosis
gcgcgugcgccgcggc

SEQ ID NO: 2850185 - RNA, 20 nt, Mycobacterium avium subsp. paratuberculosis
gcgcgugcgccgcggcggcu

SEQ ID NO: 2850186 - RNA, 22 nt, Mycobacterium avium subsp. paratuberculosis
gcgcgugcgccgcggcggcucg

SEQ ID NO: 2850187 - RNA, 16 nt, Mycobacterium avium subsp. paratuberculosis
gcgcgugcugggggug

SEQ ID NO: 2850188 - RNA, 19 nt, Mycobacterium avium subsp. paratuberculosis
gcgcgugcuggggguggcg

SEQ ID NO: 2850189 - RNA, 18 nt, Mycobacterium avium subsp. paratuberculosis
gcgcguggggcgucgccg

SEQ ID NO: 2850190 - RNA, 20 nt, Mycobacterium avium subsp. paratuberculosis
gcgcguggggcgucgccgcc

SEQ ID NO: 2850191 - RNA, 17 nt, Mycobacterium avium subsp. paratuberculosis
gcgcguggucccacacc

SEQ ID NO: 2850192 - RNA, 18 nt, Mycobacterium avium subsp. paratuberculosis
gcgcguggucccacacca

SEQ ID NO: 2850193 - RNA, 19 nt, Mycobacterium avium subsp. paratuberculosis
gcgcguggucccacaccac

SEQ ID NO: 2850194 - RNA, 18 nt, Mycobacterium avium subsp. paratuberculosis
gcgcguucaagccgccga

SEQ ID NO: 2850195 - RNA, 20 nt, Mycobacterium avium subsp. paratuberculosis
gcgcguucaagccgccgauc

SEQ ID NO: 2850196 - RNA, 21 nt, Mycobacterium avium subsp. paratuberculosis
gcgcguucaagccgccgaucu

SEQ ID NO: 2850197 - RNA, 22 nt, Mycobacterium avium subsp. paratuberculosis
gcgcguucagggugcaggcccg

SEQ ID NO: 2850198 - RNA, 15 nt, Mycobacterium avium subsp. paratuberculosis
gcgcguuccagcacg

SEQ ID NO: 2850199 - RNA, 18 nt, Mycobacterium avium subsp. paratuberculosis
gcgcguuccagcacgccc

SEQ ID NO: 2850200 - RNA, 19 nt, Mycobacterium avium subsp. paratuberculosis
gcgcguuccagcacgccca

SEQ ID NO: 2850201 - RNA, 21 nt, Mycobacterium avium subsp. paratuberculosis
gcgcguuccaucagcgcccgc

SEQ ID NO: 2850202 - RNA, 22 nt, Mycobacterium avium subsp. paratuberculosis
gcgcguuccaucagcgcccgcg

SEQ ID NO: 2850203 - RNA, 21 nt, Mycobacterium avium subsp. paratuberculosis
gcgcguucgaguucgucgacc

SEQ ID NO: 2850204 - RNA, 23 nt, Mycobacterium avium subsp. paratuberculosis
gcgcguucgaguucgucgaccag

SEQ ID NO: 2850205 - RNA, 13 nt, Mycobacterium avium subsp. paratuberculosis
gcgcguucggcgc

SEQ ID NO: 2850206 - RNA, 16 nt, Mycobacterium avium subsp. paratuberculosis
gcgcguucggcgccac

SEQ ID NO: 2850207 - RNA, 18 nt, Mycobacterium avium subsp. paratuberculosis
gcgcguucggcgccaccc

SEQ ID NO: 2850208 - RNA, 16 nt, Mycobacterium avium subsp. paratuberculosis
gcgcguucuccaccgc

SEQ ID NO: 2850209 - RNA, 20 nt, Mycobacterium avium subsp. paratuberculosis
gcgcguucuccaccgcgcgc

SEQ ID NO: 2850210 - RNA, 16 nt, Mycobacterium avium subsp. paratuberculosis
gcgcguugcgcggacc

SEQ ID NO: 2850211 - RNA, 17 nt, Mycobacterium avium subsp. paratuberculosis
gcgcguugcgcggaccg

SEQ ID NO: 2850212 - RNA, 19 nt, Mycobacterium avium subsp. paratuberculosis
gcgcguugcgcggaccggc

SEQ ID NO: 2850213 - RNA, 21 nt, Mycobacterium avium subsp. paratuberculosis
gcgcguugcgcggaccggcga

SEQ ID NO: 2850214 - RNA, 14 nt, Mycobacterium avium subsp. paratuberculosis
gcgcguugcggccg

SEQ ID NO: 2850215 - RNA, 22 nt, Mycobacterium avium subsp. paratuberculosis
gcgcguugcggccguccagcgu

SEQ ID NO: 2850216 - RNA, 15 nt, Mycobacterium avium subsp. paratuberculosis
gcgcguuggccggcu

SEQ ID NO: 2850217 - RNA, 20 nt, Mycobacterium avium subsp. paratuberculosis
gcgcguuggccggcuggaac

SEQ ID NO: 2850218 - RNA, 15 nt, Mycobacterium avium subsp. paratuberculosis
gcgcguuguccagca

SEQ ID NO: 2850219 - RNA, 16 nt, Mycobacterium avium subsp. paratuberculosis
gcgcguuguccagcag

SEQ ID NO: 2850220 - RNA, 17 nt, Mycobacterium avium subsp. paratuberculosis
gcgcguuguccagcagc

SEQ ID NO: 2850221 - RNA, 21 nt, Mycobacterium avium subsp. paratuberculosis
gcgcguuuugaaauccgggcg

SEQ ID NO: 2850222 - RNA, 16 nt, Mycobacterium avium subsp. paratuberculosis
gcgcuaacaaaagccc

SEQ ID NO: 2850223 - RNA, 13 nt, Mycobacterium avium subsp. paratuberculosis
gcgcuaaccgcgg

SEQ ID NO: 2850224 - RNA, 21 nt, Mycobacterium avium subsp. paratuberculosis
gcgcuaaggccgcugcccggc

SEQ ID NO: 2850225 - RNA, 14 nt, Mycobacterium avium subsp. paratuberculosis
gcgcuaccaggcgu

SEQ ID NO: 2850226 - RNA, 13 nt, Mycobacterium avium subsp. paratuberculosis
gcgcuaccgcgcu

SEQ ID NO: 2850227 - RNA, 18 nt, Mycobacterium avium subsp. paratuberculosis
gcgcuaccgcgcucaccg

SEQ ID NO: 2850228 - RNA, 13 nt, Mycobacterium avium subsp. paratuberculosis
gcgcuacgccggc

SEQ ID NO: 2850229 - RNA, 16 nt, Mycobacterium avium subsp. paratuberculosis
gcgcuagcugcgccgg

SEQ ID NO: 2850230 - RNA, 17 nt, Mycobacterium avium subsp. paratuberculosis
gcgcuagcugcgccggc

SEQ ID NO: 2850231 - RNA, 16 nt, Mycobacterium avium subsp. paratuberculosis
gcgcuaggacgcgggc

SEQ ID NO: 2850232 - RNA, 18 nt, Mycobacterium avium subsp. paratuberculosis
gcgcuaggacgcgggccu

SEQ ID NO: 2850233 - RNA, 19 nt, Mycobacterium avium subsp. paratuberculosis
gcgcuaggacgcgggccug

SEQ ID NO: 2850234 - RNA, 18 nt, Mycobacterium avium subsp. paratuberculosis
gcgcucggccauccgggc

SEQ ID NO: 2850235 - RNA, 19 nt, Mycobacterium avium subsp. paratuberculosis
gcgcucggccauccgggcg

SEQ ID NO: 2850236 - RNA, 20 nt, Mycobacterium avium subsp. paratuberculosis
gcgcucggccauccgggcgg

SEQ ID NO: 2850237 - RNA, 16 nt, Mycobacterium avium subsp. paratuberculosis
gcgcucggcgaccgcc

SEQ ID NO: 2850238 - RNA, 17 nt, Mycobacterium avium subsp. paratuberculosis
gcgcucggcgaccgccg

SEQ ID NO: 2850239 - RNA, 14 nt, Mycobacterium avium subsp. paratuberculosis
gcgcucggcgaccu

SEQ ID NO: 2850240 - RNA, 21 nt, Mycobacterium avium subsp. paratuberculosis
gcgcucggcgaccugcggcuc

SEQ ID NO: 2850241 - RNA, 14 nt, Mycobacterium avium subsp. paratuberculosis
gcgcucggcgacga

SEQ ID NO: 2850242 - RNA, 14 nt, Mycobacterium avium subsp. paratuberculosis
gcgcucggcguugg

SEQ ID NO: 2850243 - RNA, 17 nt, Mycobacterium avium subsp. paratuberculosis
gcgcucgggggugcccg

SEQ ID NO: 2850244 - RNA, 13 nt, Mycobacterium avium subsp. paratuberculosis
gcgcucggucagc

SEQ ID NO: 2850245 - RNA, 22 nt, Mycobacterium avium subsp. paratuberculosis
gcgcucggucagcaccggggcc

SEQ ID NO: 2850246 - RNA, 14 nt, Mycobacterium avium subsp. paratuberculosis
gcgcucggucgcgg

SEQ ID NO: 2850247 - RNA, 18 nt, Mycobacterium avium subsp. paratuberculosis
gcgcucggucgcggcgau

SEQ ID NO: 2850248 - RNA, 21 nt, Mycobacterium avium subsp. paratuberculosis
gcgcucggucgcggcgaucgg

SEQ ID NO: 2850249 - RNA, 18 nt, Mycobacterium avium subsp. paratuberculosis
gcgcucggugugcgguuc

SEQ ID NO: 2850250 - RNA, 13 nt, Mycobacterium avium subsp. paratuberculosis
gcgcucgucgaug

SEQ ID NO: 2850251 - RNA, 18 nt, Mycobacterium avium subsp. paratuberculosis
gcgcucgucguagucgag

SEQ ID NO: 2850252 - RNA, 22 nt, Mycobacterium avium subsp. paratuberculosis
gcgcucgucguagucgaggccg

SEQ ID NO: 2850253 - RNA, 14 nt, Mycobacterium avium subsp. paratuberculosis
gcgcucgucgucgc

SEQ ID NO: 2850254 - RNA, 18 nt, Mycobacterium avium subsp. paratuberculosis
gcgcucgucgucgccgau

SEQ ID NO: 2850255 - RNA, 17 nt, Mycobacterium avium subsp. paratuberculosis
gcgcucgucgucgguga

SEQ ID NO: 2850256 - RNA, 18 nt, Mycobacterium avium subsp. paratuberculosis
gcgcucuguuggccgucg

SEQ ID NO: 2850257 - RNA, 19 nt, Mycobacterium avium subsp. paratuberculosis
gcgcucuguuggccgucgc

SEQ ID NO: 2850258 - RNA, 15 nt, Mycobacterium avium subsp. paratuberculosis
gcgcucuugggcggc

SEQ ID NO: 2850259 - RNA, 16 nt, Mycobacterium avium subsp. paratuberculosis
gcgcucuugggcggcc

SEQ ID NO: 2850260 - RNA, 19 nt, Mycobacterium avium subsp. paratuberculosis
gcgcucuugggcggccggc

SEQ ID NO: 2850261 - RNA, 20 nt, Mycobacterium avium subsp. paratuberculosis
gcgcucuugggcggccggcu

SEQ ID NO: 2850262 - RNA, 21 nt, Mycobacterium avium subsp. paratuberculosis
gcgcucuugggcggccggcuu

SEQ ID NO: 2850263 - RNA, 22 nt, Mycobacterium avium subsp. paratuberculosis
gcgcucuugggcggccggcuuc

SEQ ID NO: 2850264 - RNA, 13 nt, Mycobacterium avium subsp. paratuberculosis
gcgcugaacugcu

SEQ ID NO: 2850265 - RNA, 16 nt, Mycobacterium avium subsp. paratuberculosis
gcgcugaacugcucga

SEQ ID NO: 2850266 - RNA, 15 nt, Mycobacterium avium subsp. paratuberculosis
gcgcugaagcgcgac

SEQ ID NO: 2850267 - RNA, 21 nt, Mycobacterium avium subsp. paratuberculosis
gcgcugaagugcagcgcaugg

SEQ ID NO: 2850268 - RNA, 14 nt, Mycobacterium avium subsp. paratuberculosis
gcgcugaccagcgu

SEQ ID NO: 2850269 - RNA, 23 nt, Mycobacterium avium subsp. paratuberculosis
gcgcugaccagcgugaccucgac

SEQ ID NO: 2850270 - RNA, 16 nt, Mycobacterium avium subsp. paratuberculosis
gcgcugaccaggccgu

SEQ ID NO: 2850271 - RNA, 17 nt, Mycobacterium avium subsp. paratuberculosis
gcgcugaccaggccguc

SEQ ID NO: 2850272 - RNA, 22 nt, Mycobacterium avium subsp. paratuberculosis
gcgcugaccaggccguccacca

SEQ ID NO: 2850273 - RNA, 20 nt, Mycobacterium avium subsp. paratuberculosis
gcgcugagcacggugggcgc

SEQ ID NO: 2850274 - RNA, 20 nt, Mycobacterium avium subsp. paratuberculosis
gcgcugagcagguccucgau

SEQ ID NO: 2850275 - RNA, 22 nt, Mycobacterium avium subsp. paratuberculosis
gcgcugagcagguccucgaucg

SEQ ID NO: 2850276 - RNA, 21 nt, Mycobacterium avium subsp. paratuberculosis
gcgcugagcggguaaccgcag

SEQ ID NO: 2850277 - RNA, 20 nt, Mycobacterium avium subsp. paratuberculosis
gcgcugaucgaguccucgcg

SEQ ID NO: 2850278 - RNA, 21 nt, Mycobacterium avium subsp. paratuberculosis
gcgcugaucgaguccucgcgg

SEQ ID NO: 2850279 - RNA, 14 nt, Mycobacterium avium subsp. paratuberculosis
gcgcugaucgccgc

SEQ ID NO: 2850280 - RNA, 18 nt, Mycobacterium avium subsp. paratuberculosis
gcgcugcaaccgguccgc

SEQ ID NO: 2850281 - RNA, 21 nt, Mycobacterium avium subsp. paratuberculosis
gcgcugcaaccgguccgccgu

SEQ ID NO: 2850282 - RNA, 13 nt, Mycobacterium avium subsp. paratuberculosis
gcgcugcaccgca

SEQ ID NO: 2850283 - RNA, 16 nt, Mycobacterium avium subsp. paratuberculosis
gcgcugcagcagcccg

SEQ ID NO: 2850284 - RNA, 21 nt, Mycobacterium avium subsp. paratuberculosis
gcgcugcagcagcccgaucac

SEQ ID NO: 2850285 - RNA, 15 nt, Mycobacterium avium subsp. paratuberculosis
gcgcugcagcaucca

SEQ ID NO: 2850286 - RNA, 23 nt, Mycobacterium avium subsp. paratuberculosis
gcgcugcagcgagaccucccggc

SEQ ID NO: 2850287 - RNA, 17 nt, Mycobacterium avium subsp. paratuberculosis
gcgcugcauagucggcc

SEQ ID NO: 2850288 - RNA, 19 nt, Mycobacterium avium subsp. paratuberculosis
gcgcugcauagucggcccg

SEQ ID NO: 2850289 - RNA, 20 nt, Mycobacterium avium subsp. paratuberculosis
gcgcugcauagucggcccga

SEQ ID NO: 2850290 - RNA, 21 nt, Mycobacterium avium subsp. paratuberculosis
gcgcugcaugccggugucggu

SEQ ID NO: 2850291 - RNA, 12 nt, Mycobacterium avium subsp. paratuberculosis
gcgcugccaggg

SEQ ID NO: 2850292 - RNA, 16 nt, Mycobacterium avium subsp. paratuberculosis
gcgcugccagggccgg

SEQ ID NO: 2850293 - RNA, 13 nt, Mycobacterium avium subsp. paratuberculosis
gcgcugccagucg

SEQ ID NO: 2850294 - RNA, 13 nt, Mycobacterium avium subsp. paratuberculosis
gcgcugcccagcg

SEQ ID NO: 2850295 - RNA, 15 nt, Mycobacterium avium subsp. paratuberculosis
gcgcugcccagcgcg

SEQ ID NO: 2850296 - RNA, 17 nt, Mycobacterium avium subsp. paratuberculosis
gcgcugcccagcgcggu

SEQ ID NO: 2850297 - RNA, 19 nt, Mycobacterium avium subsp. paratuberculosis
gcgcugccccagccacagc

SEQ ID NO: 2850298 - RNA, 14 nt, Mycobacterium avium subsp. paratuberculosis
gcgcugcccgccgc

SEQ ID NO: 2850299 - RNA, 17 nt, Mycobacterium avium subsp. paratuberculosis
gcgcugcccgugccgca

SEQ ID NO: 2850300 - RNA, 13 nt, Mycobacterium avium subsp. paratuberculosis
gcgcugccgacga

SEQ ID NO: 2850301 - RNA, 19 nt, Mycobacterium avium subsp. paratuberculosis
gcgcugccgacgaugucgg

SEQ ID NO: 2850302 - RNA, 20 nt, Mycobacterium avium subsp. paratuberculosis
gcgcugccgacgaugucggc

SEQ ID NO: 2850303 - RNA, 21 nt, Mycobacterium avium subsp. paratuberculosis
gcgcugccgacgaugucggcu

SEQ ID NO: 2850304 - RNA, 14 nt, Mycobacterium avium subsp. paratuberculosis
gcgcugccgagcac

SEQ ID NO: 2850305 - RNA, 18 nt, Mycobacterium avium subsp. paratuberculosis
gcgcugccgagcaccucg

SEQ ID NO: 2850306 - RNA, 21 nt, Mycobacterium avium subsp. paratuberculosis
gcgcugccgagcaccucgucg

SEQ ID NO: 2850307 - RNA, 23 nt, Mycobacterium avium subsp. paratuberculosis
gcgcugccgagcaccucgucgcc

SEQ ID NO: 2850308 - RNA, 13 nt, Mycobacterium avium subsp. paratuberculosis
gcgcugccgccgg

SEQ ID NO: 2850309 - RNA, 14 nt, Mycobacterium avium subsp. paratuberculosis
gcgcugccgccggc

SEQ ID NO: 2850310 - RNA, 15 nt, Mycobacterium avium subsp. paratuberculosis
gcgcugccgccggcc

SEQ ID NO: 2850311 - RNA, 13 nt, Mycobacterium avium subsp. paratuberculosis
gcgcugccgcgcc

SEQ ID NO: 2850312 - RNA, 16 nt, Mycobacterium avium subsp. paratuberculosis
gcgcugccgcgccccg

SEQ ID NO: 2850313 - RNA, 15 nt, Mycobacterium avium subsp. paratuberculosis
gcgcugccgcgcgcc

SEQ ID NO: 2850314 - RNA, 16 nt, Mycobacterium avium subsp. paratuberculosis
gcgcugccgcgcgccg

SEQ ID NO: 2850315 - RNA, 19 nt, Mycobacterium avium subsp. paratuberculosis
gcgcugccgcgcgccgaca

SEQ ID NO: 2850316 - RNA, 14 nt, Mycobacterium avium subsp. paratuberculosis
gcgcugccggcccg

SEQ ID NO: 2850317 - RNA, 12 nt, Mycobacterium avium subsp. paratuberculosis
gcgcugccggcg

SEQ ID NO: 2850318 - RNA, 17 nt, Mycobacterium avium subsp. paratuberculosis
gcgcugccggcgcaccc

SEQ ID NO: 2850319 - RNA, 16 nt, Mycobacterium avium subsp. paratuberculosis
gcgcuugcgaucgccg

SEQ ID NO: 2850320 - RNA, 15 nt, Mycobacterium avium subsp. paratuberculosis
gcgcuugcgcucggu

SEQ ID NO: 2850321 - RNA, 17 nt, Mycobacterium avium subsp. paratuberculosis
gcgcuugcgcucggucg

SEQ ID NO: 2850322 - RNA, 17 nt, Mycobacterium avium subsp. paratuberculosis
gcgcuugcggcgcagcc

SEQ ID NO: 2850323 - RNA, 18 nt, Mycobacterium avium subsp. paratuberculosis
gcgcuugcggcgcagcca

SEQ ID NO: 2850324 - RNA, 22 nt, Mycobacterium avium subsp. paratuberculosis
gcgcuugcggcgcagccagcuc

SEQ ID NO: 2850325 - RNA, 16 nt, Mycobacterium avium subsp. paratuberculosis
gcgcuugggucgccgg

SEQ ID NO: 2850326 - RNA, 17 nt, Mycobacterium avium subsp. paratuberculosis
gcgcuugucgcagaccc

SEQ ID NO: 2850327 - RNA, 18 nt, Mycobacterium avium subsp. paratuberculosis
gcgcuugucggcguggcc

SEQ ID NO: 2850328 - RNA, 15 nt, Mycobacterium avium subsp. paratuberculosis
gcgcuuucgcgcacg

SEQ ID NO: 2850329 - RNA, 19 nt, Mycobacterium avium subsp. paratuberculosis
gcgcuuucgcgcacgccau

SEQ ID NO: 2850330 - RNA, 20 nt, Mycobacterium avium subsp. paratuberculosis
gcgcuuucgcgcacgccauc

SEQ ID NO: 2850331 - RNA, 22 nt, Mycobacterium avium subsp. paratuberculosis
gcgcuuucgcgcacgccaucgc

SEQ ID NO: 2850332 - RNA, 15 nt, Mycobacterium avium subsp. paratuberculosis
gcgcuuucgcugguc

SEQ ID NO: 2850333 - RNA, 17 nt, Mycobacterium avium subsp. paratuberculosis
gcgcuuuggaccagggc

SEQ ID NO: 2850334 - RNA, 17 nt, Mycobacterium avium subsp. paratuberculosis
gcggaaacgacgucgcc

SEQ ID NO: 2850335 - RNA, 19 nt, Mycobacterium avium subsp. paratuberculosis
gcggaaacgacgucgccac

SEQ ID NO: 2850336 - RNA, 23 nt, Mycobacterium avium subsp. paratuberculosis
gcggaaacuccuggccccgauca

SEQ ID NO: 2850337 - RNA, 14 nt, Mycobacterium avium subsp. paratuberculosis
gcggaacaccgccu

SEQ ID NO: 2850338 - RNA, 13 nt, Mycobacterium avium subsp. paratuberculosis
gcggaacagccgg

SEQ ID NO: 2850339 - RNA, 21 nt, Mycobacterium avium subsp. paratuberculosis
gcggaacagccggcucagggu

SEQ ID NO: 2850340 - RNA, 18 nt, Mycobacterium avium subsp. paratuberculosis
gcggaacagcgucgccga

SEQ ID NO: 2850341 - RNA, 20 nt, Mycobacterium avium subsp. paratuberculosis
gcggaacccacgugcggcgc

SEQ ID NO: 2850342 - RNA, 22 nt, Mycobacterium avium subsp. paratuberculosis
gcggaacccacgugcggcgccc

SEQ ID NO: 2850343 - RNA, 20 nt, Mycobacterium avium subsp. paratuberculosis
gcggaacccguugcgcccuu

SEQ ID NO: 2850344 - RNA, 13 nt, Mycobacterium avium subsp. paratuberculosis
gcggaaccgacac

SEQ ID NO: 2850345 - RNA, 21 nt, Mycobacterium avium subsp. paratuberculosis
gcggaaccgacaccucgccgu

SEQ ID NO: 2850346 - RNA, 15 nt, Mycobacterium avium subsp. paratuberculosis
gcggaaccggccggg

SEQ ID NO: 2850347 - RNA, 21 nt, Mycobacterium avium subsp. paratuberculosis
gcggaaccggccggggcgcca

SEQ ID NO: 2850348 - RNA, 15 nt, Mycobacterium avium subsp. paratuberculosis
gcggaaccgggccgc

SEQ ID NO: 2850349 - RNA, 22 nt, Mycobacterium avium subsp. paratuberculosis
gcggaaccgggccgcuggccgc

SEQ ID NO: 2850350 - RNA, 13 nt, Mycobacterium avium subsp. paratuberculosis
gcggaaccggggg

SEQ ID NO: 2850351 - RNA, 19 nt, Mycobacterium avium subsp. paratuberculosis
gcggaaccgggggccguca

SEQ ID NO: 2850352 - RNA, 16 nt, Mycobacterium avium subsp. paratuberculosis
gcggaaccguugcagc

SEQ ID NO: 2850353 - RNA, 14 nt, Mycobacterium avium subsp. paratuberculosis
gcggaacgcgccgg

SEQ ID NO: 2850354 - RNA, 15 nt, Mycobacterium avium subsp. paratuberculosis
gcggaacgcgccggg

SEQ ID NO: 2850355 - RNA, 17 nt, Mycobacterium avium subsp. paratuberculosis
gcggaacggucggggcg

SEQ ID NO: 2850356 - RNA, 20 nt, Mycobacterium avium subsp. paratuberculosis
gcggaacggucggggcggcg

SEQ ID NO: 2850357 - RNA, 22 nt, Mycobacterium avium subsp. paratuberculosis
gcggaacggucggggcggcggg

SEQ ID NO: 2850358 - RNA, 16 nt, Mycobacterium avium subsp. paratuberculosis
gcggaacugcucccag

SEQ ID NO: 2850359 - RNA, 23 nt, Mycobacterium avium subsp. paratuberculosis
gcggaacugcucccaggcgucgu

SEQ ID NO: 2850360 - RNA, 23 nt, Mycobacterium avium subsp. paratuberculosis
gcggaagaaguucucgcacccgg

SEQ ID NO: 2850361 - RNA, 13 nt, Mycobacterium avium subsp. paratuberculosis
gcggaagccccag

SEQ ID NO: 2850362 - RNA, 21 nt, Mycobacterium avium subsp. paratuberculosis
gcggaagccccaggcccgguu

SEQ ID NO: 2850363 - RNA, 14 nt, Mycobacterium avium subsp. paratuberculosis
gcggaagcgcguuc

SEQ ID NO: 2850364 - RNA, 20 nt, Mycobacterium avium subsp. paratuberculosis
gcggaagcucaucgaggucg

SEQ ID NO: 2850365 - RNA, 23 nt, Mycobacterium avium subsp. paratuberculosis
gcggaagcugccguugcgccagc

SEQ ID NO: 2850366 - RNA, 13 nt, Mycobacterium avium subsp. paratuberculosis
gcggaaggccagc

SEQ ID NO: 2850367 - RNA, 15 nt, Mycobacterium avium subsp. paratuberculosis
gcggaaggcccccgg

SEQ ID NO: 2850368 - RNA, 20 nt, Mycobacterium avium subsp. paratuberculosis
gcggaaggcccccggcucga

SEQ ID NO: 2850369 - RNA, 22 nt, Mycobacterium avium subsp. paratuberculosis
gcggaaggcccccggcucgauc

SEQ ID NO: 2850370 - RNA, 14 nt, Mycobacterium avium subsp. paratuberculosis
gcggaaggccgcgc

SEQ ID NO: 2850371 - RNA, 22 nt, Mycobacterium avium subsp. paratuberculosis
gcggaaggccgcgcgggcggcg

SEQ ID NO: 2850372 - RNA, 23 nt, Mycobacterium avium subsp. paratuberculosis
gcggaaggccgcgcgggcggcgu

SEQ ID NO: 2850373 - RNA, 16 nt, Mycobacterium avium subsp. paratuberculosis
gcggaaguacaccggu

SEQ ID NO: 2850374 - RNA, 18 nt, Mycobacterium avium subsp. paratuberculosis
gcggaagucggugcccuu

SEQ ID NO: 2850375 - RNA, 21 nt, Mycobacterium avium subsp. paratuberculosis
gcggaaucacuuccgcggcaa

SEQ ID NO: 2850376 - RNA, 15 nt, Mycobacterium avium subsp. paratuberculosis
gcggaaucgcccggg

SEQ ID NO: 2850377 - RNA, 15 nt, Mycobacterium avium subsp. paratuberculosis
gcggaaugaacgcgg

SEQ ID NO: 2850378 - RNA, 16 nt, Mycobacterium avium subsp. paratuberculosis
gcggaaugaacgcggc

SEQ ID NO: 2850379 - RNA, 20 nt, Mycobacterium avium subsp. paratuberculosis
gcggaaugaacgcggccagg

SEQ ID NO: 2850380 - RNA, 14 nt, Mycobacterium avium subsp. paratuberculosis
gcggaaugcucgac

SEQ ID NO: 2850381 - RNA, 21 nt, Mycobacterium avium subsp. paratuberculosis
gcggaauucgcgggugcgcuc

SEQ ID NO: 2850382 - RNA, 16 nt, Mycobacterium avium subsp. paratuberculosis
gcggaauuuucgccgu

SEQ ID NO: 2850383 - RNA, 20 nt, Mycobacterium avium subsp. paratuberculosis
gcggaauuuucgccgucacu

SEQ ID NO: 2850384 - RNA, 17 nt, Mycobacterium avium subsp. paratuberculosis
gcggacaccagucgcac

SEQ ID NO: 2850385 - RNA, 17 nt, Mycobacterium avium subsp. paratuberculosis
gcggacacgaacgacgc

SEQ ID NO: 2850386 - RNA, 14 nt, Mycobacterium avium subsp. paratuberculosis
gcggacacggccgg

SEQ ID NO: 2850387 - RNA, 15 nt, Mycobacterium avium subsp. paratuberculosis
gcggacacggccggg

SEQ ID NO: 2850388 - RNA, 15 nt, Mycobacterium avium subsp. paratuberculosis
gcggacagcacguug

SEQ ID NO: 2850389 - RNA, 20 nt, Mycobacterium avium subsp. paratuberculosis
gcggacagccccgagccgcg

SEQ ID NO: 2850390 - RNA, 22 nt, Mycobacterium avium subsp. paratuberculosis
gcggacagccccgagccgcgga

SEQ ID NO: 2850391 - RNA, 15 nt, Mycobacterium avium subsp. paratuberculosis
gcggacagcgcggug

SEQ ID NO: 2850392 - RNA, 19 nt, Mycobacterium avium subsp. paratuberculosis
gcggacagcgcggugaugu

SEQ ID NO: 2850393 - RNA, 17 nt, Mycobacterium avium subsp. paratuberculosis
gcggacagcucgccggc

SEQ ID NO: 2850394 - RNA, 20 nt, Mycobacterium avium subsp. paratuberculosis
gcggacagcucgccggccgc

SEQ ID NO: 2850395 - RNA, 13 nt, Mycobacterium avium subsp. paratuberculosis
gcggacagggcgg

SEQ ID NO: 2850396 - RNA, 15 nt, Mycobacterium avium subsp. paratuberculosis
gcggacagggcggcg

SEQ ID NO: 2850397 - RNA, 17 nt, Mycobacterium avium subsp. paratuberculosis
gcggacaucgccucggc

SEQ ID NO: 2850398 - RNA, 19 nt, Mycobacterium avium subsp. paratuberculosis
gcggacaucgccucggcgu

SEQ ID NO: 2850399 - RNA, 13 nt, Mycobacterium avium subsp. paratuberculosis
gcggaccaccgcg

SEQ ID NO: 2850400 - RNA, 20 nt, Mycobacterium avium subsp. paratuberculosis
gcggacccagcuccucggcc

SEQ ID NO: 2850401 - RNA, 21 nt, Mycobacterium avium subsp. paratuberculosis
gcggacccagcuccucggcca

SEQ ID NO: 2850402 - RNA, 22 nt, Mycobacterium avium subsp. paratuberculosis
gcggacccagcuccucggccag

SEQ ID NO: 2850403 - RNA, 18 nt, Mycobacterium avium subsp. paratuberculosis
gcggaguuuggacaucac

SEQ ID NO: 2850404 - RNA, 15 nt, Mycobacterium avium subsp. paratuberculosis
gcggauacgcccggc

SEQ ID NO: 2850405 - RNA, 16 nt, Mycobacterium avium subsp. paratuberculosis
gcggauacgcccggcc

SEQ ID NO: 2850406 - RNA, 20 nt, Mycobacterium avium subsp. paratuberculosis
gcggaucacaucggacaucg

SEQ ID NO: 2850407 - RNA, 13 nt, Mycobacterium avium subsp. paratuberculosis
gcggaucagcacc

SEQ ID NO: 2850408 - RNA, 18 nt, Mycobacterium avium subsp. paratuberculosis
gcggaucagcaccgacgc

SEQ ID NO: 2850409 - RNA, 20 nt, Mycobacterium avium subsp. paratuberculosis
gcggaucagcaccgacgcgg

SEQ ID NO: 2850410 - RNA, 23 nt, Mycobacterium avium subsp. paratuberculosis
gcggaucagcaccgacgcggcga

SEQ ID NO: 2850411 - RNA, 17 nt, Mycobacterium avium subsp. paratuberculosis
gcggaucaguaccggcg

SEQ ID NO: 2850412 - RNA, 18 nt, Mycobacterium avium subsp. paratuberculosis
gcggaucaguaccggcga

SEQ ID NO: 2850413 - RNA, 19 nt, Mycobacterium avium subsp. paratuberculosis
gcggaucaguaccggcgau

SEQ ID NO: 2850414 - RNA, 21 nt, Mycobacterium avium subsp. paratuberculosis
gcggaucaguaccggcgaugc

SEQ ID NO: 2850415 - RNA, 17 nt, Mycobacterium avium subsp. paratuberculosis
gcggaucaugcgcguca

SEQ ID NO: 2850416 - RNA, 14 nt, Mycobacterium avium subsp. paratuberculosis
gcggauccagcacc

SEQ ID NO: 2850417 - RNA, 16 nt, Mycobacterium avium subsp. paratuberculosis
gcggauccagcaccgc

SEQ ID NO: 2850418 - RNA, 17 nt, Mycobacterium avium subsp. paratuberculosis
gcggauccagguggggc

SEQ ID NO: 2850419 - RNA, 21 nt, Mycobacterium avium subsp. paratuberculosis
gcggauccagguggggcacgg

SEQ ID NO: 2850420 - RNA, 14 nt, Mycobacterium avium subsp. paratuberculosis
gcggauccgacgaa

SEQ ID NO: 2850421 - RNA, 14 nt, Mycobacterium avium subsp. paratuberculosis
gcggauccgcagcu

SEQ ID NO: 2850422 - RNA, 21 nt, Mycobacterium avium subsp. paratuberculosis
gcggauccgcagcugaucggg

SEQ ID NO: 2850423 - RNA, 13 nt, Mycobacterium avium subsp. paratuberculosis
gcggauccgggcc

SEQ ID NO: 2850424 - RNA, 17 nt, Mycobacterium avium subsp. paratuberculosis
gcggauccgggccgccu

SEQ ID NO: 2850425 - RNA, 17 nt, Mycobacterium avium subsp. paratuberculosis
gcggauccgggccggcg

SEQ ID NO: 2850426 - RNA, 23 nt, Mycobacterium avium subsp. paratuberculosis
gcggauccgggccggcgucgcgg

SEQ ID NO: 2850427 - RNA, 18 nt, Mycobacterium avium subsp. paratuberculosis
gcggauccucaguccgcc

SEQ ID NO: 2850428 - RNA, 17 nt, Mycobacterium avium subsp. paratuberculosis
gcggaucgaacagggcg

SEQ ID NO: 2850429 - RNA, 21 nt, Mycobacterium avium subsp. paratuberculosis
gcggaucgagguagcgugcgc

SEQ ID NO: 2850430 - RNA, 20 nt, Mycobacterium avium subsp. paratuberculosis
gcggaucgcaucgggcgaca

SEQ ID NO: 2850431 - RNA, 13 nt, Mycobacterium avium subsp. paratuberculosis
gcggaucgcgcug

SEQ ID NO: 2850432 - RNA, 22 nt, Mycobacterium avium subsp. paratuberculosis
gcggaucgcgcugaccaggccg

SEQ ID NO: 2850433 - RNA, 20 nt, Mycobacterium avium subsp. paratuberculosis
gcggaucgcgggcgacccgc

SEQ ID NO: 2850434 - RNA, 22 nt, Mycobacterium avium subsp. paratuberculosis
gcggaucgcgggcgacccgcug

SEQ ID NO: 2850435 - RNA, 23 nt, Mycobacterium avium subsp. paratuberculosis
gcggaucgcgggcgacccgcugg

SEQ ID NO: 2850436 - RNA, 21 nt, Mycobacterium avium subsp. paratuberculosis
gcggaucgcguaguccagcac

SEQ ID NO: 2850437 - RNA, 14 nt, Mycobacterium avium subsp. paratuberculosis
gcggaucggcccga

SEQ ID NO: 2850438 - RNA, 20 nt, Mycobacterium avium subsp. paratuberculosis
gcggaucggcccgaucucgc

SEQ ID NO: 2850439 - RNA, 15 nt, Mycobacterium avium subsp. paratuberculosis
gcggaucggccuggg

SEQ ID NO: 2850440 - RNA, 15 nt, Mycobacterium avium subsp. paratuberculosis
gcggaucggcggcga

SEQ ID NO: 2850441 - RNA, 13 nt, Mycobacterium avium subsp. paratuberculosis
gcggaucggcggu

SEQ ID NO: 2850442 - RNA, 13 nt, Mycobacterium avium subsp. paratuberculosis
gcggaucgggcgu

SEQ ID NO: 2850443 - RNA, 22 nt, Mycobacterium avium subsp. paratuberculosis
gcggaucgggcguggcgucggu

SEQ ID NO: 2850444 - RNA, 18 nt, Mycobacterium avium subsp. paratuberculosis
gcggaucgguggacgcgg

SEQ ID NO: 2850445 - RNA, 19 nt, Mycobacterium avium subsp. paratuberculosis
gcggaucgguggacgcggu

SEQ ID NO: 2850446 - RNA, 16 nt, Mycobacterium avium subsp. paratuberculosis
gcggaucucgaccucg

SEQ ID NO: 2850447 - RNA, 22 nt, Mycobacterium avium subsp. paratuberculosis
gcggaucucgaccucgucggcg

SEQ ID NO: 2850448 - RNA, 23 nt, Mycobacterium avium subsp. paratuberculosis
gcggaucucgaccucgucggcgg

SEQ ID NO: 2850449 - RNA, 14 nt, Mycobacterium avium subsp. paratuberculosis
gcggaucucgucgg

SEQ ID NO: 2850450 - RNA, 15 nt, Mycobacterium avium subsp. paratuberculosis
gcggaucucgucggg

SEQ ID NO: 2850451 - RNA, 17 nt, Mycobacterium avium subsp. paratuberculosis
gcggaucucgucgggcc

SEQ ID NO: 2850452 - RNA, 20 nt, Mycobacterium avium subsp. paratuberculosis
gcggaucuucuccgccacau

SEQ ID NO: 2850453 - RNA, 18 nt, Mycobacterium avium subsp. paratuberculosis
gcggaugaagugcgccag

SEQ ID NO: 2850454 - RNA, 19 nt, Mycobacterium avium subsp. paratuberculosis
gcggaugaagugcgccagc

SEQ ID NO: 2850455 - RNA, 20 nt, Mycobacterium avium subsp. paratuberculosis
gcggaugaagugcgccagcg

SEQ ID NO: 2850456 - RNA, 21 nt, Mycobacterium avium subsp. paratuberculosis
gcggaugaagugcgccagcga

SEQ ID NO: 2850457 - RNA, 22 nt, Mycobacterium avium subsp. paratuberculosis
gcggaugaccaggucgccggcg

SEQ ID NO: 2850458 - RNA, 18 nt, Mycobacterium avium subsp. paratuberculosis
gcggaugacgggugcuca

SEQ ID NO: 2850459 - RNA, 22 nt, Mycobacterium avium subsp. paratuberculosis
gcggaugacgugcaccaccgcg

SEQ ID NO: 2850460 - RNA, 16 nt, Mycobacterium avium subsp. paratuberculosis
gcggaugaugguggcc

SEQ ID NO: 2850461 - RNA, 17 nt, Mycobacterium avium subsp. paratuberculosis
gcggaugaugguggcca

SEQ ID NO: 2850462 - RNA, 19 nt, Mycobacterium avium subsp. paratuberculosis
gcggaugcccaggccggcg

SEQ ID NO: 2850463 - RNA, 20 nt, Mycobacterium avium subsp. paratuberculosis
gcggaugcccaggccggcga

SEQ ID NO: 2850464 - RNA, 15 nt, Mycobacterium avium subsp. paratuberculosis
gcggaugcccgccgg

SEQ ID NO: 2850465 - RNA, 19 nt, Mycobacterium avium subsp. paratuberculosis
gcggaugcccgccggcguc

SEQ ID NO: 2850466 - RNA, 20 nt, Mycobacterium avium subsp. paratuberculosis
gcggaugcccgccggcgucu

SEQ ID NO: 2850467 - RNA, 16 nt, Mycobacterium avium subsp. paratuberculosis
gcggauggccccggcg

SEQ ID NO: 2850468 - RNA, 21 nt, Mycobacterium avium subsp. paratuberculosis
gcggauggccccggcgagucu

SEQ ID NO: 2850469 - RNA, 13 nt, Mycobacterium avium subsp. paratuberculosis
gcggauggccucg

SEQ ID NO: 2850470 - RNA, 18 nt, Mycobacterium avium subsp. paratuberculosis
gcggauggccucggcgau

SEQ ID NO: 2850471 - RNA, 16 nt, Mycobacterium avium subsp. paratuberculosis
gcggauggcgacggcg

SEQ ID NO: 2850472 - RNA, 18 nt, Mycobacterium avium subsp. paratuberculosis
gcggauggcgacggcgac

SEQ ID NO: 2850473 - RNA, 17 nt, Mycobacterium avium subsp. paratuberculosis
gcggauggcgccgucga

SEQ ID NO: 2850474 - RNA, 15 nt, Mycobacterium avium subsp. paratuberculosis
gcggauguccgaccg

SEQ ID NO: 2850475 - RNA, 13 nt, Mycobacterium avium subsp. paratuberculosis
gcggaugucggug

SEQ ID NO: 2850476 - RNA, 14 nt, Mycobacterium avium subsp. paratuberculosis
gcggaugucggugu

SEQ ID NO: 2850477 - RNA, 15 nt, Mycobacterium avium subsp. paratuberculosis
gcggaugucggugug

SEQ ID NO: 2850478 - RNA, 18 nt, Mycobacterium avium subsp. paratuberculosis
gcggauuaccgugacggc

SEQ ID NO: 2850479 - RNA, 21 nt, Mycobacterium avium subsp. paratuberculosis
gcggauuccagcgcgaccgcc

SEQ ID NO: 2850480 - RNA, 15 nt, Mycobacterium avium subsp. paratuberculosis
gcggauuccggcauc

SEQ ID NO: 2850481 - RNA, 18 nt, Mycobacterium avium subsp. paratuberculosis
gcggauuccggcaucggc

SEQ ID NO: 2850482 - RNA, 20 nt, Mycobacterium avium subsp. paratuberculosis
gcggauucucgcucugccgg

SEQ ID NO: 2850483 - RNA, 12 nt, Mycobacterium avium subsp. paratuberculosis
gcggauugacca

SEQ ID NO: 2850484 - RNA, 14 nt, Mycobacterium avium subsp. paratuberculosis
gcggauuggucggg

SEQ ID NO: 2850485 - RNA, 16 nt, Mycobacterium avium subsp. paratuberculosis
gcggauuggugccgau

SEQ ID NO: 2850486 - RNA, 20 nt, Mycobacterium avium subsp. paratuberculosis
gcggauuggugccgaucacc

SEQ ID NO: 2850487 - RNA, 17 nt, Mycobacterium avium subsp. paratuberculosis
gcggcacggugcgggug

SEQ ID NO: 2850488 - RNA, 20 nt, Mycobacterium avium subsp. paratuberculosis
gcggcacggugcgggugccg

SEQ ID NO: 2850489 - RNA, 22 nt, Mycobacterium avium subsp. paratuberculosis
gcggcacggugcgggugccgaa

SEQ ID NO: 2850490 - RNA, 16 nt, Mycobacterium avium subsp. paratuberculosis
gcggcacgguuggccg

SEQ ID NO: 2850491 - RNA, 17 nt, Mycobacterium avium subsp. paratuberculosis
gcggcacgguuggccgg

SEQ ID NO: 2850492 - RNA, 18 nt, Mycobacterium avium subsp. paratuberculosis
gcggcacgguuggccggc

SEQ ID NO: 2850493 - RNA, 19 nt, Mycobacterium avium subsp. paratuberculosis
gcggcacgguuggccggcc

SEQ ID NO: 2850494 - RNA, 14 nt, Mycobacterium avium subsp. paratuberculosis
gcggcacgucgccg

SEQ ID NO: 2850495 - RNA, 15 nt, Mycobacterium avium subsp. paratuberculosis
gcggcacgucgccgu

SEQ ID NO: 2850496 - RNA, 18 nt, Mycobacterium avium subsp. paratuberculosis
gcggcacgucgccguucu

SEQ ID NO: 2850497 - RNA, 22 nt, Mycobacterium avium subsp. paratuberculosis
gcggcagaccguccgguucggc

SEQ ID NO: 2850498 - RNA, 23 nt, Mycobacterium avium subsp. paratuberculosis
gcggcagaccguccgguucggcg

SEQ ID NO: 2850499 - RNA, 24 nt, Mycobacterium avium subsp. paratuberculosis
gcggcagaccguccgguucggcgg

SEQ ID NO: 2850500 - RNA, 17 nt, Mycobacterium avium subsp. paratuberculosis
gcggcagauggucucga

SEQ ID NO: 2850501 - RNA, 17 nt, Mycobacterium avium subsp. paratuberculosis
gcggcagcacaccuucc

SEQ ID NO: 2850502 - RNA, 23 nt, Mycobacterium avium subsp. paratuberculosis
gcggcagcacaccuuccaccacc

SEQ ID NO: 2850503 - RNA, 21 nt, Mycobacterium avium subsp. paratuberculosis
gcggcagcacccgcaucaacu

SEQ ID NO: 2850504 - RNA, 13 nt, Mycobacterium avium subsp. paratuberculosis
gcggcagcacguc

SEQ ID NO: 2850505 - RNA, 14 nt, Mycobacterium avium subsp. paratuberculosis
gcggcagcagcacc

SEQ ID NO: 2850506 - RNA, 15 nt, Mycobacterium avium subsp. paratuberculosis
gcggcagcagcacca

SEQ ID NO: 2850507 - RNA, 17 nt, Mycobacterium avium subsp. paratuberculosis
gcggcagcagcaccagc

SEQ ID NO: 2850508 - RNA, 21 nt, Mycobacterium avium subsp. paratuberculosis
gcggcagcagcccgucccggc

SEQ ID NO: 2850509 - RNA, 14 nt, Mycobacterium avium subsp. paratuberculosis
gcggcagcagcugc

SEQ ID NO: 2850510 - RNA, 20 nt, Mycobacterium avium subsp. paratuberculosis
gcggcagcagcugcgucggc

SEQ ID NO: 2850511 - RNA, 14 nt, Mycobacterium avium subsp. paratuberculosis
gcggcagccacggc

SEQ ID NO: 2850512 - RNA, 16 nt, Mycobacterium avium subsp. paratuberculosis
gcggcagccacggcag

SEQ ID NO: 2850513 - RNA, 18 nt, Mycobacterium avium subsp. paratuberculosis
gcggcagccagccuggcg

SEQ ID NO: 2850514 - RNA, 14 nt, Mycobacterium avium subsp. paratuberculosis
gcggcagccaggcg

SEQ ID NO: 2850515 - RNA, 15 nt, Mycobacterium avium subsp. paratuberculosis
gcggcagccaggcgu

SEQ ID NO: 2850516 - RNA, 23 nt, Mycobacterium avium subsp. paratuberculosis
gcggcagccagguacuccgguac

SEQ ID NO: 2850517 - RNA, 13 nt, Mycobacterium avium subsp. paratuberculosis
gcggcagccgggc

SEQ ID NO: 2850518 - RNA, 14 nt, Mycobacterium avium subsp. paratuberculosis
gcggcagccgggcg

SEQ ID NO: 2850519 - RNA, 15 nt, Mycobacterium avium subsp. paratuberculosis
gcggcagccgggcga

SEQ ID NO: 2850520 - RNA, 23 nt, Mycobacterium avium subsp. paratuberculosis
gcggcagccuuuccacaucugcu

SEQ ID NO: 2850521 - RNA, 19 nt, Mycobacterium avium subsp. paratuberculosis
gcggcagcgaacugccggc

SEQ ID NO: 2850522 - RNA, 17 nt, Mycobacterium avium subsp. paratuberculosis
gcggcagcgacagcgcg

SEQ ID NO: 2850523 - RNA, 19 nt, Mycobacterium avium subsp. paratuberculosis
gcggcagcgacagcgcguc

SEQ ID NO: 2850524 - RNA, 19 nt, Mycobacterium avium subsp. paratuberculosis
gcggcagcgaggcgcgcag

SEQ ID NO: 2850525 - RNA, 20 nt, Mycobacterium avium subsp. paratuberculosis
gcggcagcgaggcgcgcagg

SEQ ID NO: 2850526 - RNA, 13 nt, Mycobacterium avium subsp. paratuberculosis
gcggcagcgccag

SEQ ID NO: 2850527 - RNA, 19 nt, Mycobacterium avium subsp. paratuberculosis
gcggcagcgcgcccugagg

SEQ ID NO: 2850528 - RNA, 14 nt, Mycobacterium avium subsp. paratuberculosis
gcggcagcgcggcg

SEQ ID NO: 2850529 - RNA, 23 nt, Mycobacterium avium subsp. paratuberculosis
gcggcagcgcggcguucagcagc

SEQ ID NO: 2850530 - RNA, 14 nt, Mycobacterium avium subsp. paratuberculosis
gcggcagcgucgcc

SEQ ID NO: 2850531 - RNA, 18 nt, Mycobacterium avium subsp. paratuberculosis
gcggcagcgucgccagcc

SEQ ID NO: 2850532 - RNA, 20 nt, Mycobacterium avium subsp. paratuberculosis
gcggcagcgucgccagccgc

SEQ ID NO: 2850533 - RNA, 22 nt, Mycobacterium avium subsp. paratuberculosis
gcggcagcgucgccagccgccg

SEQ ID NO: 2850534 - RNA, 23 nt, Mycobacterium avium subsp. paratuberculosis
gcggcagcgucgccagccgccgg

SEQ ID NO: 2850535 - RNA, 15 nt, Mycobacterium avium subsp. paratuberculosis
gcggcagcucggcgg

SEQ ID NO: 2850536 - RNA, 15 nt, Mycobacterium avium subsp. paratuberculosis
gcggcaggaaccggg

SEQ ID NO: 2850537 - RNA, 17 nt, Mycobacterium avium subsp. paratuberculosis
gcggcaggaauuccagc

SEQ ID NO: 2850538 - RNA, 18 nt, Mycobacterium avium subsp. paratuberculosis
gcggcaggaauuccagcg

SEQ ID NO: 2850539 - RNA, 19 nt, Mycobacterium avium subsp. paratuberculosis
gcggcaggaauuccagcga

SEQ ID NO: 2850540 - RNA, 15 nt, Mycobacterium avium subsp. paratuberculosis
gcggcaggcgcccca

SEQ ID NO: 2850541 - RNA, 16 nt, Mycobacterium avium subsp. paratuberculosis
gcggcaggcgccccag

SEQ ID NO: 2850542 - RNA, 18 nt, Mycobacterium avium subsp. paratuberculosis
gcggcaggcgccccagcu

SEQ ID NO: 2850543 - RNA, 19 nt, Mycobacterium avium subsp. paratuberculosis
gcggcaggcgccccagcuc

SEQ ID NO: 2850544 - RNA, 15 nt, Mycobacterium avium subsp. paratuberculosis
gcggcagggccaccg

SEQ ID NO: 2850545 - RNA, 17 nt, Mycobacterium avium subsp. paratuberculosis
gcggcagggccaccguc

SEQ ID NO: 2850546 - RNA, 23 nt, Mycobacterium avium subsp. paratuberculosis
gcggcagggccaccgucagggug

SEQ ID NO: 2850547 - RNA, 14 nt, Mycobacterium avium subsp. paratuberculosis
gcggcagggccagc

SEQ ID NO: 2850548 - RNA, 16 nt, Mycobacterium avium subsp. paratuberculosis
gcggcagggccagcac

SEQ ID NO: 2850549 - RNA, 18 nt, Mycobacterium avium subsp. paratuberculosis
gcggcagggccagcacca

SEQ ID NO: 2850550 - RNA, 15 nt, Mycobacterium avium subsp. paratuberculosis
gcggcagggccaggc

SEQ ID NO: 2850551 - RNA, 23 nt, Mycobacterium avium subsp. paratuberculosis
gcggcagggccaggccgugaucg

SEQ ID NO: 2850552 - RNA, 17 nt, Mycobacterium avium subsp. paratuberculosis
gcggcagguaggcgccg

SEQ ID NO: 2850553 - RNA, 19 nt, Mycobacterium avium subsp. paratuberculosis
gcggcagguaggcgccgcu

SEQ ID NO: 2850554 - RNA, 22 nt, Mycobacterium avium subsp. paratuberculosis
gcggcagguaggcgccgcucga

SEQ ID NO: 2850555 - RNA, 20 nt, Mycobacterium avium subsp. paratuberculosis
gcggcaggucccaggccagg

SEQ ID NO: 2850556 - RNA, 17 nt, Mycobacterium avium subsp. paratuberculosis
gcggcaggucggccagc

SEQ ID NO: 2850557 - RNA, 20 nt, Mycobacterium avium subsp. paratuberculosis
gcggcaggucggccagcgcc

SEQ ID NO: 2850558 - RNA, 14 nt, Mycobacterium avium subsp. paratuberculosis
gcggcaggucggcg

SEQ ID NO: 2850559 - RNA, 17 nt, Mycobacterium avium subsp. paratuberculosis
gcggcaggucgucgucg

SEQ ID NO: 2850560 - RNA, 21 nt, Mycobacterium avium subsp. paratuberculosis
gcggcaggucgucgucgccgc

SEQ ID NO: 2850561 - RNA, 22 nt, Mycobacterium avium subsp. paratuberculosis
gcggcagguggauugucggccg

SEQ ID NO: 2850562 - RNA, 23 nt, Mycobacterium avium subsp. paratuberculosis
gcggcagguggauugucggccgc

SEQ ID NO: 2850563 - RNA, 21 nt, Mycobacterium avium subsp. paratuberculosis
gcggcagguggggcagcaccu

SEQ ID NO: 2850564 - RNA, 20 nt, Mycobacterium avium subsp. paratuberculosis
gcggcaguagcgcaccgguc

SEQ ID NO: 2850565 - RNA, 13 nt, Mycobacterium avium subsp. paratuberculosis
gcggcaguccgcc

SEQ ID NO: 2850566 - RNA, 15 nt, Mycobacterium avium subsp. paratuberculosis
gcggcaguccgccgg

SEQ ID NO: 2850567 - RNA, 13 nt, Mycobacterium avium subsp. paratuberculosis
gcggcaguccggc

SEQ ID NO: 2850568 - RNA, 15 nt, Mycobacterium avium subsp. paratuberculosis
gcggcagucgcagca

SEQ ID NO: 2850569 - RNA, 16 nt, Mycobacterium avium subsp. paratuberculosis
gcggcagucgcagcag

SEQ ID NO: 2850570 - RNA, 17 nt, Mycobacterium avium subsp. paratuberculosis
gcggcagucgcagcagc

SEQ ID NO: 2850571 - RNA, 13 nt, Mycobacterium avium subsp. paratuberculosis
gcggccaccucgc

SEQ ID NO: 2850572 - RNA, 21 nt, Mycobacterium avium subsp. paratuberculosis
gcggccaccucgccgcaggcg

SEQ ID NO: 2850573 - RNA, 22 nt, Mycobacterium avium subsp. paratuberculosis
gcggccaccucgccgcaggcgu

SEQ ID NO: 2850574 - RNA, 15 nt, Mycobacterium avium subsp. paratuberculosis
gcggccaccucggcg

SEQ ID NO: 2850575 - RNA, 23 nt, Mycobacterium avium subsp. paratuberculosis
gcggccaccucggcggcaccgcc

SEQ ID NO: 2850576 - RNA, 16 nt, Mycobacterium avium subsp. paratuberculosis
gcggccaccugggcgg

SEQ ID NO: 2850577 - RNA, 14 nt, Mycobacterium avium subsp. paratuberculosis
gcggccacgacggc

SEQ ID NO: 2850578 - RNA, 18 nt, Mycobacterium avium subsp. paratuberculosis
gcggccacgacggcgcug

SEQ ID NO: 2850579 - RNA, 20 nt, Mycobacterium avium subsp. paratuberculosis
gcggccacgacggcgcuggc

SEQ ID NO: 2850580 - RNA, 21 nt, Mycobacterium avium subsp. paratuberculosis
gcggccacgacggcgcuggcc

SEQ ID NO: 2850581 - RNA, 22 nt, Mycobacterium avium subsp. paratuberculosis
gcggccacgacggcgcuggccg

SEQ ID NO: 2850582 - RNA, 15 nt, Mycobacterium avium subsp. paratuberculosis
gcggccacgaucgcg

SEQ ID NO: 2850583 - RNA, 16 nt, Mycobacterium avium subsp. paratuberculosis
gcggccacgaucgcgg

SEQ ID NO: 2850584 - RNA, 17 nt, Mycobacterium avium subsp. paratuberculosis
gcggccacgaucgcggc

SEQ ID NO: 2850585 - RNA, 18 nt, Mycobacterium avium subsp. paratuberculosis
gcggccacgaucgcggcc

SEQ ID NO: 2850586 - RNA, 19 nt, Mycobacterium avium subsp. paratuberculosis
gcggccacgaucgcggcca

SEQ ID NO: 2850587 - RNA, 20 nt, Mycobacterium avium subsp. paratuberculosis
gcggccacgaucgcggccag

SEQ ID NO: 2850588 - RNA, 18 nt, Mycobacterium avium subsp. paratuberculosis
gcggccacgauggggacg

SEQ ID NO: 2850589 - RNA, 16 nt, Mycobacterium avium subsp. paratuberculosis
gcggccacgcaggcgu

SEQ ID NO: 2850590 - RNA, 16 nt, Mycobacterium avium subsp. paratuberculosis
gcggccacgcccuggc

SEQ ID NO: 2850591 - RNA, 20 nt, Mycobacterium avium subsp. paratuberculosis
gcggccacgcccuggccgcc

SEQ ID NO: 2850592 - RNA, 21 nt, Mycobacterium avium subsp. paratuberculosis
gcggccacgcccuggccgccg

SEQ ID NO: 2850593 - RNA, 20 nt, Mycobacterium avium subsp. paratuberculosis
gcggccacgcuagcgugacg

SEQ ID NO: 2850594 - RNA, 21 nt, Mycobacterium avium subsp. paratuberculosis
gcggccacgcuagcgugacgc

SEQ ID NO: 2850595 - RNA, 16 nt, Mycobacterium avium subsp. paratuberculosis
gcggccacgcucgggc

SEQ ID NO: 2850596 - RNA, 17 nt, Mycobacterium avium subsp. paratuberculosis
gcggccacgcucgggcc

SEQ ID NO: 2850597 - RNA, 14 nt, Mycobacterium avium subsp. paratuberculosis
gcggccagcaccag

SEQ ID NO: 2850598 - RNA, 13 nt, Mycobacterium avium subsp. paratuberculosis
gcggccagcacgg

SEQ ID NO: 2850599 - RNA, 22 nt, Mycobacterium avium subsp. paratuberculosis
gcggccagcacggucagcggcc

SEQ ID NO: 2850600 - RNA, 12 nt, Mycobacterium avium subsp. paratuberculosis
gcggccagcagc

SEQ ID NO: 2850601 - RNA, 14 nt, Mycobacterium avium subsp. paratuberculosis
gcggccagcagcac

SEQ ID NO: 2850602 - RNA, 20 nt, Mycobacterium avium subsp. paratuberculosis
gcggccagcagcaccagaug

SEQ ID NO: 2850603 - RNA, 13 nt, Mycobacterium avium subsp. paratuberculosis
gcggccagcaucg

SEQ ID NO: 2850604 - RNA, 14 nt, Mycobacterium avium subsp. paratuberculosis
gcggccagcccauc

SEQ ID NO: 2850605 - RNA, 21 nt, Mycobacterium avium subsp. paratuberculosis
gcggccagcccaucccgaucc

SEQ ID NO: 2850606 - RNA, 16 nt, Mycobacterium avium subsp. paratuberculosis
gcggccagccccggga

SEQ ID NO: 2850607 - RNA, 15 nt, Mycobacterium avium subsp. paratuberculosis
gcggccagcccgcgg

SEQ ID NO: 2850608 - RNA, 17 nt, Mycobacterium avium subsp. paratuberculosis
gcggccagcccgcggca

SEQ ID NO: 2850609 - RNA, 12 nt, Mycobacterium avium subsp. paratuberculosis
gcggccagccgc

SEQ ID NO: 2850610 - RNA, 13 nt, Mycobacterium avium subsp. paratuberculosis
gcggccagccgcg

SEQ ID NO: 2850611 - RNA, 20 nt, Mycobacterium avium subsp. paratuberculosis
gcggccagccgcucccggcg

SEQ ID NO: 2850612 - RNA, 13 nt, Mycobacterium avium subsp. paratuberculosis
gcggccagccggu

SEQ ID NO: 2850613 - RNA, 17 nt, Mycobacterium avium subsp. paratuberculosis
gcggccagccggucguc

SEQ ID NO: 2850614 - RNA, 16 nt, Mycobacterium avium subsp. paratuberculosis
gcggccagccgguugc

SEQ ID NO: 2850615 - RNA, 13 nt, Mycobacterium avium subsp. paratuberculosis
gcggccagcgaga

SEQ ID NO: 2850616 - RNA, 24 nt, Mycobacterium avium subsp. paratuberculosis
gcggccagcgagaagucgcucagc

SEQ ID NO: 2850617 - RNA, 14 nt, Mycobacterium avium subsp. paratuberculosis
gcggccagcgagga

SEQ ID NO: 2850618 - RNA, 16 nt, Mycobacterium avium subsp. paratuberculosis
gcggccagcgaggacc

SEQ ID NO: 2850619 - RNA, 18 nt, Mycobacterium avium subsp. paratuberculosis
gcggccagcgagucgaug

SEQ ID NO: 2850620 - RNA, 12 nt, Mycobacterium avium subsp. paratuberculosis
gcggccagcgca

SEQ ID NO: 2850621 - RNA, 15 nt, Mycobacterium avium subsp. paratuberculosis
gcggccagcgccccg

SEQ ID NO: 2850622 - RNA, 17 nt, Mycobacterium avium subsp. paratuberculosis
gcggccagcgccccgcc

SEQ ID NO: 2850623 - RNA, 14 nt, Mycobacterium avium subsp. paratuberculosis
gcggccagcgcccg

SEQ ID NO: 2850624 - RNA, 15 nt, Mycobacterium avium subsp. paratuberculosis
gcggccagcgcccgc

SEQ ID NO: 2850625 - RNA, 16 nt, Mycobacterium avium subsp. paratuberculosis
gcggccagcgcccgcg

SEQ ID NO: 2850626 - RNA, 13 nt, Mycobacterium avium subsp. paratuberculosis
gcggccagcgcga

SEQ ID NO: 2850627 - RNA, 14 nt, Mycobacterium avium subsp. paratuberculosis
gcggccagcgcgac

SEQ ID NO: 2850628 - RNA, 13 nt, Mycobacterium avium subsp. paratuberculosis
gcggccagcgcgc

SEQ ID NO: 2850629 - RNA, 14 nt, Mycobacterium avium subsp. paratuberculosis
gcggccagcgcgcc

SEQ ID NO: 2850630 - RNA, 15 nt, Mycobacterium avium subsp. paratuberculosis
gcggccagcgcgccg

SEQ ID NO: 2850631 - RNA, 17 nt, Mycobacterium avium subsp. paratuberculosis
gcggccagcgcgccgcc

SEQ ID NO: 2850632 - RNA, 17 nt, Mycobacterium avium subsp. paratuberculosis
gcggccagcgcgcgggc

SEQ ID NO: 2850633 - RNA, 18 nt, Mycobacterium avium subsp. paratuberculosis
gcggccagcgcgcgggcg

SEQ ID NO: 2850634 - RNA, 18 nt, Mycobacterium avium subsp. paratuberculosis
gcggccagcggcagcguc

SEQ ID NO: 2850635 - RNA, 17 nt, Mycobacterium avium subsp. paratuberculosis
gcggccagcggcgccga

SEQ ID NO: 2850636 - RNA, 14 nt, Mycobacterium avium subsp. paratuberculosis
gcggccagcgggcc

SEQ ID NO: 2850637 - RNA, 15 nt, Mycobacterium avium subsp. paratuberculosis
gcggccagcgggccg

SEQ ID NO: 2850638 - RNA, 20 nt, Mycobacterium avium subsp. paratuberculosis
gcggccagcgggccguugcc

SEQ ID NO: 2850639 - RNA, 16 nt, Mycobacterium avium subsp. paratuberculosis
gcggccagcgucuuga

SEQ ID NO: 2850640 - RNA, 13 nt, Mycobacterium avium subsp. paratuberculosis
gcggccagcguga

SEQ ID NO: 2850641 - RNA, 21 nt, Mycobacterium avium subsp. paratuberculosis
gcggccagcgugaacaccgcg

SEQ ID NO: 2850642 - RNA, 20 nt, Mycobacterium avium subsp. paratuberculosis
gcggccagcguggcgcgccc

SEQ ID NO: 2850643 - RNA, 22 nt, Mycobacterium avium subsp. paratuberculosis
gcggccagcguggcgcgccccg

SEQ ID NO: 2850644 - RNA, 15 nt, Mycobacterium avium subsp. paratuberculosis
gcggccagcucccgg

SEQ ID NO: 2850645 - RNA, 18 nt, Mycobacterium avium subsp. paratuberculosis
gcggccagcucggucgcg

SEQ ID NO: 2850646 - RNA, 19 nt, Mycobacterium avium subsp. paratuberculosis
gcggccagcucggucgcgg

SEQ ID NO: 2850647 - RNA, 14 nt, Mycobacterium avium subsp. paratuberculosis
gcggccagcugccc

SEQ ID NO: 2850648 - RNA, 16 nt, Mycobacterium avium subsp. paratuberculosis
gcggccagcugcccgc

SEQ ID NO: 2850649 - RNA, 17 nt, Mycobacterium avium subsp. paratuberculosis
gcggccagcugcccgcc

SEQ ID NO: 2850650 - RNA, 19 nt, Mycobacterium avium subsp. paratuberculosis
gcggccagcugcccgccga

SEQ ID NO: 2850651 - RNA, 17 nt, Mycobacterium avium subsp. paratuberculosis
gcggccaggaaguccuu

SEQ ID NO: 2850652 - RNA, 15 nt, Mycobacterium avium subsp. paratuberculosis
gcggccaggccggcg

SEQ ID NO: 2850653 - RNA, 17 nt, Mycobacterium avium subsp. paratuberculosis
gcggccaggccggcgac

SEQ ID NO: 2850654 - RNA, 18 nt, Mycobacterium avium subsp. paratuberculosis
gcggccaggccggcgacg

SEQ ID NO: 2850655 - RNA, 20 nt, Mycobacterium avium subsp. paratuberculosis
gcggccaggccggcgacgau

SEQ ID NO: 2850656 - RNA, 15 nt, Mycobacterium avium subsp. paratuberculosis
gcggcccgccggaac

SEQ ID NO: 2850657 - RNA, 16 nt, Mycobacterium avium subsp. paratuberculosis
gcggcccgccggaacu

SEQ ID NO: 2850658 - RNA, 13 nt, Mycobacterium avium subsp. paratuberculosis
gcggcccgccggg

SEQ ID NO: 2850659 - RNA, 17 nt, Mycobacterium avium subsp. paratuberculosis
gcggcccgccgggcguc

SEQ ID NO: 2850660 - RNA, 23 nt, Mycobacterium avium subsp. paratuberculosis
gcggcccgccucggcggccgccu

SEQ ID NO: 2850661 - RNA, 13 nt, Mycobacterium avium subsp. paratuberculosis
gcggcccgcgacg

SEQ ID NO: 2850662 - RNA, 15 nt, Mycobacterium avium subsp. paratuberculosis
gcggcccgcgacguc

SEQ ID NO: 2850663 - RNA, 16 nt, Mycobacterium avium subsp. paratuberculosis
gcggcccgcgacgucg

SEQ ID NO: 2850664 - RNA, 16 nt, Mycobacterium avium subsp. paratuberculosis
gcggcccgcgccggcg

SEQ ID NO: 2850665 - RNA, 12 nt, Mycobacterium avium subsp. paratuberculosis
gcggcccgcgcg

SEQ ID NO: 2850666 - RNA, 13 nt, Mycobacterium avium subsp. paratuberculosis
gcggcccgcgcgg

SEQ ID NO: 2850667 - RNA, 14 nt, Mycobacterium avium subsp. paratuberculosis
gcggcccgcgcggg

SEQ ID NO: 2850668 - RNA, 13 nt, Mycobacterium avium subsp. paratuberculosis
gcggcccgcggca

SEQ ID NO: 2850669 - RNA, 15 nt, Mycobacterium avium subsp. paratuberculosis
gcggcccgcggcauc

SEQ ID NO: 2850670 - RNA, 18 nt, Mycobacterium avium subsp. paratuberculosis
gcggcccgcggcaucguc

SEQ ID NO: 2850671 - RNA, 19 nt, Mycobacterium avium subsp. paratuberculosis
gcggcccgcggcaucgucg

SEQ ID NO: 2850672 - RNA, 16 nt, Mycobacterium avium subsp. paratuberculosis
gcggcccgcggcguca

SEQ ID NO: 2850673 - RNA, 14 nt, Mycobacterium avium subsp. paratuberculosis
gcggcccgcucgau

SEQ ID NO: 2850674 - RNA, 23 nt, Mycobacterium avium subsp. paratuberculosis
gcggcccgcuuccuucaucgguu

SEQ ID NO: 2850675 - RNA, 17 nt, Mycobacterium avium subsp. paratuberculosis
gcggcccggcacuggcg

SEQ ID NO: 2850676 - RNA, 19 nt, Mycobacterium avium subsp. paratuberculosis
gcggcccggccacucgccg

SEQ ID NO: 2850677 - RNA, 20 nt, Mycobacterium avium subsp. paratuberculosis
gcggcccggccacucgccgc

SEQ ID NO: 2850678 - RNA, 19 nt, Mycobacterium avium subsp. paratuberculosis
gcggcccggcccgcuggcc

SEQ ID NO: 2850679 - RNA, 20 nt, Mycobacterium avium subsp. paratuberculosis
gcggcccggcccgcuggccg

SEQ ID NO: 2850680 - RNA, 23 nt, Mycobacterium avium subsp. paratuberculosis
gcggcccggcccgcuggccgccg

SEQ ID NO: 2850681 - RNA, 11 nt, Mycobacterium avium subsp. paratuberculosis
gcggcccggcu

SEQ ID NO: 2850682 - RNA, 21 nt, Mycobacterium avium subsp. paratuberculosis
gcggcccggguggacgcccgc

SEQ ID NO: 2850683 - RNA, 21 nt, Mycobacterium avium subsp. paratuberculosis
gcggcccgguacaucgacgcg

SEQ ID NO: 2850684 - RNA, 23 nt, Mycobacterium avium subsp. paratuberculosis
gcggcccgguacaucgacgcgac

SEQ ID NO: 2850685 - RNA, 14 nt, Mycobacterium avium subsp. paratuberculosis
gcggcccguccgcc

SEQ ID NO: 2850686 - RNA, 15 nt, Mycobacterium avium subsp. paratuberculosis
gcggcccguccgccc

SEQ ID NO: 2850687 - RNA, 18 nt, Mycobacterium avium subsp. paratuberculosis
gcggcccgucgccaccac

SEQ ID NO: 2850688 - RNA, 19 nt, Mycobacterium avium subsp. paratuberculosis
gcggcccgucgccaccacg

SEQ ID NO: 2850689 - RNA, 15 nt, Mycobacterium avium subsp. paratuberculosis
gcggcccgucgccga

SEQ ID NO: 2850690 - RNA, 18 nt, Mycobacterium avium subsp. paratuberculosis
gcggcccgucgccgugcg

SEQ ID NO: 2850691 - RNA, 23 nt, Mycobacterium avium subsp. paratuberculosis
gcggcccgucgccgugcguccag

SEQ ID NO: 2850692 - RNA, 18 nt, Mycobacterium avium subsp. paratuberculosis
gcggcccguugagcaccg

SEQ ID NO: 2850693 - RNA, 19 nt, Mycobacterium avium subsp. paratuberculosis
gcggcccguugagcaccgc

SEQ ID NO: 2850694 - RNA, 22 nt, Mycobacterium avium subsp. paratuberculosis
gcggcccguugagcaccgcgaa

SEQ ID NO: 2850695 - RNA, 15 nt, Mycobacterium avium subsp. paratuberculosis
gcggcccugcagcgc

SEQ ID NO: 2850696 - RNA, 23 nt, Mycobacterium avium subsp. paratuberculosis
gcggcccugcagcgccuugaccg

SEQ ID NO: 2850697 - RNA, 19 nt, Mycobacterium avium subsp. paratuberculosis
gcggcccugcaggucgcgg

SEQ ID NO: 2850698 - RNA, 21 nt, Mycobacterium avium subsp. paratuberculosis
gcggcccugcaggucgcggug

SEQ ID NO: 2850699 - RNA, 13 nt, Mycobacterium avium subsp. paratuberculosis
gcggcccuggcgg

SEQ ID NO: 2850700 - RNA, 16 nt, Mycobacterium avium subsp. paratuberculosis
gcggcccuggcgggcg

SEQ ID NO: 2850701 - RNA, 20 nt, Mycobacterium avium subsp. paratuberculosis
gcggcccugguugagcaccg

SEQ ID NO: 2850702 - RNA, 20 nt, Mycobacterium avium subsp. paratuberculosis
gcggcccuguuugcaggcga

SEQ ID NO: 2850703 - RNA, 21 nt, Mycobacterium avium subsp. paratuberculosis
gcggcccuguuugcaggcgau

SEQ ID NO: 2850704 - RNA, 22 nt, Mycobacterium avium subsp. paratuberculosis
gcggcccuguuugcaggcgauc

SEQ ID NO: 2850705 - RNA, 20 nt, Mycobacterium avium subsp. paratuberculosis
gcggccgaaaucaacgcgcc

SEQ ID NO: 2850706 - RNA, 23 nt, Mycobacterium avium subsp. paratuberculosis
gcggccgaaaucaacgcgccgaa

SEQ ID NO: 2850707 - RNA, 17 nt, Mycobacterium avium subsp. paratuberculosis
gcggccgaaccgcugca

SEQ ID NO: 2850708 - RNA, 17 nt, Mycobacterium avium subsp. paratuberculosis
gcggccgaauccggccg

SEQ ID NO: 2850709 - RNA, 15 nt, Mycobacterium avium subsp. paratuberculosis
gcggccgacagcgcg

SEQ ID NO: 2850710 - RNA, 21 nt, Mycobacterium avium subsp. paratuberculosis
gcggccgacagcgcgucggcg

SEQ ID NO: 2850711 - RNA, 20 nt, Mycobacterium avium subsp. paratuberculosis
gcggccgacccugcguccgg

SEQ ID NO: 2850712 - RNA, 21 nt, Mycobacterium avium subsp. paratuberculosis
gcggccgacccugcguccggc

SEQ ID NO: 2850713 - RNA, 22 nt, Mycobacterium avium subsp. paratuberculosis
gcggccgacccugcguccggcc

SEQ ID NO: 2850714 - RNA, 23 nt, Mycobacterium avium subsp. paratuberculosis
gcggccgacccugcguccggccc

SEQ ID NO: 2850715 - RNA, 21 nt, Mycobacterium avium subsp. paratuberculosis
gcggccgacgcgccgucggcc

SEQ ID NO: 2850716 - RNA, 12 nt, Mycobacterium avium subsp. paratuberculosis
gcggccgagccg

SEQ ID NO: 2850717 - RNA, 15 nt, Mycobacterium avium subsp. paratuberculosis
gcggccgagccgagg

SEQ ID NO: 2850718 - RNA, 16 nt, Mycobacterium avium subsp. paratuberculosis
gcggccgagccgaggc

SEQ ID NO: 2850719 - RNA, 18 nt, Mycobacterium avium subsp. paratuberculosis
gcggccgagccgaggccg

SEQ ID NO: 2850720 - RNA, 16 nt, Mycobacterium avium subsp. paratuberculosis
gcggccgagcgcaccg

SEQ ID NO: 2850721 - RNA, 17 nt, Mycobacterium avium subsp. paratuberculosis
gcggccgagcgcaccgc

SEQ ID NO: 2850722 - RNA, 16 nt, Mycobacterium avium subsp. paratuberculosis
gcggccgagggcuucc

SEQ ID NO: 2850723 - RNA, 20 nt, Mycobacterium avium subsp. paratuberculosis
gcggccgaucauggucggcg

SEQ ID NO: 2850724 - RNA, 23 nt, Mycobacterium avium subsp. paratuberculosis
gcggccgaucauggucggcgacg

SEQ ID NO: 2850725 - RNA, 14 nt, Mycobacterium avium subsp. paratuberculosis
gcggccgaucccga

SEQ ID NO: 2850726 - RNA, 22 nt, Mycobacterium avium subsp. paratuberculosis
gcggccgaucccgaugcggacg

SEQ ID NO: 2850727 - RNA, 17 nt, Mycobacterium avium subsp. paratuberculosis
gcggccgauucggcgcc

SEQ ID NO: 2850728 - RNA, 18 nt, Mycobacterium avium subsp. paratuberculosis
gcggccgauucggcgccg

SEQ ID NO: 2850729 - RNA, 22 nt, Mycobacterium avium subsp. paratuberculosis
gcggccgauucggcgccgcgac

SEQ ID NO: 2850730 - RNA, 18 nt, Mycobacterium avium subsp. paratuberculosis
gcggccgcaaucggcgcc

SEQ ID NO: 2850731 - RNA, 22 nt, Mycobacterium avium subsp. paratuberculosis
gcggccgcaaucggcgccggcu

SEQ ID NO: 2850732 - RNA, 17 nt, Mycobacterium avium subsp. paratuberculosis
gcggccgcagcgcaucg

SEQ ID NO: 2850733 - RNA, 22 nt, Mycobacterium avium subsp. paratuberculosis
gcggccgcagcgcaucgccggc

SEQ ID NO: 2850734 - RNA, 23 nt, Mycobacterium avium subsp. paratuberculosis
gcggccgcagcgcaucgccggcg

SEQ ID NO: 2850735 - RNA, 15 nt, Mycobacterium avium subsp. paratuberculosis
gcggccgcagcgcga

SEQ ID NO: 2850736 - RNA, 21 nt, Mycobacterium avium subsp. paratuberculosis
gcggccgcagcgugggcaccg

SEQ ID NO: 2850737 - RNA, 22 nt, Mycobacterium avium subsp. paratuberculosis
gcggccgcagcgugggcaccgg

SEQ ID NO: 2850738 - RNA, 18 nt, Mycobacterium avium subsp. paratuberculosis
gcggccgcaugucgaccu

SEQ ID NO: 2850739 - RNA, 16 nt, Mycobacterium avium subsp. paratuberculosis
gcggccgccacgcugg

SEQ ID NO: 2850740 - RNA, 15 nt, Mycobacterium avium subsp. paratuberculosis
gcggccgcugcgccc

SEQ ID NO: 2850741 - RNA, 17 nt, Mycobacterium avium subsp. paratuberculosis
gcggccgcuucccaccc

SEQ ID NO: 2850742 - RNA, 16 nt, Mycobacterium avium subsp. paratuberculosis
gcggccggaacagcug

SEQ ID NO: 2850743 - RNA, 19 nt, Mycobacterium avium subsp. paratuberculosis
gcggccggaacagcugguc

SEQ ID NO: 2850744 - RNA, 18 nt, Mycobacterium avium subsp. paratuberculosis
gcggccggaaucucgugg

SEQ ID NO: 2850745 - RNA, 15 nt, Mycobacterium avium subsp. paratuberculosis
gcggccggagccgac

SEQ ID NO: 2850746 - RNA, 17 nt, Mycobacterium avium subsp. paratuberculosis
gcggccggagccgaccu

SEQ ID NO: 2850747 - RNA, 22 nt, Mycobacterium avium subsp. paratuberculosis
gcggccggagccgaccucggcg

SEQ ID NO: 2850748 - RNA, 22 nt, Mycobacterium avium subsp. paratuberculosis
gcggccggaucgaauccggcgg

SEQ ID NO: 2850749 - RNA, 17 nt, Mycobacterium avium subsp. paratuberculosis
gcggccggcacuaccgc

SEQ ID NO: 2850750 - RNA, 14 nt, Mycobacterium avium subsp. paratuberculosis
gcggccggccacgc

SEQ ID NO: 2850751 - RNA, 20 nt, Mycobacterium avium subsp. paratuberculosis
gcggccggccagcagccggu

SEQ ID NO: 2850752 - RNA, 22 nt, Mycobacterium avium subsp. paratuberculosis
gcggccggccagcagccgguac

SEQ ID NO: 2850753 - RNA, 15 nt, Mycobacterium avium subsp. paratuberculosis
gcggccggccagcgc

SEQ ID NO: 2850754 - RNA, 13 nt, Mycobacterium avium subsp. paratuberculosis
gcggccggccagu

SEQ ID NO: 2850755 - RNA, 16 nt, Mycobacterium avium subsp. paratuberculosis
gcggccggccaguccu

SEQ ID NO: 2850756 - RNA, 21 nt, Mycobacterium avium subsp. paratuberculosis
gcggccggccaguccugggcc

SEQ ID NO: 2850757 - RNA, 12 nt, Mycobacterium avium subsp. paratuberculosis
gcggccggccca

SEQ ID NO: 2850758 - RNA, 15 nt, Mycobacterium avium subsp. paratuberculosis
gcggccggcccagcg

SEQ ID NO: 2850759 - RNA, 16 nt, Mycobacterium avium subsp. paratuberculosis
gcggccggcccagcgc

SEQ ID NO: 2850760 - RNA, 12 nt, Mycobacterium avium subsp. paratuberculosis
gcggccggcccc

SEQ ID NO: 2850761 - RNA, 13 nt, Mycobacterium avium subsp. paratuberculosis
gcggccggccccg

SEQ ID NO: 2850762 - RNA, 15 nt, Mycobacterium avium subsp. paratuberculosis
gcggccggccccggc

SEQ ID NO: 2850763 - RNA, 17 nt, Mycobacterium avium subsp. paratuberculosis
gcggccggccccggccg

SEQ ID NO: 2850764 - RNA, 15 nt, Mycobacterium avium subsp. paratuberculosis
gcggccggcccggcc

SEQ ID NO: 2850765 - RNA, 15 nt, Mycobacterium avium subsp. paratuberculosis
gcggccggccgacac

SEQ ID NO: 2850766 - RNA, 20 nt, Mycobacterium avium subsp. paratuberculosis
gcggccggccgacaccccga

SEQ ID NO: 2850767 - RNA, 16 nt, Mycobacterium avium subsp. paratuberculosis
gcggccggccgcgccc

SEQ ID NO: 2850768 - RNA, 15 nt, Mycobacterium avium subsp. paratuberculosis
gcggccggccgcgcg

SEQ ID NO: 2850769 - RNA, 16 nt, Mycobacterium avium subsp. paratuberculosis
gcggccggccggccug

SEQ ID NO: 2850770 - RNA, 17 nt, Mycobacterium avium subsp. paratuberculosis
gcggccggccggccugg

SEQ ID NO: 2850771 - RNA, 19 nt, Mycobacterium avium subsp. paratuberculosis
gcggccggcgagucgcgga

SEQ ID NO: 2850772 - RNA, 15 nt, Mycobacterium avium subsp. paratuberculosis
gcggccggcgcagcc

SEQ ID NO: 2850773 - RNA, 17 nt, Mycobacterium avium subsp. paratuberculosis
gcggccggcgcagccgg

SEQ ID NO: 2850774 - RNA, 19 nt, Mycobacterium avium subsp. paratuberculosis
gcggccggcgcagccggcc

SEQ ID NO: 2850775 - RNA, 23 nt, Mycobacterium avium subsp. paratuberculosis
gcggccggcgcagccggccaccg

SEQ ID NO: 2850776 - RNA, 23 nt, Mycobacterium avium subsp. paratuberculosis
gcggccggcgccgaccgagggcg

SEQ ID NO: 2850777 - RNA, 15 nt, Mycobacterium avium subsp. paratuberculosis
gcggccggcgccggc

SEQ ID NO: 2850778 - RNA, 12 nt, Mycobacterium avium subsp. paratuberculosis
gcggccggcggc

SEQ ID NO: 2850779 - RNA, 19 nt, Mycobacterium avium subsp. paratuberculosis
gcggccggcggcaguccgg

SEQ ID NO: 2850780 - RNA, 13 nt, Mycobacterium avium subsp. paratuberculosis
gcggccggcggcg

SEQ ID NO: 2850781 - RNA, 19 nt, Mycobacterium avium subsp. paratuberculosis
gcggccggcggcgucguga

SEQ ID NO: 2850782 - RNA, 13 nt, Mycobacterium avium subsp. paratuberculosis
gcggccggcgggc

SEQ ID NO: 2850783 - RNA, 16 nt, Mycobacterium avium subsp. paratuberculosis
gcggccggcgggcagc

SEQ ID NO: 2850784 - RNA, 17 nt, Mycobacterium avium subsp. paratuberculosis
gcggccggcgggcagca

SEQ ID NO: 2850785 - RNA, 20 nt, Mycobacterium avium subsp. paratuberculosis
gcggccggcgggcagcacgg

SEQ ID NO: 2850786 - RNA, 12 nt, Mycobacterium avium subsp. paratuberculosis
gcggccggcggu

SEQ ID NO: 2850787 - RNA, 13 nt, Mycobacterium avium subsp. paratuberculosis
gcggccggcggug

SEQ ID NO: 2850788 - RNA, 16 nt, Mycobacterium avium subsp. paratuberculosis
gcggccggcggugucg

SEQ ID NO: 2850789 - RNA, 19 nt, Mycobacterium avium subsp. paratuberculosis
gcggccggcuucggccaag

SEQ ID NO: 2850790 - RNA, 21 nt, Mycobacterium avium subsp. paratuberculosis
gcggccgggaucuggccggug

SEQ ID NO: 2850791 - RNA, 22 nt, Mycobacterium avium subsp. paratuberculosis
gcggccgggaucuggccgguga

SEQ ID NO: 2850792 - RNA, 13 nt, Mycobacterium avium subsp. paratuberculosis
gcggccgggaugc

SEQ ID NO: 2850793 - RNA, 19 nt, Mycobacterium avium subsp. paratuberculosis
gcggccgggaugccgccgg

SEQ ID NO: 2850794 - RNA, 21 nt, Mycobacterium avium subsp. paratuberculosis
gcggccgggaugccgccgguc

SEQ ID NO: 2850795 - RNA, 13 nt, Mycobacterium avium subsp. paratuberculosis
gcggccgggccgg

SEQ ID NO: 2850796 - RNA, 22 nt, Mycobacterium avium subsp. paratuberculosis
gcggccgggccggaacgcccga

SEQ ID NO: 2850797 - RNA, 13 nt, Mycobacterium avium subsp. paratuberculosis
gcggccgggcgcc

SEQ ID NO: 2850798 - RNA, 14 nt, Mycobacterium avium subsp. paratuberculosis
gcggccgggcgccc

SEQ ID NO: 2850799 - RNA, 13 nt, Mycobacterium avium subsp. paratuberculosis
gcggccgggcggc

SEQ ID NO: 2850800 - RNA, 15 nt, Mycobacterium avium subsp. paratuberculosis
gcggccgggcggccg

SEQ ID NO: 2850801 - RNA, 17 nt, Mycobacterium avium subsp. paratuberculosis
gcggccgggcggccgga

SEQ ID NO: 2850802 - RNA, 19 nt, Mycobacterium avium subsp. paratuberculosis
gcggccgggcggccggagc

SEQ ID NO: 2850803 - RNA, 20 nt, Mycobacterium avium subsp. paratuberculosis
gcggccgggcggccggagcc

SEQ ID NO: 2850804 - RNA, 11 nt, Mycobacterium avium subsp. paratuberculosis
gcggccgggcu

SEQ ID NO: 2850805 - RNA, 19 nt, Mycobacterium avium subsp. paratuberculosis
gcggccggggcagacccgc

SEQ ID NO: 2850806 - RNA, 22 nt, Mycobacterium avium subsp. paratuberculosis
gcggccggggcagacccgcguc

SEQ ID NO: 2850807 - RNA, 21 nt, Mycobacterium avium subsp. paratuberculosis
gcggccggggggaggucgcgg

SEQ ID NO: 2850808 - RNA, 13 nt, Mycobacterium avium subsp. paratuberculosis
gcggccgggucga

SEQ ID NO: 2850809 - RNA, 14 nt, Mycobacterium avium subsp. paratuberculosis
gcggccgggucgag

SEQ ID NO: 2850810 - RNA, 15 nt, Mycobacterium avium subsp. paratuberculosis
gcggccgggucgagc

SEQ ID NO: 2850811 - RNA, 21 nt, Mycobacterium avium subsp. paratuberculosis
gcggccgggucgagcgcgccg

SEQ ID NO: 2850812 - RNA, 22 nt, Mycobacterium avium subsp. paratuberculosis
gcggccgggucgagcgcgccga

SEQ ID NO: 2850813 - RNA, 23 nt, Mycobacterium avium subsp. paratuberculosis
gcggccgggucgagcgcgccgag

SEQ ID NO: 2850814 - RNA, 20 nt, Mycobacterium avium subsp. paratuberculosis
gcggccggguguagcugggc

SEQ ID NO: 2850815 - RNA, 21 nt, Mycobacterium avium subsp. paratuberculosis
gcggccggguguagcugggcc

SEQ ID NO: 2850816 - RNA, 12 nt, Mycobacterium avium subsp. paratuberculosis
gcggccggugcc

SEQ ID NO: 2850817 - RNA, 17 nt, Mycobacterium avium subsp. paratuberculosis
gcggccggugccacggu

SEQ ID NO: 2850818 - RNA, 22 nt, Mycobacterium avium subsp. paratuberculosis
gcggccgguugccuuuccgcgc

SEQ ID NO: 2850819 - RNA, 24 nt, Mycobacterium avium subsp. paratuberculosis
gcggccgguugccuuuccgcgcgg

SEQ ID NO: 2850820 - RNA, 18 nt, Mycobacterium avium subsp. paratuberculosis
gcggccguagccggaccg

SEQ ID NO: 2850821 - RNA, 12 nt, Mycobacterium avium subsp. paratuberculosis
gcggccguagcg

SEQ ID NO: 2850822 - RNA, 17 nt, Mycobacterium avium subsp. paratuberculosis
gcggccguccaccacca

SEQ ID NO: 2850823 - RNA, 14 nt, Mycobacterium avium subsp. paratuberculosis
gcggccguccagcg

SEQ ID NO: 2850824 - RNA, 14 nt, Mycobacterium avium subsp. paratuberculosis
gcggccgucgccgg

SEQ ID NO: 2850825 - RNA, 21 nt, Mycobacterium avium subsp. paratuberculosis
gcggccuuuuucugcgcccga

SEQ ID NO: 2850826 - RNA, 20 nt, Mycobacterium avium subsp. paratuberculosis
gcggcgaaaacgccugcgcc

SEQ ID NO: 2850827 - RNA, 22 nt, Mycobacterium avium subsp. paratuberculosis
gcggcgaaaacgccugcgccgc

SEQ ID NO: 2850828 - RNA, 16 nt, Mycobacterium avium subsp. paratuberculosis
gcggcgaacaacgcca

SEQ ID NO: 2850829 - RNA, 16 nt, Mycobacterium avium subsp. paratuberculosis
gcggcgaacaccagca

SEQ ID NO: 2850830 - RNA, 14 nt, Mycobacterium avium subsp. paratuberculosis
gcggcgaacaccuc

SEQ ID NO: 2850831 - RNA, 15 nt, Mycobacterium avium subsp. paratuberculosis
gcggcgaacaccucg

SEQ ID NO: 2850832 - RNA, 19 nt, Mycobacterium avium subsp. paratuberculosis
gcggcgaacaccucggcga

SEQ ID NO: 2850833 - RNA, 21 nt, Mycobacterium avium subsp. paratuberculosis
gcggcgaacaccucggcgaug

SEQ ID NO: 2850834 - RNA, 23 nt, Mycobacterium avium subsp. paratuberculosis
gcggcgaacaccucggcgaugcc

SEQ ID NO: 2850835 - RNA, 14 nt, Mycobacterium avium subsp. paratuberculosis
gcggcgaaccagca

SEQ ID NO: 2850836 - RNA, 16 nt, Mycobacterium avium subsp. paratuberculosis
gcggcgaaccagcaug

SEQ ID NO: 2850837 - RNA, 15 nt, Mycobacterium avium subsp. paratuberculosis
gcggcgaaccgggcc

SEQ ID NO: 2850838 - RNA, 17 nt, Mycobacterium avium subsp. paratuberculosis
gcggcgaaccgggcccg

SEQ ID NO: 2850839 - RNA, 19 nt, Mycobacterium avium subsp. paratuberculosis
gcggcgaaccgggcccgua

SEQ ID NO: 2850840 - RNA, 16 nt, Mycobacterium avium subsp. paratuberculosis
gcggcgaacgccgccg

SEQ ID NO: 2850841 - RNA, 14 nt, Mycobacterium avium subsp. paratuberculosis
gcggcgaacgcgcg

SEQ ID NO: 2850842 - RNA, 13 nt, Mycobacterium avium subsp. paratuberculosis
gcggcgaacgcgu

SEQ ID NO: 2850843 - RNA, 18 nt, Mycobacterium avium subsp. paratuberculosis
gcggcgaacgcgucccgg

SEQ ID NO: 2850844 - RNA, 19 nt, Mycobacterium avium subsp. paratuberculosis
gcggcgaacgcgucccggg

SEQ ID NO: 2850845 - RNA, 21 nt, Mycobacterium avium subsp. paratuberculosis
gcggcgaacgcgucccgggcc

SEQ ID NO: 2850846 - RNA, 16 nt, Mycobacterium avium subsp. paratuberculosis
gcggcgaagacgucgg

SEQ ID NO: 2850847 - RNA, 21 nt, Mycobacterium avium subsp. paratuberculosis
gcggcgaagacgucggcgcgg

SEQ ID NO: 2850848 - RNA, 18 nt, Mycobacterium avium subsp. paratuberculosis
gcggcgaagccggccccg

SEQ ID NO: 2850849 - RNA, 19 nt, Mycobacterium avium subsp. paratuberculosis
gcggcgaagccggccccgc

SEQ ID NO: 2850850 - RNA, 16 nt, Mycobacterium avium subsp. paratuberculosis
gcggcgaaggcauccc

SEQ ID NO: 2850851 - RNA, 17 nt, Mycobacterium avium subsp. paratuberculosis
gcggcgaaggcaucccg

SEQ ID NO: 2850852 - RNA, 15 nt, Mycobacterium avium subsp. paratuberculosis
gcggcgaaggccagc

SEQ ID NO: 2850853 - RNA, 16 nt, Mycobacterium avium subsp. paratuberculosis
gcggcgaaggccagcg

SEQ ID NO: 2850854 - RNA, 17 nt, Mycobacterium avium subsp. paratuberculosis
gcggcgaaggccagcga

SEQ ID NO: 2850855 - RNA, 19 nt, Mycobacterium avium subsp. paratuberculosis
gcggcgaaggccagcgaua

SEQ ID NO: 2850856 - RNA, 19 nt, Mycobacterium avium subsp. paratuberculosis
gcggcgaaguugcgguuga

SEQ ID NO: 2850857 - RNA, 16 nt, Mycobacterium avium subsp. paratuberculosis
gcggcgaauccgagca

SEQ ID NO: 2850858 - RNA, 23 nt, Mycobacterium avium subsp. paratuberculosis
gcggcgaaugccugacgggaguc

SEQ ID NO: 2850859 - RNA, 14 nt, Mycobacterium avium subsp. paratuberculosis
gcggcgacacccag

SEQ ID NO: 2850860 - RNA, 19 nt, Mycobacterium avium subsp. paratuberculosis
gcggcgacacccagcggcg

SEQ ID NO: 2850861 - RNA, 20 nt, Mycobacterium avium subsp. paratuberculosis
gcggcgacacccagcggcgc

SEQ ID NO: 2850862 - RNA, 24 nt, Mycobacterium avium subsp. paratuberculosis
gcggcgacacccagcggcgcggcc

SEQ ID NO: 2850863 - RNA, 14 nt, Mycobacterium avium subsp. paratuberculosis
gcggcgacacgccg

SEQ ID NO: 2850864 - RNA, 18 nt, Mycobacterium avium subsp. paratuberculosis
gcggcgacacgccgacga

SEQ ID NO: 2850865 - RNA, 19 nt, Mycobacterium avium subsp. paratuberculosis
gcggcgacacgccgacgau

SEQ ID NO: 2850866 - RNA, 23 nt, Mycobacterium avium subsp. paratuberculosis
gcggcgacacgccgacgauccgc

SEQ ID NO: 2850867 - RNA, 16 nt, Mycobacterium avium subsp. paratuberculosis
gcggcgacagcggccu

SEQ ID NO: 2850868 - RNA, 17 nt, Mycobacterium avium subsp. paratuberculosis
gcggcgacagcggccua

SEQ ID NO: 2850869 - RNA, 13 nt, Mycobacterium avium subsp. paratuberculosis
gcggcgacaucgc

SEQ ID NO: 2850870 - RNA, 20 nt, Mycobacterium avium subsp. paratuberculosis
gcggcgacaucgccgagacg

SEQ ID NO: 2850871 - RNA, 18 nt, Mycobacterium avium subsp. paratuberculosis
gcggcgacauuggccgcg

SEQ ID NO: 2850872 - RNA, 20 nt, Mycobacterium avium subsp. paratuberculosis
gcggcgacauuggccgcgcg

SEQ ID NO: 2850873 - RNA, 20 nt, Mycobacterium avium subsp. paratuberculosis
gcggcgaccaccaccgccca

SEQ ID NO: 2850874 - RNA, 21 nt, Mycobacterium avium subsp. paratuberculosis
gcggcgaccaccaccgcccac

SEQ ID NO: 2850875 - RNA, 13 nt, Mycobacterium avium subsp. paratuberculosis
gcggcgaccaccu

SEQ ID NO: 2850876 - RNA, 14 nt, Mycobacterium avium subsp. paratuberculosis
gcggcgaccaccuc

SEQ ID NO: 2850877 - RNA, 19 nt, Mycobacterium avium subsp. paratuberculosis
gcggcgaccaccucggcga

SEQ ID NO: 2850878 - RNA, 21 nt, Mycobacterium avium subsp. paratuberculosis
gcggcgaccaccucggcgacg

SEQ ID NO: 2850879 - RNA, 13 nt, Mycobacterium avium subsp. paratuberculosis
gcggcgaccacga

SEQ ID NO: 2850880 - RNA, 14 nt, Mycobacterium avium subsp. paratuberculosis
gcggcgaccacgaa

SEQ ID NO: 2850881 - RNA, 21 nt, Mycobacterium avium subsp. paratuberculosis
gcggcgaccacgaacaccggc

SEQ ID NO: 2850882 - RNA, 13 nt, Mycobacterium avium subsp. paratuberculosis
gcggcgacccgcu

SEQ ID NO: 2850883 - RNA, 18 nt, Mycobacterium avium subsp. paratuberculosis
gcggcgacccgcuucgcc

SEQ ID NO: 2850884 - RNA, 20 nt, Mycobacterium avium subsp. paratuberculosis
gcggcgacccgcuucgcccg

SEQ ID NO: 2850885 - RNA, 13 nt, Mycobacterium avium subsp. paratuberculosis
gcggcgacccgga

SEQ ID NO: 2850886 - RNA, 15 nt, Mycobacterium avium subsp. paratuberculosis
gcggcgaccggggcg

SEQ ID NO: 2850887 - RNA, 16 nt, Mycobacterium avium subsp. paratuberculosis
gcggcgaccggggcgg

SEQ ID NO: 2850888 - RNA, 21 nt, Mycobacterium avium subsp. paratuberculosis
gcggcgaccuguuuggccagc

SEQ ID NO: 2850889 - RNA, 20 nt, Mycobacterium avium subsp. paratuberculosis
gcggcgaccuugcggcgcga

SEQ ID NO: 2850890 - RNA, 17 nt, Mycobacterium avium subsp. paratuberculosis
gcggcgacgaacgccgg

SEQ ID NO: 2850891 - RNA, 21 nt, Mycobacterium avium subsp. paratuberculosis
gcggcgacgaacgccggcauc

SEQ ID NO: 2850892 - RNA, 24 nt, Mycobacterium avium subsp. paratuberculosis
gcggcgacgaacgccggcaucagc

SEQ ID NO: 2850893 - RNA, 13 nt, Mycobacterium avium subsp. paratuberculosis
gcggcgacgauca

SEQ ID NO: 2850894 - RNA, 16 nt, Mycobacterium avium subsp. paratuberculosis
gcggcgacgaucggcu

SEQ ID NO: 2850895 - RNA, 18 nt, Mycobacterium avium subsp. paratuberculosis
gcggcgacgaucggcucg

SEQ ID NO: 2850896 - RNA, 19 nt, Mycobacterium avium subsp. paratuberculosis
gcggcgacggcaccgccgg

SEQ ID NO: 2850897 - RNA, 23 nt, Mycobacterium avium subsp. paratuberculosis
gcggcgacggcaccgccggcggc

SEQ ID NO: 2850898 - RNA, 18 nt, Mycobacterium avium subsp. paratuberculosis
gcggcgacggccguccgg

SEQ ID NO: 2850899 - RNA, 13 nt, Mycobacterium avium subsp. paratuberculosis
gcggcgacggcga

SEQ ID NO: 2850900 - RNA, 15 nt, Mycobacterium avium subsp. paratuberculosis
gcggcgacggcgacc

SEQ ID NO: 2850901 - RNA, 15 nt, Mycobacterium avium subsp. paratuberculosis
gcggcgacggcgacg

SEQ ID NO: 2850902 - RNA, 15 nt, Mycobacterium avium subsp. paratuberculosis
gcggcgacggcgucg

SEQ ID NO: 2850903 - RNA, 16 nt, Mycobacterium avium subsp. paratuberculosis
gcggcgacggcgucgg

SEQ ID NO: 2850904 - RNA, 17 nt, Mycobacterium avium subsp. paratuberculosis
gcggcgacggcgucggc

SEQ ID NO: 2850905 - RNA, 18 nt, Mycobacterium avium subsp. paratuberculosis
gcggcgacggcgucggcg

SEQ ID NO: 2850906 - RNA, 16 nt, Mycobacterium avium subsp. paratuberculosis
gcggcgacgguggcgg

SEQ ID NO: 2850907 - RNA, 16 nt, Mycobacterium avium subsp. paratuberculosis
gcggcgacgguguccg

SEQ ID NO: 2850908 - RNA, 23 nt, Mycobacterium avium subsp. paratuberculosis
gcggcgacgguguccgcggcguc

SEQ ID NO: 2850909 - RNA, 14 nt, Mycobacterium avium subsp. paratuberculosis
gcggcgcaccgagu

SEQ ID NO: 2850910 - RNA, 19 nt, Mycobacterium avium subsp. paratuberculosis
gcggcgcaccgagucggug

SEQ ID NO: 2850911 - RNA, 20 nt, Mycobacterium avium subsp. paratuberculosis
gcggcgcaccgagucgguga

SEQ ID NO: 2850912 - RNA, 13 nt, Mycobacterium avium subsp. paratuberculosis
gcggcgcaccgcc

SEQ ID NO: 2850913 - RNA, 15 nt, Mycobacterium avium subsp. paratuberculosis
gcggcgcaccgcccg

SEQ ID NO: 2850914 - RNA, 16 nt, Mycobacterium avium subsp. paratuberculosis
gcggcgcaccgcccgc

SEQ ID NO: 2850915 - RNA, 18 nt, Mycobacterium avium subsp. paratuberculosis
gcggcgcaccgcccgcgg

SEQ ID NO: 2850916 - RNA, 22 nt, Mycobacterium avium subsp. paratuberculosis
gcggcgcaccgugucgucgcug

SEQ ID NO: 2850917 - RNA, 23 nt, Mycobacterium avium subsp. paratuberculosis
gcggcgcaccgugucgucgcuga

SEQ ID NO: 2850918 - RNA, 18 nt, Mycobacterium avium subsp. paratuberculosis
gcggcgcaccuggcgcag

SEQ ID NO: 2850919 - RNA, 20 nt, Mycobacterium avium subsp. paratuberculosis
gcggcgcaccuggcgcagca

SEQ ID NO: 2850920 - RNA, 13 nt, Mycobacterium avium subsp. paratuberculosis
gcggcgcacggug

SEQ ID NO: 2850921 - RNA, 15 nt, Mycobacterium avium subsp. paratuberculosis
gcggcgcacggugcc

SEQ ID NO: 2850922 - RNA, 17 nt, Mycobacterium avium subsp. paratuberculosis
gcggcgcacggugcccg

SEQ ID NO: 2850923 - RNA, 22 nt, Mycobacterium avium subsp. paratuberculosis
gcggcgcacggugcccgucggc

SEQ ID NO: 2850924 - RNA, 14 nt, Mycobacterium avium subsp. paratuberculosis
gcggcgcacuccau

SEQ ID NO: 2850925 - RNA, 16 nt, Mycobacterium avium subsp. paratuberculosis
gcggcgcagaugaccg

SEQ ID NO: 2850926 - RNA, 19 nt, Mycobacterium avium subsp. paratuberculosis
gcggcgcagcacggccacu

SEQ ID NO: 2850927 - RNA, 21 nt, Mycobacterium avium subsp. paratuberculosis
gcggcgcagcacggccacugc

SEQ ID NO: 2850928 - RNA, 14 nt, Mycobacterium avium subsp. paratuberculosis
gcggcgcagcgcga

SEQ ID NO: 2850929 - RNA, 15 nt, Mycobacterium avium subsp. paratuberculosis
gcggcgcagcgcgau

SEQ ID NO: 2850930 - RNA, 13 nt, Mycobacterium avium subsp. paratuberculosis
gcggcgcagcguc

SEQ ID NO: 2850931 - RNA, 20 nt, Mycobacterium avium subsp. paratuberculosis
gcggcgcagcgucucgaucg

SEQ ID NO: 2850932 - RNA, 13 nt, Mycobacterium avium subsp. paratuberculosis
gcggcgcagcucg

SEQ ID NO: 2850933 - RNA, 19 nt, Mycobacterium avium subsp. paratuberculosis
gcggcgcagcucgcgcagc

SEQ ID NO: 2850934 - RNA, 22 nt, Mycobacterium avium subsp. paratuberculosis
gcggcgcagcucgcgcagcugg

SEQ ID NO: 2850935 - RNA, 14 nt, Mycobacterium avium subsp. paratuberculosis
gcggcgcaggccgg

SEQ ID NO: 2850936 - RNA, 16 nt, Mycobacterium avium subsp. paratuberculosis
gcggcgcaggcgcgca

SEQ ID NO: 2850937 - RNA, 13 nt, Mycobacterium avium subsp. paratuberculosis
gcggcgcagggcg

SEQ ID NO: 2850938 - RNA, 17 nt, Mycobacterium avium subsp. paratuberculosis
gcggcgcagggcggccg

SEQ ID NO: 2850939 - RNA, 18 nt, Mycobacterium avium subsp. paratuberculosis
gcggcgcagggcggccgg

SEQ ID NO: 2850940 - RNA, 20 nt, Mycobacterium avium subsp. paratuberculosis
gcggcgcagggcggccggcc

SEQ ID NO: 2850941 - RNA, 22 nt, Mycobacterium avium subsp. paratuberculosis
gcggcgcagggcggccggccag

SEQ ID NO: 2850942 - RNA, 16 nt, Mycobacterium avium subsp. paratuberculosis
gcggcgcagguccggc

SEQ ID NO: 2850943 - RNA, 17 nt, Mycobacterium avium subsp. paratuberculosis
gcggcgcagguccggca

SEQ ID NO: 2850944 - RNA, 18 nt, Mycobacterium avium subsp. paratuberculosis
gcggcgcagguccggcag

SEQ ID NO: 2850945 - RNA, 19 nt, Mycobacterium avium subsp. paratuberculosis
gcggcgcagguccggcagc

SEQ ID NO: 2850946 - RNA, 14 nt, Mycobacterium avium subsp. paratuberculosis
gcggcgcagucgau

SEQ ID NO: 2850947 - RNA, 15 nt, Mycobacterium avium subsp. paratuberculosis
gcggcgcagucggcc

SEQ ID NO: 2850948 - RNA, 16 nt, Mycobacterium avium subsp. paratuberculosis
gcggcgcagucggccg

SEQ ID NO: 2850949 - RNA, 17 nt, Mycobacterium avium subsp. paratuberculosis
gcggcgcagucggccgg

SEQ ID NO: 2850950 - RNA, 13 nt, Mycobacterium avium subsp. paratuberculosis
gcggcgcaguucg

SEQ ID NO: 2850951 - RNA, 21 nt, Mycobacterium avium subsp. paratuberculosis
gcggcgcaugaucgcccgcuc

SEQ ID NO: 2850952 - RNA, 12 nt, Mycobacterium avium subsp. paratuberculosis
gcggcgccaccg

SEQ ID NO: 2850953 - RNA, 13 nt, Mycobacterium avium subsp. paratuberculosis
gcggcgccaccgg

SEQ ID NO: 2850954 - RNA, 15 nt, Mycobacterium avium subsp. paratuberculosis
gcggcgccaccggcu

SEQ ID NO: 2850955 - RNA, 16 nt, Mycobacterium avium subsp. paratuberculosis
gcggcgccaccggcug

SEQ ID NO: 2850956 - RNA, 18 nt, Mycobacterium avium subsp. paratuberculosis
gcggcgccaccggcuggc

SEQ ID NO: 2850957 - RNA, 21 nt, Mycobacterium avium subsp. paratuberculosis
gcggcgccaccggcuggccgg

SEQ ID NO: 2850958 - RNA, 22 nt, Mycobacterium avium subsp. paratuberculosis
gcggcgccaccggcuggccgga

SEQ ID NO: 2850959 - RNA, 14 nt, Mycobacterium avium subsp. paratuberculosis
gcggcgccaccggg

SEQ ID NO: 2850960 - RNA, 15 nt, Mycobacterium avium subsp. paratuberculosis
gcggcgccaccggga

SEQ ID NO: 2850961 - RNA, 16 nt, Mycobacterium avium subsp. paratuberculosis
gcggcgccaccgggac

SEQ ID NO: 2850962 - RNA, 12 nt, Mycobacterium avium subsp. paratuberculosis
gcggcgccacgu

SEQ ID NO: 2850963 - RNA, 17 nt, Mycobacterium avium subsp. paratuberculosis
gcggcgccaggucgggg

SEQ ID NO: 2850964 - RNA, 18 nt, Mycobacterium avium subsp. paratuberculosis
gcggcgcccacagcaggu

SEQ ID NO: 2850965 - RNA, 14 nt, Mycobacterium avium subsp. paratuberculosis
gcggcgcccacggc

SEQ ID NO: 2850966 - RNA, 13 nt, Mycobacterium avium subsp. paratuberculosis
gcggcgcccagga

SEQ ID NO: 2850967 - RNA, 16 nt, Mycobacterium avium subsp. paratuberculosis
gcggcgcccaggaacu

SEQ ID NO: 2850968 - RNA, 14 nt, Mycobacterium avium subsp. paratuberculosis
gcggcgcccccgcg

SEQ ID NO: 2850969 - RNA, 16 nt, Mycobacterium avium subsp. paratuberculosis
gcggcgcccccgcgac

SEQ ID NO: 2850970 - RNA, 17 nt, Mycobacterium avium subsp. paratuberculosis
gcggcgcccccgcgacg

SEQ ID NO: 2850971 - RNA, 20 nt, Mycobacterium avium subsp. paratuberculosis
gcggcgcccccgcgacgucc

SEQ ID NO: 2850972 - RNA, 19 nt, Mycobacterium avium subsp. paratuberculosis
gcggcgcccgacauccagg

SEQ ID NO: 2850973 - RNA, 16 nt, Mycobacterium avium subsp. paratuberculosis
gcggcgcccgcggccu

SEQ ID NO: 2850974 - RNA, 13 nt, Mycobacterium avium subsp. paratuberculosis
gcggcgcccggcg

SEQ ID NO: 2850975 - RNA, 14 nt, Mycobacterium avium subsp. paratuberculosis
gcggcgcccggcgc

SEQ ID NO: 2850976 - RNA, 15 nt, Mycobacterium avium subsp. paratuberculosis
gcggcgcccggcgcc

SEQ ID NO: 2850977 - RNA, 15 nt, Mycobacterium avium subsp. paratuberculosis
gcggcgcccucgccg

SEQ ID NO: 2850978 - RNA, 17 nt, Mycobacterium avium subsp. paratuberculosis
gcggcgcccucgccggc

SEQ ID NO: 2850979 - RNA, 18 nt, Mycobacterium avium subsp. paratuberculosis
gcggcgcccucgccggcg

SEQ ID NO: 2850980 - RNA, 19 nt, Mycobacterium avium subsp. paratuberculosis
gcggcgcccucgccggcgg

SEQ ID NO: 2850981 - RNA, 20 nt, Mycobacterium avium subsp. paratuberculosis
gcggcgcccucgccggcggc

SEQ ID NO: 2850982 - RNA, 21 nt, Mycobacterium avium subsp. paratuberculosis
gcggcgcccucgccggcggcg

SEQ ID NO: 2850983 - RNA, 22 nt, Mycobacterium avium subsp. paratuberculosis
gcggcgcccucgccggcggcgc

SEQ ID NO: 2850984 - RNA, 17 nt, Mycobacterium avium subsp. paratuberculosis
gcggcgcccugcgaaua

SEQ ID NO: 2850985 - RNA, 17 nt, Mycobacterium avium subsp. paratuberculosis
gcggcgcccuucccggu

SEQ ID NO: 2850986 - RNA, 23 nt, Mycobacterium avium subsp. paratuberculosis
gcggcgccgaaaaacgcgacggc

SEQ ID NO: 2850987 - RNA, 14 nt, Mycobacterium avium subsp. paratuberculosis
gcggcgccgaacuc

SEQ ID NO: 2850988 - RNA, 18 nt, Mycobacterium avium subsp. paratuberculosis
gcggcgccgaacucggcg

SEQ ID NO: 2850989 - RNA, 18 nt, Mycobacterium avium subsp. paratuberculosis
gcggcgccgacguccugg

SEQ ID NO: 2850990 - RNA, 12 nt, Mycobacterium avium subsp. paratuberculosis
gcggcgccgaug

SEQ ID NO: 2850991 - RNA, 15 nt, Mycobacterium avium subsp. paratuberculosis
gcggcgccgauggcg

SEQ ID NO: 2850992 - RNA, 16 nt, Mycobacterium avium subsp. paratuberculosis
gcggcgccgcagcacg

SEQ ID NO: 2850993 - RNA, 13 nt, Mycobacterium avium subsp. paratuberculosis
gcggcgccgccac

SEQ ID NO: 2850994 - RNA, 21 nt, Mycobacterium avium subsp. paratuberculosis
gcggcgcgggcggcgucggcg

SEQ ID NO: 2850995 - RNA, 23 nt, Mycobacterium avium subsp. paratuberculosis
gcggcgcgggcggcgucggcgac

SEQ ID NO: 2850996 - RNA, 19 nt, Mycobacterium avium subsp. paratuberculosis
gcggcgcgggucgcuggcc

SEQ ID NO: 2850997 - RNA, 21 nt, Mycobacterium avium subsp. paratuberculosis
gcggcgcgggucgcuggccgc

SEQ ID NO: 2850998 - RNA, 13 nt, Mycobacterium avium subsp. paratuberculosis
gcggcgcggucgc

SEQ ID NO: 2850999 - RNA, 20 nt, Mycobacterium avium subsp. paratuberculosis
gcggcgcggucgcaggccgc

SEQ ID NO: 2851000 - RNA, 14 nt, Mycobacterium avium subsp. paratuberculosis
gcggcgcggugcgc

SEQ ID NO: 2851001 - RNA, 16 nt, Mycobacterium avium subsp. paratuberculosis
gcggcgcggugcgccg

SEQ ID NO: 2851002 - RNA, 19 nt, Mycobacterium avium subsp. paratuberculosis
gcggcgcggugcgccgaca

SEQ ID NO: 2851003 - RNA, 17 nt, Mycobacterium avium subsp. paratuberculosis
gcggcgcgguugaccgc

SEQ ID NO: 2851004 - RNA, 19 nt, Mycobacterium avium subsp. paratuberculosis
gcggcgcgguugaccgccg

SEQ ID NO: 2851005 - RNA, 23 nt, Mycobacterium avium subsp. paratuberculosis
gcggcgcgguugaccgccgacac

SEQ ID NO: 2851006 - RNA, 17 nt, Mycobacterium avium subsp. paratuberculosis
gcggcgcgguuucggcg

SEQ ID NO: 2851007 - RNA, 23 nt, Mycobacterium avium subsp. paratuberculosis
gcggcgcguccauggucgagccg

SEQ ID NO: 2851008 - RNA, 14 nt, Mycobacterium avium subsp. paratuberculosis
gcggcgcgucgcug

SEQ ID NO: 2851009 - RNA, 15 nt, Mycobacterium avium subsp. paratuberculosis
gcggcgcgucgcugg

SEQ ID NO: 2851010 - RNA, 16 nt, Mycobacterium avium subsp. paratuberculosis
gcggcgcgucgcuggg

SEQ ID NO: 2851011 - RNA, 17 nt, Mycobacterium avium subsp. paratuberculosis
gcggcgcgucgcugggc

SEQ ID NO: 2851012 - RNA, 22 nt, Mycobacterium avium subsp. paratuberculosis
gcggcgcgucgcugggcagccg

SEQ ID NO: 2851013 - RNA, 15 nt, Mycobacterium avium subsp. paratuberculosis
gcggcgcgugcgccg

SEQ ID NO: 2851014 - RNA, 16 nt, Mycobacterium avium subsp. paratuberculosis
gcggcgcgugcgccgc

SEQ ID NO: 2851015 - RNA, 20 nt, Mycobacterium avium subsp. paratuberculosis
gcggcgcgugcgccgcggcg

SEQ ID NO: 2851016 - RNA, 21 nt, Mycobacterium avium subsp. paratuberculosis
gcggcgcgugcgccgcggcgg

SEQ ID NO: 2851017 - RNA, 14 nt, Mycobacterium avium subsp. paratuberculosis
gcggcgcuaaagcc

SEQ ID NO: 2851018 - RNA, 21 nt, Mycobacterium avium subsp. paratuberculosis
gcggcgcuaaagccaccagcg

SEQ ID NO: 2851019 - RNA, 13 nt, Mycobacterium avium subsp. paratuberculosis
gcggcgcucagcg

SEQ ID NO: 2851020 - RNA, 14 nt, Mycobacterium avium subsp. paratuberculosis
gcggcgcucagcgc

SEQ ID NO: 2851021 - RNA, 21 nt, Mycobacterium avium subsp. paratuberculosis
gcggcgcucagcgcggcgggc

SEQ ID NO: 2851022 - RNA, 15 nt, Mycobacterium avium subsp. paratuberculosis
gcggcgcugaugccg

SEQ ID NO: 2851023 - RNA, 23 nt, Mycobacterium avium subsp. paratuberculosis
gcggcgcugcagcagcccgauca

SEQ ID NO: 2851024 - RNA, 15 nt, Mycobacterium avium subsp. paratuberculosis
gcggcgcugccccag

SEQ ID NO: 2851025 - RNA, 16 nt, Mycobacterium avium subsp. paratuberculosis
gcggcgcugccccagc

SEQ ID NO: 2851026 - RNA, 13 nt, Mycobacterium avium subsp. paratuberculosis
gcggcgcugccgc

SEQ ID NO: 2851027 - RNA, 15 nt, Mycobacterium avium subsp. paratuberculosis
gcggcgcugccggcg

SEQ ID NO: 2851028 - RNA, 16 nt, Mycobacterium avium subsp. paratuberculosis
gcggcgcugccggcgc

SEQ ID NO: 2851029 - RNA, 18 nt, Mycobacterium avium subsp. paratuberculosis
gcggcgcugccggcgcac

SEQ ID NO: 2851030 - RNA, 15 nt, Mycobacterium avium subsp. paratuberculosis
gcggcgcugccggug

SEQ ID NO: 2851031 - RNA, 17 nt, Mycobacterium avium subsp. paratuberculosis
gcggcgcugcgccguug

SEQ ID NO: 2851032 - RNA, 14 nt, Mycobacterium avium subsp. paratuberculosis
gcggcgcuggucgg

SEQ ID NO: 2851033 - RNA, 15 nt, Mycobacterium avium subsp. paratuberculosis
gcggcgcuggucggc

SEQ ID NO: 2851034 - RNA, 16 nt, Mycobacterium avium subsp. paratuberculosis
gcggcgcuugaccucg

SEQ ID NO: 2851035 - RNA, 17 nt, Mycobacterium avium subsp. paratuberculosis
gcggcgcuugaccucgc

SEQ ID NO: 2851036 - RNA, 19 nt, Mycobacterium avium subsp. paratuberculosis
gcggcgcuugaccucgccg

SEQ ID NO: 2851037 - RNA, 20 nt, Mycobacterium avium subsp. paratuberculosis
gcggcgcuugaccucgccga

SEQ ID NO: 2851038 - RNA, 23 nt, Mycobacterium avium subsp. paratuberculosis
gcggcgcuuucgaagugacgccg

SEQ ID NO: 2851039 - RNA, 17 nt, Mycobacterium avium subsp. paratuberculosis
gcggcggaacucgauga

SEQ ID NO: 2851040 - RNA, 17 nt, Mycobacterium avium subsp. paratuberculosis
gcggcggaccgucggug

SEQ ID NO: 2851041 - RNA, 13 nt, Mycobacterium avium subsp. paratuberculosis
gcggcggaggccu

SEQ ID NO: 2851042 - RNA, 14 nt, Mycobacterium avium subsp. paratuberculosis
gcggcggaggccug

SEQ ID NO: 2851043 - RNA, 19 nt, Mycobacterium avium subsp. paratuberculosis
gcggcggaggccugcgcgg

SEQ ID NO: 2851044 - RNA, 22 nt, Mycobacterium avium subsp. paratuberculosis
gcggcggaggccugcgcggccg

SEQ ID NO: 2851045 - RNA, 14 nt, Mycobacterium avium subsp. paratuberculosis
gcggcggaggggcc

SEQ ID NO: 2851046 - RNA, 21 nt, Mycobacterium avium subsp. paratuberculosis
gcggcggaggucagcggcccg

SEQ ID NO: 2851047 - RNA, 14 nt, Mycobacterium avium subsp. paratuberculosis
gcggcggaucagca

SEQ ID NO: 2851048 - RNA, 17 nt, Mycobacterium avium subsp. paratuberculosis
gcggcggaucagcaccg

SEQ ID NO: 2851049 - RNA, 18 nt, Mycobacterium avium subsp. paratuberculosis
gcggcggaucagcaccga

SEQ ID NO: 2851050 - RNA, 19 nt, Mycobacterium avium subsp. paratuberculosis
gcggcggaucagcaccgac

SEQ ID NO: 2851051 - RNA, 20 nt, Mycobacterium avium subsp. paratuberculosis
gcggcggaucagcaccgacg

SEQ ID NO: 2851052 - RNA, 20 nt, Mycobacterium avium subsp. paratuberculosis
gcggcggauccagcaccgcc

SEQ ID NO: 2851053 - RNA, 20 nt, Mycobacterium avium subsp. paratuberculosis
gcggcggaugggugcgguug

SEQ ID NO: 2851054 - RNA, 16 nt, Mycobacterium avium subsp. paratuberculosis
gcggcggcaaccagcu

SEQ ID NO: 2851055 - RNA, 21 nt, Mycobacterium avium subsp. paratuberculosis
gcggcggcaaccagcuccggc

SEQ ID NO: 2851056 - RNA, 22 nt, Mycobacterium avium subsp. paratuberculosis
gcggcggcaaccagcuccggca

SEQ ID NO: 2851057 - RNA, 21 nt, Mycobacterium avium subsp. paratuberculosis
gcggcggcacccaggucaccg

SEQ ID NO: 2851058 - RNA, 18 nt, Mycobacterium avium subsp. paratuberculosis
gcggcggcagcacccgca

SEQ ID NO: 2851059 - RNA, 15 nt, Mycobacterium avium subsp. paratuberculosis
gcggcggcagcagcc

SEQ ID NO: 2851060 - RNA, 14 nt, Mycobacterium avium subsp. paratuberculosis
gcggcggcagucgc

SEQ ID NO: 2851061 - RNA, 14 nt, Mycobacterium avium subsp. paratuberculosis
gcggcggccaacgc

SEQ ID NO: 2851062 - RNA, 15 nt, Mycobacterium avium subsp. paratuberculosis
gcggcggccaacgcg

SEQ ID NO: 2851063 - RNA, 12 nt, Mycobacterium avium subsp. paratuberculosis
gcggcggccaau

SEQ ID NO: 2851064 - RNA, 14 nt, Mycobacterium avium subsp. paratuberculosis
gcggcggccaccgc

SEQ ID NO: 2851065 - RNA, 13 nt, Mycobacterium avium subsp. paratuberculosis
gcggcggccaccu

SEQ ID NO: 2851066 - RNA, 15 nt, Mycobacterium avium subsp. paratuberculosis
gcggcggccaccucg

SEQ ID NO: 2851067 - RNA, 20 nt, Mycobacterium avium subsp. paratuberculosis
gcggcggccaccucgccgca

SEQ ID NO: 2851068 - RNA, 19 nt, Mycobacterium avium subsp. paratuberculosis
gcggcggccaccucggcgg

SEQ ID NO: 2851069 - RNA, 12 nt, Mycobacterium avium subsp. paratuberculosis
gcggcggccagc

SEQ ID NO: 2851070 - RNA, 19 nt, Mycobacterium avium subsp. paratuberculosis
gcggcggccagcgagucga

SEQ ID NO: 2851071 - RNA, 13 nt, Mycobacterium avium subsp. paratuberculosis
gcggcggccagga

SEQ ID NO: 2851072 - RNA, 21 nt, Mycobacterium avium subsp. paratuberculosis
gcggcggccauucaucgcgca

SEQ ID NO: 2851073 - RNA, 22 nt, Mycobacterium avium subsp. paratuberculosis
gcggcggccauucaucgcgcac

SEQ ID NO: 2851074 - RNA, 24 nt, Mycobacterium avium subsp. paratuberculosis
gcggcggccauucaucgcgcacca

SEQ ID NO: 2851075 - RNA, 10 nt, Mycobacterium avium subsp. paratuberculosis
gcggcggccc

SEQ ID NO: 2851076 - RNA, 17 nt, Mycobacterium avium subsp. paratuberculosis
gcggcggcccgccgcgc

SEQ ID NO: 2851077 - RNA, 22 nt, Mycobacterium avium subsp. paratuberculosis
gcggcggcccgccgcgcccggc

SEQ ID NO: 2851078 - RNA, 13 nt, Mycobacterium avium subsp. paratuberculosis
gcggcggcccgcg

SEQ ID NO: 2851079 - RNA, 13 nt, Mycobacterium avium subsp. paratuberculosis
gcggcgggccgca

SEQ ID NO: 2851080 - RNA, 15 nt, Mycobacterium avium subsp. paratuberculosis
gcggcgggccgcaau

SEQ ID NO: 2851081 - RNA, 24 nt, Mycobacterium avium subsp. paratuberculosis
gcggcgggcgaaguagccggcgau

SEQ ID NO: 2851082 - RNA, 16 nt, Mycobacterium avium subsp. paratuberculosis
gcggcgggcgcgucga

SEQ ID NO: 2851083 - RNA, 20 nt, Mycobacterium avium subsp. paratuberculosis
gcggcgggcgcgucgagguc

SEQ ID NO: 2851084 - RNA, 16 nt, Mycobacterium avium subsp. paratuberculosis
gcggcgggcucggacg

SEQ ID NO: 2851085 - RNA, 12 nt, Mycobacterium avium subsp. paratuberculosis
gcggcggggccu

SEQ ID NO: 2851086 - RNA, 15 nt, Mycobacterium avium subsp. paratuberculosis
gcggcggggccucga

SEQ ID NO: 2851087 - RNA, 23 nt, Mycobacterium avium subsp. paratuberculosis
gcggcgggggcgagaccgucggu

SEQ ID NO: 2851088 - RNA, 13 nt, Mycobacterium avium subsp. paratuberculosis
gcggcgggggcgg

SEQ ID NO: 2851089 - RNA, 15 nt, Mycobacterium avium subsp. paratuberculosis
gcggcgggggcgggc

SEQ ID NO: 2851090 - RNA, 16 nt, Mycobacterium avium subsp. paratuberculosis
gcggcgggggcgggcc

SEQ ID NO: 2851091 - RNA, 19 nt, Mycobacterium avium subsp. paratuberculosis
gcggcgggggcgggcccca

SEQ ID NO: 2851092 - RNA, 16 nt, Mycobacterium avium subsp. paratuberculosis
gcggcgggggucggag

SEQ ID NO: 2851093 - RNA, 15 nt, Mycobacterium avium subsp. paratuberculosis
gcggcgggguccacg

SEQ ID NO: 2851094 - RNA, 17 nt, Mycobacterium avium subsp. paratuberculosis
gcggcgggguccacgca

SEQ ID NO: 2851095 - RNA, 17 nt, Mycobacterium avium subsp. paratuberculosis
gcggcggggucguugca

SEQ ID NO: 2851096 - RNA, 22 nt, Mycobacterium avium subsp. paratuberculosis
gcggcggggucguugcacacca

SEQ ID NO: 2851097 - RNA, 15 nt, Mycobacterium avium subsp. paratuberculosis
gcggcggggugacgg

SEQ ID NO: 2851098 - RNA, 20 nt, Mycobacterium avium subsp. paratuberculosis
gcggcgggguuccgucgaac

SEQ ID NO: 2851099 - RNA, 21 nt, Mycobacterium avium subsp. paratuberculosis
gcggcgguaccgaacgacgag

SEQ ID NO: 2851100 - RNA, 23 nt, Mycobacterium avium subsp. paratuberculosis
gcggcgguaucgguggauccggu

SEQ ID NO: 2851101 - RNA, 18 nt, Mycobacterium avium subsp. paratuberculosis
gcggcgguauucgucacc

SEQ ID NO: 2851102 - RNA, 20 nt, Mycobacterium avium subsp. paratuberculosis
gcggcgguauucgucacccc

SEQ ID NO: 2851103 - RNA, 22 nt, Mycobacterium avium subsp. paratuberculosis
gcggcgguauucgucaccccac

SEQ ID NO: 2851104 - RNA, 18 nt, Mycobacterium avium subsp. paratuberculosis
gcggcggucacgcccggg

SEQ ID NO: 2851105 - RNA, 23 nt, Mycobacterium avium subsp. paratuberculosis
gcggcggucagguucgccacgau

SEQ ID NO: 2851106 - RNA, 14 nt, Mycobacterium avium subsp. paratuberculosis
gcggcgguccccga

SEQ ID NO: 2851107 - RNA, 17 nt, Mycobacterium avium subsp. paratuberculosis
gcggcgguccgcccgga

SEQ ID NO: 2851108 - RNA, 18 nt, Mycobacterium avium subsp. paratuberculosis
gcggcgguccguucggcg

SEQ ID NO: 2851109 - RNA, 13 nt, Mycobacterium avium subsp. paratuberculosis
gcggcggucgcca

SEQ ID NO: 2851110 - RNA, 21 nt, Mycobacterium avium subsp. paratuberculosis
gcggcggucgccacucgggcg

SEQ ID NO: 2851111 - RNA, 18 nt, Mycobacterium avium subsp. paratuberculosis
gcggcggucgcgcgccgg

SEQ ID NO: 2851112 - RNA, 12 nt, Mycobacterium avium subsp. paratuberculosis
gcggcggucggc

SEQ ID NO: 2851113 - RNA, 14 nt, Mycobacterium avium subsp. paratuberculosis
gcggcggucggcau

SEQ ID NO: 2851114 - RNA, 23 nt, Mycobacterium avium subsp. paratuberculosis
gcggcggucggcauagcgccgcu

SEQ ID NO: 2851115 - RNA, 24 nt, Mycobacterium avium subsp. paratuberculosis
gcggcggucggcauagcgccgcuc

SEQ ID NO: 2851116 - RNA, 13 nt, Mycobacterium avium subsp. paratuberculosis
gcggcggucggcg

SEQ ID NO: 2851117 - RNA, 15 nt, Mycobacterium avium subsp. paratuberculosis
gcggcggucggcgcc

SEQ ID NO: 2851118 - RNA, 19 nt, Mycobacterium avium subsp. paratuberculosis
gcggcggucuucuuggccg

SEQ ID NO: 2851119 - RNA, 22 nt, Mycobacterium avium subsp. paratuberculosis
gcggcggucuucuuggccgcgc

SEQ ID NO: 2851120 - RNA, 21 nt, Mycobacterium avium subsp. paratuberculosis
gcggcggugacgaacccgccg

SEQ ID NO: 2851121 - RNA, 22 nt, Mycobacterium avium subsp. paratuberculosis
gcggcggugacgaacccgccgc

SEQ ID NO: 2851122 - RNA, 21 nt, Mycobacterium avium subsp. paratuberculosis
gcggcggugagccgccacagc

SEQ ID NO: 2851123 - RNA, 20 nt, Mycobacterium avium subsp. paratuberculosis
gcggcggugagcgcgucgag

SEQ ID NO: 2851124 - RNA, 16 nt, Mycobacterium avium subsp. paratuberculosis
gcggcggugaucgccg

SEQ ID NO: 2851125 - RNA, 21 nt, Mycobacterium avium subsp. paratuberculosis
gcggcggugaucucgucggcg

SEQ ID NO: 2851126 - RNA, 22 nt, Mycobacterium avium subsp. paratuberculosis
gcggcggugaucucgucggcgg

SEQ ID NO: 2851127 - RNA, 23 nt, Mycobacterium avium subsp. paratuberculosis
gcggcggugaucucgucggcggc

SEQ ID NO: 2851128 - RNA, 14 nt, Mycobacterium avium subsp. paratuberculosis
gcggcggugccgca

SEQ ID NO: 2851129 - RNA, 15 nt, Mycobacterium avium subsp. paratuberculosis
gcggcggugccgcag

SEQ ID NO: 2851130 - RNA, 16 nt, Mycobacterium avium subsp. paratuberculosis
gcggcggugccgcagg

SEQ ID NO: 2851131 - RNA, 14 nt, Mycobacterium avium subsp. paratuberculosis
gcggcggugccggu

SEQ ID NO: 2851132 - RNA, 17 nt, Mycobacterium avium subsp. paratuberculosis
gcggcggugcgcagccg

SEQ ID NO: 2851133 - RNA, 16 nt, Mycobacterium avium subsp. paratuberculosis
gcggcggugcgucggg

SEQ ID NO: 2851134 - RNA, 22 nt, Mycobacterium avium subsp. paratuberculosis
gcggcggugcucgcgccgggcg

SEQ ID NO: 2851135 - RNA, 21 nt, Mycobacterium avium subsp. paratuberculosis
gcggcggugcucucgucgucg

SEQ ID NO: 2851136 - RNA, 22 nt, Mycobacterium avium subsp. paratuberculosis
gcggcggugcucucgucgucgg

SEQ ID NO: 2851137 - RNA, 14 nt, Mycobacterium avium subsp. paratuberculosis
gcggcgguggccug

SEQ ID NO: 2851138 - RNA, 16 nt, Mycobacterium avium subsp. paratuberculosis
gcggcgguggccugcc

SEQ ID NO: 2851139 - RNA, 21 nt, Mycobacterium avium subsp. paratuberculosis
gcggcgguggccugcccggcg

SEQ ID NO: 2851140 - RNA, 14 nt, Mycobacterium avium subsp. paratuberculosis
gcggcgguggcgau

SEQ ID NO: 2851141 - RNA, 22 nt, Mycobacterium avium subsp. paratuberculosis
gcggcggugggcugggcgaagc

SEQ ID NO: 2851142 - RNA, 15 nt, Mycobacterium avium subsp. paratuberculosis
gcggcggugucgccc

SEQ ID NO: 2851143 - RNA, 15 nt, Mycobacterium avium subsp. paratuberculosis
gcggcggugucggug

SEQ ID NO: 2851144 - RNA, 17 nt, Mycobacterium avium subsp. paratuberculosis
gcggcggugucggugcc

SEQ ID NO: 2851145 - RNA, 20 nt, Mycobacterium avium subsp. paratuberculosis
gcggcggugucggugcccag

SEQ ID NO: 2851146 - RNA, 11 nt, Mycobacterium avium subsp. paratuberculosis
gcggcgguguu

SEQ ID NO: 2851147 - RNA, 20 nt, Mycobacterium avium subsp. paratuberculosis
gcggcgguugcucgucggcc

SEQ ID NO: 2851148 - RNA, 21 nt, Mycobacterium avium subsp. paratuberculosis
gcggcgguugcucgucggccg

SEQ ID NO: 2851149 - RNA, 23 nt, Mycobacterium avium subsp. paratuberculosis
gcggcgguuucuuugaucucauc

SEQ ID NO: 2851150 - RNA, 18 nt, Mycobacterium avium subsp. paratuberculosis
gcggcgguuuuggucggc

SEQ ID NO: 2851151 - RNA, 20 nt, Mycobacterium avium subsp. paratuberculosis
gcggcgguuuuggucggcac

SEQ ID NO: 2851152 - RNA, 14 nt, Mycobacterium avium subsp. paratuberculosis
gcggcguaccgcgg

SEQ ID NO: 2851153 - RNA, 16 nt, Mycobacterium avium subsp. paratuberculosis
gcggcguaccgcggcg

SEQ ID NO: 2851154 - RNA, 19 nt, Mycobacterium avium subsp. paratuberculosis
gcggcguaccgcggcggcg

SEQ ID NO: 2851155 - RNA, 20 nt, Mycobacterium avium subsp. paratuberculosis
gcggcguaccgcggcggcgu

SEQ ID NO: 2851156 - RNA, 22 nt, Mycobacterium avium subsp. paratuberculosis
gcggcguacgcgauggcggcgc

SEQ ID NO: 2851157 - RNA, 16 nt, Mycobacterium avium subsp. paratuberculosis
gcggcguacugcgcga

SEQ ID NO: 2851158 - RNA, 19 nt, Mycobacterium avium subsp. paratuberculosis
gcggcguacugcgcgagcu

SEQ ID NO: 2851159 - RNA, 20 nt, Mycobacterium avium subsp. paratuberculosis
gcggcguacugcgcgagcuc

SEQ ID NO: 2851160 - RNA, 16 nt, Mycobacterium avium subsp. paratuberculosis
gcggcguagccgccgg

SEQ ID NO: 2851161 - RNA, 17 nt, Mycobacterium avium subsp. paratuberculosis
gcggcguagccgccggu

SEQ ID NO: 2851162 - RNA, 13 nt, Mycobacterium avium subsp. paratuberculosis
gcggcguagcgcc

SEQ ID NO: 2851163 - RNA, 19 nt, Mycobacterium avium subsp. paratuberculosis
gcggcucacagcgcggcgg

SEQ ID NO: 2851164 - RNA, 21 nt, Mycobacterium avium subsp. paratuberculosis
gcggcucacaugggcgcguug

SEQ ID NO: 2851165 - RNA, 16 nt, Mycobacterium avium subsp. paratuberculosis
gcggcuccacgaaguc

SEQ ID NO: 2851166 - RNA, 15 nt, Mycobacterium avium subsp. paratuberculosis
gcggcuccagcagcg

SEQ ID NO: 2851167 - RNA, 15 nt, Mycobacterium avium subsp. paratuberculosis
gcggcucccaccgug

SEQ ID NO: 2851168 - RNA, 19 nt, Mycobacterium avium subsp. paratuberculosis
gcggcuccgaucuccuggu

SEQ ID NO: 2851169 - RNA, 12 nt, Mycobacterium avium subsp. paratuberculosis
gcggcuccggcc

SEQ ID NO: 2851170 - RNA, 16 nt, Mycobacterium avium subsp. paratuberculosis
gcggcuccggccgcgc

SEQ ID NO: 2851171 - RNA, 18 nt, Mycobacterium avium subsp. paratuberculosis
gcggcuccggccgcgccg

SEQ ID NO: 2851172 - RNA, 22 nt, Mycobacterium avium subsp. paratuberculosis
gcggcuccggccgcgccggccu

SEQ ID NO: 2851173 - RNA, 16 nt, Mycobacterium avium subsp. paratuberculosis
gcggcucgccggcguc

SEQ ID NO: 2851174 - RNA, 11 nt, Mycobacterium avium subsp. paratuberculosis
gcggcucgcga

SEQ ID NO: 2851175 - RNA, 13 nt, Mycobacterium avium subsp. paratuberculosis
gcggcucgcgcgg

SEQ ID NO: 2851176 - RNA, 15 nt, Mycobacterium avium subsp. paratuberculosis
gcggcucgcgggugc

SEQ ID NO: 2851177 - RNA, 18 nt, Mycobacterium avium subsp. paratuberculosis
gcggcucgcgggugcggc

SEQ ID NO: 2851178 - RNA, 12 nt, Mycobacterium avium subsp. paratuberculosis
gcggcucggccu

SEQ ID NO: 2851179 - RNA, 14 nt, Mycobacterium avium subsp. paratuberculosis
gcggcucggcgcug

SEQ ID NO: 2851180 - RNA, 15 nt, Mycobacterium avium subsp. paratuberculosis
gcggcucggcgcuga

SEQ ID NO: 2851181 - RNA, 13 nt, Mycobacterium avium subsp. paratuberculosis
gcggcucggcggc

SEQ ID NO: 2851182 - RNA, 15 nt, Mycobacterium avium subsp. paratuberculosis
gcggcucggcggcgu

SEQ ID NO: 2851183 - RNA, 15 nt, Mycobacterium avium subsp. paratuberculosis
gcggcucgggcggug

SEQ ID NO: 2851184 - RNA, 18 nt, Mycobacterium avium subsp. paratuberculosis
gcggcucgggcgguggcg

SEQ ID NO: 2851185 - RNA, 14 nt, Mycobacterium avium subsp. paratuberculosis
gcggcucggucgcg

SEQ ID NO: 2851186 - RNA, 15 nt, Mycobacterium avium subsp. paratuberculosis
gcggcucggucgcga

SEQ ID NO: 2851187 - RNA, 19 nt, Mycobacterium avium subsp. paratuberculosis
gcggcucguccagcccggu

SEQ ID NO: 2851188 - RNA, 23 nt, Mycobacterium avium subsp. paratuberculosis
gcggcucguccagcccggucacc

SEQ ID NO: 2851189 - RNA, 12 nt, Mycobacterium avium subsp. paratuberculosis
gcggcucgucgg

SEQ ID NO: 2851190 - RNA, 13 nt, Mycobacterium avium subsp. paratuberculosis
gcggcucgucggc

SEQ ID NO: 2851191 - RNA, 14 nt, Mycobacterium avium subsp. paratuberculosis
gcggcucgucggcg

SEQ ID NO: 2851192 - RNA, 15 nt, Mycobacterium avium subsp. paratuberculosis
gcggcucgucggcga

SEQ ID NO: 2851193 - RNA, 17 nt, Mycobacterium avium subsp. paratuberculosis
gcggcugaaccaccgcg

SEQ ID NO: 2851194 - RNA, 19 nt, Mycobacterium avium subsp. paratuberculosis
gcggcugaaccaccgcgcc

SEQ ID NO: 2851195 - RNA, 20 nt, Mycobacterium avium subsp. paratuberculosis
gcggcugaaccaccgcgccc

SEQ ID NO: 2851196 - RNA, 21 nt, Mycobacterium avium subsp. paratuberculosis
gcggcugaaccaccgcgccca

SEQ ID NO: 2851197 - RNA, 22 nt, Mycobacterium avium subsp. paratuberculosis
gcggcugaaccaccgcgcccac

SEQ ID NO: 2851198 - RNA, 16 nt, Mycobacterium avium subsp. paratuberculosis
gcggcugaagcgcugg

SEQ ID NO: 2851199 - RNA, 17 nt, Mycobacterium avium subsp. paratuberculosis
gcggcugaagcgcuggg

SEQ ID NO: 2851200 - RNA, 23 nt, Mycobacterium avium subsp. paratuberculosis
gcggcugaagcgcugggacagcg

SEQ ID NO: 2851201 - RNA, 13 nt, Mycobacterium avium subsp. paratuberculosis
gcggcugaccgag

SEQ ID NO: 2851202 - RNA, 15 nt, Mycobacterium avium subsp. paratuberculosis
gcggcugaccgagcg

SEQ ID NO: 2851203 - RNA, 17 nt, Mycobacterium avium subsp. paratuberculosis
gcggcugaccgagcggc

SEQ ID NO: 2851204 - RNA, 16 nt, Mycobacterium avium subsp. paratuberculosis
gcggcugaucagccgg

SEQ ID NO: 2851205 - RNA, 18 nt, Mycobacterium avium subsp. paratuberculosis
gcggcugaucagccggcg

SEQ ID NO: 2851206 - RNA, 21 nt, Mycobacterium avium subsp. paratuberculosis
gcggcugaucagccggcgagc

SEQ ID NO: 2851207 - RNA, 13 nt, Mycobacterium avium subsp. paratuberculosis
gcggcugcagcag

SEQ ID NO: 2851208 - RNA, 16 nt, Mycobacterium avium subsp. paratuberculosis
gcggcugcaucaugcc

SEQ ID NO: 2851209 - RNA, 21 nt, Mycobacterium avium subsp. paratuberculosis
gcggcugcaucaugccgccca

SEQ ID NO: 2851210 - RNA, 22 nt, Mycobacterium avium subsp. paratuberculosis
gcggcugcccaggaucaccggg

SEQ ID NO: 2851211 - RNA, 24 nt, Mycobacterium avium subsp. paratuberculosis
gcggcugcccaggaucaccgggac

SEQ ID NO: 2851212 - RNA, 14 nt, Mycobacterium avium subsp. paratuberculosis
gcggcugccggcca

SEQ ID NO: 2851213 - RNA, 15 nt, Mycobacterium avium subsp. paratuberculosis
gcggcugccggccaa

SEQ ID NO: 2851214 - RNA, 13 nt, Mycobacterium avium subsp. paratuberculosis
gcggcugccggug

SEQ ID NO: 2851215 - RNA, 14 nt, Mycobacterium avium subsp. paratuberculosis
gcggcugccggugc

SEQ ID NO: 2851216 - RNA, 20 nt, Mycobacterium avium subsp. paratuberculosis
gcggcugcgcacguagccca

SEQ ID NO: 2851217 - RNA, 15 nt, Mycobacterium avium subsp. paratuberculosis
gcggcugcucgaacc

SEQ ID NO: 2851218 - RNA, 20 nt, Mycobacterium avium subsp. paratuberculosis
gcggcugcucgaaccgcgag

SEQ ID NO: 2851219 - RNA, 17 nt, Mycobacterium avium subsp. paratuberculosis
gcggcugcugcagcgcc

SEQ ID NO: 2851220 - RNA, 14 nt, Mycobacterium avium subsp. paratuberculosis
gcggcuggcccggc

SEQ ID NO: 2851221 - RNA, 13 nt, Mycobacterium avium subsp. paratuberculosis
gcggcuggccgcg

SEQ ID NO: 2851222 - RNA, 14 nt, Mycobacterium avium subsp. paratuberculosis
gcggcuggccgcgg

SEQ ID NO: 2851223 - RNA, 15 nt, Mycobacterium avium subsp. paratuberculosis
gcggcuggccgcggc

SEQ ID NO: 2851224 - RNA, 16 nt, Mycobacterium avium subsp. paratuberculosis
gcggcuggccgcggcg

SEQ ID NO: 2851225 - RNA, 21 nt, Mycobacterium avium subsp. paratuberculosis
gcggcuggccgucgucgaggc

SEQ ID NO: 2851226 - RNA, 14 nt, Mycobacterium avium subsp. paratuberculosis
gcggcuggcgggug

SEQ ID NO: 2851227 - RNA, 17 nt, Mycobacterium avium subsp. paratuberculosis
gcggcugggcagccgcg

SEQ ID NO: 2851228 - RNA, 19 nt, Mycobacterium avium subsp. paratuberculosis
gcggcugggcagccgcgcg

SEQ ID NO: 2851229 - RNA, 21 nt, Mycobacterium avium subsp. paratuberculosis
gcggcugggcagccgcgcgug

SEQ ID NO: 2851230 - RNA, 14 nt, Mycobacterium avium subsp. paratuberculosis
gcggcugggccgcg

SEQ ID NO: 2851231 - RNA, 15 nt, Mycobacterium avium subsp. paratuberculosis
gcggcugggccgcgg

SEQ ID NO: 2851232 - RNA, 17 nt, Mycobacterium avium subsp. paratuberculosis
gcggcugggucgguccc

SEQ ID NO: 2851233 - RNA, 20 nt, Mycobacterium avium subsp. paratuberculosis
gcggcugggucggucccgac

SEQ ID NO: 2851234 - RNA, 22 nt, Mycobacterium avium subsp. paratuberculosis
gcggcugggucggucccgacag

SEQ ID NO: 2851235 - RNA, 21 nt, Mycobacterium avium subsp. paratuberculosis
gcggcugguagaugccgaagc

SEQ ID NO: 2851236 - RNA, 20 nt, Mycobacterium avium subsp. paratuberculosis
gcggcuggugccgccggcga

SEQ ID NO: 2851237 - RNA, 16 nt, Mycobacterium avium subsp. paratuberculosis
gcggcuguagcacccg

SEQ ID NO: 2851238 - RNA, 17 nt, Mycobacterium avium subsp. paratuberculosis
gcggcuguagcacccgg

SEQ ID NO: 2851239 - RNA, 22 nt, Mycobacterium avium subsp. paratuberculosis
gcggcuguagcacccggccggc

SEQ ID NO: 2851240 - RNA, 19 nt, Mycobacterium avium subsp. paratuberculosis
gcggcugucguagcggccc

SEQ ID NO: 2851241 - RNA, 22 nt, Mycobacterium avium subsp. paratuberculosis
gcggcugugaucgcugacgccg

SEQ ID NO: 2851242 - RNA, 18 nt, Mycobacterium avium subsp. paratuberculosis
gcggcuucagucccgcga

SEQ ID NO: 2851243 - RNA, 19 nt, Mycobacterium avium subsp. paratuberculosis
gcggcuucagucccgcgaa

SEQ ID NO: 2851244 - RNA, 19 nt, Mycobacterium avium subsp. paratuberculosis
gcggcuucauaugacgccg

SEQ ID NO: 2851245 - RNA, 17 nt, Mycobacterium avium subsp. paratuberculosis
gcggcuugaccggcucg

SEQ ID NO: 2851246 - RNA, 18 nt, Mycobacterium avium subsp. paratuberculosis
gcggcuugaccggcucgc

SEQ ID NO: 2851247 - RNA, 20 nt, Mycobacterium avium subsp. paratuberculosis
gcggcuugaccggcucgccg

SEQ ID NO: 2851248 - RNA, 16 nt, Mycobacterium avium subsp. paratuberculosis
gcgggaucggugccga

SEQ ID NO: 2851249 - RNA, 18 nt, Mycobacterium avium subsp. paratuberculosis
gcgggaucggugccgacg

SEQ ID NO: 2851250 - RNA, 19 nt, Mycobacterium avium subsp. paratuberculosis
gcgggaucggugccgacgg

SEQ ID NO: 2851251 - RNA, 16 nt, Mycobacterium avium subsp. paratuberculosis
gcgggaucugcgccgc

SEQ ID NO: 2851252 - RNA, 19 nt, Mycobacterium avium subsp. paratuberculosis
gcgggaugaaggcacccag

SEQ ID NO: 2851253 - RNA, 15 nt, Mycobacterium avium subsp. paratuberculosis
gcgggaugccgagca

SEQ ID NO: 2851254 - RNA, 23 nt, Mycobacterium avium subsp. paratuberculosis
gcgggaugccgagcagcucggcg

SEQ ID NO: 2851255 - RNA, 20 nt, Mycobacterium avium subsp. paratuberculosis
gcgggaugcuuggucgcggc

SEQ ID NO: 2851256 - RNA, 18 nt, Mycobacterium avium subsp. paratuberculosis
gcgggauucgcgcaccuu

SEQ ID NO: 2851257 - RNA, 19 nt, Mycobacterium avium subsp. paratuberculosis
gcgggauucgcgcaccuuc

SEQ ID NO: 2851258 - RNA, 15 nt, Mycobacterium avium subsp. paratuberculosis
gcgggauuggcgcca

SEQ ID NO: 2851259 - RNA, 18 nt, Mycobacterium avium subsp. paratuberculosis
gcgggauuggcgccacug

SEQ ID NO: 2851260 - RNA, 23 nt, Mycobacterium avium subsp. paratuberculosis
gcgggauuggcgccacugccgcc

SEQ ID NO: 2851261 - RNA, 16 nt, Mycobacterium avium subsp. paratuberculosis
gcgggcaagggcaaag

SEQ ID NO: 2851262 - RNA, 17 nt, Mycobacterium avium subsp. paratuberculosis
gcgggcaaucgcugcgc

SEQ ID NO: 2851263 - RNA, 21 nt, Mycobacterium avium subsp. paratuberculosis
gcgggcaaucgcugcgcccgc

SEQ ID NO: 2851264 - RNA, 22 nt, Mycobacterium avium subsp. paratuberculosis
gcgggcaaucgcugcgcccgcc

SEQ ID NO: 2851265 - RNA, 17 nt, Mycobacterium avium subsp. paratuberculosis
gcgggcacacgcggucc

SEQ ID NO: 2851266 - RNA, 16 nt, Mycobacterium avium subsp. paratuberculosis
gcgggcaccccaucgg

SEQ ID NO: 2851267 - RNA, 22 nt, Mycobacterium avium subsp. paratuberculosis
gcgggcaccccaucggccagga

SEQ ID NO: 2851268 - RNA, 15 nt, Mycobacterium avium subsp. paratuberculosis
gcgggcaccgucguc

SEQ ID NO: 2851269 - RNA, 20 nt, Mycobacterium avium subsp. paratuberculosis
gcgggcaccgucgucgcacc

SEQ ID NO: 2851270 - RNA, 13 nt, Mycobacterium avium subsp. paratuberculosis
gcgggcaccucga

SEQ ID NO: 2851271 - RNA, 14 nt, Mycobacterium avium subsp. paratuberculosis
gcgggcaccucgau

SEQ ID NO: 2851272 - RNA, 16 nt, Mycobacterium avium subsp. paratuberculosis
gcgggcaccucggcca

SEQ ID NO: 2851273 - RNA, 13 nt, Mycobacterium avium subsp. paratuberculosis
gcgggcacgccgc

SEQ ID NO: 2851274 - RNA, 14 nt, Mycobacterium avium subsp. paratuberculosis
gcgggcacgccgcc

SEQ ID NO: 2851275 - RNA, 17 nt, Mycobacterium avium subsp. paratuberculosis
gcgggcacgccgccgcg

SEQ ID NO: 2851276 - RNA, 18 nt, Mycobacterium avium subsp. paratuberculosis
gcgggcacgccgccgcga

SEQ ID NO: 2851277 - RNA, 14 nt, Mycobacterium avium subsp. paratuberculosis
gcgggcacgucgcg

SEQ ID NO: 2851278 - RNA, 17 nt, Mycobacterium avium subsp. paratuberculosis
gcgggcacgucgcgcgg

SEQ ID NO: 2851279 - RNA, 23 nt, Mycobacterium avium subsp. paratuberculosis
gcgggcacgucgcgcggggucgg

SEQ ID NO: 2851280 - RNA, 20 nt, Mycobacterium avium subsp. paratuberculosis
gcgggcacuuaacaccucgc

SEQ ID NO: 2851281 - RNA, 18 nt, Mycobacterium avium subsp. paratuberculosis
gcgggcacuucguccauc

SEQ ID NO: 2851282 - RNA, 20 nt, Mycobacterium avium subsp. paratuberculosis
gcgggcacuucguccaucgu

SEQ ID NO: 2851283 - RNA, 16 nt, Mycobacterium avium subsp. paratuberculosis
gcgggcagagcugcug

SEQ ID NO: 2851284 - RNA, 12 nt, Mycobacterium avium subsp. paratuberculosis
gcgggcagcacc

SEQ ID NO: 2851285 - RNA, 12 nt, Mycobacterium avium subsp. paratuberculosis
gcgggcagccca

SEQ ID NO: 2851286 - RNA, 15 nt, Mycobacterium avium subsp. paratuberculosis
gcgggcagcccaggu

SEQ ID NO: 2851287 - RNA, 13 nt, Mycobacterium avium subsp. paratuberculosis
gcgggcagccgcu

SEQ ID NO: 2851288 - RNA, 19 nt, Mycobacterium avium subsp. paratuberculosis
gcgggcagccgcuuggccg

SEQ ID NO: 2851289 - RNA, 19 nt, Mycobacterium avium subsp. paratuberculosis
gcgggcagccggcgcccgc

SEQ ID NO: 2851290 - RNA, 15 nt, Mycobacterium avium subsp. paratuberculosis
gcgggcagcgagcac

SEQ ID NO: 2851291 - RNA, 21 nt, Mycobacterium avium subsp. paratuberculosis
gcgggcaggcccgagcccgac

SEQ ID NO: 2851292 - RNA, 15 nt, Mycobacterium avium subsp. paratuberculosis
gcgggcagggggacg

SEQ ID NO: 2851293 - RNA, 22 nt, Mycobacterium avium subsp. paratuberculosis
gcgggcagguacugcuugccgc

SEQ ID NO: 2851294 - RNA, 23 nt, Mycobacterium avium subsp. paratuberculosis
gcgggcauacugcuugccgucga

SEQ ID NO: 2851295 - RNA, 16 nt, Mycobacterium avium subsp. paratuberculosis
gcgggcaucgcuggug

SEQ ID NO: 2851296 - RNA, 20 nt, Mycobacterium avium subsp. paratuberculosis
gcgggcaucgcugguggccg

SEQ ID NO: 2851297 - RNA, 24 nt, Mycobacterium avium subsp. paratuberculosis
gcgggcaucgcugguggccgacgu

SEQ ID NO: 2851298 - RNA, 16 nt, Mycobacterium avium subsp. paratuberculosis
gcgggcaucggcuggu

SEQ ID NO: 2851299 - RNA, 21 nt, Mycobacterium avium subsp. paratuberculosis
gcgggcaucggcuggucggcg

SEQ ID NO: 2851300 - RNA, 23 nt, Mycobacterium avium subsp. paratuberculosis
gcgggcaucggcuggucggcggc

SEQ ID NO: 2851301 - RNA, 23 nt, Mycobacterium avium subsp. paratuberculosis
gcgggcaugaaccaggccgcgcu

SEQ ID NO: 2851302 - RNA, 14 nt, Mycobacterium avium subsp. paratuberculosis
gcgggccaaagagc

SEQ ID NO: 2851303 - RNA, 14 nt, Mycobacterium avium subsp. paratuberculosis
gcgggccaccgcgg

SEQ ID NO: 2851304 - RNA, 16 nt, Mycobacterium avium subsp. paratuberculosis
gcgggccaccgcggcg

SEQ ID NO: 2851305 - RNA, 15 nt, Mycobacterium avium subsp. paratuberculosis
gcgggccaccggcgc

SEQ ID NO: 2851306 - RNA, 17 nt, Mycobacterium avium subsp. paratuberculosis
gcgggccaccggcgcca

SEQ ID NO: 2851307 - RNA, 19 nt, Mycobacterium avium subsp. paratuberculosis
gcgggccaccggcgccagg

SEQ ID NO: 2851308 - RNA, 20 nt, Mycobacterium avium subsp. paratuberculosis
gcgggccaccggcgccaggu

SEQ ID NO: 2851309 - RNA, 17 nt, Mycobacterium avium subsp. paratuberculosis
gcgggccaccgucccgg

SEQ ID NO: 2851310 - RNA, 18 nt, Mycobacterium avium subsp. paratuberculosis
gcgggccaccgucccggu

SEQ ID NO: 2851311 - RNA, 22 nt, Mycobacterium avium subsp. paratuberculosis
gcgggccagacugcgcaccgcc

SEQ ID NO: 2851312 - RNA, 13 nt, Mycobacterium avium subsp. paratuberculosis
gcgggccagaugg

SEQ ID NO: 2851313 - RNA, 22 nt, Mycobacterium avium subsp. paratuberculosis
gcgggccagauggucgagggcg

SEQ ID NO: 2851314 - RNA, 12 nt, Mycobacterium avium subsp. paratuberculosis
gcgggccagcac

SEQ ID NO: 2851315 - RNA, 13 nt, Mycobacterium avium subsp. paratuberculosis
gcgggccagcacg

SEQ ID NO: 2851316 - RNA, 14 nt, Mycobacterium avium subsp. paratuberculosis
gcgggccagcacga

SEQ ID NO: 2851317 - RNA, 18 nt, Mycobacterium avium subsp. paratuberculosis
gcgggccagcacgacccc

SEQ ID NO: 2851318 - RNA, 19 nt, Mycobacterium avium subsp. paratuberculosis
gcgggccagcacgaccccg

SEQ ID NO: 2851319 - RNA, 20 nt, Mycobacterium avium subsp. paratuberculosis
gcgggccagcacgaccccgc

SEQ ID NO: 2851320 - RNA, 13 nt, Mycobacterium avium subsp. paratuberculosis
gcgggccagcagc

SEQ ID NO: 2851321 - RNA, 16 nt, Mycobacterium avium subsp. paratuberculosis
gcgggccagcagcagc

SEQ ID NO: 2851322 - RNA, 18 nt, Mycobacterium avium subsp. paratuberculosis
gcgggccagcagccgcgc

SEQ ID NO: 2851323 - RNA, 19 nt, Mycobacterium avium subsp. paratuberculosis
gcgggccagcagccgcgcg

SEQ ID NO: 2851324 - RNA, 13 nt, Mycobacterium avium subsp. paratuberculosis
gcgggccagcagu

SEQ ID NO: 2851325 - RNA, 15 nt, Mycobacterium avium subsp. paratuberculosis
gcgggccagccaggu

SEQ ID NO: 2851326 - RNA, 13 nt, Mycobacterium avium subsp. paratuberculosis
gcgggccagcgca

SEQ ID NO: 2851327 - RNA, 20 nt, Mycobacterium avium subsp. paratuberculosis
gcgggccagcgcaucgguca

SEQ ID NO: 2851328 - RNA, 22 nt, Mycobacterium avium subsp. paratuberculosis
gcgggccagcgcaucggucacc

SEQ ID NO: 2851329 - RNA, 20 nt, Mycobacterium avium subsp. paratuberculosis
gcgggccagcgccuucggcg

SEQ ID NO: 2851330 - RNA, 22 nt, Mycobacterium avium subsp. paratuberculosis
gcgggccagcgccuucggcgcc

SEQ ID NO: 2851331 - RNA, 23 nt, Mycobacterium avium subsp. paratuberculosis
gcgggccagcgccuucggcgcca

SEQ ID NO: 2851332 - RNA, 18 nt, Mycobacterium avium subsp. paratuberculosis
gcgggccuaggaccccgg

SEQ ID NO: 2851333 - RNA, 19 nt, Mycobacterium avium subsp. paratuberculosis
gcgggccuaggaccccggc

SEQ ID NO: 2851334 - RNA, 12 nt, Mycobacterium avium subsp. paratuberculosis
gcgggccucgcc

SEQ ID NO: 2851335 - RNA, 13 nt, Mycobacterium avium subsp. paratuberculosis
gcgggccucgccg

SEQ ID NO: 2851336 - RNA, 17 nt, Mycobacterium avium subsp. paratuberculosis
gcgggccucgccgcuuc

SEQ ID NO: 2851337 - RNA, 18 nt, Mycobacterium avium subsp. paratuberculosis
gcgggccugcucgucggg

SEQ ID NO: 2851338 - RNA, 21 nt, Mycobacterium avium subsp. paratuberculosis
gcgggccugcucgucggggca

SEQ ID NO: 2851339 - RNA, 13 nt, Mycobacterium avium subsp. paratuberculosis
gcgggccugggca

SEQ ID NO: 2851340 - RNA, 23 nt, Mycobacterium avium subsp. paratuberculosis
gcgggccuucacgcuggccucca

SEQ ID NO: 2851341 - RNA, 18 nt, Mycobacterium avium subsp. paratuberculosis
gcgggccuugagcaccgc

SEQ ID NO: 2851342 - RNA, 22 nt, Mycobacterium avium subsp. paratuberculosis
gcgggccuugagcaccgcgucg

SEQ ID NO: 2851343 - RNA, 19 nt, Mycobacterium avium subsp. paratuberculosis
gcgggcgaaaucgcgggcc

SEQ ID NO: 2851344 - RNA, 22 nt, Mycobacterium avium subsp. paratuberculosis
gcgggcgaagcgaaagacguug

SEQ ID NO: 2851345 - RNA, 23 nt, Mycobacterium avium subsp. paratuberculosis
gcgggcgaaggagaagacacgcu

SEQ ID NO: 2851346 - RNA, 19 nt, Mycobacterium avium subsp. paratuberculosis
gcgggcgaaguagccggcg

SEQ ID NO: 2851347 - RNA, 16 nt, Mycobacterium avium subsp. paratuberculosis
gcgggcgacccgcugg

SEQ ID NO: 2851348 - RNA, 24 nt, Mycobacterium avium subsp. paratuberculosis
gcgggcgacccgcuggaacagcgg

SEQ ID NO: 2851349 - RNA, 15 nt, Mycobacterium avium subsp. paratuberculosis
gcgggcgaccugcgg

SEQ ID NO: 2851350 - RNA, 20 nt, Mycobacterium avium subsp. paratuberculosis
gcgggcgaccugcgggccca

SEQ ID NO: 2851351 - RNA, 19 nt, Mycobacterium avium subsp. paratuberculosis
gcgggcgaccuggugcucg

SEQ ID NO: 2851352 - RNA, 15 nt, Mycobacterium avium subsp. paratuberculosis
gcgggcgacgucggg

SEQ ID NO: 2851353 - RNA, 21 nt, Mycobacterium avium subsp. paratuberculosis
gcgggcgacuucuucgccggc

SEQ ID NO: 2851354 - RNA, 15 nt, Mycobacterium avium subsp. paratuberculosis
gcgggcgagcagcgc

SEQ ID NO: 2851355 - RNA, 16 nt, Mycobacterium avium subsp. paratuberculosis
gcgggcgagccgacag

SEQ ID NO: 2851356 - RNA, 20 nt, Mycobacterium avium subsp. paratuberculosis
gcgggcgaucgccucggccu

SEQ ID NO: 2851357 - RNA, 20 nt, Mycobacterium avium subsp. paratuberculosis
gcgggcgaucuccagcggcc

SEQ ID NO: 2851358 - RNA, 22 nt, Mycobacterium avium subsp. paratuberculosis
gcgggcgaucuccagcggccgg

SEQ ID NO: 2851359 - RNA, 18 nt, Mycobacterium avium subsp. paratuberculosis
gcgggcgaucucgauggc

SEQ ID NO: 2851360 - RNA, 18 nt, Mycobacterium avium subsp. paratuberculosis
gcgggcgaugcggcccgg

SEQ ID NO: 2851361 - RNA, 16 nt, Mycobacterium avium subsp. paratuberculosis
gcgggcgcauaccagc

SEQ ID NO: 2851362 - RNA, 23 nt, Mycobacterium avium subsp. paratuberculosis
gcgggcgcauaccagcgcuggua

SEQ ID NO: 2851363 - RNA, 14 nt, Mycobacterium avium subsp. paratuberculosis
gcgggcgcccucca

SEQ ID NO: 2851364 - RNA, 14 nt, Mycobacterium avium subsp. paratuberculosis
gcgggcgccgaacg

SEQ ID NO: 2851365 - RNA, 18 nt, Mycobacterium avium subsp. paratuberculosis
gcgggcgccgaacgucga

SEQ ID NO: 2851366 - RNA, 19 nt, Mycobacterium avium subsp. paratuberculosis
gcgggcgccgaacgucgag

SEQ ID NO: 2851367 - RNA, 20 nt, Mycobacterium avium subsp. paratuberculosis
gcgggcgccgaagauggcca

SEQ ID NO: 2851368 - RNA, 21 nt, Mycobacterium avium subsp. paratuberculosis
gcgggcgccgaagauggccag

SEQ ID NO: 2851369 - RNA, 12 nt, Mycobacterium avium subsp. paratuberculosis
gcgggcgccggc

SEQ ID NO: 2851370 - RNA, 19 nt, Mycobacterium avium subsp. paratuberculosis
gcgggcgccggcugcccgc

SEQ ID NO: 2851371 - RNA, 22 nt, Mycobacterium avium subsp. paratuberculosis
gcgggcgccguaggccgcgcug

SEQ ID NO: 2851372 - RNA, 15 nt, Mycobacterium avium subsp. paratuberculosis
gcgggcgccgucggg

SEQ ID NO: 2851373 - RNA, 22 nt, Mycobacterium avium subsp. paratuberculosis
gcgggcgccuucuuggccgcgc

SEQ ID NO: 2851374 - RNA, 23 nt, Mycobacterium avium subsp. paratuberculosis
gcgggcgccuucuuggccgcgcc

SEQ ID NO: 2851375 - RNA, 23 nt, Mycobacterium avium subsp. paratuberculosis
gcgggcgccuucuuggcggcggu

SEQ ID NO: 2851376 - RNA, 14 nt, Mycobacterium avium subsp. paratuberculosis
gcgggcgcgcagcc

SEQ ID NO: 2851377 - RNA, 15 nt, Mycobacterium avium subsp. paratuberculosis
gcgggcgcgccggcg

SEQ ID NO: 2851378 - RNA, 22 nt, Mycobacterium avium subsp. paratuberculosis
gcgggcgcgccggcgcgcagcc

SEQ ID NO: 2851379 - RNA, 14 nt, Mycobacterium avium subsp. paratuberculosis
gcgggcgcgccguc

SEQ ID NO: 2851380 - RNA, 12 nt, Mycobacterium avium subsp. paratuberculosis
gcgggcgcgcgc

SEQ ID NO: 2851381 - RNA, 15 nt, Mycobacterium avium subsp. paratuberculosis
gcgggcgcgcgccgc

SEQ ID NO: 2851382 - RNA, 14 nt, Mycobacterium avium subsp. paratuberculosis
gcgggcgcggacag

SEQ ID NO: 2851383 - RNA, 14 nt, Mycobacterium avium subsp. paratuberculosis
gcgggcgcggccag

SEQ ID NO: 2851384 - RNA, 15 nt, Mycobacterium avium subsp. paratuberculosis
gcgggcgcggccagc

SEQ ID NO: 2851385 - RNA, 17 nt, Mycobacterium avium subsp. paratuberculosis
gcgggcgcggccagcgc

SEQ ID NO: 2851386 - RNA, 21 nt, Mycobacterium avium subsp. paratuberculosis
gcgggcggcaggucggcggga

SEQ ID NO: 2851387 - RNA, 14 nt, Mycobacterium avium subsp. paratuberculosis
gcgggcggcaucgc

SEQ ID NO: 2851388 - RNA, 22 nt, Mycobacterium avium subsp. paratuberculosis
gcgggcggcaucgcgccgcaug

SEQ ID NO: 2851389 - RNA, 13 nt, Mycobacterium avium subsp. paratuberculosis
gcgggcggccagc

SEQ ID NO: 2851390 - RNA, 15 nt, Mycobacterium avium subsp. paratuberculosis
gcgggcggccagccg

SEQ ID NO: 2851391 - RNA, 21 nt, Mycobacterium avium subsp. paratuberculosis
gcgggcggccccgggcgcugg

SEQ ID NO: 2851392 - RNA, 13 nt, Mycobacterium avium subsp. paratuberculosis
gcgggcggcccgc

SEQ ID NO: 2851393 - RNA, 15 nt, Mycobacterium avium subsp. paratuberculosis
gcgggcggcccgcac

SEQ ID NO: 2851394 - RNA, 17 nt, Mycobacterium avium subsp. paratuberculosis
gcgggcggcccgcacgg

SEQ ID NO: 2851395 - RNA, 18 nt, Mycobacterium avium subsp. paratuberculosis
gcgggcggcccgcacggc

SEQ ID NO: 2851396 - RNA, 20 nt, Mycobacterium avium subsp. paratuberculosis
gcgggcggcgaacaccagca

SEQ ID NO: 2851397 - RNA, 22 nt, Mycobacterium avium subsp. paratuberculosis
gcgggcggcgaacaccagcacc

SEQ ID NO: 2851398 - RNA, 13 nt, Mycobacterium avium subsp. paratuberculosis
gcgggcggcgcag

SEQ ID NO: 2851399 - RNA, 16 nt, Mycobacterium avium subsp. paratuberculosis
gcgggcggcgcggcgc

SEQ ID NO: 2851400 - RNA, 15 nt, Mycobacterium avium subsp. paratuberculosis
gcgggcggcgcgguu

SEQ ID NO: 2851401 - RNA, 15 nt, Mycobacterium avium subsp. paratuberculosis
gcgggcggcgguggc

SEQ ID NO: 2851402 - RNA, 16 nt, Mycobacterium avium subsp. paratuberculosis
gcgggcggcgguggcc

SEQ ID NO: 2851403 - RNA, 15 nt, Mycobacterium avium subsp. paratuberculosis
gcgggcggcgucggc

SEQ ID NO: 2851404 - RNA, 22 nt, Mycobacterium avium subsp. paratuberculosis
gcgggcggcgucguagacgcug

SEQ ID NO: 2851405 - RNA, 12 nt, Mycobacterium avium subsp. paratuberculosis
gcgggcgggccg

SEQ ID NO: 2851406 - RNA, 13 nt, Mycobacterium avium subsp. paratuberculosis
gcgggcgggccgc

SEQ ID NO: 2851407 - RNA, 14 nt, Mycobacterium avium subsp. paratuberculosis
gcgggcgggccgcc

SEQ ID NO: 2851408 - RNA, 16 nt, Mycobacterium avium subsp. paratuberculosis
gcgggcgggccgccag

SEQ ID NO: 2851409 - RNA, 13 nt, Mycobacterium avium subsp. paratuberculosis
gcgggcgggcuca

SEQ ID NO: 2851410 - RNA, 12 nt, Mycobacterium avium subsp. paratuberculosis
gcgggcggggcc

SEQ ID NO: 2851411 - RNA, 14 nt, Mycobacterium avium subsp. paratuberculosis
gcgggcggggcccg

SEQ ID NO: 2851412 - RNA, 16 nt, Mycobacterium avium subsp. paratuberculosis
gcgggcggggcgccga

SEQ ID NO: 2851413 - RNA, 18 nt, Mycobacterium avium subsp. paratuberculosis
gcgggcgggggaucggcg

SEQ ID NO: 2851414 - RNA, 14 nt, Mycobacterium avium subsp. paratuberculosis
gcgggcggucgcgc

SEQ ID NO: 2851415 - RNA, 23 nt, Mycobacterium avium subsp. paratuberculosis
gcgggcggucgcgcagccgccgg

SEQ ID NO: 2851416 - RNA, 13 nt, Mycobacterium avium subsp. paratuberculosis
gcgggcguccacg

SEQ ID NO: 2851417 - RNA, 13 nt, Mycobacterium avium subsp. paratuberculosis
gcgggggccgcga

SEQ ID NO: 2851418 - RNA, 16 nt, Mycobacterium avium subsp. paratuberculosis
gcgggggcgagaccgu

SEQ ID NO: 2851419 - RNA, 11 nt, Mycobacterium avium subsp. paratuberculosis
gcgggggcgcg

SEQ ID NO: 2851420 - RNA, 14 nt, Mycobacterium avium subsp. paratuberculosis
gcgggggcggccgg

SEQ ID NO: 2851421 - RNA, 13 nt, Mycobacterium avium subsp. paratuberculosis
gcgggggcggccu

SEQ ID NO: 2851422 - RNA, 13 nt, Mycobacterium avium subsp. paratuberculosis
gcgggggcggcgg

SEQ ID NO: 2851423 - RNA, 16 nt, Mycobacterium avium subsp. paratuberculosis
gcggggggagaggcgc

SEQ ID NO: 2851424 - RNA, 17 nt, Mycobacterium avium subsp. paratuberculosis
gcggggggagaggcgcg

SEQ ID NO: 2851425 - RNA, 19 nt, Mycobacterium avium subsp. paratuberculosis
gcggggggagaggcgcggc

SEQ ID NO: 2851426 - RNA, 23 nt, Mycobacterium avium subsp. paratuberculosis
gcggggggagggucgguggccca

SEQ ID NO: 2851427 - RNA, 16 nt, Mycobacterium avium subsp. paratuberculosis
gcggggggcgagccgg

SEQ ID NO: 2851428 - RNA, 14 nt, Mycobacterium avium subsp. paratuberculosis
gcgggggucggagc

SEQ ID NO: 2851429 - RNA, 21 nt, Mycobacterium avium subsp. paratuberculosis
gcggggguucguugcgccgcc

SEQ ID NO: 2851430 - RNA, 12 nt, Mycobacterium avium subsp. paratuberculosis
gcggggucccaa

SEQ ID NO: 2851431 - RNA, 23 nt, Mycobacterium avium subsp. paratuberculosis
gcggggucccaauccucgccgag

SEQ ID NO: 2851432 - RNA, 12 nt, Mycobacterium avium subsp. paratuberculosis
gcggggucggcc

SEQ ID NO: 2851433 - RNA, 14 nt, Mycobacterium avium subsp. paratuberculosis
gcggggucggccag

SEQ ID NO: 2851434 - RNA, 12 nt, Mycobacterium avium subsp. paratuberculosis
gcggggucggga

SEQ ID NO: 2851435 - RNA, 17 nt, Mycobacterium avium subsp. paratuberculosis
gcggggugacgcccguc

SEQ ID NO: 2851436 - RNA, 18 nt, Mycobacterium avium subsp. paratuberculosis
gcggggugagcaccgcga

SEQ ID NO: 2851437 - RNA, 21 nt, Mycobacterium avium subsp. paratuberculosis
gcggggugagcaccgcgacca

SEQ ID NO: 2851438 - RNA, 12 nt, Mycobacterium avium subsp. paratuberculosis
gcggggugccca

SEQ ID NO: 2851439 - RNA, 14 nt, Mycobacterium avium subsp. paratuberculosis
gcggggugcccggc

SEQ ID NO: 2851440 - RNA, 15 nt, Mycobacterium avium subsp. paratuberculosis
gcggggugcccggcg

SEQ ID NO: 2851441 - RNA, 16 nt, Mycobacterium avium subsp. paratuberculosis
gcggggugcccggcga

SEQ ID NO: 2851442 - RNA, 14 nt, Mycobacterium avium subsp. paratuberculosis
gcggggugcgcggc

SEQ ID NO: 2851443 - RNA, 15 nt, Mycobacterium avium subsp. paratuberculosis
gcggggugcgcggcg

SEQ ID NO: 2851444 - RNA, 18 nt, Mycobacterium avium subsp. paratuberculosis
gcgggguggcgccggcca

SEQ ID NO: 2851445 - RNA, 20 nt, Mycobacterium avium subsp. paratuberculosis
gcgggguggcgccggccagc

SEQ ID NO: 2851446 - RNA, 21 nt, Mycobacterium avium subsp. paratuberculosis
gcggggugguagacagcgugg

SEQ ID NO: 2851447 - RNA, 12 nt, Mycobacterium avium subsp. paratuberculosis
gcggggugucga

SEQ ID NO: 2851448 - RNA, 19 nt, Mycobacterium avium subsp. paratuberculosis
gcggggugucgacccaggu

SEQ ID NO: 2851449 - RNA, 22 nt, Mycobacterium avium subsp. paratuberculosis
gcggggugucgacccaggucga

SEQ ID NO: 2851450 - RNA, 23 nt, Mycobacterium avium subsp. paratuberculosis
gcggggugucgacccaggucgag

SEQ ID NO: 2851451 - RNA, 17 nt, Mycobacterium avium subsp. paratuberculosis
gcggggugugcggcacg

SEQ ID NO: 2851452 - RNA, 20 nt, Mycobacterium avium subsp. paratuberculosis
gcggggugugcucggcggcg

SEQ ID NO: 2851453 - RNA, 18 nt, Mycobacterium avium subsp. paratuberculosis
gcgggguguucaccgcgc

SEQ ID NO: 2851454 - RNA, 19 nt, Mycobacterium avium subsp. paratuberculosis
gcgggguguucaccgcgcc

SEQ ID NO: 2851455 - RNA, 21 nt, Mycobacterium avium subsp. paratuberculosis
gcgggguucaacuccucgaag

SEQ ID NO: 2851456 - RNA, 16 nt, Mycobacterium avium subsp. paratuberculosis
gcggguaaccgcagcc

SEQ ID NO: 2851457 - RNA, 21 nt, Mycobacterium avium subsp. paratuberculosis
gcggguaaccgcagccgggug

SEQ ID NO: 2851458 - RNA, 13 nt, Mycobacterium avium subsp. paratuberculosis
gcggguacagccg

SEQ ID NO: 2851459 - RNA, 17 nt, Mycobacterium avium subsp. paratuberculosis
gcggguacagccgcagg

SEQ ID NO: 2851460 - RNA, 16 nt, Mycobacterium avium subsp. paratuberculosis
gcggguacggucggcc

SEQ ID NO: 2851461 - RNA, 21 nt, Mycobacterium avium subsp. paratuberculosis
gcggguacggucggccguaca

SEQ ID NO: 2851462 - RNA, 21 nt, Mycobacterium avium subsp. paratuberculosis
gcggguagacguucuccccgc

SEQ ID NO: 2851463 - RNA, 22 nt, Mycobacterium avium subsp. paratuberculosis
gcggguagcccgucgacgggcc

SEQ ID NO: 2851464 - RNA, 14 nt, Mycobacterium avium subsp. paratuberculosis
gcggguaggcgccg

SEQ ID NO: 2851465 - RNA, 15 nt, Mycobacterium avium subsp. paratuberculosis
gcggguaggcgccga

SEQ ID NO: 2851466 - RNA, 15 nt, Mycobacterium avium subsp. paratuberculosis
gcggguaggcgucgc

SEQ ID NO: 2851467 - RNA, 14 nt, Mycobacterium avium subsp. paratuberculosis
gcggguaugucggc

SEQ ID NO: 2851468 - RNA, 21 nt, Mycobacterium avium subsp. paratuberculosis
gcggguaugucggcgacccgc

SEQ ID NO: 2851469 - RNA, 21 nt, Mycobacterium avium subsp. paratuberculosis
gcgggucacacccucggcccg

SEQ ID NO: 2851470 - RNA, 22 nt, Mycobacterium avium subsp. paratuberculosis
gcgggucacacccucggcccgc

SEQ ID NO: 2851471 - RNA, 13 nt, Mycobacterium avium subsp. paratuberculosis
gcgggucagcacc

SEQ ID NO: 2851472 - RNA, 19 nt, Mycobacterium avium subsp. paratuberculosis
gcgggucagcacccgcagc

SEQ ID NO: 2851473 - RNA, 22 nt, Mycobacterium avium subsp. paratuberculosis
gcgggucagcagcgucugcgcc

SEQ ID NO: 2851474 - RNA, 17 nt, Mycobacterium avium subsp. paratuberculosis
gcgggucagcgugcuca

SEQ ID NO: 2851475 - RNA, 19 nt, Mycobacterium avium subsp. paratuberculosis
gcgggucagcuccaccugc

SEQ ID NO: 2851476 - RNA, 20 nt, Mycobacterium avium subsp. paratuberculosis
gcgggucagcuccaccugcg

SEQ ID NO: 2851477 - RNA, 23 nt, Mycobacterium avium subsp. paratuberculosis
gcgggucagcuccaccugcggca

SEQ ID NO: 2851478 - RNA, 14 nt, Mycobacterium avium subsp. paratuberculosis
gcggguccagccgc

SEQ ID NO: 2851479 - RNA, 17 nt, Mycobacterium avium subsp. paratuberculosis
gcggguccagccgccgg

SEQ ID NO: 2851480 - RNA, 18 nt, Mycobacterium avium subsp. paratuberculosis
gcggguccagccgccggc

SEQ ID NO: 2851481 - RNA, 20 nt, Mycobacterium avium subsp. paratuberculosis
gcggguccagccgccggcgg

SEQ ID NO: 2851482 - RNA, 14 nt, Mycobacterium avium subsp. paratuberculosis
gcggguccgccccg

SEQ ID NO: 2851483 - RNA, 12 nt, Mycobacterium avium subsp. paratuberculosis
gcgggucgaugg

SEQ ID NO: 2851484 - RNA, 14 nt, Mycobacterium avium subsp. paratuberculosis
gcgggucgccgggc

SEQ ID NO: 2851485 - RNA, 13 nt, Mycobacterium avium subsp. paratuberculosis
gcgggucgcgcug

SEQ ID NO: 2851486 - RNA, 13 nt, Mycobacterium avium subsp. paratuberculosis
gcgggucgcggcc

SEQ ID NO: 2851487 - RNA, 16 nt, Mycobacterium avium subsp. paratuberculosis
gcgggucgcggcccac

SEQ ID NO: 2851488 - RNA, 18 nt, Mycobacterium avium subsp. paratuberculosis
gcgggucgcggcccaccg

SEQ ID NO: 2851489 - RNA, 19 nt, Mycobacterium avium subsp. paratuberculosis
gcgggucgcggcccaccgc

SEQ ID NO: 2851490 - RNA, 23 nt, Mycobacterium avium subsp. paratuberculosis
gcgggucgcggcccaccgcgucg

SEQ ID NO: 2851491 - RNA, 14 nt, Mycobacterium avium subsp. paratuberculosis
gcgggucgcgguuc

SEQ ID NO: 2851492 - RNA, 20 nt, Mycobacterium avium subsp. paratuberculosis
gcgggucgcuggccgcgacg

SEQ ID NO: 2851493 - RNA, 14 nt, Mycobacterium avium subsp. paratuberculosis
gcgggucggccggc

SEQ ID NO: 2851494 - RNA, 20 nt, Mycobacterium avium subsp. paratuberculosis
gcgggucggccggcggggcg

SEQ ID NO: 2851495 - RNA, 13 nt, Mycobacterium avium subsp. paratuberculosis
gcgggucggcgac

SEQ ID NO: 2851496 - RNA, 14 nt, Mycobacterium avium subsp. paratuberculosis
gcgggucggcgacg

SEQ ID NO: 2851497 - RNA, 16 nt, Mycobacterium avium subsp. paratuberculosis
gcgggucggcgacggc

SEQ ID NO: 2851498 - RNA, 20 nt, Mycobacterium avium subsp. paratuberculosis
gcgggucggcgacggcgcuc

SEQ ID NO: 2851499 - RNA, 14 nt, Mycobacterium avium subsp. paratuberculosis
gcgggucggcgccg

SEQ ID NO: 2851500 - RNA, 18 nt, Mycobacterium avium subsp. paratuberculosis
gcgggucggcgccggcca

SEQ ID NO: 2851501 - RNA, 20 nt, Mycobacterium avium subsp. paratuberculosis
gcgggucggcgccggccagc

SEQ ID NO: 2851502 - RNA, 22 nt, Mycobacterium avium subsp. paratuberculosis
gcggguuuggccgcgggcgggc

SEQ ID NO: 2851503 - RNA, 15 nt, Mycobacterium avium subsp. paratuberculosis
gcgguaaccacccgu

SEQ ID NO: 2851504 - RNA, 16 nt, Mycobacterium avium subsp. paratuberculosis
gcgguacacguggccg

SEQ ID NO: 2851505 - RNA, 15 nt, Mycobacterium avium subsp. paratuberculosis
gcgguacaucccgcc

SEQ ID NO: 2851506 - RNA, 17 nt, Mycobacterium avium subsp. paratuberculosis
gcgguacaucccgccgg

SEQ ID NO: 2851507 - RNA, 20 nt, Mycobacterium avium subsp. paratuberculosis
gcgguaccgaacgacgagcc

SEQ ID NO: 2851508 - RNA, 17 nt, Mycobacterium avium subsp. paratuberculosis
gcgguaccgccgaucgu

SEQ ID NO: 2851509 - RNA, 20 nt, Mycobacterium avium subsp. paratuberculosis
gcgguacgcgccgcgcgccc

SEQ ID NO: 2851510 - RNA, 17 nt, Mycobacterium avium subsp. paratuberculosis
gcgguagacaccgccgu

SEQ ID NO: 2851511 - RNA, 13 nt, Mycobacterium avium subsp. paratuberculosis
gcgguagcguggg

SEQ ID NO: 2851512 - RNA, 17 nt, Mycobacterium avium subsp. paratuberculosis
gcgguaggugccggccg

SEQ ID NO: 2851513 - RNA, 18 nt, Mycobacterium avium subsp. paratuberculosis
gcgguaggugccggccgc

SEQ ID NO: 2851514 - RNA, 19 nt, Mycobacterium avium subsp. paratuberculosis
gcgguaggugccggccgcg

SEQ ID NO: 2851515 - RNA, 21 nt, Mycobacterium avium subsp. paratuberculosis
gcgguauucgucaccccacca

SEQ ID NO: 2851516 - RNA, 17 nt, Mycobacterium avium subsp. paratuberculosis
gcggucaacaccgggau

SEQ ID NO: 2851517 - RNA, 18 nt, Mycobacterium avium subsp. paratuberculosis
gcggucaacacgaagccg

SEQ ID NO: 2851518 - RNA, 12 nt, Mycobacterium avium subsp. paratuberculosis
gcggucaccggc

SEQ ID NO: 2851519 - RNA, 16 nt, Mycobacterium avium subsp. paratuberculosis
gcggucaccggcucgg

SEQ ID NO: 2851520 - RNA, 18 nt, Mycobacterium avium subsp. paratuberculosis
gcggucaccggucggugc

SEQ ID NO: 2851521 - RNA, 14 nt, Mycobacterium avium subsp. paratuberculosis
gcggucacgcccgg

SEQ ID NO: 2851522 - RNA, 14 nt, Mycobacterium avium subsp. paratuberculosis
gcggucagcaccgu

SEQ ID NO: 2851523 - RNA, 23 nt, Mycobacterium avium subsp. paratuberculosis
gcggucagcauggcgaugacguc

SEQ ID NO: 2851524 - RNA, 22 nt, Mycobacterium avium subsp. paratuberculosis
gcggucagcgcguccaggugcg

SEQ ID NO: 2851525 - RNA, 17 nt, Mycobacterium avium subsp. paratuberculosis
gcggucagcucccgcag

SEQ ID NO: 2851526 - RNA, 18 nt, Mycobacterium avium subsp. paratuberculosis
gcggucagcucgaucgcc

SEQ ID NO: 2851527 - RNA, 19 nt, Mycobacterium avium subsp. paratuberculosis
gcggucagcucgaucgccg

SEQ ID NO: 2851528 - RNA, 22 nt, Mycobacterium avium subsp. paratuberculosis
gcggucagcucgaucgccgcgc

SEQ ID NO: 2851529 - RNA, 23 nt, Mycobacterium avium subsp. paratuberculosis
gcggucagcucgaucgccgcgcc

SEQ ID NO: 2851530 - RNA, 22 nt, Mycobacterium avium subsp. paratuberculosis
gcggucaggccgucucgagccg

SEQ ID NO: 2851531 - RNA, 23 nt, Mycobacterium avium subsp. paratuberculosis
gcggucaggccgucucgagccgg

SEQ ID NO: 2851532 - RNA, 19 nt, Mycobacterium avium subsp. paratuberculosis
gcggucagguucgccacga

SEQ ID NO: 2851533 - RNA, 14 nt, Mycobacterium avium subsp. paratuberculosis
gcggucaucgagcc

SEQ ID NO: 2851534 - RNA, 15 nt, Mycobacterium avium subsp. paratuberculosis
gcggucaucgagccg

SEQ ID NO: 2851535 - RNA, 19 nt, Mycobacterium avium subsp. paratuberculosis
gcggucaucgagccgguac

SEQ ID NO: 2851536 - RNA, 13 nt, Mycobacterium avium subsp. paratuberculosis
gcggucaugcgcg

SEQ ID NO: 2851537 - RNA, 14 nt, Mycobacterium avium subsp. paratuberculosis
gcggucaugcgcgg

SEQ ID NO: 2851538 - RNA, 16 nt, Mycobacterium avium subsp. paratuberculosis
gcggucaugcgcgggc

SEQ ID NO: 2851539 - RNA, 19 nt, Mycobacterium avium subsp. paratuberculosis
gcggucaugcgcgggcaau

SEQ ID NO: 2851540 - RNA, 20 nt, Mycobacterium avium subsp. paratuberculosis
gcggucaugcgcgggcaauc

SEQ ID NO: 2851541 - RNA, 21 nt, Mycobacterium avium subsp. paratuberculosis
gcgguccaccaauggcggcca

SEQ ID NO: 2851542 - RNA, 22 nt, Mycobacterium avium subsp. paratuberculosis
gcgguccaccaauggcggccac

SEQ ID NO: 2851543 - RNA, 23 nt, Mycobacterium avium subsp. paratuberculosis
gcgguccaccaauggcggccacg

SEQ ID NO: 2851544 - RNA, 24 nt, Mycobacterium avium subsp. paratuberculosis
gcgguccaccaauggcggccacga

SEQ ID NO: 2851545 - RNA, 17 nt, Mycobacterium avium subsp. paratuberculosis
gcgguccaccaccacac

SEQ ID NO: 2851546 - RNA, 19 nt, Mycobacterium avium subsp. paratuberculosis
gcgguccaccaccacaccc

SEQ ID NO: 2851547 - RNA, 13 nt, Mycobacterium avium subsp. paratuberculosis
gcgguccaccgac

SEQ ID NO: 2851548 - RNA, 17 nt, Mycobacterium avium subsp. paratuberculosis
gcgguccaccgacgcca

SEQ ID NO: 2851549 - RNA, 18 nt, Mycobacterium avium subsp. paratuberculosis
gcgguccaccgacgccac

SEQ ID NO: 2851550 - RNA, 15 nt, Mycobacterium avium subsp. paratuberculosis
gcgguccacgccggc

SEQ ID NO: 2851551 - RNA, 17 nt, Mycobacterium avium subsp. paratuberculosis
gcgguccacgccggcga

SEQ ID NO: 2851552 - RNA, 17 nt, Mycobacterium avium subsp. paratuberculosis
gcgguccacggucagcg

SEQ ID NO: 2851553 - RNA, 23 nt, Mycobacterium avium subsp. paratuberculosis
gcgguccacggucagcgcgucgg

SEQ ID NO: 2851554 - RNA, 18 nt, Mycobacterium avium subsp. paratuberculosis
gcgguccacgguggcgcc

SEQ ID NO: 2851555 - RNA, 15 nt, Mycobacterium avium subsp. paratuberculosis
gcgguccacguuggc

SEQ ID NO: 2851556 - RNA, 22 nt, Mycobacterium avium subsp. paratuberculosis
gcgguccacguuggcgaagccg

SEQ ID NO: 2851557 - RNA, 18 nt, Mycobacterium avium subsp. paratuberculosis
gcgguccacuuccgcgca

SEQ ID NO: 2851558 - RNA, 15 nt, Mycobacterium avium subsp. paratuberculosis
gcgguccagcgagcc

SEQ ID NO: 2851559 - RNA, 20 nt, Mycobacterium avium subsp. paratuberculosis
gcgguccagcgagcccuucg

SEQ ID NO: 2851560 - RNA, 21 nt, Mycobacterium avium subsp. paratuberculosis
gcgguccagcguuuccuggug

SEQ ID NO: 2851561 - RNA, 18 nt, Mycobacterium avium subsp. paratuberculosis
gcgguccaguacaccgcg

SEQ ID NO: 2851562 - RNA, 21 nt, Mycobacterium avium subsp. paratuberculosis
gcgguccauccagcgccgcag

SEQ ID NO: 2851563 - RNA, 22 nt, Mycobacterium avium subsp. paratuberculosis
gcgguccauccagcgccgcagc

SEQ ID NO: 2851564 - RNA, 17 nt, Mycobacterium avium subsp. paratuberculosis
gcgguccaucuccagcu

SEQ ID NO: 2851565 - RNA, 12 nt, Mycobacterium avium subsp. paratuberculosis
gcggucccgcgg

SEQ ID NO: 2851566 - RNA, 16 nt, Mycobacterium avium subsp. paratuberculosis
gcggucccggcggacc

SEQ ID NO: 2851567 - RNA, 19 nt, Mycobacterium avium subsp. paratuberculosis
gcggucccggucgaacauc

SEQ ID NO: 2851568 - RNA, 18 nt, Mycobacterium avium subsp. paratuberculosis
gcggucccgugcgccgcc

SEQ ID NO: 2851569 - RNA, 21 nt, Mycobacterium avium subsp. paratuberculosis
gcggucccgugcgccgcccac

SEQ ID NO: 2851570 - RNA, 22 nt, Mycobacterium avium subsp. paratuberculosis
gcggucccgugcgccgcccaca

SEQ ID NO: 2851571 - RNA, 20 nt, Mycobacterium avium subsp. paratuberculosis
gcgguccgcccggaccaggg

SEQ ID NO: 2851572 - RNA, 13 nt, Mycobacterium avium subsp. paratuberculosis
gcgguccgccgca

SEQ ID NO: 2851573 - RNA, 15 nt, Mycobacterium avium subsp. paratuberculosis
gcgguccgccgcagc

SEQ ID NO: 2851574 - RNA, 22 nt, Mycobacterium avium subsp. paratuberculosis
gcgguccgccgcagcggcgccg

SEQ ID NO: 2851575 - RNA, 24 nt, Mycobacterium avium subsp. paratuberculosis
gcgguccgccgcagcggcgccgca

SEQ ID NO: 2851576 - RNA, 19 nt, Mycobacterium avium subsp. paratuberculosis
gcgguccgcuccaccagcg

SEQ ID NO: 2851577 - RNA, 22 nt, Mycobacterium avium subsp. paratuberculosis
gcgguccgcuccaccagcgcgg

SEQ ID NO: 2851578 - RNA, 14 nt, Mycobacterium avium subsp. paratuberculosis
gcgguccucgaacc

SEQ ID NO: 2851579 - RNA, 17 nt, Mycobacterium avium subsp. paratuberculosis
gcgguccucgaaccgcu

SEQ ID NO: 2851580 - RNA, 14 nt, Mycobacterium avium subsp. paratuberculosis
gcgguccugcggcg

SEQ ID NO: 2851581 - RNA, 19 nt, Mycobacterium avium subsp. paratuberculosis
gcggucgaacaacgcggug

SEQ ID NO: 2851582 - RNA, 18 nt, Mycobacterium avium subsp. paratuberculosis
gcggucgaacgcggcgcc

SEQ ID NO: 2851583 - RNA, 19 nt, Mycobacterium avium subsp. paratuberculosis
gcggucgaacgcggcgccg

SEQ ID NO: 2851584 - RNA, 18 nt, Mycobacterium avium subsp. paratuberculosis
gcggucgaagggugcgga

SEQ ID NO: 2851585 - RNA, 16 nt, Mycobacterium avium subsp. paratuberculosis
gcggucgacacgaucg

SEQ ID NO: 2851586 - RNA, 13 nt, Mycobacterium avium subsp. paratuberculosis
gcggucggugcgc

SEQ ID NO: 2851587 - RNA, 16 nt, Mycobacterium avium subsp. paratuberculosis
gcggucggugcgcagc

SEQ ID NO: 2851588 - RNA, 17 nt, Mycobacterium avium subsp. paratuberculosis
gcggucggugcgcagca

SEQ ID NO: 2851589 - RNA, 20 nt, Mycobacterium avium subsp. paratuberculosis
gcggucggugcgcagcacgu

SEQ ID NO: 2851590 - RNA, 15 nt, Mycobacterium avium subsp. paratuberculosis
gcggucgguggcggu

SEQ ID NO: 2851591 - RNA, 18 nt, Mycobacterium avium subsp. paratuberculosis
gcggucgguggcggugcc

SEQ ID NO: 2851592 - RNA, 12 nt, Mycobacterium avium subsp. paratuberculosis
gcggucgucgcc

SEQ ID NO: 2851593 - RNA, 13 nt, Mycobacterium avium subsp. paratuberculosis
gcggucgucgccc

SEQ ID NO: 2851594 - RNA, 14 nt, Mycobacterium avium subsp. paratuberculosis
gcggucgucgccca

SEQ ID NO: 2851595 - RNA, 23 nt, Mycobacterium avium subsp. paratuberculosis
gcggucgucgcccgucucggcgu

SEQ ID NO: 2851596 - RNA, 17 nt, Mycobacterium avium subsp. paratuberculosis
gcggucgucgucgucgg

SEQ ID NO: 2851597 - RNA, 19 nt, Mycobacterium avium subsp. paratuberculosis
gcggucgucgucgucggug

SEQ ID NO: 2851598 - RNA, 19 nt, Mycobacterium avium subsp. paratuberculosis
gcggucgucuucuuggccg

SEQ ID NO: 2851599 - RNA, 20 nt, Mycobacterium avium subsp. paratuberculosis
gcggucgucuucuuggccgc

SEQ ID NO: 2851600 - RNA, 17 nt, Mycobacterium avium subsp. paratuberculosis
gcggucgugcggcugcc

SEQ ID NO: 2851601 - RNA, 19 nt, Mycobacterium avium subsp. paratuberculosis
gcggucgugcggcugccca

SEQ ID NO: 2851602 - RNA, 21 nt, Mycobacterium avium subsp. paratuberculosis
gcggucgugcgggaugccgag

SEQ ID NO: 2851603 - RNA, 15 nt, Mycobacterium avium subsp. paratuberculosis
gcggucgugucaggg

SEQ ID NO: 2851604 - RNA, 13 nt, Mycobacterium avium subsp. paratuberculosis
gcggucucgaccg

SEQ ID NO: 2851605 - RNA, 14 nt, Mycobacterium avium subsp. paratuberculosis
gcggucucgaccga

SEQ ID NO: 2851606 - RNA, 22 nt, Mycobacterium avium subsp. paratuberculosis
gcggucucgaucugcaccagcg

SEQ ID NO: 2851607 - RNA, 15 nt, Mycobacterium avium subsp. paratuberculosis
gcggucugagcccgg

SEQ ID NO: 2851608 - RNA, 15 nt, Mycobacterium avium subsp. paratuberculosis
gcggucugcgccagc

SEQ ID NO: 2851609 - RNA, 16 nt, Mycobacterium avium subsp. paratuberculosis
gcggucugcgccagcu

SEQ ID NO: 2851610 - RNA, 15 nt, Mycobacterium avium subsp. paratuberculosis
gcggucugcgcccga

SEQ ID NO: 2851611 - RNA, 16 nt, Mycobacterium avium subsp. paratuberculosis
gcggucugcgcccgau

SEQ ID NO: 2851612 - RNA, 21 nt, Mycobacterium avium subsp. paratuberculosis
gcggucugcgcccgaucggcg

SEQ ID NO: 2851613 - RNA, 17 nt, Mycobacterium avium subsp. paratuberculosis
gcggucugcggugcgcc

SEQ ID NO: 2851614 - RNA, 14 nt, Mycobacterium avium subsp. paratuberculosis
gcggucugucgcgc

SEQ ID NO: 2851615 - RNA, 14 nt, Mycobacterium avium subsp. paratuberculosis
gcggucuucgaaca

SEQ ID NO: 2851616 - RNA, 20 nt, Mycobacterium avium subsp. paratuberculosis
gcggucuucuuggccgcgcc

SEQ ID NO: 2851617 - RNA, 21 nt, Mycobacterium avium subsp. paratuberculosis
gcggucuucuuggccgcgccg

SEQ ID NO: 2851618 - RNA, 22 nt, Mycobacterium avium subsp. paratuberculosis
gcggucuucuuggccgcgccgc

SEQ ID NO: 2851619 - RNA, 18 nt, Mycobacterium avium subsp. paratuberculosis
gcggucuucuuggcgggc

SEQ ID NO: 2851620 - RNA, 17 nt, Mycobacterium avium subsp. paratuberculosis
gcggucuuggcggccag

SEQ ID NO: 2851621 - RNA, 18 nt, Mycobacterium avium subsp. paratuberculosis
gcggucuuggcggccagc

SEQ ID NO: 2851622 - RNA, 19 nt, Mycobacterium avium subsp. paratuberculosis
gcggucuuggcggccagcg

SEQ ID NO: 2851623 - RNA, 21 nt, Mycobacterium avium subsp. paratuberculosis
gcggucuuggcggccagcgcc

SEQ ID NO: 2851624 - RNA, 21 nt, Mycobacterium avium subsp. paratuberculosis
gcggugaagucggugcccagc

SEQ ID NO: 2851625 - RNA, 14 nt, Mycobacterium avium subsp. paratuberculosis
gcggugaaguugcc

SEQ ID NO: 2851626 - RNA, 19 nt, Mycobacterium avium subsp. paratuberculosis
gcggugaaguugccgccgc

SEQ ID NO: 2851627 - RNA, 17 nt, Mycobacterium avium subsp. paratuberculosis
gcggugacacccagggc

SEQ ID NO: 2851628 - RNA, 13 nt, Mycobacterium avium subsp. paratuberculosis
gcggugacaucgc

SEQ ID NO: 2851629 - RNA, 18 nt, Mycobacterium avium subsp. paratuberculosis
gcggugacaucgccaccu

SEQ ID NO: 2851630 - RNA, 13 nt, Mycobacterium avium subsp. paratuberculosis
gcggugaccacgc

SEQ ID NO: 2851631 - RNA, 16 nt, Mycobacterium avium subsp. paratuberculosis
gcggugaccacgccgu

SEQ ID NO: 2851632 - RNA, 17 nt, Mycobacterium avium subsp. paratuberculosis
gcggugaccacgccgug

SEQ ID NO: 2851633 - RNA, 15 nt, Mycobacterium avium subsp. paratuberculosis
gcggugaccgcccgc

SEQ ID NO: 2851634 - RNA, 14 nt, Mycobacterium avium subsp. paratuberculosis
gcggugaccgccgc

SEQ ID NO: 2851635 - RNA, 15 nt, Mycobacterium avium subsp. paratuberculosis
gcggugaccgccgcc

SEQ ID NO: 2851636 - RNA, 16 nt, Mycobacterium avium subsp. paratuberculosis
gcggugaccgccgcca

SEQ ID NO: 2851637 - RNA, 21 nt, Mycobacterium avium subsp. paratuberculosis
gcggugaccgccgccauccgc

SEQ ID NO: 2851638 - RNA, 14 nt, Mycobacterium avium subsp. paratuberculosis
gcggugaccgcgcc

SEQ ID NO: 2851639 - RNA, 16 nt, Mycobacterium avium subsp. paratuberculosis
gcggugaccgcgccgc

SEQ ID NO: 2851640 - RNA, 21 nt, Mycobacterium avium subsp. paratuberculosis
gcggugaccgcgccgcgggug

SEQ ID NO: 2851641 - RNA, 13 nt, Mycobacterium avium subsp. paratuberculosis
gcggugaccgcgg

SEQ ID NO: 2851642 - RNA, 18 nt, Mycobacterium avium subsp. paratuberculosis
gcggugaccgcggccucg

SEQ ID NO: 2851643 - RNA, 22 nt, Mycobacterium avium subsp. paratuberculosis
gcggugaccucgagcaccggcg

SEQ ID NO: 2851644 - RNA, 23 nt, Mycobacterium avium subsp. paratuberculosis
gcggugaccucgagcaccggcgg

SEQ ID NO: 2851645 - RNA, 13 nt, Mycobacterium avium subsp. paratuberculosis
gcggugaccuugc

SEQ ID NO: 2851646 - RNA, 18 nt, Mycobacterium avium subsp. paratuberculosis
gcggugaccuugcgggcg

SEQ ID NO: 2851647 - RNA, 13 nt, Mycobacterium avium subsp. paratuberculosis
gcggugacgcgcc

SEQ ID NO: 2851648 - RNA, 14 nt, Mycobacterium avium subsp. paratuberculosis
gcggugacgcgccg

SEQ ID NO: 2851649 - RNA, 15 nt, Mycobacterium avium subsp. paratuberculosis
gcggugacgcgccgg

SEQ ID NO: 2851650 - RNA, 16 nt, Mycobacterium avium subsp. paratuberculosis
gcggugacgcgccggc

SEQ ID NO: 2851651 - RNA, 18 nt, Mycobacterium avium subsp. paratuberculosis
gcggugacguuccagccg

SEQ ID NO: 2851652 - RNA, 19 nt, Mycobacterium avium subsp. paratuberculosis
gcggugacguuccagccgu

SEQ ID NO: 2851653 - RNA, 19 nt, Mycobacterium avium subsp. paratuberculosis
gcggugagcaccggaucga

SEQ ID NO: 2851654 - RNA, 17 nt, Mycobacterium avium subsp. paratuberculosis
gcggugagcagcaugcc

SEQ ID NO: 2851655 - RNA, 13 nt, Mycobacterium avium subsp. paratuberculosis
gcggugagccgcc

SEQ ID NO: 2851656 - RNA, 14 nt, Mycobacterium avium subsp. paratuberculosis
gcggugagccgcca

SEQ ID NO: 2851657 - RNA, 17 nt, Mycobacterium avium subsp. paratuberculosis
gcggugagccgccacag

SEQ ID NO: 2851658 - RNA, 21 nt, Mycobacterium avium subsp. paratuberculosis
gcggugagccgccacagcgcc

SEQ ID NO: 2851659 - RNA, 16 nt, Mycobacterium avium subsp. paratuberculosis
gcggugagcgcgccgg

SEQ ID NO: 2851660 - RNA, 22 nt, Mycobacterium avium subsp. paratuberculosis
gcggugaguucaucgacgucga

SEQ ID NO: 2851661 - RNA, 22 nt, Mycobacterium avium subsp. paratuberculosis
gcggugaucaggcccucgucgg

SEQ ID NO: 2851662 - RNA, 23 nt, Mycobacterium avium subsp. paratuberculosis
gcggugauccagagcaucagggc

SEQ ID NO: 2851663 - RNA, 13 nt, Mycobacterium avium subsp. paratuberculosis
gcggugauccgcc

SEQ ID NO: 2851664 - RNA, 20 nt, Mycobacterium avium subsp. paratuberculosis
gcggugauccgcccggcccg

SEQ ID NO: 2851665 - RNA, 21 nt, Mycobacterium avium subsp. paratuberculosis
gcggugauccgcccggcccgc

SEQ ID NO: 2851666 - RNA, 18 nt, Mycobacterium avium subsp. paratuberculosis
gcggugaucgccggaucg

SEQ ID NO: 2851667 - RNA, 16 nt, Mycobacterium avium subsp. paratuberculosis
gcggugaucgcgucaa

SEQ ID NO: 2851668 - RNA, 18 nt, Mycobacterium avium subsp. paratuberculosis
gcggugaucucgucggcg

SEQ ID NO: 2851669 - RNA, 15 nt, Mycobacterium avium subsp. paratuberculosis
gcggugaugaccucc

SEQ ID NO: 2851670 - RNA, 14 nt, Mycobacterium avium subsp. paratuberculosis
gcggugaugcgcgc

SEQ ID NO: 2851671 - RNA, 19 nt, Mycobacterium avium subsp. paratuberculosis
gcgguggccacggcguuga

SEQ ID NO: 2851672 - RNA, 13 nt, Mycobacterium avium subsp. paratuberculosis
gcgguggccaugc

SEQ ID NO: 2851673 - RNA, 12 nt, Mycobacterium avium subsp. paratuberculosis
gcgguggcccgg

SEQ ID NO: 2851674 - RNA, 20 nt, Mycobacterium avium subsp. paratuberculosis
gcgguggcccgguacagcgc

SEQ ID NO: 2851675 - RNA, 19 nt, Mycobacterium avium subsp. paratuberculosis
gcgguggccgaaccgcucg

SEQ ID NO: 2851676 - RNA, 14 nt, Mycobacterium avium subsp. paratuberculosis
gcgguggccgauca

SEQ ID NO: 2851677 - RNA, 16 nt, Mycobacterium avium subsp. paratuberculosis
gcgguggccgaucagg

SEQ ID NO: 2851678 - RNA, 19 nt, Mycobacterium avium subsp. paratuberculosis
gcgguggccucggggguga

SEQ ID NO: 2851679 - RNA, 18 nt, Mycobacterium avium subsp. paratuberculosis
gcgguggccugcccggcg

SEQ ID NO: 2851680 - RNA, 22 nt, Mycobacterium avium subsp. paratuberculosis
gcgguggccugcccggcggugc

SEQ ID NO: 2851681 - RNA, 19 nt, Mycobacterium avium subsp. paratuberculosis
gcgguggccuggucgaaca

SEQ ID NO: 2851682 - RNA, 18 nt, Mycobacterium avium subsp. paratuberculosis
gcgguggccuggucggcg

SEQ ID NO: 2851683 - RNA, 15 nt, Mycobacterium avium subsp. paratuberculosis
gcgguggcgaacugc

SEQ ID NO: 2851684 - RNA, 21 nt, Mycobacterium avium subsp. paratuberculosis
gcgguggcgcacaacccggac

SEQ ID NO: 2851685 - RNA, 14 nt, Mycobacterium avium subsp. paratuberculosis
gcgguggcgcccgc

SEQ ID NO: 2851686 - RNA, 15 nt, Mycobacterium avium subsp. paratuberculosis
gcgguggcgcccgcg

SEQ ID NO: 2851687 - RNA, 16 nt, Mycobacterium avium subsp. paratuberculosis
gcgguggcgcccgcgg

SEQ ID NO: 2851688 - RNA, 15 nt, Mycobacterium avium subsp. paratuberculosis
gcgguggcgccgcgg

SEQ ID NO: 2851689 - RNA, 18 nt, Mycobacterium avium subsp. paratuberculosis
gcgguggcgccgcgggcg

SEQ ID NO: 2851690 - RNA, 19 nt, Mycobacterium avium subsp. paratuberculosis
gcgguggcgccgcgggcgg

SEQ ID NO: 2851691 - RNA, 21 nt, Mycobacterium avium subsp. paratuberculosis
gcgguggcgccgcgggcgguc

SEQ ID NO: 2851692 - RNA, 22 nt, Mycobacterium avium subsp. paratuberculosis
gcgguggcgccgcgggcggucg

SEQ ID NO: 2851693 - RNA, 17 nt, Mycobacterium avium subsp. paratuberculosis
gcgguggcgccggggcg

SEQ ID NO: 2851694 - RNA, 20 nt, Mycobacterium avium subsp. paratuberculosis
gcgguggcgccggggcgggc

SEQ ID NO: 2851695 - RNA, 19 nt, Mycobacterium avium subsp. paratuberculosis
gcgguggcggcgaacgcgc

SEQ ID NO: 2851696 - RNA, 15 nt, Mycobacterium avium subsp. paratuberculosis
gcgguggcguagcgg

SEQ ID NO: 2851697 - RNA, 16 nt, Mycobacterium avium subsp. paratuberculosis
gcgguggcgugcucga

SEQ ID NO: 2851698 - RNA, 15 nt, Mycobacterium avium subsp. paratuberculosis
gcggugggcaccagc

SEQ ID NO: 2851699 - RNA, 13 nt, Mycobacterium avium subsp. paratuberculosis
gcggugggccagu

SEQ ID NO: 2851700 - RNA, 17 nt, Mycobacterium avium subsp. paratuberculosis
gcggugggcgcgggccg

SEQ ID NO: 2851701 - RNA, 19 nt, Mycobacterium avium subsp. paratuberculosis
gcggugggcgcgggccgcg

SEQ ID NO: 2851702 - RNA, 20 nt, Mycobacterium avium subsp. paratuberculosis
gcggugggcgcgggccgcgu

SEQ ID NO: 2851703 - RNA, 13 nt, Mycobacterium avium subsp. paratuberculosis
gcggugggcucgg

SEQ ID NO: 2851704 - RNA, 16 nt, Mycobacterium avium subsp. paratuberculosis
gcggugggcucggcgc

SEQ ID NO: 2851705 - RNA, 18 nt, Mycobacterium avium subsp. paratuberculosis
gcggugggcucggcgccg

SEQ ID NO: 2851706 - RNA, 19 nt, Mycobacterium avium subsp. paratuberculosis
gcggugggcucggcgccga

SEQ ID NO: 2851707 - RNA, 22 nt, Mycobacterium avium subsp. paratuberculosis
gcggugggcucggcgccgaccu

SEQ ID NO: 2851708 - RNA, 16 nt, Mycobacterium avium subsp. paratuberculosis
gcggugggcugggcga

SEQ ID NO: 2851709 - RNA, 14 nt, Mycobacterium avium subsp. paratuberculosis
gcgguggggccgaa

SEQ ID NO: 2851710 - RNA, 14 nt, Mycobacterium avium subsp. paratuberculosis
gcgguggguccgcc

SEQ ID NO: 2851711 - RNA, 19 nt, Mycobacterium avium subsp. paratuberculosis
gcgguggguccgccgggcg

SEQ ID NO: 2851712 - RNA, 15 nt, Mycobacterium avium subsp. paratuberculosis
gcggugguccgcgcg

SEQ ID NO: 2851713 - RNA, 16 nt, Mycobacterium avium subsp. paratuberculosis
gcggugguccgcgcga

SEQ ID NO: 2851714 - RNA, 23 nt, Mycobacterium avium subsp. paratuberculosis
gcgguggucgaaaucgcagacgu

SEQ ID NO: 2851715 - RNA, 14 nt, Mycobacterium avium subsp. paratuberculosis
gcgguggucggggu

SEQ ID NO: 2851716 - RNA, 19 nt, Mycobacterium avium subsp. paratuberculosis
gcgguggugaacgcgucgg

SEQ ID NO: 2851717 - RNA, 13 nt, Mycobacterium avium subsp. paratuberculosis
gcgguggugcucg

SEQ ID NO: 2851718 - RNA, 19 nt, Mycobacterium avium subsp. paratuberculosis
gcgguggugcucgccccgc

SEQ ID NO: 2851719 - RNA, 22 nt, Mycobacterium avium subsp. paratuberculosis
gcgguggugcucgccccgcccg

SEQ ID NO: 2851720 - RNA, 17 nt, Mycobacterium avium subsp. paratuberculosis
gcgguggugggcgcggu

SEQ ID NO: 2851721 - RNA, 21 nt, Mycobacterium avium subsp. paratuberculosis
gcggugguuaccagcucaccg

SEQ ID NO: 2851722 - RNA, 15 nt, Mycobacterium avium subsp. paratuberculosis
gcgguguacagcgcg

SEQ ID NO: 2851723 - RNA, 17 nt, Mycobacterium avium subsp. paratuberculosis
gcgguguacagcgcgcc

SEQ ID NO: 2851724 - RNA, 15 nt, Mycobacterium avium subsp. paratuberculosis
gcggugucaccgacg

SEQ ID NO: 2851725 - RNA, 23 nt, Mycobacterium avium subsp. paratuberculosis
gcgguguccacgaugcggugccg

SEQ ID NO: 2851726 - RNA, 24 nt, Mycobacterium avium subsp. paratuberculosis
gcgguguccacgaugcggugccgg

SEQ ID NO: 2851727 - RNA, 20 nt, Mycobacterium avium subsp. paratuberculosis
gcggugucgaagaccggugc

SEQ ID NO: 2851728 - RNA, 21 nt, Mycobacterium avium subsp. paratuberculosis
gcggugucgaagaccggugcg

SEQ ID NO: 2851729 - RNA, 14 nt, Mycobacterium avium subsp. paratuberculosis
gcggugucgaaggc

SEQ ID NO: 2851730 - RNA, 18 nt, Mycobacterium avium subsp. paratuberculosis
gcggugucgaaggccggg

SEQ ID NO: 2851731 - RNA, 16 nt, Mycobacterium avium subsp. paratuberculosis
gcggugucgagaugac

SEQ ID NO: 2851732 - RNA, 19 nt, Mycobacterium avium subsp. paratuberculosis
gcggugucgagaugaccgu

SEQ ID NO: 2851733 - RNA, 12 nt, Mycobacterium avium subsp. paratuberculosis
gcggugucgccc

SEQ ID NO: 2851734 - RNA, 17 nt, Mycobacterium avium subsp. paratuberculosis
gcggugucgcccagcug

SEQ ID NO: 2851735 - RNA, 12 nt, Mycobacterium avium subsp. paratuberculosis
gcggugucggcg

SEQ ID NO: 2851736 - RNA, 16 nt, Mycobacterium avium subsp. paratuberculosis
gcggugucggcgcccc

SEQ ID NO: 2851737 - RNA, 19 nt, Mycobacterium avium subsp. paratuberculosis
gcggugucggcgccccggc

SEQ ID NO: 2851738 - RNA, 14 nt, Mycobacterium avium subsp. paratuberculosis
gcggugucggcggc

SEQ ID NO: 2851739 - RNA, 16 nt, Mycobacterium avium subsp. paratuberculosis
gcggugucggcgucga

SEQ ID NO: 2851740 - RNA, 21 nt, Mycobacterium avium subsp. paratuberculosis
gcggugucggcgucgaucgcc

SEQ ID NO: 2851741 - RNA, 13 nt, Mycobacterium avium subsp. paratuberculosis
gcggugucggugc

SEQ ID NO: 2851742 - RNA, 16 nt, Mycobacterium avium subsp. paratuberculosis
gcggugucggugccca

SEQ ID NO: 2851743 - RNA, 21 nt, Mycobacterium avium subsp. paratuberculosis
gcggugucggugccgagcacg

SEQ ID NO: 2851744 - RNA, 22 nt, Mycobacterium avium subsp. paratuberculosis
gcggugucggugccgagcacgc

SEQ ID NO: 2851745 - RNA, 20 nt, Mycobacterium avium subsp. paratuberculosis
gcggugucguaguugcgcgc

SEQ ID NO: 2851746 - RNA, 15 nt, Mycobacterium avium subsp. paratuberculosis
gcggugugcccggcg

SEQ ID NO: 2851747 - RNA, 21 nt, Mycobacterium avium subsp. paratuberculosis
gcggugugcggcagcucggcg

SEQ ID NO: 2851748 - RNA, 14 nt, Mycobacterium avium subsp. paratuberculosis
gcggugugcggcgg

SEQ ID NO: 2851749 - RNA, 17 nt, Mycobacterium avium subsp. paratuberculosis
gcggugugcggcggcuc

SEQ ID NO: 2851750 - RNA, 16 nt, Mycobacterium avium subsp. paratuberculosis
gcggugugcuggccag

SEQ ID NO: 2851751 - RNA, 13 nt, Mycobacterium avium subsp. paratuberculosis
gcgguguggagau

SEQ ID NO: 2851752 - RNA, 21 nt, Mycobacterium avium subsp. paratuberculosis
gcggugugggcgauggcggcg

SEQ ID NO: 2851753 - RNA, 22 nt, Mycobacterium avium subsp. paratuberculosis
gcggugugggcgauggcggcgu

SEQ ID NO: 2851754 - RNA, 20 nt, Mycobacterium avium subsp. paratuberculosis
gcgguguucgagggcgcggc

SEQ ID NO: 2851755 - RNA, 21 nt, Mycobacterium avium subsp. paratuberculosis
gcgguguucgagggcgcggcg

SEQ ID NO: 2851756 - RNA, 21 nt, Mycobacterium avium subsp. paratuberculosis
gcguacgggaugaucagcagg

SEQ ID NO: 2851757 - RNA, 18 nt, Mycobacterium avium subsp. paratuberculosis
gcguacugcucggcgcgg

SEQ ID NO: 2851758 - RNA, 15 nt, Mycobacterium avium subsp. paratuberculosis
gcguacuucgcgccc

SEQ ID NO: 2851759 - RNA, 18 nt, Mycobacterium avium subsp. paratuberculosis
gcguacuucgcguuccgc

SEQ ID NO: 2851760 - RNA, 15 nt, Mycobacterium avium subsp. paratuberculosis
gcguagaaccagugc

SEQ ID NO: 2851761 - RNA, 21 nt, Mycobacterium avium subsp. paratuberculosis
gcguagaagaaauacaucugc

SEQ ID NO: 2851762 - RNA, 22 nt, Mycobacterium avium subsp. paratuberculosis
gcguagaagaaauacaucugcc

SEQ ID NO: 2851763 - RNA, 12 nt, Mycobacterium avium subsp. paratuberculosis
gcguagagccgc

SEQ ID NO: 2851764 - RNA, 16 nt, Mycobacterium avium subsp. paratuberculosis
gcguagagccgcucgc

SEQ ID NO: 2851765 - RNA, 17 nt, Mycobacterium avium subsp. paratuberculosis
gcguagcagucggccug

SEQ ID NO: 2851766 - RNA, 19 nt, Mycobacterium avium subsp. paratuberculosis
gcguagcagucggccugca

SEQ ID NO: 2851767 - RNA, 15 nt, Mycobacterium avium subsp. paratuberculosis
gcguagcgaggugug

SEQ ID NO: 2851768 - RNA, 16 nt, Mycobacterium avium subsp. paratuberculosis
gcguagcgcagcucca

SEQ ID NO: 2851769 - RNA, 19 nt, Mycobacterium avium subsp. paratuberculosis
gcguagcgggucagcucca

SEQ ID NO: 2851770 - RNA, 20 nt, Mycobacterium avium subsp. paratuberculosis
gcguagcgggucagcuccac

SEQ ID NO: 2851771 - RNA, 14 nt, Mycobacterium avium subsp. paratuberculosis
gcguagcucgccgc

SEQ ID NO: 2851772 - RNA, 19 nt, Mycobacterium avium subsp. paratuberculosis
gcguagcugcaggcgacga

SEQ ID NO: 2851773 - RNA, 13 nt, Mycobacterium avium subsp. paratuberculosis
gcguaggacagca

SEQ ID NO: 2851774 - RNA, 15 nt, Mycobacterium avium subsp. paratuberculosis
gcguaggacagcagc

SEQ ID NO: 2851775 - RNA, 17 nt, Mycobacterium avium subsp. paratuberculosis
gcguaggacagcagccg

SEQ ID NO: 2851776 - RNA, 20 nt, Mycobacterium avium subsp. paratuberculosis
gcguaggacagcagccgcuc

SEQ ID NO: 2851777 - RNA, 21 nt, Mycobacterium avium subsp. paratuberculosis
gcguaggccaggaccgggacg

SEQ ID NO: 2851778 - RNA, 18 nt, Mycobacterium avium subsp. paratuberculosis
gcguaggccuugcugagc

SEQ ID NO: 2851779 - RNA, 15 nt, Mycobacterium avium subsp. paratuberculosis
gcguaggguucgccg

SEQ ID NO: 2851780 - RNA, 17 nt, Mycobacterium avium subsp. paratuberculosis
gcguaggguucgccgau

SEQ ID NO: 2851781 - RNA, 19 nt, Mycobacterium avium subsp. paratuberculosis
gcguaggugggcagcgcgg

SEQ ID NO: 2851782 - RNA, 15 nt, Mycobacterium avium subsp. paratuberculosis
gcguaguccagcacg

SEQ ID NO: 2851783 - RNA, 19 nt, Mycobacterium avium subsp. paratuberculosis
gcguaguccagcacggcga

SEQ ID NO: 2851784 - RNA, 15 nt, Mycobacterium avium subsp. paratuberculosis
gcguagucgccggug

SEQ ID NO: 2851785 - RNA, 13 nt, Mycobacterium avium subsp. paratuberculosis
gcguagucggcgc

SEQ ID NO: 2851786 - RNA, 16 nt, Mycobacterium avium subsp. paratuberculosis
gcguagucggcgcagc

SEQ ID NO: 2851787 - RNA, 13 nt, Mycobacterium avium subsp. paratuberculosis
gcguagucggcgu

SEQ ID NO: 2851788 - RNA, 18 nt, Mycobacterium avium subsp. paratuberculosis
gcguagucggcgucggcc

SEQ ID NO: 2851789 - RNA, 22 nt, Mycobacterium avium subsp. paratuberculosis
gcguagucggcgucggccaccg

SEQ ID NO: 2851790 - RNA, 17 nt, Mycobacterium avium subsp. paratuberculosis
gcguagucggugcagug

SEQ ID NO: 2851791 - RNA, 12 nt, Mycobacterium avium subsp. paratuberculosis
gcguagucgucg

SEQ ID NO: 2851792 - RNA, 13 nt, Mycobacterium avium subsp. paratuberculosis
gcguagucgucga

SEQ ID NO: 2851793 - RNA, 14 nt, Mycobacterium avium subsp. paratuberculosis
gcguagucgucgau

SEQ ID NO: 2851794 - RNA, 21 nt, Mycobacterium avium subsp. paratuberculosis
gcguagucguugucggcgguc

SEQ ID NO: 2851795 - RNA, 18 nt, Mycobacterium avium subsp. paratuberculosis
gcguagugcagcugcagc

SEQ ID NO: 2851796 - RNA, 15 nt, Mycobacterium avium subsp. paratuberculosis
gcguagugggucggc

SEQ ID NO: 2851797 - RNA, 17 nt, Mycobacterium avium subsp. paratuberculosis
gcguagugggucggcgg

SEQ ID NO: 2851798 - RNA, 19 nt, Mycobacterium avium subsp. paratuberculosis
gcguagugggucggcggcu

SEQ ID NO: 2851799 - RNA, 20 nt, Mycobacterium avium subsp. paratuberculosis
gcguagugggucggcggcug

SEQ ID NO: 2851800 - RNA, 20 nt, Mycobacterium avium subsp. paratuberculosis
gcguaucaacugagcgcccg

SEQ ID NO: 2851801 - RNA, 22 nt, Mycobacterium avium subsp. paratuberculosis
gcguaucaacugagcgcccggu

SEQ ID NO: 2851802 - RNA, 18 nt, Mycobacterium avium subsp. paratuberculosis
gcguauccggccagccgg

SEQ ID NO: 2851803 - RNA, 20 nt, Mycobacterium avium subsp. paratuberculosis
gcguaugccgguggcguccu

SEQ ID NO: 2851804 - RNA, 18 nt, Mycobacterium avium subsp. paratuberculosis
gcguaugccuccucggug

SEQ ID NO: 2851805 - RNA, 16 nt, Mycobacterium avium subsp. paratuberculosis
gcguauugcacggcgg

SEQ ID NO: 2851806 - RNA, 17 nt, Mycobacterium avium subsp. paratuberculosis
gcguauugcacggcggc

SEQ ID NO: 2851807 - RNA, 19 nt, Mycobacterium avium subsp. paratuberculosis
gcguauugcacggcggcga

SEQ ID NO: 2851808 - RNA, 16 nt, Mycobacterium avium subsp. paratuberculosis
gcgucaaccaccggca

SEQ ID NO: 2851809 - RNA, 18 nt, Mycobacterium avium subsp. paratuberculosis
gcgucaaccaccggcauc

SEQ ID NO: 2851810 - RNA, 20 nt, Mycobacterium avium subsp. paratuberculosis
gcgucaacccguuccacauc

SEQ ID NO: 2851811 - RNA, 15 nt, Mycobacterium avium subsp. paratuberculosis
gcgucaacggcuugc

SEQ ID NO: 2851812 - RNA, 18 nt, Mycobacterium avium subsp. paratuberculosis
gcgucaacucgucggcga

SEQ ID NO: 2851813 - RNA, 19 nt, Mycobacterium avium subsp. paratuberculosis
gcgucaacucgucggcgaa

SEQ ID NO: 2851814 - RNA, 17 nt, Mycobacterium avium subsp. paratuberculosis
gcgucaauacgucacgg

SEQ ID NO: 2851815 - RNA, 18 nt, Mycobacterium avium subsp. paratuberculosis
gcgucacauacgccucac

SEQ ID NO: 2851816 - RNA, 19 nt, Mycobacterium avium subsp. paratuberculosis
gcgucacauccgucacgcc

SEQ ID NO: 2851817 - RNA, 21 nt, Mycobacterium avium subsp. paratuberculosis
gcgucaccaaugcgccggcgg

SEQ ID NO: 2851818 - RNA, 22 nt, Mycobacterium avium subsp. paratuberculosis
gcgucaccaaugcgccggcggc

SEQ ID NO: 2851819 - RNA, 20 nt, Mycobacterium avium subsp. paratuberculosis
gcgucaccaggcugcucggc

SEQ ID NO: 2851820 - RNA, 21 nt, Mycobacterium avium subsp. paratuberculosis
gcgucaccaggcugcucggcg

SEQ ID NO: 2851821 - RNA, 17 nt, Mycobacterium avium subsp. paratuberculosis
gcgucaccccaccgagc

SEQ ID NO: 2851822 - RNA, 20 nt, Mycobacterium avium subsp. paratuberculosis
gcgucacccuggaacuuguu

SEQ ID NO: 2851823 - RNA, 15 nt, Mycobacterium avium subsp. paratuberculosis
gcgucaccgcgggug

SEQ ID NO: 2851824 - RNA, 18 nt, Mycobacterium avium subsp. paratuberculosis
gcgucaccuucaccacgg

SEQ ID NO: 2851825 - RNA, 20 nt, Mycobacterium avium subsp. paratuberculosis
gcgucaccuucaccacggcc

SEQ ID NO: 2851826 - RNA, 17 nt, Mycobacterium avium subsp. paratuberculosis
gcgucacgcaucagggc

SEQ ID NO: 2851827 - RNA, 19 nt, Mycobacterium avium subsp. paratuberculosis
gcgucacgcaucagggcca

SEQ ID NO: 2851828 - RNA, 12 nt, Mycobacterium avium subsp. paratuberculosis
gcgucacgccag

SEQ ID NO: 2851829 - RNA, 16 nt, Mycobacterium avium subsp. paratuberculosis
gcgucacgccagcgug

SEQ ID NO: 2851830 - RNA, 19 nt, Mycobacterium avium subsp. paratuberculosis
gcgucacgccagcgugacg

SEQ ID NO: 2851831 - RNA, 23 nt, Mycobacterium avium subsp. paratuberculosis
gcgucacgccaguguggccgcgg

SEQ ID NO: 2851832 - RNA, 15 nt, Mycobacterium avium subsp. paratuberculosis
gcgucacgccgcgcc

SEQ ID NO: 2851833 - RNA, 16 nt, Mycobacterium avium subsp. paratuberculosis
gcgucacgccgcgccc

SEQ ID NO: 2851834 - RNA, 17 nt, Mycobacterium avium subsp. paratuberculosis
gcgucacgccgcgcccg

SEQ ID NO: 2851835 - RNA, 18 nt, Mycobacterium avium subsp. paratuberculosis
gcgucacgccgcgcccgu

SEQ ID NO: 2851836 - RNA, 20 nt, Mycobacterium avium subsp. paratuberculosis
gcgucacgccgcgcccgucg

SEQ ID NO: 2851837 - RNA, 12 nt, Mycobacterium avium subsp. paratuberculosis
gcgucacgcugg

SEQ ID NO: 2851838 - RNA, 13 nt, Mycobacterium avium subsp. paratuberculosis
gcgucacgcuggc

SEQ ID NO: 2851839 - RNA, 17 nt, Mycobacterium avium subsp. paratuberculosis
gcgucacgcuggcguga

SEQ ID NO: 2851840 - RNA, 19 nt, Mycobacterium avium subsp. paratuberculosis
gcgucacgcuggcgugacg

SEQ ID NO: 2851841 - RNA, 16 nt, Mycobacterium avium subsp. paratuberculosis
gcguccagugcaugcc

SEQ ID NO: 2851842 - RNA, 16 nt, Mycobacterium avium subsp. paratuberculosis
gcguccaguucggcca

SEQ ID NO: 2851843 - RNA, 17 nt, Mycobacterium avium subsp. paratuberculosis
gcguccaguucggccag

SEQ ID NO: 2851844 - RNA, 18 nt, Mycobacterium avium subsp. paratuberculosis
gcguccaguucggccagc

SEQ ID NO: 2851845 - RNA, 19 nt, Mycobacterium avium subsp. paratuberculosis
gcguccaguucggccagcg

SEQ ID NO: 2851846 - RNA, 20 nt, Mycobacterium avium subsp. paratuberculosis
gcguccaguucggccagcgc

SEQ ID NO: 2851847 - RNA, 22 nt, Mycobacterium avium subsp. paratuberculosis
gcguccaguucggccagcgcgg

SEQ ID NO: 2851848 - RNA, 18 nt, Mycobacterium avium subsp. paratuberculosis
gcguccaguugcggcacg

SEQ ID NO: 2851849 - RNA, 21 nt, Mycobacterium avium subsp. paratuberculosis
gcguccaguugcggcacgccg

SEQ ID NO: 2851850 - RNA, 22 nt, Mycobacterium avium subsp. paratuberculosis
gcguccaguugcggcacgccga

SEQ ID NO: 2851851 - RNA, 16 nt, Mycobacterium avium subsp. paratuberculosis
gcguccauggucgagc

SEQ ID NO: 2851852 - RNA, 17 nt, Mycobacterium avium subsp. paratuberculosis
gcguccauggucgagcc

SEQ ID NO: 2851853 - RNA, 18 nt, Mycobacterium avium subsp. paratuberculosis
gcguccauggucgagccg

SEQ ID NO: 2851854 - RNA, 22 nt, Mycobacterium avium subsp. paratuberculosis
gcguccauggucgagccgcagu

SEQ ID NO: 2851855 - RNA, 16 nt, Mycobacterium avium subsp. paratuberculosis
gcgucccagugcucga

SEQ ID NO: 2851856 - RNA, 21 nt, Mycobacterium avium subsp. paratuberculosis
gcgucccagugcucgaccaga

SEQ ID NO: 2851857 - RNA, 14 nt, Mycobacterium avium subsp. paratuberculosis
gcguccccgcgccg

SEQ ID NO: 2851858 - RNA, 17 nt, Mycobacterium avium subsp. paratuberculosis
gcguccccgcgccgggc

SEQ ID NO: 2851859 - RNA, 13 nt, Mycobacterium avium subsp. paratuberculosis
gcguccccggcgg

SEQ ID NO: 2851860 - RNA, 13 nt, Mycobacterium avium subsp. paratuberculosis
gcgucccgcgccg

SEQ ID NO: 2851861 - RNA, 15 nt, Mycobacterium avium subsp. paratuberculosis
gcgucccggcgucuc

SEQ ID NO: 2851862 - RNA, 19 nt, Mycobacterium avium subsp. paratuberculosis
gcgucccggcgucucggcg

SEQ ID NO: 2851863 - RNA, 23 nt, Mycobacterium avium subsp. paratuberculosis
gcgucccgggccuuggccaacgc

SEQ ID NO: 2851864 - RNA, 15 nt, Mycobacterium avium subsp. paratuberculosis
gcgucccggguaccu

SEQ ID NO: 2851865 - RNA, 21 nt, Mycobacterium avium subsp. paratuberculosis
gcgucccguccugggccuggc

SEQ ID NO: 2851866 - RNA, 15 nt, Mycobacterium avium subsp. paratuberculosis
gcgucccguccuugg

SEQ ID NO: 2851867 - RNA, 14 nt, Mycobacterium avium subsp. paratuberculosis
gcgucccgucggcc

SEQ ID NO: 2851868 - RNA, 15 nt, Mycobacterium avium subsp. paratuberculosis
gcgucccgucggcca

SEQ ID NO: 2851869 - RNA, 17 nt, Mycobacterium avium subsp. paratuberculosis
gcgucccguuggcgccg

SEQ ID NO: 2851870 - RNA, 20 nt, Mycobacterium avium subsp. paratuberculosis
gcgucccguuggcgccgguc

SEQ ID NO: 2851871 - RNA, 13 nt, Mycobacterium avium subsp. paratuberculosis
gcgucccuggcga

SEQ ID NO: 2851872 - RNA, 14 nt, Mycobacterium avium subsp. paratuberculosis
gcguccgacggcug

SEQ ID NO: 2851873 - RNA, 20 nt, Mycobacterium avium subsp. paratuberculosis
gcguccgagaagggccgccg

SEQ ID NO: 2851874 - RNA, 21 nt, Mycobacterium avium subsp. paratuberculosis
gcguccgagaagggccgccgc

SEQ ID NO: 2851875 - RNA, 17 nt, Mycobacterium avium subsp. paratuberculosis
gcguccgagcagcagcc

SEQ ID NO: 2851876 - RNA, 24 nt, Mycobacterium avium subsp. paratuberculosis
gcguccgagcagcagccgcagcgg

SEQ ID NO: 2851877 - RNA, 23 nt, Mycobacterium avium subsp. paratuberculosis
gcguccgaggcgguuccgguggc

SEQ ID NO: 2851878 - RNA, 18 nt, Mycobacterium avium subsp. paratuberculosis
gcguccgauaccagccgc

SEQ ID NO: 2851879 - RNA, 21 nt, Mycobacterium avium subsp. paratuberculosis
gcguccgauaccagccgcgga

SEQ ID NO: 2851880 - RNA, 19 nt, Mycobacterium avium subsp. paratuberculosis
gcguccgcaagcaccucgc

SEQ ID NO: 2851881 - RNA, 14 nt, Mycobacterium avium subsp. paratuberculosis
gcguccgccggcgg

SEQ ID NO: 2851882 - RNA, 22 nt, Mycobacterium avium subsp. paratuberculosis
gcguccgccggcggugcgggug

SEQ ID NO: 2851883 - RNA, 23 nt, Mycobacterium avium subsp. paratuberculosis
gcguccgcgaucgucucgucgag

SEQ ID NO: 2851884 - RNA, 13 nt, Mycobacterium avium subsp. paratuberculosis
gcguccgcggccg

SEQ ID NO: 2851885 - RNA, 18 nt, Mycobacterium avium subsp. paratuberculosis
gcguccgcggccgcggcg

SEQ ID NO: 2851886 - RNA, 14 nt, Mycobacterium avium subsp. paratuberculosis
gcguccgcgggcgg

SEQ ID NO: 2851887 - RNA, 17 nt, Mycobacterium avium subsp. paratuberculosis
gcguccgcgggcggggc

SEQ ID NO: 2851888 - RNA, 19 nt, Mycobacterium avium subsp. paratuberculosis
gcguccgcgguuucaccgu

SEQ ID NO: 2851889 - RNA, 16 nt, Mycobacterium avium subsp. paratuberculosis
gcguccgcgucgucga

SEQ ID NO: 2851890 - RNA, 18 nt, Mycobacterium avium subsp. paratuberculosis
gcguccgcgucgucgagg

SEQ ID NO: 2851891 - RNA, 17 nt, Mycobacterium avium subsp. paratuberculosis
gcguccggagaaccgcu

SEQ ID NO: 2851892 - RNA, 18 nt, Mycobacterium avium subsp. paratuberculosis
gcguccggaggugccggc

SEQ ID NO: 2851893 - RNA, 12 nt, Mycobacterium avium subsp. paratuberculosis
gcguccggcccg

SEQ ID NO: 2851894 - RNA, 13 nt, Mycobacterium avium subsp. paratuberculosis
gcguccggcccgg

SEQ ID NO: 2851895 - RNA, 16 nt, Mycobacterium avium subsp. paratuberculosis
gcguccggcccggcgu

SEQ ID NO: 2851896 - RNA, 19 nt, Mycobacterium avium subsp. paratuberculosis
gcguccggcccggcguccg

SEQ ID NO: 2851897 - RNA, 14 nt, Mycobacterium avium subsp. paratuberculosis
gcguccgggcgcug

SEQ ID NO: 2851898 - RNA, 19 nt, Mycobacterium avium subsp. paratuberculosis
gcguccgggcgcugcgcgg

SEQ ID NO: 2851899 - RNA, 18 nt, Mycobacterium avium subsp. paratuberculosis
gcguccguagugcucggc

SEQ ID NO: 2851900 - RNA, 19 nt, Mycobacterium avium subsp. paratuberculosis
gcguccguagugcucggcg

SEQ ID NO: 2851901 - RNA, 21 nt, Mycobacterium avium subsp. paratuberculosis
gcguccguagugcucggcguc

SEQ ID NO: 2851902 - RNA, 17 nt, Mycobacterium avium subsp. paratuberculosis
gcguccgugccguccgg

SEQ ID NO: 2851903 - RNA, 19 nt, Mycobacterium avium subsp. paratuberculosis
gcguccgugccguccggcc

SEQ ID NO: 2851904 - RNA, 16 nt, Mycobacterium avium subsp. paratuberculosis
gcguccuccucguccg

SEQ ID NO: 2851905 - RNA, 19 nt, Mycobacterium avium subsp. paratuberculosis
gcguccuccucguccgcgg

SEQ ID NO: 2851906 - RNA, 20 nt, Mycobacterium avium subsp. paratuberculosis
gcguccuccucguccgcggc

SEQ ID NO: 2851907 - RNA, 22 nt, Mycobacterium avium subsp. paratuberculosis
gcguccuccucguccgcggcgg

SEQ ID NO: 2851908 - RNA, 15 nt, Mycobacterium avium subsp. paratuberculosis
gcguccucgaccacc

SEQ ID NO: 2851909 - RNA, 19 nt, Mycobacterium avium subsp. paratuberculosis
gcguccucgacgccgcgca

SEQ ID NO: 2851910 - RNA, 13 nt, Mycobacterium avium subsp. paratuberculosis
gcguccucgacgg

SEQ ID NO: 2851911 - RNA, 13 nt, Mycobacterium avium subsp. paratuberculosis
gcguccucgauga

SEQ ID NO: 2851912 - RNA, 18 nt, Mycobacterium avium subsp. paratuberculosis
gcguccucgaugacgccg

SEQ ID NO: 2851913 - RNA, 22 nt, Mycobacterium avium subsp. paratuberculosis
gcguccucgccguacgcgccgg

SEQ ID NO: 2851914 - RNA, 23 nt, Mycobacterium avium subsp. paratuberculosis
gcguccucgccguacgcgccggc

SEQ ID NO: 2851915 - RNA, 13 nt, Mycobacterium avium subsp. paratuberculosis
gcguccucgucgg

SEQ ID NO: 2851916 - RNA, 20 nt, Mycobacterium avium subsp. paratuberculosis
gcguccugcagcagccggac

SEQ ID NO: 2851917 - RNA, 20 nt, Mycobacterium avium subsp. paratuberculosis
gcguccugcaggcaggccgg

SEQ ID NO: 2851918 - RNA, 22 nt, Mycobacterium avium subsp. paratuberculosis
gcguccugcaggcaggccggca

SEQ ID NO: 2851919 - RNA, 15 nt, Mycobacterium avium subsp. paratuberculosis
gcguccuucuccgcc

SEQ ID NO: 2851920 - RNA, 16 nt, Mycobacterium avium subsp. paratuberculosis
gcguccuucuccgccg

SEQ ID NO: 2851921 - RNA, 17 nt, Mycobacterium avium subsp. paratuberculosis
gcguccuucuccgccgg

SEQ ID NO: 2851922 - RNA, 23 nt, Mycobacterium avium subsp. paratuberculosis
gcguccuugaaggagggccgaac

SEQ ID NO: 2851923 - RNA, 16 nt, Mycobacterium avium subsp. paratuberculosis
gcguccuugaccagcu

SEQ ID NO: 2851924 - RNA, 21 nt, Mycobacterium avium subsp. paratuberculosis
gcgucgaaauagcggcgcacc

SEQ ID NO: 2851925 - RNA, 16 nt, Mycobacterium avium subsp. paratuberculosis
gcgucgaugucgucgu

SEQ ID NO: 2851926 - RNA, 19 nt, Mycobacterium avium subsp. paratuberculosis
gcgucgaugucgucgucga

SEQ ID NO: 2851927 - RNA, 18 nt, Mycobacterium avium subsp. paratuberculosis
gcgucgaugucgucguug

SEQ ID NO: 2851928 - RNA, 18 nt, Mycobacterium avium subsp. paratuberculosis
gcgucgcagaucccgccg

SEQ ID NO: 2851929 - RNA, 21 nt, Mycobacterium avium subsp. paratuberculosis
gcgucgcagaucccgccggcg

SEQ ID NO: 2851930 - RNA, 22 nt, Mycobacterium avium subsp. paratuberculosis
gcgucgcagaucccgccggcgg

SEQ ID NO: 2851931 - RNA, 23 nt, Mycobacterium avium subsp. paratuberculosis
gcgucgcagaucccgccggcggc

SEQ ID NO: 2851932 - RNA, 16 nt, Mycobacterium avium subsp. paratuberculosis
gcgucgccaauccggc

SEQ ID NO: 2851933 - RNA, 20 nt, Mycobacterium avium subsp. paratuberculosis
gcgucgccaauccggcgggc

SEQ ID NO: 2851934 - RNA, 21 nt, Mycobacterium avium subsp. paratuberculosis
gcgucgccaauccggcgggcc

SEQ ID NO: 2851935 - RNA, 22 nt, Mycobacterium avium subsp. paratuberculosis
gcgucgccaauccggcgggccu

SEQ ID NO: 2851936 - RNA, 15 nt, Mycobacterium avium subsp. paratuberculosis
gcgucgccaccaccu

SEQ ID NO: 2851937 - RNA, 17 nt, Mycobacterium avium subsp. paratuberculosis
gcgucgccagccgccgg

SEQ ID NO: 2851938 - RNA, 18 nt, Mycobacterium avium subsp. paratuberculosis
gcgucgccagccgccggc

SEQ ID NO: 2851939 - RNA, 22 nt, Mycobacterium avium subsp. paratuberculosis
gcgucgccagccgccggcucag

SEQ ID NO: 2851940 - RNA, 18 nt, Mycobacterium avium subsp. paratuberculosis
gcgucgccaugccgucgc

SEQ ID NO: 2851941 - RNA, 19 nt, Mycobacterium avium subsp. paratuberculosis
gcgucgccaugccgucgcg

SEQ ID NO: 2851942 - RNA, 12 nt, Mycobacterium avium subsp. paratuberculosis
gcgucgcccacg

SEQ ID NO: 2851943 - RNA, 20 nt, Mycobacterium avium subsp. paratuberculosis
gcgucgcccaucaccagcag

SEQ ID NO: 2851944 - RNA, 15 nt, Mycobacterium avium subsp. paratuberculosis
gcgucgcccgccgac

SEQ ID NO: 2851945 - RNA, 17 nt, Mycobacterium avium subsp. paratuberculosis
gcgucgcccgccgacgg

SEQ ID NO: 2851946 - RNA, 19 nt, Mycobacterium avium subsp. paratuberculosis
gcgucgcccgccgacggcu

SEQ ID NO: 2851947 - RNA, 14 nt, Mycobacterium avium subsp. paratuberculosis
gcgucgccgaccag

SEQ ID NO: 2851948 - RNA, 15 nt, Mycobacterium avium subsp. paratuberculosis
gcgucgccgaccagc

SEQ ID NO: 2851949 - RNA, 16 nt, Mycobacterium avium subsp. paratuberculosis
gcgucgccgaccagca

SEQ ID NO: 2851950 - RNA, 12 nt, Mycobacterium avium subsp. paratuberculosis
gcgucgccgacg

SEQ ID NO: 2851951 - RNA, 20 nt, Mycobacterium avium subsp. paratuberculosis
gcgucgccgacgggcccagc

SEQ ID NO: 2851952 - RNA, 23 nt, Mycobacterium avium subsp. paratuberculosis
gcgucgccgacgggcccagcgcg

SEQ ID NO: 2851953 - RNA, 21 nt, Mycobacterium avium subsp. paratuberculosis
gcgucgccgagccgcgccacg

SEQ ID NO: 2851954 - RNA, 21 nt, Mycobacterium avium subsp. paratuberculosis
gcgucgccgagcucgugaugg

SEQ ID NO: 2851955 - RNA, 19 nt, Mycobacterium avium subsp. paratuberculosis
gcgucgccgaucgcccggu

SEQ ID NO: 2851956 - RNA, 20 nt, Mycobacterium avium subsp. paratuberculosis
gcgucgccgaucgcccggua

SEQ ID NO: 2851957 - RNA, 16 nt, Mycobacterium avium subsp. paratuberculosis
gcgucgccgcccccga

SEQ ID NO: 2851958 - RNA, 20 nt, Mycobacterium avium subsp. paratuberculosis
gcgucgccgccccgaguucc

SEQ ID NO: 2851959 - RNA, 12 nt, Mycobacterium avium subsp. paratuberculosis
gcgucgccgccg

SEQ ID NO: 2851960 - RNA, 19 nt, Mycobacterium avium subsp. paratuberculosis
gcgucgccgccgggcgcca

SEQ ID NO: 2851961 - RNA, 14 nt, Mycobacterium avium subsp. paratuberculosis
gcgucgccgccggu

SEQ ID NO: 2851962 - RNA, 17 nt, Mycobacterium avium subsp. paratuberculosis
gcgucgccgccggugcc

SEQ ID NO: 2851963 - RNA, 18 nt, Mycobacterium avium subsp. paratuberculosis
gcgucgccgccggugccg

SEQ ID NO: 2851964 - RNA, 14 nt, Mycobacterium avium subsp. paratuberculosis
gcgucgccgcgugg

SEQ ID NO: 2851965 - RNA, 20 nt, Mycobacterium avium subsp. paratuberculosis
gcgucgccgcucuucgacga

SEQ ID NO: 2851966 - RNA, 21 nt, Mycobacterium avium subsp. paratuberculosis
gcgucgccgcucuucgacgac

SEQ ID NO: 2851967 - RNA, 14 nt, Mycobacterium avium subsp. paratuberculosis
gcgucgccgcuggu

SEQ ID NO: 2851968 - RNA, 14 nt, Mycobacterium avium subsp. paratuberculosis
gcgucgccgugccg

SEQ ID NO: 2851969 - RNA, 17 nt, Mycobacterium avium subsp. paratuberculosis
gcgucgccgugccggac

SEQ ID NO: 2851970 - RNA, 22 nt, Mycobacterium avium subsp. paratuberculosis
gcgucgccgugccggaccgcgc

SEQ ID NO: 2851971 - RNA, 23 nt, Mycobacterium avium subsp. paratuberculosis
gcgucgccgugccggaccgcgcg

SEQ ID NO: 2851972 - RNA, 16 nt, Mycobacterium avium subsp. paratuberculosis
gcgucgccuuccugcg
